United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 18

SEQ ID NO: 682821 - RNA, 18 nt, Haemophilus influenzae Rd
ucgcuuuaucuucuucuu

SEQ ID NO: 682822 - RNA, 18 nt, Haemophilus influenzae Rd
ucgcuuucauuucuucug

SEQ ID NO: 682823 - RNA, 21 nt, Haemophilus influenzae Rd
ucgcuuaaaaauccgccacuu

SEQ ID NO: 682824 - RNA, 18 nt, Haemophilus influenzae Rd
ucgcuuuucccucuuuuu

SEQ ID NO: 682825 - RNA, 17 nt, Haemophilus influenzae Rd
ucgcuuuuuuaucuaaa

SEQ ID NO: 682826 - RNA, 17 nt, Haemophilus influenzae Rd
ucggauaauaauuuuuc

SEQ ID NO: 682827 - RNA, 19 nt, Haemophilus influenzae Rd
ucgcugcgaugugaccacg

SEQ ID NO: 682828 - RNA, 18 nt, Haemophilus influenzae Rd
ucgcuggaacuucuaaac

SEQ ID NO: 682829 - RNA, 18 nt, Haemophilus influenzae Rd
ucgcuggcuaacaccauu

SEQ ID NO: 682830 - RNA, 17 nt, Haemophilus influenzae Rd
ucggauuucuuuauucu

SEQ ID NO: 682831 - RNA, 19 nt, Haemophilus influenzae Rd
ucggauuccuuuguuagau

SEQ ID NO: 682832 - RNA, 15 nt, Haemophilus influenzae Rd
ucggcgauuuauucg

SEQ ID NO: 682833 - RNA, 19 nt, Haemophilus influenzae Rd
ucggcuuccauuaauacuu

SEQ ID NO: 682834 - RNA, 13 nt, Haemophilus influenzae Rd
ucggcuucaguau

SEQ ID NO: 682835 - RNA, 15 nt, Haemophilus influenzae Rd
ucggcuauuucagcu

SEQ ID NO: 682836 - RNA, 15 nt, Haemophilus influenzae Rd
ucgggcgaaaccuuu

SEQ ID NO: 682837 - RNA, 17 nt, Haemophilus influenzae Rd
ucgggcaccauuuaaac

SEQ ID NO: 682838 - RNA, 22 nt, Haemophilus influenzae Rd
ucggugcaacaauaucauugac

SEQ ID NO: 682839 - RNA, 13 nt, Haemophilus influenzae Rd
ucguaagaacgac

SEQ ID NO: 682840 - RNA, 21 nt, Haemophilus influenzae Rd
ucguaaauucuguuuagucuu

SEQ ID NO: 682841 - RNA, 11 nt, Haemophilus influenzae Rd
ucgguuuugcg

SEQ ID NO: 682842 - RNA, 23 nt, Haemophilus influenzae Rd
ucgguagagcaggggauugaaaa

SEQ ID NO: 682843 - RNA, 13 nt, Haemophilus influenzae Rd
ucguaucaauuuu

SEQ ID NO: 682844 - RNA, 14 nt, Haemophilus influenzae Rd
ucguauaauauuuu

SEQ ID NO: 682845 - RNA, 11 nt, Haemophilus influenzae Rd
ucguauaagcg

SEQ ID NO: 682846 - RNA, 17 nt, Haemophilus influenzae Rd
ucguauccguuccacuu

SEQ ID NO: 682847 - RNA, 15 nt, Haemophilus influenzae Rd
ucgucgcuuuucccu

SEQ ID NO: 682848 - RNA, 21 nt, Haemophilus influenzae Rd
ucgucuaaaucuuuccagaag

SEQ ID NO: 682849 - RNA, 15 nt, Haemophilus influenzae Rd
ucgucuaucuaagau

SEQ ID NO: 682850 - RNA, 16 nt, Haemophilus influenzae Rd
ucgucuaucuaagaua

SEQ ID NO: 682851 - RNA, 12 nt, Haemophilus influenzae Rd
ucgucuauuuau

SEQ ID NO: 682852 - RNA, 22 nt, Haemophilus influenzae Rd
ucuaauaaagugcgguaaaauu

SEQ ID NO: 682853 - RNA, 19 nt, Haemophilus influenzae Rd
ucuaauaagauguuugagu

SEQ ID NO: 682854 - RNA, 14 nt, Haemophilus influenzae Rd
ucuaauaauccucu

SEQ ID NO: 682855 - RNA, 14 nt, Haemophilus influenzae Rd
ucuaauaaaauaua

SEQ ID NO: 682856 - RNA, 19 nt, Haemophilus influenzae Rd
ucuaaggcgacaaaauguc

SEQ ID NO: 682857 - RNA, 15 nt, Haemophilus influenzae Rd
ucuaagguauaaaua

SEQ ID NO: 682858 - RNA, 18 nt, Haemophilus influenzae Rd
ucuaagguauaaauaauu

SEQ ID NO: 682859 - RNA, 20 nt, Haemophilus influenzae Rd
ucuaagguuaugccaaugcu

SEQ ID NO: 682860 - RNA, 20 nt, Haemophilus influenzae Rd
ucuaagguuucgauauuaau

SEQ ID NO: 682861 - RNA, 16 nt, Haemophilus influenzae Rd
ucuaaguauucaugau

SEQ ID NO: 682862 - RNA, 22 nt, Haemophilus influenzae Rd
ucuacauaaugggcuuuccaau

SEQ ID NO: 682863 - RNA, 13 nt, Haemophilus influenzae Rd
ucuacaaaacaua

SEQ ID NO: 682864 - RNA, 15 nt, Haemophilus influenzae Rd
ucuacaaaacauaau

SEQ ID NO: 682865 - RNA, 15 nt, Haemophilus influenzae Rd
ucuaauuuucacaua

SEQ ID NO: 682866 - RNA, 17 nt, Haemophilus influenzae Rd
ucuaauuuucacauaau

SEQ ID NO: 682867 - RNA, 19 nt, Haemophilus influenzae Rd
ucuaauuuucacauaauaa

SEQ ID NO: 682868 - RNA, 12 nt, Haemophilus influenzae Rd
ucuaauuuuuca

SEQ ID NO: 682869 - RNA, 16 nt, Haemophilus influenzae Rd
ucuaauuuuucacuga

SEQ ID NO: 682870 - RNA, 21 nt, Haemophilus influenzae Rd
ucuaauuuauuucaucaaucu

SEQ ID NO: 682871 - RNA, 19 nt, Haemophilus influenzae Rd
ucuaauuugccaaguacaa

SEQ ID NO: 682872 - RNA, 20 nt, Haemophilus influenzae Rd
ucuaauuugccaucacucaa

SEQ ID NO: 682873 - RNA, 13 nt, Haemophilus influenzae Rd
ucuaauuuuaaaa

SEQ ID NO: 682874 - RNA, 15 nt, Haemophilus influenzae Rd
ucuaauuuuaaaaca

SEQ ID NO: 682875 - RNA, 21 nt, Haemophilus influenzae Rd
ucuaacggaucaacauaacgu

SEQ ID NO: 682876 - RNA, 16 nt, Haemophilus influenzae Rd
ucuaaauggcaaaauu

SEQ ID NO: 682877 - RNA, 22 nt, Haemophilus influenzae Rd
ucuaaauuaauuaggacaauau

SEQ ID NO: 682878 - RNA, 19 nt, Haemophilus influenzae Rd
ucuaaauuaucguuuacuu

SEQ ID NO: 682879 - RNA, 18 nt, Haemophilus influenzae Rd
ucuaaaucuuuccagaag

SEQ ID NO: 682880 - RNA, 21 nt, Haemophilus influenzae Rd
ucuaaaugacgugcuaauucu

SEQ ID NO: 682881 - RNA, 19 nt, Haemophilus influenzae Rd
ucuaagauuuuaguauuuu

SEQ ID NO: 682882 - RNA, 18 nt, Haemophilus influenzae Rd
ucuaaaaagauuugauuu

SEQ ID NO: 682883 - RNA, 12 nt, Haemophilus influenzae Rd
ucuaaaaacuuu

SEQ ID NO: 682884 - RNA, 22 nt, Haemophilus influenzae Rd
ucuaaaaagaagcucacuuuau

SEQ ID NO: 682885 - RNA, 20 nt, Haemophilus influenzae Rd
ucuaaaaaaauccuaaauaa

SEQ ID NO: 682886 - RNA, 15 nt, Haemophilus influenzae Rd
ucuaaaggcaauucc

SEQ ID NO: 682887 - RNA, 15 nt, Haemophilus influenzae Rd
ucuaaaggcuaaaua

SEQ ID NO: 682888 - RNA, 16 nt, Haemophilus influenzae Rd
ucuaaaggcuaaauaa

SEQ ID NO: 682889 - RNA, 22 nt, Haemophilus influenzae Rd
ucuaaaggcuaaauaaccuaaa

SEQ ID NO: 682890 - RNA, 24 nt, Haemophilus influenzae Rd
ucuaaauagaccgcacuuugcacu

SEQ ID NO: 682891 - RNA, 18 nt, Haemophilus influenzae Rd
ucuaaauagcuaacaaua

SEQ ID NO: 682892 - RNA, 15 nt, Haemophilus influenzae Rd
ucuaaauauuuuuca

SEQ ID NO: 682893 - RNA, 16 nt, Haemophilus influenzae Rd
ucuaaauauuuuucaa

SEQ ID NO: 682894 - RNA, 14 nt, Haemophilus influenzae Rd
ucguuguuuuaaua

SEQ ID NO: 682895 - RNA, 18 nt, Haemophilus influenzae Rd
ucguugguauuuacuaaa

SEQ ID NO: 682896 - RNA, 11 nt, Haemophilus influenzae Rd
ucguuuacuau

SEQ ID NO: 682897 - RNA, 15 nt, Haemophilus influenzae Rd
ucguuuacuuaaaau

SEQ ID NO: 682898 - RNA, 14 nt, Haemophilus influenzae Rd
ucguuaauaaaucc

SEQ ID NO: 682899 - RNA, 20 nt, Haemophilus influenzae Rd
ucguucaacccauuuuccau

SEQ ID NO: 682900 - RNA, 21 nt, Haemophilus influenzae Rd
ucguucaacccauuuuccauu

SEQ ID NO: 682901 - RNA, 13 nt, Haemophilus influenzae Rd
ucguuauuuuuug

SEQ ID NO: 682902 - RNA, 14 nt, Haemophilus influenzae Rd
ucguuauuauuaag

SEQ ID NO: 682903 - RNA, 21 nt, Haemophilus influenzae Rd
ucguuauucaucacaacuugc

SEQ ID NO: 682904 - RNA, 19 nt, Haemophilus influenzae Rd
ucgugaaucguuuguaaaa

SEQ ID NO: 682905 - RNA, 18 nt, Haemophilus influenzae Rd
ucgugauauuucacuaaa

SEQ ID NO: 682906 - RNA, 12 nt, Haemophilus influenzae Rd
ucguuaauauua

SEQ ID NO: 682907 - RNA, 18 nt, Haemophilus influenzae Rd
ucgugauccgcaauaauu

SEQ ID NO: 682908 - RNA, 20 nt, Haemophilus influenzae Rd
ucgugauccgcaauaauuaa

SEQ ID NO: 682909 - RNA, 13 nt, Haemophilus influenzae Rd
ucgugaucugcau

SEQ ID NO: 682910 - RNA, 15 nt, Haemophilus influenzae Rd
ucgugaucugcauca

SEQ ID NO: 682911 - RNA, 14 nt, Haemophilus influenzae Rd
ucugaucacaauga

SEQ ID NO: 682912 - RNA, 19 nt, Haemophilus influenzae Rd
ucugagcaaauuacccaaa

SEQ ID NO: 682913 - RNA, 23 nt, Haemophilus influenzae Rd
ucugacuaaucguccaauuucau

SEQ ID NO: 682914 - RNA, 24 nt, Haemophilus influenzae Rd
ucugaagggcgagcaacuuggaau

SEQ ID NO: 682915 - RNA, 17 nt, Haemophilus influenzae Rd
ucugaauaaauuuuuua

SEQ ID NO: 682916 - RNA, 13 nt, Haemophilus influenzae Rd
ucucuuuuuauuu

SEQ ID NO: 682917 - RNA, 18 nt, Haemophilus influenzae Rd
ucucuuuuuauuuuacua

SEQ ID NO: 682918 - RNA, 22 nt, Haemophilus influenzae Rd
ucucuuguuuuuccaauucuuu

SEQ ID NO: 682919 - RNA, 13 nt, Haemophilus influenzae Rd
ucucuuucuauuu

SEQ ID NO: 682920 - RNA, 13 nt, Haemophilus influenzae Rd
ucucuuucuuaaa

SEQ ID NO: 682921 - RNA, 23 nt, Haemophilus influenzae Rd
ucucuuuugaggcuaauaaugcc

SEQ ID NO: 682922 - RNA, 13 nt, Haemophilus influenzae Rd
ucucuuuucucaa

SEQ ID NO: 682923 - RNA, 14 nt, Haemophilus influenzae Rd
ucucugugagugga

SEQ ID NO: 682924 - RNA, 17 nt, Haemophilus influenzae Rd
ucucugcccauaagaaa

SEQ ID NO: 682925 - RNA, 21 nt, Haemophilus influenzae Rd
ucucugacuaaucguccaauu

SEQ ID NO: 682926 - RNA, 14 nt, Haemophilus influenzae Rd
ucucugacuucuag

SEQ ID NO: 682927 - RNA, 14 nt, Haemophilus influenzae Rd
ucucucuuuuuuau

SEQ ID NO: 682928 - RNA, 16 nt, Haemophilus influenzae Rd
ucucucauuuuuuacc

SEQ ID NO: 682929 - RNA, 16 nt, Haemophilus influenzae Rd
ucucuauugcuuuuac

SEQ ID NO: 682930 - RNA, 13 nt, Haemophilus influenzae Rd
ucucuguugcuca

SEQ ID NO: 682931 - RNA, 12 nt, Haemophilus influenzae Rd
ucucuguuuuau

SEQ ID NO: 682932 - RNA, 16 nt, Haemophilus influenzae Rd
ucuccccguccaaagg

SEQ ID NO: 682933 - RNA, 18 nt, Haemophilus influenzae Rd
ucucccgaaaauuguuca

SEQ ID NO: 682934 - RNA, 14 nt, Haemophilus influenzae Rd
ucucccgccgcaua

SEQ ID NO: 682935 - RNA, 22 nt, Haemophilus influenzae Rd
ucuccgcauuuuuuuauucuau

SEQ ID NO: 682936 - RNA, 19 nt, Haemophilus influenzae Rd
ucuacauuuacaucuaaaa

SEQ ID NO: 682937 - RNA, 13 nt, Haemophilus influenzae Rd
ucuccugauauag

SEQ ID NO: 682938 - RNA, 18 nt, Haemophilus influenzae Rd
ucucgaguaucaaaacuu

SEQ ID NO: 682939 - RNA, 13 nt, Haemophilus influenzae Rd
ucucgauaaaaga

SEQ ID NO: 682940 - RNA, 21 nt, Haemophilus influenzae Rd
ucucggacuucgcuaauuuuu

SEQ ID NO: 682941 - RNA, 20 nt, Haemophilus influenzae Rd
ucucggcuaaaaucugugca

SEQ ID NO: 682942 - RNA, 18 nt, Haemophilus influenzae Rd
ucucgggcugaaauaccu

SEQ ID NO: 682943 - RNA, 16 nt, Haemophilus influenzae Rd
ucucguaugcugagau

SEQ ID NO: 682944 - RNA, 11 nt, Haemophilus influenzae Rd
ucucuaaaauc

SEQ ID NO: 682945 - RNA, 19 nt, Haemophilus influenzae Rd
ucucuaaaacauugucaau

SEQ ID NO: 682946 - RNA, 15 nt, Haemophilus influenzae Rd
ucugcacuuuaauuc

SEQ ID NO: 682947 - RNA, 19 nt, Haemophilus influenzae Rd
ucugcacuuuaauucgcug

SEQ ID NO: 682948 - RNA, 19 nt, Haemophilus influenzae Rd
ucugcagaaaaauguucau

SEQ ID NO: 682949 - RNA, 14 nt, Haemophilus influenzae Rd
ucugcacuccaaaa

SEQ ID NO: 682950 - RNA, 17 nt, Haemophilus influenzae Rd
ucugcacuccaaaaguu

SEQ ID NO: 682951 - RNA, 22 nt, Haemophilus influenzae Rd
ucugcacgauagcaaugccaau

SEQ ID NO: 682952 - RNA, 19 nt, Haemophilus influenzae Rd
ucugcaauaauaucugcuu

SEQ ID NO: 682953 - RNA, 15 nt, Haemophilus influenzae Rd
ucuggaaauucguau

SEQ ID NO: 682954 - RNA, 14 nt, Haemophilus influenzae Rd
ucugcuggcucuac

SEQ ID NO: 682955 - RNA, 12 nt, Haemophilus influenzae Rd
ucugcugaaaua

SEQ ID NO: 682956 - RNA, 16 nt, Haemophilus influenzae Rd
ucugcugaaauacaaa

SEQ ID NO: 682957 - RNA, 20 nt, Haemophilus influenzae Rd
ucugcucugcaccauccauc

SEQ ID NO: 682958 - RNA, 17 nt, Haemophilus influenzae Rd
ucugcugauaccaauaa

SEQ ID NO: 682959 - RNA, 13 nt, Haemophilus influenzae Rd
ucugcuaaaucug

SEQ ID NO: 682960 - RNA, 17 nt, Haemophilus influenzae Rd
ucugguggaagguaauu

SEQ ID NO: 682961 - RNA, 18 nt, Haemophilus influenzae Rd
ucugguggaauguaaaaa

SEQ ID NO: 682962 - RNA, 22 nt, Haemophilus influenzae Rd
ucuggcuguuuugccacaaagc

SEQ ID NO: 682963 - RNA, 17 nt, Haemophilus influenzae Rd
ucuggcucgcucuucag

SEQ ID NO: 682964 - RNA, 22 nt, Haemophilus influenzae Rd
ucuggcucuaaaucuaauuuug

SEQ ID NO: 682965 - RNA, 19 nt, Haemophilus influenzae Rd
ucuggcucaauguuaaguu

SEQ ID NO: 682966 - RNA, 14 nt, Haemophilus influenzae Rd
ucuguaaugccacc

SEQ ID NO: 682967 - RNA, 18 nt, Haemophilus influenzae Rd
ucuguaauauaugaaaaa

SEQ ID NO: 682968 - RNA, 21 nt, Haemophilus influenzae Rd
ucuguauuuuuuauuuaauua

SEQ ID NO: 682969 - RNA, 18 nt, Haemophilus influenzae Rd
ucugguuuugugaguaaa

SEQ ID NO: 682970 - RNA, 14 nt, Haemophilus influenzae Rd
ucuguaaaacauuu

SEQ ID NO: 682971 - RNA, 15 nt, Haemophilus influenzae Rd
ucugucgcuuuuucc

SEQ ID NO: 682972 - RNA, 16 nt, Haemophilus influenzae Rd
ucugucgcuuuuuccu

SEQ ID NO: 682973 - RNA, 16 nt, Haemophilus influenzae Rd
ucugucacgagcuaaa

SEQ ID NO: 682974 - RNA, 21 nt, Haemophilus influenzae Rd
ucugucauaaccgugcucaau

SEQ ID NO: 682975 - RNA, 16 nt, Haemophilus influenzae Rd
ucuucagcacuugcau

SEQ ID NO: 682976 - RNA, 16 nt, Haemophilus influenzae Rd
ucuucacuacuugaac

SEQ ID NO: 682977 - RNA, 17 nt, Haemophilus influenzae Rd
ucuucagacuagcauca

SEQ ID NO: 682978 - RNA, 22 nt, Haemophilus influenzae Rd
ucuucagacuagcaucaaaaua

SEQ ID NO: 682979 - RNA, 17 nt, Haemophilus influenzae Rd
ucuucaugauuuuccaa

SEQ ID NO: 682980 - RNA, 18 nt, Haemophilus influenzae Rd
ucuucaugauuuuccaaa

SEQ ID NO: 682981 - RNA, 19 nt, Haemophilus influenzae Rd
ucuucaugauuuuccaaaa

SEQ ID NO: 682982 - RNA, 20 nt, Haemophilus influenzae Rd
ucuucaucauacaauccacc

SEQ ID NO: 682983 - RNA, 22 nt, Haemophilus influenzae Rd
ucuucaauagaacguaauaauu

SEQ ID NO: 682984 - RNA, 16 nt, Haemophilus influenzae Rd
ucuucaaucaucauuu

SEQ ID NO: 682985 - RNA, 23 nt, Haemophilus influenzae Rd
ucuucaaucaucauuuauuaaaa

SEQ ID NO: 682986 - RNA, 22 nt, Haemophilus influenzae Rd
ucuucaauaacaacuggaauuu

SEQ ID NO: 682987 - RNA, 13 nt, Haemophilus influenzae Rd
ucuuaugaaaaaa

SEQ ID NO: 682988 - RNA, 14 nt, Haemophilus influenzae Rd
ucuuauuauacauu

SEQ ID NO: 682989 - RNA, 15 nt, Haemophilus influenzae Rd
ucuuauuauacauuu

SEQ ID NO: 682990 - RNA, 18 nt, Haemophilus influenzae Rd
ucuuauacaacaaaaagg

SEQ ID NO: 682991 - RNA, 17 nt, Haemophilus influenzae Rd
ucuuauauauaaaauau

SEQ ID NO: 682992 - RNA, 12 nt, Haemophilus influenzae Rd
ucuuauauucuu

SEQ ID NO: 682993 - RNA, 19 nt, Haemophilus influenzae Rd
ucuuaguauuuuauuuaag

SEQ ID NO: 682994 - RNA, 21 nt, Haemophilus influenzae Rd
ucuuagacucguuuuuuauuu

SEQ ID NO: 682995 - RNA, 13 nt, Haemophilus influenzae Rd
ucuuagauuucua

SEQ ID NO: 682996 - RNA, 22 nt, Haemophilus influenzae Rd
ucuuacggauuuuugaacguuu

SEQ ID NO: 682997 - RNA, 12 nt, Haemophilus influenzae Rd
ucuguguuuugu

SEQ ID NO: 682998 - RNA, 14 nt, Haemophilus influenzae Rd
ucuguguuagaaag

SEQ ID NO: 682999 - RNA, 13 nt, Haemophilus influenzae Rd
ucuuaccaaaagg

SEQ ID NO: 683000 - RNA, 15 nt, Haemophilus influenzae Rd
ucuuaccuuuuucua

SEQ ID NO: 683001 - RNA, 15 nt, Haemophilus influenzae Rd
ucuuacgaagaaucc

SEQ ID NO: 683002 - RNA, 21 nt, Haemophilus influenzae Rd
ucuuaccccaacaaacacgca

SEQ ID NO: 683003 - RNA, 17 nt, Haemophilus influenzae Rd
ucuuucugcaauuuuac

SEQ ID NO: 683004 - RNA, 16 nt, Haemophilus influenzae Rd
ucuuucuuaaaauacc

SEQ ID NO: 683005 - RNA, 16 nt, Haemophilus influenzae Rd
ucuuucgcagccacuu

SEQ ID NO: 683006 - RNA, 12 nt, Haemophilus influenzae Rd
ucuuucauuuga

SEQ ID NO: 683007 - RNA, 15 nt, Haemophilus influenzae Rd
ucuuuccauuuuuuu

SEQ ID NO: 683008 - RNA, 13 nt, Haemophilus influenzae Rd
ucuuuccaaccag

SEQ ID NO: 683009 - RNA, 23 nt, Haemophilus influenzae Rd
ucuuuaucuauugauucuaaaaa

SEQ ID NO: 683010 - RNA, 21 nt, Haemophilus influenzae Rd
ucuuuaucugauuuaaucauu

SEQ ID NO: 683011 - RNA, 22 nt, Haemophilus influenzae Rd
ucuuuaauugauuaaaaaagca

SEQ ID NO: 683012 - RNA, 13 nt, Haemophilus influenzae Rd
ucuuuacaaauuu

SEQ ID NO: 683013 - RNA, 15 nt, Haemophilus influenzae Rd
ucuuuacaaauuucg

SEQ ID NO: 683014 - RNA, 19 nt, Haemophilus influenzae Rd
ucuuuaaucguuaccaaga

SEQ ID NO: 683015 - RNA, 19 nt, Haemophilus influenzae Rd
ucuuuaauuaaaauauuuu

SEQ ID NO: 683016 - RNA, 22 nt, Haemophilus influenzae Rd
ucuuuaauuaaaauauuuuuag

SEQ ID NO: 683017 - RNA, 24 nt, Haemophilus influenzae Rd
ucuuuaauagcgugcauuccuaaa

SEQ ID NO: 683018 - RNA, 22 nt, Haemophilus influenzae Rd
ucuuucacgauaauaguaucag

SEQ ID NO: 683019 - RNA, 14 nt, Haemophilus influenzae Rd
ucuuuauuaaacaa

SEQ ID NO: 683020 - RNA, 22 nt, Haemophilus influenzae Rd
ucuucccagcguaaaaaugcug

SEQ ID NO: 683021 - RNA, 17 nt, Haemophilus influenzae Rd
ucuugcuaaaaagaaau

SEQ ID NO: 683022 - RNA, 17 nt, Haemophilus influenzae Rd
ucuucccccaaaaaguu

SEQ ID NO: 683023 - RNA, 14 nt, Haemophilus influenzae Rd
ucuugcuuuuuaau

SEQ ID NO: 683024 - RNA, 15 nt, Haemophilus influenzae Rd
ucuugcuuuuuuaau

SEQ ID NO: 683025 - RNA, 17 nt, Haemophilus influenzae Rd
ucuugcuuuuuuaauca

SEQ ID NO: 683026 - RNA, 15 nt, Haemophilus influenzae Rd
ucuuguuuuuccaau

SEQ ID NO: 683027 - RNA, 22 nt, Haemophilus influenzae Rd
ucuuuaacuugcucugguugag

SEQ ID NO: 683028 - RNA, 13 nt, Haemophilus influenzae Rd
ucuuguuuuaaau

SEQ ID NO: 683029 - RNA, 14 nt, Haemophilus influenzae Rd
ucuuguuuuaauug

SEQ ID NO: 683030 - RNA, 19 nt, Haemophilus influenzae Rd
ucuuguuuaaauucaggcu

SEQ ID NO: 683031 - RNA, 15 nt, Haemophilus influenzae Rd
ucuuguggaucuaaa

SEQ ID NO: 683032 - RNA, 16 nt, Haemophilus influenzae Rd
ucuuguggugcaaccu

SEQ ID NO: 683033 - RNA, 14 nt, Haemophilus influenzae Rd
ucuuguucuccauu

SEQ ID NO: 683034 - RNA, 20 nt, Haemophilus influenzae Rd
ucuuguuggaucuuccaaua

SEQ ID NO: 683035 - RNA, 19 nt, Haemophilus influenzae Rd
ucuugggcggcuuguugaa

SEQ ID NO: 683036 - RNA, 15 nt, Haemophilus influenzae Rd
ucuuggauaauuucg

SEQ ID NO: 683037 - RNA, 17 nt, Haemophilus influenzae Rd
ucuuugaauugagugaa

SEQ ID NO: 683038 - RNA, 20 nt, Haemophilus influenzae Rd
ucuuugacuaaaguaaauuu

SEQ ID NO: 683039 - RNA, 17 nt, Haemophilus influenzae Rd
ucuuugacuaaaucaug

SEQ ID NO: 683040 - RNA, 20 nt, Haemophilus influenzae Rd
ucuuugaguaaaaaaucuag

SEQ ID NO: 683041 - RNA, 13 nt, Haemophilus influenzae Rd
ucuuugauauaaa

SEQ ID NO: 683042 - RNA, 13 nt, Haemophilus influenzae Rd
ucuuuggcuaugu

SEQ ID NO: 683043 - RNA, 19 nt, Haemophilus influenzae Rd
ucuuuguuaccuuuuccaa

SEQ ID NO: 683044 - RNA, 17 nt, Haemophilus influenzae Rd
ucuuuguucacaucaaa

SEQ ID NO: 683045 - RNA, 21 nt, Haemophilus influenzae Rd
ucuuuuaaaagaccacauucu

SEQ ID NO: 683046 - RNA, 15 nt, Haemophilus influenzae Rd
ucuuuuaaugcuucu

SEQ ID NO: 683047 - RNA, 18 nt, Haemophilus influenzae Rd
ucuuuuaauaaaaccaua

SEQ ID NO: 683048 - RNA, 15 nt, Haemophilus influenzae Rd
ucuuuucaaacaaca

SEQ ID NO: 683049 - RNA, 17 nt, Haemophilus influenzae Rd
ucuuuuaucgacaaauu

SEQ ID NO: 683050 - RNA, 21 nt, Haemophilus influenzae Rd
ucuuuuaucgagaaaauuaaa

SEQ ID NO: 683051 - RNA, 22 nt, Haemophilus influenzae Rd
ucuuuuaucgagaaaauuaaaa

SEQ ID NO: 683052 - RNA, 14 nt, Haemophilus influenzae Rd
ucuuuuaauuuuua

SEQ ID NO: 683053 - RNA, 19 nt, Haemophilus influenzae Rd
ucuuuuacaccguccaagg

SEQ ID NO: 683054 - RNA, 13 nt, Haemophilus influenzae Rd
ugaaaaaaacugu

SEQ ID NO: 683055 - RNA, 17 nt, Haemophilus influenzae Rd
ugaaaaaaagaaaacca

SEQ ID NO: 683056 - RNA, 16 nt, Haemophilus influenzae Rd
ucuuuuuuuauauuuu

SEQ ID NO: 683057 - RNA, 12 nt, Haemophilus influenzae Rd
ucuuuuuuucau

SEQ ID NO: 683058 - RNA, 15 nt, Haemophilus influenzae Rd
ugaaaaaagugcgau

SEQ ID NO: 683059 - RNA, 18 nt, Haemophilus influenzae Rd
ugaaaaaauaaccacuag

SEQ ID NO: 683060 - RNA, 20 nt, Haemophilus influenzae Rd
ugaaaaaauaucgcacuuuu

SEQ ID NO: 683061 - RNA, 21 nt, Haemophilus influenzae Rd
ucuuuuuucuuccuaugaaua

SEQ ID NO: 683062 - RNA, 17 nt, Haemophilus influenzae Rd
ucuuuuuguaauuuuug

SEQ ID NO: 683063 - RNA, 20 nt, Haemophilus influenzae Rd
ucuuuuuauuagacaauaaa

SEQ ID NO: 683064 - RNA, 13 nt, Haemophilus influenzae Rd
ucuuuuuauaaaa

SEQ ID NO: 683065 - RNA, 17 nt, Haemophilus influenzae Rd
ucuuuuguuacuuucca

SEQ ID NO: 683066 - RNA, 14 nt, Haemophilus influenzae Rd
ucuuuuucaagaac

SEQ ID NO: 683067 - RNA, 13 nt, Haemophilus influenzae Rd
ucuuuuucagaag

SEQ ID NO: 683068 - RNA, 17 nt, Haemophilus influenzae Rd
ucuuuugguaaauacug

SEQ ID NO: 683069 - RNA, 16 nt, Haemophilus influenzae Rd
ucuuuugguaauaaau

SEQ ID NO: 683070 - RNA, 19 nt, Haemophilus influenzae Rd
ucuuuugauaagcuugcgu

SEQ ID NO: 683071 - RNA, 14 nt, Haemophilus influenzae Rd
ucuuuugcacuuug

SEQ ID NO: 683072 - RNA, 17 nt, Haemophilus influenzae Rd
ucuuuugcccauucuaa

SEQ ID NO: 683073 - RNA, 13 nt, Haemophilus influenzae Rd
ucuuuucuucuaa

SEQ ID NO: 683074 - RNA, 16 nt, Haemophilus influenzae Rd
ucuuuucuaacgcuuu

SEQ ID NO: 683075 - RNA, 20 nt, Haemophilus influenzae Rd
ucuuuuccuccgaugaccuc

SEQ ID NO: 683076 - RNA, 20 nt, Haemophilus influenzae Rd
ugaaagcuauuucggcagua

SEQ ID NO: 683077 - RNA, 22 nt, Haemophilus influenzae Rd
ugaaagcuauuucggcaguacu

SEQ ID NO: 683078 - RNA, 16 nt, Haemophilus influenzae Rd
ugaaagggaaauuuau

SEQ ID NO: 683079 - RNA, 23 nt, Haemophilus influenzae Rd
ugaaagggaaauaacaaaaacaa

SEQ ID NO: 683080 - RNA, 21 nt, Haemophilus influenzae Rd
ugaaaggugguuuuuguuucg

SEQ ID NO: 683081 - RNA, 20 nt, Haemophilus influenzae Rd
ugaaaguaacaauguagaaa

SEQ ID NO: 683082 - RNA, 21 nt, Haemophilus influenzae Rd
ugaaaguaacaauguagaaau

SEQ ID NO: 683083 - RNA, 15 nt, Haemophilus influenzae Rd
ugaaagaauaucaau

SEQ ID NO: 683084 - RNA, 14 nt, Haemophilus influenzae Rd
ugaaagacgaauca

SEQ ID NO: 683085 - RNA, 14 nt, Haemophilus influenzae Rd
ugaaagauaaauua

SEQ ID NO: 683086 - RNA, 17 nt, Haemophilus influenzae Rd
ugaaagauaaauuacau

SEQ ID NO: 683087 - RNA, 16 nt, Haemophilus influenzae Rd
ugaaaguauuaaauuu

SEQ ID NO: 683088 - RNA, 16 nt, Haemophilus influenzae Rd
ugaaauaaagaaagga

SEQ ID NO: 683089 - RNA, 20 nt, Haemophilus influenzae Rd
ugaaaguuugcuuagugaaa

SEQ ID NO: 683090 - RNA, 24 nt, Haemophilus influenzae Rd
ugaaacggcgaagagauucuaauu

SEQ ID NO: 683091 - RNA, 20 nt, Haemophilus influenzae Rd
ugaaaccucccaaaaacuaa

SEQ ID NO: 683092 - RNA, 19 nt, Haemophilus influenzae Rd
ugaaaccugaguaaauaaa

SEQ ID NO: 683093 - RNA, 14 nt, Haemophilus influenzae Rd
ugaaagaaaaagau

SEQ ID NO: 683094 - RNA, 19 nt, Haemophilus influenzae Rd
ugaaacuguuuuggcauuu

SEQ ID NO: 683095 - RNA, 22 nt, Haemophilus influenzae Rd
ugaaacuguuuuggcauuuuca

SEQ ID NO: 683096 - RNA, 20 nt, Haemophilus influenzae Rd
ugaaacuugguguaauuuga

SEQ ID NO: 683097 - RNA, 14 nt, Haemophilus influenzae Rd
ugaaacagcuaaaa

SEQ ID NO: 683098 - RNA, 19 nt, Haemophilus influenzae Rd
ugaaacagcuaaaaaugaa

SEQ ID NO: 683099 - RNA, 17 nt, Haemophilus influenzae Rd
ugaaacaagcuguagca

SEQ ID NO: 683100 - RNA, 16 nt, Haemophilus influenzae Rd
ugaaacaauaaaacuu

SEQ ID NO: 683101 - RNA, 23 nt, Haemophilus influenzae Rd
ugaaaauuaguuuuucgcugcag

SEQ ID NO: 683102 - RNA, 22 nt, Haemophilus influenzae Rd
ugaaaauucuucuaacauuucu

SEQ ID NO: 683103 - RNA, 17 nt, Haemophilus influenzae Rd
ugaaaauugcaaaggca

SEQ ID NO: 683104 - RNA, 13 nt, Haemophilus influenzae Rd
ugaaaaucaaaag

SEQ ID NO: 683105 - RNA, 14 nt, Haemophilus influenzae Rd
ugaaaaucucuaua

SEQ ID NO: 683106 - RNA, 16 nt, Haemophilus influenzae Rd
ugaaaaucucuauaau

SEQ ID NO: 683107 - RNA, 20 nt, Haemophilus influenzae Rd
ugaaaagugcgguaaaaauu

SEQ ID NO: 683108 - RNA, 23 nt, Haemophilus influenzae Rd
ugaaaagugcgguaaaaauuucu

SEQ ID NO: 683109 - RNA, 15 nt, Haemophilus influenzae Rd
ugaaaauaaccgcac

SEQ ID NO: 683110 - RNA, 16 nt, Haemophilus influenzae Rd
ugaaaaguaaaugaua

SEQ ID NO: 683111 - RNA, 16 nt, Haemophilus influenzae Rd
ugaaaagcugauauaa

SEQ ID NO: 683112 - RNA, 21 nt, Haemophilus influenzae Rd
ugaaaagcugauauaaaaaug

SEQ ID NO: 683113 - RNA, 12 nt, Haemophilus influenzae Rd
ugaaaagaaaac

SEQ ID NO: 683114 - RNA, 14 nt, Haemophilus influenzae Rd
ugaaaagaaaacuu

SEQ ID NO: 683115 - RNA, 15 nt, Haemophilus influenzae Rd
ugaaaagaaaacuua

SEQ ID NO: 683116 - RNA, 22 nt, Haemophilus influenzae Rd
ugaaaagaaaguauuaaauaua

SEQ ID NO: 683117 - RNA, 13 nt, Haemophilus influenzae Rd
ugaaaacuaugcu

SEQ ID NO: 683118 - RNA, 20 nt, Haemophilus influenzae Rd
ugaaaaauggacagaauaac

SEQ ID NO: 683119 - RNA, 17 nt, Haemophilus influenzae Rd
ugaaaaauuaucaaaag

SEQ ID NO: 683120 - RNA, 13 nt, Haemophilus influenzae Rd
ugaaaaauaucac

SEQ ID NO: 683121 - RNA, 20 nt, Haemophilus influenzae Rd
ugaaaacagcggucaaaaua

SEQ ID NO: 683122 - RNA, 15 nt, Haemophilus influenzae Rd
ugaaaaagcuaaaaa

SEQ ID NO: 683123 - RNA, 19 nt, Haemophilus influenzae Rd
ugaaaaagcuaaaaaaaca

SEQ ID NO: 683124 - RNA, 14 nt, Haemophilus influenzae Rd
ugaaccaaaucuaa

SEQ ID NO: 683125 - RNA, 20 nt, Haemophilus influenzae Rd
ugaaccaacccaauuuaccu

SEQ ID NO: 683126 - RNA, 14 nt, Haemophilus influenzae Rd
ugaaccauaaacaa

SEQ ID NO: 683127 - RNA, 21 nt, Haemophilus influenzae Rd
ugaaccuucacagauuucaau

SEQ ID NO: 683128 - RNA, 17 nt, Haemophilus influenzae Rd
ugaacgccaacaacuua

SEQ ID NO: 683129 - RNA, 13 nt, Haemophilus influenzae Rd
ugaaccuauuaga

SEQ ID NO: 683130 - RNA, 16 nt, Haemophilus influenzae Rd
ugaacauaagcaacau

SEQ ID NO: 683131 - RNA, 20 nt, Haemophilus influenzae Rd
ugaaauuagguuauuuuuuc

SEQ ID NO: 683132 - RNA, 22 nt, Haemophilus influenzae Rd
ugaaauuagguuauuuuuucaa

SEQ ID NO: 683133 - RNA, 22 nt, Haemophilus influenzae Rd
ugaaauuauugcuuaugauuua

SEQ ID NO: 683134 - RNA, 14 nt, Haemophilus influenzae Rd
ugaaauucauucaa

SEQ ID NO: 683135 - RNA, 13 nt, Haemophilus influenzae Rd
ugaaaugcucuaa

SEQ ID NO: 683136 - RNA, 22 nt, Haemophilus influenzae Rd
ugaaaugcccguuacuuuuauu

SEQ ID NO: 683137 - RNA, 23 nt, Haemophilus influenzae Rd
ugaaaugcccguuacuuuuauug

SEQ ID NO: 683138 - RNA, 13 nt, Haemophilus influenzae Rd
ugaaauuaauaag

SEQ ID NO: 683139 - RNA, 16 nt, Haemophilus influenzae Rd
ugaaauuacucaucug

SEQ ID NO: 683140 - RNA, 20 nt, Haemophilus influenzae Rd
ugaaauuacucaucugaauu

SEQ ID NO: 683141 - RNA, 23 nt, Haemophilus influenzae Rd
ugaaauuacucaucugaauuuaa

SEQ ID NO: 683142 - RNA, 12 nt, Haemophilus influenzae Rd
ugaaauuuaaua

SEQ ID NO: 683143 - RNA, 21 nt, Haemophilus influenzae Rd
ugaaauugaggauuugccucu

SEQ ID NO: 683144 - RNA, 23 nt, Haemophilus influenzae Rd
ugaaauuuauuauaaaaauauuu

SEQ ID NO: 683145 - RNA, 20 nt, Haemophilus influenzae Rd
ugaaauuuaucuaaaaguaa

SEQ ID NO: 683146 - RNA, 21 nt, Haemophilus influenzae Rd
ugaaauuuccugagaauuuuc

SEQ ID NO: 683147 - RNA, 22 nt, Haemophilus influenzae Rd
ugaaauuuccugagaauuuuca

SEQ ID NO: 683148 - RNA, 13 nt, Haemophilus influenzae Rd
ugaaauuucuuua

SEQ ID NO: 683149 - RNA, 16 nt, Haemophilus influenzae Rd
ugaaauuuuaauuuag

SEQ ID NO: 683150 - RNA, 14 nt, Haemophilus influenzae Rd
ugaaauuugaaugc

SEQ ID NO: 683151 - RNA, 22 nt, Haemophilus influenzae Rd
ugaaauuuuuaucuaaauuaau

SEQ ID NO: 683152 - RNA, 13 nt, Haemophilus influenzae Rd
ugaaauuuuucau

SEQ ID NO: 683153 - RNA, 23 nt, Haemophilus influenzae Rd
ugaaauaagauuuuugauaaaaa

SEQ ID NO: 683154 - RNA, 12 nt, Haemophilus influenzae Rd
ugaaauaaaaua

SEQ ID NO: 683155 - RNA, 22 nt, Haemophilus influenzae Rd
ugaaauauuccaacgauuuugc

SEQ ID NO: 683156 - RNA, 16 nt, Haemophilus influenzae Rd
ugaaauaguuaaagaa

SEQ ID NO: 683157 - RNA, 16 nt, Haemophilus influenzae Rd
ugaaaucccuuagaaa

SEQ ID NO: 683158 - RNA, 11 nt, Haemophilus influenzae Rd
ugaaauauuuu

SEQ ID NO: 683159 - RNA, 17 nt, Haemophilus influenzae Rd
ugaaaucauuacacaga

SEQ ID NO: 683160 - RNA, 21 nt, Haemophilus influenzae Rd
gggaauaccacaguccccaua

SEQ ID NO: 683161 - RNA, 13 nt, Haemophilus influenzae Rd
gggaaucuggcuu

SEQ ID NO: 683162 - RNA, 23 nt, Haemophilus influenzae Rd
gggaaucuggcuuauggaggggg

SEQ ID NO: 683163 - RNA, 20 nt, Haemophilus influenzae Rd
gggaccauuuuuccagcaaa

SEQ ID NO: 683164 - RNA, 21 nt, Haemophilus influenzae Rd
gggacgaugauccaaaaauau

SEQ ID NO: 683165 - RNA, 13 nt, Haemophilus influenzae Rd
ggcuuucaccaaa

SEQ ID NO: 683166 - RNA, 19 nt, Haemophilus influenzae Rd
ggcuugcucuguauuuugu

SEQ ID NO: 683167 - RNA, 15 nt, Haemophilus influenzae Rd
ggcuugccguuuagu

SEQ ID NO: 683168 - RNA, 14 nt, Haemophilus influenzae Rd
ggcuuagaagugcg

SEQ ID NO: 683169 - RNA, 16 nt, Haemophilus influenzae Rd
ggcuuagauaauaaaa

SEQ ID NO: 683170 - RNA, 17 nt, Haemophilus influenzae Rd
ggcuuagauaauaaaau

SEQ ID NO: 683171 - RNA, 17 nt, Haemophilus influenzae Rd
ggcuuauuuguuuuaua

SEQ ID NO: 683172 - RNA, 15 nt, Haemophilus influenzae Rd
ggcuucucaaaugaa

SEQ ID NO: 683173 - RNA, 17 nt, Haemophilus influenzae Rd
ggcuucucaaaugaaau

SEQ ID NO: 683174 - RNA, 15 nt, Haemophilus influenzae Rd
ggcuucauuugcuuc

SEQ ID NO: 683175 - RNA, 21 nt, Haemophilus influenzae Rd
gggauauugccuaauagaaaa

SEQ ID NO: 683176 - RNA, 15 nt, Haemophilus influenzae Rd
gggauuucaaacaau

SEQ ID NO: 683177 - RNA, 18 nt, Haemophilus influenzae Rd
gggauuucaauaaauuca

SEQ ID NO: 683178 - RNA, 24 nt, Haemophilus influenzae Rd
gggauugacuaccaauauuaucgu

SEQ ID NO: 683179 - RNA, 13 nt, Haemophilus influenzae Rd
gggauuugaaaau

SEQ ID NO: 683180 - RNA, 21 nt, Haemophilus influenzae Rd
gggauuuuauuuaauauaauu

SEQ ID NO: 683181 - RNA, 11 nt, Haemophilus influenzae Rd
gggcaaucaaa

SEQ ID NO: 683182 - RNA, 15 nt, Haemophilus influenzae Rd
gggcaacagucagug

SEQ ID NO: 683183 - RNA, 18 nt, Haemophilus influenzae Rd
gggcaacagugauacuuc

SEQ ID NO: 683184 - RNA, 22 nt, Haemophilus influenzae Rd
gggucaagauuaaucuuuuuuc

SEQ ID NO: 683185 - RNA, 17 nt, Haemophilus influenzae Rd
ggguaaaauaaugcaaa

SEQ ID NO: 683186 - RNA, 21 nt, Haemophilus influenzae Rd
ggucaacauaaagauuaaaau

SEQ ID NO: 683187 - RNA, 22 nt, Haemophilus influenzae Rd
ggucaauaaaaauaauguuuuu

SEQ ID NO: 683188 - RNA, 20 nt, Haemophilus influenzae Rd
gguauuuuuuauugaaauuu

SEQ ID NO: 683189 - RNA, 12 nt, Haemophilus influenzae Rd
ggucaaaaugca

SEQ ID NO: 683190 - RNA, 20 nt, Haemophilus influenzae Rd
ggucaucucuuguuuuucca

SEQ ID NO: 683191 - RNA, 22 nt, Haemophilus influenzae Rd
ggucaucucuuguuuuuccaau

SEQ ID NO: 683192 - RNA, 23 nt, Haemophilus influenzae Rd
gguccccccuaccggacuugaac

SEQ ID NO: 683193 - RNA, 12 nt, Haemophilus influenzae Rd
ggugagugagca

SEQ ID NO: 683194 - RNA, 17 nt, Haemophilus influenzae Rd
ggugcauugucuuuuac

SEQ ID NO: 683195 - RNA, 22 nt, Haemophilus influenzae Rd
ggucugcaauaauaucugcuuu

SEQ ID NO: 683196 - RNA, 23 nt, Haemophilus influenzae Rd
ggucgguauucauaucaaugcca

SEQ ID NO: 683197 - RNA, 18 nt, Haemophilus influenzae Rd
gguguaacgcuuaaccau

SEQ ID NO: 683198 - RNA, 17 nt, Haemophilus influenzae Rd
ggugcuuaacugaaaau

SEQ ID NO: 683199 - RNA, 16 nt, Haemophilus influenzae Rd
gguucaucuaauaaua

SEQ ID NO: 683200 - RNA, 18 nt, Haemophilus influenzae Rd
gguucagcccuuuuaguu

SEQ ID NO: 683201 - RNA, 15 nt, Haemophilus influenzae Rd
gguuccccuuucuga

SEQ ID NO: 683202 - RNA, 22 nt, Haemophilus influenzae Rd
gguuauuucuugccaaaaauua

SEQ ID NO: 683203 - RNA, 12 nt, Haemophilus influenzae Rd
gguuaguacuug

SEQ ID NO: 683204 - RNA, 22 nt, Haemophilus influenzae Rd
gguuaguuguuucaccauuucc

SEQ ID NO: 683205 - RNA, 18 nt, Haemophilus influenzae Rd
gguuauaaguuuuuugcc

SEQ ID NO: 683206 - RNA, 22 nt, Haemophilus influenzae Rd
gguuaauuuucaccgcacuuuc

SEQ ID NO: 683207 - RNA, 14 nt, Haemophilus influenzae Rd
gguuagaucagaaa

SEQ ID NO: 683208 - RNA, 16 nt, Haemophilus influenzae Rd
gguuagaucagaaaac

SEQ ID NO: 683209 - RNA, 17 nt, Haemophilus influenzae Rd
gguuaaguaaucuggug

SEQ ID NO: 683210 - RNA, 13 nt, Haemophilus influenzae Rd
gguuaauguaaac

SEQ ID NO: 683211 - RNA, 20 nt, Haemophilus influenzae Rd
gguuaauguaaacaaaaaua

SEQ ID NO: 683212 - RNA, 17 nt, Haemophilus influenzae Rd
gguuucagaauaaagaa

SEQ ID NO: 683213 - RNA, 20 nt, Haemophilus influenzae Rd
gguuuaucacuaauauaaag

SEQ ID NO: 683214 - RNA, 16 nt, Haemophilus influenzae Rd
gguuucgauauuaaua

SEQ ID NO: 683215 - RNA, 19 nt, Haemophilus influenzae Rd
gguuucuaaaugaauaaaa

SEQ ID NO: 683216 - RNA, 11 nt, Haemophilus influenzae Rd
gguuugacaua

SEQ ID NO: 683217 - RNA, 19 nt, Haemophilus influenzae Rd
guaaaaaaguuugauaaag

SEQ ID NO: 683218 - RNA, 15 nt, Haemophilus influenzae Rd
guaaaaaaucaagcc

SEQ ID NO: 683219 - RNA, 21 nt, Haemophilus influenzae Rd
guaaaaauucuuuuuucuucc

SEQ ID NO: 683220 - RNA, 18 nt, Haemophilus influenzae Rd
guaaaaagaaaagugcgg

SEQ ID NO: 683221 - RNA, 12 nt, Haemophilus influenzae Rd
guaaaaauaaaa

SEQ ID NO: 683222 - RNA, 22 nt, Haemophilus influenzae Rd
guaaaaaucauuaaauaacuca

SEQ ID NO: 683223 - RNA, 16 nt, Haemophilus influenzae Rd
guaaaacaaaaggcaa

SEQ ID NO: 683224 - RNA, 14 nt, Haemophilus influenzae Rd
guaaaacauuucau

SEQ ID NO: 683225 - RNA, 16 nt, Haemophilus influenzae Rd
gguuuugcaaaccaaa

SEQ ID NO: 683226 - RNA, 23 nt, Haemophilus influenzae Rd
gguuuugccgcaaacaucaucac

SEQ ID NO: 683227 - RNA, 13 nt, Haemophilus influenzae Rd
gguuuuucuuuua

SEQ ID NO: 683228 - RNA, 13 nt, Haemophilus influenzae Rd
gguuuuuuuauua

SEQ ID NO: 683229 - RNA, 21 nt, Haemophilus influenzae Rd
guaaaaaaaagcgugauuuuu

SEQ ID NO: 683230 - RNA, 15 nt, Haemophilus influenzae Rd
gguugcuaugcccaa

SEQ ID NO: 683231 - RNA, 15 nt, Haemophilus influenzae Rd
gguuguuuuuguaaa

SEQ ID NO: 683232 - RNA, 12 nt, Haemophilus influenzae Rd
gguuuaauaauc

SEQ ID NO: 683233 - RNA, 21 nt, Haemophilus influenzae Rd
gguuuaaauuuuaaaaaauaa

SEQ ID NO: 683234 - RNA, 17 nt, Haemophilus influenzae Rd
gguuuacuuuaauuguc

SEQ ID NO: 683235 - RNA, 22 nt, Haemophilus influenzae Rd
gguugauuuuccugaugaauuu

SEQ ID NO: 683236 - RNA, 13 nt, Haemophilus influenzae Rd
gguucuuuuaauu

SEQ ID NO: 683237 - RNA, 15 nt, Haemophilus influenzae Rd
gguugaacuucuaaa

SEQ ID NO: 683238 - RNA, 20 nt, Haemophilus influenzae Rd
guaaugacgugguuugcacc

SEQ ID NO: 683239 - RNA, 13 nt, Haemophilus influenzae Rd
guaaucuugugcu

SEQ ID NO: 683240 - RNA, 19 nt, Haemophilus influenzae Rd
guaaucuuuacccauugcu

SEQ ID NO: 683241 - RNA, 15 nt, Haemophilus influenzae Rd
guaaugaaagaaaca

SEQ ID NO: 683242 - RNA, 15 nt, Haemophilus influenzae Rd
guaaugcuaaauaua

SEQ ID NO: 683243 - RNA, 16 nt, Haemophilus influenzae Rd
guaauuaagguuucuu

SEQ ID NO: 683244 - RNA, 18 nt, Haemophilus influenzae Rd
guaauuaagguuucuucu

SEQ ID NO: 683245 - RNA, 15 nt, Haemophilus influenzae Rd
guaaugcacuuucau

SEQ ID NO: 683246 - RNA, 19 nt, Haemophilus influenzae Rd
guaauuauagagaaauaau

SEQ ID NO: 683247 - RNA, 16 nt, Haemophilus influenzae Rd
guaauucgcaaauccu

SEQ ID NO: 683248 - RNA, 23 nt, Haemophilus influenzae Rd
guaauucggcgugcguaccuugu

SEQ ID NO: 683249 - RNA, 18 nt, Haemophilus influenzae Rd
guaauugauucgauaaau

SEQ ID NO: 683250 - RNA, 23 nt, Haemophilus influenzae Rd
guaauuguagccguaaguuaaac

SEQ ID NO: 683251 - RNA, 18 nt, Haemophilus influenzae Rd
guaauugagcguccacuu

SEQ ID NO: 683252 - RNA, 21 nt, Haemophilus influenzae Rd
guaauugagcguccacuucuu

SEQ ID NO: 683253 - RNA, 15 nt, Haemophilus influenzae Rd
guaauucuggcuguu

SEQ ID NO: 683254 - RNA, 21 nt, Haemophilus influenzae Rd
guaauucuggcuguuuugcca

SEQ ID NO: 683255 - RNA, 18 nt, Haemophilus influenzae Rd
guaauacaccaauaauua

SEQ ID NO: 683256 - RNA, 16 nt, Haemophilus influenzae Rd
guaauacaaaauaugc

SEQ ID NO: 683257 - RNA, 23 nt, Haemophilus influenzae Rd
guaauaaucaauuaaugggcuag

SEQ ID NO: 683258 - RNA, 22 nt, Haemophilus influenzae Rd
guaauaauccugguauuuacaa

SEQ ID NO: 683259 - RNA, 14 nt, Haemophilus influenzae Rd
guaauaaucuucuu

SEQ ID NO: 683260 - RNA, 17 nt, Haemophilus influenzae Rd
guaauaaucuucuuccc

SEQ ID NO: 683261 - RNA, 19 nt, Haemophilus influenzae Rd
guaauaaugaauauauuca

SEQ ID NO: 683262 - RNA, 17 nt, Haemophilus influenzae Rd
guaauaaguauuuugca

SEQ ID NO: 683263 - RNA, 13 nt, Haemophilus influenzae Rd
guaauaauagguu

SEQ ID NO: 683264 - RNA, 21 nt, Haemophilus influenzae Rd
guaaaacuaauacuucauagu

SEQ ID NO: 683265 - RNA, 17 nt, Haemophilus influenzae Rd
guaaaaggacuaaauuc

SEQ ID NO: 683266 - RNA, 19 nt, Haemophilus influenzae Rd
guaauccaaguauaaaaaa

SEQ ID NO: 683267 - RNA, 22 nt, Haemophilus influenzae Rd
guaauccauuuugaacaagguu

SEQ ID NO: 683268 - RNA, 15 nt, Haemophilus influenzae Rd
guaauagaguaccaa

SEQ ID NO: 683269 - RNA, 21 nt, Haemophilus influenzae Rd
guaauagauaaaguaguuuua

SEQ ID NO: 683270 - RNA, 16 nt, Haemophilus influenzae Rd
guaauacuuuugcuuc

SEQ ID NO: 683271 - RNA, 16 nt, Haemophilus influenzae Rd
guaauacuuuuuauuu

SEQ ID NO: 683272 - RNA, 14 nt, Haemophilus influenzae Rd
guacaacagcaaua

SEQ ID NO: 683273 - RNA, 12 nt, Haemophilus influenzae Rd
guacaagugcua

SEQ ID NO: 683274 - RNA, 20 nt, Haemophilus influenzae Rd
guacacaaugcuaucaggcu

SEQ ID NO: 683275 - RNA, 15 nt, Haemophilus influenzae Rd
guaauuuaucgccau

SEQ ID NO: 683276 - RNA, 14 nt, Haemophilus influenzae Rd
guaauuucaaaucu

SEQ ID NO: 683277 - RNA, 16 nt, Haemophilus influenzae Rd
guaauuucucaccaaa

SEQ ID NO: 683278 - RNA, 18 nt, Haemophilus influenzae Rd
guaauuucauaucuucuu

SEQ ID NO: 683279 - RNA, 17 nt, Haemophilus influenzae Rd
guaauuuguuagaucaa

SEQ ID NO: 683280 - RNA, 22 nt, Haemophilus influenzae Rd
guaauuugcgucuuaaauuaga

SEQ ID NO: 683281 - RNA, 20 nt, Haemophilus influenzae Rd
guaauuugaucuaauuugcc

SEQ ID NO: 683282 - RNA, 13 nt, Haemophilus influenzae Rd
guaauuuuuucuc

SEQ ID NO: 683283 - RNA, 13 nt, Haemophilus influenzae Rd
guacagaugccaa

SEQ ID NO: 683284 - RNA, 12 nt, Haemophilus influenzae Rd
guaccuuuaaau

SEQ ID NO: 683285 - RNA, 23 nt, Haemophilus influenzae Rd
guaccuuuaauuaaagccacaua

SEQ ID NO: 683286 - RNA, 13 nt, Haemophilus influenzae Rd
guaccuucugcug

SEQ ID NO: 683287 - RNA, 14 nt, Haemophilus influenzae Rd
guaccuucugcugc

SEQ ID NO: 683288 - RNA, 18 nt, Haemophilus influenzae Rd
guacgauaaacacugcgc

SEQ ID NO: 683289 - RNA, 13 nt, Haemophilus influenzae Rd
guacgagaaaaau

SEQ ID NO: 683290 - RNA, 22 nt, Haemophilus influenzae Rd
guacaucgaaaacauaauccgc

SEQ ID NO: 683291 - RNA, 17 nt, Haemophilus influenzae Rd
guacucgaauuauuuua

SEQ ID NO: 683292 - RNA, 21 nt, Haemophilus influenzae Rd
guacuuuuaacacuuuuucac

SEQ ID NO: 683293 - RNA, 18 nt, Haemophilus influenzae Rd
guagaaaacaauaaaaaa

SEQ ID NO: 683294 - RNA, 20 nt, Haemophilus influenzae Rd
guacuuggauugcaugaaau

SEQ ID NO: 683295 - RNA, 13 nt, Haemophilus influenzae Rd
guagccaauuuug

SEQ ID NO: 683296 - RNA, 13 nt, Haemophilus influenzae Rd
guagccauuuuca

SEQ ID NO: 683297 - RNA, 19 nt, Haemophilus influenzae Rd
guagaaugggcauugacua

SEQ ID NO: 683298 - RNA, 21 nt, Haemophilus influenzae Rd
guagacacaagggauuuaaaa

SEQ ID NO: 683299 - RNA, 18 nt, Haemophilus influenzae Rd
guagcacauaaagacgcu

SEQ ID NO: 683300 - RNA, 22 nt, Haemophilus influenzae Rd
guagcaggagaaagcuugcuuu

SEQ ID NO: 683301 - RNA, 20 nt, Haemophilus influenzae Rd
guauagaacgguuaugaaaa

SEQ ID NO: 683302 - RNA, 15 nt, Haemophilus influenzae Rd
guauagcuuuuugca

SEQ ID NO: 683303 - RNA, 16 nt, Haemophilus influenzae Rd
guauagcuuuuugcac

SEQ ID NO: 683304 - RNA, 19 nt, Haemophilus influenzae Rd
guaucauacuaaaaaauua

SEQ ID NO: 683305 - RNA, 18 nt, Haemophilus influenzae Rd
guaucagcuguugcaaug

SEQ ID NO: 683306 - RNA, 16 nt, Haemophilus influenzae Rd
guaucaaauacacaaa

SEQ ID NO: 683307 - RNA, 19 nt, Haemophilus influenzae Rd
guauccgccaaugcuuuua

SEQ ID NO: 683308 - RNA, 11 nt, Haemophilus influenzae Rd
guauguauuuu

SEQ ID NO: 683309 - RNA, 14 nt, Haemophilus influenzae Rd
guauguauuuucaa

SEQ ID NO: 683310 - RNA, 19 nt, Haemophilus influenzae Rd
guaucuaaauauauuuuua

SEQ ID NO: 683311 - RNA, 21 nt, Haemophilus influenzae Rd
guaucgacaguugccauugcu

SEQ ID NO: 683312 - RNA, 21 nt, Haemophilus influenzae Rd
guaugacaaacggaaaauuug

SEQ ID NO: 683313 - RNA, 20 nt, Haemophilus influenzae Rd
gucacgauuuuuuuauaaaa

SEQ ID NO: 683314 - RNA, 21 nt, Haemophilus influenzae Rd
gucacgauuuuuuuauaaaaa

SEQ ID NO: 683315 - RNA, 17 nt, Haemophilus influenzae Rd
gucaccaucacaagcaa

SEQ ID NO: 683316 - RNA, 22 nt, Haemophilus influenzae Rd
gucaccaucacaagcaaguuug

SEQ ID NO: 683317 - RNA, 15 nt, Haemophilus influenzae Rd
gucaccguauugcuc

SEQ ID NO: 683318 - RNA, 13 nt, Haemophilus influenzae Rd
gucacaggcccau

SEQ ID NO: 683319 - RNA, 17 nt, Haemophilus influenzae Rd
gucaauauauucuuggu

SEQ ID NO: 683320 - RNA, 22 nt, Haemophilus influenzae Rd
gucaaucaucccuucuuuuaua

SEQ ID NO: 683321 - RNA, 22 nt, Haemophilus influenzae Rd
gucacaccagagugaccaccaa

SEQ ID NO: 683322 - RNA, 22 nt, Haemophilus influenzae Rd
gucaaaugccgcuaaugguugc

SEQ ID NO: 683323 - RNA, 20 nt, Haemophilus influenzae Rd
gucaaaugugaccgcuuguu

SEQ ID NO: 683324 - RNA, 19 nt, Haemophilus influenzae Rd
gucaauaaaaauaauguuu

SEQ ID NO: 683325 - RNA, 12 nt, Haemophilus influenzae Rd
guauucuuucca

SEQ ID NO: 683326 - RNA, 16 nt, Haemophilus influenzae Rd
guauugaacuaaaaua

SEQ ID NO: 683327 - RNA, 17 nt, Haemophilus influenzae Rd
guauugaauaauuacuu

SEQ ID NO: 683328 - RNA, 16 nt, Haemophilus influenzae Rd
guauuaccauuuaucu

SEQ ID NO: 683329 - RNA, 18 nt, Haemophilus influenzae Rd
guauuagaaguaaauuca

SEQ ID NO: 683330 - RNA, 19 nt, Haemophilus influenzae Rd
guauucagugccuaaauuu

SEQ ID NO: 683331 - RNA, 16 nt, Haemophilus influenzae Rd
guauucaugauguaau

SEQ ID NO: 683332 - RNA, 20 nt, Haemophilus influenzae Rd
guauucaugauguaauucug

SEQ ID NO: 683333 - RNA, 16 nt, Haemophilus influenzae Rd
guauucccaaauuuuu

SEQ ID NO: 683334 - RNA, 19 nt, Haemophilus influenzae Rd
guauuuaagcugaaauuua

SEQ ID NO: 683335 - RNA, 22 nt, Haemophilus influenzae Rd
guauuuauaacacagaugaaaa

SEQ ID NO: 683336 - RNA, 16 nt, Haemophilus influenzae Rd
guauuuacuaaauucu

SEQ ID NO: 683337 - RNA, 15 nt, Haemophilus influenzae Rd
guauugcauaaaagc

SEQ ID NO: 683338 - RNA, 12 nt, Haemophilus influenzae Rd
guauuuugcaag

SEQ ID NO: 683339 - RNA, 22 nt, Haemophilus influenzae Rd
guauuuuacggauuuauauauu

SEQ ID NO: 683340 - RNA, 13 nt, Haemophilus influenzae Rd
guccaccacuggg

SEQ ID NO: 683341 - RNA, 14 nt, Haemophilus influenzae Rd
guccaauuucaucc

SEQ ID NO: 683342 - RNA, 12 nt, Haemophilus influenzae Rd
guccacagcaaa

SEQ ID NO: 683343 - RNA, 14 nt, Haemophilus influenzae Rd
guccaagguuuuaa

SEQ ID NO: 683344 - RNA, 15 nt, Haemophilus influenzae Rd
guccaaagaauaaua

SEQ ID NO: 683345 - RNA, 16 nt, Haemophilus influenzae Rd
gucaugccgcaaucaa

SEQ ID NO: 683346 - RNA, 18 nt, Haemophilus influenzae Rd
gucaugccgcaaucaagc

SEQ ID NO: 683347 - RNA, 21 nt, Haemophilus influenzae Rd
gucaucgaguuuuaucuucaa

SEQ ID NO: 683348 - RNA, 22 nt, Haemophilus influenzae Rd
gucaucauagucaggugcacga

SEQ ID NO: 683349 - RNA, 20 nt, Haemophilus influenzae Rd
gucaucagaaauaucuucaa

SEQ ID NO: 683350 - RNA, 12 nt, Haemophilus influenzae Rd
gucauauucauu

SEQ ID NO: 683351 - RNA, 13 nt, Haemophilus influenzae Rd
gucgaaauuuuuc

SEQ ID NO: 683352 - RNA, 20 nt, Haemophilus influenzae Rd
guccgaccauuaaauccuga

SEQ ID NO: 683353 - RNA, 23 nt, Haemophilus influenzae Rd
guccgugccaaagcauuaaguuu

SEQ ID NO: 683354 - RNA, 18 nt, Haemophilus influenzae Rd
gucccuguucaaauucug

SEQ ID NO: 683355 - RNA, 17 nt, Haemophilus influenzae Rd
gucccaaaauauuuuca

SEQ ID NO: 683356 - RNA, 21 nt, Haemophilus influenzae Rd
gucgcuuuucccucuuuuuca

SEQ ID NO: 683357 - RNA, 12 nt, Haemophilus influenzae Rd
gucgcuaacaua

SEQ ID NO: 683358 - RNA, 19 nt, Haemophilus influenzae Rd
gucguuguuccuaaugugc

SEQ ID NO: 683359 - RNA, 16 nt, Haemophilus influenzae Rd
gucuaaaugugcccag

SEQ ID NO: 683360 - RNA, 18 nt, Haemophilus influenzae Rd
gucuaagguuuccauaau

SEQ ID NO: 683361 - RNA, 15 nt, Haemophilus influenzae Rd
gucuaacuuuuucaa

SEQ ID NO: 683362 - RNA, 17 nt, Haemophilus influenzae Rd
gucuaaugccgccuuau

SEQ ID NO: 683363 - RNA, 17 nt, Haemophilus influenzae Rd
gucuaauuuuuuauuca

SEQ ID NO: 683364 - RNA, 15 nt, Haemophilus influenzae Rd
gucuaucuaagauaa

SEQ ID NO: 683365 - RNA, 12 nt, Haemophilus influenzae Rd
gucuauuauaaa

SEQ ID NO: 683366 - RNA, 15 nt, Haemophilus influenzae Rd
gucuauuauaaauuu

SEQ ID NO: 683367 - RNA, 17 nt, Haemophilus influenzae Rd
gucucaguaacgauguu

SEQ ID NO: 683368 - RNA, 18 nt, Haemophilus influenzae Rd
gucucaaaucguuugucg

SEQ ID NO: 683369 - RNA, 18 nt, Haemophilus influenzae Rd
gucucaaauuuuucacag

SEQ ID NO: 683370 - RNA, 13 nt, Haemophilus influenzae Rd
gucguuagcucag

SEQ ID NO: 683371 - RNA, 16 nt, Haemophilus influenzae Rd
gucguuauuuuuugcu

SEQ ID NO: 683372 - RNA, 23 nt, Haemophilus influenzae Rd
gucguaaugaaaaccuucaauug

SEQ ID NO: 683373 - RNA, 14 nt, Haemophilus influenzae Rd
gucgguuuuuucau

SEQ ID NO: 683374 - RNA, 17 nt, Haemophilus influenzae Rd
gucuucaagucuuuuuu

SEQ ID NO: 683375 - RNA, 16 nt, Haemophilus influenzae Rd
gucuuacuuuuuguuu

SEQ ID NO: 683376 - RNA, 18 nt, Haemophilus influenzae Rd
gucuucaucuuuaaacau

SEQ ID NO: 683377 - RNA, 19 nt, Haemophilus influenzae Rd
gucuguuuaaaaacggaau

SEQ ID NO: 683378 - RNA, 17 nt, Haemophilus influenzae Rd
gucuguugcaaauuuuu

SEQ ID NO: 683379 - RNA, 12 nt, Haemophilus influenzae Rd
gucuguuucuuc

SEQ ID NO: 683380 - RNA, 19 nt, Haemophilus influenzae Rd
gucuuagacucguuuuuua

SEQ ID NO: 683381 - RNA, 15 nt, Haemophilus influenzae Rd
gucuggcugaguaaa

SEQ ID NO: 683382 - RNA, 20 nt, Haemophilus influenzae Rd
gucugcugaaauacaaagca

SEQ ID NO: 683383 - RNA, 17 nt, Haemophilus influenzae Rd
gucugcaauaauaucug

SEQ ID NO: 683384 - RNA, 16 nt, Haemophilus influenzae Rd
gucugcacgaauaauu

SEQ ID NO: 683385 - RNA, 20 nt, Haemophilus influenzae Rd
gucugcacgaauaauuaaau

SEQ ID NO: 683386 - RNA, 16 nt, Haemophilus influenzae Rd
gucugcuccaaauaau

SEQ ID NO: 683387 - RNA, 14 nt, Haemophilus influenzae Rd
gucucgucaggcaa

SEQ ID NO: 683388 - RNA, 18 nt, Haemophilus influenzae Rd
gucuugaccugcagccau

SEQ ID NO: 683389 - RNA, 18 nt, Haemophilus influenzae Rd
gugaaaacuacuuuccaa

SEQ ID NO: 683390 - RNA, 21 nt, Haemophilus influenzae Rd
gucuuuuuaauuuaaauaaag

SEQ ID NO: 683391 - RNA, 14 nt, Haemophilus influenzae Rd
gucuuuaaauagau

SEQ ID NO: 683392 - RNA, 16 nt, Haemophilus influenzae Rd
gugaacugcuugcgcu

SEQ ID NO: 683393 - RNA, 19 nt, Haemophilus influenzae Rd
gugaaauuacucaucugaa

SEQ ID NO: 683394 - RNA, 22 nt, Haemophilus influenzae Rd
gugaaauuacuugaaucuaauc

SEQ ID NO: 683395 - RNA, 22 nt, Haemophilus influenzae Rd
gugaaaggaaacgcccauuuau

SEQ ID NO: 683396 - RNA, 16 nt, Haemophilus influenzae Rd
gugaauaucugucauu

SEQ ID NO: 683397 - RNA, 20 nt, Haemophilus influenzae Rd
gugaagugauucguaguaag

SEQ ID NO: 683398 - RNA, 17 nt, Haemophilus influenzae Rd
gugaauuuagccauuuu

SEQ ID NO: 683399 - RNA, 16 nt, Haemophilus influenzae Rd
gugaccugcgauaaua

SEQ ID NO: 683400 - RNA, 22 nt, Haemophilus influenzae Rd
gugacuuuuugugccaauccau

SEQ ID NO: 683401 - RNA, 20 nt, Haemophilus influenzae Rd
gugauaauuaaggucuuaca

SEQ ID NO: 683402 - RNA, 15 nt, Haemophilus influenzae Rd
gugaguugauuuaaa

SEQ ID NO: 683403 - RNA, 14 nt, Haemophilus influenzae Rd
gugauauuaaacag

SEQ ID NO: 683404 - RNA, 20 nt, Haemophilus influenzae Rd
gugauacggaaaguauuuuc

SEQ ID NO: 683405 - RNA, 14 nt, Haemophilus influenzae Rd
gugagucuugcuuu

SEQ ID NO: 683406 - RNA, 21 nt, Haemophilus influenzae Rd
gugaguaaaauacgaauaaac

SEQ ID NO: 683407 - RNA, 15 nt, Haemophilus influenzae Rd
gugaguaaaauauag

SEQ ID NO: 683408 - RNA, 17 nt, Haemophilus influenzae Rd
gugagcuugauuuucag

SEQ ID NO: 683409 - RNA, 16 nt, Haemophilus influenzae Rd
gugagcuaagcauuuc

SEQ ID NO: 683410 - RNA, 18 nt, Haemophilus influenzae Rd
gugagcuaagcauuucag

SEQ ID NO: 683411 - RNA, 15 nt, Haemophilus influenzae Rd
gugagauuucuugcu

SEQ ID NO: 683412 - RNA, 15 nt, Haemophilus influenzae Rd
gugagcaguggcuug

SEQ ID NO: 683413 - RNA, 18 nt, Haemophilus influenzae Rd
gugcaugagcuuugcuuu

SEQ ID NO: 683414 - RNA, 17 nt, Haemophilus influenzae Rd
gugauuucgcugcgaug

SEQ ID NO: 683415 - RNA, 16 nt, Haemophilus influenzae Rd
gugauuuuagaaaaau

SEQ ID NO: 683416 - RNA, 17 nt, Haemophilus influenzae Rd
gugauuuuaguuucuaa

SEQ ID NO: 683417 - RNA, 18 nt, Haemophilus influenzae Rd
gugauuucuauguuauua

SEQ ID NO: 683418 - RNA, 20 nt, Haemophilus influenzae Rd
gugauuuucagcaaaaugcg

SEQ ID NO: 683419 - RNA, 19 nt, Haemophilus influenzae Rd
gugcaaaguuaccauuuau

SEQ ID NO: 683420 - RNA, 16 nt, Haemophilus influenzae Rd
gugcaaauuuuuucaa

SEQ ID NO: 683421 - RNA, 19 nt, Haemophilus influenzae Rd
gugcaaaacuagucauauu

SEQ ID NO: 683422 - RNA, 16 nt, Haemophilus influenzae Rd
gugccauguacauuaa

SEQ ID NO: 683423 - RNA, 14 nt, Haemophilus influenzae Rd
gugcuuguuuuaaa

SEQ ID NO: 683424 - RNA, 21 nt, Haemophilus influenzae Rd
gugcgccaccuuuuguagaaa

SEQ ID NO: 683425 - RNA, 17 nt, Haemophilus influenzae Rd
gugcgcauauacuucuu

SEQ ID NO: 683426 - RNA, 13 nt, Haemophilus influenzae Rd
gugcuuuuuacaa

SEQ ID NO: 683427 - RNA, 14 nt, Haemophilus influenzae Rd
guggaaacgugcaa

SEQ ID NO: 683428 - RNA, 16 nt, Haemophilus influenzae Rd
guggaaacgugcaauu

SEQ ID NO: 683429 - RNA, 13 nt, Haemophilus influenzae Rd
guggaauaaaagu

SEQ ID NO: 683430 - RNA, 13 nt, Haemophilus influenzae Rd
guggaaggaacaa

SEQ ID NO: 683431 - RNA, 22 nt, Haemophilus influenzae Rd
guggauaauucaucaaaauuua

SEQ ID NO: 683432 - RNA, 22 nt, Haemophilus influenzae Rd
guggcacgccuaauucuugcca

SEQ ID NO: 683433 - RNA, 14 nt, Haemophilus influenzae Rd
guggacguuucaaa

SEQ ID NO: 683434 - RNA, 17 nt, Haemophilus influenzae Rd
guggacguuucaaaaau

SEQ ID NO: 683435 - RNA, 15 nt, Haemophilus influenzae Rd
guggaauguaaaaau

SEQ ID NO: 683436 - RNA, 16 nt, Haemophilus influenzae Rd
guggcguaaugguuuc

SEQ ID NO: 683437 - RNA, 14 nt, Haemophilus influenzae Rd
guggcgucaagccu

SEQ ID NO: 683438 - RNA, 18 nt, Haemophilus influenzae Rd
gugucggugguucgauuc

SEQ ID NO: 683439 - RNA, 22 nt, Haemophilus influenzae Rd
guguauuuuuaucuaaauuccu

SEQ ID NO: 683440 - RNA, 20 nt, Haemophilus influenzae Rd
gugucaaauuaauuaaucaa

SEQ ID NO: 683441 - RNA, 20 nt, Haemophilus influenzae Rd
guguauggucgguauucaua

SEQ ID NO: 683442 - RNA, 16 nt, Haemophilus influenzae Rd
guguagcaauaaacag

SEQ ID NO: 683443 - RNA, 16 nt, Haemophilus influenzae Rd
guuaacgcuuuugcaa

SEQ ID NO: 683444 - RNA, 15 nt, Haemophilus influenzae Rd
guuaauggguuaaaa

SEQ ID NO: 683445 - RNA, 19 nt, Haemophilus influenzae Rd
guuaauggguuaaaagcca

SEQ ID NO: 683446 - RNA, 14 nt, Haemophilus influenzae Rd
guuaauguaaacaa

SEQ ID NO: 683447 - RNA, 22 nt, Haemophilus influenzae Rd
guuaagccgauauuaucuaaac

SEQ ID NO: 683448 - RNA, 15 nt, Haemophilus influenzae Rd
guuaagcaccaucau

SEQ ID NO: 683449 - RNA, 16 nt, Haemophilus influenzae Rd
guuaagcaccaucaua

SEQ ID NO: 683450 - RNA, 13 nt, Haemophilus influenzae Rd
guuaagccugaua

SEQ ID NO: 683451 - RNA, 21 nt, Haemophilus influenzae Rd
guuaagcuaccugccauaaua

SEQ ID NO: 683452 - RNA, 14 nt, Haemophilus influenzae Rd
guuaaggauuuuug

SEQ ID NO: 683453 - RNA, 12 nt, Haemophilus influenzae Rd
guguuuuuucac

SEQ ID NO: 683454 - RNA, 22 nt, Haemophilus influenzae Rd
guguuuuuucaccuugaucuac

SEQ ID NO: 683455 - RNA, 21 nt, Haemophilus influenzae Rd
guuaaaacaaaagaaauuuua

SEQ ID NO: 683456 - RNA, 16 nt, Haemophilus influenzae Rd
guuaaaucacuuucau

SEQ ID NO: 683457 - RNA, 11 nt, Haemophilus influenzae Rd
guuaaaagugc

SEQ ID NO: 683458 - RNA, 18 nt, Haemophilus influenzae Rd
guguuauuggaaaauuca

SEQ ID NO: 683459 - RNA, 19 nt, Haemophilus influenzae Rd
guuacaucauccuuaccuu

SEQ ID NO: 683460 - RNA, 22 nt, Haemophilus influenzae Rd
guuacaucauccuuaccuucca

SEQ ID NO: 683461 - RNA, 21 nt, Haemophilus influenzae Rd
guuaauguuuucuugaccuuc

SEQ ID NO: 683462 - RNA, 18 nt, Haemophilus influenzae Rd
guuaccaauaacuaaaaa

SEQ ID NO: 683463 - RNA, 21 nt, Haemophilus influenzae Rd
guuaccaauaacuaaaaauac

SEQ ID NO: 683464 - RNA, 16 nt, Haemophilus influenzae Rd
guuaccgcuucuuccu

SEQ ID NO: 683465 - RNA, 17 nt, Haemophilus influenzae Rd
guuaccgcuucuuccug

SEQ ID NO: 683466 - RNA, 17 nt, Haemophilus influenzae Rd
guuagcggauaaaauaa

SEQ ID NO: 683467 - RNA, 12 nt, Haemophilus influenzae Rd
guuagcuaaaaa

SEQ ID NO: 683468 - RNA, 18 nt, Haemophilus influenzae Rd
guuauaguauauuuaucu

SEQ ID NO: 683469 - RNA, 21 nt, Haemophilus influenzae Rd
guuauauaaacaauuccccuu

SEQ ID NO: 683470 - RNA, 19 nt, Haemophilus influenzae Rd
guuaguuuuuuauguguuu

SEQ ID NO: 683471 - RNA, 16 nt, Haemophilus influenzae Rd
guuauaacguuuaaaa

SEQ ID NO: 683472 - RNA, 20 nt, Haemophilus influenzae Rd
guuauaaguuuuuugccaaa

SEQ ID NO: 683473 - RNA, 13 nt, Haemophilus influenzae Rd
guuauaauaacca

SEQ ID NO: 683474 - RNA, 19 nt, Haemophilus influenzae Rd
guuauaaacccaucauaaa

SEQ ID NO: 683475 - RNA, 18 nt, Haemophilus influenzae Rd
guuauaaauaaaaaaccg

SEQ ID NO: 683476 - RNA, 12 nt, Haemophilus influenzae Rd
guuauuucuugc

SEQ ID NO: 683477 - RNA, 12 nt, Haemophilus influenzae Rd
guuauuugcaaa

SEQ ID NO: 683478 - RNA, 13 nt, Haemophilus influenzae Rd
guucaaauuucuu

SEQ ID NO: 683479 - RNA, 20 nt, Haemophilus influenzae Rd
guucaaauuucuucacugug

SEQ ID NO: 683480 - RNA, 21 nt, Haemophilus influenzae Rd
guucaaauuucuucacugugc

SEQ ID NO: 683481 - RNA, 19 nt, Haemophilus influenzae Rd
guucaaaugaaagaagaaa

SEQ ID NO: 683482 - RNA, 16 nt, Haemophilus influenzae Rd
guucaaaacuaucaaa

SEQ ID NO: 683483 - RNA, 16 nt, Haemophilus influenzae Rd
guucaaacaucacgcc

SEQ ID NO: 683484 - RNA, 23 nt, Haemophilus influenzae Rd
guuauuuuuucaauuuaaaucaa

SEQ ID NO: 683485 - RNA, 13 nt, Haemophilus influenzae Rd
guucaaaaauauu

SEQ ID NO: 683486 - RNA, 15 nt, Haemophilus influenzae Rd
guucaaaaauauuau

SEQ ID NO: 683487 - RNA, 15 nt, Haemophilus influenzae Rd
guucaauaaaaauau

SEQ ID NO: 683488 - RNA, 13 nt, Haemophilus influenzae Rd
guucaauaauauu

SEQ ID NO: 683489 - RNA, 20 nt, Haemophilus influenzae Rd
guucaagaugugauauuaaa

SEQ ID NO: 683490 - RNA, 23 nt, Haemophilus influenzae Rd
guucaagaugugauauuaaacag

SEQ ID NO: 683491 - RNA, 16 nt, Haemophilus influenzae Rd
guucaagcaacguaaa

SEQ ID NO: 683492 - RNA, 21 nt, Haemophilus influenzae Rd
guucaagccuuugcgugccau

SEQ ID NO: 683493 - RNA, 14 nt, Haemophilus influenzae Rd
guucaacaccuaaa

SEQ ID NO: 683494 - RNA, 19 nt, Haemophilus influenzae Rd
guucaaccacuucagcaga

SEQ ID NO: 683495 - RNA, 20 nt, Haemophilus influenzae Rd
guucaauagucguuuaacca

SEQ ID NO: 683496 - RNA, 17 nt, Haemophilus influenzae Rd
guucacagagaauaaau

SEQ ID NO: 683497 - RNA, 19 nt, Haemophilus influenzae Rd
guucacagagaauaaauca

SEQ ID NO: 683498 - RNA, 17 nt, Haemophilus influenzae Rd
guuauugauaaaaauau

SEQ ID NO: 683499 - RNA, 15 nt, Haemophilus influenzae Rd
guuauuacuucacca

SEQ ID NO: 683500 - RNA, 17 nt, Haemophilus influenzae Rd
guuauuacuucaccaau

SEQ ID NO: 683501 - RNA, 19 nt, Haemophilus influenzae Rd
guuaucaucuguaaaccau

SEQ ID NO: 683502 - RNA, 20 nt, Haemophilus influenzae Rd
guuaucuguagaaacuaagc

SEQ ID NO: 683503 - RNA, 14 nt, Haemophilus influenzae Rd
guuaucuguauaaa

SEQ ID NO: 683504 - RNA, 16 nt, Haemophilus influenzae Rd
guuaugaaauugcugu

SEQ ID NO: 683505 - RNA, 17 nt, Haemophilus influenzae Rd
guuaugaaauugcugua

SEQ ID NO: 683506 - RNA, 13 nt, Haemophilus influenzae Rd
guuaucuuuaaag

SEQ ID NO: 683507 - RNA, 12 nt, Haemophilus influenzae Rd
guuaugaagccc

SEQ ID NO: 683508 - RNA, 14 nt, Haemophilus influenzae Rd
guuaugaagcccua

SEQ ID NO: 683509 - RNA, 23 nt, Haemophilus influenzae Rd
guuaugggcugacauaaauacac

SEQ ID NO: 683510 - RNA, 20 nt, Haemophilus influenzae Rd
guucaccgggcgauaaaauc

SEQ ID NO: 683511 - RNA, 21 nt, Haemophilus influenzae Rd
guucacaaaucuaaaaauaug

SEQ ID NO: 683512 - RNA, 21 nt, Haemophilus influenzae Rd
guucaucgccgugauaauauc

SEQ ID NO: 683513 - RNA, 16 nt, Haemophilus influenzae Rd
guucaucgugagcaua

SEQ ID NO: 683514 - RNA, 13 nt, Haemophilus influenzae Rd
guuccaggaaaau

SEQ ID NO: 683515 - RNA, 18 nt, Haemophilus influenzae Rd
guucugcacgaagugcgg

SEQ ID NO: 683516 - RNA, 15 nt, Haemophilus influenzae Rd
guucugcaguuucug

SEQ ID NO: 683517 - RNA, 19 nt, Haemophilus influenzae Rd
guucugccgcugcaacaaa

SEQ ID NO: 683518 - RNA, 16 nt, Haemophilus influenzae Rd
guucucgcaaaagugc

SEQ ID NO: 683519 - RNA, 19 nt, Haemophilus influenzae Rd
guucucacuaacuuuccua

SEQ ID NO: 683520 - RNA, 15 nt, Haemophilus influenzae Rd
guucgguuaaagaag

SEQ ID NO: 683521 - RNA, 16 nt, Haemophilus influenzae Rd
guucgguuaaagaagc

SEQ ID NO: 683522 - RNA, 20 nt, Haemophilus influenzae Rd
guucgagaaacuuucaaaau

SEQ ID NO: 683523 - RNA, 20 nt, Haemophilus influenzae Rd
guuucauaugccauugauuu

SEQ ID NO: 683524 - RNA, 19 nt, Haemophilus influenzae Rd
guuucaucacuucaaaaaa

SEQ ID NO: 683525 - RNA, 22 nt, Haemophilus influenzae Rd
guuucauuuuugcaccaaauuc

SEQ ID NO: 683526 - RNA, 15 nt, Haemophilus influenzae Rd
guuucuaaaugaaua

SEQ ID NO: 683527 - RNA, 19 nt, Haemophilus influenzae Rd
guuucuaaaugaauaaaac

SEQ ID NO: 683528 - RNA, 12 nt, Haemophilus influenzae Rd
guuucuaaaaua

SEQ ID NO: 683529 - RNA, 19 nt, Haemophilus influenzae Rd
guuucuaaaaucacuuuua

SEQ ID NO: 683530 - RNA, 19 nt, Haemophilus influenzae Rd
guuucggauaauaauuuuu

SEQ ID NO: 683531 - RNA, 14 nt, Haemophilus influenzae Rd
guuuccaaauuccg

SEQ ID NO: 683532 - RNA, 15 nt, Haemophilus influenzae Rd
guuucaagaagauuu

SEQ ID NO: 683533 - RNA, 22 nt, Haemophilus influenzae Rd
guuucaagaagauuugugauga

SEQ ID NO: 683534 - RNA, 14 nt, Haemophilus influenzae Rd
guuucaagucguua

SEQ ID NO: 683535 - RNA, 16 nt, Haemophilus influenzae Rd
guuucaccauuuccuu

SEQ ID NO: 683536 - RNA, 22 nt, Haemophilus influenzae Rd
guuucacauccacaaaauuccg

SEQ ID NO: 683537 - RNA, 14 nt, Haemophilus influenzae Rd
guuuagcaaacaau

SEQ ID NO: 683538 - RNA, 13 nt, Haemophilus influenzae Rd
guuuacuuaaaau

SEQ ID NO: 683539 - RNA, 16 nt, Haemophilus influenzae Rd
guuuauuuaacaauaa

SEQ ID NO: 683540 - RNA, 18 nt, Haemophilus influenzae Rd
guuuauuuaacaauaacu

SEQ ID NO: 683541 - RNA, 15 nt, Haemophilus influenzae Rd
guuuauuuauucagc

SEQ ID NO: 683542 - RNA, 18 nt, Haemophilus influenzae Rd
guuuaauuauagaaaaga

SEQ ID NO: 683543 - RNA, 16 nt, Haemophilus influenzae Rd
guuuacugaauaaaaa

SEQ ID NO: 683544 - RNA, 19 nt, Haemophilus influenzae Rd
guuuacugaauaaaaaaaa

SEQ ID NO: 683545 - RNA, 17 nt, Haemophilus influenzae Rd
guuuaauccaaacuaaa

SEQ ID NO: 683546 - RNA, 22 nt, Haemophilus influenzae Rd
guuuaauaaaucuuggugccaa

SEQ ID NO: 683547 - RNA, 20 nt, Haemophilus influenzae Rd
guuuaagggcuaaguucuau

SEQ ID NO: 683548 - RNA, 14 nt, Haemophilus influenzae Rd
guuuaauacaaucu

SEQ ID NO: 683549 - RNA, 13 nt, Haemophilus influenzae Rd
guuuaauaucgcc

SEQ ID NO: 683550 - RNA, 12 nt, Haemophilus influenzae Rd
guugugauuuuc

SEQ ID NO: 683551 - RNA, 20 nt, Haemophilus influenzae Rd
guuguguuucaacaaaaaua

SEQ ID NO: 683552 - RNA, 12 nt, Haemophilus influenzae Rd
guuuaacuucaa

SEQ ID NO: 683553 - RNA, 17 nt, Haemophilus influenzae Rd
guuguucaauuuggaaa

SEQ ID NO: 683554 - RNA, 13 nt, Haemophilus influenzae Rd
guucuguaauuca

SEQ ID NO: 683555 - RNA, 12 nt, Haemophilus influenzae Rd
guucuucaaauu

SEQ ID NO: 683556 - RNA, 22 nt, Haemophilus influenzae Rd
guuguccucccauucuuaaauc

SEQ ID NO: 683557 - RNA, 20 nt, Haemophilus influenzae Rd
guugucguuauuaugaaauu

SEQ ID NO: 683558 - RNA, 17 nt, Haemophilus influenzae Rd
guugugaaguuuuuuaa

SEQ ID NO: 683559 - RNA, 20 nt, Haemophilus influenzae Rd
guuugguuaccgcugcaggu

SEQ ID NO: 683560 - RNA, 16 nt, Haemophilus influenzae Rd
guuuguaaacgccauc

SEQ ID NO: 683561 - RNA, 13 nt, Haemophilus influenzae Rd
guuuguaauaaau

SEQ ID NO: 683562 - RNA, 22 nt, Haemophilus influenzae Rd
guuugcguaucacuuaaaccaa

SEQ ID NO: 683563 - RNA, 14 nt, Haemophilus influenzae Rd
guuugcuaauuuau

SEQ ID NO: 683564 - RNA, 17 nt, Haemophilus influenzae Rd
guuuggagauaaauaaa

SEQ ID NO: 683565 - RNA, 16 nt, Haemophilus influenzae Rd
guuuggcaauggcuga

SEQ ID NO: 683566 - RNA, 19 nt, Haemophilus influenzae Rd
guuuggcacaacaucagau

SEQ ID NO: 683567 - RNA, 17 nt, Haemophilus influenzae Rd
guuuguuucucaaguuu

SEQ ID NO: 683568 - RNA, 22 nt, Haemophilus influenzae Rd
guuuuaaaaaauaaauuuaaau

SEQ ID NO: 683569 - RNA, 16 nt, Haemophilus influenzae Rd
guuuguuccaauucug

SEQ ID NO: 683570 - RNA, 20 nt, Haemophilus influenzae Rd
guuuguaauccugcauuuuc

SEQ ID NO: 683571 - RNA, 14 nt, Haemophilus influenzae Rd
guuuguauuugagc

SEQ ID NO: 683572 - RNA, 22 nt, Haemophilus influenzae Rd
guuugucgcaggugucacagca

SEQ ID NO: 683573 - RNA, 17 nt, Haemophilus influenzae Rd
guuugugcguuuuuuaa

SEQ ID NO: 683574 - RNA, 18 nt, Haemophilus influenzae Rd
guuugugcuaaauuaaau

SEQ ID NO: 683575 - RNA, 14 nt, Haemophilus influenzae Rd
guuucuaauaccaa

SEQ ID NO: 683576 - RNA, 12 nt, Haemophilus influenzae Rd
guuucuuuaaau

SEQ ID NO: 683577 - RNA, 14 nt, Haemophilus influenzae Rd
guuucuugcccaau

SEQ ID NO: 683578 - RNA, 18 nt, Haemophilus influenzae Rd
guuucuugggauuuugcc

SEQ ID NO: 683579 - RNA, 19 nt, Haemophilus influenzae Rd
guuugcucucgucaauaca

SEQ ID NO: 683580 - RNA, 16 nt, Haemophilus influenzae Rd
guuugccgaagccuaa

SEQ ID NO: 683581 - RNA, 23 nt, Haemophilus influenzae Rd
guuugccaucuaaaaaacccgcu

SEQ ID NO: 683582 - RNA, 19 nt, Haemophilus influenzae Rd
guuuucgccaucaucagcu

SEQ ID NO: 683583 - RNA, 15 nt, Haemophilus influenzae Rd
guuuucgucacaaug

SEQ ID NO: 683584 - RNA, 15 nt, Haemophilus influenzae Rd
guuuucgugauuuug

SEQ ID NO: 683585 - RNA, 17 nt, Haemophilus influenzae Rd
guuuuauuuuuccacug

SEQ ID NO: 683586 - RNA, 18 nt, Haemophilus influenzae Rd
guuuucaaauuaaccgca

SEQ ID NO: 683587 - RNA, 20 nt, Haemophilus influenzae Rd
guuuucaacagugaaaccaa

SEQ ID NO: 683588 - RNA, 21 nt, Haemophilus influenzae Rd
guuuucaauuuuaaaauuugu

SEQ ID NO: 683589 - RNA, 14 nt, Haemophilus influenzae Rd
guuuuccaaaaacc

SEQ ID NO: 683590 - RNA, 20 nt, Haemophilus influenzae Rd
guuuuauacaguuagaacaa

SEQ ID NO: 683591 - RNA, 14 nt, Haemophilus influenzae Rd
guuuuauauucauu

SEQ ID NO: 683592 - RNA, 14 nt, Haemophilus influenzae Rd
guuuuaucagaaug

SEQ ID NO: 683593 - RNA, 21 nt, Haemophilus influenzae Rd
guuuuaucagaaugauuaucu

SEQ ID NO: 683594 - RNA, 19 nt, Haemophilus influenzae Rd
guuuuacugauucuucgcc

SEQ ID NO: 683595 - RNA, 13 nt, Haemophilus influenzae Rd
guuuuaugcuaaa

SEQ ID NO: 683596 - RNA, 21 nt, Haemophilus influenzae Rd
guuuuauuagcgaaaauuuug

SEQ ID NO: 683597 - RNA, 17 nt, Haemophilus influenzae Rd
guuuuaaaucuucuauc

SEQ ID NO: 683598 - RNA, 23 nt, Haemophilus influenzae Rd
guuuuaaaaucucucaaaaauca

SEQ ID NO: 683599 - RNA, 11 nt, Haemophilus influenzae Rd
guuuuaaaauu

SEQ ID NO: 683600 - RNA, 12 nt, Haemophilus influenzae Rd
guuuuaaaccac

SEQ ID NO: 683601 - RNA, 10 nt, Haemophilus influenzae Rd
guuuuaaccg

SEQ ID NO: 683602 - RNA, 20 nt, Haemophilus influenzae Rd
guuuuaagucuaguaacugu

SEQ ID NO: 683603 - RNA, 21 nt, Haemophilus influenzae Rd
guuuuacaccaacggcauuuc

SEQ ID NO: 683604 - RNA, 12 nt, Haemophilus influenzae Rd
guuuuaauuuug

SEQ ID NO: 683605 - RNA, 17 nt, Haemophilus influenzae Rd
guuuuaccuucaguuuu

SEQ ID NO: 683606 - RNA, 21 nt, Haemophilus influenzae Rd
guuuuaccuucaguuuucauu

SEQ ID NO: 683607 - RNA, 21 nt, Haemophilus influenzae Rd
guuuuacgcuguucuucuaau

SEQ ID NO: 683608 - RNA, 17 nt, Haemophilus influenzae Rd
guuuucugaacuaaaau

SEQ ID NO: 683609 - RNA, 20 nt, Haemophilus influenzae Rd
guuuucugauuuaaaaccgu

SEQ ID NO: 683610 - RNA, 19 nt, Haemophilus influenzae Rd
guuuucugguacaaauuua

SEQ ID NO: 683611 - RNA, 22 nt, Haemophilus influenzae Rd
guuuucuuuugcccuuaaccau

SEQ ID NO: 683612 - RNA, 19 nt, Haemophilus influenzae Rd
guuuucuugccaaaauuca

SEQ ID NO: 683613 - RNA, 20 nt, Haemophilus influenzae Rd
guuuugaaguuaucaauaaa

SEQ ID NO: 683614 - RNA, 14 nt, Haemophilus influenzae Rd
guuuugcaaaccaa

SEQ ID NO: 683615 - RNA, 24 nt, Haemophilus influenzae Rd
guuuugcaauaaaguugagaauuu

SEQ ID NO: 683616 - RNA, 15 nt, Haemophilus influenzae Rd
guuuugggauaaucu

SEQ ID NO: 683617 - RNA, 13 nt, Haemophilus influenzae Rd
guuuuguauaagg

SEQ ID NO: 683618 - RNA, 21 nt, Haemophilus influenzae Rd
guuuugcgccuucaagccuug

SEQ ID NO: 683619 - RNA, 13 nt, Haemophilus influenzae Rd
guuuugcaccacg

SEQ ID NO: 683620 - RNA, 19 nt, Haemophilus influenzae Rd
guuuugccaauacuuagcg

SEQ ID NO: 683621 - RNA, 15 nt, Haemophilus influenzae Rd
guuuuguucauccuu

SEQ ID NO: 683622 - RNA, 16 nt, Haemophilus influenzae Rd
guuuuguucaucuaac

SEQ ID NO: 683623 - RNA, 18 nt, Haemophilus influenzae Rd
guuuuguucaucuaacac

SEQ ID NO: 683624 - RNA, 20 nt, Haemophilus influenzae Rd
guuuuguucaucuaacacaa

SEQ ID NO: 683625 - RNA, 22 nt, Haemophilus influenzae Rd
guuuuucacgauauugcacaau

SEQ ID NO: 683626 - RNA, 21 nt, Haemophilus influenzae Rd
guuuuucgcugcagcugcugc

SEQ ID NO: 683627 - RNA, 15 nt, Haemophilus influenzae Rd
guuuuugguaauuua

SEQ ID NO: 683628 - RNA, 18 nt, Haemophilus influenzae Rd
guuuuugccaaaauucug

SEQ ID NO: 683629 - RNA, 12 nt, Haemophilus influenzae Rd
uaaaaaaaagcg

SEQ ID NO: 683630 - RNA, 18 nt, Haemophilus influenzae Rd
uaaaaaaacguuaaauuu

SEQ ID NO: 683631 - RNA, 20 nt, Haemophilus influenzae Rd
uaaaaaaacguuaaauuuag

SEQ ID NO: 683632 - RNA, 12 nt, Haemophilus influenzae Rd
uaaaaaaacuaa

SEQ ID NO: 683633 - RNA, 20 nt, Haemophilus influenzae Rd
uaaaaaaauccuaaauaaag

SEQ ID NO: 683634 - RNA, 13 nt, Haemophilus influenzae Rd
uaaaaaaagcaau

SEQ ID NO: 683635 - RNA, 14 nt, Haemophilus influenzae Rd
uaaaaaaagcaaua

SEQ ID NO: 683636 - RNA, 17 nt, Haemophilus influenzae Rd
guuuuuuuauaaaccaa

SEQ ID NO: 683637 - RNA, 22 nt, Haemophilus influenzae Rd
guuuuuuauuuuguguauuaag

SEQ ID NO: 683638 - RNA, 16 nt, Haemophilus influenzae Rd
guuuuuuaauaaaauc

SEQ ID NO: 683639 - RNA, 12 nt, Haemophilus influenzae Rd
guuuuuuaggcu

SEQ ID NO: 683640 - RNA, 19 nt, Haemophilus influenzae Rd
guuuuuuaggcuuaucuac

SEQ ID NO: 683641 - RNA, 18 nt, Haemophilus influenzae Rd
guuuuuuauaaacuucug

SEQ ID NO: 683642 - RNA, 15 nt, Haemophilus influenzae Rd
uaaaaaauaguuaau

SEQ ID NO: 683643 - RNA, 16 nt, Haemophilus influenzae Rd
uaaaaaauaguuaaua

SEQ ID NO: 683644 - RNA, 20 nt, Haemophilus influenzae Rd
uaaaaaagugcgguaaauuu

SEQ ID NO: 683645 - RNA, 13 nt, Haemophilus influenzae Rd
uaaaaaaguuuaa

SEQ ID NO: 683646 - RNA, 14 nt, Haemophilus influenzae Rd
uaaaaaauaaauua

SEQ ID NO: 683647 - RNA, 13 nt, Haemophilus influenzae Rd
uaaaaaauaacaa

SEQ ID NO: 683648 - RNA, 13 nt, Haemophilus influenzae Rd
uaaaaaaucucca

SEQ ID NO: 683649 - RNA, 23 nt, Haemophilus influenzae Rd
uaaaaaaugauuaaguuaaaagu

SEQ ID NO: 683650 - RNA, 23 nt, Haemophilus influenzae Rd
uaaaaaaugcgcugauuuuucac

SEQ ID NO: 683651 - RNA, 11 nt, Haemophilus influenzae Rd
uaaaaaaugcu

SEQ ID NO: 683652 - RNA, 12 nt, Haemophilus influenzae Rd
uaaaaaaucaau

SEQ ID NO: 683653 - RNA, 12 nt, Haemophilus influenzae Rd
uaaaaaaucuaa

SEQ ID NO: 683654 - RNA, 12 nt, Haemophilus influenzae Rd
uaaaaaaucuag

SEQ ID NO: 683655 - RNA, 12 nt, Haemophilus influenzae Rd
uaaaaaaucuau

SEQ ID NO: 683656 - RNA, 14 nt, Haemophilus influenzae Rd
uaaaaaaucuaucc

SEQ ID NO: 683657 - RNA, 11 nt, Haemophilus influenzae Rd
uaaaaaagaaa

SEQ ID NO: 683658 - RNA, 13 nt, Haemophilus influenzae Rd
uaaaaaagaaaua

SEQ ID NO: 683659 - RNA, 13 nt, Haemophilus influenzae Rd
uaaaaaagcaaaa

SEQ ID NO: 683660 - RNA, 24 nt, Haemophilus influenzae Rd
uaaaaaacccgcuuuuaacaaaua

SEQ ID NO: 683661 - RNA, 21 nt, Haemophilus influenzae Rd
uaaaaaacccguaauuaaaaa

SEQ ID NO: 683662 - RNA, 17 nt, Haemophilus influenzae Rd
uaaaaaaccgagucuua

SEQ ID NO: 683663 - RNA, 22 nt, Haemophilus influenzae Rd
uaaaaaaccuugggauauucca

SEQ ID NO: 683664 - RNA, 20 nt, Haemophilus influenzae Rd
uaaaaaucaucguauuaaaa

SEQ ID NO: 683665 - RNA, 17 nt, Haemophilus influenzae Rd
uaaaaaucauuaaauaa

SEQ ID NO: 683666 - RNA, 16 nt, Haemophilus influenzae Rd
uaaaaauaucguaaaa

SEQ ID NO: 683667 - RNA, 19 nt, Haemophilus influenzae Rd
uaaaaauaucguaaaaaau

SEQ ID NO: 683668 - RNA, 12 nt, Haemophilus influenzae Rd
uaaaaauauuau

SEQ ID NO: 683669 - RNA, 18 nt, Haemophilus influenzae Rd
uaaaaaucaaagagaagc

SEQ ID NO: 683670 - RNA, 23 nt, Haemophilus influenzae Rd
uaaaaaucguacaucgaaaacau

SEQ ID NO: 683671 - RNA, 20 nt, Haemophilus influenzae Rd
uaaaacagaaguugaaaaua

SEQ ID NO: 683672 - RNA, 21 nt, Haemophilus influenzae Rd
uaaaacacaucgcuugcauuu

SEQ ID NO: 683673 - RNA, 20 nt, Haemophilus influenzae Rd
uaaaacagagaaaaaaauag

SEQ ID NO: 683674 - RNA, 20 nt, Haemophilus influenzae Rd
uaaaacagagcgucaaaauu

SEQ ID NO: 683675 - RNA, 17 nt, Haemophilus influenzae Rd
uaaaaacauaguaaauu

SEQ ID NO: 683676 - RNA, 17 nt, Haemophilus influenzae Rd
uaaaaacaaauauauuu

SEQ ID NO: 683677 - RNA, 20 nt, Haemophilus influenzae Rd
uaaaacaccgucuaaauuga

SEQ ID NO: 683678 - RNA, 20 nt, Haemophilus influenzae Rd
uaaaacagcaggaauauuag

SEQ ID NO: 683679 - RNA, 22 nt, Haemophilus influenzae Rd
uaaaacagcaggaauauuagga

SEQ ID NO: 683680 - RNA, 23 nt, Haemophilus influenzae Rd
uaaaacaguuaucgccaauaaua

SEQ ID NO: 683681 - RNA, 23 nt, Haemophilus influenzae Rd
uaaaacacguuugccagaaagca

SEQ ID NO: 683682 - RNA, 20 nt, Haemophilus influenzae Rd
uaaaaccuucuggguaaaau

SEQ ID NO: 683683 - RNA, 13 nt, Haemophilus influenzae Rd
uaaaacuuuauuu

SEQ ID NO: 683684 - RNA, 17 nt, Haemophilus influenzae Rd
uaaaacuuuauuuuauu

SEQ ID NO: 683685 - RNA, 18 nt, Haemophilus influenzae Rd
uaaaacuugcgacuuggu

SEQ ID NO: 683686 - RNA, 12 nt, Haemophilus influenzae Rd
uaaaacuuccua

SEQ ID NO: 683687 - RNA, 21 nt, Haemophilus influenzae Rd
uaaaacugugcccgcagcaau

SEQ ID NO: 683688 - RNA, 22 nt, Haemophilus influenzae Rd
uaaaacugugcccgcagcaauu

SEQ ID NO: 683689 - RNA, 22 nt, Haemophilus influenzae Rd
uaaaacuuacccaguaaaacuu

SEQ ID NO: 683690 - RNA, 19 nt, Haemophilus influenzae Rd
uaaaacgaacaauuucuuu

SEQ ID NO: 683691 - RNA, 22 nt, Haemophilus influenzae Rd
uaaaagaaagggcaucaaugau

SEQ ID NO: 683692 - RNA, 24 nt, Haemophilus influenzae Rd
uaaaagcaaggcgaaucgaaagau

SEQ ID NO: 683693 - RNA, 16 nt, Haemophilus influenzae Rd
uaaaagcauuacaaag

SEQ ID NO: 683694 - RNA, 17 nt, Haemophilus influenzae Rd
uaaaagcaccgcauugu

SEQ ID NO: 683695 - RNA, 14 nt, Haemophilus influenzae Rd
uaaaagcaccuaaa

SEQ ID NO: 683696 - RNA, 19 nt, Haemophilus influenzae Rd
uaaaaguuugacuauucua

SEQ ID NO: 683697 - RNA, 15 nt, Haemophilus influenzae Rd
uaaaaguuugauuaa

SEQ ID NO: 683698 - RNA, 14 nt, Haemophilus influenzae Rd
uaaaaguuuuccga

SEQ ID NO: 683699 - RNA, 20 nt, Haemophilus influenzae Rd
uaaaaguuuuccgacaacac

SEQ ID NO: 683700 - RNA, 16 nt, Haemophilus influenzae Rd
uaaaaguuguuuugcu

SEQ ID NO: 683701 - RNA, 19 nt, Haemophilus influenzae Rd
uaaaaguuuacuauuaaag

SEQ ID NO: 683702 - RNA, 14 nt, Haemophilus influenzae Rd
uaaaaguuggcuua

SEQ ID NO: 683703 - RNA, 16 nt, Haemophilus influenzae Rd
uaaaaguguauaaaua

SEQ ID NO: 683704 - RNA, 20 nt, Haemophilus influenzae Rd
uaaaaguaaaaauaaaaaca

SEQ ID NO: 683705 - RNA, 18 nt, Haemophilus influenzae Rd
uaaaaguaaauaagccau

SEQ ID NO: 683706 - RNA, 14 nt, Haemophilus influenzae Rd
uaaaaguaagcaau

SEQ ID NO: 683707 - RNA, 15 nt, Haemophilus influenzae Rd
uaaaaguaagcaauu

SEQ ID NO: 683708 - RNA, 18 nt, Haemophilus influenzae Rd
uaaaaguagcacuuucca

SEQ ID NO: 683709 - RNA, 20 nt, Haemophilus influenzae Rd
uaaaaguagcacuuuccauc

SEQ ID NO: 683710 - RNA, 16 nt, Haemophilus influenzae Rd
uaaaagugcggcuuca

SEQ ID NO: 683711 - RNA, 18 nt, Haemophilus influenzae Rd
uaaaagugcgguaaaaaa

SEQ ID NO: 683712 - RNA, 18 nt, Haemophilus influenzae Rd
uaaaagugcgguaaauuu

SEQ ID NO: 683713 - RNA, 22 nt, Haemophilus influenzae Rd
uaaaagugcgguaaauuuuuaa

SEQ ID NO: 683714 - RNA, 20 nt, Haemophilus influenzae Rd
uaaaagugcgguugauuuuc

SEQ ID NO: 683715 - RNA, 17 nt, Haemophilus influenzae Rd
uaaaaguaucuugcuuu

SEQ ID NO: 683716 - RNA, 17 nt, Haemophilus influenzae Rd
uaaaaucacauaaaaaa

SEQ ID NO: 683717 - RNA, 14 nt, Haemophilus influenzae Rd
uaaaaucaauaaua

SEQ ID NO: 683718 - RNA, 15 nt, Haemophilus influenzae Rd
uaaaaucaauaauau

SEQ ID NO: 683719 - RNA, 22 nt, Haemophilus influenzae Rd
uaaaaucaaccgcacuuuauuc

SEQ ID NO: 683720 - RNA, 23 nt, Haemophilus influenzae Rd
uaaaaucaaccgcacuuuauuca

SEQ ID NO: 683721 - RNA, 22 nt, Haemophilus influenzae Rd
uaaaauauuuggcugauauauu

SEQ ID NO: 683722 - RNA, 14 nt, Haemophilus influenzae Rd
uaaaauauuuuccc

SEQ ID NO: 683723 - RNA, 16 nt, Haemophilus influenzae Rd
uaaaauaguuuucaca

SEQ ID NO: 683724 - RNA, 18 nt, Haemophilus influenzae Rd
uaaaaucaaaauagcuuu

SEQ ID NO: 683725 - RNA, 16 nt, Haemophilus influenzae Rd
uaaaaucucucaaaaa

SEQ ID NO: 683726 - RNA, 16 nt, Haemophilus influenzae Rd
uaaaaucagcccuuau

SEQ ID NO: 683727 - RNA, 16 nt, Haemophilus influenzae Rd
uaaaauacgaauaaac

SEQ ID NO: 683728 - RNA, 17 nt, Haemophilus influenzae Rd
uaaaauagccuaaauau

SEQ ID NO: 683729 - RNA, 19 nt, Haemophilus influenzae Rd
uaaaauagagcaaauauaa

SEQ ID NO: 683730 - RNA, 21 nt, Haemophilus influenzae Rd
uaaaauagagcaaauauaaau

SEQ ID NO: 683731 - RNA, 24 nt, Haemophilus influenzae Rd
uaaaauagugacaguaauguaaua

SEQ ID NO: 683732 - RNA, 13 nt, Haemophilus influenzae Rd
uaaaauaaaaaau

SEQ ID NO: 683733 - RNA, 12 nt, Haemophilus influenzae Rd
uaaaauaaaaag

SEQ ID NO: 683734 - RNA, 17 nt, Haemophilus influenzae Rd
uaaaauaaaagaauuuu

SEQ ID NO: 683735 - RNA, 23 nt, Haemophilus influenzae Rd
uaaaauaaaagaauuuuuaaccg

SEQ ID NO: 683736 - RNA, 12 nt, Haemophilus influenzae Rd
uaaaauaaaauu

SEQ ID NO: 683737 - RNA, 18 nt, Haemophilus influenzae Rd
uaaaauacaaauacauuu

SEQ ID NO: 683738 - RNA, 13 nt, Haemophilus influenzae Rd
uaaccguuuuuau

SEQ ID NO: 683739 - RNA, 14 nt, Haemophilus influenzae Rd
uaaccguuuuuauu

SEQ ID NO: 683740 - RNA, 18 nt, Haemophilus influenzae Rd
uaaccguuuuuauuuguu

SEQ ID NO: 683741 - RNA, 18 nt, Haemophilus influenzae Rd
uaaccgugcucaauuucu

SEQ ID NO: 683742 - RNA, 15 nt, Haemophilus influenzae Rd
uaaccucgaaucaca

SEQ ID NO: 683743 - RNA, 22 nt, Haemophilus influenzae Rd
uaaccuaaaauagagcaaauau

SEQ ID NO: 683744 - RNA, 22 nt, Haemophilus influenzae Rd
uaaccuagaacaaaaggcuuuu

SEQ ID NO: 683745 - RNA, 15 nt, Haemophilus influenzae Rd
uaaccuauaauagcu

SEQ ID NO: 683746 - RNA, 18 nt, Haemophilus influenzae Rd
uaaccgcacuuuagaaaa

SEQ ID NO: 683747 - RNA, 21 nt, Haemophilus influenzae Rd
uaaccgcacuuuagaaaauau

SEQ ID NO: 683748 - RNA, 18 nt, Haemophilus influenzae Rd
uaaccgcacuuuuuaaua

SEQ ID NO: 683749 - RNA, 19 nt, Haemophilus influenzae Rd
uaacgauguugcaaccuuc

SEQ ID NO: 683750 - RNA, 21 nt, Haemophilus influenzae Rd
uaacgauguugcaaccuucag

SEQ ID NO: 683751 - RNA, 12 nt, Haemophilus influenzae Rd
uaacgcucaaaa

SEQ ID NO: 683752 - RNA, 20 nt, Haemophilus influenzae Rd
uaacgcucaaaaauuucaga

SEQ ID NO: 683753 - RNA, 12 nt, Haemophilus influenzae Rd
uaaccaucccuu

SEQ ID NO: 683754 - RNA, 23 nt, Haemophilus influenzae Rd
uaaccaucccuuuuuacauuauu

SEQ ID NO: 683755 - RNA, 21 nt, Haemophilus influenzae Rd
uaaccaucccagucaaaaaug

SEQ ID NO: 683756 - RNA, 22 nt, Haemophilus influenzae Rd
uaaccaucccagucaaaaaugu

SEQ ID NO: 683757 - RNA, 14 nt, Haemophilus influenzae Rd
uaaccauaaaaaau

SEQ ID NO: 683758 - RNA, 19 nt, Haemophilus influenzae Rd
uaacccgccuuuguuuuau

SEQ ID NO: 683759 - RNA, 14 nt, Haemophilus influenzae Rd
uaaccauucccauu

SEQ ID NO: 683760 - RNA, 14 nt, Haemophilus influenzae Rd
uaaccccuuuucug

SEQ ID NO: 683761 - RNA, 21 nt, Haemophilus influenzae Rd
uaacccuuacuuuauacuaaa

SEQ ID NO: 683762 - RNA, 21 nt, Haemophilus influenzae Rd
uaacauuuaacaauggcaaca

SEQ ID NO: 683763 - RNA, 16 nt, Haemophilus influenzae Rd
uaacauuguuuuaaug

SEQ ID NO: 683764 - RNA, 17 nt, Haemophilus influenzae Rd
uaacauuguuuuaaugu

SEQ ID NO: 683765 - RNA, 18 nt, Haemophilus influenzae Rd
uaacauuccguuuuuaau

SEQ ID NO: 683766 - RNA, 13 nt, Haemophilus influenzae Rd
uaacauuaauaaa

SEQ ID NO: 683767 - RNA, 16 nt, Haemophilus influenzae Rd
uaacauuaauaaacca

SEQ ID NO: 683768 - RNA, 19 nt, Haemophilus influenzae Rd
uaacauuacacgagcaaug

SEQ ID NO: 683769 - RNA, 19 nt, Haemophilus influenzae Rd
uaacaucuuaguauuuuau

SEQ ID NO: 683770 - RNA, 16 nt, Haemophilus influenzae Rd
uaacagcaaacuuaaa

SEQ ID NO: 683771 - RNA, 15 nt, Haemophilus influenzae Rd
uaacagauggaucua

SEQ ID NO: 683772 - RNA, 17 nt, Haemophilus influenzae Rd
uaacaccauugagcauu

SEQ ID NO: 683773 - RNA, 17 nt, Haemophilus influenzae Rd
uaacaauguagaaaugg

SEQ ID NO: 683774 - RNA, 15 nt, Haemophilus influenzae Rd
uaacaaugaaauuau

SEQ ID NO: 683775 - RNA, 13 nt, Haemophilus influenzae Rd
uaacaaauucacu

SEQ ID NO: 683776 - RNA, 15 nt, Haemophilus influenzae Rd
uaacaaugauuaaac

SEQ ID NO: 683777 - RNA, 19 nt, Haemophilus influenzae Rd
uaacaaauaggauaaaaau

SEQ ID NO: 683778 - RNA, 20 nt, Haemophilus influenzae Rd
uaacaaagccugcuacauuu

SEQ ID NO: 683779 - RNA, 17 nt, Haemophilus influenzae Rd
uaacaaaauuaaugcca

SEQ ID NO: 683780 - RNA, 16 nt, Haemophilus influenzae Rd
uaacacagaugaaaau

SEQ ID NO: 683781 - RNA, 17 nt, Haemophilus influenzae Rd
uaacaccaaacagagug

SEQ ID NO: 683782 - RNA, 18 nt, Haemophilus influenzae Rd
uaacacaucagaaaauca

SEQ ID NO: 683783 - RNA, 20 nt, Haemophilus influenzae Rd
uaacacaucagaaaaucaaa

SEQ ID NO: 683784 - RNA, 22 nt, Haemophilus influenzae Rd
uaacacaucagaaaaucaaaaa

SEQ ID NO: 683785 - RNA, 14 nt, Haemophilus influenzae Rd
uaacaaauaauuau

SEQ ID NO: 683786 - RNA, 13 nt, Haemophilus influenzae Rd
uaacacaccaaca

SEQ ID NO: 683787 - RNA, 12 nt, Haemophilus influenzae Rd
uaacacagaaac

SEQ ID NO: 683788 - RNA, 15 nt, Haemophilus influenzae Rd
uaacacagaaaccaa

SEQ ID NO: 683789 - RNA, 23 nt, Haemophilus influenzae Rd
uaaauuucagcuuaaauacuaau

SEQ ID NO: 683790 - RNA, 23 nt, Haemophilus influenzae Rd
uaaauuuccucagguucaaacau

SEQ ID NO: 683791 - RNA, 13 nt, Haemophilus influenzae Rd
uaaauuucuacua

SEQ ID NO: 683792 - RNA, 20 nt, Haemophilus influenzae Rd
uaaauuuaguggcuaaauua

SEQ ID NO: 683793 - RNA, 22 nt, Haemophilus influenzae Rd
uaaauuuaugaucuucaaucau

SEQ ID NO: 683794 - RNA, 22 nt, Haemophilus influenzae Rd
uaaauuuauuuuuuaaaacuua

SEQ ID NO: 683795 - RNA, 13 nt, Haemophilus influenzae Rd
uaaauuucaauua

SEQ ID NO: 683796 - RNA, 15 nt, Haemophilus influenzae Rd
uaaauuucaauuaaa

SEQ ID NO: 683797 - RNA, 20 nt, Haemophilus influenzae Rd
uaaauuucaauuaaaucaaa

SEQ ID NO: 683798 - RNA, 19 nt, Haemophilus influenzae Rd
uaaauuuuauuauguuuug

SEQ ID NO: 683799 - RNA, 19 nt, Haemophilus influenzae Rd
uaaauuuuauuccaccaca

SEQ ID NO: 683800 - RNA, 20 nt, Haemophilus influenzae Rd
uaaauuuuauuccaccacag

SEQ ID NO: 683801 - RNA, 23 nt, Haemophilus influenzae Rd
uaaauuuuauuccaccacagccc

SEQ ID NO: 683802 - RNA, 18 nt, Haemophilus influenzae Rd
uaaauuuucaaauugaaa

SEQ ID NO: 683803 - RNA, 15 nt, Haemophilus influenzae Rd
uaaauuuuaaaaaau

SEQ ID NO: 683804 - RNA, 13 nt, Haemophilus influenzae Rd
uaaauuuuaaaau

SEQ ID NO: 683805 - RNA, 16 nt, Haemophilus influenzae Rd
uaaauuuuaaaauagu

SEQ ID NO: 683806 - RNA, 14 nt, Haemophilus influenzae Rd
uaaauuugguucaa

SEQ ID NO: 683807 - RNA, 17 nt, Haemophilus influenzae Rd
uaaauuugguucaauuu

SEQ ID NO: 683808 - RNA, 15 nt, Haemophilus influenzae Rd
uaaauuuugcuuuaa

SEQ ID NO: 683809 - RNA, 23 nt, Haemophilus influenzae Rd
uaacaaaauggcuuuuuugccuu

SEQ ID NO: 683810 - RNA, 14 nt, Haemophilus influenzae Rd
uaaauugaucuguu

SEQ ID NO: 683811 - RNA, 17 nt, Haemophilus influenzae Rd
uaaauugagaucaaaaa

SEQ ID NO: 683812 - RNA, 20 nt, Haemophilus influenzae Rd
uaaauugagaucaaaaauca

SEQ ID NO: 683813 - RNA, 18 nt, Haemophilus influenzae Rd
uaaauugaacugaauuaa

SEQ ID NO: 683814 - RNA, 15 nt, Haemophilus influenzae Rd
uaaauucuuuugcca

SEQ ID NO: 683815 - RNA, 13 nt, Haemophilus influenzae Rd
uaaauugaaaaaa

SEQ ID NO: 683816 - RNA, 15 nt, Haemophilus influenzae Rd
uaaauugaaaaaaua

SEQ ID NO: 683817 - RNA, 16 nt, Haemophilus influenzae Rd
uaaauugacggcuuca

SEQ ID NO: 683818 - RNA, 13 nt, Haemophilus influenzae Rd
uaaauucuucaag

SEQ ID NO: 683819 - RNA, 17 nt, Haemophilus influenzae Rd
uaaauucggaauauuca

SEQ ID NO: 683820 - RNA, 20 nt, Haemophilus influenzae Rd
uaaauucguacaaaugaaaa

SEQ ID NO: 683821 - RNA, 16 nt, Haemophilus influenzae Rd
uaaauuccuuuuuaau

SEQ ID NO: 683822 - RNA, 21 nt, Haemophilus influenzae Rd
uaaauucuccccgaugauuuu

SEQ ID NO: 683823 - RNA, 18 nt, Haemophilus influenzae Rd
uaaauucucgccauaaua

SEQ ID NO: 683824 - RNA, 19 nt, Haemophilus influenzae Rd
uaaauucuguuuagucuuc

SEQ ID NO: 683825 - RNA, 16 nt, Haemophilus influenzae Rd
uaaauucuuaccaaaa

SEQ ID NO: 683826 - RNA, 19 nt, Haemophilus influenzae Rd
uaaauucuacgucaaagcc

SEQ ID NO: 683827 - RNA, 19 nt, Haemophilus influenzae Rd
uaaauucuauaucuguaau

SEQ ID NO: 683828 - RNA, 21 nt, Haemophilus influenzae Rd
uaaauuuaccgcacuuuucuu

SEQ ID NO: 683829 - RNA, 14 nt, Haemophilus influenzae Rd
uaaauuuaaauuau

SEQ ID NO: 683830 - RNA, 21 nt, Haemophilus influenzae Rd
uaaauuuaaccacuaaaaaag

SEQ ID NO: 683831 - RNA, 21 nt, Haemophilus influenzae Rd
uaaauugcuucgugugcaccc

SEQ ID NO: 683832 - RNA, 21 nt, Haemophilus influenzae Rd
uaaauuggcauuuucaagccc

SEQ ID NO: 683833 - RNA, 21 nt, Haemophilus influenzae Rd
uaaauuggggaaguaauauuu

SEQ ID NO: 683834 - RNA, 14 nt, Haemophilus influenzae Rd
uaaauugguuuuau

SEQ ID NO: 683835 - RNA, 18 nt, Haemophilus influenzae Rd
uaaauuguugcucugaau

SEQ ID NO: 683836 - RNA, 13 nt, Haemophilus influenzae Rd
uaaauuaauuacu

SEQ ID NO: 683837 - RNA, 19 nt, Haemophilus influenzae Rd
uaaauuacauucccaaaua

SEQ ID NO: 683838 - RNA, 20 nt, Haemophilus influenzae Rd
uaaauuacauucccaaauaa

SEQ ID NO: 683839 - RNA, 19 nt, Haemophilus influenzae Rd
uaaauuaaggacuaaacuu

SEQ ID NO: 683840 - RNA, 19 nt, Haemophilus influenzae Rd
uaaauuauagauaaauauc

SEQ ID NO: 683841 - RNA, 21 nt, Haemophilus influenzae Rd
uaaauuauagauaaauaucaa

SEQ ID NO: 683842 - RNA, 23 nt, Haemophilus influenzae Rd
uaaauuauagauaaauaucaaaa

SEQ ID NO: 683843 - RNA, 16 nt, Haemophilus influenzae Rd
uaaauuaguuuaaaga

SEQ ID NO: 683844 - RNA, 18 nt, Haemophilus influenzae Rd
uaaauuagcguaaacauu

SEQ ID NO: 683845 - RNA, 13 nt, Haemophilus influenzae Rd
uaaauuaggcauu

SEQ ID NO: 683846 - RNA, 20 nt, Haemophilus influenzae Rd
uaaauuaggcauuugaagau

SEQ ID NO: 683847 - RNA, 18 nt, Haemophilus influenzae Rd
uaaauuacgaccuuuacu

SEQ ID NO: 683848 - RNA, 15 nt, Haemophilus influenzae Rd
uaaauuauuuuaaua

SEQ ID NO: 683849 - RNA, 21 nt, Haemophilus influenzae Rd
uaaauuauuuuuuauccuauu

SEQ ID NO: 683850 - RNA, 13 nt, Haemophilus influenzae Rd
uaaauuauauuuu

SEQ ID NO: 683851 - RNA, 22 nt, Haemophilus influenzae Rd
uaaauuaucguuuacuuaaaau

SEQ ID NO: 683852 - RNA, 19 nt, Haemophilus influenzae Rd
uaaauuaugcccaauuacc

SEQ ID NO: 683853 - RNA, 22 nt, Haemophilus influenzae Rd
uaaauuauggguguuuaaauuu

SEQ ID NO: 683854 - RNA, 20 nt, Haemophilus influenzae Rd
uaaauuauuugauuuuuaua

SEQ ID NO: 683855 - RNA, 15 nt, Haemophilus influenzae Rd
uaaauucaccaauuc

SEQ ID NO: 683856 - RNA, 14 nt, Haemophilus influenzae Rd
uaaauucacugugu

SEQ ID NO: 683857 - RNA, 20 nt, Haemophilus influenzae Rd
uaaauucaguaagaaaccaa

SEQ ID NO: 683858 - RNA, 18 nt, Haemophilus influenzae Rd
uaaauucaguuaagaaaa

SEQ ID NO: 683859 - RNA, 21 nt, Haemophilus influenzae Rd
uaaauucaguuaagaaaauaa

SEQ ID NO: 683860 - RNA, 15 nt, Haemophilus influenzae Rd
uaaauucauuuaaaa

SEQ ID NO: 683861 - RNA, 16 nt, Haemophilus influenzae Rd
uaaauaaaauauuugg

SEQ ID NO: 683862 - RNA, 21 nt, Haemophilus influenzae Rd
uaaauaaaccgcaucaaaauu

SEQ ID NO: 683863 - RNA, 21 nt, Haemophilus influenzae Rd
uaaauaaacgagauaagcauu

SEQ ID NO: 683864 - RNA, 17 nt, Haemophilus influenzae Rd
uaaaguuuuugcaucca

SEQ ID NO: 683865 - RNA, 15 nt, Haemophilus influenzae Rd
uaaauaaaaaauaaa

SEQ ID NO: 683866 - RNA, 21 nt, Haemophilus influenzae Rd
uaaaguugagaauuuuuucuu

SEQ ID NO: 683867 - RNA, 14 nt, Haemophilus influenzae Rd
uaaaguuuuaaacc

SEQ ID NO: 683868 - RNA, 12 nt, Haemophilus influenzae Rd
uaaauaaaaaug

SEQ ID NO: 683869 - RNA, 13 nt, Haemophilus influenzae Rd
uaaauaaaaauga

SEQ ID NO: 683870 - RNA, 20 nt, Haemophilus influenzae Rd
uaaauaaaacgggaucuauu

SEQ ID NO: 683871 - RNA, 15 nt, Haemophilus influenzae Rd
uaaaguucucaaaaa

SEQ ID NO: 683872 - RNA, 18 nt, Haemophilus influenzae Rd
uaaaguuugcaauucgcc

SEQ ID NO: 683873 - RNA, 17 nt, Haemophilus influenzae Rd
uaaaguuucuguugauu

SEQ ID NO: 683874 - RNA, 12 nt, Haemophilus influenzae Rd
uaaaguuucuuu

SEQ ID NO: 683875 - RNA, 16 nt, Haemophilus influenzae Rd
uaaaguaaauuuuaaa

SEQ ID NO: 683876 - RNA, 15 nt, Haemophilus influenzae Rd
uaaaguaaaauauug

SEQ ID NO: 683877 - RNA, 21 nt, Haemophilus influenzae Rd
uaaaggugcaacgugugccag

SEQ ID NO: 683878 - RNA, 12 nt, Haemophilus influenzae Rd
uaaauaauuaaa

SEQ ID NO: 683879 - RNA, 15 nt, Haemophilus influenzae Rd
uaaauaauuaaaaau

SEQ ID NO: 683880 - RNA, 18 nt, Haemophilus influenzae Rd
uaaauaauuaaaaauaaa

SEQ ID NO: 683881 - RNA, 16 nt, Haemophilus influenzae Rd
uaaauaaagauuauuu

SEQ ID NO: 683882 - RNA, 13 nt, Haemophilus influenzae Rd
uaaauaaaucaau

SEQ ID NO: 683883 - RNA, 14 nt, Haemophilus influenzae Rd
uaaauaaaucaaua

SEQ ID NO: 683884 - RNA, 14 nt, Haemophilus influenzae Rd
uaaauaaauucauu

SEQ ID NO: 683885 - RNA, 19 nt, Haemophilus influenzae Rd
uaaauacuugcuuaugcaa

SEQ ID NO: 683886 - RNA, 15 nt, Haemophilus influenzae Rd
uaaauaauuuccuuu

SEQ ID NO: 683887 - RNA, 18 nt, Haemophilus influenzae Rd
uaaauagccgacaucuau

SEQ ID NO: 683888 - RNA, 16 nt, Haemophilus influenzae Rd
uaaauagcuaacaaua

SEQ ID NO: 683889 - RNA, 15 nt, Haemophilus influenzae Rd
uaaauauaucaagca

SEQ ID NO: 683890 - RNA, 16 nt, Haemophilus influenzae Rd
uaaauauaucaagcag

SEQ ID NO: 683891 - RNA, 20 nt, Haemophilus influenzae Rd
uaaauauauccauaaacauu

SEQ ID NO: 683892 - RNA, 15 nt, Haemophilus influenzae Rd
uaaauagaaauuacu

SEQ ID NO: 683893 - RNA, 15 nt, Haemophilus influenzae Rd
uaaauagagaaaucc

SEQ ID NO: 683894 - RNA, 20 nt, Haemophilus influenzae Rd
uaaauagauaaucagcccaa

SEQ ID NO: 683895 - RNA, 20 nt, Haemophilus influenzae Rd
uaaauagauacaagaaagaa

SEQ ID NO: 683896 - RNA, 20 nt, Haemophilus influenzae Rd
uaaaucuucuuuaccaacua

SEQ ID NO: 683897 - RNA, 21 nt, Haemophilus influenzae Rd
uaaaucuugcuuuugguuuuc

SEQ ID NO: 683898 - RNA, 20 nt, Haemophilus influenzae Rd
uaaaucugguggagaaaugu

SEQ ID NO: 683899 - RNA, 19 nt, Haemophilus influenzae Rd
uaaaucuauuccuuucuuu

SEQ ID NO: 683900 - RNA, 15 nt, Haemophilus influenzae Rd
uaaaucacuuaauuu

SEQ ID NO: 683901 - RNA, 15 nt, Haemophilus influenzae Rd
uaaaucaauguuuuc

SEQ ID NO: 683902 - RNA, 23 nt, Haemophilus influenzae Rd
uaaaucaauguuuucagcuucaa

SEQ ID NO: 683903 - RNA, 17 nt, Haemophilus influenzae Rd
uaaaucaccuaaaucuu

SEQ ID NO: 683904 - RNA, 16 nt, Haemophilus influenzae Rd
uaaaucaaaaauuaag

SEQ ID NO: 683905 - RNA, 21 nt, Haemophilus influenzae Rd
uaaaucaaaagaauuaaaaau

SEQ ID NO: 683906 - RNA, 16 nt, Haemophilus influenzae Rd
uaaauauuuucauuua

SEQ ID NO: 683907 - RNA, 21 nt, Haemophilus influenzae Rd
uaaauauguugaauaguaaag

SEQ ID NO: 683908 - RNA, 16 nt, Haemophilus influenzae Rd
uaaauauuuuuacaaa

SEQ ID NO: 683909 - RNA, 19 nt, Haemophilus influenzae Rd
uaaauggauuuaauccacu

SEQ ID NO: 683910 - RNA, 18 nt, Haemophilus influenzae Rd
uaaaugcgugaacugcuu

SEQ ID NO: 683911 - RNA, 20 nt, Haemophilus influenzae Rd
uaaaugcuaaaauuaaaggc

SEQ ID NO: 683912 - RNA, 16 nt, Haemophilus influenzae Rd
uaaaugcuguagaaau

SEQ ID NO: 683913 - RNA, 21 nt, Haemophilus influenzae Rd
uaaaugcuguagaaauuaaua

SEQ ID NO: 683914 - RNA, 17 nt, Haemophilus influenzae Rd
uaaauuaaaaagacuaa

SEQ ID NO: 683915 - RNA, 12 nt, Haemophilus influenzae Rd
uaaauggcuuua

SEQ ID NO: 683916 - RNA, 18 nt, Haemophilus influenzae Rd
uaaaugggcaaacauuuu

SEQ ID NO: 683917 - RNA, 17 nt, Haemophilus influenzae Rd
uaaaugcgcuuuuaauu

SEQ ID NO: 683918 - RNA, 20 nt, Haemophilus influenzae Rd
uaaaugacauauaauauuaa

SEQ ID NO: 683919 - RNA, 15 nt, Haemophilus influenzae Rd
uaaaucuuuacccau

SEQ ID NO: 683920 - RNA, 12 nt, Haemophilus influenzae Rd
uaaaucuuuauc

SEQ ID NO: 683921 - RNA, 13 nt, Haemophilus influenzae Rd
uaaaugaaguuuu

SEQ ID NO: 683922 - RNA, 14 nt, Haemophilus influenzae Rd
uaaaugaauaaaac

SEQ ID NO: 683923 - RNA, 11 nt, Haemophilus influenzae Rd
uaaaugaaaag

SEQ ID NO: 683924 - RNA, 18 nt, Haemophilus influenzae Rd
uaaaccgucauuuauaaa

SEQ ID NO: 683925 - RNA, 19 nt, Haemophilus influenzae Rd
uaaaccuaugauuauagau

SEQ ID NO: 683926 - RNA, 20 nt, Haemophilus influenzae Rd
uaaacgaaugaaguuagaaa

SEQ ID NO: 683927 - RNA, 15 nt, Haemophilus influenzae Rd
uaaaccuuauugcau

SEQ ID NO: 683928 - RNA, 14 nt, Haemophilus influenzae Rd
uaaacgaccuucau

SEQ ID NO: 683929 - RNA, 16 nt, Haemophilus influenzae Rd
uaaacgaucuauuccu

SEQ ID NO: 683930 - RNA, 19 nt, Haemophilus influenzae Rd
uaaacgugauuuaccaaua

SEQ ID NO: 683931 - RNA, 22 nt, Haemophilus influenzae Rd
uaaacggucauuuacaaacaua

SEQ ID NO: 683932 - RNA, 21 nt, Haemophilus influenzae Rd
uaaacgagaaccaaaacgcaa

SEQ ID NO: 683933 - RNA, 21 nt, Haemophilus influenzae Rd
uaaacgaugggcaauggcaau

SEQ ID NO: 683934 - RNA, 22 nt, Haemophilus influenzae Rd
uaaacgaugugcauugaauuuu

SEQ ID NO: 683935 - RNA, 13 nt, Haemophilus influenzae Rd
uaaacuaaaucuu

SEQ ID NO: 683936 - RNA, 17 nt, Haemophilus influenzae Rd
uaaacuaaaucuugcuu

SEQ ID NO: 683937 - RNA, 19 nt, Haemophilus influenzae Rd
uaaacgugugauaccaaga

SEQ ID NO: 683938 - RNA, 23 nt, Haemophilus influenzae Rd
uaaacguugagccaauuuucucg

SEQ ID NO: 683939 - RNA, 15 nt, Haemophilus influenzae Rd
uaaaccguuuagcaa

SEQ ID NO: 683940 - RNA, 17 nt, Haemophilus influenzae Rd
uaaaccagcaagauaag

SEQ ID NO: 683941 - RNA, 18 nt, Haemophilus influenzae Rd
uaaaccaccgauuaauaa

SEQ ID NO: 683942 - RNA, 22 nt, Haemophilus influenzae Rd
uaaaccaccguucuauauuuug

SEQ ID NO: 683943 - RNA, 16 nt, Haemophilus influenzae Rd
uaaaccaaauuucuug

SEQ ID NO: 683944 - RNA, 23 nt, Haemophilus influenzae Rd
uaaaaucauuauccaacauuaau

SEQ ID NO: 683945 - RNA, 13 nt, Haemophilus influenzae Rd
uaaacauuuugua

SEQ ID NO: 683946 - RNA, 14 nt, Haemophilus influenzae Rd
uaaacauuuuucau

SEQ ID NO: 683947 - RNA, 15 nt, Haemophilus influenzae Rd
uaaacauuuuucauu

SEQ ID NO: 683948 - RNA, 21 nt, Haemophilus influenzae Rd
uaaacauuuuucauuuucgca

SEQ ID NO: 683949 - RNA, 18 nt, Haemophilus influenzae Rd
uaaacuucuauguuugca

SEQ ID NO: 683950 - RNA, 22 nt, Haemophilus influenzae Rd
uaaacuuuauccccuacaguga

SEQ ID NO: 683951 - RNA, 16 nt, Haemophilus influenzae Rd
uaaacuuguuaaauaa

SEQ ID NO: 683952 - RNA, 21 nt, Haemophilus influenzae Rd
uaaacuuguuaaauaaacaca

SEQ ID NO: 683953 - RNA, 13 nt, Haemophilus influenzae Rd
uaaagaauauucu

SEQ ID NO: 683954 - RNA, 17 nt, Haemophilus influenzae Rd
uaaagaaucaaauucac

SEQ ID NO: 683955 - RNA, 14 nt, Haemophilus influenzae Rd
uaaacuuuuaaagu

SEQ ID NO: 683956 - RNA, 14 nt, Haemophilus influenzae Rd
uaaacuuucaauuu

SEQ ID NO: 683957 - RNA, 20 nt, Haemophilus influenzae Rd
uaaacuuucgauaguuaaau

SEQ ID NO: 683958 - RNA, 18 nt, Haemophilus influenzae Rd
uaaacuuuucgcaaaaua

SEQ ID NO: 683959 - RNA, 23 nt, Haemophilus influenzae Rd
uaaacuuuucgcaaaauaucacu

SEQ ID NO: 683960 - RNA, 15 nt, Haemophilus influenzae Rd
uaaagagaucacugu

SEQ ID NO: 683961 - RNA, 23 nt, Haemophilus influenzae Rd
uaaagagaucacuguaaauaaua

SEQ ID NO: 683962 - RNA, 15 nt, Haemophilus influenzae Rd
uaaagagaauauuuc

SEQ ID NO: 683963 - RNA, 19 nt, Haemophilus influenzae Rd
uaaagacguuugauuguaa

SEQ ID NO: 683964 - RNA, 11 nt, Haemophilus influenzae Rd
uaaagcccugu

SEQ ID NO: 683965 - RNA, 18 nt, Haemophilus influenzae Rd
uaaagcauaauauuccuu

SEQ ID NO: 683966 - RNA, 23 nt, Haemophilus influenzae Rd
uaaagcacccaucacauuuucaa

SEQ ID NO: 683967 - RNA, 16 nt, Haemophilus influenzae Rd
uaaagagcaaauuuaa

SEQ ID NO: 683968 - RNA, 17 nt, Haemophilus influenzae Rd
uaaagagcaaauuuaaa

SEQ ID NO: 683969 - RNA, 20 nt, Haemophilus influenzae Rd
uaaagagcaaauuuaaauaa

SEQ ID NO: 683970 - RNA, 16 nt, Haemophilus influenzae Rd
uaaagccuugauuauc

SEQ ID NO: 683971 - RNA, 19 nt, Haemophilus influenzae Rd
uaaagcgaucaucauuaaa

SEQ ID NO: 683972 - RNA, 13 nt, Haemophilus influenzae Rd
uauuacuaaaauu

SEQ ID NO: 683973 - RNA, 20 nt, Haemophilus influenzae Rd
uauuacgcuguccaauaauu

SEQ ID NO: 683974 - RNA, 14 nt, Haemophilus influenzae Rd
uauuaccuaaccaa

SEQ ID NO: 683975 - RNA, 20 nt, Haemophilus influenzae Rd
uauuaccuaguuugcuauau

SEQ ID NO: 683976 - RNA, 15 nt, Haemophilus influenzae Rd
uauuacccguuugaa

SEQ ID NO: 683977 - RNA, 22 nt, Haemophilus influenzae Rd
uauuacccuauucuaaauuuau

SEQ ID NO: 683978 - RNA, 14 nt, Haemophilus influenzae Rd
uauuacauuaaaau

SEQ ID NO: 683979 - RNA, 20 nt, Haemophilus influenzae Rd
uauuaauuugucgauaaaag

SEQ ID NO: 683980 - RNA, 16 nt, Haemophilus influenzae Rd
uauuaauuuuaucuug

SEQ ID NO: 683981 - RNA, 18 nt, Haemophilus influenzae Rd
uauuaauuauuuuagauu

SEQ ID NO: 683982 - RNA, 12 nt, Haemophilus influenzae Rd
uauuaauuuaau

SEQ ID NO: 683983 - RNA, 13 nt, Haemophilus influenzae Rd
uauuacaaacaaa

SEQ ID NO: 683984 - RNA, 16 nt, Haemophilus influenzae Rd
uauuacaaacaaaaag

SEQ ID NO: 683985 - RNA, 14 nt, Haemophilus influenzae Rd
uauuacaagauaau

SEQ ID NO: 683986 - RNA, 17 nt, Haemophilus influenzae Rd
uauuaaugcuguuuaaa

SEQ ID NO: 683987 - RNA, 13 nt, Haemophilus influenzae Rd
uauuaauuacuuu

SEQ ID NO: 683988 - RNA, 14 nt, Haemophilus influenzae Rd
uauuaauuauaaaa

SEQ ID NO: 683989 - RNA, 16 nt, Haemophilus influenzae Rd
uauuaauuauaaaaua

SEQ ID NO: 683990 - RNA, 23 nt, Haemophilus influenzae Rd
uauuaaaaauaaguucaucaacu

SEQ ID NO: 683991 - RNA, 16 nt, Haemophilus influenzae Rd
uauuaaagaaaauaca

SEQ ID NO: 683992 - RNA, 21 nt, Haemophilus influenzae Rd
uauuaaagaaaauacauaauu

SEQ ID NO: 683993 - RNA, 15 nt, Haemophilus influenzae Rd
uauuaaacaaaaacc

SEQ ID NO: 683994 - RNA, 14 nt, Haemophilus influenzae Rd
uauuaaauuuuuaa

SEQ ID NO: 683995 - RNA, 17 nt, Haemophilus influenzae Rd
uauuaaauuuuuaauuu

SEQ ID NO: 683996 - RNA, 22 nt, Haemophilus influenzae Rd
uauuaaauuuuuaauuuucucg

SEQ ID NO: 683997 - RNA, 18 nt, Haemophilus influenzae Rd
uauuaagcgugcuuugcu

SEQ ID NO: 683998 - RNA, 18 nt, Haemophilus influenzae Rd
uauuaagguaauauguaa

SEQ ID NO: 683999 - RNA, 19 nt, Haemophilus influenzae Rd
uauuaagguaauauguaau

SEQ ID NO: 684000 - RNA, 17 nt, Haemophilus influenzae Rd
uauuaaguaaauauuuu

SEQ ID NO: 684001 - RNA, 20 nt, Haemophilus influenzae Rd
uauuaaguaaauauuuuuua

SEQ ID NO: 684002 - RNA, 18 nt, Haemophilus influenzae Rd
uauuaagucuauuacuaa

SEQ ID NO: 684003 - RNA, 13 nt, Haemophilus influenzae Rd
uauuaauaaaaau

SEQ ID NO: 684004 - RNA, 15 nt, Haemophilus influenzae Rd
uauuaagauauaaaa

SEQ ID NO: 684005 - RNA, 17 nt, Haemophilus influenzae Rd
uauuaagauauaaaagu

SEQ ID NO: 684006 - RNA, 20 nt, Haemophilus influenzae Rd
uauuaucaacaguaaauuuu

SEQ ID NO: 684007 - RNA, 16 nt, Haemophilus influenzae Rd
uauuaucuaaaucucu

SEQ ID NO: 684008 - RNA, 20 nt, Haemophilus influenzae Rd
uauuaucuccaagaauauuu

SEQ ID NO: 684009 - RNA, 21 nt, Haemophilus influenzae Rd
uauuaucuucaugauuuucca

SEQ ID NO: 684010 - RNA, 13 nt, Haemophilus influenzae Rd
uauuaugaaauuu

SEQ ID NO: 684011 - RNA, 16 nt, Haemophilus influenzae Rd
uauuaugaaauuuguu

SEQ ID NO: 684012 - RNA, 15 nt, Haemophilus influenzae Rd
uauuauguucucuca

SEQ ID NO: 684013 - RNA, 13 nt, Haemophilus influenzae Rd
uauuauguuuugu

SEQ ID NO: 684014 - RNA, 11 nt, Haemophilus influenzae Rd
uauuauuaaaa

SEQ ID NO: 684015 - RNA, 20 nt, Haemophilus influenzae Rd
uauuauuaaguaauacauuu

SEQ ID NO: 684016 - RNA, 19 nt, Haemophilus influenzae Rd
uauuaugguuuugcuguaa

SEQ ID NO: 684017 - RNA, 21 nt, Haemophilus influenzae Rd
uauuaugcuaauaaucuauuu

SEQ ID NO: 684018 - RNA, 23 nt, Haemophilus influenzae Rd
uauuauuuaaauggaacuuguuu

SEQ ID NO: 684019 - RNA, 13 nt, Haemophilus influenzae Rd
uauuauaaaaaua

SEQ ID NO: 684020 - RNA, 16 nt, Haemophilus influenzae Rd
uauuaguuaguuuuuu

SEQ ID NO: 684021 - RNA, 18 nt, Haemophilus influenzae Rd
uauuacuucacuuuucca

SEQ ID NO: 684022 - RNA, 15 nt, Haemophilus influenzae Rd
uauuacuuaacauca

SEQ ID NO: 684023 - RNA, 15 nt, Haemophilus influenzae Rd
uauuacuuauaagau

SEQ ID NO: 684024 - RNA, 21 nt, Haemophilus influenzae Rd
uauuacuuauaagaugacuug

SEQ ID NO: 684025 - RNA, 18 nt, Haemophilus influenzae Rd
uauuagacuuaauuucac

SEQ ID NO: 684026 - RNA, 16 nt, Haemophilus influenzae Rd
uauucuggcaauauuu

SEQ ID NO: 684027 - RNA, 19 nt, Haemophilus influenzae Rd
uauucuggcaauauuucaa

SEQ ID NO: 684028 - RNA, 12 nt, Haemophilus influenzae Rd
uauucugcacga

SEQ ID NO: 684029 - RNA, 14 nt, Haemophilus influenzae Rd
uauucuucaauaga

SEQ ID NO: 684030 - RNA, 16 nt, Haemophilus influenzae Rd
uauucuucaucuucuu

SEQ ID NO: 684031 - RNA, 19 nt, Haemophilus influenzae Rd
uauucuuggagauaauauu

SEQ ID NO: 684032 - RNA, 16 nt, Haemophilus influenzae Rd
uauucuuuaaaacauu

SEQ ID NO: 684033 - RNA, 13 nt, Haemophilus influenzae Rd
uauucuuuucucc

SEQ ID NO: 684034 - RNA, 21 nt, Haemophilus influenzae Rd
uauucuuuugaaugugagcca

SEQ ID NO: 684035 - RNA, 13 nt, Haemophilus influenzae Rd
uauugaaaaguac

SEQ ID NO: 684036 - RNA, 16 nt, Haemophilus influenzae Rd
uauugacaaagucggu

SEQ ID NO: 684037 - RNA, 19 nt, Haemophilus influenzae Rd
uauugaaauuuuaauuuag

SEQ ID NO: 684038 - RNA, 19 nt, Haemophilus influenzae Rd
uauugaaccauuuuacaau

SEQ ID NO: 684039 - RNA, 17 nt, Haemophilus influenzae Rd
uauucgcugcaaaauca

SEQ ID NO: 684040 - RNA, 16 nt, Haemophilus influenzae Rd
uauucgccuucacaaa

SEQ ID NO: 684041 - RNA, 22 nt, Haemophilus influenzae Rd
uauucgucuaaucgccaaucua

SEQ ID NO: 684042 - RNA, 20 nt, Haemophilus influenzae Rd
uauucgcuuucauaaauuca

SEQ ID NO: 684043 - RNA, 14 nt, Haemophilus influenzae Rd
uauucuaaauuuau

SEQ ID NO: 684044 - RNA, 14 nt, Haemophilus influenzae Rd
uauucuaacuauau

SEQ ID NO: 684045 - RNA, 16 nt, Haemophilus influenzae Rd
uauucuauaucugaua

SEQ ID NO: 684046 - RNA, 19 nt, Haemophilus influenzae Rd
uauucuaccgcauuuuuaa

SEQ ID NO: 684047 - RNA, 20 nt, Haemophilus influenzae Rd
uauucuaccgcauuuuuaau

SEQ ID NO: 684048 - RNA, 14 nt, Haemophilus influenzae Rd
uauucuauuuauaa

SEQ ID NO: 684049 - RNA, 16 nt, Haemophilus influenzae Rd
uauucuccaaauauaa

SEQ ID NO: 684050 - RNA, 21 nt, Haemophilus influenzae Rd
uauucuccaaauauaaaauaa

SEQ ID NO: 684051 - RNA, 24 nt, Haemophilus influenzae Rd
uauucuccuugguuuucuugccaa

SEQ ID NO: 684052 - RNA, 14 nt, Haemophilus influenzae Rd
uauucucuguugcu

SEQ ID NO: 684053 - RNA, 23 nt, Haemophilus influenzae Rd
uauucugaaaccacuaaaaacaa

SEQ ID NO: 684054 - RNA, 13 nt, Haemophilus influenzae Rd
uauucaaauuuca

SEQ ID NO: 684055 - RNA, 23 nt, Haemophilus influenzae Rd
uauucaaggagcuuuauuauugg

SEQ ID NO: 684056 - RNA, 13 nt, Haemophilus influenzae Rd
uauucaauaauau

SEQ ID NO: 684057 - RNA, 14 nt, Haemophilus influenzae Rd
uauucaauaauaua

SEQ ID NO: 684058 - RNA, 21 nt, Haemophilus influenzae Rd
uauuauuuccucuucuuagau

SEQ ID NO: 684059 - RNA, 22 nt, Haemophilus influenzae Rd
uauuauuucugacgcauugcag

SEQ ID NO: 684060 - RNA, 13 nt, Haemophilus influenzae Rd
uauuauuugcaua

SEQ ID NO: 684061 - RNA, 21 nt, Haemophilus influenzae Rd
uauuauuugcauaguuuucca

SEQ ID NO: 684062 - RNA, 18 nt, Haemophilus influenzae Rd
uauucagcacuuucgcuu

SEQ ID NO: 684063 - RNA, 14 nt, Haemophilus influenzae Rd
uauucagcaaaauc

SEQ ID NO: 684064 - RNA, 15 nt, Haemophilus influenzae Rd
uauucagcaaaauca

SEQ ID NO: 684065 - RNA, 13 nt, Haemophilus influenzae Rd
uauucauaaauuc

SEQ ID NO: 684066 - RNA, 14 nt, Haemophilus influenzae Rd
uauucaguaaacaa

SEQ ID NO: 684067 - RNA, 22 nt, Haemophilus influenzae Rd
uauucaguaaacaaguauaaaa

SEQ ID NO: 684068 - RNA, 21 nt, Haemophilus influenzae Rd
uauucaugauguaauucugcu

SEQ ID NO: 684069 - RNA, 17 nt, Haemophilus influenzae Rd
uauucauauaauucauu

SEQ ID NO: 684070 - RNA, 20 nt, Haemophilus influenzae Rd
uauuccaacgauuuugcaag

SEQ ID NO: 684071 - RNA, 23 nt, Haemophilus influenzae Rd
uauuccaagguuuuuugcuaugu

SEQ ID NO: 684072 - RNA, 21 nt, Haemophilus influenzae Rd
uauucaucgccaaauuuacuu

SEQ ID NO: 684073 - RNA, 17 nt, Haemophilus influenzae Rd
uauucauuuaaaacaaa

SEQ ID NO: 684074 - RNA, 18 nt, Haemophilus influenzae Rd
uauucccaaauuuuuugu

SEQ ID NO: 684075 - RNA, 20 nt, Haemophilus influenzae Rd
uauucccccauuaaaagaag

SEQ ID NO: 684076 - RNA, 21 nt, Haemophilus influenzae Rd
uauucgacaggaacauucaca

SEQ ID NO: 684077 - RNA, 22 nt, Haemophilus influenzae Rd
uauucgacaggaacauucacac

SEQ ID NO: 684078 - RNA, 18 nt, Haemophilus influenzae Rd
uauugaguagcugaauau

SEQ ID NO: 684079 - RNA, 15 nt, Haemophilus influenzae Rd
uauugagcaauaaau

SEQ ID NO: 684080 - RNA, 17 nt, Haemophilus influenzae Rd
uauugagcgauugaacu

SEQ ID NO: 684081 - RNA, 15 nt, Haemophilus influenzae Rd
uauugauauuaauuu

SEQ ID NO: 684082 - RNA, 16 nt, Haemophilus influenzae Rd
uauugcacuaauaaau

SEQ ID NO: 684083 - RNA, 20 nt, Haemophilus influenzae Rd
uauugauuucucugacguaa

SEQ ID NO: 684084 - RNA, 21 nt, Haemophilus influenzae Rd
uauugauguuuguaggaaaua

SEQ ID NO: 684085 - RNA, 15 nt, Haemophilus influenzae Rd
uauugauuacccauu

SEQ ID NO: 684086 - RNA, 21 nt, Haemophilus influenzae Rd
uauugauucaaugcuuccuuc

SEQ ID NO: 684087 - RNA, 12 nt, Haemophilus influenzae Rd
uauugauucuaa

SEQ ID NO: 684088 - RNA, 13 nt, Haemophilus influenzae Rd
uauugauucuaaa

SEQ ID NO: 684089 - RNA, 18 nt, Haemophilus influenzae Rd
uauugcuugcauucacaa

SEQ ID NO: 684090 - RNA, 19 nt, Haemophilus influenzae Rd
uauuggauuuacuuuaaug

SEQ ID NO: 684091 - RNA, 16 nt, Haemophilus influenzae Rd
uauuggcaauuuccca

SEQ ID NO: 684092 - RNA, 23 nt, Haemophilus influenzae Rd
uauugggcggaucgcuuguugua

SEQ ID NO: 684093 - RNA, 20 nt, Haemophilus influenzae Rd
uauugccuaauaaaaaauaa

SEQ ID NO: 684094 - RNA, 17 nt, Haemophilus influenzae Rd
uauugcucaauuaagcu

SEQ ID NO: 684095 - RNA, 14 nt, Haemophilus influenzae Rd
uauugcuuaugauu

SEQ ID NO: 684096 - RNA, 22 nt, Haemophilus influenzae Rd
uauuuaagcuauuguuauagaa

SEQ ID NO: 684097 - RNA, 13 nt, Haemophilus influenzae Rd
uauuuaacuguau

SEQ ID NO: 684098 - RNA, 22 nt, Haemophilus influenzae Rd
uauuuaaguguuuacuauuaau

SEQ ID NO: 684099 - RNA, 21 nt, Haemophilus influenzae Rd
uauuuaauaauuuaaauuuau

SEQ ID NO: 684100 - RNA, 18 nt, Haemophilus influenzae Rd
uauuuaacaaguuuagau

SEQ ID NO: 684101 - RNA, 23 nt, Haemophilus influenzae Rd
uauuuaagcuuuccuauucuaaa

SEQ ID NO: 684102 - RNA, 17 nt, Haemophilus influenzae Rd
uauuuaauacuuucuuu

SEQ ID NO: 684103 - RNA, 14 nt, Haemophilus influenzae Rd
uauuuaauauauuu

SEQ ID NO: 684104 - RNA, 23 nt, Haemophilus influenzae Rd
uauuuaauaugccaaauaaaauu

SEQ ID NO: 684105 - RNA, 14 nt, Haemophilus influenzae Rd
uauuuacaacugca

SEQ ID NO: 684106 - RNA, 21 nt, Haemophilus influenzae Rd
uauuuacaagcugaaauugag

SEQ ID NO: 684107 - RNA, 22 nt, Haemophilus influenzae Rd
uauuuaccgcuuucaauuaaug

SEQ ID NO: 684108 - RNA, 14 nt, Haemophilus influenzae Rd
uauuuacuaaauua

SEQ ID NO: 684109 - RNA, 17 nt, Haemophilus influenzae Rd
uauuuacuaaauucuuu

SEQ ID NO: 684110 - RNA, 17 nt, Haemophilus influenzae Rd
uauuuacuuuauaaaug

SEQ ID NO: 684111 - RNA, 14 nt, Haemophilus influenzae Rd
uauuuagaauuuuu

SEQ ID NO: 684112 - RNA, 19 nt, Haemophilus influenzae Rd
uauuuacuguuuuuauauu

SEQ ID NO: 684113 - RNA, 16 nt, Haemophilus influenzae Rd
uauuuagauacaaaau

SEQ ID NO: 684114 - RNA, 15 nt, Haemophilus influenzae Rd
uauuuagauauaaaa

SEQ ID NO: 684115 - RNA, 12 nt, Haemophilus influenzae Rd
uauuuagauuac

SEQ ID NO: 684116 - RNA, 17 nt, Haemophilus influenzae Rd
uauuuagcggaauuuuu

SEQ ID NO: 684117 - RNA, 20 nt, Haemophilus influenzae Rd
uauuuaggcuauuuuauaau

SEQ ID NO: 684118 - RNA, 24 nt, Haemophilus influenzae Rd
uauuuaggcuauuuuauaauuaau

SEQ ID NO: 684119 - RNA, 17 nt, Haemophilus influenzae Rd
uauuuaaaccauuuuaa

SEQ ID NO: 684120 - RNA, 22 nt, Haemophilus influenzae Rd
uauuuaaauacacuucuaaaau

SEQ ID NO: 684121 - RNA, 14 nt, Haemophilus influenzae Rd
uauuuaaauuaaaa

SEQ ID NO: 684122 - RNA, 15 nt, Haemophilus influenzae Rd
uauuuaaauuaaaaa

SEQ ID NO: 684123 - RNA, 19 nt, Haemophilus influenzae Rd
uauuguuuuuuucuaaaua

SEQ ID NO: 684124 - RNA, 21 nt, Haemophilus influenzae Rd
uauuuaaaaucagcccuuauu

SEQ ID NO: 684125 - RNA, 15 nt, Haemophilus influenzae Rd
uauugucuauuuuau

SEQ ID NO: 684126 - RNA, 23 nt, Haemophilus influenzae Rd
uauuguacuucuuacguuuaaau

SEQ ID NO: 684127 - RNA, 19 nt, Haemophilus influenzae Rd
uauuguaguaauaaaaagc

SEQ ID NO: 684128 - RNA, 22 nt, Haemophilus influenzae Rd
uauuguuaaaacgccauucaca

SEQ ID NO: 684129 - RNA, 12 nt, Haemophilus influenzae Rd
uauuugcaauaa

SEQ ID NO: 684130 - RNA, 16 nt, Haemophilus influenzae Rd
uauuugcaauaaaauu

SEQ ID NO: 684131 - RNA, 14 nt, Haemophilus influenzae Rd
uauuugcauauaaa

SEQ ID NO: 684132 - RNA, 19 nt, Haemophilus influenzae Rd
uauuuggaacaguaaauuu

SEQ ID NO: 684133 - RNA, 21 nt, Haemophilus influenzae Rd
uauuuggaacaguaaauuuaa

SEQ ID NO: 684134 - RNA, 22 nt, Haemophilus influenzae Rd
uauuuggaauugugcuaaauuu

SEQ ID NO: 684135 - RNA, 14 nt, Haemophilus influenzae Rd
uauuugcuaaaauu

SEQ ID NO: 684136 - RNA, 22 nt, Haemophilus influenzae Rd
uauuugcugcacgaguuugauu

SEQ ID NO: 684137 - RNA, 18 nt, Haemophilus influenzae Rd
uauuugagaaaaauguua

SEQ ID NO: 684138 - RNA, 21 nt, Haemophilus influenzae Rd
uauuugauuuuuauagugaua

SEQ ID NO: 684139 - RNA, 18 nt, Haemophilus influenzae Rd
uauuugcaaagauauaaa

SEQ ID NO: 684140 - RNA, 21 nt, Haemophilus influenzae Rd
uauuugcaaagauauaaacug

SEQ ID NO: 684141 - RNA, 23 nt, Haemophilus influenzae Rd
uauuugaaguugccauagacauu

SEQ ID NO: 684142 - RNA, 23 nt, Haemophilus influenzae Rd
uauuucuuuucaaacacaaaaua

SEQ ID NO: 684143 - RNA, 20 nt, Haemophilus influenzae Rd
uauuucuucauuuuaaauua

SEQ ID NO: 684144 - RNA, 21 nt, Haemophilus influenzae Rd
uauuucuucaauauguucuaa

SEQ ID NO: 684145 - RNA, 18 nt, Haemophilus influenzae Rd
uauuucuguauuaucuaa

SEQ ID NO: 684146 - RNA, 23 nt, Haemophilus influenzae Rd
uauuucuguauuuuuuauuuaau

SEQ ID NO: 684147 - RNA, 19 nt, Haemophilus influenzae Rd
uauuuggauaacaaauugc

SEQ ID NO: 684148 - RNA, 21 nt, Haemophilus influenzae Rd
uauuuggcauuugaauuacca

SEQ ID NO: 684149 - RNA, 14 nt, Haemophilus influenzae Rd
uauuugguuaugau

SEQ ID NO: 684150 - RNA, 18 nt, Haemophilus influenzae Rd
uauuugguugaacuucua

SEQ ID NO: 684151 - RNA, 22 nt, Haemophilus influenzae Rd
uauuugguugaacuucuaaaaa

SEQ ID NO: 684152 - RNA, 18 nt, Haemophilus influenzae Rd
uauuugucggaaaauaau

SEQ ID NO: 684153 - RNA, 13 nt, Haemophilus influenzae Rd
uauuuuaaaauca

SEQ ID NO: 684154 - RNA, 19 nt, Haemophilus influenzae Rd
uauuuuaaauaaaaaauaa

SEQ ID NO: 684155 - RNA, 16 nt, Haemophilus influenzae Rd
uauuuuaaugaaagua

SEQ ID NO: 684156 - RNA, 21 nt, Haemophilus influenzae Rd
uauuuuaaugcugaguaccaa

SEQ ID NO: 684157 - RNA, 17 nt, Haemophilus influenzae Rd
uauuuuaauaaagauaa

SEQ ID NO: 684158 - RNA, 16 nt, Haemophilus influenzae Rd
uauuuuaauagaauuu

SEQ ID NO: 684159 - RNA, 21 nt, Haemophilus influenzae Rd
uauuuuacggauuuauauauu

SEQ ID NO: 684160 - RNA, 13 nt, Haemophilus influenzae Rd
uauuuuacuaaac

SEQ ID NO: 684161 - RNA, 15 nt, Haemophilus influenzae Rd
uauuuuauaauuaau

SEQ ID NO: 684162 - RNA, 16 nt, Haemophilus influenzae Rd
uauuuuauaauuaaua

SEQ ID NO: 684163 - RNA, 18 nt, Haemophilus influenzae Rd
uauuuuauaauuaauaaa

SEQ ID NO: 684164 - RNA, 12 nt, Haemophilus influenzae Rd
uauuuuauauau

SEQ ID NO: 684165 - RNA, 14 nt, Haemophilus influenzae Rd
uauuuuauauauua

SEQ ID NO: 684166 - RNA, 19 nt, Haemophilus influenzae Rd
uauuuuauauauuaaaaaa

SEQ ID NO: 684167 - RNA, 19 nt, Haemophilus influenzae Rd
uauuuuaucaacuaaaaaa

SEQ ID NO: 684168 - RNA, 18 nt, Haemophilus influenzae Rd
uauuuccaucaaaagauc

SEQ ID NO: 684169 - RNA, 11 nt, Haemophilus influenzae Rd
uauuucauuug

SEQ ID NO: 684170 - RNA, 12 nt, Haemophilus influenzae Rd
uauuucagcuug

SEQ ID NO: 684171 - RNA, 20 nt, Haemophilus influenzae Rd
uauuucagcugcaauaucaa

SEQ ID NO: 684172 - RNA, 18 nt, Haemophilus influenzae Rd
uauuucgguuucaugauu

SEQ ID NO: 684173 - RNA, 15 nt, Haemophilus influenzae Rd
uauuuccucuaaaua

SEQ ID NO: 684174 - RNA, 18 nt, Haemophilus influenzae Rd
uauuucgcccuuauacaa

SEQ ID NO: 684175 - RNA, 20 nt, Haemophilus influenzae Rd
uauuucgcccuuauacaaaa

SEQ ID NO: 684176 - RNA, 22 nt, Haemophilus influenzae Rd
uauuucgcccuuauacaaaacu

SEQ ID NO: 684177 - RNA, 14 nt, Haemophilus influenzae Rd
uauuuauuauucuu

SEQ ID NO: 684178 - RNA, 21 nt, Haemophilus influenzae Rd
uauuuauuccaucaauaccua

SEQ ID NO: 684179 - RNA, 15 nt, Haemophilus influenzae Rd
uauuuauaaguaauc

SEQ ID NO: 684180 - RNA, 14 nt, Haemophilus influenzae Rd
uauuuauaauccau

SEQ ID NO: 684181 - RNA, 13 nt, Haemophilus influenzae Rd
uauuuauaaugug

SEQ ID NO: 684182 - RNA, 14 nt, Haemophilus influenzae Rd
uauuuauaaugugg

SEQ ID NO: 684183 - RNA, 13 nt, Haemophilus influenzae Rd
uauuuauagcauu

SEQ ID NO: 684184 - RNA, 15 nt, Haemophilus influenzae Rd
uauuuauagcauuua

SEQ ID NO: 684185 - RNA, 19 nt, Haemophilus influenzae Rd
uauuuauagcauuuaaaua

SEQ ID NO: 684186 - RNA, 21 nt, Haemophilus influenzae Rd
uauuuauagcuaagcaguuua

SEQ ID NO: 684187 - RNA, 19 nt, Haemophilus influenzae Rd
uauuuauauuuuuguaagg

SEQ ID NO: 684188 - RNA, 14 nt, Haemophilus influenzae Rd
uauuuauuuaauuu

SEQ ID NO: 684189 - RNA, 13 nt, Haemophilus influenzae Rd
uauuucaacauag

SEQ ID NO: 684190 - RNA, 21 nt, Haemophilus influenzae Rd
uauuucaacauagugucagca

SEQ ID NO: 684191 - RNA, 18 nt, Haemophilus influenzae Rd
ucaaaagaauuaaaaaug

SEQ ID NO: 684192 - RNA, 23 nt, Haemophilus influenzae Rd
ucaaaagaucauuuuuuuaaaua

SEQ ID NO: 684193 - RNA, 20 nt, Haemophilus influenzae Rd
ucaaaauaaggucagcaaau

SEQ ID NO: 684194 - RNA, 23 nt, Haemophilus influenzae Rd
ucaaaauaaguaucccaaauuaa

SEQ ID NO: 684195 - RNA, 16 nt, Haemophilus influenzae Rd
ucaaaauaaauaaaau

SEQ ID NO: 684196 - RNA, 14 nt, Haemophilus influenzae Rd
ucaaaauaaaacca

SEQ ID NO: 684197 - RNA, 16 nt, Haemophilus influenzae Rd
ucaaaaguauaaacuu

SEQ ID NO: 684198 - RNA, 16 nt, Haemophilus influenzae Rd
ucaaaaauuucagaau

SEQ ID NO: 684199 - RNA, 21 nt, Haemophilus influenzae Rd
ucaaaaauuucgcuauuuucu

SEQ ID NO: 684200 - RNA, 13 nt, Haemophilus influenzae Rd
ucaaaaauuugaa

SEQ ID NO: 684201 - RNA, 23 nt, Haemophilus influenzae Rd
ucaaaaauuugaauguaaaaaua

SEQ ID NO: 684202 - RNA, 13 nt, Haemophilus influenzae Rd
ucaaaaauugaua

SEQ ID NO: 684203 - RNA, 20 nt, Haemophilus influenzae Rd
ucaaaaauugauaccaagau

SEQ ID NO: 684204 - RNA, 16 nt, Haemophilus influenzae Rd
ucaaaaaucaaauuaa

SEQ ID NO: 684205 - RNA, 19 nt, Haemophilus influenzae Rd
ucaaaaaucaaauuaauuu

SEQ ID NO: 684206 - RNA, 11 nt, Haemophilus influenzae Rd
ucaaaaaugcu

SEQ ID NO: 684207 - RNA, 19 nt, Haemophilus influenzae Rd
ucaaaaccuuucuguaaau

SEQ ID NO: 684208 - RNA, 16 nt, Haemophilus influenzae Rd
ucaaaacgaguuaaga

SEQ ID NO: 684209 - RNA, 18 nt, Haemophilus influenzae Rd
ucaaaacgaucuaaaaau

SEQ ID NO: 684210 - RNA, 19 nt, Haemophilus influenzae Rd
ucaaaacgaucuaaaaaug

SEQ ID NO: 684211 - RNA, 21 nt, Haemophilus influenzae Rd
ucaaaacguucuacuuguuca

SEQ ID NO: 684212 - RNA, 16 nt, Haemophilus influenzae Rd
ucaaaacaguuuucaa

SEQ ID NO: 684213 - RNA, 15 nt, Haemophilus influenzae Rd
ucaaaaaaauaagug

SEQ ID NO: 684214 - RNA, 15 nt, Haemophilus influenzae Rd
ucaaaaaaauuuacc

SEQ ID NO: 684215 - RNA, 12 nt, Haemophilus influenzae Rd
uauuuuuuuaau

SEQ ID NO: 684216 - RNA, 13 nt, Haemophilus influenzae Rd
uauuuuuuuaauu

SEQ ID NO: 684217 - RNA, 16 nt, Haemophilus influenzae Rd
ucaaaaaguugaauuu

SEQ ID NO: 684218 - RNA, 20 nt, Haemophilus influenzae Rd
ucaaaaaguugaauuuucaa

SEQ ID NO: 684219 - RNA, 21 nt, Haemophilus influenzae Rd
ucaaaaagcacguuuuaauaa

SEQ ID NO: 684220 - RNA, 13 nt, Haemophilus influenzae Rd
ucaaaaagaaaua

SEQ ID NO: 684221 - RNA, 12 nt, Haemophilus influenzae Rd
uauuuuuaucaa

SEQ ID NO: 684222 - RNA, 13 nt, Haemophilus influenzae Rd
uauuuuuaucaua

SEQ ID NO: 684223 - RNA, 15 nt, Haemophilus influenzae Rd
uauuuuuaucauaua

SEQ ID NO: 684224 - RNA, 13 nt, Haemophilus influenzae Rd
uauuuuuauuuau

SEQ ID NO: 684225 - RNA, 13 nt, Haemophilus influenzae Rd
uauuuuuauaaau

SEQ ID NO: 684226 - RNA, 18 nt, Haemophilus influenzae Rd
uauuuuuaucuaaauucc

SEQ ID NO: 684227 - RNA, 21 nt, Haemophilus influenzae Rd
uauuuuucaaggccauauuuu

SEQ ID NO: 684228 - RNA, 13 nt, Haemophilus influenzae Rd
uauuuuucaauaa

SEQ ID NO: 684229 - RNA, 17 nt, Haemophilus influenzae Rd
uauuuuuauuaucaaaa

SEQ ID NO: 684230 - RNA, 11 nt, Haemophilus influenzae Rd
uauuuuucaua

SEQ ID NO: 684231 - RNA, 18 nt, Haemophilus influenzae Rd
uauuuuuccacuguuauu

SEQ ID NO: 684232 - RNA, 19 nt, Haemophilus influenzae Rd
uauuuuuaaucaaauaaaa

SEQ ID NO: 684233 - RNA, 18 nt, Haemophilus influenzae Rd
uauuuuguguauuaagua

SEQ ID NO: 684234 - RNA, 18 nt, Haemophilus influenzae Rd
uauuuuguuaaaaguuag

SEQ ID NO: 684235 - RNA, 21 nt, Haemophilus influenzae Rd
uauuuuucuaaaucgucgcua

SEQ ID NO: 684236 - RNA, 21 nt, Haemophilus influenzae Rd
uauuuuugauauuaagccauu

SEQ ID NO: 684237 - RNA, 21 nt, Haemophilus influenzae Rd
uauuuuugauccugaucuuuu

SEQ ID NO: 684238 - RNA, 12 nt, Haemophilus influenzae Rd
uauuuuuuacua

SEQ ID NO: 684239 - RNA, 18 nt, Haemophilus influenzae Rd
uauuuuuuaauacgaaaa

SEQ ID NO: 684240 - RNA, 14 nt, Haemophilus influenzae Rd
uauuuuuuauuuuu

SEQ ID NO: 684241 - RNA, 20 nt, Haemophilus influenzae Rd
uauuuuuucaucauuucuua

SEQ ID NO: 684242 - RNA, 15 nt, Haemophilus influenzae Rd
uauuuuuucuuaaau

SEQ ID NO: 684243 - RNA, 14 nt, Haemophilus influenzae Rd
uauuuuuuggaaua

SEQ ID NO: 684244 - RNA, 18 nt, Haemophilus influenzae Rd
uauuuuuuggaauauuau

SEQ ID NO: 684245 - RNA, 15 nt, Haemophilus influenzae Rd
uauuuucuuaauuuu

SEQ ID NO: 684246 - RNA, 17 nt, Haemophilus influenzae Rd
uauuuucuuaauuuuau

SEQ ID NO: 684247 - RNA, 12 nt, Haemophilus influenzae Rd
uauuuucuuauu

SEQ ID NO: 684248 - RNA, 18 nt, Haemophilus influenzae Rd
uauuuugaauaauaaauu

SEQ ID NO: 684249 - RNA, 21 nt, Haemophilus influenzae Rd
uauuuugauaacgcgccacuu

SEQ ID NO: 684250 - RNA, 14 nt, Haemophilus influenzae Rd
uauuuuauuaucaa

SEQ ID NO: 684251 - RNA, 14 nt, Haemophilus influenzae Rd
uauuuucaaauuca

SEQ ID NO: 684252 - RNA, 22 nt, Haemophilus influenzae Rd
uauuuuccucgacauaaaaaca

SEQ ID NO: 684253 - RNA, 14 nt, Haemophilus influenzae Rd
uauuuucuaauaag

SEQ ID NO: 684254 - RNA, 19 nt, Haemophilus influenzae Rd
uauuuucucaucauuauuu

SEQ ID NO: 684255 - RNA, 22 nt, Haemophilus influenzae Rd
ucaaauaaaauauuuuuuauuu

SEQ ID NO: 684256 - RNA, 14 nt, Haemophilus influenzae Rd
ucaaauaccucaau

SEQ ID NO: 684257 - RNA, 15 nt, Haemophilus influenzae Rd
ucaaauaaguuugau

SEQ ID NO: 684258 - RNA, 20 nt, Haemophilus influenzae Rd
ucaaauaauguguugauuuc

SEQ ID NO: 684259 - RNA, 21 nt, Haemophilus influenzae Rd
ucaaauaauguguugauuucu

SEQ ID NO: 684260 - RNA, 19 nt, Haemophilus influenzae Rd
ucaaaguaacguugcucuu

SEQ ID NO: 684261 - RNA, 21 nt, Haemophilus influenzae Rd
ucaaagugcgguaaucuuuca

SEQ ID NO: 684262 - RNA, 15 nt, Haemophilus influenzae Rd
ucaaaggcuaauucu

SEQ ID NO: 684263 - RNA, 17 nt, Haemophilus influenzae Rd
ucaaagcguuuuaaaau

SEQ ID NO: 684264 - RNA, 20 nt, Haemophilus influenzae Rd
ucaaagcguuuuaaaaucuc

SEQ ID NO: 684265 - RNA, 13 nt, Haemophilus influenzae Rd
ucaaagcucaccu

SEQ ID NO: 684266 - RNA, 21 nt, Haemophilus influenzae Rd
ucaaagaauucuggugcauuu

SEQ ID NO: 684267 - RNA, 22 nt, Haemophilus influenzae Rd
ucaaagaauugaucaaaauuau

SEQ ID NO: 684268 - RNA, 16 nt, Haemophilus influenzae Rd
ucaaagcgagaaaaac

SEQ ID NO: 684269 - RNA, 15 nt, Haemophilus influenzae Rd
ucaaagauuuuaaaa

SEQ ID NO: 684270 - RNA, 21 nt, Haemophilus influenzae Rd
ucaaagagaagcugaauaaaa

SEQ ID NO: 684271 - RNA, 18 nt, Haemophilus influenzae Rd
ucaaagaggagguagaaa

SEQ ID NO: 684272 - RNA, 20 nt, Haemophilus influenzae Rd
ucaaagaggagguagaaaau

SEQ ID NO: 684273 - RNA, 19 nt, Haemophilus influenzae Rd
ucaaaaucagcaaauuguu

SEQ ID NO: 684274 - RNA, 17 nt, Haemophilus influenzae Rd
ucaaaaucagcuaauaa

SEQ ID NO: 684275 - RNA, 17 nt, Haemophilus influenzae Rd
ucaaaauaguaaaaauu

SEQ ID NO: 684276 - RNA, 18 nt, Haemophilus influenzae Rd
ucaaaauagcuuuuuaau

SEQ ID NO: 684277 - RNA, 15 nt, Haemophilus influenzae Rd
ucaaaaugaaaacua

SEQ ID NO: 684278 - RNA, 21 nt, Haemophilus influenzae Rd
ucaaaaugaaaacuaugcucu

SEQ ID NO: 684279 - RNA, 12 nt, Haemophilus influenzae Rd
ucaaaaugcagu

SEQ ID NO: 684280 - RNA, 22 nt, Haemophilus influenzae Rd
ucaaaaugcaguagguauguuu

SEQ ID NO: 684281 - RNA, 12 nt, Haemophilus influenzae Rd
ucaaaauuugug

SEQ ID NO: 684282 - RNA, 20 nt, Haemophilus influenzae Rd
ucaaacaaacccucccauua

SEQ ID NO: 684283 - RNA, 15 nt, Haemophilus influenzae Rd
ucaaacacccaaucu

SEQ ID NO: 684284 - RNA, 12 nt, Haemophilus influenzae Rd
ucaaacaccuaa

SEQ ID NO: 684285 - RNA, 20 nt, Haemophilus influenzae Rd
ucaaacaauacaaauacuga

SEQ ID NO: 684286 - RNA, 21 nt, Haemophilus influenzae Rd
ucaaacaauaugugcuuggca

SEQ ID NO: 684287 - RNA, 22 nt, Haemophilus influenzae Rd
ucaaacaauaugugcuuggcac

SEQ ID NO: 684288 - RNA, 19 nt, Haemophilus influenzae Rd
ucaaacacaaaauaagggc

SEQ ID NO: 684289 - RNA, 13 nt, Haemophilus influenzae Rd
ucaaaauucaaaa

SEQ ID NO: 684290 - RNA, 21 nt, Haemophilus influenzae Rd
ucaaaauuacgcccuguucca

SEQ ID NO: 684291 - RNA, 22 nt, Haemophilus influenzae Rd
ucaaaauugaucgaaaaaucuu

SEQ ID NO: 684292 - RNA, 20 nt, Haemophilus influenzae Rd
ucaaaauugaugaaaauucu

SEQ ID NO: 684293 - RNA, 18 nt, Haemophilus influenzae Rd
ucaaaauugcuuaaugga

SEQ ID NO: 684294 - RNA, 14 nt, Haemophilus influenzae Rd
ucaaaccaauaaac

SEQ ID NO: 684295 - RNA, 20 nt, Haemophilus influenzae Rd
ucaaacaguucaauaaaaau

SEQ ID NO: 684296 - RNA, 14 nt, Haemophilus influenzae Rd
ucaaaccaaccaca

SEQ ID NO: 684297 - RNA, 19 nt, Haemophilus influenzae Rd
ucaaacgccguucaaaauc

SEQ ID NO: 684298 - RNA, 18 nt, Haemophilus influenzae Rd
ucaaacgacuuaauuuua

SEQ ID NO: 684299 - RNA, 17 nt, Haemophilus influenzae Rd
ucaagaauuccauugca

SEQ ID NO: 684300 - RNA, 23 nt, Haemophilus influenzae Rd
ucaagacaaauuuguugcauuuc

SEQ ID NO: 684301 - RNA, 12 nt, Haemophilus influenzae Rd
ucaagaaacuga

SEQ ID NO: 684302 - RNA, 19 nt, Haemophilus influenzae Rd
ucaagaacaguauaaccag

SEQ ID NO: 684303 - RNA, 19 nt, Haemophilus influenzae Rd
ucaacuuccgcuaauacua

SEQ ID NO: 684304 - RNA, 20 nt, Haemophilus influenzae Rd
ucaacuuccgcuaauacuag

SEQ ID NO: 684305 - RNA, 11 nt, Haemophilus influenzae Rd
ucaacuuggcu

SEQ ID NO: 684306 - RNA, 21 nt, Haemophilus influenzae Rd
ucaagaugacgaaaugaaauu

SEQ ID NO: 684307 - RNA, 16 nt, Haemophilus influenzae Rd
ucaagaugauauuuaa

SEQ ID NO: 684308 - RNA, 18 nt, Haemophilus influenzae Rd
ucaagaugauauuuaaua

SEQ ID NO: 684309 - RNA, 21 nt, Haemophilus influenzae Rd
ucaagaugauauuuaauaaaa

SEQ ID NO: 684310 - RNA, 17 nt, Haemophilus influenzae Rd
ucaagaucggaauauuu

SEQ ID NO: 684311 - RNA, 16 nt, Haemophilus influenzae Rd
ucaagaggauaacccu

SEQ ID NO: 684312 - RNA, 15 nt, Haemophilus influenzae Rd
ucaagauaccaauaa

SEQ ID NO: 684313 - RNA, 17 nt, Haemophilus influenzae Rd
ucaagauaccaauaauc

SEQ ID NO: 684314 - RNA, 16 nt, Haemophilus influenzae Rd
ucaagcacuuuuccuu

SEQ ID NO: 684315 - RNA, 18 nt, Haemophilus influenzae Rd
ucaagcaaccuaaacccg

SEQ ID NO: 684316 - RNA, 20 nt, Haemophilus influenzae Rd
ucaagauuaaucuuuuuucu

SEQ ID NO: 684317 - RNA, 17 nt, Haemophilus influenzae Rd
ucaagcaacauagucgc

SEQ ID NO: 684318 - RNA, 15 nt, Haemophilus influenzae Rd
ucaagcauaaaucuu

SEQ ID NO: 684319 - RNA, 10 nt, Haemophilus influenzae Rd
ucaagcccuc

SEQ ID NO: 684320 - RNA, 22 nt, Haemophilus influenzae Rd
ucaacucacuauccaaacauuu

SEQ ID NO: 684321 - RNA, 18 nt, Haemophilus influenzae Rd
ucaacugcaacaauuuca

SEQ ID NO: 684322 - RNA, 15 nt, Haemophilus influenzae Rd
ucaacguugggugug

SEQ ID NO: 684323 - RNA, 16 nt, Haemophilus influenzae Rd
ucaacuaaaaaauagu

SEQ ID NO: 684324 - RNA, 19 nt, Haemophilus influenzae Rd
ucaacuaaaaaauaguuaa

SEQ ID NO: 684325 - RNA, 19 nt, Haemophilus influenzae Rd
ucaacuaacacgcgcugcu

SEQ ID NO: 684326 - RNA, 20 nt, Haemophilus influenzae Rd
ucaacuaacacgcgcugcuc

SEQ ID NO: 684327 - RNA, 19 nt, Haemophilus influenzae Rd
ucaacgguuucuugggcgg

SEQ ID NO: 684328 - RNA, 18 nt, Haemophilus influenzae Rd
ucaaccgcacuuaauaaa

SEQ ID NO: 684329 - RNA, 16 nt, Haemophilus influenzae Rd
ucaaccgcacuuuauu

SEQ ID NO: 684330 - RNA, 18 nt, Haemophilus influenzae Rd
ucaacgccguauuuggca

SEQ ID NO: 684331 - RNA, 19 nt, Haemophilus influenzae Rd
ucaacgccguauuuggcaa

SEQ ID NO: 684332 - RNA, 17 nt, Haemophilus influenzae Rd
ucaaaucauuuuuugca

SEQ ID NO: 684333 - RNA, 12 nt, Haemophilus influenzae Rd
ucaaaucgauca

SEQ ID NO: 684334 - RNA, 16 nt, Haemophilus influenzae Rd
ucaaaucgaucacuua

SEQ ID NO: 684335 - RNA, 19 nt, Haemophilus influenzae Rd
ucaaaucuaacguauuuaa

SEQ ID NO: 684336 - RNA, 15 nt, Haemophilus influenzae Rd
ucaaaucuacuaaaa

SEQ ID NO: 684337 - RNA, 17 nt, Haemophilus influenzae Rd
ucaaaucuacuaaaaua

SEQ ID NO: 684338 - RNA, 17 nt, Haemophilus influenzae Rd
ucaaaucaaauuuuccu

SEQ ID NO: 684339 - RNA, 20 nt, Haemophilus influenzae Rd
ucaaaugaaagaagaaaaag

SEQ ID NO: 684340 - RNA, 16 nt, Haemophilus influenzae Rd
ucaaaucuucagcagu

SEQ ID NO: 684341 - RNA, 14 nt, Haemophilus influenzae Rd
ucaaaugaaaugca

SEQ ID NO: 684342 - RNA, 16 nt, Haemophilus influenzae Rd
ucaaauuucuucacug

SEQ ID NO: 684343 - RNA, 13 nt, Haemophilus influenzae Rd
ucaaauuuuccuu

SEQ ID NO: 684344 - RNA, 23 nt, Haemophilus influenzae Rd
ucaaauuuuccuucuauaucaga

SEQ ID NO: 684345 - RNA, 13 nt, Haemophilus influenzae Rd
ucaaauuuaaaua

SEQ ID NO: 684346 - RNA, 13 nt, Haemophilus influenzae Rd
ucaaauucuaaaa

SEQ ID NO: 684347 - RNA, 13 nt, Haemophilus influenzae Rd
ucaaauucugcuu

SEQ ID NO: 684348 - RNA, 16 nt, Haemophilus influenzae Rd
ucaaauucuguguaau

SEQ ID NO: 684349 - RNA, 14 nt, Haemophilus influenzae Rd
ucaacaacaucuug

SEQ ID NO: 684350 - RNA, 19 nt, Haemophilus influenzae Rd
ucaacaacaucuuguuuua

SEQ ID NO: 684351 - RNA, 15 nt, Haemophilus influenzae Rd
ucaacaacuaaauaa

SEQ ID NO: 684352 - RNA, 18 nt, Haemophilus influenzae Rd
ucaacaagacucucgccu

SEQ ID NO: 684353 - RNA, 19 nt, Haemophilus influenzae Rd
ucaacaagacucucgccuu

SEQ ID NO: 684354 - RNA, 18 nt, Haemophilus influenzae Rd
ucaacaaaaaacaccuaa

SEQ ID NO: 684355 - RNA, 22 nt, Haemophilus influenzae Rd
ucaacaaaaaacaccuaaaaug

SEQ ID NO: 684356 - RNA, 23 nt, Haemophilus influenzae Rd
ucaacaaaaaacaccuaaaaugg

SEQ ID NO: 684357 - RNA, 12 nt, Haemophilus influenzae Rd
ucaacccauuuu

SEQ ID NO: 684358 - RNA, 15 nt, Haemophilus influenzae Rd
ucaacccauuuucca

SEQ ID NO: 684359 - RNA, 13 nt, Haemophilus influenzae Rd
ucaacccauaauu

SEQ ID NO: 684360 - RNA, 22 nt, Haemophilus influenzae Rd
ucaaccacugucucgccacuua

SEQ ID NO: 684361 - RNA, 15 nt, Haemophilus influenzae Rd
ucaaccacuucaaau

SEQ ID NO: 684362 - RNA, 18 nt, Haemophilus influenzae Rd
ucaaccacuucaaauacc

SEQ ID NO: 684363 - RNA, 17 nt, Haemophilus influenzae Rd
ucaacagugaaaccaaa

SEQ ID NO: 684364 - RNA, 16 nt, Haemophilus influenzae Rd
ucaacagggugguugc

SEQ ID NO: 684365 - RNA, 14 nt, Haemophilus influenzae Rd
ucaacacaccuauu

SEQ ID NO: 684366 - RNA, 22 nt, Haemophilus influenzae Rd
ucaacaauuucugcauaauggc

SEQ ID NO: 684367 - RNA, 16 nt, Haemophilus influenzae Rd
ucaacaaucacuucgu

SEQ ID NO: 684368 - RNA, 17 nt, Haemophilus influenzae Rd
ucaacaccgcaaaaaua

SEQ ID NO: 684369 - RNA, 16 nt, Haemophilus influenzae Rd
ucaacaccuaauauca

SEQ ID NO: 684370 - RNA, 21 nt, Haemophilus influenzae Rd
ucaacacuuuauuacuuuuau

SEQ ID NO: 684371 - RNA, 18 nt, Haemophilus influenzae Rd
ucaauauaaaaaauaacc

SEQ ID NO: 684372 - RNA, 19 nt, Haemophilus influenzae Rd
ucaauagauaaaucaaaac

SEQ ID NO: 684373 - RNA, 17 nt, Haemophilus influenzae Rd
ucaauagccaauaauaa

SEQ ID NO: 684374 - RNA, 18 nt, Haemophilus influenzae Rd
ucaauaucuaagaaaaua

SEQ ID NO: 684375 - RNA, 15 nt, Haemophilus influenzae Rd
ucaauaucaaagaaa

SEQ ID NO: 684376 - RNA, 16 nt, Haemophilus influenzae Rd
ucaauaucaaagaaaa

SEQ ID NO: 684377 - RNA, 15 nt, Haemophilus influenzae Rd
ucaauauaaguugua

SEQ ID NO: 684378 - RNA, 16 nt, Haemophilus influenzae Rd
ucaaucaaauucaaca

SEQ ID NO: 684379 - RNA, 19 nt, Haemophilus influenzae Rd
ucaaucaagcauaaaucuu

SEQ ID NO: 684380 - RNA, 20 nt, Haemophilus influenzae Rd
ucaaucaagcauaaaucuuu

SEQ ID NO: 684381 - RNA, 12 nt, Haemophilus influenzae Rd
ucaaucacagca

SEQ ID NO: 684382 - RNA, 22 nt, Haemophilus influenzae Rd
ucaauaauauauuuaaugugua

SEQ ID NO: 684383 - RNA, 16 nt, Haemophilus influenzae Rd
ucaauaagcaaguaau

SEQ ID NO: 684384 - RNA, 16 nt, Haemophilus influenzae Rd
ucaauaacugauuuug

SEQ ID NO: 684385 - RNA, 19 nt, Haemophilus influenzae Rd
ucaauaaggcuuuuuuaau

SEQ ID NO: 684386 - RNA, 15 nt, Haemophilus influenzae Rd
ucaauaauuucaaua

SEQ ID NO: 684387 - RNA, 18 nt, Haemophilus influenzae Rd
ucaauacguuuaauauag

SEQ ID NO: 684388 - RNA, 16 nt, Haemophilus influenzae Rd
ucaauaccuaacguua

SEQ ID NO: 684389 - RNA, 17 nt, Haemophilus influenzae Rd
ucaagguugcaacauca

SEQ ID NO: 684390 - RNA, 16 nt, Haemophilus influenzae Rd
ucaaguaacuuucaca

SEQ ID NO: 684391 - RNA, 17 nt, Haemophilus influenzae Rd
ucaagcuuugcaacaaa

SEQ ID NO: 684392 - RNA, 19 nt, Haemophilus influenzae Rd
ucaaggaaaaaggcaucuu

SEQ ID NO: 684393 - RNA, 18 nt, Haemophilus influenzae Rd
ucaagcugauuuaucauu

SEQ ID NO: 684394 - RNA, 22 nt, Haemophilus influenzae Rd
ucaagccuucuaaaauaagaau

SEQ ID NO: 684395 - RNA, 16 nt, Haemophilus influenzae Rd
ucaagucguuauuuuc

SEQ ID NO: 684396 - RNA, 15 nt, Haemophilus influenzae Rd
ucaagucaaaaaccg

SEQ ID NO: 684397 - RNA, 20 nt, Haemophilus influenzae Rd
ucaaguaauacuuuuuauuu

SEQ ID NO: 684398 - RNA, 15 nt, Haemophilus influenzae Rd
ucaagugguuuauuu

SEQ ID NO: 684399 - RNA, 13 nt, Haemophilus influenzae Rd
ucaaguuaaaaaa

SEQ ID NO: 684400 - RNA, 14 nt, Haemophilus influenzae Rd
ucaaguuacuuaau

SEQ ID NO: 684401 - RNA, 16 nt, Haemophilus influenzae Rd
ucaaguuacuuaauuu

SEQ ID NO: 684402 - RNA, 16 nt, Haemophilus influenzae Rd
ucaauaaaaauauauu

SEQ ID NO: 684403 - RNA, 22 nt, Haemophilus influenzae Rd
ucaaguuuuauuugagaaaaau

SEQ ID NO: 684404 - RNA, 12 nt, Haemophilus influenzae Rd
ucaauaaaaaua

SEQ ID NO: 684405 - RNA, 20 nt, Haemophilus influenzae Rd
ucaauaaacccuaaucguuc

SEQ ID NO: 684406 - RNA, 12 nt, Haemophilus influenzae Rd
ucaauaaacucg

SEQ ID NO: 684407 - RNA, 22 nt, Haemophilus influenzae Rd
ucaauaaauaucuaaacuucaa

SEQ ID NO: 684408 - RNA, 20 nt, Haemophilus influenzae Rd
ucaauaacacucauuguaaa

SEQ ID NO: 684409 - RNA, 21 nt, Haemophilus influenzae Rd
ucacaaaguguuuuauuuauc

SEQ ID NO: 684410 - RNA, 21 nt, Haemophilus influenzae Rd
ucacaaacauaccuaaaaaug

SEQ ID NO: 684411 - RNA, 21 nt, Haemophilus influenzae Rd
ucacaaaucuucuugaaaccu

SEQ ID NO: 684412 - RNA, 14 nt, Haemophilus influenzae Rd
ucacaaaacaacca

SEQ ID NO: 684413 - RNA, 11 nt, Haemophilus influenzae Rd
ucaauuuuuca

SEQ ID NO: 684414 - RNA, 18 nt, Haemophilus influenzae Rd
ucaauuugcggagaaaac

SEQ ID NO: 684415 - RNA, 13 nt, Haemophilus influenzae Rd
ucaauuugaaaau

SEQ ID NO: 684416 - RNA, 11 nt, Haemophilus influenzae Rd
ucaauuuuaaa

SEQ ID NO: 684417 - RNA, 13 nt, Haemophilus influenzae Rd
ucaauuuuaauug

SEQ ID NO: 684418 - RNA, 17 nt, Haemophilus influenzae Rd
ucaauuuuacguuuuaa

SEQ ID NO: 684419 - RNA, 20 nt, Haemophilus influenzae Rd
ucaauuuuacguuuuaaauu

SEQ ID NO: 684420 - RNA, 21 nt, Haemophilus influenzae Rd
ucaauuuacacauugccauau

SEQ ID NO: 684421 - RNA, 22 nt, Haemophilus influenzae Rd
ucaauugccauaggauuauuca

SEQ ID NO: 684422 - RNA, 15 nt, Haemophilus influenzae Rd
ucaauuuaauaaucu

SEQ ID NO: 684423 - RNA, 17 nt, Haemophilus influenzae Rd
ucaauuuaauaaucuua

SEQ ID NO: 684424 - RNA, 17 nt, Haemophilus influenzae Rd
ucaauuccauaauaucu

SEQ ID NO: 684425 - RNA, 22 nt, Haemophilus influenzae Rd
ucaauuccauaauaucuuucuu

SEQ ID NO: 684426 - RNA, 17 nt, Haemophilus influenzae Rd
ucaauuccuucaaauuc

SEQ ID NO: 684427 - RNA, 16 nt, Haemophilus influenzae Rd
ucaauuccuucaucgu

SEQ ID NO: 684428 - RNA, 12 nt, Haemophilus influenzae Rd
ucaauuccuuua

SEQ ID NO: 684429 - RNA, 13 nt, Haemophilus influenzae Rd
ucaauucuuccca

SEQ ID NO: 684430 - RNA, 16 nt, Haemophilus influenzae Rd
ucaauuaacuauuuaa

SEQ ID NO: 684431 - RNA, 15 nt, Haemophilus influenzae Rd
ucaauuaauggaaug

SEQ ID NO: 684432 - RNA, 14 nt, Haemophilus influenzae Rd
ucaauuaaaugacc

SEQ ID NO: 684433 - RNA, 19 nt, Haemophilus influenzae Rd
ucaauguugcgccaucuaa

SEQ ID NO: 684434 - RNA, 23 nt, Haemophilus influenzae Rd
ucaauuagcaaagaauuaaaaua

SEQ ID NO: 684435 - RNA, 17 nt, Haemophilus influenzae Rd
ucaauuauuuauacuaa

SEQ ID NO: 684436 - RNA, 13 nt, Haemophilus influenzae Rd
ucaauucaucuug

SEQ ID NO: 684437 - RNA, 15 nt, Haemophilus influenzae Rd
ucaauuacauauuua

SEQ ID NO: 684438 - RNA, 22 nt, Haemophilus influenzae Rd
ucaaucaggcuuucauuuucca

SEQ ID NO: 684439 - RNA, 15 nt, Haemophilus influenzae Rd
ucaaucacuucucug

SEQ ID NO: 684440 - RNA, 13 nt, Haemophilus influenzae Rd
ucaaucaucccuu

SEQ ID NO: 684441 - RNA, 15 nt, Haemophilus influenzae Rd
ucaaucauaucauca

SEQ ID NO: 684442 - RNA, 16 nt, Haemophilus influenzae Rd
ucaaucaucauuuauu

SEQ ID NO: 684443 - RNA, 20 nt, Haemophilus influenzae Rd
ucaaucaucauuuauuaaaa

SEQ ID NO: 684444 - RNA, 15 nt, Haemophilus influenzae Rd
ucaaucgguuucaca

SEQ ID NO: 684445 - RNA, 14 nt, Haemophilus influenzae Rd
ucaaugaaauauua

SEQ ID NO: 684446 - RNA, 18 nt, Haemophilus influenzae Rd
ucaaugaaauauuacuaa

SEQ ID NO: 684447 - RNA, 20 nt, Haemophilus influenzae Rd
ucaaucuuuaaaacuauaaa

SEQ ID NO: 684448 - RNA, 20 nt, Haemophilus influenzae Rd
ucaaucucuuuacuguucaa

SEQ ID NO: 684449 - RNA, 14 nt, Haemophilus influenzae Rd
ucaaugcaacaaua

SEQ ID NO: 684450 - RNA, 14 nt, Haemophilus influenzae Rd
ucaaugcagaaaua

SEQ ID NO: 684451 - RNA, 16 nt, Haemophilus influenzae Rd
ucaaugcagaaauacu

SEQ ID NO: 684452 - RNA, 14 nt, Haemophilus influenzae Rd
ucaaugaauuaaaa

SEQ ID NO: 684453 - RNA, 22 nt, Haemophilus influenzae Rd
ucaaugaacuuaugugcaccuu

SEQ ID NO: 684454 - RNA, 21 nt, Haemophilus influenzae Rd
ucaaugggcauccaaaguaca

SEQ ID NO: 684455 - RNA, 20 nt, Haemophilus influenzae Rd
ucaaugccuuuuguauccaa

SEQ ID NO: 684456 - RNA, 20 nt, Haemophilus influenzae Rd
ucaauguuaaguucaucaua

SEQ ID NO: 684457 - RNA, 15 nt, Haemophilus influenzae Rd
ucaaugucuuuuucu

SEQ ID NO: 684458 - RNA, 22 nt, Haemophilus influenzae Rd
ucaaugguguguaaugucuuua

SEQ ID NO: 684459 - RNA, 14 nt, Haemophilus influenzae Rd
ucaaugguuuuacu

SEQ ID NO: 684460 - RNA, 16 nt, Haemophilus influenzae Rd
ucaauggcuuauugcu

SEQ ID NO: 684461 - RNA, 16 nt, Haemophilus influenzae Rd
ucacaccauuuuuaau

SEQ ID NO: 684462 - RNA, 18 nt, Haemophilus influenzae Rd
ucacaccauuuuuaauua

SEQ ID NO: 684463 - RNA, 15 nt, Haemophilus influenzae Rd
ucacacguccaucac

SEQ ID NO: 684464 - RNA, 17 nt, Haemophilus influenzae Rd
ucacaggcccaucauuu

SEQ ID NO: 684465 - RNA, 14 nt, Haemophilus influenzae Rd
ucacagauuucaau

SEQ ID NO: 684466 - RNA, 18 nt, Haemophilus influenzae Rd
ucacagauuucaauuaaa

SEQ ID NO: 684467 - RNA, 15 nt, Haemophilus influenzae Rd
ucacagauuuuuaaa

SEQ ID NO: 684468 - RNA, 20 nt, Haemophilus influenzae Rd
ucacagauuuuuuauuaauu

SEQ ID NO: 684469 - RNA, 22 nt, Haemophilus influenzae Rd
ucacagauuuuuuauuaauuau

SEQ ID NO: 684470 - RNA, 15 nt, Haemophilus influenzae Rd
ucacaaauuuccaua

SEQ ID NO: 684471 - RNA, 14 nt, Haemophilus influenzae Rd
ucacaaaucuaaaa

SEQ ID NO: 684472 - RNA, 18 nt, Haemophilus influenzae Rd
ucacaacauauaaaucuc

SEQ ID NO: 684473 - RNA, 14 nt, Haemophilus influenzae Rd
ucacaauaaaagca

SEQ ID NO: 684474 - RNA, 14 nt, Haemophilus influenzae Rd
ucacaauaagcaau

SEQ ID NO: 684475 - RNA, 12 nt, Haemophilus influenzae Rd
ucacaauaauag

SEQ ID NO: 684476 - RNA, 16 nt, Haemophilus influenzae Rd
ucacaauaauuuucaa

SEQ ID NO: 684477 - RNA, 20 nt, Haemophilus influenzae Rd
ucacaaguuaaaacuugauu

SEQ ID NO: 684478 - RNA, 23 nt, Haemophilus influenzae Rd
ucacaaggcucaucauuaugaaa

SEQ ID NO: 684479 - RNA, 15 nt, Haemophilus influenzae Rd
ucacaacuuuuuaac

SEQ ID NO: 684480 - RNA, 21 nt, Haemophilus influenzae Rd
ucacaauugauguaaaagaua

SEQ ID NO: 684481 - RNA, 22 nt, Haemophilus influenzae Rd
ucacaaucauacacaccaucaa

SEQ ID NO: 684482 - RNA, 24 nt, Haemophilus influenzae Rd
ucacacaguuauacacaaguuaca

SEQ ID NO: 684483 - RNA, 19 nt, Haemophilus influenzae Rd
ucacaucuugaccaucuaa

SEQ ID NO: 684484 - RNA, 23 nt, Haemophilus influenzae Rd
ucacaucgccaacuugaauaccu

SEQ ID NO: 684485 - RNA, 23 nt, Haemophilus influenzae Rd
ucacauauuguuucuucucuuua

SEQ ID NO: 684486 - RNA, 19 nt, Haemophilus influenzae Rd
ucacauaaauuacaaugua

SEQ ID NO: 684487 - RNA, 17 nt, Haemophilus influenzae Rd
ucacaguaccuacauuu

SEQ ID NO: 684488 - RNA, 14 nt, Haemophilus influenzae Rd
ucacaguaaagauu

SEQ ID NO: 684489 - RNA, 14 nt, Haemophilus influenzae Rd
ucacagucuuuuaa

SEQ ID NO: 684490 - RNA, 21 nt, Haemophilus influenzae Rd
ucacagucuuuuaacacauaa

SEQ ID NO: 684491 - RNA, 23 nt, Haemophilus influenzae Rd
ucacaguuggggcuaaaaauauu

SEQ ID NO: 684492 - RNA, 13 nt, Haemophilus influenzae Rd
ucaccacaaaaua

SEQ ID NO: 684493 - RNA, 20 nt, Haemophilus influenzae Rd
ucaccacaaaauaaaugauu

SEQ ID NO: 684494 - RNA, 23 nt, Haemophilus influenzae Rd
ucaccacaaaauaaaugauuauc

SEQ ID NO: 684495 - RNA, 22 nt, Haemophilus influenzae Rd
ucaccaagacuauuaaguucaa

SEQ ID NO: 684496 - RNA, 18 nt, Haemophilus influenzae Rd
ucaccauuuccuuugagc

SEQ ID NO: 684497 - RNA, 12 nt, Haemophilus influenzae Rd
ucaccauaauca

SEQ ID NO: 684498 - RNA, 15 nt, Haemophilus influenzae Rd
ucaccauaucaauuu

SEQ ID NO: 684499 - RNA, 15 nt, Haemophilus influenzae Rd
ucaccagugaauuuc

SEQ ID NO: 684500 - RNA, 18 nt, Haemophilus influenzae Rd
ucaccgccaagcgcugca

SEQ ID NO: 684501 - RNA, 17 nt, Haemophilus influenzae Rd
ucaccgcaauaauaccu

SEQ ID NO: 684502 - RNA, 17 nt, Haemophilus influenzae Rd
ucaccgcacuuaaucac

SEQ ID NO: 684503 - RNA, 17 nt, Haemophilus influenzae Rd
ucaccgcacuuucuucu

SEQ ID NO: 684504 - RNA, 16 nt, Haemophilus influenzae Rd
ucaccgcacuuuucuu

SEQ ID NO: 684505 - RNA, 18 nt, Haemophilus influenzae Rd
ucaccgcacuuuuuacuu

SEQ ID NO: 684506 - RNA, 19 nt, Haemophilus influenzae Rd
ucaccgauaauaugcauca

SEQ ID NO: 684507 - RNA, 14 nt, Haemophilus influenzae Rd
ucaccgcuuuucuc

SEQ ID NO: 684508 - RNA, 18 nt, Haemophilus influenzae Rd
ucaccucgugcuguuuuc

SEQ ID NO: 684509 - RNA, 20 nt, Haemophilus influenzae Rd
ucaccucgugcuguuuucaa

SEQ ID NO: 684510 - RNA, 23 nt, Haemophilus influenzae Rd
ucaccugaagaauacaagcgauu

SEQ ID NO: 684511 - RNA, 13 nt, Haemophilus influenzae Rd
ucaccuucaagua

SEQ ID NO: 684512 - RNA, 20 nt, Haemophilus influenzae Rd
ucacgaucauaaauuuuggu

SEQ ID NO: 684513 - RNA, 19 nt, Haemophilus influenzae Rd
ucacgauaaggcuuauuuu

SEQ ID NO: 684514 - RNA, 16 nt, Haemophilus influenzae Rd
ucacgaccuuuuucag

SEQ ID NO: 684515 - RNA, 16 nt, Haemophilus influenzae Rd
ucacgacccaccacuu

SEQ ID NO: 684516 - RNA, 18 nt, Haemophilus influenzae Rd
ucacgacaaaguggagaa

SEQ ID NO: 684517 - RNA, 19 nt, Haemophilus influenzae Rd
ucacgcucuuuuaucucgg

SEQ ID NO: 684518 - RNA, 19 nt, Haemophilus influenzae Rd
ucacgcugacuuaaugcaa

SEQ ID NO: 684519 - RNA, 21 nt, Haemophilus influenzae Rd
ucacggguuggaagaauguuu

SEQ ID NO: 684520 - RNA, 21 nt, Haemophilus influenzae Rd
ucacggguuugguaagcaaua

SEQ ID NO: 684521 - RNA, 22 nt, Haemophilus influenzae Rd
ucacgguuauaccacauaaaug

SEQ ID NO: 684522 - RNA, 23 nt, Haemophilus influenzae Rd
ucacgguuauaccacauaaaugu

SEQ ID NO: 684523 - RNA, 15 nt, Haemophilus influenzae Rd
ucacgcccaaauacu

SEQ ID NO: 684524 - RNA, 21 nt, Haemophilus influenzae Rd
ucacgauuuuuuuauaaaaaa

SEQ ID NO: 684525 - RNA, 15 nt, Haemophilus influenzae Rd
ucacuggcucauuau

SEQ ID NO: 684526 - RNA, 22 nt, Haemophilus influenzae Rd
ucacuggcguaaaccucgccuu

SEQ ID NO: 684527 - RNA, 17 nt, Haemophilus influenzae Rd
ucacuuaaaccaaauug

SEQ ID NO: 684528 - RNA, 18 nt, Haemophilus influenzae Rd
ucacugcggcaaaaucuu

SEQ ID NO: 684529 - RNA, 15 nt, Haemophilus influenzae Rd
ucacugcauuuucuu

SEQ ID NO: 684530 - RNA, 21 nt, Haemophilus influenzae Rd
ucacugcauuuucuuuuucaa

SEQ ID NO: 684531 - RNA, 23 nt, Haemophilus influenzae Rd
ucacugaauuucauucaaaaaua

SEQ ID NO: 684532 - RNA, 13 nt, Haemophilus influenzae Rd
ucacugauuucac

SEQ ID NO: 684533 - RNA, 18 nt, Haemophilus influenzae Rd
ucacugaauaaugugcaa

SEQ ID NO: 684534 - RNA, 20 nt, Haemophilus influenzae Rd
ucacuucaggguuuucauca

SEQ ID NO: 684535 - RNA, 22 nt, Haemophilus influenzae Rd
ucacuucaggguuuucaucauu

SEQ ID NO: 684536 - RNA, 22 nt, Haemophilus influenzae Rd
ucacuucaucuauauuauacuu

SEQ ID NO: 684537 - RNA, 16 nt, Haemophilus influenzae Rd
ucacuucuaacuaaaa

SEQ ID NO: 684538 - RNA, 19 nt, Haemophilus influenzae Rd
ucacuuggcgaaaaucauc

SEQ ID NO: 684539 - RNA, 23 nt, Haemophilus influenzae Rd
ucacuugugguuauuugauuauc

SEQ ID NO: 684540 - RNA, 21 nt, Haemophilus influenzae Rd
ucacuugaagucuauaaaaga

SEQ ID NO: 684541 - RNA, 15 nt, Haemophilus influenzae Rd
ucacuuucauccucu

SEQ ID NO: 684542 - RNA, 13 nt, Haemophilus influenzae Rd
ucacuuuuaauuc

SEQ ID NO: 684543 - RNA, 16 nt, Haemophilus influenzae Rd
ucacuugauaaaaaug

SEQ ID NO: 684544 - RNA, 19 nt, Haemophilus influenzae Rd
ucacuuuacucggcccauu

SEQ ID NO: 684545 - RNA, 12 nt, Haemophilus influenzae Rd
ucacuaaaaauc

SEQ ID NO: 684546 - RNA, 13 nt, Haemophilus influenzae Rd
ucacuaaauaaau

SEQ ID NO: 684547 - RNA, 19 nt, Haemophilus influenzae Rd
ucacuaaauaaauggucaa

SEQ ID NO: 684548 - RNA, 15 nt, Haemophilus influenzae Rd
ucacguaauacacgg

SEQ ID NO: 684549 - RNA, 14 nt, Haemophilus influenzae Rd
ucacguucaaaaau

SEQ ID NO: 684550 - RNA, 16 nt, Haemophilus influenzae Rd
ucacguguuuuuucac

SEQ ID NO: 684551 - RNA, 17 nt, Haemophilus influenzae Rd
ucacuacguguuaauaa

SEQ ID NO: 684552 - RNA, 22 nt, Haemophilus influenzae Rd
ucacuacgauuuaauguauaaa

SEQ ID NO: 684553 - RNA, 17 nt, Haemophilus influenzae Rd
ucacuacacccucaguu

SEQ ID NO: 684554 - RNA, 17 nt, Haemophilus influenzae Rd
ucacuagccauaaauaa

SEQ ID NO: 684555 - RNA, 19 nt, Haemophilus influenzae Rd
ucacuagccauaaauaaau

SEQ ID NO: 684556 - RNA, 20 nt, Haemophilus influenzae Rd
ucacuacagguugcucgccu

SEQ ID NO: 684557 - RNA, 14 nt, Haemophilus influenzae Rd
ucacuaauuugcuu

SEQ ID NO: 684558 - RNA, 17 nt, Haemophilus influenzae Rd
ucacuauuucaucuuua

SEQ ID NO: 684559 - RNA, 20 nt, Haemophilus influenzae Rd
ucacucaauuuacacauugc

SEQ ID NO: 684560 - RNA, 20 nt, Haemophilus influenzae Rd
ucagacaacgccagaaguug

SEQ ID NO: 684561 - RNA, 15 nt, Haemophilus influenzae Rd
ucagacaaucugugu

SEQ ID NO: 684562 - RNA, 19 nt, Haemophilus influenzae Rd
ucagacuagcaucaaaaua

SEQ ID NO: 684563 - RNA, 20 nt, Haemophilus influenzae Rd
ucagacuagcaucaaaauaa

SEQ ID NO: 684564 - RNA, 20 nt, Haemophilus influenzae Rd
ucacuuuucgcaauuuuaac

SEQ ID NO: 684565 - RNA, 18 nt, Haemophilus influenzae Rd
ucagaaaaagcuuccuuu

SEQ ID NO: 684566 - RNA, 19 nt, Haemophilus influenzae Rd
ucagaaaagacaucacugg

SEQ ID NO: 684567 - RNA, 21 nt, Haemophilus influenzae Rd
ucagaaaguucuaauucauuu

SEQ ID NO: 684568 - RNA, 16 nt, Haemophilus influenzae Rd
ucagaaauaucuucaa

SEQ ID NO: 684569 - RNA, 15 nt, Haemophilus influenzae Rd
ucagaacaagcauuu

SEQ ID NO: 684570 - RNA, 18 nt, Haemophilus influenzae Rd
ucagaacaagcauuuuuc

SEQ ID NO: 684571 - RNA, 19 nt, Haemophilus influenzae Rd
ucagaacaagcauuuuuca

SEQ ID NO: 684572 - RNA, 20 nt, Haemophilus influenzae Rd
ucagaacaagcauuuuucau

SEQ ID NO: 684573 - RNA, 17 nt, Haemophilus influenzae Rd
ucagaaaugaccuucac

SEQ ID NO: 684574 - RNA, 11 nt, Haemophilus influenzae Rd
ucagaauaaag

SEQ ID NO: 684575 - RNA, 17 nt, Haemophilus influenzae Rd
ucagaauaauuaacaaa

SEQ ID NO: 684576 - RNA, 20 nt, Haemophilus influenzae Rd
ucagaauagccgcaaucaca

SEQ ID NO: 684577 - RNA, 21 nt, Haemophilus influenzae Rd
ucagaaguuaaaacuugaaug

SEQ ID NO: 684578 - RNA, 22 nt, Haemophilus influenzae Rd
ucagaagucacauauuguuucu

SEQ ID NO: 684579 - RNA, 20 nt, Haemophilus influenzae Rd
ucagaacugcuuucuuccaa

SEQ ID NO: 684580 - RNA, 15 nt, Haemophilus influenzae Rd
ucagauggaauauuu

SEQ ID NO: 684581 - RNA, 14 nt, Haemophilus influenzae Rd
ucagauugaacgcu

SEQ ID NO: 684582 - RNA, 19 nt, Haemophilus influenzae Rd
ucagauuauguucauuuuc

SEQ ID NO: 684583 - RNA, 22 nt, Haemophilus influenzae Rd
ucagcaaaagacgaagaaacaa

SEQ ID NO: 684584 - RNA, 16 nt, Haemophilus influenzae Rd
ucagcaaaaucacucg

SEQ ID NO: 684585 - RNA, 13 nt, Haemophilus influenzae Rd
ucagcaaaaugcg

SEQ ID NO: 684586 - RNA, 17 nt, Haemophilus influenzae Rd
ucagauaaucaaaaaug

SEQ ID NO: 684587 - RNA, 15 nt, Haemophilus influenzae Rd
ucagauaacguaagu

SEQ ID NO: 684588 - RNA, 18 nt, Haemophilus influenzae Rd
ucagauaacguaaguaau

SEQ ID NO: 684589 - RNA, 23 nt, Haemophilus influenzae Rd
ucagauacuuucuaauuauuuca

SEQ ID NO: 684590 - RNA, 12 nt, Haemophilus influenzae Rd
ucagagcgaaua

SEQ ID NO: 684591 - RNA, 16 nt, Haemophilus influenzae Rd
ucagagccguuugcug

SEQ ID NO: 684592 - RNA, 16 nt, Haemophilus influenzae Rd
ucagagguucgaaucc

SEQ ID NO: 684593 - RNA, 16 nt, Haemophilus influenzae Rd
ucagccgcuuuuugau

SEQ ID NO: 684594 - RNA, 12 nt, Haemophilus influenzae Rd
ucagccuauuuu

SEQ ID NO: 684595 - RNA, 17 nt, Haemophilus influenzae Rd
ucagccacuaauuucac

SEQ ID NO: 684596 - RNA, 12 nt, Haemophilus influenzae Rd
ucagcaucagaa

SEQ ID NO: 684597 - RNA, 20 nt, Haemophilus influenzae Rd
ucagccaaauuuuucuuuuc

SEQ ID NO: 684598 - RNA, 18 nt, Haemophilus influenzae Rd
ucagcaauuucuucagcu

SEQ ID NO: 684599 - RNA, 16 nt, Haemophilus influenzae Rd
ucagcaaguucugcac

SEQ ID NO: 684600 - RNA, 17 nt, Haemophilus influenzae Rd
ucagcaaauuaucugau

SEQ ID NO: 684601 - RNA, 18 nt, Haemophilus influenzae Rd
ucagcaacgguguggaaa

SEQ ID NO: 684602 - RNA, 16 nt, Haemophilus influenzae Rd
ucagcauaauguuugc

SEQ ID NO: 684603 - RNA, 22 nt, Haemophilus influenzae Rd
ucagcauauugaaauuggaauc

SEQ ID NO: 684604 - RNA, 22 nt, Haemophilus influenzae Rd
ucagcacuuucgcuuaaaaauc

SEQ ID NO: 684605 - RNA, 18 nt, Haemophilus influenzae Rd
uaucaaagaauuuuuuca

SEQ ID NO: 684606 - RNA, 19 nt, Haemophilus influenzae Rd
uaucaaagaauuuuuucac

SEQ ID NO: 684607 - RNA, 15 nt, Haemophilus influenzae Rd
uaucaacuaaaaaau

SEQ ID NO: 684608 - RNA, 15 nt, Haemophilus influenzae Rd
uaucaacuaaaucau

SEQ ID NO: 684609 - RNA, 21 nt, Haemophilus influenzae Rd
uaucacuuuuuuauucuccaa

SEQ ID NO: 684610 - RNA, 14 nt, Haemophilus influenzae Rd
uaucacuuaaacca

SEQ ID NO: 684611 - RNA, 15 nt, Haemophilus influenzae Rd
uaucacuuaaaccaa

SEQ ID NO: 684612 - RNA, 17 nt, Haemophilus influenzae Rd
uaucacuucuguaagca

SEQ ID NO: 684613 - RNA, 20 nt, Haemophilus influenzae Rd
uaucacuucuguaagcagcu

SEQ ID NO: 684614 - RNA, 17 nt, Haemophilus influenzae Rd
uaucacgcaccacuuca

SEQ ID NO: 684615 - RNA, 17 nt, Haemophilus influenzae Rd
uaucaaaacuugcuaca

SEQ ID NO: 684616 - RNA, 13 nt, Haemophilus influenzae Rd
uaucaaaaaguug

SEQ ID NO: 684617 - RNA, 20 nt, Haemophilus influenzae Rd
uaucaaacaagcccacauuu

SEQ ID NO: 684618 - RNA, 22 nt, Haemophilus influenzae Rd
uaucaaacaguucaauaaaaau

SEQ ID NO: 684619 - RNA, 17 nt, Haemophilus influenzae Rd
uauauuuuaucaacuaa

SEQ ID NO: 684620 - RNA, 22 nt, Haemophilus influenzae Rd
uauauuuuaucaacuaaaaaau

SEQ ID NO: 684621 - RNA, 20 nt, Haemophilus influenzae Rd
uauauuucggcauaauggca

SEQ ID NO: 684622 - RNA, 14 nt, Haemophilus influenzae Rd
uauauuuugaauaa

SEQ ID NO: 684623 - RNA, 12 nt, Haemophilus influenzae Rd
uauauuuuuaau

SEQ ID NO: 684624 - RNA, 12 nt, Haemophilus influenzae Rd
uauauuucuaau

SEQ ID NO: 684625 - RNA, 13 nt, Haemophilus influenzae Rd
uauauuucuaaua

SEQ ID NO: 684626 - RNA, 19 nt, Haemophilus influenzae Rd
uauauuucuuuucaaacac

SEQ ID NO: 684627 - RNA, 21 nt, Haemophilus influenzae Rd
uauauuugaguuauuuuuaau

SEQ ID NO: 684628 - RNA, 15 nt, Haemophilus influenzae Rd
uauauuucacuggcu

SEQ ID NO: 684629 - RNA, 16 nt, Haemophilus influenzae Rd
uauaugccuaaaaaga

SEQ ID NO: 684630 - RNA, 19 nt, Haemophilus influenzae Rd
uauaugguucauuauuaau

SEQ ID NO: 684631 - RNA, 23 nt, Haemophilus influenzae Rd
uauaaugcaccgcacacaacgac

SEQ ID NO: 684632 - RNA, 18 nt, Haemophilus influenzae Rd
uauaaucuccauaauauu

SEQ ID NO: 684633 - RNA, 20 nt, Haemophilus influenzae Rd
uauaaucuucucuagucuug

SEQ ID NO: 684634 - RNA, 15 nt, Haemophilus influenzae Rd
uauaaucuuuaaaau

SEQ ID NO: 684635 - RNA, 15 nt, Haemophilus influenzae Rd
uauaaucuuuaaauu

SEQ ID NO: 684636 - RNA, 16 nt, Haemophilus influenzae Rd
uauaaucuuuaaauuu

SEQ ID NO: 684637 - RNA, 15 nt, Haemophilus influenzae Rd
uauaaucaauuauuu

SEQ ID NO: 684638 - RNA, 19 nt, Haemophilus influenzae Rd
uauaaucaauuauuucagc

SEQ ID NO: 684639 - RNA, 15 nt, Haemophilus influenzae Rd
uauaaguuuuuugcc

SEQ ID NO: 684640 - RNA, 14 nt, Haemophilus influenzae Rd
uauagugauuauuu

SEQ ID NO: 684641 - RNA, 14 nt, Haemophilus influenzae Rd
uauaguauauuuau

SEQ ID NO: 684642 - RNA, 17 nt, Haemophilus influenzae Rd
uauagucauucaaugca

SEQ ID NO: 684643 - RNA, 13 nt, Haemophilus influenzae Rd
uauauaaacaauu

SEQ ID NO: 684644 - RNA, 16 nt, Haemophilus influenzae Rd
uauaguuuuauuuuaa

SEQ ID NO: 684645 - RNA, 17 nt, Haemophilus influenzae Rd
uauaguuuuauuuuaau

SEQ ID NO: 684646 - RNA, 19 nt, Haemophilus influenzae Rd
uauaguuuuauuuuaauuu

SEQ ID NO: 684647 - RNA, 13 nt, Haemophilus influenzae Rd
uauauaaaaaacc

SEQ ID NO: 684648 - RNA, 21 nt, Haemophilus influenzae Rd
uauauaaaaaacccgcuuauu

SEQ ID NO: 684649 - RNA, 19 nt, Haemophilus influenzae Rd
uauauaauuuaacauaacu

SEQ ID NO: 684650 - RNA, 13 nt, Haemophilus influenzae Rd
uauauaaauaacu

SEQ ID NO: 684651 - RNA, 12 nt, Haemophilus influenzae Rd
uauauaaauccg

SEQ ID NO: 684652 - RNA, 14 nt, Haemophilus influenzae Rd
uauauaaauuuaga

SEQ ID NO: 684653 - RNA, 11 nt, Haemophilus influenzae Rd
uauauccaaau

SEQ ID NO: 684654 - RNA, 15 nt, Haemophilus influenzae Rd
uauaucacagauuuu

SEQ ID NO: 684655 - RNA, 20 nt, Haemophilus influenzae Rd
uauaucacagauuuuuaaau

SEQ ID NO: 684656 - RNA, 18 nt, Haemophilus influenzae Rd
uauaucacagauuuuuua

SEQ ID NO: 684657 - RNA, 16 nt, Haemophilus influenzae Rd
uauauauuaaaaaaau

SEQ ID NO: 684658 - RNA, 14 nt, Haemophilus influenzae Rd
uauauauuuuccua

SEQ ID NO: 684659 - RNA, 15 nt, Haemophilus influenzae Rd
uauccaucaagaaag

SEQ ID NO: 684660 - RNA, 13 nt, Haemophilus influenzae Rd
uauccaccacaau

SEQ ID NO: 684661 - RNA, 12 nt, Haemophilus influenzae Rd
uauccacuucau

SEQ ID NO: 684662 - RNA, 14 nt, Haemophilus influenzae Rd
uauccaccagcaca

SEQ ID NO: 684663 - RNA, 18 nt, Haemophilus influenzae Rd
uauccauuucuaaaggca

SEQ ID NO: 684664 - RNA, 17 nt, Haemophilus influenzae Rd
uaucccaacagaaaauu

SEQ ID NO: 684665 - RNA, 19 nt, Haemophilus influenzae Rd
uaucccaacagaaaauuug

SEQ ID NO: 684666 - RNA, 14 nt, Haemophilus influenzae Rd
uaucccaaauuaaa

SEQ ID NO: 684667 - RNA, 18 nt, Haemophilus influenzae Rd
uauccaagaaguuuucca

SEQ ID NO: 684668 - RNA, 21 nt, Haemophilus influenzae Rd
uauccacauaaccaaagggca

SEQ ID NO: 684669 - RNA, 22 nt, Haemophilus influenzae Rd
uauccaaaauuaaauugaaaaa

SEQ ID NO: 684670 - RNA, 22 nt, Haemophilus influenzae Rd
uaucauuuaacggggauuuuuu

SEQ ID NO: 684671 - RNA, 13 nt, Haemophilus influenzae Rd
uaucauuuaacuu

SEQ ID NO: 684672 - RNA, 18 nt, Haemophilus influenzae Rd
uaucauuuaauaauuuag

SEQ ID NO: 684673 - RNA, 13 nt, Haemophilus influenzae Rd
uaucagauuuagg

SEQ ID NO: 684674 - RNA, 23 nt, Haemophilus influenzae Rd
uaucagauuuaggcaauaaaaaa

SEQ ID NO: 684675 - RNA, 21 nt, Haemophilus influenzae Rd
uaucauugcuccacuucuuau

SEQ ID NO: 684676 - RNA, 19 nt, Haemophilus influenzae Rd
uaucggagggggauuuucu

SEQ ID NO: 684677 - RNA, 13 nt, Haemophilus influenzae Rd
uaucggauucuga

SEQ ID NO: 684678 - RNA, 15 nt, Haemophilus influenzae Rd
uaucgcccauucuac

SEQ ID NO: 684679 - RNA, 16 nt, Haemophilus influenzae Rd
uauccuguuguuuuuu

SEQ ID NO: 684680 - RNA, 15 nt, Haemophilus influenzae Rd
uauccuauaaaacaa

SEQ ID NO: 684681 - RNA, 17 nt, Haemophilus influenzae Rd
uauccuauuaauuuaau

SEQ ID NO: 684682 - RNA, 23 nt, Haemophilus influenzae Rd
uaucguguaaaaguuguuuugcu

SEQ ID NO: 684683 - RNA, 15 nt, Haemophilus influenzae Rd
uaucguagguuuuuu

SEQ ID NO: 684684 - RNA, 14 nt, Haemophilus influenzae Rd
uaucgucuaucuaa

SEQ ID NO: 684685 - RNA, 17 nt, Haemophilus influenzae Rd
uaucgucuuguuuucaa

SEQ ID NO: 684686 - RNA, 19 nt, Haemophilus influenzae Rd
uaucgucaaauuuaaauag

SEQ ID NO: 684687 - RNA, 22 nt, Haemophilus influenzae Rd
uaucggcaaucaauucaucuug

SEQ ID NO: 684688 - RNA, 20 nt, Haemophilus influenzae Rd
uaucucauccacuaaaccau

SEQ ID NO: 684689 - RNA, 19 nt, Haemophilus influenzae Rd
uaucucgaauaucgacuaa

SEQ ID NO: 684690 - RNA, 22 nt, Haemophilus influenzae Rd
uaucucgaauaucgacuaauau

SEQ ID NO: 684691 - RNA, 17 nt, Haemophilus influenzae Rd
uaucuauuggauaaauu

SEQ ID NO: 684692 - RNA, 18 nt, Haemophilus influenzae Rd
uaucuaaaauauaacauu

SEQ ID NO: 684693 - RNA, 18 nt, Haemophilus influenzae Rd
uaucuauugagauuuaau

SEQ ID NO: 684694 - RNA, 21 nt, Haemophilus influenzae Rd
uauguuuaccaccgauaaaca

SEQ ID NO: 684695 - RNA, 14 nt, Haemophilus influenzae Rd
uauguugcuuuuau

SEQ ID NO: 684696 - RNA, 13 nt, Haemophilus influenzae Rd
uauuaaaaacuaa

SEQ ID NO: 684697 - RNA, 18 nt, Haemophilus influenzae Rd
uauuaaaaauauaaccgc

SEQ ID NO: 684698 - RNA, 20 nt, Haemophilus influenzae Rd
uauguuuugauaaccuauca

SEQ ID NO: 684699 - RNA, 14 nt, Haemophilus influenzae Rd
uauguuuuguagau

SEQ ID NO: 684700 - RNA, 18 nt, Haemophilus influenzae Rd
uauguuugcaucaaucau

SEQ ID NO: 684701 - RNA, 23 nt, Haemophilus influenzae Rd
uauguuugcaucaaucauuaacu

SEQ ID NO: 684702 - RNA, 14 nt, Haemophilus influenzae Rd
uaugugaauaaaau

SEQ ID NO: 684703 - RNA, 22 nt, Haemophilus influenzae Rd
uauguggaucaugguaauuuaa

SEQ ID NO: 684704 - RNA, 20 nt, Haemophilus influenzae Rd
uauggugggcuggguagaaa

SEQ ID NO: 684705 - RNA, 17 nt, Haemophilus influenzae Rd
uaugguucauuauuaau

SEQ ID NO: 684706 - RNA, 12 nt, Haemophilus influenzae Rd
uauguaaauaag

SEQ ID NO: 684707 - RNA, 20 nt, Haemophilus influenzae Rd
uauguaaauaaggaauuuua

SEQ ID NO: 684708 - RNA, 16 nt, Haemophilus influenzae Rd
uaugguaauuagccuu

SEQ ID NO: 684709 - RNA, 12 nt, Haemophilus influenzae Rd
uauggggcugua

SEQ ID NO: 684710 - RNA, 13 nt, Haemophilus influenzae Rd
uauguauuuucaa

SEQ ID NO: 684711 - RNA, 19 nt, Haemophilus influenzae Rd
uauguauaauuccuaaaau

SEQ ID NO: 684712 - RNA, 16 nt, Haemophilus influenzae Rd
uaugucguuucugugg

SEQ ID NO: 684713 - RNA, 23 nt, Haemophilus influenzae Rd
uauguagcaguugcuaaaucacc

SEQ ID NO: 684714 - RNA, 18 nt, Haemophilus influenzae Rd
uaugccuacuuuuuauuu

SEQ ID NO: 684715 - RNA, 13 nt, Haemophilus influenzae Rd
uaugccauaaaau

SEQ ID NO: 684716 - RNA, 13 nt, Haemophilus influenzae Rd
uaugccaaucaca

SEQ ID NO: 684717 - RNA, 23 nt, Haemophilus influenzae Rd
uauggaucacccauuaaauaaaa

SEQ ID NO: 684718 - RNA, 22 nt, Haemophilus influenzae Rd
uauggauauuguaggaagacag

SEQ ID NO: 684719 - RNA, 19 nt, Haemophilus influenzae Rd
uauggagggggauaacgac

SEQ ID NO: 684720 - RNA, 22 nt, Haemophilus influenzae Rd
uauggcuugugcuauacaaaau

SEQ ID NO: 684721 - RNA, 12 nt, Haemophilus influenzae Rd
uauggcguucac

SEQ ID NO: 684722 - RNA, 21 nt, Haemophilus influenzae Rd
uauggcucuaaauuaauuuac

SEQ ID NO: 684723 - RNA, 19 nt, Haemophilus influenzae Rd
uauggcaaugaauaaacag

SEQ ID NO: 684724 - RNA, 17 nt, Haemophilus influenzae Rd
uaugcuuucagauaacg

SEQ ID NO: 684725 - RNA, 13 nt, Haemophilus influenzae Rd
uaugcuuaucauu

SEQ ID NO: 684726 - RNA, 23 nt, Haemophilus influenzae Rd
uaugacuuagggcucaaaucuac

SEQ ID NO: 684727 - RNA, 15 nt, Haemophilus influenzae Rd
uaugauaaaugcaau

SEQ ID NO: 684728 - RNA, 13 nt, Haemophilus influenzae Rd
uaugaccaaauac

SEQ ID NO: 684729 - RNA, 17 nt, Haemophilus influenzae Rd
uaugaccaaauacaauu

SEQ ID NO: 684730 - RNA, 14 nt, Haemophilus influenzae Rd
uaugaccauuaauc

SEQ ID NO: 684731 - RNA, 19 nt, Haemophilus influenzae Rd
uaugcaaaguauuuuucua

SEQ ID NO: 684732 - RNA, 20 nt, Haemophilus influenzae Rd
uaugauuuagaacaauauuu

SEQ ID NO: 684733 - RNA, 18 nt, Haemophilus influenzae Rd
uaugauuucuucaaagcu

SEQ ID NO: 684734 - RNA, 20 nt, Haemophilus influenzae Rd
uaucuggauguuguaaaaua

SEQ ID NO: 684735 - RNA, 17 nt, Haemophilus influenzae Rd
uaucuuuauuauuucug

SEQ ID NO: 684736 - RNA, 19 nt, Haemophilus influenzae Rd
uaucuuuacccuauuacuu

SEQ ID NO: 684737 - RNA, 21 nt, Haemophilus influenzae Rd
uaucuuugauuuucuuauuaa

SEQ ID NO: 684738 - RNA, 22 nt, Haemophilus influenzae Rd
uaucuucuucuuggcaauauuu

SEQ ID NO: 684739 - RNA, 18 nt, Haemophilus influenzae Rd
uaugaauaagcgaaaaac

SEQ ID NO: 684740 - RNA, 21 nt, Haemophilus influenzae Rd
uaugaauaagcgaaaaacaua

SEQ ID NO: 684741 - RNA, 22 nt, Haemophilus influenzae Rd
uaugaacuuguucgucaccgua

SEQ ID NO: 684742 - RNA, 22 nt, Haemophilus influenzae Rd
uaugaagaaagaucuucggauu

SEQ ID NO: 684743 - RNA, 20 nt, Haemophilus influenzae Rd
uaugaagacuaaacagaauu

SEQ ID NO: 684744 - RNA, 23 nt, Haemophilus influenzae Rd
uaugaaaacgcgagguugaagua

SEQ ID NO: 684745 - RNA, 21 nt, Haemophilus influenzae Rd
uaucuuuugguaaauacuguu

SEQ ID NO: 684746 - RNA, 21 nt, Haemophilus influenzae Rd
uaugaaacgcgaguaaaauaa

SEQ ID NO: 684747 - RNA, 15 nt, Haemophilus influenzae Rd
uaugaaaaauaauca

SEQ ID NO: 684748 - RNA, 16 nt, Haemophilus influenzae Rd
uaugaaaaauaaucau

SEQ ID NO: 684749 - RNA, 20 nt, Haemophilus influenzae Rd
uaugaaaaaugcuuguucug

SEQ ID NO: 684750 - RNA, 19 nt, Haemophilus influenzae Rd
uaugaaagccaaugcggcu

SEQ ID NO: 684751 - RNA, 15 nt, Haemophilus influenzae Rd
uaugaaauaaagaaa

SEQ ID NO: 684752 - RNA, 15 nt, Haemophilus influenzae Rd
uaugaaaucaaggac

SEQ ID NO: 684753 - RNA, 14 nt, Haemophilus influenzae Rd
uaugaaauuucuuu

SEQ ID NO: 684754 - RNA, 17 nt, Haemophilus influenzae Rd
uagaaaacaauaaaaaa

SEQ ID NO: 684755 - RNA, 23 nt, Haemophilus influenzae Rd
uagaaaauauaauuaaucugcac

SEQ ID NO: 684756 - RNA, 22 nt, Haemophilus influenzae Rd
uagaaaaucacuucucgucuuu

SEQ ID NO: 684757 - RNA, 14 nt, Haemophilus influenzae Rd
uagaugaaauuuau

SEQ ID NO: 684758 - RNA, 20 nt, Haemophilus influenzae Rd
uagaugaaauuuauuauaaa

SEQ ID NO: 684759 - RNA, 22 nt, Haemophilus influenzae Rd
uagaugaaauuuauuauaaaaa

SEQ ID NO: 684760 - RNA, 18 nt, Haemophilus influenzae Rd
uagaugaauuagaaaaau

SEQ ID NO: 684761 - RNA, 23 nt, Haemophilus influenzae Rd
uagauguaaccuuucgggaugug

SEQ ID NO: 684762 - RNA, 18 nt, Haemophilus influenzae Rd
uagaugugccauguacau

SEQ ID NO: 684763 - RNA, 22 nt, Haemophilus influenzae Rd
uagaugugccauguacauuaau

SEQ ID NO: 684764 - RNA, 14 nt, Haemophilus influenzae Rd
uagaugauuuuaaa

SEQ ID NO: 684765 - RNA, 19 nt, Haemophilus influenzae Rd
uagaugauuuuaaaauaaa

SEQ ID NO: 684766 - RNA, 22 nt, Haemophilus influenzae Rd
uagaugauuuuaaaauaaauuu

SEQ ID NO: 684767 - RNA, 18 nt, Haemophilus influenzae Rd
uagaugauuuuaaaguaa

SEQ ID NO: 684768 - RNA, 19 nt, Haemophilus influenzae Rd
uagaugauuuuaaaguaaa

SEQ ID NO: 684769 - RNA, 20 nt, Haemophilus influenzae Rd
uagaugauuuuaaaguaaau

SEQ ID NO: 684770 - RNA, 21 nt, Haemophilus influenzae Rd
uagauuuucuucaucauacaa

SEQ ID NO: 684771 - RNA, 19 nt, Haemophilus influenzae Rd
uagauuucuguuaaaucua

SEQ ID NO: 684772 - RNA, 13 nt, Haemophilus influenzae Rd
uagauuugugaac

SEQ ID NO: 684773 - RNA, 21 nt, Haemophilus influenzae Rd
uagauuuaagcaauaaacaaa

SEQ ID NO: 684774 - RNA, 22 nt, Haemophilus influenzae Rd
uagauuuaagcuuauuucacuu

SEQ ID NO: 684775 - RNA, 16 nt, Haemophilus influenzae Rd
uagauuuaauaucuuc

SEQ ID NO: 684776 - RNA, 21 nt, Haemophilus influenzae Rd
uagauuuaauaucuucuaaua

SEQ ID NO: 684777 - RNA, 16 nt, Haemophilus influenzae Rd
uagauucggcuaaaac

SEQ ID NO: 684778 - RNA, 19 nt, Haemophilus influenzae Rd
uagauucggcuaaaacaga

SEQ ID NO: 684779 - RNA, 19 nt, Haemophilus influenzae Rd
uagauuggauggagagaau

SEQ ID NO: 684780 - RNA, 19 nt, Haemophilus influenzae Rd
uagauugugaaauuucaua

SEQ ID NO: 684781 - RNA, 16 nt, Haemophilus influenzae Rd
uagauuacgcuuuacu

SEQ ID NO: 684782 - RNA, 18 nt, Haemophilus influenzae Rd
uagauuacuuuuagauaa

SEQ ID NO: 684783 - RNA, 22 nt, Haemophilus influenzae Rd
uagauuacuuuuagauaaauuu

SEQ ID NO: 684784 - RNA, 19 nt, Haemophilus influenzae Rd
uagauuaucgccuaaaauu

SEQ ID NO: 684785 - RNA, 19 nt, Haemophilus influenzae Rd
uagcaagaacaauuaauac

SEQ ID NO: 684786 - RNA, 15 nt, Haemophilus influenzae Rd
uagcaggagaaagcu

SEQ ID NO: 684787 - RNA, 17 nt, Haemophilus influenzae Rd
uagcaacaccaccagcg

SEQ ID NO: 684788 - RNA, 20 nt, Haemophilus influenzae Rd
uagcaaacuagguaauaauc

SEQ ID NO: 684789 - RNA, 16 nt, Haemophilus influenzae Rd
uagauuuuuuacucaa

SEQ ID NO: 684790 - RNA, 19 nt, Haemophilus influenzae Rd
uagcaaaacaagacaaaau

SEQ ID NO: 684791 - RNA, 15 nt, Haemophilus influenzae Rd
uagcaucugauuuuc

SEQ ID NO: 684792 - RNA, 18 nt, Haemophilus influenzae Rd
uagcaucugauuuucagg

SEQ ID NO: 684793 - RNA, 21 nt, Haemophilus influenzae Rd
uagcauuuaaauauuaucuuc

SEQ ID NO: 684794 - RNA, 15 nt, Haemophilus influenzae Rd
uagccccaaauuacu

SEQ ID NO: 684795 - RNA, 22 nt, Haemophilus influenzae Rd
uagcccaccaauuaaccauaaa

SEQ ID NO: 684796 - RNA, 17 nt, Haemophilus influenzae Rd
uagccauuuuggaaugg

SEQ ID NO: 684797 - RNA, 16 nt, Haemophilus influenzae Rd
uagcccgaaaauuaag

SEQ ID NO: 684798 - RNA, 14 nt, Haemophilus influenzae Rd
uagcggauaaaaua

SEQ ID NO: 684799 - RNA, 18 nt, Haemophilus influenzae Rd
uagcgcuguuacuucuuu

SEQ ID NO: 684800 - RNA, 18 nt, Haemophilus influenzae Rd
uagcggauucugcuacuu

SEQ ID NO: 684801 - RNA, 12 nt, Haemophilus influenzae Rd
uagcguaaacau

SEQ ID NO: 684802 - RNA, 23 nt, Haemophilus influenzae Rd
uagcguaaacauuuuguaucuaa

SEQ ID NO: 684803 - RNA, 17 nt, Haemophilus influenzae Rd
uagcguaguauggcaag

SEQ ID NO: 684804 - RNA, 13 nt, Haemophilus influenzae Rd
uagcguauuuugu

SEQ ID NO: 684805 - RNA, 13 nt, Haemophilus influenzae Rd
uagcgcaaucaac

SEQ ID NO: 684806 - RNA, 13 nt, Haemophilus influenzae Rd
uaggcaaaaacac

SEQ ID NO: 684807 - RNA, 19 nt, Haemophilus influenzae Rd
uaggaugaaauuugaauau

SEQ ID NO: 684808 - RNA, 17 nt, Haemophilus influenzae Rd
uaggauuuggcacuaaa

SEQ ID NO: 684809 - RNA, 21 nt, Haemophilus influenzae Rd
uaggcaucaaaauucaaaaug

SEQ ID NO: 684810 - RNA, 23 nt, Haemophilus influenzae Rd
uaggcauuuagagggauaaaaau

SEQ ID NO: 684811 - RNA, 14 nt, Haemophilus influenzae Rd
uaggcuaauuauuu

SEQ ID NO: 684812 - RNA, 18 nt, Haemophilus influenzae Rd
uagcuucaagcugcauuu

SEQ ID NO: 684813 - RNA, 23 nt, Haemophilus influenzae Rd
uaggaauuugaucacgaguaaua

SEQ ID NO: 684814 - RNA, 18 nt, Haemophilus influenzae Rd
uagcuuccgcuuuuuucg

SEQ ID NO: 684815 - RNA, 13 nt, Haemophilus influenzae Rd
uaggacuaaauca

SEQ ID NO: 684816 - RNA, 21 nt, Haemophilus influenzae Rd
uaggacauagccuuuuucuuu

SEQ ID NO: 684817 - RNA, 18 nt, Haemophilus influenzae Rd
uagcugucucauuuugcu

SEQ ID NO: 684818 - RNA, 17 nt, Haemophilus influenzae Rd
uagcuuaccuuaauuaa

SEQ ID NO: 684819 - RNA, 21 nt, Haemophilus influenzae Rd
uagcuuaccuuaauuaaucuu

SEQ ID NO: 684820 - RNA, 16 nt, Haemophilus influenzae Rd
uauaaguucuaaauaa

SEQ ID NO: 684821 - RNA, 19 nt, Haemophilus influenzae Rd
uauaaguuauuuauauaau

SEQ ID NO: 684822 - RNA, 18 nt, Haemophilus influenzae Rd
uauaaguuauuuuuacaa

SEQ ID NO: 684823 - RNA, 18 nt, Haemophilus influenzae Rd
uauaagugccaacaauau

SEQ ID NO: 684824 - RNA, 21 nt, Haemophilus influenzae Rd
uauaagugccaacaauaucac

SEQ ID NO: 684825 - RNA, 13 nt, Haemophilus influenzae Rd
uauaacuuaaauc

SEQ ID NO: 684826 - RNA, 19 nt, Haemophilus influenzae Rd
uauaacuuaaaucaacuug

SEQ ID NO: 684827 - RNA, 18 nt, Haemophilus influenzae Rd
uauaagaguuuccuuaua

SEQ ID NO: 684828 - RNA, 21 nt, Haemophilus influenzae Rd
uauaagaaaaguuuuauauuu

SEQ ID NO: 684829 - RNA, 17 nt, Haemophilus influenzae Rd
uauaagaaaauuaucug

SEQ ID NO: 684830 - RNA, 15 nt, Haemophilus influenzae Rd
uauaagaaauaaucg

SEQ ID NO: 684831 - RNA, 14 nt, Haemophilus influenzae Rd
uauaagauuaauga

SEQ ID NO: 684832 - RNA, 18 nt, Haemophilus influenzae Rd
uauaagccgcaccaauaa

SEQ ID NO: 684833 - RNA, 17 nt, Haemophilus influenzae Rd
uauaagcuauuuacugu

SEQ ID NO: 684834 - RNA, 14 nt, Haemophilus influenzae Rd
uauaacauuuauuu

SEQ ID NO: 684835 - RNA, 22 nt, Haemophilus influenzae Rd
uauaacauuuauuuuucuuaug

SEQ ID NO: 684836 - RNA, 12 nt, Haemophilus influenzae Rd
uauaacaaauag

SEQ ID NO: 684837 - RNA, 17 nt, Haemophilus influenzae Rd
uauaacaaguuagaugc

SEQ ID NO: 684838 - RNA, 17 nt, Haemophilus influenzae Rd
uauaaccacguaauucu

SEQ ID NO: 684839 - RNA, 20 nt, Haemophilus influenzae Rd
uauaacuaggcaucaaaauu

SEQ ID NO: 684840 - RNA, 16 nt, Haemophilus influenzae Rd
uauaacguuuaaaaau

SEQ ID NO: 684841 - RNA, 19 nt, Haemophilus influenzae Rd
uauaacguuuaaaaauuaa

SEQ ID NO: 684842 - RNA, 20 nt, Haemophilus influenzae Rd
uauaacguuuaaaaauuaau

SEQ ID NO: 684843 - RNA, 14 nt, Haemophilus influenzae Rd
uaguucaucaucau

SEQ ID NO: 684844 - RNA, 20 nt, Haemophilus influenzae Rd
uagugccaaucaagauaacu

SEQ ID NO: 684845 - RNA, 16 nt, Haemophilus influenzae Rd
uagugcugcuguuuua

SEQ ID NO: 684846 - RNA, 19 nt, Haemophilus influenzae Rd
uaguucuucaaauugcaaa

SEQ ID NO: 684847 - RNA, 14 nt, Haemophilus influenzae Rd
uaguucuuccuugg

SEQ ID NO: 684848 - RNA, 19 nt, Haemophilus influenzae Rd
uauaaaaauuauuuucuag

SEQ ID NO: 684849 - RNA, 13 nt, Haemophilus influenzae Rd
uauaaaauaaaau

SEQ ID NO: 684850 - RNA, 17 nt, Haemophilus influenzae Rd
uaguuggguaaucaaau

SEQ ID NO: 684851 - RNA, 19 nt, Haemophilus influenzae Rd
uaguuggguaaucaaauuc

SEQ ID NO: 684852 - RNA, 22 nt, Haemophilus influenzae Rd
uaguugguaaagauuguuuuuu

SEQ ID NO: 684853 - RNA, 16 nt, Haemophilus influenzae Rd
uaguugcgguggugaa

SEQ ID NO: 684854 - RNA, 21 nt, Haemophilus influenzae Rd
uaguuguuucaccauuuccuu

SEQ ID NO: 684855 - RNA, 17 nt, Haemophilus influenzae Rd
uaguuguuuuaguucua

SEQ ID NO: 684856 - RNA, 15 nt, Haemophilus influenzae Rd
uaguuuacuuuugau

SEQ ID NO: 684857 - RNA, 13 nt, Haemophilus influenzae Rd
uaguuuauaaaaa

SEQ ID NO: 684858 - RNA, 17 nt, Haemophilus influenzae Rd
uaguuuauaaaaaaauc

SEQ ID NO: 684859 - RNA, 17 nt, Haemophilus influenzae Rd
uaguuuauuaauuugcu

SEQ ID NO: 684860 - RNA, 15 nt, Haemophilus influenzae Rd
uagucauucaaugca

SEQ ID NO: 684861 - RNA, 19 nt, Haemophilus influenzae Rd
uagucauauugauuucucu

SEQ ID NO: 684862 - RNA, 23 nt, Haemophilus influenzae Rd
uagucccgcuuuugccauauuua

SEQ ID NO: 684863 - RNA, 16 nt, Haemophilus influenzae Rd
uaguccuuaauuuaau

SEQ ID NO: 684864 - RNA, 21 nt, Haemophilus influenzae Rd
uagucgaaaucauaaucugaa

SEQ ID NO: 684865 - RNA, 22 nt, Haemophilus influenzae Rd
uagugauuucuauguuauuaaa

SEQ ID NO: 684866 - RNA, 20 nt, Haemophilus influenzae Rd
uaguaucagcuguugcaaug

SEQ ID NO: 684867 - RNA, 18 nt, Haemophilus influenzae Rd
uaguaguuagaauuuuaa

SEQ ID NO: 684868 - RNA, 21 nt, Haemophilus influenzae Rd
uaguagagucauuuacagguu

SEQ ID NO: 684869 - RNA, 19 nt, Haemophilus influenzae Rd
uagucacagaaccuaaugc

SEQ ID NO: 684870 - RNA, 15 nt, Haemophilus influenzae Rd
uaggcuuaauucuug

SEQ ID NO: 684871 - RNA, 13 nt, Haemophilus influenzae Rd
uaggcuuaucuac

SEQ ID NO: 684872 - RNA, 21 nt, Haemophilus influenzae Rd
uaggcuauaaagagauuauuu

SEQ ID NO: 684873 - RNA, 17 nt, Haemophilus influenzae Rd
uaggcuauuuuauaauu

SEQ ID NO: 684874 - RNA, 13 nt, Haemophilus influenzae Rd
uagguuaauaguu

SEQ ID NO: 684875 - RNA, 16 nt, Haemophilus influenzae Rd
uagguuuaaaagauac

SEQ ID NO: 684876 - RNA, 23 nt, Haemophilus influenzae Rd
uaguaaauaacacaucagaaaau

SEQ ID NO: 684877 - RNA, 14 nt, Haemophilus influenzae Rd
uaguaaagaauauu

SEQ ID NO: 684878 - RNA, 16 nt, Haemophilus influenzae Rd
uaguaaauuuuccaau

SEQ ID NO: 684879 - RNA, 23 nt, Haemophilus influenzae Rd
uaguaacuguucgguuuuuugau

SEQ ID NO: 684880 - RNA, 13 nt, Haemophilus influenzae Rd
uagguuuuguauu

SEQ ID NO: 684881 - RNA, 17 nt, Haemophilus influenzae Rd
uaguaaaaauuguugau

SEQ ID NO: 684882 - RNA, 17 nt, Haemophilus influenzae Rd
uaguaaaaaaucaagcc

SEQ ID NO: 684883 - RNA, 12 nt, Haemophilus influenzae Rd
uaguaaaauaau

SEQ ID NO: 684884 - RNA, 20 nt, Haemophilus influenzae Rd
uaguaaacacuuaaauaguu

SEQ ID NO: 684885 - RNA, 13 nt, Haemophilus influenzae Rd
uaguaaacuuuua

SEQ ID NO: 684886 - RNA, 12 nt, Haemophilus influenzae Rd
uaguaaagaaau

SEQ ID NO: 684887 - RNA, 12 nt, Haemophilus influenzae Rd
uaguaaggcacu

SEQ ID NO: 684888 - RNA, 14 nt, Haemophilus influenzae Rd
uaguaauauagcaa

SEQ ID NO: 684889 - RNA, 12 nt, Haemophilus influenzae Rd
uaguaauuggca

SEQ ID NO: 684890 - RNA, 17 nt, Haemophilus influenzae Rd
uaguaauuuuaauucuu

SEQ ID NO: 684891 - RNA, 14 nt, Haemophilus influenzae Rd
uacgaucugcaucu

SEQ ID NO: 684892 - RNA, 18 nt, Haemophilus influenzae Rd
uacggcguagaaugcaaa

SEQ ID NO: 684893 - RNA, 18 nt, Haemophilus influenzae Rd
uacggcuaaacgaucuaa

SEQ ID NO: 684894 - RNA, 18 nt, Haemophilus influenzae Rd
uacggauaauuucccuaa

SEQ ID NO: 684895 - RNA, 17 nt, Haemophilus influenzae Rd
uacggaugcaauccacu

SEQ ID NO: 684896 - RNA, 15 nt, Haemophilus influenzae Rd
uacggcaaacuaaag

SEQ ID NO: 684897 - RNA, 18 nt, Haemophilus influenzae Rd
uacggcaaauuaaaucac

SEQ ID NO: 684898 - RNA, 15 nt, Haemophilus influenzae Rd
uacguaguacaucau

SEQ ID NO: 684899 - RNA, 21 nt, Haemophilus influenzae Rd
uacguagaaaacaauaaaaaa

SEQ ID NO: 684900 - RNA, 16 nt, Haemophilus influenzae Rd
uacgggauuuuuucgc

SEQ ID NO: 684901 - RNA, 16 nt, Haemophilus influenzae Rd
uaccuaaguuuugguc

SEQ ID NO: 684902 - RNA, 13 nt, Haemophilus influenzae Rd
uaccuaauggaua

SEQ ID NO: 684903 - RNA, 20 nt, Haemophilus influenzae Rd
uaccuaauggauauagaaau

SEQ ID NO: 684904 - RNA, 19 nt, Haemophilus influenzae Rd
uaccuagcgggauaagauu

SEQ ID NO: 684905 - RNA, 17 nt, Haemophilus influenzae Rd
uaccuucuguuuucaau

SEQ ID NO: 684906 - RNA, 20 nt, Haemophilus influenzae Rd
uaccuucuugauuauuuaau

SEQ ID NO: 684907 - RNA, 22 nt, Haemophilus influenzae Rd
uaccuuguuuugcaauaaaguu

SEQ ID NO: 684908 - RNA, 21 nt, Haemophilus influenzae Rd
uacgaauuaagcgaacaccuu

SEQ ID NO: 684909 - RNA, 17 nt, Haemophilus influenzae Rd
uacgaagaauccacauu

SEQ ID NO: 684910 - RNA, 12 nt, Haemophilus influenzae Rd
uacgaauaaacg

SEQ ID NO: 684911 - RNA, 19 nt, Haemophilus influenzae Rd
uacgaucacgauuuuucuc

SEQ ID NO: 684912 - RNA, 12 nt, Haemophilus influenzae Rd
uacgauaaacac

SEQ ID NO: 684913 - RNA, 15 nt, Haemophilus influenzae Rd
uacgauaguaaaaaa

SEQ ID NO: 684914 - RNA, 19 nt, Haemophilus influenzae Rd
uacgauaguaaaaaaucaa

SEQ ID NO: 684915 - RNA, 16 nt, Haemophilus influenzae Rd
uaccacgguugauacc

SEQ ID NO: 684916 - RNA, 16 nt, Haemophilus influenzae Rd
uacauagaacguuuuu

SEQ ID NO: 684917 - RNA, 18 nt, Haemophilus influenzae Rd
uaccagagcguuuaaagu

SEQ ID NO: 684918 - RNA, 18 nt, Haemophilus influenzae Rd
uacccaaaugaugaaaca

SEQ ID NO: 684919 - RNA, 12 nt, Haemophilus influenzae Rd
uacccaaauuau

SEQ ID NO: 684920 - RNA, 13 nt, Haemophilus influenzae Rd
uacccaaauuuau

SEQ ID NO: 684921 - RNA, 15 nt, Haemophilus influenzae Rd
uaccgcaaucuucac

SEQ ID NO: 684922 - RNA, 23 nt, Haemophilus influenzae Rd
uaccgcaccuuuacguuuaacug

SEQ ID NO: 684923 - RNA, 16 nt, Haemophilus influenzae Rd
uaccgcacuuucuucg

SEQ ID NO: 684924 - RNA, 22 nt, Haemophilus influenzae Rd
uaccgcacuuuuuuuauaucuu

SEQ ID NO: 684925 - RNA, 15 nt, Haemophilus influenzae Rd
uaccgcauuuuuaau

SEQ ID NO: 684926 - RNA, 17 nt, Haemophilus influenzae Rd
uaccgccagugauuuuu

SEQ ID NO: 684927 - RNA, 18 nt, Haemophilus influenzae Rd
uacccgugccuaauucac

SEQ ID NO: 684928 - RNA, 14 nt, Haemophilus influenzae Rd
uacccuauucuaaa

SEQ ID NO: 684929 - RNA, 21 nt, Haemophilus influenzae Rd
uacccacuucauauaaaucaa

SEQ ID NO: 684930 - RNA, 22 nt, Haemophilus influenzae Rd
uacccacuucauauaaaucaau

SEQ ID NO: 684931 - RNA, 22 nt, Haemophilus influenzae Rd
uacucauuuaucaaacaagccc

SEQ ID NO: 684932 - RNA, 14 nt, Haemophilus influenzae Rd
uacucaucugaauu

SEQ ID NO: 684933 - RNA, 21 nt, Haemophilus influenzae Rd
uacucaugaguuguuuuuuca

SEQ ID NO: 684934 - RNA, 20 nt, Haemophilus influenzae Rd
uacucguagaguuuuuucac

SEQ ID NO: 684935 - RNA, 22 nt, Haemophilus influenzae Rd
uacucgagcauaaacuaaaaua

SEQ ID NO: 684936 - RNA, 23 nt, Haemophilus influenzae Rd
uacguuuaguaaaauaaaaaauc

SEQ ID NO: 684937 - RNA, 14 nt, Haemophilus influenzae Rd
uacguuuuuccaua

SEQ ID NO: 684938 - RNA, 14 nt, Haemophilus influenzae Rd
uacuaaaaaauuaa

SEQ ID NO: 684939 - RNA, 17 nt, Haemophilus influenzae Rd
uacuaaaaaauuaaauu

SEQ ID NO: 684940 - RNA, 20 nt, Haemophilus influenzae Rd
uacuaaaaaauuaaauugua

SEQ ID NO: 684941 - RNA, 15 nt, Haemophilus influenzae Rd
uacucacagagccuu

SEQ ID NO: 684942 - RNA, 15 nt, Haemophilus influenzae Rd
uacuauuaauucucu

SEQ ID NO: 684943 - RNA, 17 nt, Haemophilus influenzae Rd
uacucaaagaaauagau

SEQ ID NO: 684944 - RNA, 21 nt, Haemophilus influenzae Rd
uacucaaagaaauagauuauu

SEQ ID NO: 684945 - RNA, 15 nt, Haemophilus influenzae Rd
uacucuuuuuuagau

SEQ ID NO: 684946 - RNA, 13 nt, Haemophilus influenzae Rd
uacugaaccauag

SEQ ID NO: 684947 - RNA, 14 nt, Haemophilus influenzae Rd
uacucuuaacaaaa

SEQ ID NO: 684948 - RNA, 13 nt, Haemophilus influenzae Rd
uacucuuaauuuu

SEQ ID NO: 684949 - RNA, 17 nt, Haemophilus influenzae Rd
uacucuuaauuuuugau

SEQ ID NO: 684950 - RNA, 18 nt, Haemophilus influenzae Rd
uacugccuuuuucuucuu

SEQ ID NO: 684951 - RNA, 12 nt, Haemophilus influenzae Rd
uacugaccuuua

SEQ ID NO: 684952 - RNA, 14 nt, Haemophilus influenzae Rd
uacugacuuucuaa

SEQ ID NO: 684953 - RNA, 17 nt, Haemophilus influenzae Rd
uacuucuuacaacaaau

SEQ ID NO: 684954 - RNA, 20 nt, Haemophilus influenzae Rd
uacuucuuacaacaaauugu

SEQ ID NO: 684955 - RNA, 15 nt, Haemophilus influenzae Rd
uacuuggaauaucau

SEQ ID NO: 684956 - RNA, 13 nt, Haemophilus influenzae Rd
uacuucuuugaau

SEQ ID NO: 684957 - RNA, 17 nt, Haemophilus influenzae Rd
uacuugaacuaauauca

SEQ ID NO: 684958 - RNA, 24 nt, Haemophilus influenzae Rd
uacuugaccagagccaaauacaau

SEQ ID NO: 684959 - RNA, 22 nt, Haemophilus influenzae Rd
uacuuguuggcauugaaaccua

SEQ ID NO: 684960 - RNA, 12 nt, Haemophilus influenzae Rd
uacuuguuuaug

SEQ ID NO: 684961 - RNA, 18 nt, Haemophilus influenzae Rd
uacuuguuuaugucuaaa

SEQ ID NO: 684962 - RNA, 17 nt, Haemophilus influenzae Rd
uacuuggggcuaauuuu

SEQ ID NO: 684963 - RNA, 23 nt, Haemophilus influenzae Rd
uacuuggggcuaauuuuuaaaau

SEQ ID NO: 684964 - RNA, 19 nt, Haemophilus influenzae Rd
uacuuggaugaaaucaaac

SEQ ID NO: 684965 - RNA, 20 nt, Haemophilus influenzae Rd
uacuuggauugcaugaaaug

SEQ ID NO: 684966 - RNA, 18 nt, Haemophilus influenzae Rd
uacuuggcauuucaagcu

SEQ ID NO: 684967 - RNA, 21 nt, Haemophilus influenzae Rd
uacuuggcguucauaucuuua

SEQ ID NO: 684968 - RNA, 12 nt, Haemophilus influenzae Rd
uacuuuauaaau

SEQ ID NO: 684969 - RNA, 17 nt, Haemophilus influenzae Rd
uacuuuauacuaaaagu

SEQ ID NO: 684970 - RNA, 13 nt, Haemophilus influenzae Rd
uacuuuaucacaa

SEQ ID NO: 684971 - RNA, 22 nt, Haemophilus influenzae Rd
uacuuuauugcggaguuuuaau

SEQ ID NO: 684972 - RNA, 16 nt, Haemophilus influenzae Rd
uacuuuccaauuccau

SEQ ID NO: 684973 - RNA, 16 nt, Haemophilus influenzae Rd
uacuuuuacaauccua

SEQ ID NO: 684974 - RNA, 19 nt, Haemophilus influenzae Rd
uacuuuuacgacuaauuuu

SEQ ID NO: 684975 - RNA, 17 nt, Haemophilus influenzae Rd
uacuuuuagauaaauuu

SEQ ID NO: 684976 - RNA, 20 nt, Haemophilus influenzae Rd
uacuuuguugaaugccauuc

SEQ ID NO: 684977 - RNA, 22 nt, Haemophilus influenzae Rd
uagaaaaaagaucagguuaaug

SEQ ID NO: 684978 - RNA, 16 nt, Haemophilus influenzae Rd
uacuuuuucuaauaau

SEQ ID NO: 684979 - RNA, 18 nt, Haemophilus influenzae Rd
uagaaaaaucgaagaaau

SEQ ID NO: 684980 - RNA, 17 nt, Haemophilus influenzae Rd
uacuuuugauuuauuaa

SEQ ID NO: 684981 - RNA, 17 nt, Haemophilus influenzae Rd
uacuuuugcacugcaau

SEQ ID NO: 684982 - RNA, 19 nt, Haemophilus influenzae Rd
uacuuuugcacugcaauga

SEQ ID NO: 684983 - RNA, 14 nt, Haemophilus influenzae Rd
uacuuuuuauuagu

SEQ ID NO: 684984 - RNA, 15 nt, Haemophilus influenzae Rd
uacuuuuuauuuuug

SEQ ID NO: 684985 - RNA, 15 nt, Haemophilus influenzae Rd
uacuuuuauugguaa

SEQ ID NO: 684986 - RNA, 18 nt, Haemophilus influenzae Rd
uacuuaguaauauagcaa

SEQ ID NO: 684987 - RNA, 16 nt, Haemophilus influenzae Rd
uacuuccgauuuuaau

SEQ ID NO: 684988 - RNA, 17 nt, Haemophilus influenzae Rd
uacuuccgauuuuaauu

SEQ ID NO: 684989 - RNA, 22 nt, Haemophilus influenzae Rd
uacuuccgauuuuaauugugca

SEQ ID NO: 684990 - RNA, 19 nt, Haemophilus influenzae Rd
uacuuccgcuuuaauaauc

SEQ ID NO: 684991 - RNA, 12 nt, Haemophilus influenzae Rd
uacuucaucaaa

SEQ ID NO: 684992 - RNA, 14 nt, Haemophilus influenzae Rd
uacuucgcaggaau

SEQ ID NO: 684993 - RNA, 17 nt, Haemophilus influenzae Rd
uacuuaauugauuuuaa

SEQ ID NO: 684994 - RNA, 17 nt, Haemophilus influenzae Rd
uacuuaaaguuaucaaa

SEQ ID NO: 684995 - RNA, 17 nt, Haemophilus influenzae Rd
uacuuaaaucuuuaccu

SEQ ID NO: 684996 - RNA, 14 nt, Haemophilus influenzae Rd
uacuuagauaaauu

SEQ ID NO: 684997 - RNA, 15 nt, Haemophilus influenzae Rd
uacuggcucuucuuu

SEQ ID NO: 684998 - RNA, 15 nt, Haemophilus influenzae Rd
uacuggugaaauuaa

SEQ ID NO: 684999 - RNA, 14 nt, Haemophilus influenzae Rd
uacuggcacuaaac

SEQ ID NO: 685000 - RNA, 22 nt, Haemophilus influenzae Rd
uacuggaaauucuucaauaaca

SEQ ID NO: 685001 - RNA, 19 nt, Haemophilus influenzae Rd
uacugucaccucguaaaau

SEQ ID NO: 685002 - RNA, 20 nt, Haemophilus influenzae Rd
uacugucguguaaucgccuu

SEQ ID NO: 685003 - RNA, 20 nt, Haemophilus influenzae Rd
uacuguggauaauucaucaa

SEQ ID NO: 685004 - RNA, 13 nt, Haemophilus influenzae Rd
uacuguucaaaua

SEQ ID NO: 685005 - RNA, 20 nt, Haemophilus influenzae Rd
uaauagcuucuuuuaucgac

SEQ ID NO: 685006 - RNA, 18 nt, Haemophilus influenzae Rd
uaauagguauaagaguuu

SEQ ID NO: 685007 - RNA, 21 nt, Haemophilus influenzae Rd
uaauaggaauaacacaccaac

SEQ ID NO: 685008 - RNA, 16 nt, Haemophilus influenzae Rd
uaauaggaguaaaaau

SEQ ID NO: 685009 - RNA, 17 nt, Haemophilus influenzae Rd
uaauaggaguaaaaaua

SEQ ID NO: 685010 - RNA, 15 nt, Haemophilus influenzae Rd
uaauaggauaaauaa

SEQ ID NO: 685011 - RNA, 17 nt, Haemophilus influenzae Rd
uaauaggauaaauaaac

SEQ ID NO: 685012 - RNA, 20 nt, Haemophilus influenzae Rd
uaauagguuguccacaauac

SEQ ID NO: 685013 - RNA, 17 nt, Haemophilus influenzae Rd
  misc_feature (7)..(7): n is a, c, g or u
uaauagnaaaaauuuag

SEQ ID NO: 685014 - RNA, 13 nt, Haemophilus influenzae Rd
uaauaguaaaauu

SEQ ID NO: 685015 - RNA, 16 nt, Haemophilus influenzae Rd
uaauaguaaaauugcc

SEQ ID NO: 685016 - RNA, 19 nt, Haemophilus influenzae Rd
uaauaguaaacuuuuaaag

SEQ ID NO: 685017 - RNA, 20 nt, Haemophilus influenzae Rd
uaauaguuguuugugaaguu

SEQ ID NO: 685018 - RNA, 18 nt, Haemophilus influenzae Rd
uaacguuacuaaaauccu

SEQ ID NO: 685019 - RNA, 15 nt, Haemophilus influenzae Rd
uaacguauuuucuca

SEQ ID NO: 685020 - RNA, 19 nt, Haemophilus influenzae Rd
uaauaucgcccgauuuuaa

SEQ ID NO: 685021 - RNA, 13 nt, Haemophilus influenzae Rd
uaauauauuaugu

SEQ ID NO: 685022 - RNA, 21 nt, Haemophilus influenzae Rd
uaauauauucuacguauugaa

SEQ ID NO: 685023 - RNA, 20 nt, Haemophilus influenzae Rd
uaauaucaaucacuucucug

SEQ ID NO: 685024 - RNA, 12 nt, Haemophilus influenzae Rd
uaauaucacaac

SEQ ID NO: 685025 - RNA, 21 nt, Haemophilus influenzae Rd
uaauaucacuuuguacaccaa

SEQ ID NO: 685026 - RNA, 17 nt, Haemophilus influenzae Rd
uaauaucauuuuuagaa

SEQ ID NO: 685027 - RNA, 18 nt, Haemophilus influenzae Rd
uaauauaaaggauuuuau

SEQ ID NO: 685028 - RNA, 12 nt, Haemophilus influenzae Rd
uaauauaaauua

SEQ ID NO: 685029 - RNA, 21 nt, Haemophilus influenzae Rd
uaauauaagugauuaaaguga

SEQ ID NO: 685030 - RNA, 23 nt, Haemophilus influenzae Rd
uaauauaaguuauuuauauaauu

SEQ ID NO: 685031 - RNA, 20 nt, Haemophilus influenzae Rd
uaauauaccccaaacuauau

SEQ ID NO: 685032 - RNA, 15 nt, Haemophilus influenzae Rd
uaauauaugaaaaau

SEQ ID NO: 685033 - RNA, 18 nt, Haemophilus influenzae Rd
uaauauaugaaaaauaau

SEQ ID NO: 685034 - RNA, 11 nt, Haemophilus influenzae Rd
uaauauuucuu

SEQ ID NO: 685035 - RNA, 20 nt, Haemophilus influenzae Rd
uaauauuuaccgcuuucaau

SEQ ID NO: 685036 - RNA, 21 nt, Haemophilus influenzae Rd
uaauaucuuuaacaaaaucaa

SEQ ID NO: 685037 - RNA, 20 nt, Haemophilus influenzae Rd
uaauauucaaaacauuaauu

SEQ ID NO: 685038 - RNA, 17 nt, Haemophilus influenzae Rd
uaauauuccaaaaaaua

SEQ ID NO: 685039 - RNA, 19 nt, Haemophilus influenzae Rd
uaauauuccaaaaaauaag

SEQ ID NO: 685040 - RNA, 21 nt, Haemophilus influenzae Rd
uaauauuccuuagaaaguaaa

SEQ ID NO: 685041 - RNA, 15 nt, Haemophilus influenzae Rd
uaaucacugaauuuc

SEQ ID NO: 685042 - RNA, 16 nt, Haemophilus influenzae Rd
uaaucacugaauuuca

SEQ ID NO: 685043 - RNA, 13 nt, Haemophilus influenzae Rd
uaaucacuugaag

SEQ ID NO: 685044 - RNA, 22 nt, Haemophilus influenzae Rd
uaaucacuugaagucuauaaaa

SEQ ID NO: 685045 - RNA, 22 nt, Haemophilus influenzae Rd
uaaucagaacaagcauuuuuca

SEQ ID NO: 685046 - RNA, 15 nt, Haemophilus influenzae Rd
uaauccgcaucuaaa

SEQ ID NO: 685047 - RNA, 22 nt, Haemophilus influenzae Rd
uaauccuacuuguacaagugcu

SEQ ID NO: 685048 - RNA, 17 nt, Haemophilus influenzae Rd
uaauccuaguuuuuucc

SEQ ID NO: 685049 - RNA, 19 nt, Haemophilus influenzae Rd
uaauccguuaaauuuagau

SEQ ID NO: 685050 - RNA, 19 nt, Haemophilus influenzae Rd
uaauccguuaauuucaucc

SEQ ID NO: 685051 - RNA, 20 nt, Haemophilus influenzae Rd
uaauccugccaguagaaaau

SEQ ID NO: 685052 - RNA, 17 nt, Haemophilus influenzae Rd
uaauccugucaucugua

SEQ ID NO: 685053 - RNA, 17 nt, Haemophilus influenzae Rd
uaauccuuucacuaaag

SEQ ID NO: 685054 - RNA, 21 nt, Haemophilus influenzae Rd
uaauccaacuaugaagacuaa

SEQ ID NO: 685055 - RNA, 18 nt, Haemophilus influenzae Rd
uaauccaaggaauuggau

SEQ ID NO: 685056 - RNA, 19 nt, Haemophilus influenzae Rd
uaauccaaacuaaaugcuc

SEQ ID NO: 685057 - RNA, 22 nt, Haemophilus influenzae Rd
uaaucauuacuuagauauauua

SEQ ID NO: 685058 - RNA, 15 nt, Haemophilus influenzae Rd
uaaugccaagaaagu

SEQ ID NO: 685059 - RNA, 17 nt, Haemophilus influenzae Rd
uaaugccugcauuaaua

SEQ ID NO: 685060 - RNA, 14 nt, Haemophilus influenzae Rd
uaaugccuguuacg

SEQ ID NO: 685061 - RNA, 18 nt, Haemophilus influenzae Rd
uaaugcaguaauaaaucc

SEQ ID NO: 685062 - RNA, 19 nt, Haemophilus influenzae Rd
uaaugcaguaauaaauccu

SEQ ID NO: 685063 - RNA, 17 nt, Haemophilus influenzae Rd
uaaugcaaccaaacaaa

SEQ ID NO: 685064 - RNA, 20 nt, Haemophilus influenzae Rd
uaaugcagcagcuucuucuu

SEQ ID NO: 685065 - RNA, 24 nt, Haemophilus influenzae Rd
uaaugcagcagcuucuucuuccug

SEQ ID NO: 685066 - RNA, 14 nt, Haemophilus influenzae Rd
uaaugcaauuucaa

SEQ ID NO: 685067 - RNA, 11 nt, Haemophilus influenzae Rd
uaaugauuaau

SEQ ID NO: 685068 - RNA, 14 nt, Haemophilus influenzae Rd
uaaugauuaauuaa

SEQ ID NO: 685069 - RNA, 12 nt, Haemophilus influenzae Rd
uaaugaaaacag

SEQ ID NO: 685070 - RNA, 20 nt, Haemophilus influenzae Rd
uaaugaaagggaaauuuauu

SEQ ID NO: 685071 - RNA, 13 nt, Haemophilus influenzae Rd
uaaugaaauauuc

SEQ ID NO: 685072 - RNA, 14 nt, Haemophilus influenzae Rd
uaaucuuuuuucuu

SEQ ID NO: 685073 - RNA, 19 nt, Haemophilus influenzae Rd
uaaugaaucugcaccuaaa

SEQ ID NO: 685074 - RNA, 13 nt, Haemophilus influenzae Rd
uaaugaacgaacu

SEQ ID NO: 685075 - RNA, 21 nt, Haemophilus influenzae Rd
uaaugaacgaacuaaaauggu

SEQ ID NO: 685076 - RNA, 16 nt, Haemophilus influenzae Rd
uaaugaaccaaaucua

SEQ ID NO: 685077 - RNA, 21 nt, Haemophilus influenzae Rd
uaaugaaccaaaucuaacauu

SEQ ID NO: 685078 - RNA, 15 nt, Haemophilus influenzae Rd
uaaugauauuauucc

SEQ ID NO: 685079 - RNA, 15 nt, Haemophilus influenzae Rd
uaaugauaaucuaaa

SEQ ID NO: 685080 - RNA, 20 nt, Haemophilus influenzae Rd
uaaugauaaucuaaaaaacc

SEQ ID NO: 685081 - RNA, 16 nt, Haemophilus influenzae Rd
uaaugagguauaaaau

SEQ ID NO: 685082 - RNA, 21 nt, Haemophilus influenzae Rd
uaauggcccguguuucaauuc

SEQ ID NO: 685083 - RNA, 23 nt, Haemophilus influenzae Rd
uaauggcgguaaaaaaguaacaa

SEQ ID NO: 685084 - RNA, 12 nt, Haemophilus influenzae Rd
uaauguuucaua

SEQ ID NO: 685085 - RNA, 20 nt, Haemophilus influenzae Rd
uaaugguuguaaauuuucaa

SEQ ID NO: 685086 - RNA, 23 nt, Haemophilus influenzae Rd
uaaugguuacagaaauauuauua

SEQ ID NO: 685087 - RNA, 15 nt, Haemophilus influenzae Rd
uaaugguauugugau

SEQ ID NO: 685088 - RNA, 22 nt, Haemophilus influenzae Rd
uaauggguaaucaauauuuauu

SEQ ID NO: 685089 - RNA, 12 nt, Haemophilus influenzae Rd
uaauuaauauua

SEQ ID NO: 685090 - RNA, 13 nt, Haemophilus influenzae Rd
uaauuaauauuag

SEQ ID NO: 685091 - RNA, 15 nt, Haemophilus influenzae Rd
uaauuaauauuagau

SEQ ID NO: 685092 - RNA, 12 nt, Haemophilus influenzae Rd
uaauuaaaagga

SEQ ID NO: 685093 - RNA, 12 nt, Haemophilus influenzae Rd
uaauuaaaauau

SEQ ID NO: 685094 - RNA, 17 nt, Haemophilus influenzae Rd
uaauguuuucauuaauu

SEQ ID NO: 685095 - RNA, 20 nt, Haemophilus influenzae Rd
uaauguuuucauuaauuuca

SEQ ID NO: 685096 - RNA, 18 nt, Haemophilus influenzae Rd
uaauguuuuuaugaccgc

SEQ ID NO: 685097 - RNA, 22 nt, Haemophilus influenzae Rd
uaauguuuguuccacuucauaa

SEQ ID NO: 685098 - RNA, 17 nt, Haemophilus influenzae Rd
uaauuacgccuaaccaa

SEQ ID NO: 685099 - RNA, 17 nt, Haemophilus influenzae Rd
uaauuacucacuauaac

SEQ ID NO: 685100 - RNA, 14 nt, Haemophilus influenzae Rd
uaauuauagagaaa

SEQ ID NO: 685101 - RNA, 17 nt, Haemophilus influenzae Rd
uaauuauagagaaauaa

SEQ ID NO: 685102 - RNA, 21 nt, Haemophilus influenzae Rd
uaauuauagagaaauaaucac

SEQ ID NO: 685103 - RNA, 21 nt, Haemophilus influenzae Rd
uaauuaauuuagauaaaaauu

SEQ ID NO: 685104 - RNA, 18 nt, Haemophilus influenzae Rd
uaauuaccugugaaaaca

SEQ ID NO: 685105 - RNA, 19 nt, Haemophilus influenzae Rd
uaauuauguauuuucuuua

SEQ ID NO: 685106 - RNA, 20 nt, Haemophilus influenzae Rd
uaauucacgcauuuaaauaa

SEQ ID NO: 685107 - RNA, 23 nt, Haemophilus influenzae Rd
uaauucagcgagagaauauuuag

SEQ ID NO: 685108 - RNA, 21 nt, Haemophilus influenzae Rd
uaauucagcggcauuugcauc

SEQ ID NO: 685109 - RNA, 20 nt, Haemophilus influenzae Rd
uaauucagcggcuuucuuca

SEQ ID NO: 685110 - RNA, 20 nt, Haemophilus influenzae Rd
uaauucagggauuaagaaaa

SEQ ID NO: 685111 - RNA, 21 nt, Haemophilus influenzae Rd
uaauucagggauuaagaaaau

SEQ ID NO: 685112 - RNA, 18 nt, Haemophilus influenzae Rd
uaauucaggugggaaaua

SEQ ID NO: 685113 - RNA, 20 nt, Haemophilus influenzae Rd
uaauucaguguaauguuuua

SEQ ID NO: 685114 - RNA, 20 nt, Haemophilus influenzae Rd
uaauucgaucagcacgauaa

SEQ ID NO: 685115 - RNA, 23 nt, Haemophilus influenzae Rd
uaauucaagaugauauuuaauaa

SEQ ID NO: 685116 - RNA, 20 nt, Haemophilus influenzae Rd
uaauucaagcaaauauuuag

SEQ ID NO: 685117 - RNA, 23 nt, Haemophilus influenzae Rd
uaauucaauaucugcacguaaag

SEQ ID NO: 685118 - RNA, 15 nt, Haemophilus influenzae Rd
uaauuauuuaaaucu

SEQ ID NO: 685119 - RNA, 13 nt, Haemophilus influenzae Rd
uaauuauuuuaga

SEQ ID NO: 685120 - RNA, 14 nt, Haemophilus influenzae Rd
uaauuucaauauaa

SEQ ID NO: 685121 - RNA, 15 nt, Haemophilus influenzae Rd
uaauuucauuaauaa

SEQ ID NO: 685122 - RNA, 16 nt, Haemophilus influenzae Rd
uaauuucauaaaaauu

SEQ ID NO: 685123 - RNA, 21 nt, Haemophilus influenzae Rd
uaauuucaucguauuuccuau

SEQ ID NO: 685124 - RNA, 17 nt, Haemophilus influenzae Rd
uaauuucacauuaugau

SEQ ID NO: 685125 - RNA, 16 nt, Haemophilus influenzae Rd
uaauuucccuaaaauc

SEQ ID NO: 685126 - RNA, 18 nt, Haemophilus influenzae Rd
uaauuucccuaaaaucuu

SEQ ID NO: 685127 - RNA, 15 nt, Haemophilus influenzae Rd
uaauuucauuuugca

SEQ ID NO: 685128 - RNA, 17 nt, Haemophilus influenzae Rd
uaauuucuuuuccuugc

SEQ ID NO: 685129 - RNA, 18 nt, Haemophilus influenzae Rd
uaauuucugcgauauauu

SEQ ID NO: 685130 - RNA, 19 nt, Haemophilus influenzae Rd
uaauuugaucuaauuugcc

SEQ ID NO: 685131 - RNA, 16 nt, Haemophilus influenzae Rd
uaauuugcacacuuaa

SEQ ID NO: 685132 - RNA, 18 nt, Haemophilus influenzae Rd
uaauuugcacacuuaaac

SEQ ID NO: 685133 - RNA, 14 nt, Haemophilus influenzae Rd
uaauuugcaucauu

SEQ ID NO: 685134 - RNA, 17 nt, Haemophilus influenzae Rd
uaauuugccaucacuca

SEQ ID NO: 685135 - RNA, 17 nt, Haemophilus influenzae Rd
uaauuugcuuuuugauu

SEQ ID NO: 685136 - RNA, 21 nt, Haemophilus influenzae Rd
uaauuuggucuguuucuucua

SEQ ID NO: 685137 - RNA, 11 nt, Haemophilus influenzae Rd
uaauuuauaca

SEQ ID NO: 685138 - RNA, 22 nt, Haemophilus influenzae Rd
uaauuuaucaucuaguuuuaau

SEQ ID NO: 685139 - RNA, 15 nt, Haemophilus influenzae Rd
uaauuucaaaucuuc

SEQ ID NO: 685140 - RNA, 14 nt, Haemophilus influenzae Rd
uaauuuauuuucua

SEQ ID NO: 685141 - RNA, 13 nt, Haemophilus influenzae Rd
uaauuucaaaauc

SEQ ID NO: 685142 - RNA, 16 nt, Haemophilus influenzae Rd
uaauuucaaaaucaca

SEQ ID NO: 685143 - RNA, 15 nt, Haemophilus influenzae Rd
uaauuuauuaaaaau

SEQ ID NO: 685144 - RNA, 12 nt, Haemophilus influenzae Rd
uaauuuaaauuu

SEQ ID NO: 685145 - RNA, 16 nt, Haemophilus influenzae Rd
uaauuuaagaaaaacg

SEQ ID NO: 685146 - RNA, 15 nt, Haemophilus influenzae Rd
uaauuuaauucuaaa

SEQ ID NO: 685147 - RNA, 19 nt, Haemophilus influenzae Rd
uaauuuaauucuaaauucu

SEQ ID NO: 685148 - RNA, 19 nt, Haemophilus influenzae Rd
uaauuuaaggcuuuuucug

SEQ ID NO: 685149 - RNA, 19 nt, Haemophilus influenzae Rd
uaauuuacagccugcgagc

SEQ ID NO: 685150 - RNA, 23 nt, Haemophilus influenzae Rd
uaauuuagaaaaagaaaaccugc

SEQ ID NO: 685151 - RNA, 17 nt, Haemophilus influenzae Rd
uaauuuagauaaaaauu

SEQ ID NO: 685152 - RNA, 17 nt, Haemophilus influenzae Rd
uaauuuagcccgaaaau

SEQ ID NO: 685153 - RNA, 22 nt, Haemophilus influenzae Rd
uaauuguuugguagaguaaauu

SEQ ID NO: 685154 - RNA, 12 nt, Haemophilus influenzae Rd
uaauuuaaaaag

SEQ ID NO: 685155 - RNA, 17 nt, Haemophilus influenzae Rd
uaauuuaaaaaaucacc

SEQ ID NO: 685156 - RNA, 21 nt, Haemophilus influenzae Rd
uaauuuaaaaaaucaccgcac

SEQ ID NO: 685157 - RNA, 18 nt, Haemophilus influenzae Rd
uaauuuaaauaaagcauu

SEQ ID NO: 685158 - RNA, 20 nt, Haemophilus influenzae Rd
uaauucguuaauaaauccau

SEQ ID NO: 685159 - RNA, 20 nt, Haemophilus influenzae Rd
uaauucgugccacaugauaa

SEQ ID NO: 685160 - RNA, 23 nt, Haemophilus influenzae Rd
uaauucgugccacaugauaaaaa

SEQ ID NO: 685161 - RNA, 20 nt, Haemophilus influenzae Rd
uacaaaagagcgguugaaaa

SEQ ID NO: 685162 - RNA, 23 nt, Haemophilus influenzae Rd
uacaaaauccacacuuuaaaagu

SEQ ID NO: 685163 - RNA, 13 nt, Haemophilus influenzae Rd
uaauuuuucuuca

SEQ ID NO: 685164 - RNA, 14 nt, Haemophilus influenzae Rd
uaauuuuuuacgau

SEQ ID NO: 685165 - RNA, 19 nt, Haemophilus influenzae Rd
uaauuuuuuacgauauuuu

SEQ ID NO: 685166 - RNA, 15 nt, Haemophilus influenzae Rd
uaauuuuuuauaaaa

SEQ ID NO: 685167 - RNA, 17 nt, Haemophilus influenzae Rd
uaauuuuuuauaaaauu

SEQ ID NO: 685168 - RNA, 18 nt, Haemophilus influenzae Rd
uaauuuuuuauucaaaau

SEQ ID NO: 685169 - RNA, 13 nt, Haemophilus influenzae Rd
uaauuuuuuucca

SEQ ID NO: 685170 - RNA, 20 nt, Haemophilus influenzae Rd
uacaaaaaagccacuuucaa

SEQ ID NO: 685171 - RNA, 13 nt, Haemophilus influenzae Rd
uaauuuuuaaaau

SEQ ID NO: 685172 - RNA, 15 nt, Haemophilus influenzae Rd
uaauuuuuaaaauag

SEQ ID NO: 685173 - RNA, 16 nt, Haemophilus influenzae Rd
uaauuuuuaaaauaga

SEQ ID NO: 685174 - RNA, 17 nt, Haemophilus influenzae Rd
uaauuuuuaaagaaauc

SEQ ID NO: 685175 - RNA, 16 nt, Haemophilus influenzae Rd
uaauuuuuaauucuuu

SEQ ID NO: 685176 - RNA, 17 nt, Haemophilus influenzae Rd
uaauuuuuagauuauuu

SEQ ID NO: 685177 - RNA, 14 nt, Haemophilus influenzae Rd
uaauuuuuauaauu

SEQ ID NO: 685178 - RNA, 15 nt, Haemophilus influenzae Rd
uaauuuuuauaauuu

SEQ ID NO: 685179 - RNA, 19 nt, Haemophilus influenzae Rd
uaauuuuuauaauuuugau

SEQ ID NO: 685180 - RNA, 22 nt, Haemophilus influenzae Rd
uaauuuuggcgaaccuuucaua

SEQ ID NO: 685181 - RNA, 21 nt, Haemophilus influenzae Rd
uaauuuuguaagcauuaaaaa

SEQ ID NO: 685182 - RNA, 23 nt, Haemophilus influenzae Rd
uaauuuuguuagcggauaaaaua

SEQ ID NO: 685183 - RNA, 13 nt, Haemophilus influenzae Rd
uaauuuguuagau

SEQ ID NO: 685184 - RNA, 20 nt, Haemophilus influenzae Rd
uaauuuguuagaucaaauuu

SEQ ID NO: 685185 - RNA, 15 nt, Haemophilus influenzae Rd
uaauuuguuuuucga

SEQ ID NO: 685186 - RNA, 14 nt, Haemophilus influenzae Rd
uaauuuuaaaacau

SEQ ID NO: 685187 - RNA, 11 nt, Haemophilus influenzae Rd
uaauuuuaaaa

SEQ ID NO: 685188 - RNA, 12 nt, Haemophilus influenzae Rd
uaauuuuaauuc

SEQ ID NO: 685189 - RNA, 18 nt, Haemophilus influenzae Rd
uaauuuuaccaagaaaua

SEQ ID NO: 685190 - RNA, 21 nt, Haemophilus influenzae Rd
uaauuuuacguaguacaucau

SEQ ID NO: 685191 - RNA, 13 nt, Haemophilus influenzae Rd
uaauuuuauagaa

SEQ ID NO: 685192 - RNA, 12 nt, Haemophilus influenzae Rd
uaauuuuauagc

SEQ ID NO: 685193 - RNA, 23 nt, Haemophilus influenzae Rd
uaauuuuauagcuuuaguuuuag

SEQ ID NO: 685194 - RNA, 22 nt, Haemophilus influenzae Rd
uaauuuucagugauuccaacaa

SEQ ID NO: 685195 - RNA, 22 nt, Haemophilus influenzae Rd
uaauuuuauuuuuugcggacgc

SEQ ID NO: 685196 - RNA, 22 nt, Haemophilus influenzae Rd
uaauuuucaaacacaacauaau

SEQ ID NO: 685197 - RNA, 14 nt, Haemophilus influenzae Rd
uaauuuucacauaa

SEQ ID NO: 685198 - RNA, 15 nt, Haemophilus influenzae Rd
uacaacucuaaauug

SEQ ID NO: 685199 - RNA, 24 nt, Haemophilus influenzae Rd
uacaacuucaucaauggcaucgcu

SEQ ID NO: 685200 - RNA, 14 nt, Haemophilus influenzae Rd
uacaagaaaccaaa

SEQ ID NO: 685201 - RNA, 15 nt, Haemophilus influenzae Rd
uacaagaaagaaaua

SEQ ID NO: 685202 - RNA, 12 nt, Haemophilus influenzae Rd
uacaaagcacga

SEQ ID NO: 685203 - RNA, 16 nt, Haemophilus influenzae Rd
uacaaguauuuuccuu

SEQ ID NO: 685204 - RNA, 23 nt, Haemophilus influenzae Rd
uacaaguacuacuggcauuuuuu

SEQ ID NO: 685205 - RNA, 20 nt, Haemophilus influenzae Rd
uacaagguagauugauacag

SEQ ID NO: 685206 - RNA, 20 nt, Haemophilus influenzae Rd
uacaaguggcgguaaaaaug

SEQ ID NO: 685207 - RNA, 21 nt, Haemophilus influenzae Rd
uacaauucuuguuuaauauuu

SEQ ID NO: 685208 - RNA, 17 nt, Haemophilus influenzae Rd
uacaauuaauuaaauau

SEQ ID NO: 685209 - RNA, 17 nt, Haemophilus influenzae Rd
uacacauuucuucuagu

SEQ ID NO: 685210 - RNA, 18 nt, Haemophilus influenzae Rd
uacacauggccaauuuca

SEQ ID NO: 685211 - RNA, 23 nt, Haemophilus influenzae Rd
uacacaucagagcgaauacuguu

SEQ ID NO: 685212 - RNA, 16 nt, Haemophilus influenzae Rd
uacaccccaaaauccc

SEQ ID NO: 685213 - RNA, 18 nt, Haemophilus influenzae Rd
uacacgagcaauggcaau

SEQ ID NO: 685214 - RNA, 17 nt, Haemophilus influenzae Rd
uacacucacuuuuccuu

SEQ ID NO: 685215 - RNA, 23 nt, Haemophilus influenzae Rd
uacacuucugccagauguuggaa

SEQ ID NO: 685216 - RNA, 15 nt, Haemophilus influenzae Rd
uacacuuaaauuaua

SEQ ID NO: 685217 - RNA, 15 nt, Haemophilus influenzae Rd
uacagcacuaaaagc

SEQ ID NO: 685218 - RNA, 18 nt, Haemophilus influenzae Rd
uacagugacuaaaacaac

SEQ ID NO: 685219 - RNA, 21 nt, Haemophilus influenzae Rd
uacagugacaaauuuugcauu

SEQ ID NO: 685220 - RNA, 15 nt, Haemophilus influenzae Rd
uacauaaaaaacaca

SEQ ID NO: 685221 - RNA, 22 nt, Haemophilus influenzae Rd
uacaguuugcgugaauaucuaa

SEQ ID NO: 685222 - RNA, 21 nt, Haemophilus influenzae Rd
gcugccucuucauuguggaaa

SEQ ID NO: 685223 - RNA, 17 nt, Haemophilus influenzae Rd
gcugcacaagcaccacu

SEQ ID NO: 685224 - RNA, 16 nt, Haemophilus influenzae Rd
gcugcaacaaauaaau

SEQ ID NO: 685225 - RNA, 16 nt, Haemophilus influenzae Rd
gcugcaugaagaacuu

SEQ ID NO: 685226 - RNA, 20 nt, Haemophilus influenzae Rd
gcugcauuucaauuucacug

SEQ ID NO: 685227 - RNA, 15 nt, Haemophilus influenzae Rd
gcugcauaaagcuca

SEQ ID NO: 685228 - RNA, 15 nt, Haemophilus influenzae Rd
gcugcagcugcugcu

SEQ ID NO: 685229 - RNA, 21 nt, Haemophilus influenzae Rd
gcuggaucggcuauuucagcu

SEQ ID NO: 685230 - RNA, 21 nt, Haemophilus influenzae Rd
gcuggauuaucuauaucuuua

SEQ ID NO: 685231 - RNA, 14 nt, Haemophilus influenzae Rd
gcugcugcaccaga

SEQ ID NO: 685232 - RNA, 19 nt, Haemophilus influenzae Rd
gcugcugcaccagagaaaa

SEQ ID NO: 685233 - RNA, 14 nt, Haemophilus influenzae Rd
gcuggaauauggaa

SEQ ID NO: 685234 - RNA, 16 nt, Haemophilus influenzae Rd
gcuggaauauuuuucu

SEQ ID NO: 685235 - RNA, 17 nt, Haemophilus influenzae Rd
gcugcuuguaaccaaua

SEQ ID NO: 685236 - RNA, 22 nt, Haemophilus influenzae Rd
gcugcucuaccgacugagcuaa

SEQ ID NO: 685237 - RNA, 16 nt, Haemophilus influenzae Rd
gcugugcaagcauuuc

SEQ ID NO: 685238 - RNA, 15 nt, Haemophilus influenzae Rd
gcuguguaagcuggc

SEQ ID NO: 685239 - RNA, 22 nt, Haemophilus influenzae Rd
gcuguugugaguaagucuucuu

SEQ ID NO: 685240 - RNA, 19 nt, Haemophilus influenzae Rd
gcuguuuaaaucuaagccu

SEQ ID NO: 685241 - RNA, 19 nt, Haemophilus influenzae Rd
gcuguuucaaugucuuuuu

SEQ ID NO: 685242 - RNA, 17 nt, Haemophilus influenzae Rd
gcuguugcaaugacagu

SEQ ID NO: 685243 - RNA, 22 nt, Haemophilus influenzae Rd
gcuguaguagauaacaacuaaa

SEQ ID NO: 685244 - RNA, 18 nt, Haemophilus influenzae Rd
gcugucaaacgaaaaaaa

SEQ ID NO: 685245 - RNA, 19 nt, Haemophilus influenzae Rd
gcugucaaacgaaaaaaau

SEQ ID NO: 685246 - RNA, 23 nt, Haemophilus influenzae Rd
gcugucaaacgaaaaaaauaaaa

SEQ ID NO: 685247 - RNA, 17 nt, Haemophilus influenzae Rd
gcuguaaugacagaauc

SEQ ID NO: 685248 - RNA, 21 nt, Haemophilus influenzae Rd
gcuguaaugacagaaucuaaa

SEQ ID NO: 685249 - RNA, 12 nt, Haemophilus influenzae Rd
gcuguaaugauc

SEQ ID NO: 685250 - RNA, 17 nt, Haemophilus influenzae Rd
gcuguaaaaaaucuuua

SEQ ID NO: 685251 - RNA, 14 nt, Haemophilus influenzae Rd
gcuguaaaucuuua

SEQ ID NO: 685252 - RNA, 17 nt, Haemophilus influenzae Rd
gcuggcguuuacuuggc

SEQ ID NO: 685253 - RNA, 19 nt, Haemophilus influenzae Rd
gcuggcguuuuuuauaaac

SEQ ID NO: 685254 - RNA, 13 nt, Haemophilus influenzae Rd
gcuggcuaaauuu

SEQ ID NO: 685255 - RNA, 21 nt, Haemophilus influenzae Rd
gcuggcuuucuuuuucaaguu

SEQ ID NO: 685256 - RNA, 15 nt, Haemophilus influenzae Rd
gcuggguuugcacuu

SEQ ID NO: 685257 - RNA, 15 nt, Haemophilus influenzae Rd
gcuuauguaaauuua

SEQ ID NO: 685258 - RNA, 14 nt, Haemophilus influenzae Rd
gcuuagauaauaaa

SEQ ID NO: 685259 - RNA, 21 nt, Haemophilus influenzae Rd
gcuuauaagcuguauuacuua

SEQ ID NO: 685260 - RNA, 18 nt, Haemophilus influenzae Rd
gcuuaaaugaucuaaugg

SEQ ID NO: 685261 - RNA, 16 nt, Haemophilus influenzae Rd
gcuuaaaaaagugaaa

SEQ ID NO: 685262 - RNA, 14 nt, Haemophilus influenzae Rd
gcuuaaagcaauca

SEQ ID NO: 685263 - RNA, 18 nt, Haemophilus influenzae Rd
gcuuaaugcgcccuuuaa

SEQ ID NO: 685264 - RNA, 16 nt, Haemophilus influenzae Rd
gcuuacagcaaaagca

SEQ ID NO: 685265 - RNA, 13 nt, Haemophilus influenzae Rd
gcuuccaacaaaa

SEQ ID NO: 685266 - RNA, 15 nt, Haemophilus influenzae Rd
gcuuccaacauaugc

SEQ ID NO: 685267 - RNA, 22 nt, Haemophilus influenzae Rd
gcuucaguauccgccaaugcuu

SEQ ID NO: 685268 - RNA, 13 nt, Haemophilus influenzae Rd
gcuucaucaaauu

SEQ ID NO: 685269 - RNA, 19 nt, Haemophilus influenzae Rd
gcuucaaaaucaccauauu

SEQ ID NO: 685270 - RNA, 13 nt, Haemophilus influenzae Rd
gcuuauuuuguug

SEQ ID NO: 685271 - RNA, 18 nt, Haemophilus influenzae Rd
gcuuauuuacuuuauaaa

SEQ ID NO: 685272 - RNA, 15 nt, Haemophilus influenzae Rd
gcuuccagaaaauug

SEQ ID NO: 685273 - RNA, 17 nt, Haemophilus influenzae Rd
gcuucgcgcuaaaucau

SEQ ID NO: 685274 - RNA, 23 nt, Haemophilus influenzae Rd
gcuucgccagcagugccaaccac

SEQ ID NO: 685275 - RNA, 22 nt, Haemophilus influenzae Rd
gcuucgccauuuuuaaaaauaa

SEQ ID NO: 685276 - RNA, 15 nt, Haemophilus influenzae Rd
gcuucggccuauuaa

SEQ ID NO: 685277 - RNA, 19 nt, Haemophilus influenzae Rd
gcuugacgaaauaaaucua

SEQ ID NO: 685278 - RNA, 13 nt, Haemophilus influenzae Rd
gcuugaacaaaaa

SEQ ID NO: 685279 - RNA, 15 nt, Haemophilus influenzae Rd
gcuugaauaaauccc

SEQ ID NO: 685280 - RNA, 18 nt, Haemophilus influenzae Rd
gcuugaauaaauccccca

SEQ ID NO: 685281 - RNA, 22 nt, Haemophilus influenzae Rd
gcuucuucaucgcucaucguau

SEQ ID NO: 685282 - RNA, 18 nt, Haemophilus influenzae Rd
gcuucuucgauaaaaucu

SEQ ID NO: 685283 - RNA, 15 nt, Haemophilus influenzae Rd
gcuucuucuuccugc

SEQ ID NO: 685284 - RNA, 16 nt, Haemophilus influenzae Rd
gcuucuaauuuuugca

SEQ ID NO: 685285 - RNA, 17 nt, Haemophilus influenzae Rd
gcuucuaauuuuaaaac

SEQ ID NO: 685286 - RNA, 19 nt, Haemophilus influenzae Rd
gcuucuaauuuuaaaacau

SEQ ID NO: 685287 - RNA, 15 nt, Haemophilus influenzae Rd
gcuugggaaucuggc

SEQ ID NO: 685288 - RNA, 17 nt, Haemophilus influenzae Rd
gcuuggcgaguaaauuu

SEQ ID NO: 685289 - RNA, 20 nt, Haemophilus influenzae Rd
gcuuguggacguuucaaaaa

SEQ ID NO: 685290 - RNA, 15 nt, Haemophilus influenzae Rd
gcuugugaaauaaaa

SEQ ID NO: 685291 - RNA, 18 nt, Haemophilus influenzae Rd
gcuugugaaauaaaauau

SEQ ID NO: 685292 - RNA, 23 nt, Haemophilus influenzae Rd
gcuuuacuacaucagguuuaaua

SEQ ID NO: 685293 - RNA, 12 nt, Haemophilus influenzae Rd
gcuuuacaauga

SEQ ID NO: 685294 - RNA, 13 nt, Haemophilus influenzae Rd
gcuuuaauuucuu

SEQ ID NO: 685295 - RNA, 17 nt, Haemophilus influenzae Rd
gcuuuaauuuuaucuaa

SEQ ID NO: 685296 - RNA, 15 nt, Haemophilus influenzae Rd
gcuuuaacaauuacu

SEQ ID NO: 685297 - RNA, 17 nt, Haemophilus influenzae Rd
gcuuuaacccauuuauu

SEQ ID NO: 685298 - RNA, 17 nt, Haemophilus influenzae Rd
gcuuuaaguaaaaguaa

SEQ ID NO: 685299 - RNA, 14 nt, Haemophilus influenzae Rd
gcuuuaacgagaau

SEQ ID NO: 685300 - RNA, 16 nt, Haemophilus influenzae Rd
gcuuguucagcaacau

SEQ ID NO: 685301 - RNA, 15 nt, Haemophilus influenzae Rd
gcuugaugucaguga

SEQ ID NO: 685302 - RNA, 22 nt, Haemophilus influenzae Rd
gcuugaguuucgccagcaccac

SEQ ID NO: 685303 - RNA, 22 nt, Haemophilus influenzae Rd
gcuugauaaccuucaaugguuu

SEQ ID NO: 685304 - RNA, 17 nt, Haemophilus influenzae Rd
gcuugagcugcugcaag

SEQ ID NO: 685305 - RNA, 21 nt, Haemophilus influenzae Rd
gcuugcauucacuucuaaaac

SEQ ID NO: 685306 - RNA, 20 nt, Haemophilus influenzae Rd
gcuugccaauugaauuaaaa

SEQ ID NO: 685307 - RNA, 22 nt, Haemophilus influenzae Rd
gcuugcgcugaaagaaauuuua

SEQ ID NO: 685308 - RNA, 19 nt, Haemophilus influenzae Rd
gcuugcgguugaauuucuu

SEQ ID NO: 685309 - RNA, 16 nt, Haemophilus influenzae Rd
gcuugcuguucgauuu

SEQ ID NO: 685310 - RNA, 11 nt, Haemophilus influenzae Rd
gcuugcucaau

SEQ ID NO: 685311 - RNA, 14 nt, Haemophilus influenzae Rd
gcuuuguaaguugg

SEQ ID NO: 685312 - RNA, 15 nt, Haemophilus influenzae Rd
gcuuugcuugcccag

SEQ ID NO: 685313 - RNA, 14 nt, Haemophilus influenzae Rd
gcuuuuaucaagua

SEQ ID NO: 685314 - RNA, 13 nt, Haemophilus influenzae Rd
gcuuugugauuga

SEQ ID NO: 685315 - RNA, 14 nt, Haemophilus influenzae Rd
gcuuuguuguuuau

SEQ ID NO: 685316 - RNA, 17 nt, Haemophilus influenzae Rd
gcuuuuacgaacguuuc

SEQ ID NO: 685317 - RNA, 14 nt, Haemophilus influenzae Rd
gcuuuuaacaaaua

SEQ ID NO: 685318 - RNA, 17 nt, Haemophilus influenzae Rd
gcuuuuuacguucaugu

SEQ ID NO: 685319 - RNA, 18 nt, Haemophilus influenzae Rd
gcuuuuugaucucuuucu

SEQ ID NO: 685320 - RNA, 23 nt, Haemophilus influenzae Rd
gcuuuuugcgccaacgcaucuau

SEQ ID NO: 685321 - RNA, 15 nt, Haemophilus influenzae Rd
gcuuuugguuuucug

SEQ ID NO: 685322 - RNA, 19 nt, Haemophilus influenzae Rd
gcuuuugccauauuuaaua

SEQ ID NO: 685323 - RNA, 11 nt, Haemophilus influenzae Rd
gcuuuugcuuc

SEQ ID NO: 685324 - RNA, 13 nt, Haemophilus influenzae Rd
gcuuuucguuucu

SEQ ID NO: 685325 - RNA, 15 nt, Haemophilus influenzae Rd
gcuuuucccucuuuu

SEQ ID NO: 685326 - RNA, 11 nt, Haemophilus influenzae Rd
gcuuuucccuu

SEQ ID NO: 685327 - RNA, 16 nt, Haemophilus influenzae Rd
gcuuuucccuuuucuu

SEQ ID NO: 685328 - RNA, 20 nt, Haemophilus influenzae Rd
gcuuuucuuuuauacuuacu

SEQ ID NO: 685329 - RNA, 18 nt, Haemophilus influenzae Rd
gcuuuucugauaauuuuu

SEQ ID NO: 685330 - RNA, 21 nt, Haemophilus influenzae Rd
gcuuuucucaaaacaucuuua

SEQ ID NO: 685331 - RNA, 15 nt, Haemophilus influenzae Rd
gcuuucuuauucagu

SEQ ID NO: 685332 - RNA, 23 nt, Haemophilus influenzae Rd
gcuuucuagaugaugaaauuuuu

SEQ ID NO: 685333 - RNA, 13 nt, Haemophilus influenzae Rd
gcuuugccuaauu

SEQ ID NO: 685334 - RNA, 17 nt, Haemophilus influenzae Rd
gcuuugccaauuccuug

SEQ ID NO: 685335 - RNA, 21 nt, Haemophilus influenzae Rd
gcuuugccacggcacauucug

SEQ ID NO: 685336 - RNA, 17 nt, Haemophilus influenzae Rd
gcuuugauaaaugguuu

SEQ ID NO: 685337 - RNA, 15 nt, Haemophilus influenzae Rd
gcuuugagguaaaag

SEQ ID NO: 685338 - RNA, 23 nt, Haemophilus influenzae Rd
gcuuugagguaaaagugcgguga

SEQ ID NO: 685339 - RNA, 20 nt, Haemophilus influenzae Rd
gcuuugagaaagaauauaaa

SEQ ID NO: 685340 - RNA, 23 nt, Haemophilus influenzae Rd
gcuuugagaaagaauauaaauaa

SEQ ID NO: 685341 - RNA, 17 nt, Haemophilus influenzae Rd
gcuuuccuauucuaaac

SEQ ID NO: 685342 - RNA, 15 nt, Haemophilus influenzae Rd
gcuuuaucaaagaau

SEQ ID NO: 685343 - RNA, 16 nt, Haemophilus influenzae Rd
gcuuuauuuaaauuaa

SEQ ID NO: 685344 - RNA, 19 nt, Haemophilus influenzae Rd
gcuuuauuuagaauuuuua

SEQ ID NO: 685345 - RNA, 21 nt, Haemophilus influenzae Rd
gcuuucacuauuucaucuuua

SEQ ID NO: 685346 - RNA, 20 nt, Haemophilus influenzae Rd
ggaaaauagaaaguggcuua

SEQ ID NO: 685347 - RNA, 18 nt, Haemophilus influenzae Rd
ggaaacuacggacuaaau

SEQ ID NO: 685348 - RNA, 21 nt, Haemophilus influenzae Rd
ggaaacuacggacuaaauaaa

SEQ ID NO: 685349 - RNA, 22 nt, Haemophilus influenzae Rd
ggaaacuacggacuaaauaaau

SEQ ID NO: 685350 - RNA, 17 nt, Haemophilus influenzae Rd
ggaaacguaaaauaucu

SEQ ID NO: 685351 - RNA, 16 nt, Haemophilus influenzae Rd
ggaaagcguugaagcu

SEQ ID NO: 685352 - RNA, 14 nt, Haemophilus influenzae Rd
ggaaaggcauuaga

SEQ ID NO: 685353 - RNA, 14 nt, Haemophilus influenzae Rd
ggaaaggcauuuuu

SEQ ID NO: 685354 - RNA, 17 nt, Haemophilus influenzae Rd
ggaaacuaugcagaauc

SEQ ID NO: 685355 - RNA, 22 nt, Haemophilus influenzae Rd
gcuuuuuucaaugcuuuuugcg

SEQ ID NO: 685356 - RNA, 21 nt, Haemophilus influenzae Rd
ggaaaaauaaauggauuuaau

SEQ ID NO: 685357 - RNA, 23 nt, Haemophilus influenzae Rd
ggaaaguucucgcaaaagugcgg

SEQ ID NO: 685358 - RNA, 23 nt, Haemophilus influenzae Rd
ggaaagucccgugagcauuuagu

SEQ ID NO: 685359 - RNA, 20 nt, Haemophilus influenzae Rd
ggaaagugcagcccaaauaa

SEQ ID NO: 685360 - RNA, 21 nt, Haemophilus influenzae Rd
ggaaagugcagcccaaauaaa

SEQ ID NO: 685361 - RNA, 13 nt, Haemophilus influenzae Rd
ggaaaucuuggcu

SEQ ID NO: 685362 - RNA, 22 nt, Haemophilus influenzae Rd
ggaaaucuuggcucauuuuaaa

SEQ ID NO: 685363 - RNA, 14 nt, Haemophilus influenzae Rd
ggaaauucuucaau

SEQ ID NO: 685364 - RNA, 17 nt, Haemophilus influenzae Rd
ggaaauugccaaaaaag

SEQ ID NO: 685365 - RNA, 21 nt, Haemophilus influenzae Rd
ggaaaugaaaccaaauccuuu

SEQ ID NO: 685366 - RNA, 23 nt, Haemophilus influenzae Rd
ggaacaagaccugcuucuuuuaa

SEQ ID NO: 685367 - RNA, 16 nt, Haemophilus influenzae Rd
ggaagcgaauuuaaga

SEQ ID NO: 685368 - RNA, 10 nt, Haemophilus influenzae Rd
ggaagaaaaa

SEQ ID NO: 685369 - RNA, 12 nt, Haemophilus influenzae Rd
ggaacuucuaaa

SEQ ID NO: 685370 - RNA, 13 nt, Haemophilus influenzae Rd
ggaauguaaaauu

SEQ ID NO: 685371 - RNA, 16 nt, Haemophilus influenzae Rd
ggaauauucaacgcgc

SEQ ID NO: 685372 - RNA, 14 nt, Haemophilus influenzae Rd
ggaauucaucaagc

SEQ ID NO: 685373 - RNA, 19 nt, Haemophilus influenzae Rd
ggaauucuucuggcauauc

SEQ ID NO: 685374 - RNA, 15 nt, Haemophilus influenzae Rd
ggaauugguagacac

SEQ ID NO: 685375 - RNA, 18 nt, Haemophilus influenzae Rd
ggacaccgcuaaaccuug

SEQ ID NO: 685376 - RNA, 21 nt, Haemophilus influenzae Rd
ggacauaagagaaccgaacac

SEQ ID NO: 685377 - RNA, 23 nt, Haemophilus influenzae Rd
ggacuaaauuagaauuuaguccu

SEQ ID NO: 685378 - RNA, 18 nt, Haemophilus influenzae Rd
ggacuaagcuuuuuuuaa

SEQ ID NO: 685379 - RNA, 22 nt, Haemophilus influenzae Rd
ggagagcuuagauacauaaaaa

SEQ ID NO: 685380 - RNA, 14 nt, Haemophilus influenzae Rd
ggagaauaacaugc

SEQ ID NO: 685381 - RNA, 23 nt, Haemophilus influenzae Rd
ggagaacuucaaauuguacuuuu

SEQ ID NO: 685382 - RNA, 17 nt, Haemophilus influenzae Rd
ggauaacccuccgcauu

SEQ ID NO: 685383 - RNA, 13 nt, Haemophilus influenzae Rd
ggauaaaauaaac

SEQ ID NO: 685384 - RNA, 22 nt, Haemophilus influenzae Rd
ggauaaaauaaacauuuuucau

SEQ ID NO: 685385 - RNA, 18 nt, Haemophilus influenzae Rd
ggaucauaaguaaaacca

SEQ ID NO: 685386 - RNA, 14 nt, Haemophilus influenzae Rd
ggauauggauauuc

SEQ ID NO: 685387 - RNA, 23 nt, Haemophilus influenzae Rd
ggauaauuuagcccgaaaauuaa

SEQ ID NO: 685388 - RNA, 17 nt, Haemophilus influenzae Rd
ggauaauguucuuuuaa

SEQ ID NO: 685389 - RNA, 19 nt, Haemophilus influenzae Rd
ggauaauguuucacuuugc

SEQ ID NO: 685390 - RNA, 15 nt, Haemophilus influenzae Rd
ggcaaacaaaauaaa

SEQ ID NO: 685391 - RNA, 18 nt, Haemophilus influenzae Rd
ggcauacuuaacaaaucc

SEQ ID NO: 685392 - RNA, 22 nt, Haemophilus influenzae Rd
ggcauauugcuugcauucacaa

SEQ ID NO: 685393 - RNA, 19 nt, Haemophilus influenzae Rd
ggcauauaagauuuuugcc

SEQ ID NO: 685394 - RNA, 23 nt, Haemophilus influenzae Rd
ggcacgaccaauauugaaaagua

SEQ ID NO: 685395 - RNA, 13 nt, Haemophilus influenzae Rd
ggcacauaaauca

SEQ ID NO: 685396 - RNA, 20 nt, Haemophilus influenzae Rd
ggcagccauaaaugcuacuu

SEQ ID NO: 685397 - RNA, 20 nt, Haemophilus influenzae Rd
ggcagaauuucgucaaaaau

SEQ ID NO: 685398 - RNA, 21 nt, Haemophilus influenzae Rd
ggcagcaagaccccaagcaaa

SEQ ID NO: 685399 - RNA, 14 nt, Haemophilus influenzae Rd
gcggacuuuuucau

SEQ ID NO: 685400 - RNA, 11 nt, Haemophilus influenzae Rd
gcggagaaaau

SEQ ID NO: 685401 - RNA, 13 nt, Haemophilus influenzae Rd
gcggauaaccaaa

SEQ ID NO: 685402 - RNA, 15 nt, Haemophilus influenzae Rd
gcgcuuucaauuuuc

SEQ ID NO: 685403 - RNA, 16 nt, Haemophilus influenzae Rd
gcgcuugugcuggagu

SEQ ID NO: 685404 - RNA, 15 nt, Haemophilus influenzae Rd
gcgagucgcacccgc

SEQ ID NO: 685405 - RNA, 14 nt, Haemophilus influenzae Rd
gcgauaauuugcau

SEQ ID NO: 685406 - RNA, 17 nt, Haemophilus influenzae Rd
gcgaucaccauaaucaa

SEQ ID NO: 685407 - RNA, 13 nt, Haemophilus influenzae Rd
gcgaucuguuuua

SEQ ID NO: 685408 - RNA, 12 nt, Haemophilus influenzae Rd
gcgaucugcacu

SEQ ID NO: 685409 - RNA, 14 nt, Haemophilus influenzae Rd
gcgacuuucccugc

SEQ ID NO: 685410 - RNA, 20 nt, Haemophilus influenzae Rd
gcgagaaaaacgaauuaaug

SEQ ID NO: 685411 - RNA, 23 nt, Haemophilus influenzae Rd
gcgacucaccgcaauaauaccuu

SEQ ID NO: 685412 - RNA, 22 nt, Haemophilus influenzae Rd
gcgaauuuaagaaaaaauauaa

SEQ ID NO: 685413 - RNA, 17 nt, Haemophilus influenzae Rd
gcgacauuaagugcauc

SEQ ID NO: 685414 - RNA, 16 nt, Haemophilus influenzae Rd
gcgaaucgcuucagaa

SEQ ID NO: 685415 - RNA, 17 nt, Haemophilus influenzae Rd
gcgaagagauucuaauu

SEQ ID NO: 685416 - RNA, 21 nt, Haemophilus influenzae Rd
gccuaaauacauuuagugcua

SEQ ID NO: 685417 - RNA, 14 nt, Haemophilus influenzae Rd
gcgguaauuauaga

SEQ ID NO: 685418 - RNA, 13 nt, Haemophilus influenzae Rd
gcgguaaaaaaau

SEQ ID NO: 685419 - RNA, 17 nt, Haemophilus influenzae Rd
gcgguaagaaaaucaac

SEQ ID NO: 685420 - RNA, 21 nt, Haemophilus influenzae Rd
gcgguccguuuucaaugcaaa

SEQ ID NO: 685421 - RNA, 14 nt, Haemophilus influenzae Rd
gcggcuauggcagc

SEQ ID NO: 685422 - RNA, 17 nt, Haemophilus influenzae Rd
gcggcuauggcagccgc

SEQ ID NO: 685423 - RNA, 18 nt, Haemophilus influenzae Rd
gcggcuauggcagccgca

SEQ ID NO: 685424 - RNA, 18 nt, Haemophilus influenzae Rd
gcggugcaauuugaaaag

SEQ ID NO: 685425 - RNA, 22 nt, Haemophilus influenzae Rd
gcgucgcagccuuguucugcag

SEQ ID NO: 685426 - RNA, 18 nt, Haemophilus influenzae Rd
gcgugagcgauagccaaa

SEQ ID NO: 685427 - RNA, 21 nt, Haemophilus influenzae Rd
gcgucuaaugccgccuuaucu

SEQ ID NO: 685428 - RNA, 12 nt, Haemophilus influenzae Rd
gcguuaaaucac

SEQ ID NO: 685429 - RNA, 14 nt, Haemophilus influenzae Rd
gcguucaucuuaua

SEQ ID NO: 685430 - RNA, 15 nt, Haemophilus influenzae Rd
gcguucaauaugcaa

SEQ ID NO: 685431 - RNA, 22 nt, Haemophilus influenzae Rd
gcguucacguaauggaauaugg

SEQ ID NO: 685432 - RNA, 18 nt, Haemophilus influenzae Rd
gcuaucuuaccuuuuucu

SEQ ID NO: 685433 - RNA, 21 nt, Haemophilus influenzae Rd
gcuaucaggcuuaacuuucuc

SEQ ID NO: 685434 - RNA, 20 nt, Haemophilus influenzae Rd
gcuauacaaaauuuuguccg

SEQ ID NO: 685435 - RNA, 14 nt, Haemophilus influenzae Rd
gcuauagcuugcag

SEQ ID NO: 685436 - RNA, 20 nt, Haemophilus influenzae Rd
gcuauaaaucguauaagccc

SEQ ID NO: 685437 - RNA, 22 nt, Haemophilus influenzae Rd
gcuagcgaauuagguugaauuu

SEQ ID NO: 685438 - RNA, 13 nt, Haemophilus influenzae Rd
gcguuucaaaugc

SEQ ID NO: 685439 - RNA, 22 nt, Haemophilus influenzae Rd
gcguuuaggagaagauuuauau

SEQ ID NO: 685440 - RNA, 19 nt, Haemophilus influenzae Rd
gcuauucccgcauuuauca

SEQ ID NO: 685441 - RNA, 12 nt, Haemophilus influenzae Rd
gcuauuuucuaa

SEQ ID NO: 685442 - RNA, 20 nt, Haemophilus influenzae Rd
gcuauuuucuaauuuucaca

SEQ ID NO: 685443 - RNA, 12 nt, Haemophilus influenzae Rd
gcuauuuugcau

SEQ ID NO: 685444 - RNA, 17 nt, Haemophilus influenzae Rd
gcuauuuuuaauuuacu

SEQ ID NO: 685445 - RNA, 14 nt, Haemophilus influenzae Rd
gcuauuaaaaaaag

SEQ ID NO: 685446 - RNA, 16 nt, Haemophilus influenzae Rd
gcuauuaaaaaaagca

SEQ ID NO: 685447 - RNA, 12 nt, Haemophilus influenzae Rd
gcucaaaaugcu

SEQ ID NO: 685448 - RNA, 15 nt, Haemophilus influenzae Rd
gcucaaaaugcucuu

SEQ ID NO: 685449 - RNA, 16 nt, Haemophilus influenzae Rd
gcucaaauuuucuguu

SEQ ID NO: 685450 - RNA, 11 nt, Haemophilus influenzae Rd
gcucaaauaaa

SEQ ID NO: 685451 - RNA, 23 nt, Haemophilus influenzae Rd
gcucaaauaaauugcccucugca

SEQ ID NO: 685452 - RNA, 16 nt, Haemophilus influenzae Rd
gcucaauaauuuucac

SEQ ID NO: 685453 - RNA, 17 nt, Haemophilus influenzae Rd
gcucccgccccacuuuc

SEQ ID NO: 685454 - RNA, 20 nt, Haemophilus influenzae Rd
gcucccagugcugaaauaua

SEQ ID NO: 685455 - RNA, 15 nt, Haemophilus influenzae Rd
gcucacuaauucccc

SEQ ID NO: 685456 - RNA, 17 nt, Haemophilus influenzae Rd
gcucaggaaaacguuca

SEQ ID NO: 685457 - RNA, 19 nt, Haemophilus influenzae Rd
gcuccaguaagcauauuug

SEQ ID NO: 685458 - RNA, 16 nt, Haemophilus influenzae Rd
gcugacgguucaguuu

SEQ ID NO: 685459 - RNA, 18 nt, Haemophilus influenzae Rd
gcugaccacuuucaauuu

SEQ ID NO: 685460 - RNA, 19 nt, Haemophilus influenzae Rd
gcugacaaauuuguugauc

SEQ ID NO: 685461 - RNA, 21 nt, Haemophilus influenzae Rd
gcugaaaugaaguaauaaucu

SEQ ID NO: 685462 - RNA, 14 nt, Haemophilus influenzae Rd
gcugaauaaaagag

SEQ ID NO: 685463 - RNA, 17 nt, Haemophilus influenzae Rd
gcugaguacacaaaacu

SEQ ID NO: 685464 - RNA, 23 nt, Haemophilus influenzae Rd
gcugauaauaaagcuacuaaaaa

SEQ ID NO: 685465 - RNA, 23 nt, Haemophilus influenzae Rd
gcugauaaauuccuuccaacaau

SEQ ID NO: 685466 - RNA, 15 nt, Haemophilus influenzae Rd
gcugauaaauuucua

SEQ ID NO: 685467 - RNA, 17 nt, Haemophilus influenzae Rd
gcugaucuugguagaaa

SEQ ID NO: 685468 - RNA, 15 nt, Haemophilus influenzae Rd
gcucuuggauuuuuu

SEQ ID NO: 685469 - RNA, 18 nt, Haemophilus influenzae Rd
gcucuucuuuaauuucuu

SEQ ID NO: 685470 - RNA, 20 nt, Haemophilus influenzae Rd
gcucuucuuuaauuucuuca

SEQ ID NO: 685471 - RNA, 15 nt, Haemophilus influenzae Rd
gcucuucagcuucuu

SEQ ID NO: 685472 - RNA, 17 nt, Haemophilus influenzae Rd
gcucuucagcuucuuca

SEQ ID NO: 685473 - RNA, 18 nt, Haemophilus influenzae Rd
gcucuuuuuauuuagaac

SEQ ID NO: 685474 - RNA, 14 nt, Haemophilus influenzae Rd
gcucuuuaacaaau

SEQ ID NO: 685475 - RNA, 15 nt, Haemophilus influenzae Rd
gcucuuuaacaaauu

SEQ ID NO: 685476 - RNA, 16 nt, Haemophilus influenzae Rd
gcucuuuuuguugauc

SEQ ID NO: 685477 - RNA, 23 nt, Haemophilus influenzae Rd
gcucuuuuuguugaucuaacguu

SEQ ID NO: 685478 - RNA, 14 nt, Haemophilus influenzae Rd
gcugaaagaaauuu

SEQ ID NO: 685479 - RNA, 13 nt, Haemophilus influenzae Rd
gcucuguauuuug

SEQ ID NO: 685480 - RNA, 18 nt, Haemophilus influenzae Rd
gcucugcuagucguucuu

SEQ ID NO: 685481 - RNA, 12 nt, Haemophilus influenzae Rd
gcucugcaccuu

SEQ ID NO: 685482 - RNA, 19 nt, Haemophilus influenzae Rd
gcucguauaauauuuucuu

SEQ ID NO: 685483 - RNA, 15 nt, Haemophilus influenzae Rd
gcucguuauuauuaa

SEQ ID NO: 685484 - RNA, 16 nt, Haemophilus influenzae Rd
gcucgugauuaucuaa

SEQ ID NO: 685485 - RNA, 14 nt, Haemophilus influenzae Rd
gcucuaaaagcugu

SEQ ID NO: 685486 - RNA, 18 nt, Haemophilus influenzae Rd
gcucuaaauuaauuuacu

SEQ ID NO: 685487 - RNA, 14 nt, Haemophilus influenzae Rd
gcucucguuguucu

SEQ ID NO: 685488 - RNA, 14 nt, Haemophilus influenzae Rd
gcucuaucuuauua

SEQ ID NO: 685489 - RNA, 13 nt, Haemophilus influenzae Rd
gcucuauuuaucc

SEQ ID NO: 685490 - RNA, 21 nt, Haemophilus influenzae Rd
gcucuacgcaagcgguuaaau

SEQ ID NO: 685491 - RNA, 12 nt, Haemophilus influenzae Rd
gcucuagaaaau

SEQ ID NO: 685492 - RNA, 17 nt, Haemophilus influenzae Rd
gcucuaccgacugagcu

SEQ ID NO: 685493 - RNA, 16 nt, Haemophilus influenzae Rd
gcucuaccuaaaauaa

SEQ ID NO: 685494 - RNA, 20 nt, Haemophilus influenzae Rd
gcaucgcuggcuaaauuuuu

SEQ ID NO: 685495 - RNA, 22 nt, Haemophilus influenzae Rd
gcaucgcccaauuuggcaaaag

SEQ ID NO: 685496 - RNA, 17 nt, Haemophilus influenzae Rd
gcaucgugaugauuuuc

SEQ ID NO: 685497 - RNA, 13 nt, Haemophilus influenzae Rd
gcaucugauuuuc

SEQ ID NO: 685498 - RNA, 15 nt, Haemophilus influenzae Rd
gcaucugauuuucag

SEQ ID NO: 685499 - RNA, 21 nt, Haemophilus influenzae Rd
gcaucuucuauucucuguugc

SEQ ID NO: 685500 - RNA, 14 nt, Haemophilus influenzae Rd
gcaugaauaucuuc

SEQ ID NO: 685501 - RNA, 19 nt, Haemophilus influenzae Rd
gcaugaagaacuuguaguu

SEQ ID NO: 685502 - RNA, 21 nt, Haemophilus influenzae Rd
gcauguuuacuuaaaucuuua

SEQ ID NO: 685503 - RNA, 14 nt, Haemophilus influenzae Rd
gcauuaaaaauuua

SEQ ID NO: 685504 - RNA, 20 nt, Haemophilus influenzae Rd
gcauuacaaagccuugauuc

SEQ ID NO: 685505 - RNA, 16 nt, Haemophilus influenzae Rd
gcauuaaguuuuuagc

SEQ ID NO: 685506 - RNA, 21 nt, Haemophilus influenzae Rd
gcauuaauaaucuaauccaaa

SEQ ID NO: 685507 - RNA, 20 nt, Haemophilus influenzae Rd
gcauuaauaggaauaacaca

SEQ ID NO: 685508 - RNA, 23 nt, Haemophilus influenzae Rd
gcauuaauuggcgcaacaucaaa

SEQ ID NO: 685509 - RNA, 21 nt, Haemophilus influenzae Rd
gcauuguaaaccaaauuucuu

SEQ ID NO: 685510 - RNA, 21 nt, Haemophilus influenzae Rd
gcauugugggcuuuaagcuuu

SEQ ID NO: 685511 - RNA, 22 nt, Haemophilus influenzae Rd
gcauuguuaucuaaauaauuuc

SEQ ID NO: 685512 - RNA, 14 nt, Haemophilus influenzae Rd
gcauuuaaauauua

SEQ ID NO: 685513 - RNA, 13 nt, Haemophilus influenzae Rd
gcauuuaaauaaa

SEQ ID NO: 685514 - RNA, 15 nt, Haemophilus influenzae Rd
gcauuuaaauaagga

SEQ ID NO: 685515 - RNA, 22 nt, Haemophilus influenzae Rd
gcauuuaaauaaggaucuugua

SEQ ID NO: 685516 - RNA, 13 nt, Haemophilus influenzae Rd
gcauuucaagcug

SEQ ID NO: 685517 - RNA, 15 nt, Haemophilus influenzae Rd
gcauugaguuuuucu

SEQ ID NO: 685518 - RNA, 23 nt, Haemophilus influenzae Rd
gcauugauugcuuuaacugaagc

SEQ ID NO: 685519 - RNA, 15 nt, Haemophilus influenzae Rd
gcauucacaaaaguu

SEQ ID NO: 685520 - RNA, 23 nt, Haemophilus influenzae Rd
gcauucacaaaaguuugcaacau

SEQ ID NO: 685521 - RNA, 17 nt, Haemophilus influenzae Rd
gcauucccacgguucca

SEQ ID NO: 685522 - RNA, 15 nt, Haemophilus influenzae Rd
gccaagaauaaaaug

SEQ ID NO: 685523 - RNA, 17 nt, Haemophilus influenzae Rd
gccaacucgaacaugaa

SEQ ID NO: 685524 - RNA, 14 nt, Haemophilus influenzae Rd
gccaacguaagcac

SEQ ID NO: 685525 - RNA, 18 nt, Haemophilus influenzae Rd
gccaacgcuuaaugaacu

SEQ ID NO: 685526 - RNA, 14 nt, Haemophilus influenzae Rd
gccaaauuuaaaaa

SEQ ID NO: 685527 - RNA, 21 nt, Haemophilus influenzae Rd
gccaaaucaucggcuacaggu

SEQ ID NO: 685528 - RNA, 11 nt, Haemophilus influenzae Rd
gccaaaucuca

SEQ ID NO: 685529 - RNA, 23 nt, Haemophilus influenzae Rd
gcauuugccguaaagauacacgu

SEQ ID NO: 685530 - RNA, 12 nt, Haemophilus influenzae Rd
gcauuugcauau

SEQ ID NO: 685531 - RNA, 13 nt, Haemophilus influenzae Rd
gcauuuucuucca

SEQ ID NO: 685532 - RNA, 16 nt, Haemophilus influenzae Rd
gcauuuuuuauuuuua

SEQ ID NO: 685533 - RNA, 21 nt, Haemophilus influenzae Rd
gcauuuuguaagcaacacaga

SEQ ID NO: 685534 - RNA, 14 nt, Haemophilus influenzae Rd
gccaaaaauuaaua

SEQ ID NO: 685535 - RNA, 19 nt, Haemophilus influenzae Rd
gccaaaaauuaauacugaa

SEQ ID NO: 685536 - RNA, 20 nt, Haemophilus influenzae Rd
gccaaaaauuaauacugaaa

SEQ ID NO: 685537 - RNA, 16 nt, Haemophilus influenzae Rd
gcauuuuuaugauuaa

SEQ ID NO: 685538 - RNA, 18 nt, Haemophilus influenzae Rd
gcauuuuucuuuaaaauu

SEQ ID NO: 685539 - RNA, 21 nt, Haemophilus influenzae Rd
gccaaaguguggcuuuuuuuc

SEQ ID NO: 685540 - RNA, 14 nt, Haemophilus influenzae Rd
gccaaauaugaacu

SEQ ID NO: 685541 - RNA, 16 nt, Haemophilus influenzae Rd
gccaaaaugagcuuuu

SEQ ID NO: 685542 - RNA, 16 nt, Haemophilus influenzae Rd
gccaauaauaaagcuc

SEQ ID NO: 685543 - RNA, 21 nt, Haemophilus influenzae Rd
gccaaguccccauuuguagaa

SEQ ID NO: 685544 - RNA, 22 nt, Haemophilus influenzae Rd
gccaaguccccauuuguagaaa

SEQ ID NO: 685545 - RNA, 21 nt, Haemophilus influenzae Rd
gccaagugcggucagcauaaa

SEQ ID NO: 685546 - RNA, 21 nt, Haemophilus influenzae Rd
gccaaguacaauuaaauccau

SEQ ID NO: 685547 - RNA, 11 nt, Haemophilus influenzae Rd
gccaauacuua

SEQ ID NO: 685548 - RNA, 21 nt, Haemophilus influenzae Rd
gccaaugcuuuuaauuuagcg

SEQ ID NO: 685549 - RNA, 20 nt, Haemophilus influenzae Rd
gccaauggaaauaccaugga

SEQ ID NO: 685550 - RNA, 16 nt, Haemophilus influenzae Rd
gccaauugaauuaaaa

SEQ ID NO: 685551 - RNA, 13 nt, Haemophilus influenzae Rd
gccaaugccucuu

SEQ ID NO: 685552 - RNA, 16 nt, Haemophilus influenzae Rd
gccacaaauaaacaaa

SEQ ID NO: 685553 - RNA, 14 nt, Haemophilus influenzae Rd
gccacaacugaagc

SEQ ID NO: 685554 - RNA, 23 nt, Haemophilus influenzae Rd
gccacaacugaagcuucuucacc

SEQ ID NO: 685555 - RNA, 22 nt, Haemophilus influenzae Rd
gccacugcgcccgcugcauccg

SEQ ID NO: 685556 - RNA, 23 nt, Haemophilus influenzae Rd
gccacuguugugaaguuuuuuaa

SEQ ID NO: 685557 - RNA, 20 nt, Haemophilus influenzae Rd
gccacuuaauccuuucacua

SEQ ID NO: 685558 - RNA, 16 nt, Haemophilus influenzae Rd
gccacuucuucaaaga

SEQ ID NO: 685559 - RNA, 20 nt, Haemophilus influenzae Rd
gccagcaccacguucauaaa

SEQ ID NO: 685560 - RNA, 17 nt, Haemophilus influenzae Rd
gccagaaagcagguuuu

SEQ ID NO: 685561 - RNA, 14 nt, Haemophilus influenzae Rd
gccagcuaaagaaa

SEQ ID NO: 685562 - RNA, 19 nt, Haemophilus influenzae Rd
gccagcuaaagaaagcaau

SEQ ID NO: 685563 - RNA, 13 nt, Haemophilus influenzae Rd
gccauuucccaua

SEQ ID NO: 685564 - RNA, 21 nt, Haemophilus influenzae Rd
gccauuuucuaccgcacuuau

SEQ ID NO: 685565 - RNA, 14 nt, Haemophilus influenzae Rd
gccauuuuuaaguu

SEQ ID NO: 685566 - RNA, 15 nt, Haemophilus influenzae Rd
gccauugcuaaauuu

SEQ ID NO: 685567 - RNA, 18 nt, Haemophilus influenzae Rd
gccauugcuagccaauaa

SEQ ID NO: 685568 - RNA, 14 nt, Haemophilus influenzae Rd
gcccaaaugcaaca

SEQ ID NO: 685569 - RNA, 14 nt, Haemophilus influenzae Rd
gcccaauuuggcaa

SEQ ID NO: 685570 - RNA, 14 nt, Haemophilus influenzae Rd
gcccaauccagauu

SEQ ID NO: 685571 - RNA, 23 nt, Haemophilus influenzae Rd
gcccaauccagauuaaaaauuca

SEQ ID NO: 685572 - RNA, 17 nt, Haemophilus influenzae Rd
gcccaaguugugccaau

SEQ ID NO: 685573 - RNA, 21 nt, Haemophilus influenzae Rd
gcccaauaaaaguaauuucuu

SEQ ID NO: 685574 - RNA, 14 nt, Haemophilus influenzae Rd
gccauggcuuuuuc

SEQ ID NO: 685575 - RNA, 18 nt, Haemophilus influenzae Rd
gccauggcuuuuuccuga

SEQ ID NO: 685576 - RNA, 15 nt, Haemophilus influenzae Rd
gccauuaaacuucug

SEQ ID NO: 685577 - RNA, 14 nt, Haemophilus influenzae Rd
gccauuaaaauuca

SEQ ID NO: 685578 - RNA, 15 nt, Haemophilus influenzae Rd
gccauucacauucuu

SEQ ID NO: 685579 - RNA, 19 nt, Haemophilus influenzae Rd
gccauucacauucuuuuaa

SEQ ID NO: 685580 - RNA, 19 nt, Haemophilus influenzae Rd
gccauucguucccaaauau

SEQ ID NO: 685581 - RNA, 22 nt, Haemophilus influenzae Rd
gccaucaauaacugaucgccau

SEQ ID NO: 685582 - RNA, 16 nt, Haemophilus influenzae Rd
gccauauuuucccagu

SEQ ID NO: 685583 - RNA, 15 nt, Haemophilus influenzae Rd
gccaucaauaaaaag

SEQ ID NO: 685584 - RNA, 17 nt, Haemophilus influenzae Rd
gccaucacagucuuuua

SEQ ID NO: 685585 - RNA, 15 nt, Haemophilus influenzae Rd
gccaucaccaagaau

SEQ ID NO: 685586 - RNA, 15 nt, Haemophilus influenzae Rd
gcccuguugaaacag

SEQ ID NO: 685587 - RNA, 20 nt, Haemophilus influenzae Rd
gcccuguagauuacagagcc

SEQ ID NO: 685588 - RNA, 14 nt, Haemophilus influenzae Rd
gcccucgccuugca

SEQ ID NO: 685589 - RNA, 13 nt, Haemophilus influenzae Rd
gcccuauaccacc

SEQ ID NO: 685590 - RNA, 23 nt, Haemophilus influenzae Rd
gccccugcaauugugucauucgc

SEQ ID NO: 685591 - RNA, 21 nt, Haemophilus influenzae Rd
gccgcaaaaccuaacauaaug

SEQ ID NO: 685592 - RNA, 14 nt, Haemophilus influenzae Rd
gccgacacuaaaaa

SEQ ID NO: 685593 - RNA, 21 nt, Haemophilus influenzae Rd
gccgaauaaacgaccuucauc

SEQ ID NO: 685594 - RNA, 15 nt, Haemophilus influenzae Rd
gcccuuuuucaauua

SEQ ID NO: 685595 - RNA, 15 nt, Haemophilus influenzae Rd
gcccuuuauuuuguu

SEQ ID NO: 685596 - RNA, 17 nt, Haemophilus influenzae Rd
gcccuucaccuucgaau

SEQ ID NO: 685597 - RNA, 18 nt, Haemophilus influenzae Rd
gcccuuaaccaucuuuuu

SEQ ID NO: 685598 - RNA, 23 nt, Haemophilus influenzae Rd
gcccuuaaccaucuuuuuuugca

SEQ ID NO: 685599 - RNA, 13 nt, Haemophilus influenzae Rd
gccgugauaacaa

SEQ ID NO: 685600 - RNA, 22 nt, Haemophilus influenzae Rd
gccgugauaacaacucacaaua

SEQ ID NO: 685601 - RNA, 21 nt, Haemophilus influenzae Rd
gccguucaaaacaauggcuga

SEQ ID NO: 685602 - RNA, 12 nt, Haemophilus influenzae Rd
gccguaaugcuu

SEQ ID NO: 685603 - RNA, 15 nt, Haemophilus influenzae Rd
gccguauugaauaau

SEQ ID NO: 685604 - RNA, 22 nt, Haemophilus influenzae Rd
gccgccuuuuucauauucccaa

SEQ ID NO: 685605 - RNA, 16 nt, Haemophilus influenzae Rd
gccgcaaucacaaaau

SEQ ID NO: 685606 - RNA, 19 nt, Haemophilus influenzae Rd
gaauuucuuaaaagaaauu

SEQ ID NO: 685607 - RNA, 15 nt, Haemophilus influenzae Rd
gaauuucuaauuuuu

SEQ ID NO: 685608 - RNA, 20 nt, Haemophilus influenzae Rd
gaauuuguaagauuuugccu

SEQ ID NO: 685609 - RNA, 21 nt, Haemophilus influenzae Rd
gaauuugaucacgaguaauau

SEQ ID NO: 685610 - RNA, 14 nt, Haemophilus influenzae Rd
gaguaucaaaacuu

SEQ ID NO: 685611 - RNA, 15 nt, Haemophilus influenzae Rd
gaguaucaaaacuug

SEQ ID NO: 685612 - RNA, 13 nt, Haemophilus influenzae Rd
gagucaauccagu

SEQ ID NO: 685613 - RNA, 21 nt, Haemophilus influenzae Rd
gagugcgaucaccauaaucaa

SEQ ID NO: 685614 - RNA, 15 nt, Haemophilus influenzae Rd
gagucgccugcucua

SEQ ID NO: 685615 - RNA, 14 nt, Haemophilus influenzae Rd
gauaaaaaagaaau

SEQ ID NO: 685616 - RNA, 17 nt, Haemophilus influenzae Rd
gauaaaaaccagauaaa

SEQ ID NO: 685617 - RNA, 18 nt, Haemophilus influenzae Rd
gaguucuugcaacuuuuu

SEQ ID NO: 685618 - RNA, 19 nt, Haemophilus influenzae Rd
gaguucuugcaacuuuuuu

SEQ ID NO: 685619 - RNA, 21 nt, Haemophilus influenzae Rd
gaguucucguugcaucuucua

SEQ ID NO: 685620 - RNA, 20 nt, Haemophilus influenzae Rd
gaguuaggcauugacuaaga

SEQ ID NO: 685621 - RNA, 15 nt, Haemophilus influenzae Rd
gaguuauuucuuuaa

SEQ ID NO: 685622 - RNA, 14 nt, Haemophilus influenzae Rd
gaguucaacgacaa

SEQ ID NO: 685623 - RNA, 22 nt, Haemophilus influenzae Rd
gauaaaacagagaaaaaaauag

SEQ ID NO: 685624 - RNA, 23 nt, Haemophilus influenzae Rd
gauaaaaauuaaggaaagcccca

SEQ ID NO: 685625 - RNA, 14 nt, Haemophilus influenzae Rd
gauaaaaagugcgg

SEQ ID NO: 685626 - RNA, 22 nt, Haemophilus influenzae Rd
gauaaaaauaaaaaaacccagu

SEQ ID NO: 685627 - RNA, 18 nt, Haemophilus influenzae Rd
gauaaaauuaaucauaaa

SEQ ID NO: 685628 - RNA, 12 nt, Haemophilus influenzae Rd
gauaaaaucaaa

SEQ ID NO: 685629 - RNA, 14 nt, Haemophilus influenzae Rd
gauaaaauaaacau

SEQ ID NO: 685630 - RNA, 21 nt, Haemophilus influenzae Rd
gauaaacaaaccuaaaccuua

SEQ ID NO: 685631 - RNA, 13 nt, Haemophilus influenzae Rd
gauaaagauaacu

SEQ ID NO: 685632 - RNA, 21 nt, Haemophilus influenzae Rd
gauaaaguaguuuuaguaauu

SEQ ID NO: 685633 - RNA, 21 nt, Haemophilus influenzae Rd
gauacuuuuaauuaaauacaa

SEQ ID NO: 685634 - RNA, 22 nt, Haemophilus influenzae Rd
gauacuuuuaauuaaauacaaa

SEQ ID NO: 685635 - RNA, 11 nt, Haemophilus influenzae Rd
gauacuuucua

SEQ ID NO: 685636 - RNA, 13 nt, Haemophilus influenzae Rd
gauaccgauaaaa

SEQ ID NO: 685637 - RNA, 14 nt, Haemophilus influenzae Rd
gauaccacauucca

SEQ ID NO: 685638 - RNA, 14 nt, Haemophilus influenzae Rd
gauaccaagauaau

SEQ ID NO: 685639 - RNA, 15 nt, Haemophilus influenzae Rd
gauacauuucuaaaa

SEQ ID NO: 685640 - RNA, 20 nt, Haemophilus influenzae Rd
gauaccaagcauauuugcug

SEQ ID NO: 685641 - RNA, 12 nt, Haemophilus influenzae Rd
gauacaagaaag

SEQ ID NO: 685642 - RNA, 17 nt, Haemophilus influenzae Rd
gauacaaucgguuaaaa

SEQ ID NO: 685643 - RNA, 18 nt, Haemophilus influenzae Rd
gauacaaucgguuaaaag

SEQ ID NO: 685644 - RNA, 15 nt, Haemophilus influenzae Rd
gauacauaauauuga

SEQ ID NO: 685645 - RNA, 22 nt, Haemophilus influenzae Rd
gauaaccuuuaccgucaauaaa

SEQ ID NO: 685646 - RNA, 21 nt, Haemophilus influenzae Rd
gauaacgcuugaauaaauccc

SEQ ID NO: 685647 - RNA, 16 nt, Haemophilus influenzae Rd
gauaacuaauuucgca

SEQ ID NO: 685648 - RNA, 20 nt, Haemophilus influenzae Rd
gauaacguaaguaaugaaaa

SEQ ID NO: 685649 - RNA, 16 nt, Haemophilus influenzae Rd
gauaaucaaaaaugcu

SEQ ID NO: 685650 - RNA, 13 nt, Haemophilus influenzae Rd
gauaauauuuuug

SEQ ID NO: 685651 - RNA, 17 nt, Haemophilus influenzae Rd
gauaauauuuuugccaa

SEQ ID NO: 685652 - RNA, 22 nt, Haemophilus influenzae Rd
gauaauaucgcccgcuuuaagu

SEQ ID NO: 685653 - RNA, 22 nt, Haemophilus influenzae Rd
gauaauaugcaucacuugugcu

SEQ ID NO: 685654 - RNA, 18 nt, Haemophilus influenzae Rd
gauaauauguuuugccaa

SEQ ID NO: 685655 - RNA, 20 nt, Haemophilus influenzae Rd
gauaauauuccaaaaaauaa

SEQ ID NO: 685656 - RNA, 18 nt, Haemophilus influenzae Rd
gauaauagacauagaaag

SEQ ID NO: 685657 - RNA, 22 nt, Haemophilus influenzae Rd
gauaauaaagcuacuaaaaauu

SEQ ID NO: 685658 - RNA, 20 nt, Haemophilus influenzae Rd
gauaaucagcccaagcuuuu

SEQ ID NO: 685659 - RNA, 19 nt, Haemophilus influenzae Rd
gauaauccagcuacauuca

SEQ ID NO: 685660 - RNA, 17 nt, Haemophilus influenzae Rd
gauaaucuaaaaaaccu

SEQ ID NO: 685661 - RNA, 17 nt, Haemophilus influenzae Rd
gauaaucuacaaaacau

SEQ ID NO: 685662 - RNA, 20 nt, Haemophilus influenzae Rd
gauaaucuacaaaacauaau

SEQ ID NO: 685663 - RNA, 17 nt, Haemophilus influenzae Rd
gauaaugaugaaugcuu

SEQ ID NO: 685664 - RNA, 16 nt, Haemophilus influenzae Rd
gauaauguuagacauu

SEQ ID NO: 685665 - RNA, 16 nt, Haemophilus influenzae Rd
gauaauuaaagucaga

SEQ ID NO: 685666 - RNA, 15 nt, Haemophilus influenzae Rd
gauaauuaacaauau

SEQ ID NO: 685667 - RNA, 20 nt, Haemophilus influenzae Rd
gauaaugguuacagaaauau

SEQ ID NO: 685668 - RNA, 20 nt, Haemophilus influenzae Rd
gauaauuucccuaaaaucuu

SEQ ID NO: 685669 - RNA, 11 nt, Haemophilus influenzae Rd
gauacaaauaa

SEQ ID NO: 685670 - RNA, 16 nt, Haemophilus influenzae Rd
gauacaaagauuucau

SEQ ID NO: 685671 - RNA, 15 nt, Haemophilus influenzae Rd
gauacaaaauguuua

SEQ ID NO: 685672 - RNA, 15 nt, Haemophilus influenzae Rd
gauaauuuaagcaaa

SEQ ID NO: 685673 - RNA, 13 nt, Haemophilus influenzae Rd
gauauuacuuaua

SEQ ID NO: 685674 - RNA, 17 nt, Haemophilus influenzae Rd
gauauguuaauaagccc

SEQ ID NO: 685675 - RNA, 11 nt, Haemophilus influenzae Rd
gauauuaauac

SEQ ID NO: 685676 - RNA, 14 nt, Haemophilus influenzae Rd
gauauugcacaaua

SEQ ID NO: 685677 - RNA, 10 nt, Haemophilus influenzae Rd
gauauccauu

SEQ ID NO: 685678 - RNA, 19 nt, Haemophilus influenzae Rd
gauagcaaugccaaucuaa

SEQ ID NO: 685679 - RNA, 13 nt, Haemophilus influenzae Rd
gauaugaaauaaa

SEQ ID NO: 685680 - RNA, 21 nt, Haemophilus influenzae Rd
gauauuuaacaucaugaaaug

SEQ ID NO: 685681 - RNA, 19 nt, Haemophilus influenzae Rd
gaucaagcacuuuuccuuu

SEQ ID NO: 685682 - RNA, 17 nt, Haemophilus influenzae Rd
gaucaagccacugauua

SEQ ID NO: 685683 - RNA, 16 nt, Haemophilus influenzae Rd
gaucaggaucaaaaau

SEQ ID NO: 685684 - RNA, 15 nt, Haemophilus influenzae Rd
gaucauuagcaacuu

SEQ ID NO: 685685 - RNA, 17 nt, Haemophilus influenzae Rd
gaucaugguuguaauaa

SEQ ID NO: 685686 - RNA, 19 nt, Haemophilus influenzae Rd
gaucaugguuguaauaaug

SEQ ID NO: 685687 - RNA, 21 nt, Haemophilus influenzae Rd
gauccacauagcaaaaaaccu

SEQ ID NO: 685688 - RNA, 14 nt, Haemophilus influenzae Rd
gauccacacuucau

SEQ ID NO: 685689 - RNA, 21 nt, Haemophilus influenzae Rd
gauccacacuucaucacuaaa

SEQ ID NO: 685690 - RNA, 19 nt, Haemophilus influenzae Rd
gaucgaaaaaucuuugaau

SEQ ID NO: 685691 - RNA, 22 nt, Haemophilus influenzae Rd
gaucgcuuguuguaaauugguu

SEQ ID NO: 685692 - RNA, 22 nt, Haemophilus influenzae Rd
gaugacuuguuucauaaaaaau

SEQ ID NO: 685693 - RNA, 15 nt, Haemophilus influenzae Rd
gaugaugcaggaaag

SEQ ID NO: 685694 - RNA, 16 nt, Haemophilus influenzae Rd
gaugaugcaggaaagg

SEQ ID NO: 685695 - RNA, 18 nt, Haemophilus influenzae Rd
gaugaugcaggaaaggca

SEQ ID NO: 685696 - RNA, 21 nt, Haemophilus influenzae Rd
gaugcauuuuuuaaucuaugg

SEQ ID NO: 685697 - RNA, 20 nt, Haemophilus influenzae Rd
gaugccaagggcugaagcuc

SEQ ID NO: 685698 - RNA, 17 nt, Haemophilus influenzae Rd
gaucgucuugaccugca

SEQ ID NO: 685699 - RNA, 17 nt, Haemophilus influenzae Rd
gaugacuggcaaaaaug

SEQ ID NO: 685700 - RNA, 18 nt, Haemophilus influenzae Rd
gaugacaaaagugcgguu

SEQ ID NO: 685701 - RNA, 15 nt, Haemophilus influenzae Rd
gaugaauuaagacgg

SEQ ID NO: 685702 - RNA, 19 nt, Haemophilus influenzae Rd
gaugccgaaugaagaaaug

SEQ ID NO: 685703 - RNA, 22 nt, Haemophilus influenzae Rd
gaugcgauccaaaauucugugu

SEQ ID NO: 685704 - RNA, 16 nt, Haemophilus influenzae Rd
gauggaauaaauuuug

SEQ ID NO: 685705 - RNA, 22 nt, Haemophilus influenzae Rd
gauggaauaaauuuugcccucu

SEQ ID NO: 685706 - RNA, 13 nt, Haemophilus influenzae Rd
gaugguaaaaugu

SEQ ID NO: 685707 - RNA, 19 nt, Haemophilus influenzae Rd
gauggcaguuuggaaagag

SEQ ID NO: 685708 - RNA, 21 nt, Haemophilus influenzae Rd
gauguaaauuuucagcguuuu

SEQ ID NO: 685709 - RNA, 17 nt, Haemophilus influenzae Rd
gauguaccaaaauguug

SEQ ID NO: 685710 - RNA, 15 nt, Haemophilus influenzae Rd
gauuacguguaguug

SEQ ID NO: 685711 - RNA, 18 nt, Haemophilus influenzae Rd
gauuaccaggaaauauuc

SEQ ID NO: 685712 - RNA, 20 nt, Haemophilus influenzae Rd
gauuaaucagugucuuaacu

SEQ ID NO: 685713 - RNA, 17 nt, Haemophilus influenzae Rd
gauuaaguauaacuaau

SEQ ID NO: 685714 - RNA, 15 nt, Haemophilus influenzae Rd
gauuaucauuaaaua

SEQ ID NO: 685715 - RNA, 18 nt, Haemophilus influenzae Rd
gauuaucauuaaauauaa

SEQ ID NO: 685716 - RNA, 21 nt, Haemophilus influenzae Rd
gauuauccacuaaaaaacuaa

SEQ ID NO: 685717 - RNA, 17 nt, Haemophilus influenzae Rd
gauuacuucgcaggaau

SEQ ID NO: 685718 - RNA, 20 nt, Haemophilus influenzae Rd
gauuaaagugcgguaaauuu

SEQ ID NO: 685719 - RNA, 18 nt, Haemophilus influenzae Rd
gauuaaaaugguuuaaau

SEQ ID NO: 685720 - RNA, 15 nt, Haemophilus influenzae Rd
gauuaacaauaaugu

SEQ ID NO: 685721 - RNA, 22 nt, Haemophilus influenzae Rd
gauguuugaggaucacacaaaa

SEQ ID NO: 685722 - RNA, 12 nt, Haemophilus influenzae Rd
gauuguucggua

SEQ ID NO: 685723 - RNA, 16 nt, Haemophilus influenzae Rd
gauuguucgguaagcg

SEQ ID NO: 685724 - RNA, 15 nt, Haemophilus influenzae Rd
gauuggauuuugaaa

SEQ ID NO: 685725 - RNA, 20 nt, Haemophilus influenzae Rd
gauuuaauaccauacauaaa

SEQ ID NO: 685726 - RNA, 17 nt, Haemophilus influenzae Rd
gauuuaaucauuacuua

SEQ ID NO: 685727 - RNA, 19 nt, Haemophilus influenzae Rd
gauuuaaauugaaaaaaua

SEQ ID NO: 685728 - RNA, 19 nt, Haemophilus influenzae Rd
gauugcuaaauaaauuccu

SEQ ID NO: 685729 - RNA, 21 nt, Haemophilus influenzae Rd
gauugagcgauagaaauaaag

SEQ ID NO: 685730 - RNA, 22 nt, Haemophilus influenzae Rd
gauugaugcgaaaauggcuaaa

SEQ ID NO: 685731 - RNA, 11 nt, Haemophilus influenzae Rd
gauugcgaaua

SEQ ID NO: 685732 - RNA, 19 nt, Haemophilus influenzae Rd
gauucuucauaaauaccgc

SEQ ID NO: 685733 - RNA, 19 nt, Haemophilus influenzae Rd
gauucugugcaauauuucc

SEQ ID NO: 685734 - RNA, 21 nt, Haemophilus influenzae Rd
gauugaacguuuaacuucaac

SEQ ID NO: 685735 - RNA, 19 nt, Haemophilus influenzae Rd
gauucuuugagucggggau

SEQ ID NO: 685736 - RNA, 13 nt, Haemophilus influenzae Rd
gauugacuuguuu

SEQ ID NO: 685737 - RNA, 13 nt, Haemophilus influenzae Rd
gauugagaaaaug

SEQ ID NO: 685738 - RNA, 16 nt, Haemophilus influenzae Rd
gauugaccgcccaaca

SEQ ID NO: 685739 - RNA, 18 nt, Haemophilus influenzae Rd
gauugaccgcccaacauu

SEQ ID NO: 685740 - RNA, 13 nt, Haemophilus influenzae Rd
gauugaccaauga

SEQ ID NO: 685741 - RNA, 21 nt, Haemophilus influenzae Rd
gauuauguagcaguugcuaaa

SEQ ID NO: 685742 - RNA, 22 nt, Haemophilus influenzae Rd
gcaaaaaaucuuuuauucugca

SEQ ID NO: 685743 - RNA, 15 nt, Haemophilus influenzae Rd
gcaaaaacaaguggu

SEQ ID NO: 685744 - RNA, 17 nt, Haemophilus influenzae Rd
gcaaaaaauacauugcu

SEQ ID NO: 685745 - RNA, 24 nt, Haemophilus influenzae Rd
gcaaaaauaucggcaucuacaccu

SEQ ID NO: 685746 - RNA, 15 nt, Haemophilus influenzae Rd
gcaaaaauacuaacu

SEQ ID NO: 685747 - RNA, 17 nt, Haemophilus influenzae Rd
gcaaaagccaauaagag

SEQ ID NO: 685748 - RNA, 22 nt, Haemophilus influenzae Rd
gcaaaaaugacaucauuaauaa

SEQ ID NO: 685749 - RNA, 19 nt, Haemophilus influenzae Rd
gcaaaaacccucaagaaac

SEQ ID NO: 685750 - RNA, 18 nt, Haemophilus influenzae Rd
gauuuucacuaauuugcu

SEQ ID NO: 685751 - RNA, 16 nt, Haemophilus influenzae Rd
gauuuugguucguuuu

SEQ ID NO: 685752 - RNA, 23 nt, Haemophilus influenzae Rd
gauuuuauucauaaauuccuuuu

SEQ ID NO: 685753 - RNA, 13 nt, Haemophilus influenzae Rd
gauuuuaguuucu

SEQ ID NO: 685754 - RNA, 15 nt, Haemophilus influenzae Rd
gauuuuuaaaucaau

SEQ ID NO: 685755 - RNA, 15 nt, Haemophilus influenzae Rd
gauuuaauguauaaa

SEQ ID NO: 685756 - RNA, 13 nt, Haemophilus influenzae Rd
gauuuauuaauag

SEQ ID NO: 685757 - RNA, 15 nt, Haemophilus influenzae Rd
gauuuauuauuuaau

SEQ ID NO: 685758 - RNA, 20 nt, Haemophilus influenzae Rd
gauuuauuuaacaaugaaau

SEQ ID NO: 685759 - RNA, 12 nt, Haemophilus influenzae Rd
gauuuauuucug

SEQ ID NO: 685760 - RNA, 20 nt, Haemophilus influenzae Rd
gauuuauuuugguauuuuug

SEQ ID NO: 685761 - RNA, 18 nt, Haemophilus influenzae Rd
gauuugccucuucuuuug

SEQ ID NO: 685762 - RNA, 20 nt, Haemophilus influenzae Rd
gauuuuaaauucuccccgau

SEQ ID NO: 685763 - RNA, 22 nt, Haemophilus influenzae Rd
gauuuuacuuuuucuaauaauu

SEQ ID NO: 685764 - RNA, 17 nt, Haemophilus influenzae Rd
gauuuuacgauuucugc

SEQ ID NO: 685765 - RNA, 15 nt, Haemophilus influenzae Rd
gauuugcacuuucua

SEQ ID NO: 685766 - RNA, 15 nt, Haemophilus influenzae Rd
gcaaacgcucuuuaa

SEQ ID NO: 685767 - RNA, 16 nt, Haemophilus influenzae Rd
gcaaagaauuaaaaua

SEQ ID NO: 685768 - RNA, 18 nt, Haemophilus influenzae Rd
gcaaacucgguuuauuuu

SEQ ID NO: 685769 - RNA, 15 nt, Haemophilus influenzae Rd
gcaaaauauucuauu

SEQ ID NO: 685770 - RNA, 11 nt, Haemophilus influenzae Rd
gcaaaauaauc

SEQ ID NO: 685771 - RNA, 16 nt, Haemophilus influenzae Rd
gcaaaagguaaaaauu

SEQ ID NO: 685772 - RNA, 17 nt, Haemophilus influenzae Rd
gcaaaaguaagcaaaua

SEQ ID NO: 685773 - RNA, 16 nt, Haemophilus influenzae Rd
gcaaaaucaucaaaca

SEQ ID NO: 685774 - RNA, 14 nt, Haemophilus influenzae Rd
gcaaacagcaauaa

SEQ ID NO: 685775 - RNA, 14 nt, Haemophilus influenzae Rd
gcaaacaaguuucu

SEQ ID NO: 685776 - RNA, 23 nt, Haemophilus influenzae Rd
gcaaacaaguuucuaaaaucacu

SEQ ID NO: 685777 - RNA, 22 nt, Haemophilus influenzae Rd
gcaaacauaccacuucagaauu

SEQ ID NO: 685778 - RNA, 14 nt, Haemophilus influenzae Rd
gcaaacaucaucac

SEQ ID NO: 685779 - RNA, 16 nt, Haemophilus influenzae Rd
gcaaagcaaaaucaaa

SEQ ID NO: 685780 - RNA, 15 nt, Haemophilus influenzae Rd
gcaaauaaaauagac

SEQ ID NO: 685781 - RNA, 22 nt, Haemophilus influenzae Rd
gcaaaguauuuuucuaaaucgu

SEQ ID NO: 685782 - RNA, 22 nt, Haemophilus influenzae Rd
gcaaagguuuuauuuugaacaa

SEQ ID NO: 685783 - RNA, 13 nt, Haemophilus influenzae Rd
gcaaaucaccuuc

SEQ ID NO: 685784 - RNA, 14 nt, Haemophilus influenzae Rd
gcaaauaaucucuu

SEQ ID NO: 685785 - RNA, 16 nt, Haemophilus influenzae Rd
gcaaauacguauaauu

SEQ ID NO: 685786 - RNA, 20 nt, Haemophilus influenzae Rd
gcaaaugaggaaaauaaagg

SEQ ID NO: 685787 - RNA, 22 nt, Haemophilus influenzae Rd
gcaaauccuugaaucauuucau

SEQ ID NO: 685788 - RNA, 13 nt, Haemophilus influenzae Rd
gcaaauuaucuga

SEQ ID NO: 685789 - RNA, 13 nt, Haemophilus influenzae Rd
gcaaauuaaauca

SEQ ID NO: 685790 - RNA, 15 nt, Haemophilus influenzae Rd
gcaaaugguguuuua

SEQ ID NO: 685791 - RNA, 19 nt, Haemophilus influenzae Rd
gcacuguugugaaguuuuu

SEQ ID NO: 685792 - RNA, 19 nt, Haemophilus influenzae Rd
gcacuguuucaguuaucuc

SEQ ID NO: 685793 - RNA, 15 nt, Haemophilus influenzae Rd
gcacuguuauauaaa

SEQ ID NO: 685794 - RNA, 17 nt, Haemophilus influenzae Rd
gcacuuagauuugaacc

SEQ ID NO: 685795 - RNA, 22 nt, Haemophilus influenzae Rd
gcacuucaaaaagugcgguucu

SEQ ID NO: 685796 - RNA, 16 nt, Haemophilus influenzae Rd
gcacuucaauuucacc

SEQ ID NO: 685797 - RNA, 21 nt, Haemophilus influenzae Rd
gcagauuaauuuuuuauaaaa

SEQ ID NO: 685798 - RNA, 22 nt, Haemophilus influenzae Rd
gcagauuuuuuaugaccaaaua

SEQ ID NO: 685799 - RNA, 17 nt, Haemophilus influenzae Rd
gcagauuuuuuuauaaa

SEQ ID NO: 685800 - RNA, 23 nt, Haemophilus influenzae Rd
gcagauuuuuuuaugagcaaaua

SEQ ID NO: 685801 - RNA, 22 nt, Haemophilus influenzae Rd
gcagauuuuuauaucuaaauaa

SEQ ID NO: 685802 - RNA, 12 nt, Haemophilus influenzae Rd
gcagauugcuga

SEQ ID NO: 685803 - RNA, 17 nt, Haemophilus influenzae Rd
gcagcagguuuuccuac

SEQ ID NO: 685804 - RNA, 17 nt, Haemophilus influenzae Rd
gcagggaaaaauuuuac

SEQ ID NO: 685805 - RNA, 19 nt, Haemophilus influenzae Rd
gcagguuguuuuuguaaaa

SEQ ID NO: 685806 - RNA, 14 nt, Haemophilus influenzae Rd
gcagguuuugcaaa

SEQ ID NO: 685807 - RNA, 17 nt, Haemophilus influenzae Rd
gcagguuuugcaaauac

SEQ ID NO: 685808 - RNA, 20 nt, Haemophilus influenzae Rd
gcagguuuuuuauuucucau

SEQ ID NO: 685809 - RNA, 23 nt, Haemophilus influenzae Rd
gcaguauuaguugguacuaaaga

SEQ ID NO: 685810 - RNA, 20 nt, Haemophilus influenzae Rd
gcauaauggcuuaauaaugg

SEQ ID NO: 685811 - RNA, 20 nt, Haemophilus influenzae Rd
gcauauaaaauaaagaaacg

SEQ ID NO: 685812 - RNA, 15 nt, Haemophilus influenzae Rd
gcauauaagauuuuu

SEQ ID NO: 685813 - RNA, 23 nt, Haemophilus influenzae Rd
gcaguuucuggcucuaaaucuaa

SEQ ID NO: 685814 - RNA, 17 nt, Haemophilus influenzae Rd
gcauaaggaccaagcaa

SEQ ID NO: 685815 - RNA, 19 nt, Haemophilus influenzae Rd
gcauaaaagugcgguaaaa

SEQ ID NO: 685816 - RNA, 13 nt, Haemophilus influenzae Rd
gcauaaaauaauu

SEQ ID NO: 685817 - RNA, 15 nt, Haemophilus influenzae Rd
gcauaaacaaaauaa

SEQ ID NO: 685818 - RNA, 15 nt, Haemophilus influenzae Rd
gcauccauucucaaa

SEQ ID NO: 685819 - RNA, 21 nt, Haemophilus influenzae Rd
gcauccacaccaccagacaaa

SEQ ID NO: 685820 - RNA, 13 nt, Haemophilus influenzae Rd
gcaucauuaauac

SEQ ID NO: 685821 - RNA, 19 nt, Haemophilus influenzae Rd
gcaucauuaauacacaaaa

SEQ ID NO: 685822 - RNA, 13 nt, Haemophilus influenzae Rd
gcaucagauuuuu

SEQ ID NO: 685823 - RNA, 16 nt, Haemophilus influenzae Rd
gcaucagauuuuucgc

SEQ ID NO: 685824 - RNA, 14 nt, Haemophilus influenzae Rd
gcaucaaaacguuc

SEQ ID NO: 685825 - RNA, 20 nt, Haemophilus influenzae Rd
gcaucaaaauaaauaaaaua

SEQ ID NO: 685826 - RNA, 21 nt, Haemophilus influenzae Rd
gcaucaaaauaaauaaaauau

SEQ ID NO: 685827 - RNA, 16 nt, Haemophilus influenzae Rd
gcaucaaaauucaaaa

SEQ ID NO: 685828 - RNA, 22 nt, Haemophilus influenzae Rd
gcaucaaaggcuaauucuacac

SEQ ID NO: 685829 - RNA, 14 nt, Haemophilus influenzae Rd
gcaucaacuugauu

SEQ ID NO: 685830 - RNA, 15 nt, Haemophilus influenzae Rd
gcauaucugcugcug

SEQ ID NO: 685831 - RNA, 11 nt, Haemophilus influenzae Rd
gcauauuuucc

SEQ ID NO: 685832 - RNA, 22 nt, Haemophilus influenzae Rd
gcauauucgcaccuucagccac

SEQ ID NO: 685833 - RNA, 13 nt, Haemophilus influenzae Rd
gcaauuugaaaag

SEQ ID NO: 685834 - RNA, 16 nt, Haemophilus influenzae Rd
gcaauuugaaaagaau

SEQ ID NO: 685835 - RNA, 21 nt, Haemophilus influenzae Rd
gcaauuugaaaagaauuucau

SEQ ID NO: 685836 - RNA, 17 nt, Haemophilus influenzae Rd
gcaauuugaauuaauac

SEQ ID NO: 685837 - RNA, 15 nt, Haemophilus influenzae Rd
gcaauuuccauucua

SEQ ID NO: 685838 - RNA, 15 nt, Haemophilus influenzae Rd
gcacaacgguugaaa

SEQ ID NO: 685839 - RNA, 15 nt, Haemophilus influenzae Rd
gcacaagcaccacuu

SEQ ID NO: 685840 - RNA, 11 nt, Haemophilus influenzae Rd
gcacaaucaaa

SEQ ID NO: 685841 - RNA, 23 nt, Haemophilus influenzae Rd
gcacaauuacuucuuacaacaaa

SEQ ID NO: 685842 - RNA, 21 nt, Haemophilus influenzae Rd
gcacaauucucaucagccuuu

SEQ ID NO: 685843 - RNA, 19 nt, Haemophilus influenzae Rd
gcaauucgccugcuugaua

SEQ ID NO: 685844 - RNA, 15 nt, Haemophilus influenzae Rd
gcaauguauucaaac

SEQ ID NO: 685845 - RNA, 20 nt, Haemophilus influenzae Rd
gcaauggcuuguuccacauu

SEQ ID NO: 685846 - RNA, 22 nt, Haemophilus influenzae Rd
gcaauggcuuguuccacauuau

SEQ ID NO: 685847 - RNA, 21 nt, Haemophilus influenzae Rd
gcaauggcuuuuaauccaagu

SEQ ID NO: 685848 - RNA, 21 nt, Haemophilus influenzae Rd
gcaauuaagccugcaaagccu

SEQ ID NO: 685849 - RNA, 22 nt, Haemophilus influenzae Rd
gcaauuaaggcauuuucccaca

SEQ ID NO: 685850 - RNA, 21 nt, Haemophilus influenzae Rd
gcaccaccuuuauuaaagccu

SEQ ID NO: 685851 - RNA, 20 nt, Haemophilus influenzae Rd
gcaccacgaccuaagaaaag

SEQ ID NO: 685852 - RNA, 17 nt, Haemophilus influenzae Rd
gcacauuuuuaccaauu

SEQ ID NO: 685853 - RNA, 12 nt, Haemophilus influenzae Rd
gcacauucugag

SEQ ID NO: 685854 - RNA, 21 nt, Haemophilus influenzae Rd
gcacaucaaauucuaaaacaa

SEQ ID NO: 685855 - RNA, 17 nt, Haemophilus influenzae Rd
gcacauaaguaaaauag

SEQ ID NO: 685856 - RNA, 18 nt, Haemophilus influenzae Rd
gcaagccaaguuguaaaa

SEQ ID NO: 685857 - RNA, 16 nt, Haemophilus influenzae Rd
gcaagguauuucaaca

SEQ ID NO: 685858 - RNA, 20 nt, Haemophilus influenzae Rd
gcaagcgcguuuaucaucug

SEQ ID NO: 685859 - RNA, 22 nt, Haemophilus influenzae Rd
gcaagcggcacucucuugggug

SEQ ID NO: 685860 - RNA, 20 nt, Haemophilus influenzae Rd
gcaaauugcccuguugaaac

SEQ ID NO: 685861 - RNA, 19 nt, Haemophilus influenzae Rd
gcaaauuuaaauaauaaau

SEQ ID NO: 685862 - RNA, 16 nt, Haemophilus influenzae Rd
gcaagaugaauuaaga

SEQ ID NO: 685863 - RNA, 19 nt, Haemophilus influenzae Rd
gcaagauuguuaucuguag

SEQ ID NO: 685864 - RNA, 21 nt, Haemophilus influenzae Rd
gcaagcaaaauuaacagcaaa

SEQ ID NO: 685865 - RNA, 13 nt, Haemophilus influenzae Rd
gcaacuuuugcaa

SEQ ID NO: 685866 - RNA, 15 nt, Haemophilus influenzae Rd
gcaacuuuugcaaaa

SEQ ID NO: 685867 - RNA, 15 nt, Haemophilus influenzae Rd
gcaagaaauucacuc

SEQ ID NO: 685868 - RNA, 23 nt, Haemophilus influenzae Rd
gcaagaaauucacucaauucaaa

SEQ ID NO: 685869 - RNA, 14 nt, Haemophilus influenzae Rd
gcaauagauucuaa

SEQ ID NO: 685870 - RNA, 15 nt, Haemophilus influenzae Rd
gcaauaucaucauca

SEQ ID NO: 685871 - RNA, 20 nt, Haemophilus influenzae Rd
gcaauaguuggguaaucaaa

SEQ ID NO: 685872 - RNA, 17 nt, Haemophilus influenzae Rd
gcaauaucuauuggaau

SEQ ID NO: 685873 - RNA, 14 nt, Haemophilus influenzae Rd
gcaauaugcacuaa

SEQ ID NO: 685874 - RNA, 16 nt, Haemophilus influenzae Rd
gcaaguccaaguuuuu

SEQ ID NO: 685875 - RNA, 20 nt, Haemophilus influenzae Rd
gcaagugagcuaagcauuuc

SEQ ID NO: 685876 - RNA, 16 nt, Haemophilus influenzae Rd
gcaagugcaguuucag

SEQ ID NO: 685877 - RNA, 21 nt, Haemophilus influenzae Rd
gcaagucugcugaaauacaaa

SEQ ID NO: 685878 - RNA, 17 nt, Haemophilus influenzae Rd
gcaagugcgguaaaauu

SEQ ID NO: 685879 - RNA, 15 nt, Haemophilus influenzae Rd
gcaauauuuaauaua

SEQ ID NO: 685880 - RNA, 12 nt, Haemophilus influenzae Rd
gcaauauuucaa

SEQ ID NO: 685881 - RNA, 13 nt, Haemophilus influenzae Rd
gcaauauuucaau

SEQ ID NO: 685882 - RNA, 21 nt, Haemophilus influenzae Rd
gcaauauuuuagcaagugcgc

SEQ ID NO: 685883 - RNA, 14 nt, Haemophilus influenzae Rd
gcaaucaaaaauga

SEQ ID NO: 685884 - RNA, 13 nt, Haemophilus influenzae Rd
gcaaucaagcaaa

SEQ ID NO: 685885 - RNA, 19 nt, Haemophilus influenzae Rd
gcaauaucgauuuggauuu

SEQ ID NO: 685886 - RNA, 22 nt, Haemophilus influenzae Rd
gcaaucacaaaauggcaaacaa

SEQ ID NO: 685887 - RNA, 15 nt, Haemophilus influenzae Rd
gcaauggaauaccag

SEQ ID NO: 685888 - RNA, 15 nt, Haemophilus influenzae Rd
gcaaucuucacaaau

SEQ ID NO: 685889 - RNA, 15 nt, Haemophilus influenzae Rd
gcaaugaaauuuuug

SEQ ID NO: 685890 - RNA, 13 nt, Haemophilus influenzae Rd
gcaccagaugcaa

SEQ ID NO: 685891 - RNA, 16 nt, Haemophilus influenzae Rd
gcaccgucauuuucaa

SEQ ID NO: 685892 - RNA, 21 nt, Haemophilus influenzae Rd
gcaccgucauuuucaagccac

SEQ ID NO: 685893 - RNA, 19 nt, Haemophilus influenzae Rd
gcacgauaguggaauaaug

SEQ ID NO: 685894 - RNA, 23 nt, Haemophilus influenzae Rd
gcacgaccacccauuaaauagcg

SEQ ID NO: 685895 - RNA, 21 nt, Haemophilus influenzae Rd
gcaccuucaacauuuuuugcu

SEQ ID NO: 685896 - RNA, 14 nt, Haemophilus influenzae Rd
gcaccuucagccac

SEQ ID NO: 685897 - RNA, 15 nt, Haemophilus influenzae Rd
gcaccuucagccacu

SEQ ID NO: 685898 - RNA, 16 nt, Haemophilus influenzae Rd
gcaccuucagccacua

SEQ ID NO: 685899 - RNA, 14 nt, Haemophilus influenzae Rd
gcaccuuguaacca

SEQ ID NO: 685900 - RNA, 17 nt, Haemophilus influenzae Rd
gcaccuuguaaccaagc

SEQ ID NO: 685901 - RNA, 18 nt, Haemophilus influenzae Rd
gcaccuuguaaccaagcu

SEQ ID NO: 685902 - RNA, 15 nt, Haemophilus influenzae Rd
gcaccuucaccacuu

SEQ ID NO: 685903 - RNA, 19 nt, Haemophilus influenzae Rd
gcaccuuuugcaagcauuc

SEQ ID NO: 685904 - RNA, 19 nt, Haemophilus influenzae Rd
gcacguuaauuaccacaug

SEQ ID NO: 685905 - RNA, 15 nt, Haemophilus influenzae Rd
gcacuaaaccugcuu

SEQ ID NO: 685906 - RNA, 20 nt, Haemophilus influenzae Rd
gcacuccaaaaguuggauua

SEQ ID NO: 685907 - RNA, 17 nt, Haemophilus influenzae Rd
gcacucuaauaagugag

SEQ ID NO: 685908 - RNA, 18 nt, Haemophilus influenzae Rd
gcacugaaauucauucaa

SEQ ID NO: 685909 - RNA, 16 nt, Haemophilus influenzae Rd
gcacguaacaaaugca

SEQ ID NO: 685910 - RNA, 17 nt, Haemophilus influenzae Rd
gcacguaguaaauuuuc

SEQ ID NO: 685911 - RNA, 16 nt, Haemophilus influenzae Rd
gcacgggaaauccagc

SEQ ID NO: 685912 - RNA, 19 nt, Haemophilus influenzae Rd
cuuuguuuuaaugauaaau

SEQ ID NO: 685913 - RNA, 23 nt, Haemophilus influenzae Rd
cuuuguuuuauagccuucugcca

SEQ ID NO: 685914 - RNA, 18 nt, Haemophilus influenzae Rd
cuuuguugaaugccauuc

SEQ ID NO: 685915 - RNA, 18 nt, Haemophilus influenzae Rd
cuuuuaaaguguggauuu

SEQ ID NO: 685916 - RNA, 22 nt, Haemophilus influenzae Rd
cuuuuaaauacagcucaaaaug

SEQ ID NO: 685917 - RNA, 23 nt, Haemophilus influenzae Rd
cuuuuaaauacagcucaaaaugc

SEQ ID NO: 685918 - RNA, 21 nt, Haemophilus influenzae Rd
cuuuuaaaagaccacauucua

SEQ ID NO: 685919 - RNA, 23 nt, Haemophilus influenzae Rd
cuuuuaaacgugugauaccaaga

SEQ ID NO: 685920 - RNA, 13 nt, Haemophilus influenzae Rd
cuuuuaaacguuu

SEQ ID NO: 685921 - RNA, 19 nt, Haemophilus influenzae Rd
cuuuuaaacguuuauuuau

SEQ ID NO: 685922 - RNA, 23 nt, Haemophilus influenzae Rd
cuuuuaaacuauugaaaauuaaa

SEQ ID NO: 685923 - RNA, 17 nt, Haemophilus influenzae Rd
cuuuuaacacuuuuuca

SEQ ID NO: 685924 - RNA, 15 nt, Haemophilus influenzae Rd
cuuuuaaguuaggau

SEQ ID NO: 685925 - RNA, 15 nt, Haemophilus influenzae Rd
cuuuuaaguugugau

SEQ ID NO: 685926 - RNA, 14 nt, Haemophilus influenzae Rd
cuuuuaauuuuuac

SEQ ID NO: 685927 - RNA, 20 nt, Haemophilus influenzae Rd
cuuuuaauuaaauacaaaac

SEQ ID NO: 685928 - RNA, 22 nt, Haemophilus influenzae Rd
cuuuuaauuaaauacaaaacag

SEQ ID NO: 685929 - RNA, 15 nt, Haemophilus influenzae Rd
cuuuuaauucauuga

SEQ ID NO: 685930 - RNA, 20 nt, Haemophilus influenzae Rd
cuuuuaauucgccccaaaca

SEQ ID NO: 685931 - RNA, 22 nt, Haemophilus influenzae Rd
cuuugugaggaaguuaaaauac

SEQ ID NO: 685932 - RNA, 20 nt, Haemophilus influenzae Rd
cuuuguucacaucaaaauug

SEQ ID NO: 685933 - RNA, 20 nt, Haemophilus influenzae Rd
cuuucuuuuuguuuaaaagc

SEQ ID NO: 685934 - RNA, 15 nt, Haemophilus influenzae Rd
cuuuguaaugcuuuu

SEQ ID NO: 685935 - RNA, 19 nt, Haemophilus influenzae Rd
cuuuguacaccaaaauaac

SEQ ID NO: 685936 - RNA, 13 nt, Haemophilus influenzae Rd
cuuuguauggcaa

SEQ ID NO: 685937 - RNA, 14 nt, Haemophilus influenzae Rd
cuuuguauggcaaa

SEQ ID NO: 685938 - RNA, 15 nt, Haemophilus influenzae Rd
cuuucuuuucaauuu

SEQ ID NO: 685939 - RNA, 13 nt, Haemophilus influenzae Rd
cuuucuuuuucaa

SEQ ID NO: 685940 - RNA, 17 nt, Haemophilus influenzae Rd
cuuucuuuuucaaguuc

SEQ ID NO: 685941 - RNA, 17 nt, Haemophilus influenzae Rd
cuuucuuguauugccac

SEQ ID NO: 685942 - RNA, 19 nt, Haemophilus influenzae Rd
cuuuucccaaugcaccaaa

SEQ ID NO: 685943 - RNA, 16 nt, Haemophilus influenzae Rd
cuuuucccuuuucuua

SEQ ID NO: 685944 - RNA, 19 nt, Haemophilus influenzae Rd
cuuuucaauuugaaaauuu

SEQ ID NO: 685945 - RNA, 21 nt, Haemophilus influenzae Rd
cuuuucaauuugaaaauuuau

SEQ ID NO: 685946 - RNA, 24 nt, Haemophilus influenzae Rd
cuuuucaauuugaaaauuuauuug

SEQ ID NO: 685947 - RNA, 12 nt, Haemophilus influenzae Rd
cuuuucaaacaa

SEQ ID NO: 685948 - RNA, 17 nt, Haemophilus influenzae Rd
cuuuucaaacaacaagu

SEQ ID NO: 685949 - RNA, 16 nt, Haemophilus influenzae Rd
cuuuucaaacacaaaa

SEQ ID NO: 685950 - RNA, 19 nt, Haemophilus influenzae Rd
cuuuucaaacacaaaauaa

SEQ ID NO: 685951 - RNA, 14 nt, Haemophilus influenzae Rd
cuuuucaacaaaaa

SEQ ID NO: 685952 - RNA, 14 nt, Haemophilus influenzae Rd
cuuuuauuaacaaa

SEQ ID NO: 685953 - RNA, 14 nt, Haemophilus influenzae Rd
cuuuuauguuucuc

SEQ ID NO: 685954 - RNA, 19 nt, Haemophilus influenzae Rd
cuuuuauagacuucaagug

SEQ ID NO: 685955 - RNA, 18 nt, Haemophilus influenzae Rd
cuuuuauauguaaaauuu

SEQ ID NO: 685956 - RNA, 17 nt, Haemophilus influenzae Rd
cuuuuauccaccagcac

SEQ ID NO: 685957 - RNA, 14 nt, Haemophilus influenzae Rd
cuuuuaucgagaaa

SEQ ID NO: 685958 - RNA, 17 nt, Haemophilus influenzae Rd
cuuuuaguuuccccuga

SEQ ID NO: 685959 - RNA, 22 nt, Haemophilus influenzae Rd
cuuuuaguuuccccugaaugcg

SEQ ID NO: 685960 - RNA, 17 nt, Haemophilus influenzae Rd
cuuuuauaaagaucaau

SEQ ID NO: 685961 - RNA, 18 nt, Haemophilus influenzae Rd
cuuuuauaaagaucaaug

SEQ ID NO: 685962 - RNA, 16 nt, Haemophilus influenzae Rd
cuuuuauaaccaguua

SEQ ID NO: 685963 - RNA, 20 nt, Haemophilus influenzae Rd
cuuuuauaagugaaaugcuc

SEQ ID NO: 685964 - RNA, 19 nt, Haemophilus influenzae Rd
cuuuuacaccguccaaggu

SEQ ID NO: 685965 - RNA, 12 nt, Haemophilus influenzae Rd
cuuuuacauuug

SEQ ID NO: 685966 - RNA, 12 nt, Haemophilus influenzae Rd
cuuuuaccaauu

SEQ ID NO: 685967 - RNA, 22 nt, Haemophilus influenzae Rd
cuuuuaccuuuaagcauugucc

SEQ ID NO: 685968 - RNA, 19 nt, Haemophilus influenzae Rd
cuuuuacgaacguuucauc

SEQ ID NO: 685969 - RNA, 20 nt, Haemophilus influenzae Rd
cuuuuacgaacguuucauca

SEQ ID NO: 685970 - RNA, 22 nt, Haemophilus influenzae Rd
cuuuuacgacuaauuuuuuaau

SEQ ID NO: 685971 - RNA, 20 nt, Haemophilus influenzae Rd
cuuuucuauaauuaaacauu

SEQ ID NO: 685972 - RNA, 16 nt, Haemophilus influenzae Rd
cuuuucuucuaauucu

SEQ ID NO: 685973 - RNA, 15 nt, Haemophilus influenzae Rd
cuuuucuuauuucug

SEQ ID NO: 685974 - RNA, 12 nt, Haemophilus influenzae Rd
cuuuucuucauc

SEQ ID NO: 685975 - RNA, 13 nt, Haemophilus influenzae Rd
cuuuucuucaucg

SEQ ID NO: 685976 - RNA, 20 nt, Haemophilus influenzae Rd
cuuuucuucaucgcuuaggg

SEQ ID NO: 685977 - RNA, 16 nt, Haemophilus influenzae Rd
cuuuucuuuuauacuu

SEQ ID NO: 685978 - RNA, 12 nt, Haemophilus influenzae Rd
cuuuucgaauua

SEQ ID NO: 685979 - RNA, 19 nt, Haemophilus influenzae Rd
cuuuucgaauuaaacguga

SEQ ID NO: 685980 - RNA, 20 nt, Haemophilus influenzae Rd
cuuuucgauagaacaaaugu

SEQ ID NO: 685981 - RNA, 13 nt, Haemophilus influenzae Rd
cuuuuccuuguuu

SEQ ID NO: 685982 - RNA, 15 nt, Haemophilus influenzae Rd
cuuuucuaaacgaag

SEQ ID NO: 685983 - RNA, 20 nt, Haemophilus influenzae Rd
cuuuucuaacgcuuuuaaac

SEQ ID NO: 685984 - RNA, 16 nt, Haemophilus influenzae Rd
cuuuucuagcaauaaa

SEQ ID NO: 685985 - RNA, 14 nt, Haemophilus influenzae Rd
cuuuugcuucacgu

SEQ ID NO: 685986 - RNA, 17 nt, Haemophilus influenzae Rd
cuuuugcuaccacguuu

SEQ ID NO: 685987 - RNA, 15 nt, Haemophilus influenzae Rd
cuuuuguuacuuucc

SEQ ID NO: 685988 - RNA, 16 nt, Haemophilus influenzae Rd
cuuuuguuacuuucca

SEQ ID NO: 685989 - RNA, 16 nt, Haemophilus influenzae Rd
cuuuugugccagcugg

SEQ ID NO: 685990 - RNA, 15 nt, Haemophilus influenzae Rd
cuuuuguauuuuaug

SEQ ID NO: 685991 - RNA, 19 nt, Haemophilus influenzae Rd
cuuuugucacagcgcgacu

SEQ ID NO: 685992 - RNA, 22 nt, Haemophilus influenzae Rd
cuuuugcaaaaaugacaucauu

SEQ ID NO: 685993 - RNA, 18 nt, Haemophilus influenzae Rd
cuuuugauuuuauuuacu

SEQ ID NO: 685994 - RNA, 21 nt, Haemophilus influenzae Rd
cuuuuugcgccaacgcaucua

SEQ ID NO: 685995 - RNA, 21 nt, Haemophilus influenzae Rd
cuuuuugcagggauuucaaua

SEQ ID NO: 685996 - RNA, 13 nt, Haemophilus influenzae Rd
cuuuuucuugauc

SEQ ID NO: 685997 - RNA, 14 nt, Haemophilus influenzae Rd
cuuuuucuugaucu

SEQ ID NO: 685998 - RNA, 16 nt, Haemophilus influenzae Rd
cuuuuucuauuuuuuc

SEQ ID NO: 685999 - RNA, 14 nt, Haemophilus influenzae Rd
cuuuuucagauacu

SEQ ID NO: 686000 - RNA, 19 nt, Haemophilus influenzae Rd
cuuuuuccugaauaacuac

SEQ ID NO: 686001 - RNA, 11 nt, Haemophilus influenzae Rd
cuuuuuccuca

SEQ ID NO: 686002 - RNA, 13 nt, Haemophilus influenzae Rd
cuuuuuauaaaaa

SEQ ID NO: 686003 - RNA, 15 nt, Haemophilus influenzae Rd
cuuuuuaucuaaaaa

SEQ ID NO: 686004 - RNA, 15 nt, Haemophilus influenzae Rd
cuuuuuaucuaaauu

SEQ ID NO: 686005 - RNA, 16 nt, Haemophilus influenzae Rd
cuuuuuauauuuuuuu

SEQ ID NO: 686006 - RNA, 14 nt, Haemophilus influenzae Rd
cuuuuuauguuuug

SEQ ID NO: 686007 - RNA, 19 nt, Haemophilus influenzae Rd
cuuuuuauuagacaauaaa

SEQ ID NO: 686008 - RNA, 12 nt, Haemophilus influenzae Rd
cuuuuucaaguu

SEQ ID NO: 686009 - RNA, 12 nt, Haemophilus influenzae Rd
cuuuuucaagaa

SEQ ID NO: 686010 - RNA, 17 nt, Haemophilus influenzae Rd
cuuuuucaagaacagaa

SEQ ID NO: 686011 - RNA, 13 nt, Haemophilus influenzae Rd
cuuuuuauuuaga

SEQ ID NO: 686012 - RNA, 23 nt, Haemophilus influenzae Rd
cuuuuuaauuuaaauaaagcauu

SEQ ID NO: 686013 - RNA, 18 nt, Haemophilus influenzae Rd
cuuuuuaauuuauacaaa

SEQ ID NO: 686014 - RNA, 21 nt, Haemophilus influenzae Rd
cuuuuguuguuauucuaauua

SEQ ID NO: 686015 - RNA, 18 nt, Haemophilus influenzae Rd
cuuuuguuuuaucagaau

SEQ ID NO: 686016 - RNA, 22 nt, Haemophilus influenzae Rd
cuuuuuuucuucucguuuuuua

SEQ ID NO: 686017 - RNA, 14 nt, Haemophilus influenzae Rd
cuuuuuuuuguuuu

SEQ ID NO: 686018 - RNA, 13 nt, Haemophilus influenzae Rd
gaaaaaacaagag

SEQ ID NO: 686019 - RNA, 21 nt, Haemophilus influenzae Rd
cuuuuugugccaauccauaaa

SEQ ID NO: 686020 - RNA, 16 nt, Haemophilus influenzae Rd
cuuuuuguuuaaaagc

SEQ ID NO: 686021 - RNA, 16 nt, Haemophilus influenzae Rd
cuuuuuguaugagaau

SEQ ID NO: 686022 - RNA, 23 nt, Haemophilus influenzae Rd
cuuuuuucuugcuaaaaagaaau

SEQ ID NO: 686023 - RNA, 20 nt, Haemophilus influenzae Rd
cuuuuuugcuuauuuuguug

SEQ ID NO: 686024 - RNA, 16 nt, Haemophilus influenzae Rd
cuuuuuucgcaccaau

SEQ ID NO: 686025 - RNA, 19 nt, Haemophilus influenzae Rd
cuuuuuucgcaccaaugcc

SEQ ID NO: 686026 - RNA, 21 nt, Haemophilus influenzae Rd
gaaaaauugguacgagaaaaa

SEQ ID NO: 686027 - RNA, 12 nt, Haemophilus influenzae Rd
gaaaaauguuua

SEQ ID NO: 686028 - RNA, 15 nt, Haemophilus influenzae Rd
gaaaaauguuuaccu

SEQ ID NO: 686029 - RNA, 22 nt, Haemophilus influenzae Rd
gaaaacacguccgcaaccagca

SEQ ID NO: 686030 - RNA, 21 nt, Haemophilus influenzae Rd
gaaaacagcggucaaaauaga

SEQ ID NO: 686031 - RNA, 14 nt, Haemophilus influenzae Rd
gaaaaccaaaacau

SEQ ID NO: 686032 - RNA, 15 nt, Haemophilus influenzae Rd
gaaaaagcuuccuuu

SEQ ID NO: 686033 - RNA, 17 nt, Haemophilus influenzae Rd
gaaaaaggcugcuugau

SEQ ID NO: 686034 - RNA, 19 nt, Haemophilus influenzae Rd
gaaaaauccuguucagcuu

SEQ ID NO: 686035 - RNA, 19 nt, Haemophilus influenzae Rd
gaaaaaucgucaaaaucau

SEQ ID NO: 686036 - RNA, 21 nt, Haemophilus influenzae Rd
gaaaaaucaggguuauuugca

SEQ ID NO: 686037 - RNA, 21 nt, Haemophilus influenzae Rd
gaaaaaucuuuaccaaaaaau

SEQ ID NO: 686038 - RNA, 17 nt, Haemophilus influenzae Rd
gaaaaaugccacuaagg

SEQ ID NO: 686039 - RNA, 14 nt, Haemophilus influenzae Rd
gaaaaauggacaga

SEQ ID NO: 686040 - RNA, 22 nt, Haemophilus influenzae Rd
gaaaaguuuuauauuuuuucuu

SEQ ID NO: 686041 - RNA, 18 nt, Haemophilus influenzae Rd
gaaaagugcggagaaaau

SEQ ID NO: 686042 - RNA, 17 nt, Haemophilus influenzae Rd
gaaaagugcgguaaaaa

SEQ ID NO: 686043 - RNA, 16 nt, Haemophilus influenzae Rd
gaaaaguaaaugauaa

SEQ ID NO: 686044 - RNA, 21 nt, Haemophilus influenzae Rd
gaaaagugcaugauguuuuuc

SEQ ID NO: 686045 - RNA, 22 nt, Haemophilus influenzae Rd
gaaaagugcaugauguuuuuca

SEQ ID NO: 686046 - RNA, 14 nt, Haemophilus influenzae Rd
gaaaauaacuucau

SEQ ID NO: 686047 - RNA, 14 nt, Haemophilus influenzae Rd
gaaaauaauauuga

SEQ ID NO: 686048 - RNA, 16 nt, Haemophilus influenzae Rd
gaaaauagaauuugca

SEQ ID NO: 686049 - RNA, 18 nt, Haemophilus influenzae Rd
gaaaauacguacauuguc

SEQ ID NO: 686050 - RNA, 16 nt, Haemophilus influenzae Rd
gaaaacucgacuuuug

SEQ ID NO: 686051 - RNA, 13 nt, Haemophilus influenzae Rd
gaaaagaauaaua

SEQ ID NO: 686052 - RNA, 23 nt, Haemophilus influenzae Rd
gaaaagaauaauauuaaagaaaa

SEQ ID NO: 686053 - RNA, 18 nt, Haemophilus influenzae Rd
gaaaagaaaguauuaaau

SEQ ID NO: 686054 - RNA, 10 nt, Haemophilus influenzae Rd
gaaaagaaau

SEQ ID NO: 686055 - RNA, 14 nt, Haemophilus influenzae Rd
gaaaagaauuucau

SEQ ID NO: 686056 - RNA, 15 nt, Haemophilus influenzae Rd
gaaaaugcuuauaaa

SEQ ID NO: 686057 - RNA, 16 nt, Haemophilus influenzae Rd
gaaaaugcuuauaaaa

SEQ ID NO: 686058 - RNA, 19 nt, Haemophilus influenzae Rd
gaaaaugcuuauaaaacag

SEQ ID NO: 686059 - RNA, 19 nt, Haemophilus influenzae Rd
gaaaauauuauguuuuccc

SEQ ID NO: 686060 - RNA, 22 nt, Haemophilus influenzae Rd
gaaaauauucuucauaaaaaaa

SEQ ID NO: 686061 - RNA, 15 nt, Haemophilus influenzae Rd
gaaaaucaaagauau

SEQ ID NO: 686062 - RNA, 20 nt, Haemophilus influenzae Rd
gaaaaucgcaauaaauuuau

SEQ ID NO: 686063 - RNA, 21 nt, Haemophilus influenzae Rd
gaaaaucacgcucuuuuaucu

SEQ ID NO: 686064 - RNA, 22 nt, Haemophilus influenzae Rd
gaaacaaucuguggcguauuua

SEQ ID NO: 686065 - RNA, 16 nt, Haemophilus influenzae Rd
gaaacaacgcguacuu

SEQ ID NO: 686066 - RNA, 13 nt, Haemophilus influenzae Rd
gaaaauuuugcca

SEQ ID NO: 686067 - RNA, 21 nt, Haemophilus influenzae Rd
gaaaauuuugccaauuacauu

SEQ ID NO: 686068 - RNA, 18 nt, Haemophilus influenzae Rd
gaaaauuaagaaaauaau

SEQ ID NO: 686069 - RNA, 19 nt, Haemophilus influenzae Rd
gaaaauuaagaaaauaaua

SEQ ID NO: 686070 - RNA, 20 nt, Haemophilus influenzae Rd
gaaaauuaagaaaauaauau

SEQ ID NO: 686071 - RNA, 21 nt, Haemophilus influenzae Rd
gaaaauuauugugagauauga

SEQ ID NO: 686072 - RNA, 15 nt, Haemophilus influenzae Rd
gaaaauucaaaucuu

SEQ ID NO: 686073 - RNA, 15 nt, Haemophilus influenzae Rd
gaaaauugcaccuuc

SEQ ID NO: 686074 - RNA, 20 nt, Haemophilus influenzae Rd
gaaaauugcaccuucuuuug

SEQ ID NO: 686075 - RNA, 11 nt, Haemophilus influenzae Rd
gaaaccaacag

SEQ ID NO: 686076 - RNA, 17 nt, Haemophilus influenzae Rd
gaaaccaacgaaaauag

SEQ ID NO: 686077 - RNA, 18 nt, Haemophilus influenzae Rd
gaaaccaacuuugaccau

SEQ ID NO: 686078 - RNA, 16 nt, Haemophilus influenzae Rd
gaaacauuuuucccug

SEQ ID NO: 686079 - RNA, 19 nt, Haemophilus influenzae Rd
gaaaccacuaaaaacaagu

SEQ ID NO: 686080 - RNA, 18 nt, Haemophilus influenzae Rd
gaaaccauugaugaaaug

SEQ ID NO: 686081 - RNA, 22 nt, Haemophilus influenzae Rd
gaaacaggacaccgcuaaaccu

SEQ ID NO: 686082 - RNA, 16 nt, Haemophilus influenzae Rd
gaaacagaaauaacac

SEQ ID NO: 686083 - RNA, 15 nt, Haemophilus influenzae Rd
gaaacagcuaaaaau

SEQ ID NO: 686084 - RNA, 17 nt, Haemophilus influenzae Rd
gaaacagcuaaaaauga

SEQ ID NO: 686085 - RNA, 18 nt, Haemophilus influenzae Rd
gaaaccucccaaaaacua

SEQ ID NO: 686086 - RNA, 18 nt, Haemophilus influenzae Rd
gaaaccuuuuucuuccau

SEQ ID NO: 686087 - RNA, 19 nt, Haemophilus influenzae Rd
gaaaccuuuuucuuccauu

SEQ ID NO: 686088 - RNA, 14 nt, Haemophilus influenzae Rd
gaaacuuucaaaau

SEQ ID NO: 686089 - RNA, 21 nt, Haemophilus influenzae Rd
gaaacuugagauuuuuugacc

SEQ ID NO: 686090 - RNA, 13 nt, Haemophilus influenzae Rd
gaaagacugcuac

SEQ ID NO: 686091 - RNA, 21 nt, Haemophilus influenzae Rd
gaaagaauauaaauaaaacaa

SEQ ID NO: 686092 - RNA, 18 nt, Haemophilus influenzae Rd
gaaacgguuaauaaauuc

SEQ ID NO: 686093 - RNA, 22 nt, Haemophilus influenzae Rd
gaaacuacuuucuauuaaaaaa

SEQ ID NO: 686094 - RNA, 21 nt, Haemophilus influenzae Rd
gaaacuaugcagaaucagaau

SEQ ID NO: 686095 - RNA, 16 nt, Haemophilus influenzae Rd
gaaacgguuaguacuu

SEQ ID NO: 686096 - RNA, 14 nt, Haemophilus influenzae Rd
gaaacguuggguuu

SEQ ID NO: 686097 - RNA, 14 nt, Haemophilus influenzae Rd
gaaauacauuauua

SEQ ID NO: 686098 - RNA, 18 nt, Haemophilus influenzae Rd
gaaauagacuacuuaaaa

SEQ ID NO: 686099 - RNA, 20 nt, Haemophilus influenzae Rd
gaaauagacuacuuaaaauu

SEQ ID NO: 686100 - RNA, 15 nt, Haemophilus influenzae Rd
gaaauagcguuuuuc

SEQ ID NO: 686101 - RNA, 17 nt, Haemophilus influenzae Rd
gaaauaccauggauacc

SEQ ID NO: 686102 - RNA, 17 nt, Haemophilus influenzae Rd
gaaauaccuucuugauu

SEQ ID NO: 686103 - RNA, 16 nt, Haemophilus influenzae Rd
gaaauacgagaaagcu

SEQ ID NO: 686104 - RNA, 21 nt, Haemophilus influenzae Rd
gaaauacgagaaagcucacca

SEQ ID NO: 686105 - RNA, 16 nt, Haemophilus influenzae Rd
gaaauauaauaaauau

SEQ ID NO: 686106 - RNA, 18 nt, Haemophilus influenzae Rd
gaaauaguuaaagaaaau

SEQ ID NO: 686107 - RNA, 20 nt, Haemophilus influenzae Rd
gaaauaguuaaagaaaauau

SEQ ID NO: 686108 - RNA, 22 nt, Haemophilus influenzae Rd
gaaauauauuuguuuuuaguuu

SEQ ID NO: 686109 - RNA, 21 nt, Haemophilus influenzae Rd
gaaauaucuaggcuaauuauu

SEQ ID NO: 686110 - RNA, 21 nt, Haemophilus influenzae Rd
gaaauauuccaacgauuuugc

SEQ ID NO: 686111 - RNA, 21 nt, Haemophilus influenzae Rd
gaaauaugauuuagaacaaua

SEQ ID NO: 686112 - RNA, 22 nt, Haemophilus influenzae Rd
gaaauauugggcucugcauaau

SEQ ID NO: 686113 - RNA, 23 nt, Haemophilus influenzae Rd
gaaauauugucuauuugcuuucc

SEQ ID NO: 686114 - RNA, 17 nt, Haemophilus influenzae Rd
gaaauauuuacuucacg

SEQ ID NO: 686115 - RNA, 17 nt, Haemophilus influenzae Rd
gaaauauuuuaauagaa

SEQ ID NO: 686116 - RNA, 12 nt, Haemophilus influenzae Rd
gaaauauuuuua

SEQ ID NO: 686117 - RNA, 14 nt, Haemophilus influenzae Rd
gaaaguuaaaacag

SEQ ID NO: 686118 - RNA, 14 nt, Haemophilus influenzae Rd
gaaaguuaaucaaa

SEQ ID NO: 686119 - RNA, 22 nt, Haemophilus influenzae Rd
gaaaguucucgcaaaagugcgg

SEQ ID NO: 686120 - RNA, 17 nt, Haemophilus influenzae Rd
gaaaguugaauauuuug

SEQ ID NO: 686121 - RNA, 23 nt, Haemophilus influenzae Rd
gaaaguuggccaauuugcauaug

SEQ ID NO: 686122 - RNA, 21 nt, Haemophilus influenzae Rd
gaaagugcagcccaaauaaag

SEQ ID NO: 686123 - RNA, 23 nt, Haemophilus influenzae Rd
gaaaguuugcuuagugaaaagaa

SEQ ID NO: 686124 - RNA, 17 nt, Haemophilus influenzae Rd
gaaaguuuuaagugcgg

SEQ ID NO: 686125 - RNA, 13 nt, Haemophilus influenzae Rd
gaaauaaaucuaa

SEQ ID NO: 686126 - RNA, 15 nt, Haemophilus influenzae Rd
gaaauaaaucuaagc

SEQ ID NO: 686127 - RNA, 14 nt, Haemophilus influenzae Rd
gaaauaaccuagaa

SEQ ID NO: 686128 - RNA, 19 nt, Haemophilus influenzae Rd
gaaauaaucguuuuuccac

SEQ ID NO: 686129 - RNA, 20 nt, Haemophilus influenzae Rd
gaaagggcgugauaccaaug

SEQ ID NO: 686130 - RNA, 23 nt, Haemophilus influenzae Rd
gaaagggauuuuuuauacuuguu

SEQ ID NO: 686131 - RNA, 16 nt, Haemophilus influenzae Rd
gaaaguagauauuucu

SEQ ID NO: 686132 - RNA, 13 nt, Haemophilus influenzae Rd
gaaaguaauugca

SEQ ID NO: 686133 - RNA, 19 nt, Haemophilus influenzae Rd
gaaagucgauucaaauaac

SEQ ID NO: 686134 - RNA, 19 nt, Haemophilus influenzae Rd
gaaaguaauggaagaauag

SEQ ID NO: 686135 - RNA, 10 nt, Haemophilus influenzae Rd
gaaaguaauu

SEQ ID NO: 686136 - RNA, 16 nt, Haemophilus influenzae Rd
gaaagcaauguaguug

SEQ ID NO: 686137 - RNA, 17 nt, Haemophilus influenzae Rd
gaaagccuuuuaaaaug

SEQ ID NO: 686138 - RNA, 18 nt, Haemophilus influenzae Rd
gaaagccuuuuaaaauga

SEQ ID NO: 686139 - RNA, 14 nt, Haemophilus influenzae Rd
gaaagcauugcugg

SEQ ID NO: 686140 - RNA, 19 nt, Haemophilus influenzae Rd
gaaaugcggacuuuuucau

SEQ ID NO: 686141 - RNA, 16 nt, Haemophilus influenzae Rd
gaaauggcuuuucaau

SEQ ID NO: 686142 - RNA, 20 nt, Haemophilus influenzae Rd
gaaauguacuggcucuucuu

SEQ ID NO: 686143 - RNA, 22 nt, Haemophilus influenzae Rd
gaaauguacuggcucuucuuuc

SEQ ID NO: 686144 - RNA, 21 nt, Haemophilus influenzae Rd
gaaaucuuggcucauuuuaaa

SEQ ID NO: 686145 - RNA, 13 nt, Haemophilus influenzae Rd
gaaaucauaaacu

SEQ ID NO: 686146 - RNA, 20 nt, Haemophilus influenzae Rd
gaaaucauaaacugauaauu

SEQ ID NO: 686147 - RNA, 14 nt, Haemophilus influenzae Rd
gaaaucauuucaau

SEQ ID NO: 686148 - RNA, 19 nt, Haemophilus influenzae Rd
gaaauccccuacagauaca

SEQ ID NO: 686149 - RNA, 22 nt, Haemophilus influenzae Rd
gaaaucaaggcuuuuuuauucc

SEQ ID NO: 686150 - RNA, 13 nt, Haemophilus influenzae Rd
gaaaucaaauuga

SEQ ID NO: 686151 - RNA, 21 nt, Haemophilus influenzae Rd
gaaaucgcacucacaauacca

SEQ ID NO: 686152 - RNA, 22 nt, Haemophilus influenzae Rd
gaaaucgcacucacaauaccaa

SEQ ID NO: 686153 - RNA, 23 nt, Haemophilus influenzae Rd
gaaauugcguguuuauauaccau

SEQ ID NO: 686154 - RNA, 17 nt, Haemophilus influenzae Rd
gaaauugauauaaaugg

SEQ ID NO: 686155 - RNA, 16 nt, Haemophilus influenzae Rd
gaaauugccaaaaaag

SEQ ID NO: 686156 - RNA, 13 nt, Haemophilus influenzae Rd
gaaauuucaccgu

SEQ ID NO: 686157 - RNA, 18 nt, Haemophilus influenzae Rd
gaaauuuauuauaaaaau

SEQ ID NO: 686158 - RNA, 17 nt, Haemophilus influenzae Rd
gaaauuuaauaagaauu

SEQ ID NO: 686159 - RNA, 19 nt, Haemophilus influenzae Rd
gaacaaaaaauuaaccgca

SEQ ID NO: 686160 - RNA, 17 nt, Haemophilus influenzae Rd
gaaauuugaauauaaga

SEQ ID NO: 686161 - RNA, 12 nt, Haemophilus influenzae Rd
gaaauuuuguuu

SEQ ID NO: 686162 - RNA, 23 nt, Haemophilus influenzae Rd
gaaauucgcuuuuuuaguuagaa

SEQ ID NO: 686163 - RNA, 21 nt, Haemophilus influenzae Rd
gaaauucacucaauucaaaga

SEQ ID NO: 686164 - RNA, 20 nt, Haemophilus influenzae Rd
gaaauucauucaacaaaaau

SEQ ID NO: 686165 - RNA, 13 nt, Haemophilus influenzae Rd
gaaauuaagcagc

SEQ ID NO: 686166 - RNA, 21 nt, Haemophilus influenzae Rd
gaaauuaaccccagaaaugcu

SEQ ID NO: 686167 - RNA, 13 nt, Haemophilus influenzae Rd
gaaauuacuguca

SEQ ID NO: 686168 - RNA, 22 nt, Haemophilus influenzae Rd
gaaauuacugucaccucguaaa

SEQ ID NO: 686169 - RNA, 18 nt, Haemophilus influenzae Rd
gaaauuacuugaaucuaa

SEQ ID NO: 686170 - RNA, 22 nt, Haemophilus influenzae Rd
gaaauuacuugaaucuaauccu

SEQ ID NO: 686171 - RNA, 13 nt, Haemophilus influenzae Rd
gaaauuagacaaa

SEQ ID NO: 686172 - RNA, 20 nt, Haemophilus influenzae Rd
gaaauguugucuaaguaauu

SEQ ID NO: 686173 - RNA, 23 nt, Haemophilus influenzae Rd
gaaauguuuaauuauagaaaaga

SEQ ID NO: 686174 - RNA, 16 nt, Haemophilus influenzae Rd
gaaauguuugaaggca

SEQ ID NO: 686175 - RNA, 13 nt, Haemophilus influenzae Rd
gaaauguuuuuuc

SEQ ID NO: 686176 - RNA, 15 nt, Haemophilus influenzae Rd
gaaauuaaaauaaua

SEQ ID NO: 686177 - RNA, 20 nt, Haemophilus influenzae Rd
gaaauuaaaauaauauccaa

SEQ ID NO: 686178 - RNA, 17 nt, Haemophilus influenzae Rd
gaacaagcauuuuucau

SEQ ID NO: 686179 - RNA, 18 nt, Haemophilus influenzae Rd
gaacaagcauuuuucaua

SEQ ID NO: 686180 - RNA, 16 nt, Haemophilus influenzae Rd
gaacaagccccacagg

SEQ ID NO: 686181 - RNA, 10 nt, Haemophilus influenzae Rd
gaacacucua

SEQ ID NO: 686182 - RNA, 22 nt, Haemophilus influenzae Rd
gaacagguugcugauaaagaua

SEQ ID NO: 686183 - RNA, 19 nt, Haemophilus influenzae Rd
gaacaucaaauccuuguuu

SEQ ID NO: 686184 - RNA, 14 nt, Haemophilus influenzae Rd
gaacauaagcaaca

SEQ ID NO: 686185 - RNA, 15 nt, Haemophilus influenzae Rd
gaacaucauuuucaa

SEQ ID NO: 686186 - RNA, 19 nt, Haemophilus influenzae Rd
gaacauucacaccuaagua

SEQ ID NO: 686187 - RNA, 21 nt, Haemophilus influenzae Rd
gaacauugugacauuggauua

SEQ ID NO: 686188 - RNA, 16 nt, Haemophilus influenzae Rd
gaaccaacccaauuua

SEQ ID NO: 686189 - RNA, 17 nt, Haemophilus influenzae Rd
gaauauaugguucauua

SEQ ID NO: 686190 - RNA, 14 nt, Haemophilus influenzae Rd
gaauaucaucuaga

SEQ ID NO: 686191 - RNA, 17 nt, Haemophilus influenzae Rd
gaauaucuuugacuaaa

SEQ ID NO: 686192 - RNA, 21 nt, Haemophilus influenzae Rd
gaauaucuuugacuaaaucau

SEQ ID NO: 686193 - RNA, 20 nt, Haemophilus influenzae Rd
gaauaucuaaaugacgugcu

SEQ ID NO: 686194 - RNA, 22 nt, Haemophilus influenzae Rd
gaauaucuaaaugacgugcuaa

SEQ ID NO: 686195 - RNA, 20 nt, Haemophilus influenzae Rd
gaauaucuacgccuaauugu

SEQ ID NO: 686196 - RNA, 16 nt, Haemophilus influenzae Rd
gaauauucuuuaaaua

SEQ ID NO: 686197 - RNA, 21 nt, Haemophilus influenzae Rd
gaauauucuuuaaauauucaa

SEQ ID NO: 686198 - RNA, 20 nt, Haemophilus influenzae Rd
gaauauucuuuuuaaauauu

SEQ ID NO: 686199 - RNA, 15 nt, Haemophilus influenzae Rd
gaauauugaucaucu

SEQ ID NO: 686200 - RNA, 23 nt, Haemophilus influenzae Rd
gaauauuccauuaacuaaaccau

SEQ ID NO: 686201 - RNA, 22 nt, Haemophilus influenzae Rd
gaauauugguagcuaaaaauaa

SEQ ID NO: 686202 - RNA, 18 nt, Haemophilus influenzae Rd
gaauauugguuuuauuca

SEQ ID NO: 686203 - RNA, 12 nt, Haemophilus influenzae Rd
gaauauuuggga

SEQ ID NO: 686204 - RNA, 19 nt, Haemophilus influenzae Rd
gaauauuugggaaauggcu

SEQ ID NO: 686205 - RNA, 23 nt, Haemophilus influenzae Rd
gaauacucgcggaucacuuucug

SEQ ID NO: 686206 - RNA, 15 nt, Haemophilus influenzae Rd
gaauagcuauuuuuc

SEQ ID NO: 686207 - RNA, 16 nt, Haemophilus influenzae Rd
gaauagcaauaucugc

SEQ ID NO: 686208 - RNA, 22 nt, Haemophilus influenzae Rd
gaauagccaaaacgaauagaaa

SEQ ID NO: 686209 - RNA, 22 nt, Haemophilus influenzae Rd
gaauauaauucagcaagaaacu

SEQ ID NO: 686210 - RNA, 23 nt, Haemophilus influenzae Rd
gaauauaagaaaucucuuucaau

SEQ ID NO: 686211 - RNA, 14 nt, Haemophilus influenzae Rd
gaauauaaauaaaa

SEQ ID NO: 686212 - RNA, 19 nt, Haemophilus influenzae Rd
gaauaauccccuaaacuaa

SEQ ID NO: 686213 - RNA, 12 nt, Haemophilus influenzae Rd
gaauaauaacgu

SEQ ID NO: 686214 - RNA, 12 nt, Haemophilus influenzae Rd
gaauaauaaugc

SEQ ID NO: 686215 - RNA, 17 nt, Haemophilus influenzae Rd
gaauaauauuaaagaaa

SEQ ID NO: 686216 - RNA, 12 nt, Haemophilus influenzae Rd
gaauaaaugacc

SEQ ID NO: 686217 - RNA, 14 nt, Haemophilus influenzae Rd
gaauaaauuaaaaa

SEQ ID NO: 686218 - RNA, 17 nt, Haemophilus influenzae Rd
gaauaaauuaaaaaaau

SEQ ID NO: 686219 - RNA, 23 nt, Haemophilus influenzae Rd
gaauaaaucacccggcacauaaa

SEQ ID NO: 686220 - RNA, 20 nt, Haemophilus influenzae Rd
gaauaacccuuguaacguau

SEQ ID NO: 686221 - RNA, 22 nt, Haemophilus influenzae Rd
gaauaaccacauauagugaaaa

SEQ ID NO: 686222 - RNA, 13 nt, Haemophilus influenzae Rd
gaauacgaucugc

SEQ ID NO: 686223 - RNA, 20 nt, Haemophilus influenzae Rd
gaauacgaucugcaucuaau

SEQ ID NO: 686224 - RNA, 20 nt, Haemophilus influenzae Rd
gaauaccccaaguuucuaaa

SEQ ID NO: 686225 - RNA, 13 nt, Haemophilus influenzae Rd
gaauaccugauuu

SEQ ID NO: 686226 - RNA, 14 nt, Haemophilus influenzae Rd
gaauacacuuuaaa

SEQ ID NO: 686227 - RNA, 22 nt, Haemophilus influenzae Rd
gaauacauccauaacuaaaagg

SEQ ID NO: 686228 - RNA, 15 nt, Haemophilus influenzae Rd
gaauacacgaugcuc

SEQ ID NO: 686229 - RNA, 15 nt, Haemophilus influenzae Rd
gaauacaagucacgu

SEQ ID NO: 686230 - RNA, 14 nt, Haemophilus influenzae Rd
gaauaauucaaaac

SEQ ID NO: 686231 - RNA, 14 nt, Haemophilus influenzae Rd
gaauaauuuuggau

SEQ ID NO: 686232 - RNA, 13 nt, Haemophilus influenzae Rd
gaaguacauucaa

SEQ ID NO: 686233 - RNA, 20 nt, Haemophilus influenzae Rd
gaagguuucgcauaaaaauu

SEQ ID NO: 686234 - RNA, 19 nt, Haemophilus influenzae Rd
gaagucacauauuguuucu

SEQ ID NO: 686235 - RNA, 21 nt, Haemophilus influenzae Rd
gaagguuuaguggguaaacca

SEQ ID NO: 686236 - RNA, 18 nt, Haemophilus influenzae Rd
gaagguucgaauccuuca

SEQ ID NO: 686237 - RNA, 15 nt, Haemophilus influenzae Rd
gaagugaaagauaaa

SEQ ID NO: 686238 - RNA, 22 nt, Haemophilus influenzae Rd
gaaguuaaaacuugaauggcua

SEQ ID NO: 686239 - RNA, 16 nt, Haemophilus influenzae Rd
gaaguuaaaccugcca

SEQ ID NO: 686240 - RNA, 14 nt, Haemophilus influenzae Rd
gaauaaaaaagccu

SEQ ID NO: 686241 - RNA, 19 nt, Haemophilus influenzae Rd
gaauaaaaaagccuugauu

SEQ ID NO: 686242 - RNA, 17 nt, Haemophilus influenzae Rd
gaaguuuuacugauucu

SEQ ID NO: 686243 - RNA, 13 nt, Haemophilus influenzae Rd
gaauaaaauaaga

SEQ ID NO: 686244 - RNA, 13 nt, Haemophilus influenzae Rd
gaauaaaauaauc

SEQ ID NO: 686245 - RNA, 17 nt, Haemophilus influenzae Rd
gaauaaaagauaacaaa

SEQ ID NO: 686246 - RNA, 14 nt, Haemophilus influenzae Rd
gaaucccauauuua

SEQ ID NO: 686247 - RNA, 18 nt, Haemophilus influenzae Rd
gaaucgaaauuaaaauaa

SEQ ID NO: 686248 - RNA, 20 nt, Haemophilus influenzae Rd
gaauauuuuuuugcuuuucc

SEQ ID NO: 686249 - RNA, 17 nt, Haemophilus influenzae Rd
gaaucacaacuugacca

SEQ ID NO: 686250 - RNA, 18 nt, Haemophilus influenzae Rd
gaaucagaguuaaaaguc

SEQ ID NO: 686251 - RNA, 13 nt, Haemophilus influenzae Rd
gaaucaucuucau

SEQ ID NO: 686252 - RNA, 19 nt, Haemophilus influenzae Rd
gaauccaaaauuacuuuuc

SEQ ID NO: 686253 - RNA, 16 nt, Haemophilus influenzae Rd
gaaucauuuucaccaa

SEQ ID NO: 686254 - RNA, 23 nt, Haemophilus influenzae Rd
gaaucauuuucaccaauuuaucu

SEQ ID NO: 686255 - RNA, 14 nt, Haemophilus influenzae Rd
gaaucgugacaaua

SEQ ID NO: 686256 - RNA, 14 nt, Haemophilus influenzae Rd
gaaucuaaaacuau

SEQ ID NO: 686257 - RNA, 15 nt, Haemophilus influenzae Rd
gaaucguuuguaaaa

SEQ ID NO: 686258 - RNA, 17 nt, Haemophilus influenzae Rd
gaaucucacguacuuuu

SEQ ID NO: 686259 - RNA, 11 nt, Haemophilus influenzae Rd
gaaugauucaa

SEQ ID NO: 686260 - RNA, 14 nt, Haemophilus influenzae Rd
gaaugacuuucacu

SEQ ID NO: 686261 - RNA, 12 nt, Haemophilus influenzae Rd
gaaucuuuaucu

SEQ ID NO: 686262 - RNA, 20 nt, Haemophilus influenzae Rd
gaaucuuagucaaugccuaa

SEQ ID NO: 686263 - RNA, 20 nt, Haemophilus influenzae Rd
gaaugaaaguuuucguaaau

SEQ ID NO: 686264 - RNA, 17 nt, Haemophilus influenzae Rd
gaaugaaauucagugau

SEQ ID NO: 686265 - RNA, 15 nt, Haemophilus influenzae Rd
gaaugaaguuagaaa

SEQ ID NO: 686266 - RNA, 22 nt, Haemophilus influenzae Rd
gaaugaaguuagaaacagaagu

SEQ ID NO: 686267 - RNA, 21 nt, Haemophilus influenzae Rd
gaaugcuuuuauaagugaaau

SEQ ID NO: 686268 - RNA, 17 nt, Haemophilus influenzae Rd
gaaugccauuaaacuuc

SEQ ID NO: 686269 - RNA, 19 nt, Haemophilus influenzae Rd
gaaugccauuaaacuucug

SEQ ID NO: 686270 - RNA, 15 nt, Haemophilus influenzae Rd
gaaugcccagcaauu

SEQ ID NO: 686271 - RNA, 12 nt, Haemophilus influenzae Rd
gaauuaaaucug

SEQ ID NO: 686272 - RNA, 16 nt, Haemophilus influenzae Rd
gaauuaaacgugauuu

SEQ ID NO: 686273 - RNA, 19 nt, Haemophilus influenzae Rd
gaauuaaagugcagauuuu

SEQ ID NO: 686274 - RNA, 12 nt, Haemophilus influenzae Rd
gaauuaaaucca

SEQ ID NO: 686275 - RNA, 18 nt, Haemophilus influenzae Rd
gaauuaaaauaugauucu

SEQ ID NO: 686276 - RNA, 21 nt, Haemophilus influenzae Rd
gaauguuuugauugagauuua

SEQ ID NO: 686277 - RNA, 18 nt, Haemophilus influenzae Rd
gaaugucuuaaagauaaa

SEQ ID NO: 686278 - RNA, 15 nt, Haemophilus influenzae Rd
gaauguaaaaauaac

SEQ ID NO: 686279 - RNA, 18 nt, Haemophilus influenzae Rd
gaaugguugcaaaggcag

SEQ ID NO: 686280 - RNA, 15 nt, Haemophilus influenzae Rd
gaaugguaacauuca

SEQ ID NO: 686281 - RNA, 17 nt, Haemophilus influenzae Rd
gaauggcgaauuucacg

SEQ ID NO: 686282 - RNA, 19 nt, Haemophilus influenzae Rd
gaauucgaagguauauaag

SEQ ID NO: 686283 - RNA, 15 nt, Haemophilus influenzae Rd
gaauugcauuuucuu

SEQ ID NO: 686284 - RNA, 20 nt, Haemophilus influenzae Rd
gaauugaucgaaugauucaa

SEQ ID NO: 686285 - RNA, 22 nt, Haemophilus influenzae Rd
gaauuucauaaacgguauuuuc

SEQ ID NO: 686286 - RNA, 14 nt, Haemophilus influenzae Rd
gaauuuaucaucaa

SEQ ID NO: 686287 - RNA, 15 nt, Haemophilus influenzae Rd
gaauuuaucaucaau

SEQ ID NO: 686288 - RNA, 16 nt, Haemophilus influenzae Rd
gaauuuaaacuuagga

SEQ ID NO: 686289 - RNA, 19 nt, Haemophilus influenzae Rd
gaauuggcgaaccuucacu

SEQ ID NO: 686290 - RNA, 22 nt, Haemophilus influenzae Rd
gaauugcuccuccuaaugcagc

SEQ ID NO: 686291 - RNA, 18 nt, Haemophilus influenzae Rd
gaauugugcuaaauuuuu

SEQ ID NO: 686292 - RNA, 23 nt, Haemophilus influenzae Rd
gaauuguaccuucugcugcaguu

SEQ ID NO: 686293 - RNA, 15 nt, Haemophilus influenzae Rd
gaauuaguaaagaaa

SEQ ID NO: 686294 - RNA, 19 nt, Haemophilus influenzae Rd
gaauuaguuuuuuauuucu

SEQ ID NO: 686295 - RNA, 21 nt, Haemophilus influenzae Rd
gaauuaguuucaacuuggaaa

SEQ ID NO: 686296 - RNA, 12 nt, Haemophilus influenzae Rd
gaauuaauaacg

SEQ ID NO: 686297 - RNA, 13 nt, Haemophilus influenzae Rd
gaauuaauaacgc

SEQ ID NO: 686298 - RNA, 16 nt, Haemophilus influenzae Rd
gaauuaccaauuccaa

SEQ ID NO: 686299 - RNA, 23 nt, Haemophilus influenzae Rd
gaaccauuuauaaugcaaccaaa

SEQ ID NO: 686300 - RNA, 16 nt, Haemophilus influenzae Rd
gaaccauuuuacaaua

SEQ ID NO: 686301 - RNA, 20 nt, Haemophilus influenzae Rd
gaaccgauuuuaaauucucc

SEQ ID NO: 686302 - RNA, 23 nt, Haemophilus influenzae Rd
gaacgauagccguccauuucaau

SEQ ID NO: 686303 - RNA, 18 nt, Haemophilus influenzae Rd
gaacgauuaaaaaugcuu

SEQ ID NO: 686304 - RNA, 23 nt, Haemophilus influenzae Rd
gaacgccgcaacuaauaaaccaa

SEQ ID NO: 686305 - RNA, 18 nt, Haemophilus influenzae Rd
gaaccugucgcaaugaag

SEQ ID NO: 686306 - RNA, 20 nt, Haemophilus influenzae Rd
gaaccugauaaguagaaaaa

SEQ ID NO: 686307 - RNA, 16 nt, Haemophilus influenzae Rd
gaaccuauuagaauuu

SEQ ID NO: 686308 - RNA, 14 nt, Haemophilus influenzae Rd
gaaccuaaugcagu

SEQ ID NO: 686309 - RNA, 15 nt, Haemophilus influenzae Rd
gaacgguucgccuga

SEQ ID NO: 686310 - RNA, 13 nt, Haemophilus influenzae Rd
gaacgguagcagg

SEQ ID NO: 686311 - RNA, 18 nt, Haemophilus influenzae Rd
gaacggucaaaaugcagu

SEQ ID NO: 686312 - RNA, 16 nt, Haemophilus influenzae Rd
gaacggcgauuuugcg

SEQ ID NO: 686313 - RNA, 16 nt, Haemophilus influenzae Rd
gaacucaauuccuuca

SEQ ID NO: 686314 - RNA, 17 nt, Haemophilus influenzae Rd
gaacucaauuccuucau

SEQ ID NO: 686315 - RNA, 18 nt, Haemophilus influenzae Rd
gaacucacaauugaugua

SEQ ID NO: 686316 - RNA, 22 nt, Haemophilus influenzae Rd
gaacuauuauuccaaauaucuu

SEQ ID NO: 686317 - RNA, 12 nt, Haemophilus influenzae Rd
gaacuaaaauau

SEQ ID NO: 686318 - RNA, 12 nt, Haemophilus influenzae Rd
gaacuaauauca

SEQ ID NO: 686319 - RNA, 21 nt, Haemophilus influenzae Rd
gaacuaaaaggacuaagcuuu

SEQ ID NO: 686320 - RNA, 17 nt, Haemophilus influenzae Rd
gaacguaaauucaggca

SEQ ID NO: 686321 - RNA, 23 nt, Haemophilus influenzae Rd
gaacguuuuugucguucuuuuuc

SEQ ID NO: 686322 - RNA, 21 nt, Haemophilus influenzae Rd
gaacucuaucuaaauggcaaa

SEQ ID NO: 686323 - RNA, 18 nt, Haemophilus influenzae Rd
gaacuuaugugcaccuuc

SEQ ID NO: 686324 - RNA, 18 nt, Haemophilus influenzae Rd
gaagcuaagaaaauccaa

SEQ ID NO: 686325 - RNA, 19 nt, Haemophilus influenzae Rd
gaagcucacuuuauauagu

SEQ ID NO: 686326 - RNA, 21 nt, Haemophilus influenzae Rd
gaagcugcuuuuaauaugcug

SEQ ID NO: 686327 - RNA, 16 nt, Haemophilus influenzae Rd
gaagccgaugaaagcu

SEQ ID NO: 686328 - RNA, 13 nt, Haemophilus influenzae Rd
gaagccaaaucau

SEQ ID NO: 686329 - RNA, 13 nt, Haemophilus influenzae Rd
gaagaugaaagug

SEQ ID NO: 686330 - RNA, 16 nt, Haemophilus influenzae Rd
gaagaugaaagugcgg

SEQ ID NO: 686331 - RNA, 22 nt, Haemophilus influenzae Rd
gaagagauuauuugcauauaaa

SEQ ID NO: 686332 - RNA, 18 nt, Haemophilus influenzae Rd
gaagaguaaaacuaauuu

SEQ ID NO: 686333 - RNA, 22 nt, Haemophilus influenzae Rd
gaagauuuacccaacaaauuua

SEQ ID NO: 686334 - RNA, 15 nt, Haemophilus influenzae Rd
gaagauuaauugcua

SEQ ID NO: 686335 - RNA, 15 nt, Haemophilus influenzae Rd
gaagauuacuuucau

SEQ ID NO: 686336 - RNA, 17 nt, Haemophilus influenzae Rd
gaagauuuauauuccau

SEQ ID NO: 686337 - RNA, 13 nt, Haemophilus influenzae Rd
gaagaauacaagc

SEQ ID NO: 686338 - RNA, 13 nt, Haemophilus influenzae Rd
gaagaaucuugcg

SEQ ID NO: 686339 - RNA, 23 nt, Haemophilus influenzae Rd
gaagaaacgagcauauuuuccau

SEQ ID NO: 686340 - RNA, 12 nt, Haemophilus influenzae Rd
gaagaagauaau

SEQ ID NO: 686341 - RNA, 17 nt, Haemophilus influenzae Rd
gaacuugaauugaagag

SEQ ID NO: 686342 - RNA, 18 nt, Haemophilus influenzae Rd
gaacuugaauugaagagu

SEQ ID NO: 686343 - RNA, 22 nt, Haemophilus influenzae Rd
cuucuucgcuccaaucaucauc

SEQ ID NO: 686344 - RNA, 14 nt, Haemophilus influenzae Rd
cuucuuccugcaaa

SEQ ID NO: 686345 - RNA, 22 nt, Haemophilus influenzae Rd
cuucuucccaaccuaauuguuc

SEQ ID NO: 686346 - RNA, 17 nt, Haemophilus influenzae Rd
cuucuugcagggcuuug

SEQ ID NO: 686347 - RNA, 18 nt, Haemophilus influenzae Rd
cuucuugcagggcuuugu

SEQ ID NO: 686348 - RNA, 21 nt, Haemophilus influenzae Rd
cuucugguggaagcuucauau

SEQ ID NO: 686349 - RNA, 15 nt, Haemophilus influenzae Rd
cuucuggguaaaaua

SEQ ID NO: 686350 - RNA, 20 nt, Haemophilus influenzae Rd
cuucugggucuuuuugugga

SEQ ID NO: 686351 - RNA, 19 nt, Haemophilus influenzae Rd
cuucuguugggaauaauuc

SEQ ID NO: 686352 - RNA, 19 nt, Haemophilus influenzae Rd
cuucuuacguuuaaauuua

SEQ ID NO: 686353 - RNA, 12 nt, Haemophilus influenzae Rd
cuucuucaauug

SEQ ID NO: 686354 - RNA, 14 nt, Haemophilus influenzae Rd
cuucugccauauca

SEQ ID NO: 686355 - RNA, 22 nt, Haemophilus influenzae Rd
cuucugccagauguuggaaauu

SEQ ID NO: 686356 - RNA, 17 nt, Haemophilus influenzae Rd
cuucugcugcacgagcu

SEQ ID NO: 686357 - RNA, 23 nt, Haemophilus influenzae Rd
cuucugcuugguaauaaucaauu

SEQ ID NO: 686358 - RNA, 21 nt, Haemophilus influenzae Rd
cuucugcuuuacguuuugcuu

SEQ ID NO: 686359 - RNA, 15 nt, Haemophilus influenzae Rd
cuucugcaccagaaa

SEQ ID NO: 686360 - RNA, 22 nt, Haemophilus influenzae Rd
cuucugaacgcgcgccaauaaa

SEQ ID NO: 686361 - RNA, 13 nt, Haemophilus influenzae Rd
cuugaacaaaaag

SEQ ID NO: 686362 - RNA, 14 nt, Haemophilus influenzae Rd
cuucuuucaaugca

SEQ ID NO: 686363 - RNA, 22 nt, Haemophilus influenzae Rd
cuucuuuauuugagccaauaac

SEQ ID NO: 686364 - RNA, 23 nt, Haemophilus influenzae Rd
cuucuuguaaacugcuuucaaaa

SEQ ID NO: 686365 - RNA, 19 nt, Haemophilus influenzae Rd
cuucuuuaauuucuucaac

SEQ ID NO: 686366 - RNA, 20 nt, Haemophilus influenzae Rd
cuucuuuaauuucuucaacu

SEQ ID NO: 686367 - RNA, 22 nt, Haemophilus influenzae Rd
cuugaaaguaaucgccccaaaa

SEQ ID NO: 686368 - RNA, 21 nt, Haemophilus influenzae Rd
cuugaugcucugcauaaaagc

SEQ ID NO: 686369 - RNA, 20 nt, Haemophilus influenzae Rd
cuugcacuaauugugguaaa

SEQ ID NO: 686370 - RNA, 18 nt, Haemophilus influenzae Rd
cuugauugcacuucaccg

SEQ ID NO: 686371 - RNA, 23 nt, Haemophilus influenzae Rd
cuugauaaaaaugagauuauuuc

SEQ ID NO: 686372 - RNA, 23 nt, Haemophilus influenzae Rd
cuugcagggcuuuguauuuugug

SEQ ID NO: 686373 - RNA, 23 nt, Haemophilus influenzae Rd
cuugcucacgggcagaaugaauc

SEQ ID NO: 686374 - RNA, 20 nt, Haemophilus influenzae Rd
cuugcuaucgagguuuucgu

SEQ ID NO: 686375 - RNA, 14 nt, Haemophilus influenzae Rd
cuuguuuuaaaauu

SEQ ID NO: 686376 - RNA, 15 nt, Haemophilus influenzae Rd
cuuguuuuaaaauuu

SEQ ID NO: 686377 - RNA, 12 nt, Haemophilus influenzae Rd
cuuguuuuaaau

SEQ ID NO: 686378 - RNA, 14 nt, Haemophilus influenzae Rd
cuuguuuuaauuga

SEQ ID NO: 686379 - RNA, 18 nt, Haemophilus influenzae Rd
cuuguuuuccaaacauuu

SEQ ID NO: 686380 - RNA, 20 nt, Haemophilus influenzae Rd
cuuguuuuaaaucuucuauc

SEQ ID NO: 686381 - RNA, 14 nt, Haemophilus influenzae Rd
cuuguuuugcaaua

SEQ ID NO: 686382 - RNA, 21 nt, Haemophilus influenzae Rd
cuuguuuacugaauaaaaaaa

SEQ ID NO: 686383 - RNA, 13 nt, Haemophilus influenzae Rd
cuuguucuucaua

SEQ ID NO: 686384 - RNA, 15 nt, Haemophilus influenzae Rd
cuuguuggcauugaa

SEQ ID NO: 686385 - RNA, 19 nt, Haemophilus influenzae Rd
cuuguuggaaaaaugcugg

SEQ ID NO: 686386 - RNA, 22 nt, Haemophilus influenzae Rd
cuuguucuccauuaagcacagg

SEQ ID NO: 686387 - RNA, 22 nt, Haemophilus influenzae Rd
cuuguucuucggguuuauguaa

SEQ ID NO: 686388 - RNA, 15 nt, Haemophilus influenzae Rd
cuuuaacaaaaucaa

SEQ ID NO: 686389 - RNA, 15 nt, Haemophilus influenzae Rd
cuuuaaauuuuccug

SEQ ID NO: 686390 - RNA, 15 nt, Haemophilus influenzae Rd
cuuuaaauuuugcuu

SEQ ID NO: 686391 - RNA, 21 nt, Haemophilus influenzae Rd
cuuuaaauuuugcuuuaaauc

SEQ ID NO: 686392 - RNA, 17 nt, Haemophilus influenzae Rd
cuuuaacaauuacugca

SEQ ID NO: 686393 - RNA, 22 nt, Haemophilus influenzae Rd
cuuuaaauucuucgaaaauaac

SEQ ID NO: 686394 - RNA, 18 nt, Haemophilus influenzae Rd
cuuuaaauagauaaucag

SEQ ID NO: 686395 - RNA, 13 nt, Haemophilus influenzae Rd
cuuuaacccauuu

SEQ ID NO: 686396 - RNA, 16 nt, Haemophilus influenzae Rd
cuuuaacccauuuauu

SEQ ID NO: 686397 - RNA, 13 nt, Haemophilus influenzae Rd
cuuuaaauauuua

SEQ ID NO: 686398 - RNA, 14 nt, Haemophilus influenzae Rd
cuuuaaauauuuaa

SEQ ID NO: 686399 - RNA, 15 nt, Haemophilus influenzae Rd
cuuuaaauauuuaaa

SEQ ID NO: 686400 - RNA, 17 nt, Haemophilus influenzae Rd
cuuuaaauauuuaaaaa

SEQ ID NO: 686401 - RNA, 20 nt, Haemophilus influenzae Rd
cuuuaaauauuuaaaaagaa

SEQ ID NO: 686402 - RNA, 14 nt, Haemophilus influenzae Rd
cuuuaaaaaauaac

SEQ ID NO: 686403 - RNA, 23 nt, Haemophilus influenzae Rd
cuuguggcggguuucuuuuaucg

SEQ ID NO: 686404 - RNA, 19 nt, Haemophilus influenzae Rd
cuuguggguuuauugguaa

SEQ ID NO: 686405 - RNA, 14 nt, Haemophilus influenzae Rd
cuuguguuuuagaa

SEQ ID NO: 686406 - RNA, 22 nt, Haemophilus influenzae Rd
cuuguucaaaaauuucgcuauu

SEQ ID NO: 686407 - RNA, 17 nt, Haemophilus influenzae Rd
cuuguucaaauaaugug

SEQ ID NO: 686408 - RNA, 13 nt, Haemophilus influenzae Rd
cuuguucaaguug

SEQ ID NO: 686409 - RNA, 19 nt, Haemophilus influenzae Rd
cuuguucacguguuuuuuc

SEQ ID NO: 686410 - RNA, 15 nt, Haemophilus influenzae Rd
cuuguuaaauaaaca

SEQ ID NO: 686411 - RNA, 13 nt, Haemophilus influenzae Rd
cuugugaaccauu

SEQ ID NO: 686412 - RNA, 15 nt, Haemophilus influenzae Rd
cuugugcuauacaaa

SEQ ID NO: 686413 - RNA, 16 nt, Haemophilus influenzae Rd
cuugugcauaaacaaa

SEQ ID NO: 686414 - RNA, 15 nt, Haemophilus influenzae Rd
cuugugcucgauuuu

SEQ ID NO: 686415 - RNA, 18 nt, Haemophilus influenzae Rd
cuugugcucgauuuuuaa

SEQ ID NO: 686416 - RNA, 20 nt, Haemophilus influenzae Rd
cuugugcucgauuuuuaaaa

SEQ ID NO: 686417 - RNA, 18 nt, Haemophilus influenzae Rd
cuugugcgauaagcgguu

SEQ ID NO: 686418 - RNA, 14 nt, Haemophilus influenzae Rd
cuugugcuuugugc

SEQ ID NO: 686419 - RNA, 20 nt, Haemophilus influenzae Rd
cuuguggaauaaaauaaucu

SEQ ID NO: 686420 - RNA, 20 nt, Haemophilus influenzae Rd
cuuguaaagauuguccuuuu

SEQ ID NO: 686421 - RNA, 16 nt, Haemophilus influenzae Rd
cuuguaaaauuggugg

SEQ ID NO: 686422 - RNA, 20 nt, Haemophilus influenzae Rd
cuugcuuuugguuuucuggu

SEQ ID NO: 686423 - RNA, 12 nt, Haemophilus influenzae Rd
cuugcuuuuuaa

SEQ ID NO: 686424 - RNA, 23 nt, Haemophilus influenzae Rd
cuuguaaugcaaaccauuuaucc

SEQ ID NO: 686425 - RNA, 13 nt, Haemophilus influenzae Rd
cuuguaauuucau

SEQ ID NO: 686426 - RNA, 16 nt, Haemophilus influenzae Rd
cuuguaauuucauuuu

SEQ ID NO: 686427 - RNA, 16 nt, Haemophilus influenzae Rd
cuugucauuaaaaaau

SEQ ID NO: 686428 - RNA, 19 nt, Haemophilus influenzae Rd
cuugucauuaaaaaauaau

SEQ ID NO: 686429 - RNA, 13 nt, Haemophilus influenzae Rd
cuuuaccaaauag

SEQ ID NO: 686430 - RNA, 19 nt, Haemophilus influenzae Rd
cuuuaccauugcguucacu

SEQ ID NO: 686431 - RNA, 12 nt, Haemophilus influenzae Rd
cuuuaauaauca

SEQ ID NO: 686432 - RNA, 16 nt, Haemophilus influenzae Rd
cuuuaauaguaaacuu

SEQ ID NO: 686433 - RNA, 22 nt, Haemophilus influenzae Rd
cuuuaauaguaaacuuuuaaag

SEQ ID NO: 686434 - RNA, 20 nt, Haemophilus influenzae Rd
cuuuacccuauuacuuucca

SEQ ID NO: 686435 - RNA, 20 nt, Haemophilus influenzae Rd
cuuuaccuugcauuucuuua

SEQ ID NO: 686436 - RNA, 21 nt, Haemophilus influenzae Rd
cuuuaccuuguaaacuuuccu

SEQ ID NO: 686437 - RNA, 13 nt, Haemophilus influenzae Rd
cuuuacgacuaaa

SEQ ID NO: 686438 - RNA, 21 nt, Haemophilus influenzae Rd
cuuuauaguuguaggugggcu

SEQ ID NO: 686439 - RNA, 19 nt, Haemophilus influenzae Rd
cuuuauagccuauaauuaa

SEQ ID NO: 686440 - RNA, 22 nt, Haemophilus influenzae Rd
cuuucacacugcccuucucugc

SEQ ID NO: 686441 - RNA, 11 nt, Haemophilus influenzae Rd
cuuucaccaaa

SEQ ID NO: 686442 - RNA, 22 nt, Haemophilus influenzae Rd
cuuucaccaaauaauguuaaau

SEQ ID NO: 686443 - RNA, 17 nt, Haemophilus influenzae Rd
cuuucaccgcuuuucuc

SEQ ID NO: 686444 - RNA, 17 nt, Haemophilus influenzae Rd
cuuucaguuaaauuuuc

SEQ ID NO: 686445 - RNA, 17 nt, Haemophilus influenzae Rd
cuuucacgucaccuacu

SEQ ID NO: 686446 - RNA, 15 nt, Haemophilus influenzae Rd
cuuucacuauuucau

SEQ ID NO: 686447 - RNA, 15 nt, Haemophilus influenzae Rd
cuuuaucauaacuau

SEQ ID NO: 686448 - RNA, 22 nt, Haemophilus influenzae Rd
cuuuauucaaccguacacgcgc

SEQ ID NO: 686449 - RNA, 13 nt, Haemophilus influenzae Rd
cuuuauuacuuuu

SEQ ID NO: 686450 - RNA, 15 nt, Haemophilus influenzae Rd
cuuuauuacuuuuau

SEQ ID NO: 686451 - RNA, 17 nt, Haemophilus influenzae Rd
cuuuauuacuuuuaucc

SEQ ID NO: 686452 - RNA, 16 nt, Haemophilus influenzae Rd
cuuuauuaaacaaaaa

SEQ ID NO: 686453 - RNA, 12 nt, Haemophilus influenzae Rd
cuuuauuacagu

SEQ ID NO: 686454 - RNA, 19 nt, Haemophilus influenzae Rd
cuuuccguucauaaauagg

SEQ ID NO: 686455 - RNA, 19 nt, Haemophilus influenzae Rd
cuuuccccccuuagcucag

SEQ ID NO: 686456 - RNA, 20 nt, Haemophilus influenzae Rd
cuuucccgcaacuuuugcaa

SEQ ID NO: 686457 - RNA, 18 nt, Haemophilus influenzae Rd
cuuuccgauuaauauacc

SEQ ID NO: 686458 - RNA, 22 nt, Haemophilus influenzae Rd
cuuuccauacccuugcuucugg

SEQ ID NO: 686459 - RNA, 19 nt, Haemophilus influenzae Rd
cuuucauccucucgccaaa

SEQ ID NO: 686460 - RNA, 17 nt, Haemophilus influenzae Rd
cuuucauauaaauaaga

SEQ ID NO: 686461 - RNA, 19 nt, Haemophilus influenzae Rd
cuuucaucguuugaacaaa

SEQ ID NO: 686462 - RNA, 19 nt, Haemophilus influenzae Rd
cuuucugaacacucuaucu

SEQ ID NO: 686463 - RNA, 17 nt, Haemophilus influenzae Rd
cuuucgcggaauuucag

SEQ ID NO: 686464 - RNA, 17 nt, Haemophilus influenzae Rd
cuuucgcguaauaacaa

SEQ ID NO: 686465 - RNA, 18 nt, Haemophilus influenzae Rd
cuuccauaucacauuuua

SEQ ID NO: 686466 - RNA, 22 nt, Haemophilus influenzae Rd
cuuccauaucacauuuuauuga

SEQ ID NO: 686467 - RNA, 12 nt, Haemophilus influenzae Rd
cuuccaaaauuu

SEQ ID NO: 686468 - RNA, 18 nt, Haemophilus influenzae Rd
cuuccaaagaaucaucuu

SEQ ID NO: 686469 - RNA, 15 nt, Haemophilus influenzae Rd
cuucauuuuaaauua

SEQ ID NO: 686470 - RNA, 18 nt, Haemophilus influenzae Rd
cuucauuuuaaauuauuu

SEQ ID NO: 686471 - RNA, 14 nt, Haemophilus influenzae Rd
cuucauuugcuuua

SEQ ID NO: 686472 - RNA, 21 nt, Haemophilus influenzae Rd
cuucauuugcuuuaacccauu

SEQ ID NO: 686473 - RNA, 22 nt, Haemophilus influenzae Rd
cuucauuuugagauaaauuuuu

SEQ ID NO: 686474 - RNA, 14 nt, Haemophilus influenzae Rd
cuucauuauauucc

SEQ ID NO: 686475 - RNA, 20 nt, Haemophilus influenzae Rd
cuucauuaaaaccaauuuuu

SEQ ID NO: 686476 - RNA, 21 nt, Haemophilus influenzae Rd
cuuccgcgcuuagcaauguuu

SEQ ID NO: 686477 - RNA, 20 nt, Haemophilus influenzae Rd
cuuccgcuggugggaauaau

SEQ ID NO: 686478 - RNA, 17 nt, Haemophilus influenzae Rd
cuuccauuaauucauau

SEQ ID NO: 686479 - RNA, 14 nt, Haemophilus influenzae Rd
cuuccaucuuuuug

SEQ ID NO: 686480 - RNA, 17 nt, Haemophilus influenzae Rd
cuuccaucuuuuugagc

SEQ ID NO: 686481 - RNA, 13 nt, Haemophilus influenzae Rd
cuuccauuuuuau

SEQ ID NO: 686482 - RNA, 13 nt, Haemophilus influenzae Rd
cuuccauuuuuua

SEQ ID NO: 686483 - RNA, 17 nt, Haemophilus influenzae Rd
cuucgccauuuuuaaaa

SEQ ID NO: 686484 - RNA, 21 nt, Haemophilus influenzae Rd
cuuccgcuuuuuucgcaccaa

SEQ ID NO: 686485 - RNA, 13 nt, Haemophilus influenzae Rd
cuucgaugcuuuu

SEQ ID NO: 686486 - RNA, 17 nt, Haemophilus influenzae Rd
cuucgaugcuuuuucau

SEQ ID NO: 686487 - RNA, 18 nt, Haemophilus influenzae Rd
cuucgaugugcauuuuuc

SEQ ID NO: 686488 - RNA, 20 nt, Haemophilus influenzae Rd
cuucgaugugcauuuuucau

SEQ ID NO: 686489 - RNA, 20 nt, Haemophilus influenzae Rd
cuucgauuuuucuaaaauca

SEQ ID NO: 686490 - RNA, 14 nt, Haemophilus influenzae Rd
cuucauagugagau

SEQ ID NO: 686491 - RNA, 18 nt, Haemophilus influenzae Rd
cuucauagaaaccaauaa

SEQ ID NO: 686492 - RNA, 13 nt, Haemophilus influenzae Rd
cuucauaaaaaaa

SEQ ID NO: 686493 - RNA, 14 nt, Haemophilus influenzae Rd
cuucaguuuucauu

SEQ ID NO: 686494 - RNA, 16 nt, Haemophilus influenzae Rd
cuucaguuuucauuuu

SEQ ID NO: 686495 - RNA, 18 nt, Haemophilus influenzae Rd
cuucaguuuucauuuuuu

SEQ ID NO: 686496 - RNA, 17 nt, Haemophilus influenzae Rd
cuucauaaguccaaguu

SEQ ID NO: 686497 - RNA, 16 nt, Haemophilus influenzae Rd
cuucaucagccgcuuu

SEQ ID NO: 686498 - RNA, 17 nt, Haemophilus influenzae Rd
cuucaucaaaaugaaaa

SEQ ID NO: 686499 - RNA, 17 nt, Haemophilus influenzae Rd
cuucaucaccugcuuua

SEQ ID NO: 686500 - RNA, 13 nt, Haemophilus influenzae Rd
cuucauauaaucu

SEQ ID NO: 686501 - RNA, 20 nt, Haemophilus influenzae Rd
cuucauaguuggauuauuua

SEQ ID NO: 686502 - RNA, 14 nt, Haemophilus influenzae Rd
cuucauccauuuuc

SEQ ID NO: 686503 - RNA, 19 nt, Haemophilus influenzae Rd
cuucagcguugucaucaga

SEQ ID NO: 686504 - RNA, 20 nt, Haemophilus influenzae Rd
cuucagcuuguuuaaucaca

SEQ ID NO: 686505 - RNA, 14 nt, Haemophilus influenzae Rd
cuucagcuucuuca

SEQ ID NO: 686506 - RNA, 17 nt, Haemophilus influenzae Rd
cuucagcuucuucaucg

SEQ ID NO: 686507 - RNA, 21 nt, Haemophilus influenzae Rd
cuucaguccgccuuuuugcuu

SEQ ID NO: 686508 - RNA, 16 nt, Haemophilus influenzae Rd
cuucagccacuaauuu

SEQ ID NO: 686509 - RNA, 18 nt, Haemophilus influenzae Rd
cuucagccacuaauuuca

SEQ ID NO: 686510 - RNA, 19 nt, Haemophilus influenzae Rd
cuucagcaaguucugcacg

SEQ ID NO: 686511 - RNA, 14 nt, Haemophilus influenzae Rd
cuucagcauuuaaa

SEQ ID NO: 686512 - RNA, 17 nt, Haemophilus influenzae Rd
cuucagcaguuuggcaa

SEQ ID NO: 686513 - RNA, 17 nt, Haemophilus influenzae Rd
cuucaccaaucacagcc

SEQ ID NO: 686514 - RNA, 20 nt, Haemophilus influenzae Rd
cuucacacaccaacacgcca

SEQ ID NO: 686515 - RNA, 18 nt, Haemophilus influenzae Rd
cuuauuauacauuuaacc

SEQ ID NO: 686516 - RNA, 16 nt, Haemophilus influenzae Rd
cuuauucaaacgcccu

SEQ ID NO: 686517 - RNA, 19 nt, Haemophilus influenzae Rd
cuuaucuacaaucaaaaaa

SEQ ID NO: 686518 - RNA, 16 nt, Haemophilus influenzae Rd
cuuauccugccuugca

SEQ ID NO: 686519 - RNA, 15 nt, Haemophilus influenzae Rd
cuuaucuuaaaaaag

SEQ ID NO: 686520 - RNA, 17 nt, Haemophilus influenzae Rd
cuuaucuaaaaagauuu

SEQ ID NO: 686521 - RNA, 16 nt, Haemophilus influenzae Rd
cuuaucgguuggauuu

SEQ ID NO: 686522 - RNA, 23 nt, Haemophilus influenzae Rd
cuuauuaccuacuaauuagguuc

SEQ ID NO: 686523 - RNA, 23 nt, Haemophilus influenzae Rd
cuuauguuuugguuuucuuuuuu

SEQ ID NO: 686524 - RNA, 19 nt, Haemophilus influenzae Rd
cuuacuacguguucaucau

SEQ ID NO: 686525 - RNA, 12 nt, Haemophilus influenzae Rd
cuuagauaaauu

SEQ ID NO: 686526 - RNA, 16 nt, Haemophilus influenzae Rd
cuuagauaacguucau

SEQ ID NO: 686527 - RNA, 16 nt, Haemophilus influenzae Rd
cuuagauuugaaccuu

SEQ ID NO: 686528 - RNA, 14 nt, Haemophilus influenzae Rd
cuuagauuuucuua

SEQ ID NO: 686529 - RNA, 18 nt, Haemophilus influenzae Rd
cuuauauuauuuagauua

SEQ ID NO: 686530 - RNA, 17 nt, Haemophilus influenzae Rd
cuuauauucaaauuuca

SEQ ID NO: 686531 - RNA, 14 nt, Haemophilus influenzae Rd
cuuauauucagacu

SEQ ID NO: 686532 - RNA, 16 nt, Haemophilus influenzae Rd
cuuauacaacaaaaag

SEQ ID NO: 686533 - RNA, 23 nt, Haemophilus influenzae Rd
cuuaucccauaccguauuuuuuu

SEQ ID NO: 686534 - RNA, 23 nt, Haemophilus influenzae Rd
cuuauccguuacauuauuuaauu

SEQ ID NO: 686535 - RNA, 15 nt, Haemophilus influenzae Rd
cuuaucgcaaucacg

SEQ ID NO: 686536 - RNA, 17 nt, Haemophilus influenzae Rd
cuuaauagagaauaauu

SEQ ID NO: 686537 - RNA, 11 nt, Haemophilus influenzae Rd
cuuaaauauau

SEQ ID NO: 686538 - RNA, 17 nt, Haemophilus influenzae Rd
cuuaaauauaucaagca

SEQ ID NO: 686539 - RNA, 18 nt, Haemophilus influenzae Rd
cuuaaauauaucaagcag

SEQ ID NO: 686540 - RNA, 21 nt, Haemophilus influenzae Rd
cuuaaaguuaucaaacaguuc

SEQ ID NO: 686541 - RNA, 23 nt, Haemophilus influenzae Rd
cuuaaagcaaucaaaaaugaaag

SEQ ID NO: 686542 - RNA, 17 nt, Haemophilus influenzae Rd
cuuaaacucgaaggaaa

SEQ ID NO: 686543 - RNA, 17 nt, Haemophilus influenzae Rd
cuuaauugugugcguuu

SEQ ID NO: 686544 - RNA, 17 nt, Haemophilus influenzae Rd
cuuaauugauuuuaaag

SEQ ID NO: 686545 - RNA, 13 nt, Haemophilus influenzae Rd
cuuaauuuaauua

SEQ ID NO: 686546 - RNA, 15 nt, Haemophilus influenzae Rd
cuuaauuuaauuaug

SEQ ID NO: 686547 - RNA, 23 nt, Haemophilus influenzae Rd
cuuaauuuaauuauguauuuucu

SEQ ID NO: 686548 - RNA, 18 nt, Haemophilus influenzae Rd
cuuaauuaaucuuuuuuc

SEQ ID NO: 686549 - RNA, 20 nt, Haemophilus influenzae Rd
cuuaauuagauuuauuuucu

SEQ ID NO: 686550 - RNA, 22 nt, Haemophilus influenzae Rd
cuuaauuaacgggcuuaaacuu

SEQ ID NO: 686551 - RNA, 16 nt, Haemophilus influenzae Rd
cuuaaucauuuuuuaa

SEQ ID NO: 686552 - RNA, 14 nt, Haemophilus influenzae Rd
cuuaccuuccacuu

SEQ ID NO: 686553 - RNA, 13 nt, Haemophilus influenzae Rd
cuuacaacaaauu

SEQ ID NO: 686554 - RNA, 14 nt, Haemophilus influenzae Rd
cuuaauuuuuuaac

SEQ ID NO: 686555 - RNA, 16 nt, Haemophilus influenzae Rd
cuuaauuucuuaauua

SEQ ID NO: 686556 - RNA, 16 nt, Haemophilus influenzae Rd
cuuacagcaaaagcaa

SEQ ID NO: 686557 - RNA, 19 nt, Haemophilus influenzae Rd
cuuacagggcuuuauuuuu

SEQ ID NO: 686558 - RNA, 18 nt, Haemophilus influenzae Rd
cuguuuaaaucuaagccu

SEQ ID NO: 686559 - RNA, 17 nt, Haemophilus influenzae Rd
cuguuggaauuucaaaa

SEQ ID NO: 686560 - RNA, 20 nt, Haemophilus influenzae Rd
cuguuggagcaagcucaaaa

SEQ ID NO: 686561 - RNA, 19 nt, Haemophilus influenzae Rd
cuguugcgacagauacauu

SEQ ID NO: 686562 - RNA, 21 nt, Haemophilus influenzae Rd
cuguugcgacagauacauuua

SEQ ID NO: 686563 - RNA, 15 nt, Haemophilus influenzae Rd
cuguugagcaucuac

SEQ ID NO: 686564 - RNA, 14 nt, Haemophilus influenzae Rd
cuguugauguuuua

SEQ ID NO: 686565 - RNA, 19 nt, Haemophilus influenzae Rd
cuguucggacuuacaucug

SEQ ID NO: 686566 - RNA, 15 nt, Haemophilus influenzae Rd
cuguuuuaugcuaaa

SEQ ID NO: 686567 - RNA, 15 nt, Haemophilus influenzae Rd
cuguuuucauuauau

SEQ ID NO: 686568 - RNA, 18 nt, Haemophilus influenzae Rd
cuguuuucaauuuuaaaa

SEQ ID NO: 686569 - RNA, 17 nt, Haemophilus influenzae Rd
cuguuuuggcauuuuca

SEQ ID NO: 686570 - RNA, 16 nt, Haemophilus influenzae Rd
cuguuuugccugcuuc

SEQ ID NO: 686571 - RNA, 17 nt, Haemophilus influenzae Rd
cuguuuugccugcuucg

SEQ ID NO: 686572 - RNA, 19 nt, Haemophilus influenzae Rd
cuguuugcguuucagcagg

SEQ ID NO: 686573 - RNA, 18 nt, Haemophilus influenzae Rd
cuguuucuuuucaucuuc

SEQ ID NO: 686574 - RNA, 16 nt, Haemophilus influenzae Rd
cuguuugauaacuuua

SEQ ID NO: 686575 - RNA, 19 nt, Haemophilus influenzae Rd
cuguuugauaacuuuaagu

SEQ ID NO: 686576 - RNA, 20 nt, Haemophilus influenzae Rd
cuguuugauaacuuuaagua

SEQ ID NO: 686577 - RNA, 16 nt, Haemophilus influenzae Rd
cuguuuguuuuuucua

SEQ ID NO: 686578 - RNA, 17 nt, Haemophilus influenzae Rd
cuguuugugcacagauu

SEQ ID NO: 686579 - RNA, 10 nt, Haemophilus influenzae Rd
cuguuuuaag

SEQ ID NO: 686580 - RNA, 20 nt, Haemophilus influenzae Rd
cuguuuuaagguuuuuuccg

SEQ ID NO: 686581 - RNA, 15 nt, Haemophilus influenzae Rd
cuguuucaguuaucu

SEQ ID NO: 686582 - RNA, 22 nt, Haemophilus influenzae Rd
cuguuucacgaucauaaauuuu

SEQ ID NO: 686583 - RNA, 21 nt, Haemophilus influenzae Rd
cuguuuauuuuuuauaugcca

SEQ ID NO: 686584 - RNA, 13 nt, Haemophilus influenzae Rd
cuguuucuaauuc

SEQ ID NO: 686585 - RNA, 14 nt, Haemophilus influenzae Rd
cuguuucuaauucg

SEQ ID NO: 686586 - RNA, 17 nt, Haemophilus influenzae Rd
cuguuucuaauucggcu

SEQ ID NO: 686587 - RNA, 20 nt, Haemophilus influenzae Rd
cuguuuuugguaauuuacuc

SEQ ID NO: 686588 - RNA, 14 nt, Haemophilus influenzae Rd
cuguuuuuccauuc

SEQ ID NO: 686589 - RNA, 17 nt, Haemophilus influenzae Rd
cuuaaaaaagugaaaga

SEQ ID NO: 686590 - RNA, 22 nt, Haemophilus influenzae Rd
cuuaaaagaaauucgcuuuuuu

SEQ ID NO: 686591 - RNA, 12 nt, Haemophilus influenzae Rd
cuuaaaaacccc

SEQ ID NO: 686592 - RNA, 13 nt, Haemophilus influenzae Rd
cuuaaaaauaaag

SEQ ID NO: 686593 - RNA, 19 nt, Haemophilus influenzae Rd
cuuaaaaucuugguuuaaa

SEQ ID NO: 686594 - RNA, 22 nt, Haemophilus influenzae Rd
cuuaaaauucaaagauuauuua

SEQ ID NO: 686595 - RNA, 20 nt, Haemophilus influenzae Rd
cuuaaaauacccauaaaauu

SEQ ID NO: 686596 - RNA, 19 nt, Haemophilus influenzae Rd
cugcuuucuagaugaugaa

SEQ ID NO: 686597 - RNA, 15 nt, Haemophilus influenzae Rd
cugcuuuuucuugcu

SEQ ID NO: 686598 - RNA, 13 nt, Haemophilus influenzae Rd
cugcuuuuuucca

SEQ ID NO: 686599 - RNA, 17 nt, Haemophilus influenzae Rd
cugcuugguaauaauca

SEQ ID NO: 686600 - RNA, 18 nt, Haemophilus influenzae Rd
cugcuugguaauaaucaa

SEQ ID NO: 686601 - RNA, 15 nt, Haemophilus influenzae Rd
cugcuugcgcuugug

SEQ ID NO: 686602 - RNA, 19 nt, Haemophilus influenzae Rd
cugcuuuauuuggcauuug

SEQ ID NO: 686603 - RNA, 18 nt, Haemophilus influenzae Rd
cugcuuuaacaauuacug

SEQ ID NO: 686604 - RNA, 18 nt, Haemophilus influenzae Rd
cugcuuuagcuugauuga

SEQ ID NO: 686605 - RNA, 18 nt, Haemophilus influenzae Rd
cugcuuguaaccaauaaa

SEQ ID NO: 686606 - RNA, 15 nt, Haemophilus influenzae Rd
cugcuaguucuucaa

SEQ ID NO: 686607 - RNA, 21 nt, Haemophilus influenzae Rd
cugcucacgccgugauaacaa

SEQ ID NO: 686608 - RNA, 13 nt, Haemophilus influenzae Rd
cugcuucuuuauc

SEQ ID NO: 686609 - RNA, 16 nt, Haemophilus influenzae Rd
cugcuucuuuuaauaa

SEQ ID NO: 686610 - RNA, 21 nt, Haemophilus influenzae Rd
cuggaaucaaugaguggucgu

SEQ ID NO: 686611 - RNA, 22 nt, Haemophilus influenzae Rd
cuggaauauggaaaugcuuaau

SEQ ID NO: 686612 - RNA, 21 nt, Haemophilus influenzae Rd
cuggaaauuccacuuuuucau

SEQ ID NO: 686613 - RNA, 18 nt, Haemophilus influenzae Rd
cuggcacacguugcaccu

SEQ ID NO: 686614 - RNA, 18 nt, Haemophilus influenzae Rd
cuggauaaaugccgccac

SEQ ID NO: 686615 - RNA, 17 nt, Haemophilus influenzae Rd
cuguaguagauaacaac

SEQ ID NO: 686616 - RNA, 17 nt, Haemophilus influenzae Rd
cuguaauuucacuuccg

SEQ ID NO: 686617 - RNA, 23 nt, Haemophilus influenzae Rd
cuguaauugggcgcauaaccauu

SEQ ID NO: 686618 - RNA, 20 nt, Haemophilus influenzae Rd
cuguaaaaaaucuuuaagug

SEQ ID NO: 686619 - RNA, 14 nt, Haemophilus influenzae Rd
cugucaauuuuucu

SEQ ID NO: 686620 - RNA, 19 nt, Haemophilus influenzae Rd
cuguauuuuuuauuuaauu

SEQ ID NO: 686621 - RNA, 11 nt, Haemophilus influenzae Rd
cuguauuucgu

SEQ ID NO: 686622 - RNA, 23 nt, Haemophilus influenzae Rd
cuguauuagguaaauuugguuca

SEQ ID NO: 686623 - RNA, 17 nt, Haemophilus influenzae Rd
cugucacgagcuaaaaa

SEQ ID NO: 686624 - RNA, 14 nt, Haemophilus influenzae Rd
cugucgcuucuaau

SEQ ID NO: 686625 - RNA, 16 nt, Haemophilus influenzae Rd
cugucgcuucuaauuc

SEQ ID NO: 686626 - RNA, 17 nt, Haemophilus influenzae Rd
cuggugaaauuaauuua

SEQ ID NO: 686627 - RNA, 14 nt, Haemophilus influenzae Rd
cuggugagugagca

SEQ ID NO: 686628 - RNA, 22 nt, Haemophilus influenzae Rd
cuggugagugagcauuucguau

SEQ ID NO: 686629 - RNA, 15 nt, Haemophilus influenzae Rd
cuggcguagcugcag

SEQ ID NO: 686630 - RNA, 20 nt, Haemophilus influenzae Rd
cugccauaauaacgccaccc

SEQ ID NO: 686631 - RNA, 19 nt, Haemophilus influenzae Rd
cugcccauaagugagaaaa

SEQ ID NO: 686632 - RNA, 21 nt, Haemophilus influenzae Rd
cugcauaaagcucagccaaac

SEQ ID NO: 686633 - RNA, 19 nt, Haemophilus influenzae Rd
cugcauaacgauaacugaa

SEQ ID NO: 686634 - RNA, 21 nt, Haemophilus influenzae Rd
cugcaguuuuuuguuuuuccg

SEQ ID NO: 686635 - RNA, 15 nt, Haemophilus influenzae Rd
cugccacugcgcccg

SEQ ID NO: 686636 - RNA, 14 nt, Haemophilus influenzae Rd
cugccacuucuugc

SEQ ID NO: 686637 - RNA, 13 nt, Haemophilus influenzae Rd
cugccuaauaagc

SEQ ID NO: 686638 - RNA, 22 nt, Haemophilus influenzae Rd
cugcccgucaugccgcaaucaa

SEQ ID NO: 686639 - RNA, 13 nt, Haemophilus influenzae Rd
cugccgaauagau

SEQ ID NO: 686640 - RNA, 16 nt, Haemophilus influenzae Rd
cugcgggucuuguucc

SEQ ID NO: 686641 - RNA, 19 nt, Haemophilus influenzae Rd
cugcuaacucaucaacaaa

SEQ ID NO: 686642 - RNA, 16 nt, Haemophilus influenzae Rd
cugcuaauacugucac

SEQ ID NO: 686643 - RNA, 12 nt, Haemophilus influenzae Rd
cugccugauuuu

SEQ ID NO: 686644 - RNA, 16 nt, Haemophilus influenzae Rd
cugccucuguauuuuu

SEQ ID NO: 686645 - RNA, 18 nt, Haemophilus influenzae Rd
cugaucuugguagaaaau

SEQ ID NO: 686646 - RNA, 14 nt, Haemophilus influenzae Rd
cugauuguccaaag

SEQ ID NO: 686647 - RNA, 23 nt, Haemophilus influenzae Rd
cugauuagggugcagauuuuuuu

SEQ ID NO: 686648 - RNA, 15 nt, Haemophilus influenzae Rd
cugauuaaucaaaaa

SEQ ID NO: 686649 - RNA, 17 nt, Haemophilus influenzae Rd
cugauguuuaccgcaaa

SEQ ID NO: 686650 - RNA, 18 nt, Haemophilus influenzae Rd
cugcaaggauauuuccau

SEQ ID NO: 686651 - RNA, 17 nt, Haemophilus influenzae Rd
cugcaaagccuucaccu

SEQ ID NO: 686652 - RNA, 13 nt, Haemophilus influenzae Rd
cugauuuaaaaaa

SEQ ID NO: 686653 - RNA, 14 nt, Haemophilus influenzae Rd
cugauuuaaaaaaa

SEQ ID NO: 686654 - RNA, 15 nt, Haemophilus influenzae Rd
cugauuuaaaaaaac

SEQ ID NO: 686655 - RNA, 21 nt, Haemophilus influenzae Rd
cugauuuaccugaacguucac

SEQ ID NO: 686656 - RNA, 19 nt, Haemophilus influenzae Rd
cugauuuagguuucaauuu

SEQ ID NO: 686657 - RNA, 18 nt, Haemophilus influenzae Rd
cugauuuccuguaaaaaa

SEQ ID NO: 686658 - RNA, 20 nt, Haemophilus influenzae Rd
cugcagguaauacacuuuca

SEQ ID NO: 686659 - RNA, 21 nt, Haemophilus influenzae Rd
cugcagagaagaaauacaauc

SEQ ID NO: 686660 - RNA, 17 nt, Haemophilus influenzae Rd
cugcacgggaaauccag

SEQ ID NO: 686661 - RNA, 22 nt, Haemophilus influenzae Rd
cugcacuauauacauuaacaau

SEQ ID NO: 686662 - RNA, 22 nt, Haemophilus influenzae Rd
cugcaaugauaagauguuucac

SEQ ID NO: 686663 - RNA, 22 nt, Haemophilus influenzae Rd
cugcaauaauaucugcuuuuuc

SEQ ID NO: 686664 - RNA, 22 nt, Haemophilus influenzae Rd
cugcaagugcgguaaaauuuuu

SEQ ID NO: 686665 - RNA, 22 nt, Haemophilus influenzae Rd
cugcaauaucaaucccacuugu

SEQ ID NO: 686666 - RNA, 18 nt, Haemophilus influenzae Rd
cugcaauuuuacgagaaa

SEQ ID NO: 686667 - RNA, 20 nt, Haemophilus influenzae Rd
cucuauggcccgauauuuug

SEQ ID NO: 686668 - RNA, 20 nt, Haemophilus influenzae Rd
cucuauuugucggaaaauaa

SEQ ID NO: 686669 - RNA, 19 nt, Haemophilus influenzae Rd
cugagcuuuucuuguaaug

SEQ ID NO: 686670 - RNA, 14 nt, Haemophilus influenzae Rd
cugaguaaauaauu

SEQ ID NO: 686671 - RNA, 20 nt, Haemophilus influenzae Rd
cugagguuccccuaaaaaau

SEQ ID NO: 686672 - RNA, 21 nt, Haemophilus influenzae Rd
cugagguuccccuaaaaaaua

SEQ ID NO: 686673 - RNA, 22 nt, Haemophilus influenzae Rd
cugagguuccccuaaaaaauaa

SEQ ID NO: 686674 - RNA, 16 nt, Haemophilus influenzae Rd
cugaguauguuuugau

SEQ ID NO: 686675 - RNA, 17 nt, Haemophilus influenzae Rd
cugagguucaaaacuau

SEQ ID NO: 686676 - RNA, 16 nt, Haemophilus influenzae Rd
cugagugcaagccacg

SEQ ID NO: 686677 - RNA, 23 nt, Haemophilus influenzae Rd
cugaguccuuuuaguuuccccug

SEQ ID NO: 686678 - RNA, 15 nt, Haemophilus influenzae Rd
cugauaacucuaaag

SEQ ID NO: 686679 - RNA, 13 nt, Haemophilus influenzae Rd
cugauaaagauaa

SEQ ID NO: 686680 - RNA, 21 nt, Haemophilus influenzae Rd
cugauaaguagaaaaauuggu

SEQ ID NO: 686681 - RNA, 16 nt, Haemophilus influenzae Rd
cugauaaguucauaaa

SEQ ID NO: 686682 - RNA, 14 nt, Haemophilus influenzae Rd
cugauacugccaac

SEQ ID NO: 686683 - RNA, 20 nt, Haemophilus influenzae Rd
cugauccacgguauuuucuu

SEQ ID NO: 686684 - RNA, 14 nt, Haemophilus influenzae Rd
cugauccacuuaca

SEQ ID NO: 686685 - RNA, 17 nt, Haemophilus influenzae Rd
cugauccacuuacauua

SEQ ID NO: 686686 - RNA, 18 nt, Haemophilus influenzae Rd
cugauaugccaaggcucc

SEQ ID NO: 686687 - RNA, 18 nt, Haemophilus influenzae Rd
cugauaucccaucacuac

SEQ ID NO: 686688 - RNA, 13 nt, Haemophilus influenzae Rd
cugauauaguggc

SEQ ID NO: 686689 - RNA, 15 nt, Haemophilus influenzae Rd
cugauagguaauaau

SEQ ID NO: 686690 - RNA, 15 nt, Haemophilus influenzae Rd
cugaucaauuuaauc

SEQ ID NO: 686691 - RNA, 17 nt, Haemophilus influenzae Rd
cugaucaauuuaaucaa

SEQ ID NO: 686692 - RNA, 12 nt, Haemophilus influenzae Rd
cugauauuuaaa

SEQ ID NO: 686693 - RNA, 18 nt, Haemophilus influenzae Rd
cuccagcaaaagcaagau

SEQ ID NO: 686694 - RNA, 17 nt, Haemophilus influenzae Rd
cuccagacugcauugca

SEQ ID NO: 686695 - RNA, 17 nt, Haemophilus influenzae Rd
cuccauugcaauuucag

SEQ ID NO: 686696 - RNA, 19 nt, Haemophilus influenzae Rd
cuccauugcaauuucagcu

SEQ ID NO: 686697 - RNA, 19 nt, Haemophilus influenzae Rd
cucccacaugggcaucaua

SEQ ID NO: 686698 - RNA, 14 nt, Haemophilus influenzae Rd
cucccgccccacuu

SEQ ID NO: 686699 - RNA, 13 nt, Haemophilus influenzae Rd
cucccccauugaa

SEQ ID NO: 686700 - RNA, 16 nt, Haemophilus influenzae Rd
cucgacauaaaaacau

SEQ ID NO: 686701 - RNA, 16 nt, Haemophilus influenzae Rd
cuccugauauaguggc

SEQ ID NO: 686702 - RNA, 20 nt, Haemophilus influenzae Rd
cucgccaauagguugcaaau

SEQ ID NO: 686703 - RNA, 23 nt, Haemophilus influenzae Rd
cucgccaauagguugcaaaucga

SEQ ID NO: 686704 - RNA, 15 nt, Haemophilus influenzae Rd
cucgccaaaucucaa

SEQ ID NO: 686705 - RNA, 17 nt, Haemophilus influenzae Rd
cucgccaaaucucaaaa

SEQ ID NO: 686706 - RNA, 15 nt, Haemophilus influenzae Rd
cucgaguaucaaaac

SEQ ID NO: 686707 - RNA, 15 nt, Haemophilus influenzae Rd
cucgcucgccaagaa

SEQ ID NO: 686708 - RNA, 21 nt, Haemophilus influenzae Rd
cucggucgauggcugggauuu

SEQ ID NO: 686709 - RNA, 23 nt, Haemophilus influenzae Rd
cucguccgaccauuaaauccuga

SEQ ID NO: 686710 - RNA, 22 nt, Haemophilus influenzae Rd
cucguccgcauuuggugggcaa

SEQ ID NO: 686711 - RNA, 19 nt, Haemophilus influenzae Rd
cucgugauuaucuaaauuu

SEQ ID NO: 686712 - RNA, 15 nt, Haemophilus influenzae Rd
cucguaaaauauuaa

SEQ ID NO: 686713 - RNA, 12 nt, Haemophilus influenzae Rd
cucuaccaucua

SEQ ID NO: 686714 - RNA, 17 nt, Haemophilus influenzae Rd
cucuaccgacugagcua

SEQ ID NO: 686715 - RNA, 14 nt, Haemophilus influenzae Rd
cucuaaaucuaauu

SEQ ID NO: 686716 - RNA, 15 nt, Haemophilus influenzae Rd
cucuaaaucuaauuu

SEQ ID NO: 686717 - RNA, 21 nt, Haemophilus influenzae Rd
cucuaaaagcuguuuacuuuu

SEQ ID NO: 686718 - RNA, 16 nt, Haemophilus influenzae Rd
cucguuucauaugcca

SEQ ID NO: 686719 - RNA, 14 nt, Haemophilus influenzae Rd
cuaccuaauaaagc

SEQ ID NO: 686720 - RNA, 13 nt, Haemophilus influenzae Rd
cuaauaggcuuaa

SEQ ID NO: 686721 - RNA, 17 nt, Haemophilus influenzae Rd
cuaauagcgugaaaagc

SEQ ID NO: 686722 - RNA, 18 nt, Haemophilus influenzae Rd
cuaauacgucuaauuuag

SEQ ID NO: 686723 - RNA, 13 nt, Haemophilus influenzae Rd
cuaauacuucaua

SEQ ID NO: 686724 - RNA, 15 nt, Haemophilus influenzae Rd
cuaauagaacuguua

SEQ ID NO: 686725 - RNA, 23 nt, Haemophilus influenzae Rd
cuaauaccgcagcagguuuuccu

SEQ ID NO: 686726 - RNA, 13 nt, Haemophilus influenzae Rd
cuaauacacgagg

SEQ ID NO: 686727 - RNA, 13 nt, Haemophilus influenzae Rd
cuaauaauuuuag

SEQ ID NO: 686728 - RNA, 16 nt, Haemophilus influenzae Rd
cuacggacuaaauaaa

SEQ ID NO: 686729 - RNA, 17 nt, Haemophilus influenzae Rd
cuacggacuaaauaaau

SEQ ID NO: 686730 - RNA, 20 nt, Haemophilus influenzae Rd
cuacguaauuuaauuuauca

SEQ ID NO: 686731 - RNA, 21 nt, Haemophilus influenzae Rd
cuacguauugaacuaaaauau

SEQ ID NO: 686732 - RNA, 19 nt, Haemophilus influenzae Rd
cuacgccuaauucaucuuc

SEQ ID NO: 686733 - RNA, 23 nt, Haemophilus influenzae Rd
cuaccugcuguaacguuaaauga

SEQ ID NO: 686734 - RNA, 20 nt, Haemophilus influenzae Rd
cuacgaauugguucuaaaua

SEQ ID NO: 686735 - RNA, 22 nt, Haemophilus influenzae Rd
cuacgaauugguucuaaauauu

SEQ ID NO: 686736 - RNA, 18 nt, Haemophilus influenzae Rd
cuacgacauuuuuaacua

SEQ ID NO: 686737 - RNA, 13 nt, Haemophilus influenzae Rd
cuagaagaucaac

SEQ ID NO: 686738 - RNA, 21 nt, Haemophilus influenzae Rd
cuagaaauaucuaggcuaauu

SEQ ID NO: 686739 - RNA, 14 nt, Haemophilus influenzae Rd
cuagaaagcaaugu

SEQ ID NO: 686740 - RNA, 15 nt, Haemophilus influenzae Rd
cuagaacaaaaggcu

SEQ ID NO: 686741 - RNA, 17 nt, Haemophilus influenzae Rd
cuacguguucaucaucg

SEQ ID NO: 686742 - RNA, 18 nt, Haemophilus influenzae Rd
cuacuaucauccgcuugu

SEQ ID NO: 686743 - RNA, 16 nt, Haemophilus influenzae Rd
cuacuacgcuaacacu

SEQ ID NO: 686744 - RNA, 22 nt, Haemophilus influenzae Rd
cuagauaaugaugaaugcuuuu

SEQ ID NO: 686745 - RNA, 21 nt, Haemophilus influenzae Rd
cuagauauuguucuacugguu

SEQ ID NO: 686746 - RNA, 18 nt, Haemophilus influenzae Rd
cuagcaaucuuuggcaaa

SEQ ID NO: 686747 - RNA, 16 nt, Haemophilus influenzae Rd
cuagccuuauuuuguc

SEQ ID NO: 686748 - RNA, 20 nt, Haemophilus influenzae Rd
cuagccaguuaauuagugug

SEQ ID NO: 686749 - RNA, 15 nt, Haemophilus influenzae Rd
cuagccauaaauaaa

SEQ ID NO: 686750 - RNA, 15 nt, Haemophilus influenzae Rd
cuagcaucaaaauaa

SEQ ID NO: 686751 - RNA, 18 nt, Haemophilus influenzae Rd
cuagcaucaaaauaaaua

SEQ ID NO: 686752 - RNA, 20 nt, Haemophilus influenzae Rd
cuagcaucaaaauaaauaaa

SEQ ID NO: 686753 - RNA, 15 nt, Haemophilus influenzae Rd
cuagcaucgcauaac

SEQ ID NO: 686754 - RNA, 18 nt, Haemophilus influenzae Rd
cuauauccaaaucaaaaa

SEQ ID NO: 686755 - RNA, 14 nt, Haemophilus influenzae Rd
cuaucuuuugguaa

SEQ ID NO: 686756 - RNA, 20 nt, Haemophilus influenzae Rd
cuaugacguuuauuuacagu

SEQ ID NO: 686757 - RNA, 16 nt, Haemophilus influenzae Rd
cuaugaaaucaaggac

SEQ ID NO: 686758 - RNA, 23 nt, Haemophilus influenzae Rd
cuaugaauaagcgaaaaacauau

SEQ ID NO: 686759 - RNA, 19 nt, Haemophilus influenzae Rd
cuauggcccgauauuuugg

SEQ ID NO: 686760 - RNA, 17 nt, Haemophilus influenzae Rd
cuauaaaucguauaagc

SEQ ID NO: 686761 - RNA, 20 nt, Haemophilus influenzae Rd
cuagcgcuguuacuucuuuc

SEQ ID NO: 686762 - RNA, 18 nt, Haemophilus influenzae Rd
cuaggaaugaucugcacc

SEQ ID NO: 686763 - RNA, 19 nt, Haemophilus influenzae Rd
cuauaaaacaaauaagccc

SEQ ID NO: 686764 - RNA, 18 nt, Haemophilus influenzae Rd
cuauaauuuuagaacuua

SEQ ID NO: 686765 - RNA, 18 nt, Haemophilus influenzae Rd
cuauaccuaucuuauuaa

SEQ ID NO: 686766 - RNA, 19 nt, Haemophilus influenzae Rd
cuauagaauuauuuaaacu

SEQ ID NO: 686767 - RNA, 12 nt, Haemophilus influenzae Rd
cuauacuaauuu

SEQ ID NO: 686768 - RNA, 23 nt, Haemophilus influenzae Rd
cuauaacuaggcaucaaaauuca

SEQ ID NO: 686769 - RNA, 15 nt, Haemophilus influenzae Rd
cuauaauuaaacauu

SEQ ID NO: 686770 - RNA, 18 nt, Haemophilus influenzae Rd
cuauaauuucgccauuuu

SEQ ID NO: 686771 - RNA, 20 nt, Haemophilus influenzae Rd
cuauaauuucgccauuuuuu

SEQ ID NO: 686772 - RNA, 22 nt, Haemophilus influenzae Rd
cuauaauuucgccauuuuuucc

SEQ ID NO: 686773 - RNA, 20 nt, Haemophilus influenzae Rd
cucaaucucuuuacuguuca

SEQ ID NO: 686774 - RNA, 23 nt, Haemophilus influenzae Rd
cucaauccaaguauuuuguggaa

SEQ ID NO: 686775 - RNA, 20 nt, Haemophilus influenzae Rd
cucaagguugcccacaaaau

SEQ ID NO: 686776 - RNA, 23 nt, Haemophilus influenzae Rd
cucaaauaaauugcccucugcau

SEQ ID NO: 686777 - RNA, 18 nt, Haemophilus influenzae Rd
cucaacaucaaaaccauu

SEQ ID NO: 686778 - RNA, 14 nt, Haemophilus influenzae Rd
cucaccaaauuguu

SEQ ID NO: 686779 - RNA, 17 nt, Haemophilus influenzae Rd
cucacauugccauuuuu

SEQ ID NO: 686780 - RNA, 18 nt, Haemophilus influenzae Rd
cucacauugccauuuuuc

SEQ ID NO: 686781 - RNA, 12 nt, Haemophilus influenzae Rd
cucacauccauu

SEQ ID NO: 686782 - RNA, 17 nt, Haemophilus influenzae Rd
cucaauguuaaguucau

SEQ ID NO: 686783 - RNA, 14 nt, Haemophilus influenzae Rd
cucaauuaagcuaa

SEQ ID NO: 686784 - RNA, 19 nt, Haemophilus influenzae Rd
cucaauuccuucaucgucu

SEQ ID NO: 686785 - RNA, 23 nt, Haemophilus influenzae Rd
cucaauuccuucaucgucuucuu

SEQ ID NO: 686786 - RNA, 15 nt, Haemophilus influenzae Rd
cucaaugaauuaaaa

SEQ ID NO: 686787 - RNA, 16 nt, Haemophilus influenzae Rd
cucaaugaauuaaaag

SEQ ID NO: 686788 - RNA, 13 nt, Haemophilus influenzae Rd
cuauuuuuuccug

SEQ ID NO: 686789 - RNA, 23 nt, Haemophilus influenzae Rd
cuauuuuucgcuacgccuuggau

SEQ ID NO: 686790 - RNA, 11 nt, Haemophilus influenzae Rd
cuauuuuuaau

SEQ ID NO: 686791 - RNA, 13 nt, Haemophilus influenzae Rd
cuauuuuuaauuu

SEQ ID NO: 686792 - RNA, 19 nt, Haemophilus influenzae Rd
cuauuugucggaaaauaau

SEQ ID NO: 686793 - RNA, 17 nt, Haemophilus influenzae Rd
cuauuuuauaauuaaua

SEQ ID NO: 686794 - RNA, 14 nt, Haemophilus influenzae Rd
cuauuuuauuugcc

SEQ ID NO: 686795 - RNA, 21 nt, Haemophilus influenzae Rd
cuauuuuaucaagaacaguau

SEQ ID NO: 686796 - RNA, 15 nt, Haemophilus influenzae Rd
cuauuuaagccuuga

SEQ ID NO: 686797 - RNA, 18 nt, Haemophilus influenzae Rd
cuauuacaagauaaucag

SEQ ID NO: 686798 - RNA, 13 nt, Haemophilus influenzae Rd
cuauuacuuucca

SEQ ID NO: 686799 - RNA, 19 nt, Haemophilus influenzae Rd
cuauuaauuacuuuuauau

SEQ ID NO: 686800 - RNA, 18 nt, Haemophilus influenzae Rd
cuauuaauuuaauucuaa

SEQ ID NO: 686801 - RNA, 19 nt, Haemophilus influenzae Rd
cuauuaauuuaauucuaaa

SEQ ID NO: 686802 - RNA, 15 nt, Haemophilus influenzae Rd
cuauuaauuuuaaau

SEQ ID NO: 686803 - RNA, 15 nt, Haemophilus influenzae Rd
cuauuacccacuuca

SEQ ID NO: 686804 - RNA, 16 nt, Haemophilus influenzae Rd
cuauuacccacuucac

SEQ ID NO: 686805 - RNA, 19 nt, Haemophilus influenzae Rd
cuauuacccacuucacaca

SEQ ID NO: 686806 - RNA, 21 nt, Haemophilus influenzae Rd
cuauuucuuugaguaaaaaau

SEQ ID NO: 686807 - RNA, 14 nt, Haemophilus influenzae Rd
cuauuucaucuuua

SEQ ID NO: 686808 - RNA, 16 nt, Haemophilus influenzae Rd
cuauuuacguaaaaaa

SEQ ID NO: 686809 - RNA, 19 nt, Haemophilus influenzae Rd
cuauuuacuguuuuuauau

SEQ ID NO: 686810 - RNA, 22 nt, Haemophilus influenzae Rd
cuauuuauccccaauuaaggau

SEQ ID NO: 686811 - RNA, 22 nt, Haemophilus influenzae Rd
cucaggugugccaucacagucu

SEQ ID NO: 686812 - RNA, 14 nt, Haemophilus influenzae Rd
cucagguauuucuu

SEQ ID NO: 686813 - RNA, 14 nt, Haemophilus influenzae Rd
cucaucaacaaaau

SEQ ID NO: 686814 - RNA, 22 nt, Haemophilus influenzae Rd
cucaucgcgccaacgaaaucau

SEQ ID NO: 686815 - RNA, 18 nt, Haemophilus influenzae Rd
cucaucguaucaauuuua

SEQ ID NO: 686816 - RNA, 13 nt, Haemophilus influenzae Rd
cucagauaaugau

SEQ ID NO: 686817 - RNA, 12 nt, Haemophilus influenzae Rd
cucacuucuuua

SEQ ID NO: 686818 - RNA, 15 nt, Haemophilus influenzae Rd
cucaggaacaucacc

SEQ ID NO: 686819 - RNA, 15 nt, Haemophilus influenzae Rd
cucagcaauuuucuu

SEQ ID NO: 686820 - RNA, 11 nt, Haemophilus influenzae Rd
cucagcaagcu

SEQ ID NO: 686821 - RNA, 14 nt, Haemophilus influenzae Rd
cucagcaagcuggc

SEQ ID NO: 686822 - RNA, 15 nt, Haemophilus influenzae Rd
cgugcgauaaaauca

SEQ ID NO: 686823 - RNA, 15 nt, Haemophilus influenzae Rd
cgugcuguuuucaau

SEQ ID NO: 686824 - RNA, 13 nt, Haemophilus influenzae Rd
cgugcuuccauuu

SEQ ID NO: 686825 - RNA, 14 nt, Haemophilus influenzae Rd
cgugcugcagcuug

SEQ ID NO: 686826 - RNA, 17 nt, Haemophilus influenzae Rd
cgugggaauuuucccau

SEQ ID NO: 686827 - RNA, 19 nt, Haemophilus influenzae Rd
cguuacgaacuucagauac

SEQ ID NO: 686828 - RNA, 14 nt, Haemophilus influenzae Rd
cguuacuaaaaucc

SEQ ID NO: 686829 - RNA, 14 nt, Haemophilus influenzae Rd
cguuagauacuuua

SEQ ID NO: 686830 - RNA, 21 nt, Haemophilus influenzae Rd
cguuagauacuuuacguaaag

SEQ ID NO: 686831 - RNA, 12 nt, Haemophilus influenzae Rd
cguuauuuugau

SEQ ID NO: 686832 - RNA, 19 nt, Haemophilus influenzae Rd
cguuauuuuuuaagcuuua

SEQ ID NO: 686833 - RNA, 20 nt, Haemophilus influenzae Rd
cguucaaaaagaacggucaa

SEQ ID NO: 686834 - RNA, 22 nt, Haemophilus influenzae Rd
cguuauucaucacaacuugcaa

SEQ ID NO: 686835 - RNA, 17 nt, Haemophilus influenzae Rd
cguuauuaugaaauuug

SEQ ID NO: 686836 - RNA, 21 nt, Haemophilus influenzae Rd
cguucgcaaugaaauuuuuga

SEQ ID NO: 686837 - RNA, 16 nt, Haemophilus influenzae Rd
cguucacguuuuucau

SEQ ID NO: 686838 - RNA, 22 nt, Haemophilus influenzae Rd
cguguucuagugcaacaacaaa

SEQ ID NO: 686839 - RNA, 15 nt, Haemophilus influenzae Rd
cguguguuuguaaac

SEQ ID NO: 686840 - RNA, 13 nt, Haemophilus influenzae Rd
cguguucaaccac

SEQ ID NO: 686841 - RNA, 12 nt, Haemophilus influenzae Rd
cguguucaucau

SEQ ID NO: 686842 - RNA, 17 nt, Haemophilus influenzae Rd
cguuaaaucaaaaccaa

SEQ ID NO: 686843 - RNA, 20 nt, Haemophilus influenzae Rd
cguuaaaucaaaaccaauca

SEQ ID NO: 686844 - RNA, 14 nt, Haemophilus influenzae Rd
cguuacauuauuua

SEQ ID NO: 686845 - RNA, 21 nt, Haemophilus influenzae Rd
cgugugcgauucaucacuucu

SEQ ID NO: 686846 - RNA, 11 nt, Haemophilus influenzae Rd
cgugugcaccc

SEQ ID NO: 686847 - RNA, 17 nt, Haemophilus influenzae Rd
cgugucaguaacuacaa

SEQ ID NO: 686848 - RNA, 14 nt, Haemophilus influenzae Rd
cgugugaaauuccu

SEQ ID NO: 686849 - RNA, 15 nt, Haemophilus influenzae Rd
cgugguucaaaacca

SEQ ID NO: 686850 - RNA, 23 nt, Haemophilus influenzae Rd
cgugucaaauuaauuaaucaaua

SEQ ID NO: 686851 - RNA, 18 nt, Haemophilus influenzae Rd
cguguaaucgccuugugc

SEQ ID NO: 686852 - RNA, 21 nt, Haemophilus influenzae Rd
cuaaagauuuauguugaauuu

SEQ ID NO: 686853 - RNA, 13 nt, Haemophilus influenzae Rd
cuaaagauggacg

SEQ ID NO: 686854 - RNA, 14 nt, Haemophilus influenzae Rd
cuaaaccuucccca

SEQ ID NO: 686855 - RNA, 19 nt, Haemophilus influenzae Rd
cuaaacuuguuaaauaaac

SEQ ID NO: 686856 - RNA, 17 nt, Haemophilus influenzae Rd
cuaaacuuuagagauuu

SEQ ID NO: 686857 - RNA, 15 nt, Haemophilus influenzae Rd
cuaaacgaagaaaaa

SEQ ID NO: 686858 - RNA, 20 nt, Haemophilus influenzae Rd
cuaaaugugacauuguaaag

SEQ ID NO: 686859 - RNA, 23 nt, Haemophilus influenzae Rd
cuaaauuaauuaggacaauauuu

SEQ ID NO: 686860 - RNA, 15 nt, Haemophilus influenzae Rd
cuaaauuaauuuacu

SEQ ID NO: 686861 - RNA, 19 nt, Haemophilus influenzae Rd
cuaaauuaucguuuacuua

SEQ ID NO: 686862 - RNA, 19 nt, Haemophilus influenzae Rd
cuaaauuauggguguuuaa

SEQ ID NO: 686863 - RNA, 16 nt, Haemophilus influenzae Rd
cuaaauuauuugauuu

SEQ ID NO: 686864 - RNA, 13 nt, Haemophilus influenzae Rd
cuaaauucaauuu

SEQ ID NO: 686865 - RNA, 21 nt, Haemophilus influenzae Rd
cuaaauucaguaagaaaccaa

SEQ ID NO: 686866 - RNA, 22 nt, Haemophilus influenzae Rd
cuaaaucugguggagaaauguc

SEQ ID NO: 686867 - RNA, 17 nt, Haemophilus influenzae Rd
cuaaaucuguuucauuu

SEQ ID NO: 686868 - RNA, 19 nt, Haemophilus influenzae Rd
cuaaaucuguuucauuugu

SEQ ID NO: 686869 - RNA, 19 nt, Haemophilus influenzae Rd
cuaaaucuuaugaaacagc

SEQ ID NO: 686870 - RNA, 18 nt, Haemophilus influenzae Rd
cuaaaucuucuuuaccaa

SEQ ID NO: 686871 - RNA, 11 nt, Haemophilus influenzae Rd
cuaaaugaaua

SEQ ID NO: 686872 - RNA, 12 nt, Haemophilus influenzae Rd
cuaaauggcaaa

SEQ ID NO: 686873 - RNA, 15 nt, Haemophilus influenzae Rd
cuaacaauauuucac

SEQ ID NO: 686874 - RNA, 18 nt, Haemophilus influenzae Rd
cuaacacgcgcugcucug

SEQ ID NO: 686875 - RNA, 15 nt, Haemophilus influenzae Rd
cuaacacugccaaug

SEQ ID NO: 686876 - RNA, 13 nt, Haemophilus influenzae Rd
cuaacacaauaac

SEQ ID NO: 686877 - RNA, 21 nt, Haemophilus influenzae Rd
cuaacauaaugcgauguaauu

SEQ ID NO: 686878 - RNA, 16 nt, Haemophilus influenzae Rd
cuaacauaauuguguu

SEQ ID NO: 686879 - RNA, 16 nt, Haemophilus influenzae Rd
cuaacagggcauaaau

SEQ ID NO: 686880 - RNA, 20 nt, Haemophilus influenzae Rd
cuaacauugcaucagccacc

SEQ ID NO: 686881 - RNA, 14 nt, Haemophilus influenzae Rd
cuaaauucuuuugc

SEQ ID NO: 686882 - RNA, 19 nt, Haemophilus influenzae Rd
cuaaauugaccgcacuugu

SEQ ID NO: 686883 - RNA, 13 nt, Haemophilus influenzae Rd
cuaaauuucccau

SEQ ID NO: 686884 - RNA, 15 nt, Haemophilus influenzae Rd
cuaaauuucccauuu

SEQ ID NO: 686885 - RNA, 18 nt, Haemophilus influenzae Rd
cuaaauuucccauuuguc

SEQ ID NO: 686886 - RNA, 17 nt, Haemophilus influenzae Rd
cuaaauuugacuucuug

SEQ ID NO: 686887 - RNA, 18 nt, Haemophilus influenzae Rd
cuaacaauaauuugccaa

SEQ ID NO: 686888 - RNA, 15 nt, Haemophilus influenzae Rd
cuaacaauagaauug

SEQ ID NO: 686889 - RNA, 20 nt, Haemophilus influenzae Rd
cuaaauuuuuggcugcugca

SEQ ID NO: 686890 - RNA, 22 nt, Haemophilus influenzae Rd
cuaaauuuuuuugcauuuugga

SEQ ID NO: 686891 - RNA, 11 nt, Haemophilus influenzae Rd
cuaaauuuuag

SEQ ID NO: 686892 - RNA, 15 nt, Haemophilus influenzae Rd
cuaacaaauuuaaua

SEQ ID NO: 686893 - RNA, 17 nt, Haemophilus influenzae Rd
cuaacaaauuuaauauu

SEQ ID NO: 686894 - RNA, 21 nt, Haemophilus influenzae Rd
cuaacaaauuuaauauuucuu

SEQ ID NO: 686895 - RNA, 11 nt, Haemophilus influenzae Rd
cuaagccuugu

SEQ ID NO: 686896 - RNA, 14 nt, Haemophilus influenzae Rd
cuaagcauuucagu

SEQ ID NO: 686897 - RNA, 14 nt, Haemophilus influenzae Rd
cuaagccaaaucca

SEQ ID NO: 686898 - RNA, 18 nt, Haemophilus influenzae Rd
cuaagaaaauagaagcca

SEQ ID NO: 686899 - RNA, 23 nt, Haemophilus influenzae Rd
cuaagaaaauagaagccaaauca

SEQ ID NO: 686900 - RNA, 16 nt, Haemophilus influenzae Rd
cuaacuuuucuucaau

SEQ ID NO: 686901 - RNA, 14 nt, Haemophilus influenzae Rd
cuaaguagggcuau

SEQ ID NO: 686902 - RNA, 19 nt, Haemophilus influenzae Rd
cuaaguaagucgcaucaac

SEQ ID NO: 686903 - RNA, 17 nt, Haemophilus influenzae Rd
cuaaguacaaaagagcg

SEQ ID NO: 686904 - RNA, 21 nt, Haemophilus influenzae Rd
cuaaguauuaagccaaaaccu

SEQ ID NO: 686905 - RNA, 17 nt, Haemophilus influenzae Rd
cuaagcuuaauauguuc

SEQ ID NO: 686906 - RNA, 13 nt, Haemophilus influenzae Rd
cuaaguucuaaaa

SEQ ID NO: 686907 - RNA, 15 nt, Haemophilus influenzae Rd
cuaaguucuaaaauu

SEQ ID NO: 686908 - RNA, 16 nt, Haemophilus influenzae Rd
cuaaguucuauaauuu

SEQ ID NO: 686909 - RNA, 19 nt, Haemophilus influenzae Rd
cuaaguucuauaauuuuag

SEQ ID NO: 686910 - RNA, 20 nt, Haemophilus influenzae Rd
cuaaguucuauaauuuuaga

SEQ ID NO: 686911 - RNA, 15 nt, Haemophilus influenzae Rd
cuaaguuuuggucaa

SEQ ID NO: 686912 - RNA, 16 nt, Haemophilus influenzae Rd
cuaacauuuuuuuuau

SEQ ID NO: 686913 - RNA, 21 nt, Haemophilus influenzae Rd
cuaaccgcacucuuucaaaaa

SEQ ID NO: 686914 - RNA, 23 nt, Haemophilus influenzae Rd
cuaaccccuuuucugacauuucg

SEQ ID NO: 686915 - RNA, 16 nt, Haemophilus influenzae Rd
cuaaccgcacuuuuua

SEQ ID NO: 686916 - RNA, 20 nt, Haemophilus influenzae Rd
cuaaccgcacuuuuuaauaa

SEQ ID NO: 686917 - RNA, 16 nt, Haemophilus influenzae Rd
cuaaccgcacuuuuuc

SEQ ID NO: 686918 - RNA, 18 nt, Haemophilus influenzae Rd
cuaacggaucaacauaac

SEQ ID NO: 686919 - RNA, 15 nt, Haemophilus influenzae Rd
cuaacuucuuccacu

SEQ ID NO: 686920 - RNA, 20 nt, Haemophilus influenzae Rd
cuaacgccauuggauacaua

SEQ ID NO: 686921 - RNA, 17 nt, Haemophilus influenzae Rd
cuaacgcuuuuaaacgu

SEQ ID NO: 686922 - RNA, 22 nt, Haemophilus influenzae Rd
cguuugccgaagccuaaaucuu

SEQ ID NO: 686923 - RNA, 16 nt, Haemophilus influenzae Rd
cguuucccgcuccaau

SEQ ID NO: 686924 - RNA, 22 nt, Haemophilus influenzae Rd
cguuuuuuuaucauagagccaa

SEQ ID NO: 686925 - RNA, 21 nt, Haemophilus influenzae Rd
cguuuuuuucacggcauagua

SEQ ID NO: 686926 - RNA, 12 nt, Haemophilus influenzae Rd
cuaaaaaaacua

SEQ ID NO: 686927 - RNA, 23 nt, Haemophilus influenzae Rd
cuaaaaaaauaaccgcacuuuau

SEQ ID NO: 686928 - RNA, 20 nt, Haemophilus influenzae Rd
cuaaaaaaauccuaaauaaa

SEQ ID NO: 686929 - RNA, 19 nt, Haemophilus influenzae Rd
cuaaaaaagaguaaauauu

SEQ ID NO: 686930 - RNA, 22 nt, Haemophilus influenzae Rd
cuaaaaaagaguaaauauuguc

SEQ ID NO: 686931 - RNA, 23 nt, Haemophilus influenzae Rd
cuaaaaaacccgcuuuuaacaaa

SEQ ID NO: 686932 - RNA, 16 nt, Haemophilus influenzae Rd
cuaaaaaaccuuggga

SEQ ID NO: 686933 - RNA, 12 nt, Haemophilus influenzae Rd
cuaaaaaacuaa

SEQ ID NO: 686934 - RNA, 16 nt, Haemophilus influenzae Rd
cguuuuuuauuuugug

SEQ ID NO: 686935 - RNA, 22 nt, Haemophilus influenzae Rd
cguuuuugucguucuuuuucca

SEQ ID NO: 686936 - RNA, 19 nt, Haemophilus influenzae Rd
cuaaaacuuaguuuuaauu

SEQ ID NO: 686937 - RNA, 24 nt, Haemophilus influenzae Rd
cuaaaacuuaguuuuaauucugca

SEQ ID NO: 686938 - RNA, 19 nt, Haemophilus influenzae Rd
cuaaaagcggcgcaucaau

SEQ ID NO: 686939 - RNA, 18 nt, Haemophilus influenzae Rd
cuaaaccaccaauaagcc

SEQ ID NO: 686940 - RNA, 22 nt, Haemophilus influenzae Rd
cuaaaccauuuaauaaaacaaa

SEQ ID NO: 686941 - RNA, 20 nt, Haemophilus influenzae Rd
cuaaaccgauagcuuuuguu

SEQ ID NO: 686942 - RNA, 17 nt, Haemophilus influenzae Rd
cuaaaccugcuucuuuu

SEQ ID NO: 686943 - RNA, 20 nt, Haemophilus influenzae Rd
cuaaaaccacaucauuuuuu

SEQ ID NO: 686944 - RNA, 12 nt, Haemophilus influenzae Rd
cuaaaaaugccc

SEQ ID NO: 686945 - RNA, 21 nt, Haemophilus influenzae Rd
cuaaaaauugcugcaacuaac

SEQ ID NO: 686946 - RNA, 15 nt, Haemophilus influenzae Rd
cuaaaaauuuaaaua

SEQ ID NO: 686947 - RNA, 18 nt, Haemophilus influenzae Rd
cuaaaacacguuugccag

SEQ ID NO: 686948 - RNA, 22 nt, Haemophilus influenzae Rd
cuaaaaaacuaacgugcuguuu

SEQ ID NO: 686949 - RNA, 17 nt, Haemophilus influenzae Rd
cuaaaaauaauuuuacu

SEQ ID NO: 686950 - RNA, 14 nt, Haemophilus influenzae Rd
cuaaaaauccugaa

SEQ ID NO: 686951 - RNA, 20 nt, Haemophilus influenzae Rd
cuaaaaauccugaagauuuu

SEQ ID NO: 686952 - RNA, 22 nt, Haemophilus influenzae Rd
cuaaaaagcccaaaugcaacaa

SEQ ID NO: 686953 - RNA, 21 nt, Haemophilus influenzae Rd
cuaaaaagauuugauuuuuau

SEQ ID NO: 686954 - RNA, 16 nt, Haemophilus influenzae Rd
cuaaaaagaaauaaaa

SEQ ID NO: 686955 - RNA, 19 nt, Haemophilus influenzae Rd
cguucuuggaaaucuuggc

SEQ ID NO: 686956 - RNA, 21 nt, Haemophilus influenzae Rd
cguucuugaugauaaucuucc

SEQ ID NO: 686957 - RNA, 22 nt, Haemophilus influenzae Rd
cguucuuuuaaugcuucugccg

SEQ ID NO: 686958 - RNA, 12 nt, Haemophilus influenzae Rd
cguucuuuuucc

SEQ ID NO: 686959 - RNA, 20 nt, Haemophilus influenzae Rd
cguuuaacugcuuuuuucca

SEQ ID NO: 686960 - RNA, 13 nt, Haemophilus influenzae Rd
cguuuaacuucaa

SEQ ID NO: 686961 - RNA, 21 nt, Haemophilus influenzae Rd
cguuuaaccacguauuuuuua

SEQ ID NO: 686962 - RNA, 21 nt, Haemophilus influenzae Rd
cguuggucugcccaugcuuug

SEQ ID NO: 686963 - RNA, 17 nt, Haemophilus influenzae Rd
cguuguacgccacauac

SEQ ID NO: 686964 - RNA, 19 nt, Haemophilus influenzae Rd
cguuguucuucuguuaaac

SEQ ID NO: 686965 - RNA, 19 nt, Haemophilus influenzae Rd
cguuggguuugauuuauac

SEQ ID NO: 686966 - RNA, 22 nt, Haemophilus influenzae Rd
cguugguaaagccaacuuuuuc

SEQ ID NO: 686967 - RNA, 17 nt, Haemophilus influenzae Rd
cguccaguuauaauaac

SEQ ID NO: 686968 - RNA, 14 nt, Haemophilus influenzae Rd
cguccauucuguaa

SEQ ID NO: 686969 - RNA, 15 nt, Haemophilus influenzae Rd
cguccgaccauuaaa

SEQ ID NO: 686970 - RNA, 16 nt, Haemophilus influenzae Rd
cguccgcaaccagcag

SEQ ID NO: 686971 - RNA, 16 nt, Haemophilus influenzae Rd
cguccuacuacagccc

SEQ ID NO: 686972 - RNA, 17 nt, Haemophilus influenzae Rd
cgucgcagccuuguucu

SEQ ID NO: 686973 - RNA, 18 nt, Haemophilus influenzae Rd
cgucgcagccuuguucug

SEQ ID NO: 686974 - RNA, 22 nt, Haemophilus influenzae Rd
cgucgcagccuuguucugcagc

SEQ ID NO: 686975 - RNA, 16 nt, Haemophilus influenzae Rd
cgucuaaaucuuucca

SEQ ID NO: 686976 - RNA, 18 nt, Haemophilus influenzae Rd
cgucuaaucgccaaucua

SEQ ID NO: 686977 - RNA, 16 nt, Haemophilus influenzae Rd
cgucuugccauaguac

SEQ ID NO: 686978 - RNA, 18 nt, Haemophilus influenzae Rd
cgugaaauuagacaaaaa

SEQ ID NO: 686979 - RNA, 20 nt, Haemophilus influenzae Rd
cgugaaauuagacaaaaaug

SEQ ID NO: 686980 - RNA, 15 nt, Haemophilus influenzae Rd
cgugaauguccauuu

SEQ ID NO: 686981 - RNA, 17 nt, Haemophilus influenzae Rd
cgugaauacgaucugca

SEQ ID NO: 686982 - RNA, 21 nt, Haemophilus influenzae Rd
cgugauaaugccucuuuaaca

SEQ ID NO: 686983 - RNA, 14 nt, Haemophilus influenzae Rd
cgugaguaaaauau

SEQ ID NO: 686984 - RNA, 14 nt, Haemophilus influenzae Rd
cgugaucugcauca

SEQ ID NO: 686985 - RNA, 15 nt, Haemophilus influenzae Rd
cgugauuaucuaaau

SEQ ID NO: 686986 - RNA, 13 nt, Haemophilus influenzae Rd
cgugcaaauaaau

SEQ ID NO: 686987 - RNA, 14 nt, Haemophilus influenzae Rd
cgugcaauagaugu

SEQ ID NO: 686988 - RNA, 12 nt, Haemophilus influenzae Rd
cgugcagacuag

SEQ ID NO: 686989 - RNA, 18 nt, Haemophilus influenzae Rd
cgcguaauaaauaagggc

SEQ ID NO: 686990 - RNA, 21 nt, Haemophilus influenzae Rd
cgcugaaaugaaguaauaauc

SEQ ID NO: 686991 - RNA, 12 nt, Haemophilus influenzae Rd
cgcugcaacaaa

SEQ ID NO: 686992 - RNA, 20 nt, Haemophilus influenzae Rd
cgcugcaacaaauaaaucau

SEQ ID NO: 686993 - RNA, 13 nt, Haemophilus influenzae Rd
cgcugcaaaauca

SEQ ID NO: 686994 - RNA, 14 nt, Haemophilus influenzae Rd
cgcugcaaaaugaa

SEQ ID NO: 686995 - RNA, 17 nt, Haemophilus influenzae Rd
cgcugcaaaaugaacag

SEQ ID NO: 686996 - RNA, 13 nt, Haemophilus influenzae Rd
cgcugcagcuuca

SEQ ID NO: 686997 - RNA, 16 nt, Haemophilus influenzae Rd
cgcuccucugcauucu

SEQ ID NO: 686998 - RNA, 15 nt, Haemophilus influenzae Rd
cgcucaucguaucaa

SEQ ID NO: 686999 - RNA, 13 nt, Haemophilus influenzae Rd
cgcuuugagaaag

SEQ ID NO: 687000 - RNA, 18 nt, Haemophilus influenzae Rd
cgcuuugagaaagaauau

SEQ ID NO: 687001 - RNA, 22 nt, Haemophilus influenzae Rd
cgcuuggucacugguucaaguc

SEQ ID NO: 687002 - RNA, 16 nt, Haemophilus influenzae Rd
cgcuugaauaaauccc

SEQ ID NO: 687003 - RNA, 20 nt, Haemophilus influenzae Rd
cgcuucuuccuguuuaucag

SEQ ID NO: 687004 - RNA, 13 nt, Haemophilus influenzae Rd
cgcuucuuuaacu

SEQ ID NO: 687005 - RNA, 19 nt, Haemophilus influenzae Rd
cggcacgguuucugccgcg

SEQ ID NO: 687006 - RNA, 19 nt, Haemophilus influenzae Rd
cggcaagcaaacagcaaua

SEQ ID NO: 687007 - RNA, 24 nt, Haemophilus influenzae Rd
cggcaauccacgccccaacauagc

SEQ ID NO: 687008 - RNA, 15 nt, Haemophilus influenzae Rd
cggccacuaauaagg

SEQ ID NO: 687009 - RNA, 18 nt, Haemophilus influenzae Rd
cggccaauacuggcugaa

SEQ ID NO: 687010 - RNA, 13 nt, Haemophilus influenzae Rd
cggcgcguaaauc

SEQ ID NO: 687011 - RNA, 18 nt, Haemophilus influenzae Rd
cggcgaagagauucuaau

SEQ ID NO: 687012 - RNA, 14 nt, Haemophilus influenzae Rd
cggcgaauguggcu

SEQ ID NO: 687013 - RNA, 12 nt, Haemophilus influenzae Rd
cgggcaaaaacu

SEQ ID NO: 687014 - RNA, 20 nt, Haemophilus influenzae Rd
cgggauaacuuucaguuaaa

SEQ ID NO: 687015 - RNA, 16 nt, Haemophilus influenzae Rd
cgggauaccagccuga

SEQ ID NO: 687016 - RNA, 13 nt, Haemophilus influenzae Rd
cggcugcuugcac

SEQ ID NO: 687017 - RNA, 18 nt, Haemophilus influenzae Rd
cggcuuggaguagugcau

SEQ ID NO: 687018 - RNA, 14 nt, Haemophilus influenzae Rd
cgguaaauuuuuag

SEQ ID NO: 687019 - RNA, 20 nt, Haemophilus influenzae Rd
cgguaaaucugauucagaaa

SEQ ID NO: 687020 - RNA, 15 nt, Haemophilus influenzae Rd
cgguaagaaaaucaa

SEQ ID NO: 687021 - RNA, 21 nt, Haemophilus influenzae Rd
cgguaaguacgauaaacacug

SEQ ID NO: 687022 - RNA, 16 nt, Haemophilus influenzae Rd
cgguauaaaccuugca

SEQ ID NO: 687023 - RNA, 15 nt, Haemophilus influenzae Rd
cgguauuuuuauuua

SEQ ID NO: 687024 - RNA, 17 nt, Haemophilus influenzae Rd
cgguauuuuuuuauuua

SEQ ID NO: 687025 - RNA, 23 nt, Haemophilus influenzae Rd
cgguagauuuucaucguuaauua

SEQ ID NO: 687026 - RNA, 21 nt, Haemophilus influenzae Rd
cgggcugaaauaccuucuuga

SEQ ID NO: 687027 - RNA, 14 nt, Haemophilus influenzae Rd
cguaaguaguaaag

SEQ ID NO: 687028 - RNA, 14 nt, Haemophilus influenzae Rd
cguaauaaauaaaa

SEQ ID NO: 687029 - RNA, 13 nt, Haemophilus influenzae Rd
cguaauaaauaag

SEQ ID NO: 687030 - RNA, 22 nt, Haemophilus influenzae Rd
cguaauaacauucaguuuuuaa

SEQ ID NO: 687031 - RNA, 17 nt, Haemophilus influenzae Rd
cguaauaccaaaauugc

SEQ ID NO: 687032 - RNA, 22 nt, Haemophilus influenzae Rd
cguaagaucagauuuuuuucag

SEQ ID NO: 687033 - RNA, 15 nt, Haemophilus influenzae Rd
cguaaaguaaaugcu

SEQ ID NO: 687034 - RNA, 17 nt, Haemophilus influenzae Rd
cguaaauccugcuucuu

SEQ ID NO: 687035 - RNA, 10 nt, Haemophilus influenzae Rd
cguaaaguuu

SEQ ID NO: 687036 - RNA, 21 nt, Haemophilus influenzae Rd
cguaaauucuguuuagucuuc

SEQ ID NO: 687037 - RNA, 15 nt, Haemophilus influenzae Rd
cguaaauuauuuauu

SEQ ID NO: 687038 - RNA, 14 nt, Haemophilus influenzae Rd
cgguugauuuuccu

SEQ ID NO: 687039 - RNA, 19 nt, Haemophilus influenzae Rd
cguaaaaaugcuguuucua

SEQ ID NO: 687040 - RNA, 12 nt, Haemophilus influenzae Rd
cguaaaaauucg

SEQ ID NO: 687041 - RNA, 15 nt, Haemophilus influenzae Rd
cgguuuuuuuauuau

SEQ ID NO: 687042 - RNA, 15 nt, Haemophilus influenzae Rd
cgguugaauuuuuuu

SEQ ID NO: 687043 - RNA, 16 nt, Haemophilus influenzae Rd
cgguucgccugauuuc

SEQ ID NO: 687044 - RNA, 16 nt, Haemophilus influenzae Rd
cguaauguuuaaagua

SEQ ID NO: 687045 - RNA, 13 nt, Haemophilus influenzae Rd
cguaauuaaaaau

SEQ ID NO: 687046 - RNA, 17 nt, Haemophilus influenzae Rd
cguaauuaaaaauaacc

SEQ ID NO: 687047 - RNA, 16 nt, Haemophilus influenzae Rd
cguaaugcuuuauuua

SEQ ID NO: 687048 - RNA, 20 nt, Haemophilus influenzae Rd
cguaauggaauauggcggcu

SEQ ID NO: 687049 - RNA, 19 nt, Haemophilus influenzae Rd
cguaaucuggcaaaucuuu

SEQ ID NO: 687050 - RNA, 14 nt, Haemophilus influenzae Rd
cguaauauucuuua

SEQ ID NO: 687051 - RNA, 16 nt, Haemophilus influenzae Rd
cguaauauuuaccgcu

SEQ ID NO: 687052 - RNA, 22 nt, Haemophilus influenzae Rd
cguaauauuugacgaaauaaau

SEQ ID NO: 687053 - RNA, 23 nt, Haemophilus influenzae Rd
cguacaacgugaaguaaauauuu

SEQ ID NO: 687054 - RNA, 18 nt, Haemophilus influenzae Rd
cguacacgcgcaaauuuu

SEQ ID NO: 687055 - RNA, 13 nt, Haemophilus influenzae Rd
cguaauuucaaau

SEQ ID NO: 687056 - RNA, 20 nt, Haemophilus influenzae Rd
cguaauuucaucuuuuaaau

SEQ ID NO: 687057 - RNA, 23 nt, Haemophilus influenzae Rd
cguaauuuuaaaaccacaauaaa

SEQ ID NO: 687058 - RNA, 15 nt, Haemophilus influenzae Rd
cguacaaacccacaa

SEQ ID NO: 687059 - RNA, 16 nt, Haemophilus influenzae Rd
cguaccaaauuccauu

SEQ ID NO: 687060 - RNA, 16 nt, Haemophilus influenzae Rd
cggucagcauaaagag

SEQ ID NO: 687061 - RNA, 18 nt, Haemophilus influenzae Rd
cggucagcauaaagagaa

SEQ ID NO: 687062 - RNA, 15 nt, Haemophilus influenzae Rd
cggugguucgauucc

SEQ ID NO: 687063 - RNA, 20 nt, Haemophilus influenzae Rd
cgguguuuuuuuucuuuaaa

SEQ ID NO: 687064 - RNA, 18 nt, Haemophilus influenzae Rd
cgguuaaaaaagaaauau

SEQ ID NO: 687065 - RNA, 22 nt, Haemophilus influenzae Rd
cgguuaaaaaagaaauauuuuu

SEQ ID NO: 687066 - RNA, 20 nt, Haemophilus influenzae Rd
ccccugguguuauuggaaaa

SEQ ID NO: 687067 - RNA, 16 nt, Haemophilus influenzae Rd
ccccuuaauuauuuua

SEQ ID NO: 687068 - RNA, 19 nt, Haemophilus influenzae Rd
ccccuucaaauauaacgac

SEQ ID NO: 687069 - RNA, 17 nt, Haemophilus influenzae Rd
cccugaaagucgauuca

SEQ ID NO: 687070 - RNA, 16 nt, Haemophilus influenzae Rd
cccugaagcaacaauc

SEQ ID NO: 687071 - RNA, 23 nt, Haemophilus influenzae Rd
ccgaaaaugguuacguuuuucca

SEQ ID NO: 687072 - RNA, 13 nt, Haemophilus influenzae Rd
cccuuaauuauuu

SEQ ID NO: 687073 - RNA, 22 nt, Haemophilus influenzae Rd
cccuguuuuaagguuuuuuccg

SEQ ID NO: 687074 - RNA, 17 nt, Haemophilus influenzae Rd
cccuuaauacugcugaa

SEQ ID NO: 687075 - RNA, 20 nt, Haemophilus influenzae Rd
ccgacuuugucaauauaaag

SEQ ID NO: 687076 - RNA, 19 nt, Haemophilus influenzae Rd
ccgagcucuuucauuaaau

SEQ ID NO: 687077 - RNA, 16 nt, Haemophilus influenzae Rd
ccgauaaaugcacauu

SEQ ID NO: 687078 - RNA, 21 nt, Haemophilus influenzae Rd
ccgauaaaugcacauuuuuac

SEQ ID NO: 687079 - RNA, 18 nt, Haemophilus influenzae Rd
ccgauaaaaccuaaaauu

SEQ ID NO: 687080 - RNA, 21 nt, Haemophilus influenzae Rd
ccgauauguuuuuuacgaagu

SEQ ID NO: 687081 - RNA, 21 nt, Haemophilus influenzae Rd
ccgcagcuaauccaaaucaag

SEQ ID NO: 687082 - RNA, 23 nt, Haemophilus influenzae Rd
ccgcagcuaauccaaaucaagcu

SEQ ID NO: 687083 - RNA, 20 nt, Haemophilus influenzae Rd
ccgcacuuuaaacuguugcc

SEQ ID NO: 687084 - RNA, 22 nt, Haemophilus influenzae Rd
ccgcacuuuaaauauuuaaaaa

SEQ ID NO: 687085 - RNA, 17 nt, Haemophilus influenzae Rd
ccgcacuuuccccccuu

SEQ ID NO: 687086 - RNA, 23 nt, Haemophilus influenzae Rd
ccgcacuuucgccgaguaaauuc

SEQ ID NO: 687087 - RNA, 22 nt, Haemophilus influenzae Rd
ccgcacuuuggaauauucuuuu

SEQ ID NO: 687088 - RNA, 13 nt, Haemophilus influenzae Rd
ccgauuaauucaa

SEQ ID NO: 687089 - RNA, 20 nt, Haemophilus influenzae Rd
ccgcaacuaauaaaccaaua

SEQ ID NO: 687090 - RNA, 18 nt, Haemophilus influenzae Rd
ccgcaaccguggcaaccg

SEQ ID NO: 687091 - RNA, 17 nt, Haemophilus influenzae Rd
ccgauuucuuuacaaau

SEQ ID NO: 687092 - RNA, 21 nt, Haemophilus influenzae Rd
ccgauuuuaauugugcaauuu

SEQ ID NO: 687093 - RNA, 17 nt, Haemophilus influenzae Rd
ccgauuuuacgauuucu

SEQ ID NO: 687094 - RNA, 18 nt, Haemophilus influenzae Rd
ccgcccauuccacccaua

SEQ ID NO: 687095 - RNA, 18 nt, Haemophilus influenzae Rd
ccgcugcagcuucagcaa

SEQ ID NO: 687096 - RNA, 17 nt, Haemophilus influenzae Rd
ccgcucuuuaacaaauu

SEQ ID NO: 687097 - RNA, 21 nt, Haemophilus influenzae Rd
ccgcuucaaucgcaacacguu

SEQ ID NO: 687098 - RNA, 19 nt, Haemophilus influenzae Rd
ccgcuaaugcccacgucca

SEQ ID NO: 687099 - RNA, 11 nt, Haemophilus influenzae Rd
ccgcuaauggu

SEQ ID NO: 687100 - RNA, 22 nt, Haemophilus influenzae Rd
ccgcuuuugcauugagcacuuc

SEQ ID NO: 687101 - RNA, 18 nt, Haemophilus influenzae Rd
ccgucagccaaauuuuuc

SEQ ID NO: 687102 - RNA, 16 nt, Haemophilus influenzae Rd
ccgucuaaaaauccug

SEQ ID NO: 687103 - RNA, 17 nt, Haemophilus influenzae Rd
ccguaaccgcccagcau

SEQ ID NO: 687104 - RNA, 14 nt, Haemophilus influenzae Rd
ccguagcacuggca

SEQ ID NO: 687105 - RNA, 23 nt, Haemophilus influenzae Rd
ccguagccguuuugcguugcggu

SEQ ID NO: 687106 - RNA, 15 nt, Haemophilus influenzae Rd
ccgugcucaauuucu

SEQ ID NO: 687107 - RNA, 13 nt, Haemophilus influenzae Rd
ccgucuuuaaaua

SEQ ID NO: 687108 - RNA, 14 nt, Haemophilus influenzae Rd
ccgucuuuaaauag

SEQ ID NO: 687109 - RNA, 20 nt, Haemophilus influenzae Rd
ccuacaucgccuugcauaau

SEQ ID NO: 687110 - RNA, 19 nt, Haemophilus influenzae Rd
ccuacauuaaucaccauau

SEQ ID NO: 687111 - RNA, 11 nt, Haemophilus influenzae Rd
ccuaauuauuu

SEQ ID NO: 687112 - RNA, 18 nt, Haemophilus influenzae Rd
ccuaauucaucuucuuua

SEQ ID NO: 687113 - RNA, 21 nt, Haemophilus influenzae Rd
ccuaauauugcaccauaacuu

SEQ ID NO: 687114 - RNA, 12 nt, Haemophilus influenzae Rd
ccuaaugauuaa

SEQ ID NO: 687115 - RNA, 13 nt, Haemophilus influenzae Rd
ccuaaugauuaau

SEQ ID NO: 687116 - RNA, 21 nt, Haemophilus influenzae Rd
ccuaauggauauagaaaucau

SEQ ID NO: 687117 - RNA, 22 nt, Haemophilus influenzae Rd
ccuaauggauauagaaaucaua

SEQ ID NO: 687118 - RNA, 12 nt, Haemophilus influenzae Rd
ccuaacauaaug

SEQ ID NO: 687119 - RNA, 21 nt, Haemophilus influenzae Rd
ccuaacauacugcuuucuaga

SEQ ID NO: 687120 - RNA, 14 nt, Haemophilus influenzae Rd
ccuaacaauaauuu

SEQ ID NO: 687121 - RNA, 13 nt, Haemophilus influenzae Rd
ccuaaccaaagcg

SEQ ID NO: 687122 - RNA, 13 nt, Haemophilus influenzae Rd
ccuaauagaaaaa

SEQ ID NO: 687123 - RNA, 14 nt, Haemophilus influenzae Rd
ccuaauagaaaaau

SEQ ID NO: 687124 - RNA, 11 nt, Haemophilus influenzae Rd
ccguuuaccau

SEQ ID NO: 687125 - RNA, 13 nt, Haemophilus influenzae Rd
ccguuuucaaugc

SEQ ID NO: 687126 - RNA, 17 nt, Haemophilus influenzae Rd
ccguuuucaaugcaaau

SEQ ID NO: 687127 - RNA, 15 nt, Haemophilus influenzae Rd
ccuccaaauucuuua

SEQ ID NO: 687128 - RNA, 18 nt, Haemophilus influenzae Rd
ccuccaaauucuuuaaau

SEQ ID NO: 687129 - RNA, 19 nt, Haemophilus influenzae Rd
ccuccuaaugcagcagcuu

SEQ ID NO: 687130 - RNA, 15 nt, Haemophilus influenzae Rd
ccucuugcuucuaau

SEQ ID NO: 687131 - RNA, 17 nt, Haemophilus influenzae Rd
ccucuugcacaauuugg

SEQ ID NO: 687132 - RNA, 13 nt, Haemophilus influenzae Rd
ccucuuggauuuu

SEQ ID NO: 687133 - RNA, 15 nt, Haemophilus influenzae Rd
ccucuuggauuuucu

SEQ ID NO: 687134 - RNA, 20 nt, Haemophilus influenzae Rd
ccucucggcgguucuuguuu

SEQ ID NO: 687135 - RNA, 16 nt, Haemophilus influenzae Rd
ccugaagcaacaauca

SEQ ID NO: 687136 - RNA, 16 nt, Haemophilus influenzae Rd
ccugaagcaucuggca

SEQ ID NO: 687137 - RNA, 22 nt, Haemophilus influenzae Rd
ccucuuuaauuucgccagaacu

SEQ ID NO: 687138 - RNA, 12 nt, Haemophilus influenzae Rd
ccucuuuuucag

SEQ ID NO: 687139 - RNA, 19 nt, Haemophilus influenzae Rd
ccucuuuuucagaagucac

SEQ ID NO: 687140 - RNA, 13 nt, Haemophilus influenzae Rd
ccucuuuuuucau

SEQ ID NO: 687141 - RNA, 16 nt, Haemophilus influenzae Rd
ccuguauaauuuuuca

SEQ ID NO: 687142 - RNA, 19 nt, Haemophilus influenzae Rd
ccugcgugaaugacuuuca

SEQ ID NO: 687143 - RNA, 21 nt, Haemophilus influenzae Rd
ccugcugcaguuacugccucu

SEQ ID NO: 687144 - RNA, 15 nt, Haemophilus influenzae Rd
cgacucguccaucaa

SEQ ID NO: 687145 - RNA, 13 nt, Haemophilus influenzae Rd
cgacuuuauauug

SEQ ID NO: 687146 - RNA, 17 nt, Haemophilus influenzae Rd
cgacuuuguccaaaaau

SEQ ID NO: 687147 - RNA, 12 nt, Haemophilus influenzae Rd
cgagcauauuuu

SEQ ID NO: 687148 - RNA, 18 nt, Haemophilus influenzae Rd
cgagaaagguguaauucc

SEQ ID NO: 687149 - RNA, 22 nt, Haemophilus influenzae Rd
cgagaaagguguaauuccauau

SEQ ID NO: 687150 - RNA, 19 nt, Haemophilus influenzae Rd
cgagaaaauuaaaaauuua

SEQ ID NO: 687151 - RNA, 17 nt, Haemophilus influenzae Rd
cgagaaccaaaacgcaa

SEQ ID NO: 687152 - RNA, 23 nt, Haemophilus influenzae Rd
cgagacauuauuuuuacaaauag

SEQ ID NO: 687153 - RNA, 22 nt, Haemophilus influenzae Rd
cgagaaguuaaaccugccaacg

SEQ ID NO: 687154 - RNA, 12 nt, Haemophilus influenzae Rd
cgagucuuagac

SEQ ID NO: 687155 - RNA, 16 nt, Haemophilus influenzae Rd
cgaguggcggacgggu

SEQ ID NO: 687156 - RNA, 13 nt, Haemophilus influenzae Rd
cgaguaaaauaaa

SEQ ID NO: 687157 - RNA, 17 nt, Haemophilus influenzae Rd
cgaguaaaauaaaaagg

SEQ ID NO: 687158 - RNA, 17 nt, Haemophilus influenzae Rd
cgaguaaaaauaaaaug

SEQ ID NO: 687159 - RNA, 16 nt, Haemophilus influenzae Rd
cgaguaaauucaccaa

SEQ ID NO: 687160 - RNA, 15 nt, Haemophilus influenzae Rd
cgaguaaauuuagag

SEQ ID NO: 687161 - RNA, 16 nt, Haemophilus influenzae Rd
cgagguaagcugaagu

SEQ ID NO: 687162 - RNA, 16 nt, Haemophilus influenzae Rd
cgagggauuuuaaauc

SEQ ID NO: 687163 - RNA, 20 nt, Haemophilus influenzae Rd
cgaguuaauuauuuuaaaua

SEQ ID NO: 687164 - RNA, 16 nt, Haemophilus influenzae Rd
cgaguucuuuugguaa

SEQ ID NO: 687165 - RNA, 16 nt, Haemophilus influenzae Rd
cgaguuuuucaaaaau

SEQ ID NO: 687166 - RNA, 15 nt, Haemophilus influenzae Rd
cgauaauauuuuugc

SEQ ID NO: 687167 - RNA, 17 nt, Haemophilus influenzae Rd
cgauagucaccaucaca

SEQ ID NO: 687168 - RNA, 15 nt, Haemophilus influenzae Rd
cgauaguaaaaaauc

SEQ ID NO: 687169 - RNA, 14 nt, Haemophilus influenzae Rd
cgauagcuuuuguu

SEQ ID NO: 687170 - RNA, 22 nt, Haemophilus influenzae Rd
cgagcuggcaucaucauuuuuu

SEQ ID NO: 687171 - RNA, 16 nt, Haemophilus influenzae Rd
cgagcuacauggauuu

SEQ ID NO: 687172 - RNA, 16 nt, Haemophilus influenzae Rd
cgagcgagaccacuuu

SEQ ID NO: 687173 - RNA, 14 nt, Haemophilus influenzae Rd
cgauguugcaaccu

SEQ ID NO: 687174 - RNA, 22 nt, Haemophilus influenzae Rd
cgauugugaccgauuuucuaag

SEQ ID NO: 687175 - RNA, 17 nt, Haemophilus influenzae Rd
cgauuguugcaucguga

SEQ ID NO: 687176 - RNA, 20 nt, Haemophilus influenzae Rd
cgauuuacgccaagacagua

SEQ ID NO: 687177 - RNA, 23 nt, Haemophilus influenzae Rd
cgauugcucguuauuauuaagug

SEQ ID NO: 687178 - RNA, 15 nt, Haemophilus influenzae Rd
cgauugcauuuuuua

SEQ ID NO: 687179 - RNA, 19 nt, Haemophilus influenzae Rd
cgauugcauuuuuuauaaa

SEQ ID NO: 687180 - RNA, 18 nt, Haemophilus influenzae Rd
cgauuuuuauauaaauaa

SEQ ID NO: 687181 - RNA, 17 nt, Haemophilus influenzae Rd
cgauuuuucuaaaauca

SEQ ID NO: 687182 - RNA, 13 nt, Haemophilus influenzae Rd
cgauuuuucucua

SEQ ID NO: 687183 - RNA, 14 nt, Haemophilus influenzae Rd
cgauuuuucucuag

SEQ ID NO: 687184 - RNA, 20 nt, Haemophilus influenzae Rd
cgauuuugcaagguuuccaa

SEQ ID NO: 687185 - RNA, 12 nt, Haemophilus influenzae Rd
cgauuuggauuu

SEQ ID NO: 687186 - RNA, 11 nt, Haemophilus influenzae Rd
cgauuuuaaau

SEQ ID NO: 687187 - RNA, 16 nt, Haemophilus influenzae Rd
cgauuuuaauugugca

SEQ ID NO: 687188 - RNA, 17 nt, Haemophilus influenzae Rd
cgauuucgugcaauaac

SEQ ID NO: 687189 - RNA, 17 nt, Haemophilus influenzae Rd
cgauuucuuuugguuua

SEQ ID NO: 687190 - RNA, 18 nt, Haemophilus influenzae Rd
cgauuugcuauccaaccu

SEQ ID NO: 687191 - RNA, 16 nt, Haemophilus influenzae Rd
cgauuugcacuuucua

SEQ ID NO: 687192 - RNA, 14 nt, Haemophilus influenzae Rd
cgauuucaucuuca

SEQ ID NO: 687193 - RNA, 23 nt, Haemophilus influenzae Rd
cgauggaaaugaguaaaccgauu

SEQ ID NO: 687194 - RNA, 20 nt, Haemophilus influenzae Rd
cgauggcugggauuucaaac

SEQ ID NO: 687195 - RNA, 15 nt, Haemophilus influenzae Rd
cgaugucuaaaugug

SEQ ID NO: 687196 - RNA, 19 nt, Haemophilus influenzae Rd
cgaugucuaaaugugccca

SEQ ID NO: 687197 - RNA, 14 nt, Haemophilus influenzae Rd
cgaugugcauugaa

SEQ ID NO: 687198 - RNA, 23 nt, Haemophilus influenzae Rd
cgaucacugcaccguugaaugcu

SEQ ID NO: 687199 - RNA, 14 nt, Haemophilus influenzae Rd
cgauauuuuuucag

SEQ ID NO: 687200 - RNA, 12 nt, Haemophilus influenzae Rd
cgauauuuauaa

SEQ ID NO: 687201 - RNA, 17 nt, Haemophilus influenzae Rd
cgauauuucgcacgugc

SEQ ID NO: 687202 - RNA, 20 nt, Haemophilus influenzae Rd
cgauauuuuuaucaauaacu

SEQ ID NO: 687203 - RNA, 22 nt, Haemophilus influenzae Rd
cgcacgcauauuaguuaguuuu

SEQ ID NO: 687204 - RNA, 12 nt, Haemophilus influenzae Rd
cgcaccgcuucu

SEQ ID NO: 687205 - RNA, 17 nt, Haemophilus influenzae Rd
cgcaaaaucuugcugaa

SEQ ID NO: 687206 - RNA, 23 nt, Haemophilus influenzae Rd
cgcaaaagugcggucaauuuuuc

SEQ ID NO: 687207 - RNA, 17 nt, Haemophilus influenzae Rd
cgcaaccagcagaaaau

SEQ ID NO: 687208 - RNA, 15 nt, Haemophilus influenzae Rd
cgcaagcaccaaagc

SEQ ID NO: 687209 - RNA, 16 nt, Haemophilus influenzae Rd
cgcaauuaaugcagcc

SEQ ID NO: 687210 - RNA, 18 nt, Haemophilus influenzae Rd
cgcauuguuaucuaaaua

SEQ ID NO: 687211 - RNA, 14 nt, Haemophilus influenzae Rd
cgcauuuaaauaaa

SEQ ID NO: 687212 - RNA, 17 nt, Haemophilus influenzae Rd
cgcauuuuacagauuuu

SEQ ID NO: 687213 - RNA, 14 nt, Haemophilus influenzae Rd
cgcauuuuuuuauu

SEQ ID NO: 687214 - RNA, 22 nt, Haemophilus influenzae Rd
cgccaaucauacuaaauacauu

SEQ ID NO: 687215 - RNA, 20 nt, Haemophilus influenzae Rd
cgccaaucuaagccuaagcc

SEQ ID NO: 687216 - RNA, 22 nt, Haemophilus influenzae Rd
cgcauacguaauacuuuugcuu

SEQ ID NO: 687217 - RNA, 18 nt, Haemophilus influenzae Rd
cgcauauuuuguucuaca

SEQ ID NO: 687218 - RNA, 22 nt, Haemophilus influenzae Rd
cgcaucauucaaugcaacaaua

SEQ ID NO: 687219 - RNA, 14 nt, Haemophilus influenzae Rd
cgcaguuaaaacug

SEQ ID NO: 687220 - RNA, 16 nt, Haemophilus influenzae Rd
cgcagcgugaccugcg

SEQ ID NO: 687221 - RNA, 15 nt, Haemophilus influenzae Rd
ccuucgaaugcuugc

SEQ ID NO: 687222 - RNA, 16 nt, Haemophilus influenzae Rd
ccuucgcuauuuuucg

SEQ ID NO: 687223 - RNA, 16 nt, Haemophilus influenzae Rd
ccuucuuugauauaaa

SEQ ID NO: 687224 - RNA, 20 nt, Haemophilus influenzae Rd
ccuucuuuuauagacuucaa

SEQ ID NO: 687225 - RNA, 14 nt, Haemophilus influenzae Rd
ccuugaaucauuuc

SEQ ID NO: 687226 - RNA, 22 nt, Haemophilus influenzae Rd
ccuugaaucauuucaucuacac

SEQ ID NO: 687227 - RNA, 22 nt, Haemophilus influenzae Rd
ccuugaauugcuuuaauuucuu

SEQ ID NO: 687228 - RNA, 23 nt, Haemophilus influenzae Rd
ccuugaauugcuuuaauuucuuu

SEQ ID NO: 687229 - RNA, 20 nt, Haemophilus influenzae Rd
ccuugacauauucuguugaa

SEQ ID NO: 687230 - RNA, 14 nt, Haemophilus influenzae Rd
ccuucugccauaac

SEQ ID NO: 687231 - RNA, 14 nt, Haemophilus influenzae Rd
ccuucuucacuacu

SEQ ID NO: 687232 - RNA, 21 nt, Haemophilus influenzae Rd
ccuucuucaguaccagucacu

SEQ ID NO: 687233 - RNA, 22 nt, Haemophilus influenzae Rd
ccuugcauaauuccuuuuucua

SEQ ID NO: 687234 - RNA, 19 nt, Haemophilus influenzae Rd
ccuugcccagcaagggauu

SEQ ID NO: 687235 - RNA, 13 nt, Haemophilus influenzae Rd
ccuugcaagcagu

SEQ ID NO: 687236 - RNA, 16 nt, Haemophilus influenzae Rd
ccuugauuauuuuuua

SEQ ID NO: 687237 - RNA, 20 nt, Haemophilus influenzae Rd
ccuugaaguuugauuccguu

SEQ ID NO: 687238 - RNA, 19 nt, Haemophilus influenzae Rd
ccuugcucacgggcagaau

SEQ ID NO: 687239 - RNA, 16 nt, Haemophilus influenzae Rd
ccuuguaaccaagcug

SEQ ID NO: 687240 - RNA, 19 nt, Haemophilus influenzae Rd
ccuugguuuucuugccaaa

SEQ ID NO: 687241 - RNA, 17 nt, Haemophilus influenzae Rd
ccuuuacgggauuuuuu

SEQ ID NO: 687242 - RNA, 15 nt, Haemophilus influenzae Rd
ccuuuacguuuaacu

SEQ ID NO: 687243 - RNA, 16 nt, Haemophilus influenzae Rd
ccuuuaaggugcagau

SEQ ID NO: 687244 - RNA, 20 nt, Haemophilus influenzae Rd
ccuugugcgacaaguuugau

SEQ ID NO: 687245 - RNA, 13 nt, Haemophilus influenzae Rd
ccuuguucuucau

SEQ ID NO: 687246 - RNA, 21 nt, Haemophilus influenzae Rd
ccuuuuaccaauugauuuuuc

SEQ ID NO: 687247 - RNA, 14 nt, Haemophilus influenzae Rd
ccuuuuaauaaauu

SEQ ID NO: 687248 - RNA, 20 nt, Haemophilus influenzae Rd
ccuuuuaaugcuccauggac

SEQ ID NO: 687249 - RNA, 15 nt, Haemophilus influenzae Rd
ccuuuuaugaauaug

SEQ ID NO: 687250 - RNA, 22 nt, Haemophilus influenzae Rd
ccuuuuauuucuuagauuucua

SEQ ID NO: 687251 - RNA, 23 nt, Haemophilus influenzae Rd
ccuuucguaguuaugaugugcuu

SEQ ID NO: 687252 - RNA, 18 nt, Haemophilus influenzae Rd
ccuuucuggcucugcuga

SEQ ID NO: 687253 - RNA, 16 nt, Haemophilus influenzae Rd
ccuuucuguaaauaug

SEQ ID NO: 687254 - RNA, 20 nt, Haemophilus influenzae Rd
ccuuuacugacuuucuaacu

SEQ ID NO: 687255 - RNA, 20 nt, Haemophilus influenzae Rd
ccuuuagacaacaacuuuuc

SEQ ID NO: 687256 - RNA, 22 nt, Haemophilus influenzae Rd
ccuuuauugauccuagauguaa

SEQ ID NO: 687257 - RNA, 19 nt, Haemophilus influenzae Rd
ccuuuaugacuauuuuuuu

SEQ ID NO: 687258 - RNA, 13 nt, Haemophilus influenzae Rd
ccuuuccacgccu

SEQ ID NO: 687259 - RNA, 17 nt, Haemophilus influenzae Rd
cgaaaauuuugccaauu

SEQ ID NO: 687260 - RNA, 18 nt, Haemophilus influenzae Rd
cgaaacauaaaaagagag

SEQ ID NO: 687261 - RNA, 14 nt, Haemophilus influenzae Rd
cgaaaauuaagaaa

SEQ ID NO: 687262 - RNA, 17 nt, Haemophilus influenzae Rd
cgaaaauuaagaaaaua

SEQ ID NO: 687263 - RNA, 17 nt, Haemophilus influenzae Rd
cgaaaauggcuaaauuc

SEQ ID NO: 687264 - RNA, 21 nt, Haemophilus influenzae Rd
cgaaaauuuaccgcacuuuga

SEQ ID NO: 687265 - RNA, 13 nt, Haemophilus influenzae Rd
cgaaaaggcaaac

SEQ ID NO: 687266 - RNA, 21 nt, Haemophilus influenzae Rd
cgaaaauaacuucauccauuu

SEQ ID NO: 687267 - RNA, 22 nt, Haemophilus influenzae Rd
cgaaaaucacgcucuuuuaucu

SEQ ID NO: 687268 - RNA, 21 nt, Haemophilus influenzae Rd
cgaaaaucaucauauucacuu

SEQ ID NO: 687269 - RNA, 14 nt, Haemophilus influenzae Rd
cgaaaaaacaagag

SEQ ID NO: 687270 - RNA, 21 nt, Haemophilus influenzae Rd
ccuuuuuuuagaauuaaauuu

SEQ ID NO: 687271 - RNA, 22 nt, Haemophilus influenzae Rd
ccuuuuuguuguauaagauuaa

SEQ ID NO: 687272 - RNA, 23 nt, Haemophilus influenzae Rd
ccuuuuuguuguauaagauuaau

SEQ ID NO: 687273 - RNA, 19 nt, Haemophilus influenzae Rd
ccuuuuucuaacacaacuu

SEQ ID NO: 687274 - RNA, 21 nt, Haemophilus influenzae Rd
ccuuuuucagcuaaugcuuua

SEQ ID NO: 687275 - RNA, 18 nt, Haemophilus influenzae Rd
ccuuuugccuaaaaccug

SEQ ID NO: 687276 - RNA, 18 nt, Haemophilus influenzae Rd
cgaaaccuuuuucuucca

SEQ ID NO: 687277 - RNA, 21 nt, Haemophilus influenzae Rd
cgaaaccuuuuucuuccauuu

SEQ ID NO: 687278 - RNA, 16 nt, Haemophilus influenzae Rd
cgaaacuugagauuuu

SEQ ID NO: 687279 - RNA, 17 nt, Haemophilus influenzae Rd
cgaaaggcgagggauuu

SEQ ID NO: 687280 - RNA, 20 nt, Haemophilus influenzae Rd
cgaaaggcgagggauuuuaa

SEQ ID NO: 687281 - RNA, 13 nt, Haemophilus influenzae Rd
cgaaauuaaaaua

SEQ ID NO: 687282 - RNA, 15 nt, Haemophilus influenzae Rd
cgaaauuaaaauaau

SEQ ID NO: 687283 - RNA, 23 nt, Haemophilus influenzae Rd
cgaaauuaaaugggacaaagcag

SEQ ID NO: 687284 - RNA, 17 nt, Haemophilus influenzae Rd
cgaaaucgcacucacaa

SEQ ID NO: 687285 - RNA, 23 nt, Haemophilus influenzae Rd
cgaaaucgcacucacaauaccaa

SEQ ID NO: 687286 - RNA, 23 nt, Haemophilus influenzae Rd
cgaaauaucgcccuuauuuugug

SEQ ID NO: 687287 - RNA, 16 nt, Haemophilus influenzae Rd
cgaacacgccaccauu

SEQ ID NO: 687288 - RNA, 15 nt, Haemophilus influenzae Rd
cgaaauuuuucgcaa

SEQ ID NO: 687289 - RNA, 17 nt, Haemophilus influenzae Rd
cgaaccuuucauauaaa

SEQ ID NO: 687290 - RNA, 20 nt, Haemophilus influenzae Rd
cgaaccuuucauauaaauaa

SEQ ID NO: 687291 - RNA, 17 nt, Haemophilus influenzae Rd
cgaacauucccuuucca

SEQ ID NO: 687292 - RNA, 22 nt, Haemophilus influenzae Rd
cgaccguuuuuucuuuuuccug

SEQ ID NO: 687293 - RNA, 20 nt, Haemophilus influenzae Rd
cgaccguauugucugcaacg

SEQ ID NO: 687294 - RNA, 20 nt, Haemophilus influenzae Rd
cgacgauuuaauagcacaga

SEQ ID NO: 687295 - RNA, 14 nt, Haemophilus influenzae Rd
cgaccuugcaaauu

SEQ ID NO: 687296 - RNA, 14 nt, Haemophilus influenzae Rd
cgaccauuaaaucc

SEQ ID NO: 687297 - RNA, 15 nt, Haemophilus influenzae Rd
cgaccauuacagcaa

SEQ ID NO: 687298 - RNA, 18 nt, Haemophilus influenzae Rd
cgaccaauauugaaaagu

SEQ ID NO: 687299 - RNA, 22 nt, Haemophilus influenzae Rd
cgacauuuugucgccuuagaua

SEQ ID NO: 687300 - RNA, 21 nt, Haemophilus influenzae Rd
cgacaucugguuuugugagua

SEQ ID NO: 687301 - RNA, 19 nt, Haemophilus influenzae Rd
cgacaucaaucaaauucaa

SEQ ID NO: 687302 - RNA, 20 nt, Haemophilus influenzae Rd
cgaacguuucaucacuucaa

SEQ ID NO: 687303 - RNA, 13 nt, Haemophilus influenzae Rd
cgaacuaauaagc

SEQ ID NO: 687304 - RNA, 23 nt, Haemophilus influenzae Rd
cgaacgugggaauuuucccauuu

SEQ ID NO: 687305 - RNA, 18 nt, Haemophilus influenzae Rd
cgaacuggcugagagaag

SEQ ID NO: 687306 - RNA, 13 nt, Haemophilus influenzae Rd
cgaagauuacuuu

SEQ ID NO: 687307 - RNA, 19 nt, Haemophilus influenzae Rd
cgaagauuacuuucauaaa

SEQ ID NO: 687308 - RNA, 22 nt, Haemophilus influenzae Rd
cgaagcucgucuaaaucuuucc

SEQ ID NO: 687309 - RNA, 23 nt, Haemophilus influenzae Rd
cgaaggcaaaucaccuucaagua

SEQ ID NO: 687310 - RNA, 17 nt, Haemophilus influenzae Rd
cgaagccuaaaucuucu

SEQ ID NO: 687311 - RNA, 20 nt, Haemophilus influenzae Rd
cgaagugaauaauguuuuca

SEQ ID NO: 687312 - RNA, 21 nt, Haemophilus influenzae Rd
cgaauacugcgacuuucccug

SEQ ID NO: 687313 - RNA, 18 nt, Haemophilus influenzae Rd
cgaauaggcgaucugcua

SEQ ID NO: 687314 - RNA, 16 nt, Haemophilus influenzae Rd
cgaauagcuucugcca

SEQ ID NO: 687315 - RNA, 16 nt, Haemophilus influenzae Rd
cgaauagauuuaaaca

SEQ ID NO: 687316 - RNA, 16 nt, Haemophilus influenzae Rd
cgaauagccaaaacga

SEQ ID NO: 687317 - RNA, 15 nt, Haemophilus influenzae Rd
cgaauaauccuucuu

SEQ ID NO: 687318 - RNA, 14 nt, Haemophilus influenzae Rd
cgaauccaaugccu

SEQ ID NO: 687319 - RNA, 23 nt, Haemophilus influenzae Rd
cgaauauaagguaguuuuccuuu

SEQ ID NO: 687320 - RNA, 17 nt, Haemophilus influenzae Rd
cgaaucgcaaauggaau

SEQ ID NO: 687321 - RNA, 22 nt, Haemophilus influenzae Rd
cgaauguggcagcaaaguuggc

SEQ ID NO: 687322 - RNA, 18 nt, Haemophilus influenzae Rd
cgaauuaaagugcagauu

SEQ ID NO: 687323 - RNA, 23 nt, Haemophilus influenzae Rd
cgaauuaaagugcagauuuuuuu

SEQ ID NO: 687324 - RNA, 21 nt, Haemophilus influenzae Rd
cgaauuagguugaauuuuugu

SEQ ID NO: 687325 - RNA, 18 nt, Haemophilus influenzae Rd
cgaauuaguauaaacauc

SEQ ID NO: 687326 - RNA, 17 nt, Haemophilus influenzae Rd
cgacaaugcguaauucu

SEQ ID NO: 687327 - RNA, 22 nt, Haemophilus influenzae Rd
cgacaaauuaauaagaaaauca

SEQ ID NO: 687328 - RNA, 14 nt, Haemophilus influenzae Rd
cgacaacacuugcu

SEQ ID NO: 687329 - RNA, 23 nt, Haemophilus influenzae Rd
cgaauugguucuaaauauuuuuc

SEQ ID NO: 687330 - RNA, 21 nt, Haemophilus influenzae Rd
cgaauugacggugcauuugca

SEQ ID NO: 687331 - RNA, 22 nt, Haemophilus influenzae Rd
ccaaagcauuaaguuuuuagca

SEQ ID NO: 687332 - RNA, 21 nt, Haemophilus influenzae Rd
ccaaagccaaugccaaaacca

SEQ ID NO: 687333 - RNA, 15 nt, Haemophilus influenzae Rd
ccaaagacuaaaacc

SEQ ID NO: 687334 - RNA, 17 nt, Haemophilus influenzae Rd
ccaaagaagcuuuccau

SEQ ID NO: 687335 - RNA, 17 nt, Haemophilus influenzae Rd
ccaaagaaucaucuuca

SEQ ID NO: 687336 - RNA, 16 nt, Haemophilus influenzae Rd
ccaaacuuggaucaua

SEQ ID NO: 687337 - RNA, 18 nt, Haemophilus influenzae Rd
ccaaacgguauuucaauu

SEQ ID NO: 687338 - RNA, 22 nt, Haemophilus influenzae Rd
ccaaauagaugaaauuuauuau

SEQ ID NO: 687339 - RNA, 22 nt, Haemophilus influenzae Rd
ccaaauaucuucauaucuuuga

SEQ ID NO: 687340 - RNA, 14 nt, Haemophilus influenzae Rd
ccaaauaugaacuu

SEQ ID NO: 687341 - RNA, 17 nt, Haemophilus influenzae Rd
ccaaaugaugaaacaag

SEQ ID NO: 687342 - RNA, 19 nt, Haemophilus influenzae Rd
ccaaaugaugaaacaagcu

SEQ ID NO: 687343 - RNA, 22 nt, Haemophilus influenzae Rd
ccaaauccuuuugcauuauuga

SEQ ID NO: 687344 - RNA, 19 nt, Haemophilus influenzae Rd
ccaaagugcgguauuuuuu

SEQ ID NO: 687345 - RNA, 13 nt, Haemophilus influenzae Rd
ccaaauaaugcau

SEQ ID NO: 687346 - RNA, 20 nt, Haemophilus influenzae Rd
ccaaauaauguuaaaucuaa

SEQ ID NO: 687347 - RNA, 12 nt, Haemophilus influenzae Rd
ccaaauacaauu

SEQ ID NO: 687348 - RNA, 16 nt, Haemophilus influenzae Rd
ccaaauacaauuuuuu

SEQ ID NO: 687349 - RNA, 21 nt, Haemophilus influenzae Rd
ccaaauaauacuugaccaaaa

SEQ ID NO: 687350 - RNA, 13 nt, Haemophilus influenzae Rd
ccaaauaauacau

SEQ ID NO: 687351 - RNA, 19 nt, Haemophilus influenzae Rd
ccaaauaauccuagaguaa

SEQ ID NO: 687352 - RNA, 17 nt, Haemophilus influenzae Rd
ccaaaguuuccuucgcc

SEQ ID NO: 687353 - RNA, 22 nt, Haemophilus influenzae Rd
ccaaauaaaauuacaaaaccaa

SEQ ID NO: 687354 - RNA, 16 nt, Haemophilus influenzae Rd
ccaaaaauccucaucu

SEQ ID NO: 687355 - RNA, 16 nt, Haemophilus influenzae Rd
ccaaaacgaauagaaa

SEQ ID NO: 687356 - RNA, 22 nt, Haemophilus influenzae Rd
ccaaaaccuagaaauuuuggcu

SEQ ID NO: 687357 - RNA, 21 nt, Haemophilus influenzae Rd
ccaaaacaguaaugaaagaaa

SEQ ID NO: 687358 - RNA, 14 nt, Haemophilus influenzae Rd
ccaaaagauucaac

SEQ ID NO: 687359 - RNA, 19 nt, Haemophilus influenzae Rd
ccaaaagcugccaucugau

SEQ ID NO: 687360 - RNA, 21 nt, Haemophilus influenzae Rd
ccaaaagcuggauuaaauaac

SEQ ID NO: 687361 - RNA, 21 nt, Haemophilus influenzae Rd
cauuucucgggcugaaauacc

SEQ ID NO: 687362 - RNA, 23 nt, Haemophilus influenzae Rd
cauuucucgggcugaaauaccuu

SEQ ID NO: 687363 - RNA, 22 nt, Haemophilus influenzae Rd
cauuucgucgcuuuucccucuu

SEQ ID NO: 687364 - RNA, 15 nt, Haemophilus influenzae Rd
cauuucuaaaauaau

SEQ ID NO: 687365 - RNA, 16 nt, Haemophilus influenzae Rd
cauuucuaaaauaaua

SEQ ID NO: 687366 - RNA, 15 nt, Haemophilus influenzae Rd
cauuucuaaauaaaa

SEQ ID NO: 687367 - RNA, 17 nt, Haemophilus influenzae Rd
cauuucuaaauaaaauu

SEQ ID NO: 687368 - RNA, 16 nt, Haemophilus influenzae Rd
cauuucuaaugcaauu

SEQ ID NO: 687369 - RNA, 13 nt, Haemophilus influenzae Rd
cauuucuggagaa

SEQ ID NO: 687370 - RNA, 23 nt, Haemophilus influenzae Rd
cauuucuggagaaccuuggaaau

SEQ ID NO: 687371 - RNA, 12 nt, Haemophilus influenzae Rd
ccaaaaaagccc

SEQ ID NO: 687372 - RNA, 15 nt, Haemophilus influenzae Rd
ccaaaaaagcccaag

SEQ ID NO: 687373 - RNA, 19 nt, Haemophilus influenzae Rd
cauuucucuaaaacauugu

SEQ ID NO: 687374 - RNA, 23 nt, Haemophilus influenzae Rd
ccaaaaaagcguugaaaauaaau

SEQ ID NO: 687375 - RNA, 13 nt, Haemophilus influenzae Rd
ccaaacauuuuua

SEQ ID NO: 687376 - RNA, 14 nt, Haemophilus influenzae Rd
ccaaacauuuuuau

SEQ ID NO: 687377 - RNA, 16 nt, Haemophilus influenzae Rd
ccaaaauucuguguuu

SEQ ID NO: 687378 - RNA, 13 nt, Haemophilus influenzae Rd
ccaaaauuucuga

SEQ ID NO: 687379 - RNA, 19 nt, Haemophilus influenzae Rd
ccaaaauuacuuuucgaua

SEQ ID NO: 687380 - RNA, 23 nt, Haemophilus influenzae Rd
ccaaaaguuggauuaaacaacca

SEQ ID NO: 687381 - RNA, 21 nt, Haemophilus influenzae Rd
ccaaaaguuguggaaguugcu

SEQ ID NO: 687382 - RNA, 11 nt, Haemophilus influenzae Rd
ccaaaauauuu

SEQ ID NO: 687383 - RNA, 14 nt, Haemophilus influenzae Rd
ccaaaauauuucau

SEQ ID NO: 687384 - RNA, 17 nt, Haemophilus influenzae Rd
ccaaaauauuucauuug

SEQ ID NO: 687385 - RNA, 22 nt, Haemophilus influenzae Rd
ccaaaaucacgccagauaaaau

SEQ ID NO: 687386 - RNA, 12 nt, Haemophilus influenzae Rd
ccaaaaucauca

SEQ ID NO: 687387 - RNA, 17 nt, Haemophilus influenzae Rd
ccaacuaacauacccau

SEQ ID NO: 687388 - RNA, 14 nt, Haemophilus influenzae Rd
ccaacuaacuaagg

SEQ ID NO: 687389 - RNA, 22 nt, Haemophilus influenzae Rd
ccaacuaaggugcagauuuuuu

SEQ ID NO: 687390 - RNA, 21 nt, Haemophilus influenzae Rd
ccaagaaagucauuaaugcau

SEQ ID NO: 687391 - RNA, 20 nt, Haemophilus influenzae Rd
ccaagaaaagugcgaugaca

SEQ ID NO: 687392 - RNA, 19 nt, Haemophilus influenzae Rd
ccaacugcaacagcugcac

SEQ ID NO: 687393 - RNA, 20 nt, Haemophilus influenzae Rd
ccaacgccuaauccauucaa

SEQ ID NO: 687394 - RNA, 14 nt, Haemophilus influenzae Rd
ccaaccgguaaaau

SEQ ID NO: 687395 - RNA, 15 nt, Haemophilus influenzae Rd
ccaaccuacauuaau

SEQ ID NO: 687396 - RNA, 18 nt, Haemophilus influenzae Rd
ccaacgggccaguuugaa

SEQ ID NO: 687397 - RNA, 18 nt, Haemophilus influenzae Rd
ccaaaugcggccaauacu

SEQ ID NO: 687398 - RNA, 18 nt, Haemophilus influenzae Rd
ccaaaugcacauaacaaa

SEQ ID NO: 687399 - RNA, 22 nt, Haemophilus influenzae Rd
ccaaaugcacauaacaaaaugg

SEQ ID NO: 687400 - RNA, 20 nt, Haemophilus influenzae Rd
ccaaauuacuuggggcuaau

SEQ ID NO: 687401 - RNA, 23 nt, Haemophilus influenzae Rd
ccaaauuggguucgcaaauaacg

SEQ ID NO: 687402 - RNA, 22 nt, Haemophilus influenzae Rd
ccaaauuaucaaagaauuuuuu

SEQ ID NO: 687403 - RNA, 17 nt, Haemophilus influenzae Rd
ccaaauucauucuugcu

SEQ ID NO: 687404 - RNA, 15 nt, Haemophilus influenzae Rd
ccaaauucauuuuuu

SEQ ID NO: 687405 - RNA, 22 nt, Haemophilus influenzae Rd
ccaaauuccgcaauauuuaaau

SEQ ID NO: 687406 - RNA, 15 nt, Haemophilus influenzae Rd
ccaacaaauuuaaau

SEQ ID NO: 687407 - RNA, 17 nt, Haemophilus influenzae Rd
ccaacaaauuuaaauga

SEQ ID NO: 687408 - RNA, 16 nt, Haemophilus influenzae Rd
ccaacaaaauaaacac

SEQ ID NO: 687409 - RNA, 20 nt, Haemophilus influenzae Rd
ccaacaacuuauuuggaaca

SEQ ID NO: 687410 - RNA, 11 nt, Haemophilus influenzae Rd
ccaacaacugc

SEQ ID NO: 687411 - RNA, 17 nt, Haemophilus influenzae Rd
ccaacagaaaucauuuc

SEQ ID NO: 687412 - RNA, 19 nt, Haemophilus influenzae Rd
ccaaccgccugcauagaau

SEQ ID NO: 687413 - RNA, 15 nt, Haemophilus influenzae Rd
ccaacauaaacauug

SEQ ID NO: 687414 - RNA, 15 nt, Haemophilus influenzae Rd
ccaacauacauuaau

SEQ ID NO: 687415 - RNA, 11 nt, Haemophilus influenzae Rd
ccaaccaauca

SEQ ID NO: 687416 - RNA, 21 nt, Haemophilus influenzae Rd
ccaacauuucacuaaauaaau

SEQ ID NO: 687417 - RNA, 19 nt, Haemophilus influenzae Rd
ccaagguuauuuagcccuu

SEQ ID NO: 687418 - RNA, 23 nt, Haemophilus influenzae Rd
ccaagugaaauucuaccugcugu

SEQ ID NO: 687419 - RNA, 12 nt, Haemophilus influenzae Rd
ccaagugcauga

SEQ ID NO: 687420 - RNA, 22 nt, Haemophilus influenzae Rd
ccaaguccccauuuguagaaag

SEQ ID NO: 687421 - RNA, 19 nt, Haemophilus influenzae Rd
ccaagguugcucaauccaa

SEQ ID NO: 687422 - RNA, 22 nt, Haemophilus influenzae Rd
ccaagguugcucaauccaagua

SEQ ID NO: 687423 - RNA, 18 nt, Haemophilus influenzae Rd
ccaaguuugcacuucuuc

SEQ ID NO: 687424 - RNA, 23 nt, Haemophilus influenzae Rd
ccaaguuuucacuucguuguggc

SEQ ID NO: 687425 - RNA, 20 nt, Haemophilus influenzae Rd
ccaaguuuuuuaucuuuuuc

SEQ ID NO: 687426 - RNA, 17 nt, Haemophilus influenzae Rd
ccaauaaaaagauaacu

SEQ ID NO: 687427 - RNA, 15 nt, Haemophilus influenzae Rd
ccaauaaaacaguua

SEQ ID NO: 687428 - RNA, 12 nt, Haemophilus influenzae Rd
ccaagugcuuua

SEQ ID NO: 687429 - RNA, 14 nt, Haemophilus influenzae Rd
ccaagugcuuuacc

SEQ ID NO: 687430 - RNA, 18 nt, Haemophilus influenzae Rd
ccaagugcuuuaccuguu

SEQ ID NO: 687431 - RNA, 22 nt, Haemophilus influenzae Rd
ccaagaucaagcacuuuuccuu

SEQ ID NO: 687432 - RNA, 12 nt, Haemophilus influenzae Rd
ccaagaaucaag

SEQ ID NO: 687433 - RNA, 15 nt, Haemophilus influenzae Rd
ccaagaauaaaaugu

SEQ ID NO: 687434 - RNA, 15 nt, Haemophilus influenzae Rd
ccaagccaauuauuu

SEQ ID NO: 687435 - RNA, 22 nt, Haemophilus influenzae Rd
ccaagcaaugcuuuaaucauuu

SEQ ID NO: 687436 - RNA, 14 nt, Haemophilus influenzae Rd
ccaagauucuaaau

SEQ ID NO: 687437 - RNA, 18 nt, Haemophilus influenzae Rd
ccaagcguuaauccaagg

SEQ ID NO: 687438 - RNA, 19 nt, Haemophilus influenzae Rd
ccaauccgcuuguuaauac

SEQ ID NO: 687439 - RNA, 14 nt, Haemophilus influenzae Rd
ccaauccuaaaucu

SEQ ID NO: 687440 - RNA, 15 nt, Haemophilus influenzae Rd
ccaauccauuuuuaa

SEQ ID NO: 687441 - RNA, 13 nt, Haemophilus influenzae Rd
ccaauauuuuuca

SEQ ID NO: 687442 - RNA, 14 nt, Haemophilus influenzae Rd
ccaauauuuuucau

SEQ ID NO: 687443 - RNA, 23 nt, Haemophilus influenzae Rd
ccaaucacuagccauaaauaaau

SEQ ID NO: 687444 - RNA, 23 nt, Haemophilus influenzae Rd
ccaaucuccguugggauuuuuua

SEQ ID NO: 687445 - RNA, 18 nt, Haemophilus influenzae Rd
ccaaucuaaacacacucu

SEQ ID NO: 687446 - RNA, 16 nt, Haemophilus influenzae Rd
ccaaucuaauucuucc

SEQ ID NO: 687447 - RNA, 14 nt, Haemophilus influenzae Rd
ccaaugagaaaaag

SEQ ID NO: 687448 - RNA, 16 nt, Haemophilus influenzae Rd
ccaaugcaacaggaau

SEQ ID NO: 687449 - RNA, 15 nt, Haemophilus influenzae Rd
ccaaugcaacuugca

SEQ ID NO: 687450 - RNA, 14 nt, Haemophilus influenzae Rd
ccaauaauaaagcu

SEQ ID NO: 687451 - RNA, 22 nt, Haemophilus influenzae Rd
ccaauaauaaagcuccuugaau

SEQ ID NO: 687452 - RNA, 20 nt, Haemophilus influenzae Rd
ccaauaaaaguaauuucuuu

SEQ ID NO: 687453 - RNA, 13 nt, Haemophilus influenzae Rd
ccaauaaacauua

SEQ ID NO: 687454 - RNA, 14 nt, Haemophilus influenzae Rd
ccaauaauucuuua

SEQ ID NO: 687455 - RNA, 14 nt, Haemophilus influenzae Rd
ccaauaccaauaau

SEQ ID NO: 687456 - RNA, 20 nt, Haemophilus influenzae Rd
ccaauaauccuuuuuuugaa

SEQ ID NO: 687457 - RNA, 12 nt, Haemophilus influenzae Rd
ccaauagauuac

SEQ ID NO: 687458 - RNA, 17 nt, Haemophilus influenzae Rd
ccaauacuggcugaaca

SEQ ID NO: 687459 - RNA, 17 nt, Haemophilus influenzae Rd
ccaauacuguuuggcaa

SEQ ID NO: 687460 - RNA, 18 nt, Haemophilus influenzae Rd
ccaauaggaagcauuucu

SEQ ID NO: 687461 - RNA, 21 nt, Haemophilus influenzae Rd
ccaauauaauuuacuguuuaa

SEQ ID NO: 687462 - RNA, 13 nt, Haemophilus influenzae Rd
ccacaacuuuuuc

SEQ ID NO: 687463 - RNA, 15 nt, Haemophilus influenzae Rd
ccacaacuuuuucau

SEQ ID NO: 687464 - RNA, 21 nt, Haemophilus influenzae Rd
ccacaauaaaauaauauauua

SEQ ID NO: 687465 - RNA, 20 nt, Haemophilus influenzae Rd
ccacaaguagauuacacauu

SEQ ID NO: 687466 - RNA, 21 nt, Haemophilus influenzae Rd
ccacaagcaacaauauuagga

SEQ ID NO: 687467 - RNA, 16 nt, Haemophilus influenzae Rd
ccacaaaaucugcucc

SEQ ID NO: 687468 - RNA, 21 nt, Haemophilus influenzae Rd
ccacaaaauggcuguuguuuu

SEQ ID NO: 687469 - RNA, 9 nt, Haemophilus influenzae Rd
ccacaaaca

SEQ ID NO: 687470 - RNA, 22 nt, Haemophilus influenzae Rd
ccaauuugcgccacaauauuua

SEQ ID NO: 687471 - RNA, 13 nt, Haemophilus influenzae Rd
ccaauuuguacca

SEQ ID NO: 687472 - RNA, 15 nt, Haemophilus influenzae Rd
ccaauuuuggaucgg

SEQ ID NO: 687473 - RNA, 15 nt, Haemophilus influenzae Rd
ccaauuuuucaaaac

SEQ ID NO: 687474 - RNA, 23 nt, Haemophilus influenzae Rd
ccaaugccuugugcauaaacaaa

SEQ ID NO: 687475 - RNA, 19 nt, Haemophilus influenzae Rd
ccaauuaauucucccucaa

SEQ ID NO: 687476 - RNA, 15 nt, Haemophilus influenzae Rd
ccaauguuugguaua

SEQ ID NO: 687477 - RNA, 17 nt, Haemophilus influenzae Rd
ccaauuaccugaugaaa

SEQ ID NO: 687478 - RNA, 14 nt, Haemophilus influenzae Rd
ccaauuaaccauaa

SEQ ID NO: 687479 - RNA, 20 nt, Haemophilus influenzae Rd
ccaauuagaugauuuuaaaa

SEQ ID NO: 687480 - RNA, 18 nt, Haemophilus influenzae Rd
ccaauuagauuacgcuuu

SEQ ID NO: 687481 - RNA, 22 nt, Haemophilus influenzae Rd
ccaauuagcugguuuauuuauu

SEQ ID NO: 687482 - RNA, 22 nt, Haemophilus influenzae Rd
ccaauuauccgagagaaaguua

SEQ ID NO: 687483 - RNA, 19 nt, Haemophilus influenzae Rd
ccaauuauuggcaauuucc

SEQ ID NO: 687484 - RNA, 22 nt, Haemophilus influenzae Rd
ccaauucaaagauuuuaaaauu

SEQ ID NO: 687485 - RNA, 20 nt, Haemophilus influenzae Rd
ccaauuccccagcagaguua

SEQ ID NO: 687486 - RNA, 19 nt, Haemophilus influenzae Rd
ccaauucuaguucuucccc

SEQ ID NO: 687487 - RNA, 15 nt, Haemophilus influenzae Rd
ccaauucucugcauc

SEQ ID NO: 687488 - RNA, 17 nt, Haemophilus influenzae Rd
ccaauucuuuuaaaugu

SEQ ID NO: 687489 - RNA, 18 nt, Haemophilus influenzae Rd
ccacaggauaaaaaccag

SEQ ID NO: 687490 - RNA, 16 nt, Haemophilus influenzae Rd
ccaccguucuauauuu

SEQ ID NO: 687491 - RNA, 22 nt, Haemophilus influenzae Rd
ccacccuucuuucaaauucccu

SEQ ID NO: 687492 - RNA, 17 nt, Haemophilus influenzae Rd
ccaccuuuuguagaaaa

SEQ ID NO: 687493 - RNA, 15 nt, Haemophilus influenzae Rd
ccacgauaaauccuu

SEQ ID NO: 687494 - RNA, 17 nt, Haemophilus influenzae Rd
ccacgaggucaaucuuu

SEQ ID NO: 687495 - RNA, 19 nt, Haemophilus influenzae Rd
ccacgguauuuucuuauug

SEQ ID NO: 687496 - RNA, 17 nt, Haemophilus influenzae Rd
ccacgccagcuacaucu

SEQ ID NO: 687497 - RNA, 23 nt, Haemophilus influenzae Rd
ccacccauuucaccacuucaucc

SEQ ID NO: 687498 - RNA, 16 nt, Haemophilus influenzae Rd
ccacccaaaauuucag

SEQ ID NO: 687499 - RNA, 17 nt, Haemophilus influenzae Rd
ccaccagagaaaucauc

SEQ ID NO: 687500 - RNA, 16 nt, Haemophilus influenzae Rd
ccaccacaauuaauga

SEQ ID NO: 687501 - RNA, 12 nt, Haemophilus influenzae Rd
ccaccaaaacca

SEQ ID NO: 687502 - RNA, 19 nt, Haemophilus influenzae Rd
ccacauuucccuuagauuu

SEQ ID NO: 687503 - RNA, 21 nt, Haemophilus influenzae Rd
ccaccaauuaaccauaaaaaa

SEQ ID NO: 687504 - RNA, 22 nt, Haemophilus influenzae Rd
ccaccaaaugcacauaacaaaa

SEQ ID NO: 687505 - RNA, 15 nt, Haemophilus influenzae Rd
ccacaugauauauuu

SEQ ID NO: 687506 - RNA, 19 nt, Haemophilus influenzae Rd
ccacauuauuuggugagau

SEQ ID NO: 687507 - RNA, 14 nt, Haemophilus influenzae Rd
ccacaugaauuucu

SEQ ID NO: 687508 - RNA, 13 nt, Haemophilus influenzae Rd
ccacaugaacaag

SEQ ID NO: 687509 - RNA, 16 nt, Haemophilus influenzae Rd
ccacaucaucaagcaa

SEQ ID NO: 687510 - RNA, 21 nt, Haemophilus influenzae Rd
ccacauauagugaaaaaauaa

SEQ ID NO: 687511 - RNA, 22 nt, Haemophilus influenzae Rd
ccacaguccccauaucucugcc

SEQ ID NO: 687512 - RNA, 15 nt, Haemophilus influenzae Rd
ccacauaaccaaagg

SEQ ID NO: 687513 - RNA, 16 nt, Haemophilus influenzae Rd
ccagagaaaucaucaa

SEQ ID NO: 687514 - RNA, 24 nt, Haemophilus influenzae Rd
ccagaccuaagguuaauuuuugau

SEQ ID NO: 687515 - RNA, 13 nt, Haemophilus influenzae Rd
ccacguucauuuc

SEQ ID NO: 687516 - RNA, 12 nt, Haemophilus influenzae Rd
ccacuuuuucau

SEQ ID NO: 687517 - RNA, 22 nt, Haemophilus influenzae Rd
ccacuuuugguggauuauaaac

SEQ ID NO: 687518 - RNA, 14 nt, Haemophilus influenzae Rd
ccacuuuuuucacg

SEQ ID NO: 687519 - RNA, 16 nt, Haemophilus influenzae Rd
ccagaaaauugcaccu

SEQ ID NO: 687520 - RNA, 21 nt, Haemophilus influenzae Rd
ccagaaaauugcaccuucuuu

SEQ ID NO: 687521 - RNA, 14 nt, Haemophilus influenzae Rd
ccagaaugguaaug

SEQ ID NO: 687522 - RNA, 19 nt, Haemophilus influenzae Rd
ccagaaagcagguuuuucu

SEQ ID NO: 687523 - RNA, 15 nt, Haemophilus influenzae Rd
ccagcaauaccacag

SEQ ID NO: 687524 - RNA, 18 nt, Haemophilus influenzae Rd
ccagcaaguucauauaaa

SEQ ID NO: 687525 - RNA, 13 nt, Haemophilus influenzae Rd
ccagaugcaauaa

SEQ ID NO: 687526 - RNA, 17 nt, Haemophilus influenzae Rd
ccaggcgaaaccgccuu

SEQ ID NO: 687527 - RNA, 11 nt, Haemophilus influenzae Rd
ccagcuugacg

SEQ ID NO: 687528 - RNA, 18 nt, Haemophilus influenzae Rd
ccagcguaaaaaugcugu

SEQ ID NO: 687529 - RNA, 17 nt, Haemophilus influenzae Rd
ccagccccucagauaau

SEQ ID NO: 687530 - RNA, 23 nt, Haemophilus influenzae Rd
ccauaagguuuggacaccuuuuu

SEQ ID NO: 687531 - RNA, 23 nt, Haemophilus influenzae Rd
ccauaaaagaccucucuaggcuu

SEQ ID NO: 687532 - RNA, 22 nt, Haemophilus influenzae Rd
ccauagcggauaaccaaaauau

SEQ ID NO: 687533 - RNA, 17 nt, Haemophilus influenzae Rd
ccauacuugccacaggu

SEQ ID NO: 687534 - RNA, 18 nt, Haemophilus influenzae Rd
ccauaauggcaauuuuau

SEQ ID NO: 687535 - RNA, 22 nt, Haemophilus influenzae Rd
ccauacccuugcuucuggaaau

SEQ ID NO: 687536 - RNA, 16 nt, Haemophilus influenzae Rd
ccauacgcgaugcauu

SEQ ID NO: 687537 - RNA, 19 nt, Haemophilus influenzae Rd
ccauacgcgaugcauugau

SEQ ID NO: 687538 - RNA, 20 nt, Haemophilus influenzae Rd
ccauacgcgaugcauugauu

SEQ ID NO: 687539 - RNA, 16 nt, Haemophilus influenzae Rd
ccauaccguauuuuuu

SEQ ID NO: 687540 - RNA, 21 nt, Haemophilus influenzae Rd
ccauaccguauuuuuuuaauu

SEQ ID NO: 687541 - RNA, 23 nt, Haemophilus influenzae Rd
ccauaguuuggcugaaauucuaa

SEQ ID NO: 687542 - RNA, 21 nt, Haemophilus influenzae Rd
ccauaguccgcaccaugggca

SEQ ID NO: 687543 - RNA, 22 nt, Haemophilus influenzae Rd
ccauaguggcaauaacuacaac

SEQ ID NO: 687544 - RNA, 15 nt, Haemophilus influenzae Rd
ccauauaccaauaau

SEQ ID NO: 687545 - RNA, 12 nt, Haemophilus influenzae Rd
ccauauucuuuc

SEQ ID NO: 687546 - RNA, 20 nt, Haemophilus influenzae Rd
ccauauucuuucgccaacca

SEQ ID NO: 687547 - RNA, 17 nt, Haemophilus influenzae Rd
ccauauacuugccaaaa

SEQ ID NO: 687548 - RNA, 17 nt, Haemophilus influenzae Rd
ccaucacauuuucaaau

SEQ ID NO: 687549 - RNA, 22 nt, Haemophilus influenzae Rd
ccauauuuucccaguaaauauc

SEQ ID NO: 687550 - RNA, 21 nt, Haemophilus influenzae Rd
ccaucaaaagaucauuuuuuu

SEQ ID NO: 687551 - RNA, 17 nt, Haemophilus influenzae Rd
ccaucccagucaaaaau

SEQ ID NO: 687552 - RNA, 20 nt, Haemophilus influenzae Rd
ccauccauaacggcaagcaa

SEQ ID NO: 687553 - RNA, 18 nt, Haemophilus influenzae Rd
ccaucugauuuuguggca

SEQ ID NO: 687554 - RNA, 21 nt, Haemophilus influenzae Rd
ccaucuaauugugcuaaauaa

SEQ ID NO: 687555 - RNA, 23 nt, Haemophilus influenzae Rd
ccaugaugaaauaauucauguuu

SEQ ID NO: 687556 - RNA, 23 nt, Haemophilus influenzae Rd
ccaugaugaugggaugaaaucaa

SEQ ID NO: 687557 - RNA, 20 nt, Haemophilus influenzae Rd
ccaugacaagcaaccugugg

SEQ ID NO: 687558 - RNA, 11 nt, Haemophilus influenzae Rd
ccaucuucaac

SEQ ID NO: 687559 - RNA, 13 nt, Haemophilus influenzae Rd
ccaugccuguucu

SEQ ID NO: 687560 - RNA, 15 nt, Haemophilus influenzae Rd
ccauggcuuuuuccu

SEQ ID NO: 687561 - RNA, 16 nt, Haemophilus influenzae Rd
ccauggcuuuuuccug

SEQ ID NO: 687562 - RNA, 17 nt, Haemophilus influenzae Rd
ccauggcuuuuuccuga

SEQ ID NO: 687563 - RNA, 22 nt, Haemophilus influenzae Rd
ccauuggggcgaccauuacagc

SEQ ID NO: 687564 - RNA, 17 nt, Haemophilus influenzae Rd
ccauuggaaaaugcuua

SEQ ID NO: 687565 - RNA, 15 nt, Haemophilus influenzae Rd
ccauucucuaacgca

SEQ ID NO: 687566 - RNA, 19 nt, Haemophilus influenzae Rd
ccauucguucccaaauauc

SEQ ID NO: 687567 - RNA, 15 nt, Haemophilus influenzae Rd
ccauucuaaaaaaau

SEQ ID NO: 687568 - RNA, 22 nt, Haemophilus influenzae Rd
ccauucuaaugagcguuuaacu

SEQ ID NO: 687569 - RNA, 17 nt, Haemophilus influenzae Rd
ccauucuguaaacuaaa

SEQ ID NO: 687570 - RNA, 22 nt, Haemophilus influenzae Rd
ccauucuguaaacuaaaucuug

SEQ ID NO: 687571 - RNA, 14 nt, Haemophilus influenzae Rd
ccauucacuuucac

SEQ ID NO: 687572 - RNA, 16 nt, Haemophilus influenzae Rd
ccauucacuuucacau

SEQ ID NO: 687573 - RNA, 18 nt, Haemophilus influenzae Rd
ccauucacguucuuuaau

SEQ ID NO: 687574 - RNA, 14 nt, Haemophilus influenzae Rd
ccauucacuacaca

SEQ ID NO: 687575 - RNA, 18 nt, Haemophilus influenzae Rd
ccauuccacaagccacau

SEQ ID NO: 687576 - RNA, 15 nt, Haemophilus influenzae Rd
ccauuccacccauac

SEQ ID NO: 687577 - RNA, 19 nt, Haemophilus influenzae Rd
ccauuaguuguuuuaguuc

SEQ ID NO: 687578 - RNA, 21 nt, Haemophilus influenzae Rd
ccauuauuuuucucauaauag

SEQ ID NO: 687579 - RNA, 13 nt, Haemophilus influenzae Rd
ccauuaaaagaag

SEQ ID NO: 687580 - RNA, 21 nt, Haemophilus influenzae Rd
ccauuaaauccugacaaccug

SEQ ID NO: 687581 - RNA, 17 nt, Haemophilus influenzae Rd
ccauuaaauaaaaauga

SEQ ID NO: 687582 - RNA, 19 nt, Haemophilus influenzae Rd
ccauuaaauaaaaaugaug

SEQ ID NO: 687583 - RNA, 11 nt, Haemophilus influenzae Rd
ccauuacaagc

SEQ ID NO: 687584 - RNA, 18 nt, Haemophilus influenzae Rd
ccauuaauacuuuugcac

SEQ ID NO: 687585 - RNA, 18 nt, Haemophilus influenzae Rd
ccauuaaugguauuguga

SEQ ID NO: 687586 - RNA, 17 nt, Haemophilus influenzae Rd
ccauuaacuaaaccauu

SEQ ID NO: 687587 - RNA, 21 nt, Haemophilus influenzae Rd
ccauuaaccaacauaaacauu

SEQ ID NO: 687588 - RNA, 15 nt, Haemophilus influenzae Rd
cccacugauuuuucu

SEQ ID NO: 687589 - RNA, 14 nt, Haemophilus influenzae Rd
cccaccgcaaaagc

SEQ ID NO: 687590 - RNA, 19 nt, Haemophilus influenzae Rd
cccacuucgauauuuuccg

SEQ ID NO: 687591 - RNA, 11 nt, Haemophilus influenzae Rd
cccagaauggu

SEQ ID NO: 687592 - RNA, 19 nt, Haemophilus influenzae Rd
cccagaauuaagaucuaaa

SEQ ID NO: 687593 - RNA, 18 nt, Haemophilus influenzae Rd
cccaauuuaccugauuca

SEQ ID NO: 687594 - RNA, 23 nt, Haemophilus influenzae Rd
cccaauuaccugaugaaaucauu

SEQ ID NO: 687595 - RNA, 15 nt, Haemophilus influenzae Rd
cccaauuauuggauu

SEQ ID NO: 687596 - RNA, 15 nt, Haemophilus influenzae Rd
cccaauauuuuucau

SEQ ID NO: 687597 - RNA, 18 nt, Haemophilus influenzae Rd
cccaagcuuuuucuuguu

SEQ ID NO: 687598 - RNA, 16 nt, Haemophilus influenzae Rd
cccaagccaauuauuu

SEQ ID NO: 687599 - RNA, 13 nt, Haemophilus influenzae Rd
cccaagauuuuau

SEQ ID NO: 687600 - RNA, 11 nt, Haemophilus influenzae Rd
ccauugugaug

SEQ ID NO: 687601 - RNA, 12 nt, Haemophilus influenzae Rd
ccccucauguuu

SEQ ID NO: 687602 - RNA, 16 nt, Haemophilus influenzae Rd
cccauuucuaaugcaa

SEQ ID NO: 687603 - RNA, 15 nt, Haemophilus influenzae Rd
cccauuugaauuuua

SEQ ID NO: 687604 - RNA, 15 nt, Haemophilus influenzae Rd
cccauuggaagauuu

SEQ ID NO: 687605 - RNA, 18 nt, Haemophilus influenzae Rd
cccauuggaagauuucuu

SEQ ID NO: 687606 - RNA, 21 nt, Haemophilus influenzae Rd
cccauuggaauauacaguuca

SEQ ID NO: 687607 - RNA, 14 nt, Haemophilus influenzae Rd
ccccauaucucugc

SEQ ID NO: 687608 - RNA, 17 nt, Haemophilus influenzae Rd
ccccauuauugugaugg

SEQ ID NO: 687609 - RNA, 13 nt, Haemophilus influenzae Rd
cccaguuuaccgc

SEQ ID NO: 687610 - RNA, 18 nt, Haemophilus influenzae Rd
cccaguuuaccgccaagu

SEQ ID NO: 687611 - RNA, 21 nt, Haemophilus influenzae Rd
cccauagcggauaaccaaaau

SEQ ID NO: 687612 - RNA, 19 nt, Haemophilus influenzae Rd
cccauaagugagaaaauac

SEQ ID NO: 687613 - RNA, 20 nt, Haemophilus influenzae Rd
cagcuaaaaaugaauuaguu

SEQ ID NO: 687614 - RNA, 17 nt, Haemophilus influenzae Rd
cagcuaagccaauaauu

SEQ ID NO: 687615 - RNA, 15 nt, Haemophilus influenzae Rd
cagcuaauaacacau

SEQ ID NO: 687616 - RNA, 17 nt, Haemophilus influenzae Rd
cagcuaacggcaaauaa

SEQ ID NO: 687617 - RNA, 19 nt, Haemophilus influenzae Rd
cagcuaauccaaaucaagc

SEQ ID NO: 687618 - RNA, 15 nt, Haemophilus influenzae Rd
cagcuaauaggcuua

SEQ ID NO: 687619 - RNA, 18 nt, Haemophilus influenzae Rd
cacugaggcuaauaauaa

SEQ ID NO: 687620 - RNA, 20 nt, Haemophilus influenzae Rd
cacugaggcuaauaauaaaa

SEQ ID NO: 687621 - RNA, 21 nt, Haemophilus influenzae Rd
cagcuaccguagauuccuaau

SEQ ID NO: 687622 - RNA, 16 nt, Haemophilus influenzae Rd
cagcuacauucaucaa

SEQ ID NO: 687623 - RNA, 20 nt, Haemophilus influenzae Rd
cagcuacauucaucaaaaca

SEQ ID NO: 687624 - RNA, 19 nt, Haemophilus influenzae Rd
cagcugauaaguucauaaa

SEQ ID NO: 687625 - RNA, 20 nt, Haemophilus influenzae Rd
cagcugauaaguucauaaaa

SEQ ID NO: 687626 - RNA, 22 nt, Haemophilus influenzae Rd
cagcugcaauaucaaucccacu

SEQ ID NO: 687627 - RNA, 19 nt, Haemophilus influenzae Rd
cagcugcacaagcaccacu

SEQ ID NO: 687628 - RNA, 19 nt, Haemophilus influenzae Rd
caggaaaaccacaagaugg

SEQ ID NO: 687629 - RNA, 19 nt, Haemophilus influenzae Rd
cagcuuuaaggcacagauu

SEQ ID NO: 687630 - RNA, 22 nt, Haemophilus influenzae Rd
cagcuuuacccgggccaaauaa

SEQ ID NO: 687631 - RNA, 23 nt, Haemophilus influenzae Rd
cagcuuuacucauaucuaaagca

SEQ ID NO: 687632 - RNA, 17 nt, Haemophilus influenzae Rd
cagcuugcgccauugaa

SEQ ID NO: 687633 - RNA, 23 nt, Haemophilus influenzae Rd
caggcaacucaguuuuugaggaa

SEQ ID NO: 687634 - RNA, 15 nt, Haemophilus influenzae Rd
caggaacauucacac

SEQ ID NO: 687635 - RNA, 23 nt, Haemophilus influenzae Rd
caggcgaaaccgccuuugauaau

SEQ ID NO: 687636 - RNA, 22 nt, Haemophilus influenzae Rd
caggcuucaauuugagaaauaa

SEQ ID NO: 687637 - RNA, 21 nt, Haemophilus influenzae Rd
caggcuugaguuucgccagca

SEQ ID NO: 687638 - RNA, 16 nt, Haemophilus influenzae Rd
caggcuuucacuauuu

SEQ ID NO: 687639 - RNA, 18 nt, Haemophilus influenzae Rd
caggcuuucacuauuuca

SEQ ID NO: 687640 - RNA, 16 nt, Haemophilus influenzae Rd
caggcuuucauuuucc

SEQ ID NO: 687641 - RNA, 14 nt, Haemophilus influenzae Rd
cagggaaaaauuuu

SEQ ID NO: 687642 - RNA, 21 nt, Haemophilus influenzae Rd
cagguaauuggugugcaauac

SEQ ID NO: 687643 - RNA, 18 nt, Haemophilus influenzae Rd
cagggauuucaauaaauu

SEQ ID NO: 687644 - RNA, 15 nt, Haemophilus influenzae Rd
cagggauuaagaaaa

SEQ ID NO: 687645 - RNA, 15 nt, Haemophilus influenzae Rd
cagguauuucuucaa

SEQ ID NO: 687646 - RNA, 19 nt, Haemophilus influenzae Rd
caggucgagggucaaaaga

SEQ ID NO: 687647 - RNA, 21 nt, Haemophilus influenzae Rd
caggucgagggucaaaagaaa

SEQ ID NO: 687648 - RNA, 12 nt, Haemophilus influenzae Rd
caguacaauuaa

SEQ ID NO: 687649 - RNA, 16 nt, Haemophilus influenzae Rd
caguaccuuuaauuaa

SEQ ID NO: 687650 - RNA, 19 nt, Haemophilus influenzae Rd
caguauuaaucugauaaau

SEQ ID NO: 687651 - RNA, 16 nt, Haemophilus influenzae Rd
caguaucuggcucaau

SEQ ID NO: 687652 - RNA, 22 nt, Haemophilus influenzae Rd
cagguucaaaacgcucaacaua

SEQ ID NO: 687653 - RNA, 14 nt, Haemophilus influenzae Rd
caguaaauuuuucc

SEQ ID NO: 687654 - RNA, 15 nt, Haemophilus influenzae Rd
caguuauucuucaga

SEQ ID NO: 687655 - RNA, 18 nt, Haemophilus influenzae Rd
caguuauucuucagaacu

SEQ ID NO: 687656 - RNA, 13 nt, Haemophilus influenzae Rd
caguuauuuuuua

SEQ ID NO: 687657 - RNA, 17 nt, Haemophilus influenzae Rd
caguuaaggauuuuuga

SEQ ID NO: 687658 - RNA, 15 nt, Haemophilus influenzae Rd
caguuaagaaaauaa

SEQ ID NO: 687659 - RNA, 16 nt, Haemophilus influenzae Rd
caguuaagaaaauaau

SEQ ID NO: 687660 - RNA, 19 nt, Haemophilus influenzae Rd
caguuaauuagaauaacaa

SEQ ID NO: 687661 - RNA, 20 nt, Haemophilus influenzae Rd
caguuaauuagaauaacaac

SEQ ID NO: 687662 - RNA, 20 nt, Haemophilus influenzae Rd
caguuacuuauuuagcaagc

SEQ ID NO: 687663 - RNA, 14 nt, Haemophilus influenzae Rd
caguuaucgccaau

SEQ ID NO: 687664 - RNA, 15 nt, Haemophilus influenzae Rd
caguuaugcaaauac

SEQ ID NO: 687665 - RNA, 22 nt, Haemophilus influenzae Rd
cagugauuuucacauccacaaa

SEQ ID NO: 687666 - RNA, 22 nt, Haemophilus influenzae Rd
cagugaucccagcauaaauaaa

SEQ ID NO: 687667 - RNA, 15 nt, Haemophilus influenzae Rd
cagugauuauauuuu

SEQ ID NO: 687668 - RNA, 13 nt, Haemophilus influenzae Rd
cagugauguaaau

SEQ ID NO: 687669 - RNA, 18 nt, Haemophilus influenzae Rd
caguggggaauaaaauaa

SEQ ID NO: 687670 - RNA, 20 nt, Haemophilus influenzae Rd
cagugggagaacuuuuaaaa

SEQ ID NO: 687671 - RNA, 19 nt, Haemophilus influenzae Rd
cauaagcauuuugauaauu

SEQ ID NO: 687672 - RNA, 13 nt, Haemophilus influenzae Rd
cauaagcaauaau

SEQ ID NO: 687673 - RNA, 20 nt, Haemophilus influenzae Rd
cauaagcugcaucaauauug

SEQ ID NO: 687674 - RNA, 16 nt, Haemophilus influenzae Rd
cauaaaguauacuuuu

SEQ ID NO: 687675 - RNA, 16 nt, Haemophilus influenzae Rd
cauaaagcucagccaa

SEQ ID NO: 687676 - RNA, 13 nt, Haemophilus influenzae Rd
cauaacuuaaauu

SEQ ID NO: 687677 - RNA, 18 nt, Haemophilus influenzae Rd
cauaacuuaaauuuuuau

SEQ ID NO: 687678 - RNA, 19 nt, Haemophilus influenzae Rd
cauaacuuaugaauaauaa

SEQ ID NO: 687679 - RNA, 19 nt, Haemophilus influenzae Rd
cauaacuuuccauauaaca

SEQ ID NO: 687680 - RNA, 12 nt, Haemophilus influenzae Rd
cauaacuuuuug

SEQ ID NO: 687681 - RNA, 13 nt, Haemophilus influenzae Rd
cauaauauuuuua

SEQ ID NO: 687682 - RNA, 16 nt, Haemophilus influenzae Rd
cauaauauuuuuacuc

SEQ ID NO: 687683 - RNA, 18 nt, Haemophilus influenzae Rd
cauaauaggcgcguaaua

SEQ ID NO: 687684 - RNA, 15 nt, Haemophilus influenzae Rd
cauaaucaggcugug

SEQ ID NO: 687685 - RNA, 17 nt, Haemophilus influenzae Rd
cauaauccacuaaaaac

SEQ ID NO: 687686 - RNA, 13 nt, Haemophilus influenzae Rd
cauaaguccaagu

SEQ ID NO: 687687 - RNA, 15 nt, Haemophilus influenzae Rd
cauaagugagaaaau

SEQ ID NO: 687688 - RNA, 17 nt, Haemophilus influenzae Rd
cauaagugagaaaauac

SEQ ID NO: 687689 - RNA, 13 nt, Haemophilus influenzae Rd
cauaaguaaaaua

SEQ ID NO: 687690 - RNA, 14 nt, Haemophilus influenzae Rd
cauaaguaaaauag

SEQ ID NO: 687691 - RNA, 17 nt, Haemophilus influenzae Rd
cauaaguaaaauaguca

SEQ ID NO: 687692 - RNA, 23 nt, Haemophilus influenzae Rd
cauaaguaugugauguaauauua

SEQ ID NO: 687693 - RNA, 14 nt, Haemophilus influenzae Rd
cauaauacuugaac

SEQ ID NO: 687694 - RNA, 15 nt, Haemophilus influenzae Rd
cauaauagaaacuaa

SEQ ID NO: 687695 - RNA, 19 nt, Haemophilus influenzae Rd
cauaauagaaacuaaacuu

SEQ ID NO: 687696 - RNA, 12 nt, Haemophilus influenzae Rd
cauaauaaaaau

SEQ ID NO: 687697 - RNA, 13 nt, Haemophilus influenzae Rd
cauaauaaaaaaa

SEQ ID NO: 687698 - RNA, 15 nt, Haemophilus influenzae Rd
caguuuucauuuuuu

SEQ ID NO: 687699 - RNA, 16 nt, Haemophilus influenzae Rd
caguuuucauuuuuug

SEQ ID NO: 687700 - RNA, 13 nt, Haemophilus influenzae Rd
cauaaaauaauuu

SEQ ID NO: 687701 - RNA, 20 nt, Haemophilus influenzae Rd
cauaaaagugcgguaaaaaa

SEQ ID NO: 687702 - RNA, 21 nt, Haemophilus influenzae Rd
cauaaaagugcgguaaaaaaa

SEQ ID NO: 687703 - RNA, 14 nt, Haemophilus influenzae Rd
cauaaaaucuucua

SEQ ID NO: 687704 - RNA, 16 nt, Haemophilus influenzae Rd
cauaaacaaaauaaac

SEQ ID NO: 687705 - RNA, 12 nt, Haemophilus influenzae Rd
caguuuggaaag

SEQ ID NO: 687706 - RNA, 13 nt, Haemophilus influenzae Rd
caguuuggaaaga

SEQ ID NO: 687707 - RNA, 17 nt, Haemophilus influenzae Rd
caguuuggaaagaguaa

SEQ ID NO: 687708 - RNA, 19 nt, Haemophilus influenzae Rd
caguuuaucucuuucuuaa

SEQ ID NO: 687709 - RNA, 21 nt, Haemophilus influenzae Rd
caguuuaucucuuucuuaaaa

SEQ ID NO: 687710 - RNA, 13 nt, Haemophilus influenzae Rd
caguuucaagcac

SEQ ID NO: 687711 - RNA, 16 nt, Haemophilus influenzae Rd
caugaauuucuaauuu

SEQ ID NO: 687712 - RNA, 20 nt, Haemophilus influenzae Rd
caugaaguuggagauuuuuu

SEQ ID NO: 687713 - RNA, 19 nt, Haemophilus influenzae Rd
caugaauauugguuuuauu

SEQ ID NO: 687714 - RNA, 22 nt, Haemophilus influenzae Rd
caugaugaugggaugaaaucaa

SEQ ID NO: 687715 - RNA, 18 nt, Haemophilus influenzae Rd
caugagcugggcaaacaa

SEQ ID NO: 687716 - RNA, 18 nt, Haemophilus influenzae Rd
caugagcuucaaaaucac

SEQ ID NO: 687717 - RNA, 21 nt, Haemophilus influenzae Rd
caugaguuguuuuuucaguug

SEQ ID NO: 687718 - RNA, 23 nt, Haemophilus influenzae Rd
cauguaaacccacaacuuuuuca

SEQ ID NO: 687719 - RNA, 16 nt, Haemophilus influenzae Rd
cauguacauuaaugua

SEQ ID NO: 687720 - RNA, 22 nt, Haemophilus influenzae Rd
cauguaaauaguuauuuauucc

SEQ ID NO: 687721 - RNA, 15 nt, Haemophilus influenzae Rd
caugugguaauuaac

SEQ ID NO: 687722 - RNA, 18 nt, Haemophilus influenzae Rd
caugccgcaaucaagcaa

SEQ ID NO: 687723 - RNA, 15 nt, Haemophilus influenzae Rd
caugccaagcuaauu

SEQ ID NO: 687724 - RNA, 22 nt, Haemophilus influenzae Rd
caugccaagcuaauugguaaaa

SEQ ID NO: 687725 - RNA, 18 nt, Haemophilus influenzae Rd
cauggcgaccauucucua

SEQ ID NO: 687726 - RNA, 18 nt, Haemophilus influenzae Rd
cauggccaauuucaucgc

SEQ ID NO: 687727 - RNA, 22 nt, Haemophilus influenzae Rd
caugcugagugaaaccugcuug

SEQ ID NO: 687728 - RNA, 17 nt, Haemophilus influenzae Rd
cauuaguaucuuccauu

SEQ ID NO: 687729 - RNA, 18 nt, Haemophilus influenzae Rd
cauuacgugcaaauaaau

SEQ ID NO: 687730 - RNA, 19 nt, Haemophilus influenzae Rd
cauuacgugcaaauaaauu

SEQ ID NO: 687731 - RNA, 19 nt, Haemophilus influenzae Rd
cauuacggcaggaaugaaa

SEQ ID NO: 687732 - RNA, 12 nt, Haemophilus influenzae Rd
cauuauugugau

SEQ ID NO: 687733 - RNA, 23 nt, Haemophilus influenzae Rd
cauuauugugauggggauuuuuu

SEQ ID NO: 687734 - RNA, 19 nt, Haemophilus influenzae Rd
cauuauuuaauuuuuuaua

SEQ ID NO: 687735 - RNA, 15 nt, Haemophilus influenzae Rd
cauuaucaaaugcca

SEQ ID NO: 687736 - RNA, 21 nt, Haemophilus influenzae Rd
cauuauauuccuuauucaaau

SEQ ID NO: 687737 - RNA, 23 nt, Haemophilus influenzae Rd
cauucaaucuuuuuguuaauaaa

SEQ ID NO: 687738 - RNA, 22 nt, Haemophilus influenzae Rd
cauucaaugcagaaauacuuuu

SEQ ID NO: 687739 - RNA, 20 nt, Haemophilus influenzae Rd
cauucacaccuaaguaaguc

SEQ ID NO: 687740 - RNA, 19 nt, Haemophilus influenzae Rd
cauucacaggguucagccc

SEQ ID NO: 687741 - RNA, 16 nt, Haemophilus influenzae Rd
cauucacauucuuuua

SEQ ID NO: 687742 - RNA, 21 nt, Haemophilus influenzae Rd
cauucacauucuuuuaaauac

SEQ ID NO: 687743 - RNA, 14 nt, Haemophilus influenzae Rd
cauucaaaaauaaa

SEQ ID NO: 687744 - RNA, 21 nt, Haemophilus influenzae Rd
cauucaaaaauaaagcccugu

SEQ ID NO: 687745 - RNA, 18 nt, Haemophilus influenzae Rd
cauuauuuuuacaaauag

SEQ ID NO: 687746 - RNA, 16 nt, Haemophilus influenzae Rd
cauuauuuuuaucgac

SEQ ID NO: 687747 - RNA, 15 nt, Haemophilus influenzae Rd
cauucagcacuaauu

SEQ ID NO: 687748 - RNA, 17 nt, Haemophilus influenzae Rd
cauucacucggaaugcc

SEQ ID NO: 687749 - RNA, 15 nt, Haemophilus influenzae Rd
cauucacuuucacau

SEQ ID NO: 687750 - RNA, 20 nt, Haemophilus influenzae Rd
cauuccacgcuaaaaucuug

SEQ ID NO: 687751 - RNA, 23 nt, Haemophilus influenzae Rd
cauuccacgcuaaaaucuugcac

SEQ ID NO: 687752 - RNA, 13 nt, Haemophilus influenzae Rd
cauucauuuugag

SEQ ID NO: 687753 - RNA, 16 nt, Haemophilus influenzae Rd
cauucgccuaaugccu

SEQ ID NO: 687754 - RNA, 13 nt, Haemophilus influenzae Rd
cauucgcauauuu

SEQ ID NO: 687755 - RNA, 17 nt, Haemophilus influenzae Rd
cauucgcauauuuuugc

SEQ ID NO: 687756 - RNA, 12 nt, Haemophilus influenzae Rd
cauugcuaaauu

SEQ ID NO: 687757 - RNA, 18 nt, Haemophilus influenzae Rd
cauugcuaagggcaacaa

SEQ ID NO: 687758 - RNA, 20 nt, Haemophilus influenzae Rd
cauugcuauggcaaugaaua

SEQ ID NO: 687759 - RNA, 21 nt, Haemophilus influenzae Rd
cauugcuauggcaaugaauaa

SEQ ID NO: 687760 - RNA, 19 nt, Haemophilus influenzae Rd
cauuggugaaaggaaacgc

SEQ ID NO: 687761 - RNA, 16 nt, Haemophilus influenzae Rd
cauugccauuucugca

SEQ ID NO: 687762 - RNA, 15 nt, Haemophilus influenzae Rd
cauugaaaauacagu

SEQ ID NO: 687763 - RNA, 13 nt, Haemophilus influenzae Rd
cauucuuuuaaau

SEQ ID NO: 687764 - RNA, 15 nt, Haemophilus influenzae Rd
cauucuuuuaaauac

SEQ ID NO: 687765 - RNA, 23 nt, Haemophilus influenzae Rd
cauucuuuucgcaauucuuuuuc

SEQ ID NO: 687766 - RNA, 16 nt, Haemophilus influenzae Rd
cauugcaucagccacc

SEQ ID NO: 687767 - RNA, 15 nt, Haemophilus influenzae Rd
cauugcauccacuuc

SEQ ID NO: 687768 - RNA, 16 nt, Haemophilus influenzae Rd
cauugcauccacuuca

SEQ ID NO: 687769 - RNA, 14 nt, Haemophilus influenzae Rd
cauugcauuuuuau

SEQ ID NO: 687770 - RNA, 17 nt, Haemophilus influenzae Rd
cauugccaaagcauuua

SEQ ID NO: 687771 - RNA, 23 nt, Haemophilus influenzae Rd
cauucgguguucguuuguuugaa

SEQ ID NO: 687772 - RNA, 13 nt, Haemophilus influenzae Rd
cauuucauuugag

SEQ ID NO: 687773 - RNA, 19 nt, Haemophilus influenzae Rd
cauuucauaacguuuacga

SEQ ID NO: 687774 - RNA, 16 nt, Haemophilus influenzae Rd
cauuucaucuacacca

SEQ ID NO: 687775 - RNA, 17 nt, Haemophilus influenzae Rd
cauuucaucuacaccaa

SEQ ID NO: 687776 - RNA, 14 nt, Haemophilus influenzae Rd
cauuucacuaaaua

SEQ ID NO: 687777 - RNA, 23 nt, Haemophilus influenzae Rd
cauuucccucaagacaaauuugu

SEQ ID NO: 687778 - RNA, 13 nt, Haemophilus influenzae Rd
cauuucccauaau

SEQ ID NO: 687779 - RNA, 13 nt, Haemophilus influenzae Rd
cauuuccugugca

SEQ ID NO: 687780 - RNA, 17 nt, Haemophilus influenzae Rd
cauuucgcuugagugau

SEQ ID NO: 687781 - RNA, 18 nt, Haemophilus influenzae Rd
cauuucgcggacuuuuuu

SEQ ID NO: 687782 - RNA, 16 nt, Haemophilus influenzae Rd
cauuuauggaaauaaa

SEQ ID NO: 687783 - RNA, 17 nt, Haemophilus influenzae Rd
cauuuauggaaauaaau

SEQ ID NO: 687784 - RNA, 18 nt, Haemophilus influenzae Rd
cauuuagguuagaauaaa

SEQ ID NO: 687785 - RNA, 13 nt, Haemophilus influenzae Rd
cauuuaucaaaca

SEQ ID NO: 687786 - RNA, 16 nt, Haemophilus influenzae Rd
cauuucaauaucaauc

SEQ ID NO: 687787 - RNA, 19 nt, Haemophilus influenzae Rd
cauuucaagcuuugcaaca

SEQ ID NO: 687788 - RNA, 16 nt, Haemophilus influenzae Rd
cauuguaguuuuucac

SEQ ID NO: 687789 - RNA, 18 nt, Haemophilus influenzae Rd
cauugucauaccccaaac

SEQ ID NO: 687790 - RNA, 19 nt, Haemophilus influenzae Rd
cauugucauaccccaaacu

SEQ ID NO: 687791 - RNA, 14 nt, Haemophilus influenzae Rd
cauuguaaaccaaa

SEQ ID NO: 687792 - RNA, 19 nt, Haemophilus influenzae Rd
cauuguaaaccaaauuucu

SEQ ID NO: 687793 - RNA, 16 nt, Haemophilus influenzae Rd
cauuuagagggauaaa

SEQ ID NO: 687794 - RNA, 13 nt, Haemophilus influenzae Rd
cauuuauaaaaug

SEQ ID NO: 687795 - RNA, 21 nt, Haemophilus influenzae Rd
cauuguccacagcaaaagaaa

SEQ ID NO: 687796 - RNA, 23 nt, Haemophilus influenzae Rd
cauuuacggcuuagauaauaaaa

SEQ ID NO: 687797 - RNA, 23 nt, Haemophilus influenzae Rd
caucagcuccuacauuaaaagau

SEQ ID NO: 687798 - RNA, 15 nt, Haemophilus influenzae Rd
caucauuaauacaca

SEQ ID NO: 687799 - RNA, 22 nt, Haemophilus influenzae Rd
caucauuaauacacaaaaucca

SEQ ID NO: 687800 - RNA, 14 nt, Haemophilus influenzae Rd
cauccaaaguacac

SEQ ID NO: 687801 - RNA, 15 nt, Haemophilus influenzae Rd
caucauuacuuuuuu

SEQ ID NO: 687802 - RNA, 21 nt, Haemophilus influenzae Rd
caucauuaugaaaaaaagaaa

SEQ ID NO: 687803 - RNA, 16 nt, Haemophilus influenzae Rd
cauccaauguugcaau

SEQ ID NO: 687804 - RNA, 19 nt, Haemophilus influenzae Rd
cauccauaacggcaagcaa

SEQ ID NO: 687805 - RNA, 22 nt, Haemophilus influenzae Rd
cauccgcaauuaauccaucauu

SEQ ID NO: 687806 - RNA, 14 nt, Haemophilus influenzae Rd
caucgcuucaucau

SEQ ID NO: 687807 - RNA, 16 nt, Haemophilus influenzae Rd
caucgcugaaauuaau

SEQ ID NO: 687808 - RNA, 14 nt, Haemophilus influenzae Rd
caucgcugccuaau

SEQ ID NO: 687809 - RNA, 15 nt, Haemophilus influenzae Rd
caucgcaucuguauc

SEQ ID NO: 687810 - RNA, 16 nt, Haemophilus influenzae Rd
caucgcaucuguaucu

SEQ ID NO: 687811 - RNA, 13 nt, Haemophilus influenzae Rd
caucgcagugauc

SEQ ID NO: 687812 - RNA, 16 nt, Haemophilus influenzae Rd
caucgcaucaaaggcu

SEQ ID NO: 687813 - RNA, 14 nt, Haemophilus influenzae Rd
caucguauuuccua

SEQ ID NO: 687814 - RNA, 15 nt, Haemophilus influenzae Rd
caucgugaugauuuu

SEQ ID NO: 687815 - RNA, 13 nt, Haemophilus influenzae Rd
caucgucuucuuc

SEQ ID NO: 687816 - RNA, 19 nt, Haemophilus influenzae Rd
caucguuaaaccaaauaau

SEQ ID NO: 687817 - RNA, 19 nt, Haemophilus influenzae Rd
caucguguugccauuuuug

SEQ ID NO: 687818 - RNA, 23 nt, Haemophilus influenzae Rd
caucucaaaugugaaaacuacuu

SEQ ID NO: 687819 - RNA, 20 nt, Haemophilus influenzae Rd
caucucaaggcgauccugau

SEQ ID NO: 687820 - RNA, 15 nt, Haemophilus influenzae Rd
caucuaaaaauaauu

SEQ ID NO: 687821 - RNA, 21 nt, Haemophilus influenzae Rd
caucuaaaaauaauuuuacuu

SEQ ID NO: 687822 - RNA, 11 nt, Haemophilus influenzae Rd
caucuaacaca

SEQ ID NO: 687823 - RNA, 13 nt, Haemophilus influenzae Rd
caucuaacacaau

SEQ ID NO: 687824 - RNA, 18 nt, Haemophilus influenzae Rd
caucuaauucacuaccuc

SEQ ID NO: 687825 - RNA, 22 nt, Haemophilus influenzae Rd
caucuaauugugcuaaauaauu

SEQ ID NO: 687826 - RNA, 18 nt, Haemophilus influenzae Rd
caucuaaguauucaugau

SEQ ID NO: 687827 - RNA, 13 nt, Haemophilus influenzae Rd
caucuaauaauaa

SEQ ID NO: 687828 - RNA, 20 nt, Haemophilus influenzae Rd
caucuaccacgauaaauccu

SEQ ID NO: 687829 - RNA, 15 nt, Haemophilus influenzae Rd
caucuacccaauaaa

SEQ ID NO: 687830 - RNA, 16 nt, Haemophilus influenzae Rd
caucuacccacacacc

SEQ ID NO: 687831 - RNA, 17 nt, Haemophilus influenzae Rd
caucaaucauaaaaaca

SEQ ID NO: 687832 - RNA, 17 nt, Haemophilus influenzae Rd
caucaaugccauuuuuu

SEQ ID NO: 687833 - RNA, 18 nt, Haemophilus influenzae Rd
caucaauaccuaacguua

SEQ ID NO: 687834 - RNA, 11 nt, Haemophilus influenzae Rd
caucaauauua

SEQ ID NO: 687835 - RNA, 13 nt, Haemophilus influenzae Rd
caucaauaucugc

SEQ ID NO: 687836 - RNA, 18 nt, Haemophilus influenzae Rd
caucaaagcguucauuuu

SEQ ID NO: 687837 - RNA, 21 nt, Haemophilus influenzae Rd
caucaaagcguucauuuugau

SEQ ID NO: 687838 - RNA, 18 nt, Haemophilus influenzae Rd
caucaaagcguuuuucua

SEQ ID NO: 687839 - RNA, 17 nt, Haemophilus influenzae Rd
caucaaagcucaccugc

SEQ ID NO: 687840 - RNA, 21 nt, Haemophilus influenzae Rd
cauauuucugcaaauaaagaa

SEQ ID NO: 687841 - RNA, 18 nt, Haemophilus influenzae Rd
cauauuugaaguugccau

SEQ ID NO: 687842 - RNA, 23 nt, Haemophilus influenzae Rd
caucaaauugaugcucugcuagu

SEQ ID NO: 687843 - RNA, 21 nt, Haemophilus influenzae Rd
caucaaauccgccaaucauac

SEQ ID NO: 687844 - RNA, 15 nt, Haemophilus influenzae Rd
caucaaauccuuguu

SEQ ID NO: 687845 - RNA, 22 nt, Haemophilus influenzae Rd
cauaucgacaaccguugcauug

SEQ ID NO: 687846 - RNA, 19 nt, Haemophilus influenzae Rd
cauauucgacaauuucugc

SEQ ID NO: 687847 - RNA, 16 nt, Haemophilus influenzae Rd
cauauucccaaggcuc

SEQ ID NO: 687848 - RNA, 11 nt, Haemophilus influenzae Rd
cauauuuaaaa

SEQ ID NO: 687849 - RNA, 19 nt, Haemophilus influenzae Rd
cauauugaacacucuaauc

SEQ ID NO: 687850 - RNA, 23 nt, Haemophilus influenzae Rd
cauauucgcuuucauaaauucau

SEQ ID NO: 687851 - RNA, 15 nt, Haemophilus influenzae Rd
caucaccaagaauca

SEQ ID NO: 687852 - RNA, 12 nt, Haemophilus influenzae Rd
caucacauccac

SEQ ID NO: 687853 - RNA, 18 nt, Haemophilus influenzae Rd
caucacauccacaaaaaa

SEQ ID NO: 687854 - RNA, 15 nt, Haemophilus influenzae Rd
caucaauucuuccca

SEQ ID NO: 687855 - RNA, 16 nt, Haemophilus influenzae Rd
caucaauucuucccaa

SEQ ID NO: 687856 - RNA, 19 nt, Haemophilus influenzae Rd
caucacaacuugcaaccau

SEQ ID NO: 687857 - RNA, 13 nt, Haemophilus influenzae Rd
caucaccacaaaa

SEQ ID NO: 687858 - RNA, 17 nt, Haemophilus influenzae Rd
caucacguaauacaaaa

SEQ ID NO: 687859 - RNA, 18 nt, Haemophilus influenzae Rd
caucacguaauacaaaau

SEQ ID NO: 687860 - RNA, 17 nt, Haemophilus influenzae Rd
caucacguucaaaaaua

SEQ ID NO: 687861 - RNA, 14 nt, Haemophilus influenzae Rd
caucacuugugcua

SEQ ID NO: 687862 - RNA, 20 nt, Haemophilus influenzae Rd
caucacucguugguauuuac

SEQ ID NO: 687863 - RNA, 19 nt, Haemophilus influenzae Rd
caucagauuuuucgcauuu

SEQ ID NO: 687864 - RNA, 18 nt, Haemophilus influenzae Rd
cauaguucacuaaaaauc

SEQ ID NO: 687865 - RNA, 22 nt, Haemophilus influenzae Rd
cauaguugaugaaccauaaaca

SEQ ID NO: 687866 - RNA, 19 nt, Haemophilus influenzae Rd
cauaguuuuccauuuuuga

SEQ ID NO: 687867 - RNA, 22 nt, Haemophilus influenzae Rd
cauaguuuggcugaaauucuaa

SEQ ID NO: 687868 - RNA, 20 nt, Haemophilus influenzae Rd
cauagucgcuggaacuucua

SEQ ID NO: 687869 - RNA, 14 nt, Haemophilus influenzae Rd
cauauaaaauaaag

SEQ ID NO: 687870 - RNA, 22 nt, Haemophilus influenzae Rd
cauaucagguaauuggugugca

SEQ ID NO: 687871 - RNA, 20 nt, Haemophilus influenzae Rd
cauauacuucuuuagcugca

SEQ ID NO: 687872 - RNA, 14 nt, Haemophilus influenzae Rd
cauauagacaacua

SEQ ID NO: 687873 - RNA, 16 nt, Haemophilus influenzae Rd
cauagcugaaaaauaa

SEQ ID NO: 687874 - RNA, 20 nt, Haemophilus influenzae Rd
cauagcugaaaaauaaaaaa

SEQ ID NO: 687875 - RNA, 23 nt, Haemophilus influenzae Rd
cauagcugaaaaauaaaaaauau

SEQ ID NO: 687876 - RNA, 14 nt, Haemophilus influenzae Rd
cauaggacaggcua

SEQ ID NO: 687877 - RNA, 14 nt, Haemophilus influenzae Rd
cauaguaaauuuua

SEQ ID NO: 687878 - RNA, 16 nt, Haemophilus influenzae Rd
cauagauaacuucuuc

SEQ ID NO: 687879 - RNA, 19 nt, Haemophilus influenzae Rd
cauagauaacuucuucauu

SEQ ID NO: 687880 - RNA, 18 nt, Haemophilus influenzae Rd
cauagauugaaaaguaaa

SEQ ID NO: 687881 - RNA, 14 nt, Haemophilus influenzae Rd
cauagauuuaagcu

SEQ ID NO: 687882 - RNA, 15 nt, Haemophilus influenzae Rd
cauagauaaauauau

SEQ ID NO: 687883 - RNA, 17 nt, Haemophilus influenzae Rd
cauagcacguaaugcaa

SEQ ID NO: 687884 - RNA, 14 nt, Haemophilus influenzae Rd
cauagccuuuuucu

SEQ ID NO: 687885 - RNA, 18 nt, Haemophilus influenzae Rd
cauaauguucccuauaaa

SEQ ID NO: 687886 - RNA, 23 nt, Haemophilus influenzae Rd
cauaauguucccuauaaauaaac

SEQ ID NO: 687887 - RNA, 21 nt, Haemophilus influenzae Rd
cauaauuaccugugaaaacac

SEQ ID NO: 687888 - RNA, 19 nt, Haemophilus influenzae Rd
cauaauggcuuaauaaugg

SEQ ID NO: 687889 - RNA, 20 nt, Haemophilus influenzae Rd
cauaauuaaggcugcugaau

SEQ ID NO: 687890 - RNA, 20 nt, Haemophilus influenzae Rd
cauaauugugggaaaguugg

SEQ ID NO: 687891 - RNA, 14 nt, Haemophilus influenzae Rd
cauaauuuauauua

SEQ ID NO: 687892 - RNA, 19 nt, Haemophilus influenzae Rd
cauaauuucagcaucagaa

SEQ ID NO: 687893 - RNA, 20 nt, Haemophilus influenzae Rd
cauacaacgcucugcaccuu

SEQ ID NO: 687894 - RNA, 15 nt, Haemophilus influenzae Rd
cauacaaguauuuuc

SEQ ID NO: 687895 - RNA, 16 nt, Haemophilus influenzae Rd
cauacaaguauuuucc

SEQ ID NO: 687896 - RNA, 21 nt, Haemophilus influenzae Rd
cauacaaucucuagauuuuuu

SEQ ID NO: 687897 - RNA, 21 nt, Haemophilus influenzae Rd
cauagaaggcuaguucuuccu

SEQ ID NO: 687898 - RNA, 22 nt, Haemophilus influenzae Rd
cauagaaggcuaguucuuccuu

SEQ ID NO: 687899 - RNA, 15 nt, Haemophilus influenzae Rd
cauagaacguuuuuu

SEQ ID NO: 687900 - RNA, 14 nt, Haemophilus influenzae Rd
cauagacauuagua

SEQ ID NO: 687901 - RNA, 16 nt, Haemophilus influenzae Rd
caauucccaguaaucu

SEQ ID NO: 687902 - RNA, 22 nt, Haemophilus influenzae Rd
caauucccaguaaucuuuuaau

SEQ ID NO: 687903 - RNA, 14 nt, Haemophilus influenzae Rd
caauuccuucaaau

SEQ ID NO: 687904 - RNA, 19 nt, Haemophilus influenzae Rd
caauucuaguucuuccccu

SEQ ID NO: 687905 - RNA, 21 nt, Haemophilus influenzae Rd
caauucuaguucuuccccuca

SEQ ID NO: 687906 - RNA, 23 nt, Haemophilus influenzae Rd
caauucuauauuauuuaagccag

SEQ ID NO: 687907 - RNA, 21 nt, Haemophilus influenzae Rd
caauucucugacgcugaccac

SEQ ID NO: 687908 - RNA, 14 nt, Haemophilus influenzae Rd
caauugaugcacaa

SEQ ID NO: 687909 - RNA, 21 nt, Haemophilus influenzae Rd
caauugccgacacuaaaaagc

SEQ ID NO: 687910 - RNA, 22 nt, Haemophilus influenzae Rd
caauucuuuuuguaauuuuuga

SEQ ID NO: 687911 - RNA, 21 nt, Haemophilus influenzae Rd
caauugcucgugcaggauaaa

SEQ ID NO: 687912 - RNA, 19 nt, Haemophilus influenzae Rd
caauugggauuauuuuugu

SEQ ID NO: 687913 - RNA, 21 nt, Haemophilus influenzae Rd
caauugguaaaauuucuucua

SEQ ID NO: 687914 - RNA, 15 nt, Haemophilus influenzae Rd
caauuuaagcccugc

SEQ ID NO: 687915 - RNA, 17 nt, Haemophilus influenzae Rd
caauugugucauucgca

SEQ ID NO: 687916 - RNA, 17 nt, Haemophilus influenzae Rd
caauuguuguuggcaua

SEQ ID NO: 687917 - RNA, 19 nt, Haemophilus influenzae Rd
caauugugccguauuuuuu

SEQ ID NO: 687918 - RNA, 18 nt, Haemophilus influenzae Rd
caauuagcugguuuauuu

SEQ ID NO: 687919 - RNA, 22 nt, Haemophilus influenzae Rd
caauuagaugacuggcaaaaau

SEQ ID NO: 687920 - RNA, 16 nt, Haemophilus influenzae Rd
caauuagaugauuuua

SEQ ID NO: 687921 - RNA, 19 nt, Haemophilus influenzae Rd
caauuagaugauuuuaaaa

SEQ ID NO: 687922 - RNA, 22 nt, Haemophilus influenzae Rd
caauuagaugauuuuaaaauaa

SEQ ID NO: 687923 - RNA, 17 nt, Haemophilus influenzae Rd
caauuacgacauucuuu

SEQ ID NO: 687924 - RNA, 23 nt, Haemophilus influenzae Rd
caauuaccuuagccaaaucaucu

SEQ ID NO: 687925 - RNA, 19 nt, Haemophilus influenzae Rd
caauuauuggauugaauca

SEQ ID NO: 687926 - RNA, 13 nt, Haemophilus influenzae Rd
caauuauuggcaa

SEQ ID NO: 687927 - RNA, 17 nt, Haemophilus influenzae Rd
caauuauccgagagaaa

SEQ ID NO: 687928 - RNA, 21 nt, Haemophilus influenzae Rd
caauuauccgagagaaaguua

SEQ ID NO: 687929 - RNA, 18 nt, Haemophilus influenzae Rd
caauucacgagccaauac

SEQ ID NO: 687930 - RNA, 22 nt, Haemophilus influenzae Rd
caauucaaagaaguagccgccu

SEQ ID NO: 687931 - RNA, 18 nt, Haemophilus influenzae Rd
caauucacugcaacguua

SEQ ID NO: 687932 - RNA, 16 nt, Haemophilus influenzae Rd
caauucaaauuuuugu

SEQ ID NO: 687933 - RNA, 16 nt, Haemophilus influenzae Rd
caaucacuguaucuuu

SEQ ID NO: 687934 - RNA, 20 nt, Haemophilus influenzae Rd
caaucacuucucugacuaau

SEQ ID NO: 687935 - RNA, 14 nt, Haemophilus influenzae Rd
caaucagcaaaacu

SEQ ID NO: 687936 - RNA, 18 nt, Haemophilus influenzae Rd
caaucaggcuuucauuuu

SEQ ID NO: 687937 - RNA, 18 nt, Haemophilus influenzae Rd
caaucaggcgauccaucg

SEQ ID NO: 687938 - RNA, 16 nt, Haemophilus influenzae Rd
caauuaagcaauagcg

SEQ ID NO: 687939 - RNA, 15 nt, Haemophilus influenzae Rd
caauuaaggauuuau

SEQ ID NO: 687940 - RNA, 21 nt, Haemophilus influenzae Rd
caauuaaaucaaaaauuaaga

SEQ ID NO: 687941 - RNA, 18 nt, Haemophilus influenzae Rd
caauuaaccauaaaaaau

SEQ ID NO: 687942 - RNA, 19 nt, Haemophilus influenzae Rd
caauuaaguagauaacaaa

SEQ ID NO: 687943 - RNA, 23 nt, Haemophilus influenzae Rd
caauuaauaauaagccgaagaag

SEQ ID NO: 687944 - RNA, 16 nt, Haemophilus influenzae Rd
caauuaauacgucaau

SEQ ID NO: 687945 - RNA, 19 nt, Haemophilus influenzae Rd
caauuuuucggauuaagug

SEQ ID NO: 687946 - RNA, 13 nt, Haemophilus influenzae Rd
caauuuuucaaaa

SEQ ID NO: 687947 - RNA, 13 nt, Haemophilus influenzae Rd
caauuuuuaauuc

SEQ ID NO: 687948 - RNA, 18 nt, Haemophilus influenzae Rd
caauuuuugcauuuucag

SEQ ID NO: 687949 - RNA, 20 nt, Haemophilus influenzae Rd
cacaaaaaauucuuugccuu

SEQ ID NO: 687950 - RNA, 20 nt, Haemophilus influenzae Rd
caauuuucuucacugcaucu

SEQ ID NO: 687951 - RNA, 21 nt, Haemophilus influenzae Rd
caauuuucugugagucuugcu

SEQ ID NO: 687952 - RNA, 14 nt, Haemophilus influenzae Rd
caauuuguccuuua

SEQ ID NO: 687953 - RNA, 19 nt, Haemophilus influenzae Rd
caauuugugcauaaacagc

SEQ ID NO: 687954 - RNA, 20 nt, Haemophilus influenzae Rd
caauuuuaauugguuuugug

SEQ ID NO: 687955 - RNA, 11 nt, Haemophilus influenzae Rd
caauuuuaaaa

SEQ ID NO: 687956 - RNA, 22 nt, Haemophilus influenzae Rd
caauuuggcgcauuaaacucac

SEQ ID NO: 687957 - RNA, 14 nt, Haemophilus influenzae Rd
caauuucuucagcu

SEQ ID NO: 687958 - RNA, 16 nt, Haemophilus influenzae Rd
caauuugaaaagaauu

SEQ ID NO: 687959 - RNA, 21 nt, Haemophilus influenzae Rd
caauuugacgcgcacauacuu

SEQ ID NO: 687960 - RNA, 16 nt, Haemophilus influenzae Rd
caauuucauuugcacc

SEQ ID NO: 687961 - RNA, 12 nt, Haemophilus influenzae Rd
caauuucguuua

SEQ ID NO: 687962 - RNA, 17 nt, Haemophilus influenzae Rd
caauuucuaaaaaucug

SEQ ID NO: 687963 - RNA, 21 nt, Haemophilus influenzae Rd
caauuucuaaaaaucugucau

SEQ ID NO: 687964 - RNA, 14 nt, Haemophilus influenzae Rd
caauuucucuggcu

SEQ ID NO: 687965 - RNA, 15 nt, Haemophilus influenzae Rd
caauuucugcauaau

SEQ ID NO: 687966 - RNA, 20 nt, Haemophilus influenzae Rd
caauuucuaccgcacuuuca

SEQ ID NO: 687967 - RNA, 16 nt, Haemophilus influenzae Rd
caauuuccauaaaaga

SEQ ID NO: 687968 - RNA, 17 nt, Haemophilus influenzae Rd
caauuuccauaaaagac

SEQ ID NO: 687969 - RNA, 19 nt, Haemophilus influenzae Rd
caauuucaaauaaacauac

SEQ ID NO: 687970 - RNA, 14 nt, Haemophilus influenzae Rd
caauuucaucacau

SEQ ID NO: 687971 - RNA, 15 nt, Haemophilus influenzae Rd
caauuucacugccaa

SEQ ID NO: 687972 - RNA, 14 nt, Haemophilus influenzae Rd
caauuucaauugcc

SEQ ID NO: 687973 - RNA, 13 nt, Haemophilus influenzae Rd
cacaaaucuaaaa

SEQ ID NO: 687974 - RNA, 15 nt, Haemophilus influenzae Rd
cacaaaucuaaaaau

SEQ ID NO: 687975 - RNA, 16 nt, Haemophilus influenzae Rd
cacaaaucuaaaaaua

SEQ ID NO: 687976 - RNA, 19 nt, Haemophilus influenzae Rd
cacaaaucuaaaaauaugu

SEQ ID NO: 687977 - RNA, 14 nt, Haemophilus influenzae Rd
cacaaauauuaucu

SEQ ID NO: 687978 - RNA, 14 nt, Haemophilus influenzae Rd
cacaaagacuaaua

SEQ ID NO: 687979 - RNA, 23 nt, Haemophilus influenzae Rd
cacaaacuccguccaaucuaauu

SEQ ID NO: 687980 - RNA, 14 nt, Haemophilus influenzae Rd
cacaaagaaaaacu

SEQ ID NO: 687981 - RNA, 15 nt, Haemophilus influenzae Rd
cacaaagaaaaacua

SEQ ID NO: 687982 - RNA, 21 nt, Haemophilus influenzae Rd
cacaaacuaauuucauuuugc

SEQ ID NO: 687983 - RNA, 23 nt, Haemophilus influenzae Rd
cacaaaaucuugaacgcaaauac

SEQ ID NO: 687984 - RNA, 19 nt, Haemophilus influenzae Rd
cacaaaauggcaaacaaaa

SEQ ID NO: 687985 - RNA, 23 nt, Haemophilus influenzae Rd
cacaacggaagauuuacccaaca

SEQ ID NO: 687986 - RNA, 15 nt, Haemophilus influenzae Rd
cacaacgguugaaau

SEQ ID NO: 687987 - RNA, 14 nt, Haemophilus influenzae Rd
cacaacugaagcuu

SEQ ID NO: 687988 - RNA, 14 nt, Haemophilus influenzae Rd
cacaacuaccacag

SEQ ID NO: 687989 - RNA, 18 nt, Haemophilus influenzae Rd
cacaaccuuguuccagga

SEQ ID NO: 687990 - RNA, 23 nt, Haemophilus influenzae Rd
cacaacauagcugaaaaauaaaa

SEQ ID NO: 687991 - RNA, 16 nt, Haemophilus influenzae Rd
cacaacaucagaugga

SEQ ID NO: 687992 - RNA, 14 nt, Haemophilus influenzae Rd
cacaacaaagaugg

SEQ ID NO: 687993 - RNA, 15 nt, Haemophilus influenzae Rd
cacaacaauuaaugu

SEQ ID NO: 687994 - RNA, 22 nt, Haemophilus influenzae Rd
cacaacaugcccuuucucaaau

SEQ ID NO: 687995 - RNA, 22 nt, Haemophilus influenzae Rd
cacacccuuuucaaacaacaag

SEQ ID NO: 687996 - RNA, 21 nt, Haemophilus influenzae Rd
cacaccagagugaccaccaau

SEQ ID NO: 687997 - RNA, 21 nt, Haemophilus influenzae Rd
cacacccaugaaucgaacacu

SEQ ID NO: 687998 - RNA, 17 nt, Haemophilus influenzae Rd
cacacuauuaauuacuu

SEQ ID NO: 687999 - RNA, 18 nt, Haemophilus influenzae Rd
cacacugcccuucucugc

SEQ ID NO: 688000 - RNA, 19 nt, Haemophilus influenzae Rd
cacacugcccuucucugcc

SEQ ID NO: 688001 - RNA, 16 nt, Haemophilus influenzae Rd
cacagaaacagaaaua

SEQ ID NO: 688002 - RNA, 13 nt, Haemophilus influenzae Rd
cacagaaaccaau

SEQ ID NO: 688003 - RNA, 17 nt, Haemophilus influenzae Rd
cacagaaaggacagcca

SEQ ID NO: 688004 - RNA, 19 nt, Haemophilus influenzae Rd
cacacuuuaauaguaaacu

SEQ ID NO: 688005 - RNA, 19 nt, Haemophilus influenzae Rd
cacaaucgcaucgucuuua

SEQ ID NO: 688006 - RNA, 18 nt, Haemophilus influenzae Rd
cacaauaagcaauccuaa

SEQ ID NO: 688007 - RNA, 17 nt, Haemophilus influenzae Rd
cacaauaauauauuucu

SEQ ID NO: 688008 - RNA, 22 nt, Haemophilus influenzae Rd
cacaauauuugguugaacuucu

SEQ ID NO: 688009 - RNA, 16 nt, Haemophilus influenzae Rd
cacaaucaaucuuuaa

SEQ ID NO: 688010 - RNA, 16 nt, Haemophilus influenzae Rd
cacaauauuuaauaug

SEQ ID NO: 688011 - RNA, 16 nt, Haemophilus influenzae Rd
cacaagcaccacuucc

SEQ ID NO: 688012 - RNA, 12 nt, Haemophilus influenzae Rd
cacaagcaacaa

SEQ ID NO: 688013 - RNA, 18 nt, Haemophilus influenzae Rd
cacaagaugguaauuuug

SEQ ID NO: 688014 - RNA, 16 nt, Haemophilus influenzae Rd
cacaagauuugccaaa

SEQ ID NO: 688015 - RNA, 17 nt, Haemophilus influenzae Rd
cacaagggauuuaaaau

SEQ ID NO: 688016 - RNA, 21 nt, Haemophilus influenzae Rd
cacaagcuuguccaugaaaaa

SEQ ID NO: 688017 - RNA, 22 nt, Haemophilus influenzae Rd
cacaagcuuguccaugaaaaac

SEQ ID NO: 688018 - RNA, 21 nt, Haemophilus influenzae Rd
cacaagugcggguucuuuuuu

SEQ ID NO: 688019 - RNA, 18 nt, Haemophilus influenzae Rd
cacacaccaacacgccau

SEQ ID NO: 688020 - RNA, 21 nt, Haemophilus influenzae Rd
cacacaaacuaauuucauuuu

SEQ ID NO: 688021 - RNA, 16 nt, Haemophilus influenzae Rd
cacaauugauguaaaa

SEQ ID NO: 688022 - RNA, 23 nt, Haemophilus influenzae Rd
cacaauugauguaaaagauaaaa

SEQ ID NO: 688023 - RNA, 16 nt, Haemophilus influenzae Rd
cacaaugauuaauauc

SEQ ID NO: 688024 - RNA, 22 nt, Haemophilus influenzae Rd
cacaaugauuaauaucacugca

SEQ ID NO: 688025 - RNA, 13 nt, Haemophilus influenzae Rd
cacagauuuuuaa

SEQ ID NO: 688026 - RNA, 19 nt, Haemophilus influenzae Rd
cacagauuuuuacuucauc

SEQ ID NO: 688027 - RNA, 21 nt, Haemophilus influenzae Rd
cacagauuuuuacuucaucaa

SEQ ID NO: 688028 - RNA, 14 nt, Haemophilus influenzae Rd
cacagauuuuuuau

SEQ ID NO: 688029 - RNA, 19 nt, Haemophilus influenzae Rd
cacagcgcgacuauuugca

SEQ ID NO: 688030 - RNA, 15 nt, Haemophilus influenzae Rd
cacagccaagaucaa

SEQ ID NO: 688031 - RNA, 21 nt, Haemophilus influenzae Rd
cacagccaagaucaagcacuu

SEQ ID NO: 688032 - RNA, 20 nt, Haemophilus influenzae Rd
cacaggaugcaccaauacca

SEQ ID NO: 688033 - RNA, 18 nt, Haemophilus influenzae Rd
cacagggcugauaaauuu

SEQ ID NO: 688034 - RNA, 16 nt, Haemophilus influenzae Rd
cacauagcaaaaaacc

SEQ ID NO: 688035 - RNA, 20 nt, Haemophilus influenzae Rd
cacauaaagacgcuguuucu

SEQ ID NO: 688036 - RNA, 14 nt, Haemophilus influenzae Rd
cacauaaaucauuu

SEQ ID NO: 688037 - RNA, 23 nt, Haemophilus influenzae Rd
cacauaaguuaccgcuucuuccu

SEQ ID NO: 688038 - RNA, 12 nt, Haemophilus influenzae Rd
cacaguauuuau

SEQ ID NO: 688039 - RNA, 18 nt, Haemophilus influenzae Rd
cacagucaaauugugauu

SEQ ID NO: 688040 - RNA, 20 nt, Haemophilus influenzae Rd
cacaguccccauaucucugc

SEQ ID NO: 688041 - RNA, 13 nt, Haemophilus influenzae Rd
cacaguuuuauuu

SEQ ID NO: 688042 - RNA, 20 nt, Haemophilus influenzae Rd
cacaucagcaaucauuugcc

SEQ ID NO: 688043 - RNA, 16 nt, Haemophilus influenzae Rd
cacaucagaaaaucaa

SEQ ID NO: 688044 - RNA, 23 nt, Haemophilus influenzae Rd
cacauauuuuugauauuaagcca

SEQ ID NO: 688045 - RNA, 16 nt, Haemophilus influenzae Rd
cacaucaaauucuaaa

SEQ ID NO: 688046 - RNA, 15 nt, Haemophilus influenzae Rd
cacauccauuccugc

SEQ ID NO: 688047 - RNA, 13 nt, Haemophilus influenzae Rd
cacaucauuuuuu

SEQ ID NO: 688048 - RNA, 23 nt, Haemophilus influenzae Rd
cacaugauaaaaaccgcugucau

SEQ ID NO: 688049 - RNA, 14 nt, Haemophilus influenzae Rd
cacaugauauauuu

SEQ ID NO: 688050 - RNA, 23 nt, Haemophilus influenzae Rd
cacauuagugaaugaugccauuu

SEQ ID NO: 688051 - RNA, 11 nt, Haemophilus influenzae Rd
cacauuacccc

SEQ ID NO: 688052 - RNA, 14 nt, Haemophilus influenzae Rd
cacauucuaauccu

SEQ ID NO: 688053 - RNA, 23 nt, Haemophilus influenzae Rd
cacauugccauauucgcuuucau

SEQ ID NO: 688054 - RNA, 13 nt, Haemophilus influenzae Rd
cacauuucuucua

SEQ ID NO: 688055 - RNA, 16 nt, Haemophilus influenzae Rd
caccaacaaauucuaa

SEQ ID NO: 688056 - RNA, 15 nt, Haemophilus influenzae Rd
caccaaauaucgcaa

SEQ ID NO: 688057 - RNA, 21 nt, Haemophilus influenzae Rd
caccaaaugguggcuuuuguu

SEQ ID NO: 688058 - RNA, 21 nt, Haemophilus influenzae Rd
caccaaauuguucuaggcuuu

SEQ ID NO: 688059 - RNA, 16 nt, Haemophilus influenzae Rd
caccaaagcaaaauua

SEQ ID NO: 688060 - RNA, 23 nt, Haemophilus influenzae Rd
caccaauaauugaugcuaaauua

SEQ ID NO: 688061 - RNA, 17 nt, Haemophilus influenzae Rd
caccaagcauuacgccu

SEQ ID NO: 688062 - RNA, 12 nt, Haemophilus influenzae Rd
caccaagcaauu

SEQ ID NO: 688063 - RNA, 19 nt, Haemophilus influenzae Rd
caccacaagcugaccacuu

SEQ ID NO: 688064 - RNA, 22 nt, Haemophilus influenzae Rd
caccaauuaucaauguuugugc

SEQ ID NO: 688065 - RNA, 20 nt, Haemophilus influenzae Rd
caccaauuccgucagaauuu

SEQ ID NO: 688066 - RNA, 23 nt, Haemophilus influenzae Rd
caccaauuccgucagaauuucau

SEQ ID NO: 688067 - RNA, 15 nt, Haemophilus influenzae Rd
caccacuucauccaa

SEQ ID NO: 688068 - RNA, 23 nt, Haemophilus influenzae Rd
caccagaaacauagauaacuucu

SEQ ID NO: 688069 - RNA, 12 nt, Haemophilus influenzae Rd
caccagagaaaa

SEQ ID NO: 688070 - RNA, 22 nt, Haemophilus influenzae Rd
caccacucgcgccgauuggaug

SEQ ID NO: 688071 - RNA, 15 nt, Haemophilus influenzae Rd
caccacucacuggcu

SEQ ID NO: 688072 - RNA, 17 nt, Haemophilus influenzae Rd
caccauaaucaaaauua

SEQ ID NO: 688073 - RNA, 22 nt, Haemophilus influenzae Rd
caccauaaucaaaauuacgccu

SEQ ID NO: 688074 - RNA, 12 nt, Haemophilus influenzae Rd
caccauacgcaa

SEQ ID NO: 688075 - RNA, 15 nt, Haemophilus influenzae Rd
caccagcuugcuccg

SEQ ID NO: 688076 - RNA, 21 nt, Haemophilus influenzae Rd
caccauccaucaaauccgcca

SEQ ID NO: 688077 - RNA, 16 nt, Haemophilus influenzae Rd
caccauugauuuuuac

SEQ ID NO: 688078 - RNA, 23 nt, Haemophilus influenzae Rd
caccauuuaaacaccaauucaaa

SEQ ID NO: 688079 - RNA, 17 nt, Haemophilus influenzae Rd
cacccaaaauuucagcu

SEQ ID NO: 688080 - RNA, 22 nt, Haemophilus influenzae Rd
caccauuugguggcuuuuuuau

SEQ ID NO: 688081 - RNA, 14 nt, Haemophilus influenzae Rd
cacccauuuugauu

SEQ ID NO: 688082 - RNA, 20 nt, Haemophilus influenzae Rd
caccucgugcuguuuucaau

SEQ ID NO: 688083 - RNA, 14 nt, Haemophilus influenzae Rd
caccugaugcuuua

SEQ ID NO: 688084 - RNA, 15 nt, Haemophilus influenzae Rd
caccugcaucaauuu

SEQ ID NO: 688085 - RNA, 21 nt, Haemophilus influenzae Rd
caccugcaucaauuuuacguu

SEQ ID NO: 688086 - RNA, 19 nt, Haemophilus influenzae Rd
caccguaaccgcccagcau

SEQ ID NO: 688087 - RNA, 12 nt, Haemophilus influenzae Rd
caccuauuuuuu

SEQ ID NO: 688088 - RNA, 22 nt, Haemophilus influenzae Rd
caccuaagucaggaauaaaaga

SEQ ID NO: 688089 - RNA, 16 nt, Haemophilus influenzae Rd
caccuaauucuuucac

SEQ ID NO: 688090 - RNA, 23 nt, Haemophilus influenzae Rd
caccuaaaaugggucaagauuaa

SEQ ID NO: 688091 - RNA, 20 nt, Haemophilus influenzae Rd
caccuuuacguuuaacugcg

SEQ ID NO: 688092 - RNA, 19 nt, Haemophilus influenzae Rd
caccuugauugagaugcca

SEQ ID NO: 688093 - RNA, 18 nt, Haemophilus influenzae Rd
caccuugaauugcauuuu

SEQ ID NO: 688094 - RNA, 18 nt, Haemophilus influenzae Rd
cacgaccuuucggacuuu

SEQ ID NO: 688095 - RNA, 21 nt, Haemophilus influenzae Rd
cacgacccaccacuuaaaaau

SEQ ID NO: 688096 - RNA, 21 nt, Haemophilus influenzae Rd
cacgacgagcuuuccaaacaa

SEQ ID NO: 688097 - RNA, 16 nt, Haemophilus influenzae Rd
cacgagcaauggcaau

SEQ ID NO: 688098 - RNA, 15 nt, Haemophilus influenzae Rd
cacgagcuaaaaaau

SEQ ID NO: 688099 - RNA, 17 nt, Haemophilus influenzae Rd
caccuuuugcaagcauu

SEQ ID NO: 688100 - RNA, 19 nt, Haemophilus influenzae Rd
caccuuugccucgcaugcg

SEQ ID NO: 688101 - RNA, 12 nt, Haemophilus influenzae Rd
caccuuuuuccu

SEQ ID NO: 688102 - RNA, 13 nt, Haemophilus influenzae Rd
caccuuuuguaga

SEQ ID NO: 688103 - RNA, 18 nt, Haemophilus influenzae Rd
cacccgccuuaaucauug

SEQ ID NO: 688104 - RNA, 14 nt, Haemophilus influenzae Rd
caccgaauguggca

SEQ ID NO: 688105 - RNA, 23 nt, Haemophilus influenzae Rd
cacccuacgauacuuuuaauuaa

SEQ ID NO: 688106 - RNA, 16 nt, Haemophilus influenzae Rd
cacccucaguuaccau

SEQ ID NO: 688107 - RNA, 15 nt, Haemophilus influenzae Rd
caccgcauucuucuu

SEQ ID NO: 688108 - RNA, 16 nt, Haemophilus influenzae Rd
caccgcagaaguaaaa

SEQ ID NO: 688109 - RNA, 13 nt, Haemophilus influenzae Rd
caccgcacuuugg

SEQ ID NO: 688110 - RNA, 21 nt, Haemophilus influenzae Rd
caccgcacuuugugcuccccc

SEQ ID NO: 688111 - RNA, 15 nt, Haemophilus influenzae Rd
caccgcacuuuuuag

SEQ ID NO: 688112 - RNA, 13 nt, Haemophilus influenzae Rd
caccgauuaauaa

SEQ ID NO: 688113 - RNA, 20 nt, Haemophilus influenzae Rd
caccgauugauguuaugcuu

SEQ ID NO: 688114 - RNA, 15 nt, Haemophilus influenzae Rd
caccgauaauaugca

SEQ ID NO: 688115 - RNA, 15 nt, Haemophilus influenzae Rd
caccgcccuuuuuau

SEQ ID NO: 688116 - RNA, 14 nt, Haemophilus influenzae Rd
caccgcuucagcaa

SEQ ID NO: 688117 - RNA, 20 nt, Haemophilus influenzae Rd
caccgcuguaaugacagaau

SEQ ID NO: 688118 - RNA, 13 nt, Haemophilus influenzae Rd
cacgauuuuucuc

SEQ ID NO: 688119 - RNA, 16 nt, Haemophilus influenzae Rd
cacgauuuuuuuauaa

SEQ ID NO: 688120 - RNA, 16 nt, Haemophilus influenzae Rd
cacgauuuucaauaca

SEQ ID NO: 688121 - RNA, 21 nt, Haemophilus influenzae Rd
cacgaucugcaacaucaccga

SEQ ID NO: 688122 - RNA, 21 nt, Haemophilus influenzae Rd
cacgaugaugcaggaaaggca

SEQ ID NO: 688123 - RNA, 21 nt, Haemophilus influenzae Rd
cacgauucuuccaauuacuaa

SEQ ID NO: 688124 - RNA, 22 nt, Haemophilus influenzae Rd
cacgauucuuccaauuacuaau

SEQ ID NO: 688125 - RNA, 21 nt, Haemophilus influenzae Rd
cacgaucgcccguauuuugca

SEQ ID NO: 688126 - RNA, 18 nt, Haemophilus influenzae Rd
cacgauauugcacaauag

SEQ ID NO: 688127 - RNA, 23 nt, Haemophilus influenzae Rd
cacgaucagggccaguugaaaga

SEQ ID NO: 688128 - RNA, 20 nt, Haemophilus influenzae Rd
cacgauaguggaauaaugaa

SEQ ID NO: 688129 - RNA, 23 nt, Haemophilus influenzae Rd
cacgcccaagguuauauaacaua

SEQ ID NO: 688130 - RNA, 13 nt, Haemophilus influenzae Rd
cacgcauuuaaau

SEQ ID NO: 688131 - RNA, 18 nt, Haemophilus influenzae Rd
cacggcgcguaaaucaga

SEQ ID NO: 688132 - RNA, 15 nt, Haemophilus influenzae Rd
cacggcaauaauuua

SEQ ID NO: 688133 - RNA, 16 nt, Haemophilus influenzae Rd
cacggauuucggcuua

SEQ ID NO: 688134 - RNA, 18 nt, Haemophilus influenzae Rd
cacgcuuugucagugguu

SEQ ID NO: 688135 - RNA, 23 nt, Haemophilus influenzae Rd
cacgccuuugucuuauucaaacu

SEQ ID NO: 688136 - RNA, 20 nt, Haemophilus influenzae Rd
cacgccuaauaccaauacga

SEQ ID NO: 688137 - RNA, 21 nt, Haemophilus influenzae Rd
cacgcucaaucucuuuacugu

SEQ ID NO: 688138 - RNA, 20 nt, Haemophilus influenzae Rd
cacguuugccagaaagcauu

SEQ ID NO: 688139 - RNA, 13 nt, Haemophilus influenzae Rd
cacguuuugcacc

SEQ ID NO: 688140 - RNA, 19 nt, Haemophilus influenzae Rd
cacguuguacgccacauac

SEQ ID NO: 688141 - RNA, 17 nt, Haemophilus influenzae Rd
cacguucuuuuaaugcu

SEQ ID NO: 688142 - RNA, 15 nt, Haemophilus influenzae Rd
cacuaaaaacgcauc

SEQ ID NO: 688143 - RNA, 14 nt, Haemophilus influenzae Rd
cacuaaaaaacuaa

SEQ ID NO: 688144 - RNA, 13 nt, Haemophilus influenzae Rd
cacuaaaaacaag

SEQ ID NO: 688145 - RNA, 13 nt, Haemophilus influenzae Rd
cacuaaagcaaua

SEQ ID NO: 688146 - RNA, 16 nt, Haemophilus influenzae Rd
cacuaaaccugcuucu

SEQ ID NO: 688147 - RNA, 13 nt, Haemophilus influenzae Rd
cacuaaaauuugu

SEQ ID NO: 688148 - RNA, 18 nt, Haemophilus influenzae Rd
cacuaaaccauuuuggaa

SEQ ID NO: 688149 - RNA, 14 nt, Haemophilus influenzae Rd
cacuaacuuuccua

SEQ ID NO: 688150 - RNA, 12 nt, Haemophilus influenzae Rd
cacuaauuugcu

SEQ ID NO: 688151 - RNA, 18 nt, Haemophilus influenzae Rd
cacuaaggguuaagacaa

SEQ ID NO: 688152 - RNA, 13 nt, Haemophilus influenzae Rd
cacuaauauaaag

SEQ ID NO: 688153 - RNA, 15 nt, Haemophilus influenzae Rd
cacuaauauaaagau

SEQ ID NO: 688154 - RNA, 20 nt, Haemophilus influenzae Rd
cacuaauauaaagauaauua

SEQ ID NO: 688155 - RNA, 18 nt, Haemophilus influenzae Rd
cacgguguuuuuuuucuu

SEQ ID NO: 688156 - RNA, 19 nt, Haemophilus influenzae Rd
cacgguuuuccacuucuuc

SEQ ID NO: 688157 - RNA, 14 nt, Haemophilus influenzae Rd
cacguaaugcaagu

SEQ ID NO: 688158 - RNA, 14 nt, Haemophilus influenzae Rd
cacguagauacaua

SEQ ID NO: 688159 - RNA, 23 nt, Haemophilus influenzae Rd
cacguacuuuuaacacuuuuuca

SEQ ID NO: 688160 - RNA, 12 nt, Haemophilus influenzae Rd
cacguccgcaac

SEQ ID NO: 688161 - RNA, 17 nt, Haemophilus influenzae Rd
cacguccgcaaccagca

SEQ ID NO: 688162 - RNA, 16 nt, Haemophilus influenzae Rd
cacucgcucuaacaau

SEQ ID NO: 688163 - RNA, 19 nt, Haemophilus influenzae Rd
cacucuaucuaaaauauaa

SEQ ID NO: 688164 - RNA, 20 nt, Haemophilus influenzae Rd
cacucguggaauuucauaaa

SEQ ID NO: 688165 - RNA, 15 nt, Haemophilus influenzae Rd
cacucucuugggugg

SEQ ID NO: 688166 - RNA, 14 nt, Haemophilus influenzae Rd
cacugaaaaaugga

SEQ ID NO: 688167 - RNA, 18 nt, Haemophilus influenzae Rd
cacucuuucaaaaaucaa

SEQ ID NO: 688168 - RNA, 13 nt, Haemophilus influenzae Rd
cacuauaaaauac

SEQ ID NO: 688169 - RNA, 13 nt, Haemophilus influenzae Rd
cacuaugauuuuu

SEQ ID NO: 688170 - RNA, 22 nt, Haemophilus influenzae Rd
cacuauuaauguuauuaaauau

SEQ ID NO: 688171 - RNA, 14 nt, Haemophilus influenzae Rd
cacuauuacuuuca

SEQ ID NO: 688172 - RNA, 21 nt, Haemophilus influenzae Rd
cacuacuaacguuucuaauac

SEQ ID NO: 688173 - RNA, 18 nt, Haemophilus influenzae Rd
cacucacuuuaaucgaaa

SEQ ID NO: 688174 - RNA, 14 nt, Haemophilus influenzae Rd
cacucacuuuuccu

SEQ ID NO: 688175 - RNA, 14 nt, Haemophilus influenzae Rd
caacauauugcgaa

SEQ ID NO: 688176 - RNA, 13 nt, Haemophilus influenzae Rd
caacauauuuucu

SEQ ID NO: 688177 - RNA, 14 nt, Haemophilus influenzae Rd
caacauauuuucua

SEQ ID NO: 688178 - RNA, 20 nt, Haemophilus influenzae Rd
caacauauuuucuaaggcuu

SEQ ID NO: 688179 - RNA, 23 nt, Haemophilus influenzae Rd
caacaucauaagguacaacagac

SEQ ID NO: 688180 - RNA, 22 nt, Haemophilus influenzae Rd
caacaucaacuaauuuauuaaa

SEQ ID NO: 688181 - RNA, 11 nt, Haemophilus influenzae Rd
caaccuugagc

SEQ ID NO: 688182 - RNA, 22 nt, Haemophilus influenzae Rd
caacgacgguauaaaccuugca

SEQ ID NO: 688183 - RNA, 14 nt, Haemophilus influenzae Rd
caacgaaaauagca

SEQ ID NO: 688184 - RNA, 14 nt, Haemophilus influenzae Rd
caacgcaucuauug

SEQ ID NO: 688185 - RNA, 18 nt, Haemophilus influenzae Rd
caacgcaucuuuauaaca

SEQ ID NO: 688186 - RNA, 19 nt, Haemophilus influenzae Rd
caacgcaucuuuauaacau

SEQ ID NO: 688187 - RNA, 15 nt, Haemophilus influenzae Rd
caacgccuacgccgu

SEQ ID NO: 688188 - RNA, 13 nt, Haemophilus influenzae Rd
caacgcauuagca

SEQ ID NO: 688189 - RNA, 14 nt, Haemophilus influenzae Rd
caacggggcaaggc

SEQ ID NO: 688190 - RNA, 15 nt, Haemophilus influenzae Rd
caacgguguggaaag

SEQ ID NO: 688191 - RNA, 18 nt, Haemophilus influenzae Rd
caacgguaacugauuuug

SEQ ID NO: 688192 - RNA, 20 nt, Haemophilus influenzae Rd
caacgguaacugauuuugcu

SEQ ID NO: 688193 - RNA, 18 nt, Haemophilus influenzae Rd
caacguaagcaccaaugu

SEQ ID NO: 688194 - RNA, 17 nt, Haemophilus influenzae Rd
caacuaaaaagacaaaa

SEQ ID NO: 688195 - RNA, 18 nt, Haemophilus influenzae Rd
caacuaaaaagacaaaac

SEQ ID NO: 688196 - RNA, 18 nt, Haemophilus influenzae Rd
caacuaaaaaucccauuu

SEQ ID NO: 688197 - RNA, 14 nt, Haemophilus influenzae Rd
caacucacaauaau

SEQ ID NO: 688198 - RNA, 18 nt, Haemophilus influenzae Rd
caagaaagcguucaucaa

SEQ ID NO: 688199 - RNA, 21 nt, Haemophilus influenzae Rd
caagaaagcguucaucaauuu

SEQ ID NO: 688200 - RNA, 17 nt, Haemophilus influenzae Rd
caagaaaguuuuaagug

SEQ ID NO: 688201 - RNA, 17 nt, Haemophilus influenzae Rd
caagaaauaauaaaaua

SEQ ID NO: 688202 - RNA, 20 nt, Haemophilus influenzae Rd
caagaaagaaauauaauaaa

SEQ ID NO: 688203 - RNA, 17 nt, Haemophilus influenzae Rd
caagaaaccaaaauagc

SEQ ID NO: 688204 - RNA, 19 nt, Haemophilus influenzae Rd
caagaaaccaaaauagcug

SEQ ID NO: 688205 - RNA, 16 nt, Haemophilus influenzae Rd
caagaaauuuuguuuu

SEQ ID NO: 688206 - RNA, 21 nt, Haemophilus influenzae Rd
caagaaauuuuguuuuguuca

SEQ ID NO: 688207 - RNA, 11 nt, Haemophilus influenzae Rd
caagaagauuu

SEQ ID NO: 688208 - RNA, 13 nt, Haemophilus influenzae Rd
caagaauauuuca

SEQ ID NO: 688209 - RNA, 13 nt, Haemophilus influenzae Rd
caagaauaaaaug

SEQ ID NO: 688210 - RNA, 14 nt, Haemophilus influenzae Rd
caagaauaaaaugu

SEQ ID NO: 688211 - RNA, 13 nt, Haemophilus influenzae Rd
caacuuugaccau

SEQ ID NO: 688212 - RNA, 23 nt, Haemophilus influenzae Rd
caacuuguuguguuucagcuucg

SEQ ID NO: 688213 - RNA, 15 nt, Haemophilus influenzae Rd
caacuuuuucaucuu

SEQ ID NO: 688214 - RNA, 13 nt, Haemophilus influenzae Rd
caacuuuuuuagg

SEQ ID NO: 688215 - RNA, 22 nt, Haemophilus influenzae Rd
caacucguucuuuguuaccuuu

SEQ ID NO: 688216 - RNA, 15 nt, Haemophilus influenzae Rd
caacuugaauaccug

SEQ ID NO: 688217 - RNA, 16 nt, Haemophilus influenzae Rd
caacuugcaaccauaa

SEQ ID NO: 688218 - RNA, 16 nt, Haemophilus influenzae Rd
caacuugccagcagaa

SEQ ID NO: 688219 - RNA, 12 nt, Haemophilus influenzae Rd
caacuuggaaug

SEQ ID NO: 688220 - RNA, 18 nt, Haemophilus influenzae Rd
caagaucuaaaaacuuuu

SEQ ID NO: 688221 - RNA, 19 nt, Haemophilus influenzae Rd
caagaugacgaaaugaaau

SEQ ID NO: 688222 - RNA, 14 nt, Haemophilus influenzae Rd
caagaucaauauaa

SEQ ID NO: 688223 - RNA, 12 nt, Haemophilus influenzae Rd
caagauacuuuu

SEQ ID NO: 688224 - RNA, 20 nt, Haemophilus influenzae Rd
caagagucuugccaacgcag

SEQ ID NO: 688225 - RNA, 16 nt, Haemophilus influenzae Rd
caagacugaauuuuac

SEQ ID NO: 688226 - RNA, 16 nt, Haemophilus influenzae Rd
caagacguucuaauug

SEQ ID NO: 688227 - RNA, 21 nt, Haemophilus influenzae Rd
caagagccuccacaagcaaca

SEQ ID NO: 688228 - RNA, 18 nt, Haemophilus influenzae Rd
caagaccugcuucuuuua

SEQ ID NO: 688229 - RNA, 20 nt, Haemophilus influenzae Rd
caagaccugcuucuuuuaau

SEQ ID NO: 688230 - RNA, 21 nt, Haemophilus influenzae Rd
caagaaugacuggcuugugaa

SEQ ID NO: 688231 - RNA, 17 nt, Haemophilus influenzae Rd
caagaauuuuaauaagg

SEQ ID NO: 688232 - RNA, 13 nt, Haemophilus influenzae Rd
caagacaaaauaa

SEQ ID NO: 688233 - RNA, 13 nt, Haemophilus influenzae Rd
caagaauuccauu

SEQ ID NO: 688234 - RNA, 19 nt, Haemophilus influenzae Rd
caauaaugauguaccaaaa

SEQ ID NO: 688235 - RNA, 16 nt, Haemophilus influenzae Rd
caauaauccuuuuuuu

SEQ ID NO: 688236 - RNA, 21 nt, Haemophilus influenzae Rd
caauaauuaaugcuaaaccaa

SEQ ID NO: 688237 - RNA, 14 nt, Haemophilus influenzae Rd
caauaauguugcug

SEQ ID NO: 688238 - RNA, 16 nt, Haemophilus influenzae Rd
caauaauuaaacagcc

SEQ ID NO: 688239 - RNA, 23 nt, Haemophilus influenzae Rd
caauaauuaaacagccaaacaaa

SEQ ID NO: 688240 - RNA, 15 nt, Haemophilus influenzae Rd
caauaccacagcauu

SEQ ID NO: 688241 - RNA, 16 nt, Haemophilus influenzae Rd
caauaccaauuuccau

SEQ ID NO: 688242 - RNA, 16 nt, Haemophilus influenzae Rd
caauacaucaguaaug

SEQ ID NO: 688243 - RNA, 23 nt, Haemophilus influenzae Rd
caauaccaagugcugguagcaau

SEQ ID NO: 688244 - RNA, 19 nt, Haemophilus influenzae Rd
caauaagauagaaauguug

SEQ ID NO: 688245 - RNA, 13 nt, Haemophilus influenzae Rd
caauaagcaagua

SEQ ID NO: 688246 - RNA, 14 nt, Haemophilus influenzae Rd
caauaacuaaaaau

SEQ ID NO: 688247 - RNA, 16 nt, Haemophilus influenzae Rd
caauaacuaaaaauac

SEQ ID NO: 688248 - RNA, 18 nt, Haemophilus influenzae Rd
caaguugggauuuaucuu

SEQ ID NO: 688249 - RNA, 22 nt, Haemophilus influenzae Rd
caaguugggauuuaucuucccc

SEQ ID NO: 688250 - RNA, 16 nt, Haemophilus influenzae Rd
caaguucugcacgaag

SEQ ID NO: 688251 - RNA, 15 nt, Haemophilus influenzae Rd
caaguucuucauuua

SEQ ID NO: 688252 - RNA, 19 nt, Haemophilus influenzae Rd
caauauaaucaauuauuuc

SEQ ID NO: 688253 - RNA, 14 nt, Haemophilus influenzae Rd
caauauaauuauca

SEQ ID NO: 688254 - RNA, 20 nt, Haemophilus influenzae Rd
caauauaauuuacuguuuaa

SEQ ID NO: 688255 - RNA, 22 nt, Haemophilus influenzae Rd
caauauauucggaaaaaauuug

SEQ ID NO: 688256 - RNA, 15 nt, Haemophilus influenzae Rd
caauaugaacauuau

SEQ ID NO: 688257 - RNA, 15 nt, Haemophilus influenzae Rd
caauauaggcuauau

SEQ ID NO: 688258 - RNA, 13 nt, Haemophilus influenzae Rd
caauauagucaaa

SEQ ID NO: 688259 - RNA, 16 nt, Haemophilus influenzae Rd
caauauagucaaauaa

SEQ ID NO: 688260 - RNA, 15 nt, Haemophilus influenzae Rd
caauauauaaauccg

SEQ ID NO: 688261 - RNA, 16 nt, Haemophilus influenzae Rd
caauagauguuaauug

SEQ ID NO: 688262 - RNA, 23 nt, Haemophilus influenzae Rd
caauagaacgaaccccuugaauu

SEQ ID NO: 688263 - RNA, 15 nt, Haemophilus influenzae Rd
caauagaauuggugc

SEQ ID NO: 688264 - RNA, 19 nt, Haemophilus influenzae Rd
caaucacgaucugcaacau

SEQ ID NO: 688265 - RNA, 14 nt, Haemophilus influenzae Rd
caaucaauucuuuc

SEQ ID NO: 688266 - RNA, 20 nt, Haemophilus influenzae Rd
caauauggaacaguugaaaa

SEQ ID NO: 688267 - RNA, 20 nt, Haemophilus influenzae Rd
caaucaagcauaaaucuuua

SEQ ID NO: 688268 - RNA, 13 nt, Haemophilus influenzae Rd
caaucaagcaaau

SEQ ID NO: 688269 - RNA, 15 nt, Haemophilus influenzae Rd
caaucaagcaaauag

SEQ ID NO: 688270 - RNA, 15 nt, Haemophilus influenzae Rd
caauauguuuaccac

SEQ ID NO: 688271 - RNA, 20 nt, Haemophilus influenzae Rd
caaucaacgcuguacaaagc

SEQ ID NO: 688272 - RNA, 21 nt, Haemophilus influenzae Rd
caagaugguaauuuuggcgaa

SEQ ID NO: 688273 - RNA, 13 nt, Haemophilus influenzae Rd
caagauucuaaau

SEQ ID NO: 688274 - RNA, 17 nt, Haemophilus influenzae Rd
caagauucuaaauauug

SEQ ID NO: 688275 - RNA, 14 nt, Haemophilus influenzae Rd
caagauuuuauaca

SEQ ID NO: 688276 - RNA, 13 nt, Haemophilus influenzae Rd
caagcaagccaca

SEQ ID NO: 688277 - RNA, 13 nt, Haemophilus influenzae Rd
caagcaaacagca

SEQ ID NO: 688278 - RNA, 11 nt, Haemophilus influenzae Rd
caagccuuugg

SEQ ID NO: 688279 - RNA, 14 nt, Haemophilus influenzae Rd
caagcucaaaaacg

SEQ ID NO: 688280 - RNA, 20 nt, Haemophilus influenzae Rd
caagcuaauugguaaaauua

SEQ ID NO: 688281 - RNA, 19 nt, Haemophilus influenzae Rd
caagcuuguccaugaaaaa

SEQ ID NO: 688282 - RNA, 19 nt, Haemophilus influenzae Rd
caagcuuuuucuuguucug

SEQ ID NO: 688283 - RNA, 23 nt, Haemophilus influenzae Rd
caagcugauuuaucauuccccag

SEQ ID NO: 688284 - RNA, 16 nt, Haemophilus influenzae Rd
caagguuguaagccca

SEQ ID NO: 688285 - RNA, 23 nt, Haemophilus influenzae Rd
caaguaacgccgcacucgcugua

SEQ ID NO: 688286 - RNA, 13 nt, Haemophilus influenzae Rd
caaguaacuuuca

SEQ ID NO: 688287 - RNA, 16 nt, Haemophilus influenzae Rd
caaguaacuuucacaa

SEQ ID NO: 688288 - RNA, 20 nt, Haemophilus influenzae Rd
caaguaauacaccaauaauu

SEQ ID NO: 688289 - RNA, 21 nt, Haemophilus influenzae Rd
caaguaauacaccaauaauua

SEQ ID NO: 688290 - RNA, 12 nt, Haemophilus influenzae Rd
caaguaauuuaa

SEQ ID NO: 688291 - RNA, 14 nt, Haemophilus influenzae Rd
caaguccccauuug

SEQ ID NO: 688292 - RNA, 20 nt, Haemophilus influenzae Rd
caaguccccauuuguagaaa

SEQ ID NO: 688293 - RNA, 22 nt, Haemophilus influenzae Rd
caaggcuuuaauuuuaucuaau

SEQ ID NO: 688294 - RNA, 17 nt, Haemophilus influenzae Rd
caagggauuuaaaaucc

SEQ ID NO: 688295 - RNA, 15 nt, Haemophilus influenzae Rd
caagggauuugaaaa

SEQ ID NO: 688296 - RNA, 17 nt, Haemophilus influenzae Rd
caaggccauauuuuccc

SEQ ID NO: 688297 - RNA, 17 nt, Haemophilus influenzae Rd
caaggcuaacuggcaau

SEQ ID NO: 688298 - RNA, 18 nt, Haemophilus influenzae Rd
caaggcuccaguuguaaa

SEQ ID NO: 688299 - RNA, 22 nt, Haemophilus influenzae Rd
caagugaaauucuaccugcugu

SEQ ID NO: 688300 - RNA, 15 nt, Haemophilus influenzae Rd
caagugcaguuucag

SEQ ID NO: 688301 - RNA, 19 nt, Haemophilus influenzae Rd
caagucuuaaucuuaucaa

SEQ ID NO: 688302 - RNA, 21 nt, Haemophilus influenzae Rd
caagucucuaugauuuuuuug

SEQ ID NO: 688303 - RNA, 19 nt, Haemophilus influenzae Rd
caagucugcugaaauacaa

SEQ ID NO: 688304 - RNA, 20 nt, Haemophilus influenzae Rd
caagucugcugaaauacaaa

SEQ ID NO: 688305 - RNA, 23 nt, Haemophilus influenzae Rd
caagucugcugaaauacaaagca

SEQ ID NO: 688306 - RNA, 17 nt, Haemophilus influenzae Rd
caagucccuguucaaau

SEQ ID NO: 688307 - RNA, 19 nt, Haemophilus influenzae Rd
caagugcggguucuuuuuu

SEQ ID NO: 688308 - RNA, 16 nt, Haemophilus influenzae Rd
caagugcgguaaaauu

SEQ ID NO: 688309 - RNA, 22 nt, Haemophilus influenzae Rd
caagugcgguaaaauuuuucuc

SEQ ID NO: 688310 - RNA, 21 nt, Haemophilus influenzae Rd
caagugcggucagcauaaaga

SEQ ID NO: 688311 - RNA, 19 nt, Haemophilus influenzae Rd
caagugcgguugaaaaauu

SEQ ID NO: 688312 - RNA, 19 nt, Haemophilus influenzae Rd
caagugcugguagcaauaa

SEQ ID NO: 688313 - RNA, 13 nt, Haemophilus influenzae Rd
caaguuaaaaaau

SEQ ID NO: 688314 - RNA, 22 nt, Haemophilus influenzae Rd
caaguuaaaaaaugauuaaguu

SEQ ID NO: 688315 - RNA, 17 nt, Haemophilus influenzae Rd
caaguuaaaacuugauu

SEQ ID NO: 688316 - RNA, 24 nt, Haemophilus influenzae Rd
caagugugugaaaggcaagcucua

SEQ ID NO: 688317 - RNA, 15 nt, Haemophilus influenzae Rd
caaaaguuugcaaca

SEQ ID NO: 688318 - RNA, 16 nt, Haemophilus influenzae Rd
caaaaguuugcaacau

SEQ ID NO: 688319 - RNA, 22 nt, Haemophilus influenzae Rd
caaaaguuguggaaguugcucu

SEQ ID NO: 688320 - RNA, 23 nt, Haemophilus influenzae Rd
caaaaguuguggaaguugcucua

SEQ ID NO: 688321 - RNA, 22 nt, Haemophilus influenzae Rd
caaaaguuggacuaaacaacua

SEQ ID NO: 688322 - RNA, 18 nt, Haemophilus influenzae Rd
caaaagugcgguaaaaau

SEQ ID NO: 688323 - RNA, 19 nt, Haemophilus influenzae Rd
caaaagugcgguaaaaauu

SEQ ID NO: 688324 - RNA, 20 nt, Haemophilus influenzae Rd
caaaagugcgguaaaaauua

SEQ ID NO: 688325 - RNA, 22 nt, Haemophilus influenzae Rd
caaaagugcgguaaauuuuuac

SEQ ID NO: 688326 - RNA, 20 nt, Haemophilus influenzae Rd
caaaagugcuuaaaugcaaa

SEQ ID NO: 688327 - RNA, 14 nt, Haemophilus influenzae Rd
caaaaguauugagc

SEQ ID NO: 688328 - RNA, 13 nt, Haemophilus influenzae Rd
caaaaguaaauaa

SEQ ID NO: 688329 - RNA, 14 nt, Haemophilus influenzae Rd
caaaaguaaauaau

SEQ ID NO: 688330 - RNA, 23 nt, Haemophilus influenzae Rd
auuuuucaaggccauauuuuccc

SEQ ID NO: 688331 - RNA, 11 nt, Haemophilus influenzae Rd
auuuuucacug

SEQ ID NO: 688332 - RNA, 16 nt, Haemophilus influenzae Rd
auuuuuagauuauuuu

SEQ ID NO: 688333 - RNA, 18 nt, Haemophilus influenzae Rd
auuuuuagauuauuuuua

SEQ ID NO: 688334 - RNA, 21 nt, Haemophilus influenzae Rd
auuuuuagccuaagauuuuau

SEQ ID NO: 688335 - RNA, 17 nt, Haemophilus influenzae Rd
auuuuuaugauuuugca

SEQ ID NO: 688336 - RNA, 19 nt, Haemophilus influenzae Rd
auuuuuauaucuaaauaau

SEQ ID NO: 688337 - RNA, 15 nt, Haemophilus influenzae Rd
auuuuuaucaauaac

SEQ ID NO: 688338 - RNA, 14 nt, Haemophilus influenzae Rd
auuuuuaucauaua

SEQ ID NO: 688339 - RNA, 17 nt, Haemophilus influenzae Rd
auuuuuauuuaaugggu

SEQ ID NO: 688340 - RNA, 13 nt, Haemophilus influenzae Rd
auuuuuauuuucu

SEQ ID NO: 688341 - RNA, 22 nt, Haemophilus influenzae Rd
auuuuucaauaagcaaguaauu

SEQ ID NO: 688342 - RNA, 21 nt, Haemophilus influenzae Rd
caaaauaguaaaaauuguuga

SEQ ID NO: 688343 - RNA, 22 nt, Haemophilus influenzae Rd
caaaauaguaaaaauuguugau

SEQ ID NO: 688344 - RNA, 16 nt, Haemophilus influenzae Rd
caaaauauuuucaaau

SEQ ID NO: 688345 - RNA, 22 nt, Haemophilus influenzae Rd
caaaauauuaguuagcuaaaaa

SEQ ID NO: 688346 - RNA, 10 nt, Haemophilus influenzae Rd
caaaaucaag

SEQ ID NO: 688347 - RNA, 18 nt, Haemophilus influenzae Rd
caaaaucagcuaauaaca

SEQ ID NO: 688348 - RNA, 22 nt, Haemophilus influenzae Rd
caaaaucacgccagauaaaauu

SEQ ID NO: 688349 - RNA, 21 nt, Haemophilus influenzae Rd
caaaaucaguuauugauaaaa

SEQ ID NO: 688350 - RNA, 22 nt, Haemophilus influenzae Rd
caaaaucauauugauuuacauu

SEQ ID NO: 688351 - RNA, 14 nt, Haemophilus influenzae Rd
caaaauaaaaccau

SEQ ID NO: 688352 - RNA, 21 nt, Haemophilus influenzae Rd
caaaauagcugugcaaaaucu

SEQ ID NO: 688353 - RNA, 15 nt, Haemophilus influenzae Rd
caaaauaaaugauua

SEQ ID NO: 688354 - RNA, 21 nt, Haemophilus influenzae Rd
caaaauaaaugauuauccacu

SEQ ID NO: 688355 - RNA, 21 nt, Haemophilus influenzae Rd
caaaauaaugagguauaaaau

SEQ ID NO: 688356 - RNA, 21 nt, Haemophilus influenzae Rd
caaaauucuacgccauuuucu

SEQ ID NO: 688357 - RNA, 21 nt, Haemophilus influenzae Rd
caaaauuauaaaccaguuaaa

SEQ ID NO: 688358 - RNA, 21 nt, Haemophilus influenzae Rd
caaaauuaugcugauuugaca

SEQ ID NO: 688359 - RNA, 20 nt, Haemophilus influenzae Rd
caaaauuaaauugaaaaaau

SEQ ID NO: 688360 - RNA, 17 nt, Haemophilus influenzae Rd
caaaauuagacuuucuu

SEQ ID NO: 688361 - RNA, 22 nt, Haemophilus influenzae Rd
caaaauugaucgaaaaaucuuu

SEQ ID NO: 688362 - RNA, 19 nt, Haemophilus influenzae Rd
caaaauugaugaaaauucu

SEQ ID NO: 688363 - RNA, 12 nt, Haemophilus influenzae Rd
caaaauugaagc

SEQ ID NO: 688364 - RNA, 12 nt, Haemophilus influenzae Rd
caaaauugcuuu

SEQ ID NO: 688365 - RNA, 22 nt, Haemophilus influenzae Rd
caaaauuuaaaaucgcaauuuu

SEQ ID NO: 688366 - RNA, 16 nt, Haemophilus influenzae Rd
caaacaagcccacauu

SEQ ID NO: 688367 - RNA, 21 nt, Haemophilus influenzae Rd
caaacaacaagucaaugcacc

SEQ ID NO: 688368 - RNA, 11 nt, Haemophilus influenzae Rd
caaacaaaaag

SEQ ID NO: 688369 - RNA, 14 nt, Haemophilus influenzae Rd
caaacaaaauaaau

SEQ ID NO: 688370 - RNA, 20 nt, Haemophilus influenzae Rd
caaacaaaauuuuaaauaaa

SEQ ID NO: 688371 - RNA, 21 nt, Haemophilus influenzae Rd
caaacaaaauuuuaaauaaaa

SEQ ID NO: 688372 - RNA, 23 nt, Haemophilus influenzae Rd
caaacaaaaagugcggugauuuu

SEQ ID NO: 688373 - RNA, 12 nt, Haemophilus influenzae Rd
caaaauuucagc

SEQ ID NO: 688374 - RNA, 15 nt, Haemophilus influenzae Rd
caaaauuucagcuag

SEQ ID NO: 688375 - RNA, 19 nt, Haemophilus influenzae Rd
caaaauuuguuaagugauc

SEQ ID NO: 688376 - RNA, 20 nt, Haemophilus influenzae Rd
caaaauuuguuaagugaucu

SEQ ID NO: 688377 - RNA, 15 nt, Haemophilus influenzae Rd
caaaaucauucguau

SEQ ID NO: 688378 - RNA, 22 nt, Haemophilus influenzae Rd
caaaaucauucguaucaacuuu

SEQ ID NO: 688379 - RNA, 18 nt, Haemophilus influenzae Rd
caaaaucauuaaaaucug

SEQ ID NO: 688380 - RNA, 21 nt, Haemophilus influenzae Rd
caaaaucuaaauuucuacuau

SEQ ID NO: 688381 - RNA, 23 nt, Haemophilus influenzae Rd
caaaaucuuuacgaauuguaccu

SEQ ID NO: 688382 - RNA, 22 nt, Haemophilus influenzae Rd
caaaaucucuggagaaaauugc

SEQ ID NO: 688383 - RNA, 23 nt, Haemophilus influenzae Rd
caaaaugcgugcugugauugaug

SEQ ID NO: 688384 - RNA, 22 nt, Haemophilus influenzae Rd
caaaaugcuugaauaaaugacc

SEQ ID NO: 688385 - RNA, 13 nt, Haemophilus influenzae Rd
caaaaugaacagu

SEQ ID NO: 688386 - RNA, 15 nt, Haemophilus influenzae Rd
caaaauggcaaacaa

SEQ ID NO: 688387 - RNA, 15 nt, Haemophilus influenzae Rd
caaaaugucgccauu

SEQ ID NO: 688388 - RNA, 22 nt, Haemophilus influenzae Rd
caaaauguuuacgcuaauuuaa

SEQ ID NO: 688389 - RNA, 18 nt, Haemophilus influenzae Rd
caaacauuugaccugcgu

SEQ ID NO: 688390 - RNA, 20 nt, Haemophilus influenzae Rd
caaaccaccgcgacucaccg

SEQ ID NO: 688391 - RNA, 20 nt, Haemophilus influenzae Rd
caaaccaaaaucuaaaccag

SEQ ID NO: 688392 - RNA, 12 nt, Haemophilus influenzae Rd
caaacacaaaau

SEQ ID NO: 688393 - RNA, 15 nt, Haemophilus influenzae Rd
caaacagcaauaaau

SEQ ID NO: 688394 - RNA, 16 nt, Haemophilus influenzae Rd
caaacagcaauaaaua

SEQ ID NO: 688395 - RNA, 17 nt, Haemophilus influenzae Rd
caaacagcaauaaauaa

SEQ ID NO: 688396 - RNA, 18 nt, Haemophilus influenzae Rd
caaacagcaauaaauaau

SEQ ID NO: 688397 - RNA, 19 nt, Haemophilus influenzae Rd
caaacaguucaauaaaaau

SEQ ID NO: 688398 - RNA, 14 nt, Haemophilus influenzae Rd
caaacauaccacuu

SEQ ID NO: 688399 - RNA, 23 nt, Haemophilus influenzae Rd
caaacauaccacuucagaauuca

SEQ ID NO: 688400 - RNA, 17 nt, Haemophilus influenzae Rd
caaacauaccuaaaaau

SEQ ID NO: 688401 - RNA, 20 nt, Haemophilus influenzae Rd
caaacauaccuaaaaaugcc

SEQ ID NO: 688402 - RNA, 22 nt, Haemophilus influenzae Rd
caaacagggcagugauguaaau

SEQ ID NO: 688403 - RNA, 16 nt, Haemophilus influenzae Rd
caaacaggaauacuca

SEQ ID NO: 688404 - RNA, 14 nt, Haemophilus influenzae Rd
caaacuauuaccua

SEQ ID NO: 688405 - RNA, 16 nt, Haemophilus influenzae Rd
caaacucuaauuccac

SEQ ID NO: 688406 - RNA, 18 nt, Haemophilus influenzae Rd
caaacucuaauuccaccg

SEQ ID NO: 688407 - RNA, 15 nt, Haemophilus influenzae Rd
caaacugaucauaau

SEQ ID NO: 688408 - RNA, 18 nt, Haemophilus influenzae Rd
caaacgaaaaaaauaaaa

SEQ ID NO: 688409 - RNA, 17 nt, Haemophilus influenzae Rd
caaacgagacauuauuu

SEQ ID NO: 688410 - RNA, 14 nt, Haemophilus influenzae Rd
caaacgcucuuuaa

SEQ ID NO: 688411 - RNA, 16 nt, Haemophilus influenzae Rd
caaacgcucuuuaauu

SEQ ID NO: 688412 - RNA, 17 nt, Haemophilus influenzae Rd
caaacgcucuuuaauug

SEQ ID NO: 688413 - RNA, 20 nt, Haemophilus influenzae Rd
caaacgcucuuuaauuguuu

SEQ ID NO: 688414 - RNA, 21 nt, Haemophilus influenzae Rd
caaacgcuccauuaccguaug

SEQ ID NO: 688415 - RNA, 17 nt, Haemophilus influenzae Rd
caaacgaugaagaaaau

SEQ ID NO: 688416 - RNA, 16 nt, Haemophilus influenzae Rd
caacauaaauagagaa

SEQ ID NO: 688417 - RNA, 18 nt, Haemophilus influenzae Rd
caacauaaagauuaaaau

SEQ ID NO: 688418 - RNA, 17 nt, Haemophilus influenzae Rd
caacauaagcugcauca

SEQ ID NO: 688419 - RNA, 12 nt, Haemophilus influenzae Rd
caacaguaaauu

SEQ ID NO: 688420 - RNA, 18 nt, Haemophilus influenzae Rd
caacaguaaauuuuucca

SEQ ID NO: 688421 - RNA, 19 nt, Haemophilus influenzae Rd
caacaguaaauuuuuccac

SEQ ID NO: 688422 - RNA, 22 nt, Haemophilus influenzae Rd
caacagauucacggccgucaau

SEQ ID NO: 688423 - RNA, 14 nt, Haemophilus influenzae Rd
caacaacgauagca

SEQ ID NO: 688424 - RNA, 24 nt, Haemophilus influenzae Rd
caacaacgcccucgccuugcaaau

SEQ ID NO: 688425 - RNA, 17 nt, Haemophilus influenzae Rd
caacaaauuuaaaugau

SEQ ID NO: 688426 - RNA, 16 nt, Haemophilus influenzae Rd
caacaauaauuuuuaa

SEQ ID NO: 688427 - RNA, 18 nt, Haemophilus influenzae Rd
caacaccuaaaugagaaa

SEQ ID NO: 688428 - RNA, 14 nt, Haemophilus influenzae Rd
caacaccuaagaac

SEQ ID NO: 688429 - RNA, 20 nt, Haemophilus influenzae Rd
caaauccuuguuuuucaaaa

SEQ ID NO: 688430 - RNA, 22 nt, Haemophilus influenzae Rd
caaaucuggcaccuaaugaggu

SEQ ID NO: 688431 - RNA, 14 nt, Haemophilus influenzae Rd
caaaucgagguuuu

SEQ ID NO: 688432 - RNA, 19 nt, Haemophilus influenzae Rd
caaaucuuucgcuugcugu

SEQ ID NO: 688433 - RNA, 20 nt, Haemophilus influenzae Rd
caaaucuugacauaauuuca

SEQ ID NO: 688434 - RNA, 14 nt, Haemophilus influenzae Rd
caaauuaaaaauau

SEQ ID NO: 688435 - RNA, 18 nt, Haemophilus influenzae Rd
caaaugucauugauggcu

SEQ ID NO: 688436 - RNA, 12 nt, Haemophilus influenzae Rd
caaaugucgaaa

SEQ ID NO: 688437 - RNA, 20 nt, Haemophilus influenzae Rd
caaaugugaccgcuuguuua

SEQ ID NO: 688438 - RNA, 14 nt, Haemophilus influenzae Rd
caaauguaaaacag

SEQ ID NO: 688439 - RNA, 20 nt, Haemophilus influenzae Rd
caaaugggugcuuguucaug

SEQ ID NO: 688440 - RNA, 11 nt, Haemophilus influenzae Rd
caaaugcuuug

SEQ ID NO: 688441 - RNA, 14 nt, Haemophilus influenzae Rd
caaauggcaucaau

SEQ ID NO: 688442 - RNA, 20 nt, Haemophilus influenzae Rd
caaauucagcuaauucagcu

SEQ ID NO: 688443 - RNA, 13 nt, Haemophilus influenzae Rd
caaauucaauugu

SEQ ID NO: 688444 - RNA, 13 nt, Haemophilus influenzae Rd
caaauuccauuca

SEQ ID NO: 688445 - RNA, 15 nt, Haemophilus influenzae Rd
caaauuccgcaauau

SEQ ID NO: 688446 - RNA, 19 nt, Haemophilus influenzae Rd
caaauuuuccgcauaaaua

SEQ ID NO: 688447 - RNA, 12 nt, Haemophilus influenzae Rd
caaauuuuccuu

SEQ ID NO: 688448 - RNA, 17 nt, Haemophilus influenzae Rd
caaauuuugaugaaagu

SEQ ID NO: 688449 - RNA, 13 nt, Haemophilus influenzae Rd
caaauuuugcauu

SEQ ID NO: 688450 - RNA, 14 nt, Haemophilus influenzae Rd
caacaaauaaauca

SEQ ID NO: 688451 - RNA, 19 nt, Haemophilus influenzae Rd
caacaaagucaauacacau

SEQ ID NO: 688452 - RNA, 21 nt, Haemophilus influenzae Rd
caacaaagugcggcaaaaaau

SEQ ID NO: 688453 - RNA, 13 nt, Haemophilus influenzae Rd
caaauuuuuucaa

SEQ ID NO: 688454 - RNA, 15 nt, Haemophilus influenzae Rd
caacaaaaaacaccu

SEQ ID NO: 688455 - RNA, 20 nt, Haemophilus influenzae Rd
caaauuuuucuuuucuucua

SEQ ID NO: 688456 - RNA, 14 nt, Haemophilus influenzae Rd
caaauuuuucacag

SEQ ID NO: 688457 - RNA, 21 nt, Haemophilus influenzae Rd
caaauuuuuguugauaaacau

SEQ ID NO: 688458 - RNA, 12 nt, Haemophilus influenzae Rd
caacaaaagugc

SEQ ID NO: 688459 - RNA, 15 nt, Haemophilus influenzae Rd
caacaaaagugcggu

SEQ ID NO: 688460 - RNA, 15 nt, Haemophilus influenzae Rd
caaagcuguaaaauu

SEQ ID NO: 688461 - RNA, 15 nt, Haemophilus influenzae Rd
caaagcguuuuaaaa

SEQ ID NO: 688462 - RNA, 18 nt, Haemophilus influenzae Rd
caaagcguucauuuugau

SEQ ID NO: 688463 - RNA, 13 nt, Haemophilus influenzae Rd
caaagauggauau

SEQ ID NO: 688464 - RNA, 20 nt, Haemophilus influenzae Rd
caaagauguuccuacagaac

SEQ ID NO: 688465 - RNA, 22 nt, Haemophilus influenzae Rd
caaagauauaaacugauuuuga

SEQ ID NO: 688466 - RNA, 16 nt, Haemophilus influenzae Rd
caaagagaagcugaau

SEQ ID NO: 688467 - RNA, 23 nt, Haemophilus influenzae Rd
caaagagaagcugaauaaaagag

SEQ ID NO: 688468 - RNA, 13 nt, Haemophilus influenzae Rd
caaagaggccucu

SEQ ID NO: 688469 - RNA, 16 nt, Haemophilus influenzae Rd
caaagacuaaaaccac

SEQ ID NO: 688470 - RNA, 21 nt, Haemophilus influenzae Rd
caaagacuaaaaccacaucau

SEQ ID NO: 688471 - RNA, 13 nt, Haemophilus influenzae Rd
caaacuuggauca

SEQ ID NO: 688472 - RNA, 15 nt, Haemophilus influenzae Rd
caaacugccaaacaa

SEQ ID NO: 688473 - RNA, 15 nt, Haemophilus influenzae Rd
caaacuuaaauacau

SEQ ID NO: 688474 - RNA, 23 nt, Haemophilus influenzae Rd
caaauauuuuccucgacauaaaa

SEQ ID NO: 688475 - RNA, 14 nt, Haemophilus influenzae Rd
caaaucaaaaagcu

SEQ ID NO: 688476 - RNA, 15 nt, Haemophilus influenzae Rd
caaaucaaauuuucc

SEQ ID NO: 688477 - RNA, 16 nt, Haemophilus influenzae Rd
caaaucaaauuuuccu

SEQ ID NO: 688478 - RNA, 18 nt, Haemophilus influenzae Rd
caaaucaaauuuuccuuc

SEQ ID NO: 688479 - RNA, 19 nt, Haemophilus influenzae Rd
caaauauugguuauuuaaa

SEQ ID NO: 688480 - RNA, 17 nt, Haemophilus influenzae Rd
caaauauucuucuaaaa

SEQ ID NO: 688481 - RNA, 21 nt, Haemophilus influenzae Rd
caaauauucuucuaaaagauc

SEQ ID NO: 688482 - RNA, 19 nt, Haemophilus influenzae Rd
caaauaugguaauuagccu

SEQ ID NO: 688483 - RNA, 21 nt, Haemophilus influenzae Rd
caaauauauuucuaauaaagu

SEQ ID NO: 688484 - RNA, 20 nt, Haemophilus influenzae Rd
caaauacugaccuuuaggau

SEQ ID NO: 688485 - RNA, 16 nt, Haemophilus influenzae Rd
caaagggcugauauuu

SEQ ID NO: 688486 - RNA, 16 nt, Haemophilus influenzae Rd
caaauaacguuuuaag

SEQ ID NO: 688487 - RNA, 13 nt, Haemophilus influenzae Rd
caaauaaauuugg

SEQ ID NO: 688488 - RNA, 19 nt, Haemophilus influenzae Rd
caaauaaccuaucccaaaa

SEQ ID NO: 688489 - RNA, 20 nt, Haemophilus influenzae Rd
caaauaacgcauaauuugcu

SEQ ID NO: 688490 - RNA, 22 nt, Haemophilus influenzae Rd
caaaggcaggacguuuuaauag

SEQ ID NO: 688491 - RNA, 16 nt, Haemophilus influenzae Rd
caaagggcacuuugca

SEQ ID NO: 688492 - RNA, 14 nt, Haemophilus influenzae Rd
auuuacuuuauaaa

SEQ ID NO: 688493 - RNA, 20 nt, Haemophilus influenzae Rd
auuuacuggaaauucuucaa

SEQ ID NO: 688494 - RNA, 13 nt, Haemophilus influenzae Rd
auuuagaaaguau

SEQ ID NO: 688495 - RNA, 20 nt, Haemophilus influenzae Rd
auuuagcggcuuuuugcuuu

SEQ ID NO: 688496 - RNA, 14 nt, Haemophilus influenzae Rd
auuuagcguauuuu

SEQ ID NO: 688497 - RNA, 19 nt, Haemophilus influenzae Rd
auuuagcgucgguaauauc

SEQ ID NO: 688498 - RNA, 13 nt, Haemophilus influenzae Rd
auuuagccaguaa

SEQ ID NO: 688499 - RNA, 16 nt, Haemophilus influenzae Rd
auuuagccaguaauuu

SEQ ID NO: 688500 - RNA, 16 nt, Haemophilus influenzae Rd
auuuaggcuauuuuau

SEQ ID NO: 688501 - RNA, 18 nt, Haemophilus influenzae Rd
auuuaggcuauuuuauaa

SEQ ID NO: 688502 - RNA, 21 nt, Haemophilus influenzae Rd
auuuagcccgaaaauuaagaa

SEQ ID NO: 688503 - RNA, 23 nt, Haemophilus influenzae Rd
auuuagcccgaaaauuaagaaaa

SEQ ID NO: 688504 - RNA, 13 nt, Haemophilus influenzae Rd
auuuaucauuccc

SEQ ID NO: 688505 - RNA, 14 nt, Haemophilus influenzae Rd
auuuaucaucuagu

SEQ ID NO: 688506 - RNA, 14 nt, Haemophilus influenzae Rd
auuuaucaaacaag

SEQ ID NO: 688507 - RNA, 14 nt, Haemophilus influenzae Rd
auuuauaguuuaaa

SEQ ID NO: 688508 - RNA, 19 nt, Haemophilus influenzae Rd
auuuauauaauuuaacaua

SEQ ID NO: 688509 - RNA, 18 nt, Haemophilus influenzae Rd
auuuauauaugauaaaaa

SEQ ID NO: 688510 - RNA, 19 nt, Haemophilus influenzae Rd
auuuacugauuuaaaaaaa

SEQ ID NO: 688511 - RNA, 16 nt, Haemophilus influenzae Rd
auuuacugauuuuaag

SEQ ID NO: 688512 - RNA, 19 nt, Haemophilus influenzae Rd
auuuacucuuuuuuagaua

SEQ ID NO: 688513 - RNA, 23 nt, Haemophilus influenzae Rd
auuuacucuuuuuuagauaaaaa

SEQ ID NO: 688514 - RNA, 18 nt, Haemophilus influenzae Rd
auuuacguaaaaaaguuu

SEQ ID NO: 688515 - RNA, 22 nt, Haemophilus influenzae Rd
auuuacguaaugcuuuugcuuc

SEQ ID NO: 688516 - RNA, 14 nt, Haemophilus influenzae Rd
auuuacgaaaacuu

SEQ ID NO: 688517 - RNA, 23 nt, Haemophilus influenzae Rd
auuuacgaaaacuuucauuccug

SEQ ID NO: 688518 - RNA, 21 nt, Haemophilus influenzae Rd
auuuacgcaaccaucuuuaau

SEQ ID NO: 688519 - RNA, 21 nt, Haemophilus influenzae Rd
auuuaccaauaggaagcauuu

SEQ ID NO: 688520 - RNA, 14 nt, Haemophilus influenzae Rd
auuuacccaaauua

SEQ ID NO: 688521 - RNA, 14 nt, Haemophilus influenzae Rd
auuuacagaacaaa

SEQ ID NO: 688522 - RNA, 18 nt, Haemophilus influenzae Rd
auuuacauuaauuuuucc

SEQ ID NO: 688523 - RNA, 19 nt, Haemophilus influenzae Rd
auuuacauuaauuuuuccg

SEQ ID NO: 688524 - RNA, 19 nt, Haemophilus influenzae Rd
auuuaaguaaugcuaaaua

SEQ ID NO: 688525 - RNA, 21 nt, Haemophilus influenzae Rd
auuuaaguaaugcuaaauaua

SEQ ID NO: 688526 - RNA, 19 nt, Haemophilus influenzae Rd
auuuaauaaaacaaaugua

SEQ ID NO: 688527 - RNA, 13 nt, Haemophilus influenzae Rd
auuuaauaaaaug

SEQ ID NO: 688528 - RNA, 14 nt, Haemophilus influenzae Rd
auuuaaugaugaaa

SEQ ID NO: 688529 - RNA, 16 nt, Haemophilus influenzae Rd
auuuaaugaugaaacu

SEQ ID NO: 688530 - RNA, 19 nt, Haemophilus influenzae Rd
auuuaauggcugaaugcuu

SEQ ID NO: 688531 - RNA, 20 nt, Haemophilus influenzae Rd
auuuaaugggugauccauaa

SEQ ID NO: 688532 - RNA, 20 nt, Haemophilus influenzae Rd
auuuaauuaggauguaaaaa

SEQ ID NO: 688533 - RNA, 14 nt, Haemophilus influenzae Rd
auuuaauuucaaaa

SEQ ID NO: 688534 - RNA, 16 nt, Haemophilus influenzae Rd
auuuaauuucaaaauc

SEQ ID NO: 688535 - RNA, 20 nt, Haemophilus influenzae Rd
auuuaauuucaaaaucacau

SEQ ID NO: 688536 - RNA, 12 nt, Haemophilus influenzae Rd
auuuaauuuuuu

SEQ ID NO: 688537 - RNA, 15 nt, Haemophilus influenzae Rd
auuuacaaacauauu

SEQ ID NO: 688538 - RNA, 20 nt, Haemophilus influenzae Rd
auuuaaaauuggacaauguu

SEQ ID NO: 688539 - RNA, 22 nt, Haemophilus influenzae Rd
auuuaaaaucagcccuuauuuu

SEQ ID NO: 688540 - RNA, 13 nt, Haemophilus influenzae Rd
auuuaaaaguaaa

SEQ ID NO: 688541 - RNA, 15 nt, Haemophilus influenzae Rd
auuuaaaaguaaaaa

SEQ ID NO: 688542 - RNA, 19 nt, Haemophilus influenzae Rd
auuuaaaaguaaaaauaaa

SEQ ID NO: 688543 - RNA, 20 nt, Haemophilus influenzae Rd
auuuaaaaguaaaaauaaaa

SEQ ID NO: 688544 - RNA, 16 nt, Haemophilus influenzae Rd
auuuaaaauauauauu

SEQ ID NO: 688545 - RNA, 15 nt, Haemophilus influenzae Rd
auuuaagcauccauc

SEQ ID NO: 688546 - RNA, 19 nt, Haemophilus influenzae Rd
auuuaaaccauuuuaauca

SEQ ID NO: 688547 - RNA, 16 nt, Haemophilus influenzae Rd
auugguacgagaaaaa

SEQ ID NO: 688548 - RNA, 19 nt, Haemophilus influenzae Rd
auugguacgccagucacuu

SEQ ID NO: 688549 - RNA, 15 nt, Haemophilus influenzae Rd
auugguaacaacugc

SEQ ID NO: 688550 - RNA, 22 nt, Haemophilus influenzae Rd
auugguaacaacugcuaggaca

SEQ ID NO: 688551 - RNA, 16 nt, Haemophilus influenzae Rd
auugguucuaaauauu

SEQ ID NO: 688552 - RNA, 18 nt, Haemophilus influenzae Rd
auugguucuaaauauuuu

SEQ ID NO: 688553 - RNA, 11 nt, Haemophilus influenzae Rd
auuguuuuuuc

SEQ ID NO: 688554 - RNA, 20 nt, Haemophilus influenzae Rd
auuguuuuuucauauuuuaa

SEQ ID NO: 688555 - RNA, 23 nt, Haemophilus influenzae Rd
auuguuuucuuuauuaaacaaaa

SEQ ID NO: 688556 - RNA, 16 nt, Haemophilus influenzae Rd
auuuaaaaaucuguga

SEQ ID NO: 688557 - RNA, 12 nt, Haemophilus influenzae Rd
auuuaaaacaag

SEQ ID NO: 688558 - RNA, 14 nt, Haemophilus influenzae Rd
auuucauaucuucu

SEQ ID NO: 688559 - RNA, 14 nt, Haemophilus influenzae Rd
auuucauaguuuuc

SEQ ID NO: 688560 - RNA, 19 nt, Haemophilus influenzae Rd
auuucauuguuaaauaaau

SEQ ID NO: 688561 - RNA, 20 nt, Haemophilus influenzae Rd
auuucauuguuaaauaaauc

SEQ ID NO: 688562 - RNA, 22 nt, Haemophilus influenzae Rd
auuucauuguuaaauaaauccu

SEQ ID NO: 688563 - RNA, 19 nt, Haemophilus influenzae Rd
auuucauucaacaauucau

SEQ ID NO: 688564 - RNA, 23 nt, Haemophilus influenzae Rd
auuucauuugcacccgcuuuaau

SEQ ID NO: 688565 - RNA, 17 nt, Haemophilus influenzae Rd
auuuccaacacauuauc

SEQ ID NO: 688566 - RNA, 18 nt, Haemophilus influenzae Rd
auuuccaacacauuauca

SEQ ID NO: 688567 - RNA, 19 nt, Haemophilus influenzae Rd
auuucaguagaaucaaggc

SEQ ID NO: 688568 - RNA, 20 nt, Haemophilus influenzae Rd
auuucaguagaaucaaggcu

SEQ ID NO: 688569 - RNA, 13 nt, Haemophilus influenzae Rd
auuucauaaaaau

SEQ ID NO: 688570 - RNA, 14 nt, Haemophilus influenzae Rd
auuucauaaaaauu

SEQ ID NO: 688571 - RNA, 18 nt, Haemophilus influenzae Rd
auuucauaaaaauuaggu

SEQ ID NO: 688572 - RNA, 22 nt, Haemophilus influenzae Rd
auuucauaaacgguauuuucuc

SEQ ID NO: 688573 - RNA, 15 nt, Haemophilus influenzae Rd
auuucacuuuacauu

SEQ ID NO: 688574 - RNA, 19 nt, Haemophilus influenzae Rd
auuucacuuuguuuuacuu

SEQ ID NO: 688575 - RNA, 15 nt, Haemophilus influenzae Rd
auuucacaccauuuu

SEQ ID NO: 688576 - RNA, 21 nt, Haemophilus influenzae Rd
auuucacauuaugauauuuca

SEQ ID NO: 688577 - RNA, 14 nt, Haemophilus influenzae Rd
auuucacaauuuuu

SEQ ID NO: 688578 - RNA, 15 nt, Haemophilus influenzae Rd
auuucacaauuuuug

SEQ ID NO: 688579 - RNA, 21 nt, Haemophilus influenzae Rd
auuucaccgcacuuuuuuaug

SEQ ID NO: 688580 - RNA, 22 nt, Haemophilus influenzae Rd
auuucaccgcagaaguaaaaua

SEQ ID NO: 688581 - RNA, 15 nt, Haemophilus influenzae Rd
auuucaccguauuuu

SEQ ID NO: 688582 - RNA, 22 nt, Haemophilus influenzae Rd
auuucacgcugacguuguucaa

SEQ ID NO: 688583 - RNA, 15 nt, Haemophilus influenzae Rd
auuucacuaaauaaa

SEQ ID NO: 688584 - RNA, 16 nt, Haemophilus influenzae Rd
auuucacuaaauaaau

SEQ ID NO: 688585 - RNA, 23 nt, Haemophilus influenzae Rd
auuucacuauucagcaaccuaaa

SEQ ID NO: 688586 - RNA, 21 nt, Haemophilus influenzae Rd
auuucacuggcucauuauuca

SEQ ID NO: 688587 - RNA, 17 nt, Haemophilus influenzae Rd
auuuaugaucuucaauc

SEQ ID NO: 688588 - RNA, 13 nt, Haemophilus influenzae Rd
auuuaucuucccc

SEQ ID NO: 688589 - RNA, 14 nt, Haemophilus influenzae Rd
auuuaucuuccccc

SEQ ID NO: 688590 - RNA, 15 nt, Haemophilus influenzae Rd
auuuaucuuccccca

SEQ ID NO: 688591 - RNA, 18 nt, Haemophilus influenzae Rd
auuuaugcuguuuuauag

SEQ ID NO: 688592 - RNA, 16 nt, Haemophilus influenzae Rd
auuuauggaaauaaau

SEQ ID NO: 688593 - RNA, 19 nt, Haemophilus influenzae Rd
auuuauggaaauaaauccu

SEQ ID NO: 688594 - RNA, 18 nt, Haemophilus influenzae Rd
auuuauguugaauuuuca

SEQ ID NO: 688595 - RNA, 13 nt, Haemophilus influenzae Rd
auuucaauugcca

SEQ ID NO: 688596 - RNA, 16 nt, Haemophilus influenzae Rd
auuucaauuuaagccc

SEQ ID NO: 688597 - RNA, 19 nt, Haemophilus influenzae Rd
auuucaauuuaagcccugc

SEQ ID NO: 688598 - RNA, 18 nt, Haemophilus influenzae Rd
auuucccauaauccagca

SEQ ID NO: 688599 - RNA, 15 nt, Haemophilus influenzae Rd
auuucccucaaaauu

SEQ ID NO: 688600 - RNA, 15 nt, Haemophilus influenzae Rd
auuuccacuuuuuca

SEQ ID NO: 688601 - RNA, 18 nt, Haemophilus influenzae Rd
auuuccaucaaaagauca

SEQ ID NO: 688602 - RNA, 12 nt, Haemophilus influenzae Rd
auuuccauucua

SEQ ID NO: 688603 - RNA, 18 nt, Haemophilus influenzae Rd
auuuccugugcauuggcu

SEQ ID NO: 688604 - RNA, 18 nt, Haemophilus influenzae Rd
auuuccuguauaauuuuu

SEQ ID NO: 688605 - RNA, 20 nt, Haemophilus influenzae Rd
auuuccucuucuuagauaga

SEQ ID NO: 688606 - RNA, 15 nt, Haemophilus influenzae Rd
auuuccugagaauuu

SEQ ID NO: 688607 - RNA, 17 nt, Haemophilus influenzae Rd
auuuccugagaauuuuc

SEQ ID NO: 688608 - RNA, 20 nt, Haemophilus influenzae Rd
auuuccuauacuaauuuuag

SEQ ID NO: 688609 - RNA, 11 nt, Haemophilus influenzae Rd
auuuccuuuuu

SEQ ID NO: 688610 - RNA, 17 nt, Haemophilus influenzae Rd
auuuccuuugcugccau

SEQ ID NO: 688611 - RNA, 16 nt, Haemophilus influenzae Rd
auuucgccauuuuuuc

SEQ ID NO: 688612 - RNA, 19 nt, Haemophilus influenzae Rd
auuucgcggacuuuuuuau

SEQ ID NO: 688613 - RNA, 18 nt, Haemophilus influenzae Rd
auuucgcuauuguuaaaa

SEQ ID NO: 688614 - RNA, 21 nt, Haemophilus influenzae Rd
auuuuaccgcacuuuuaaaau

SEQ ID NO: 688615 - RNA, 21 nt, Haemophilus influenzae Rd
auuuuaccgcacuuuuuuucu

SEQ ID NO: 688616 - RNA, 20 nt, Haemophilus influenzae Rd
auuuuaggugcuuuuaaauu

SEQ ID NO: 688617 - RNA, 14 nt, Haemophilus influenzae Rd
auuuuaguagauuu

SEQ ID NO: 688618 - RNA, 14 nt, Haemophilus influenzae Rd
auuuuaguauuuuu

SEQ ID NO: 688619 - RNA, 23 nt, Haemophilus influenzae Rd
auuuuaguuagauaagccauuaa

SEQ ID NO: 688620 - RNA, 17 nt, Haemophilus influenzae Rd
auuuuagcuaauggcug

SEQ ID NO: 688621 - RNA, 23 nt, Haemophilus influenzae Rd
auuuuaucaacuaaaaaauaguu

SEQ ID NO: 688622 - RNA, 13 nt, Haemophilus influenzae Rd
auuuuauauauua

SEQ ID NO: 688623 - RNA, 21 nt, Haemophilus influenzae Rd
auuuuauaucaagcugugcaa

SEQ ID NO: 688624 - RNA, 19 nt, Haemophilus influenzae Rd
auuuuccaccgcacuuucc

SEQ ID NO: 688625 - RNA, 16 nt, Haemophilus influenzae Rd
auuuuccaaaauuucu

SEQ ID NO: 688626 - RNA, 15 nt, Haemophilus influenzae Rd
auuuuccaaauucca

SEQ ID NO: 688627 - RNA, 22 nt, Haemophilus influenzae Rd
auuuuccauuggugaaaucaac

SEQ ID NO: 688628 - RNA, 16 nt, Haemophilus influenzae Rd
auuuuccaucaccuuc

SEQ ID NO: 688629 - RNA, 13 nt, Haemophilus influenzae Rd
auuuuccaucauc

SEQ ID NO: 688630 - RNA, 16 nt, Haemophilus influenzae Rd
auuuuccaucaucuua

SEQ ID NO: 688631 - RNA, 16 nt, Haemophilus influenzae Rd
auuuucccaguaaaua

SEQ ID NO: 688632 - RNA, 18 nt, Haemophilus influenzae Rd
auuuuccgcacuuuuuau

SEQ ID NO: 688633 - RNA, 16 nt, Haemophilus influenzae Rd
auuuucguuuacccac

SEQ ID NO: 688634 - RNA, 22 nt, Haemophilus influenzae Rd
auuuucuaaaaaacguauuaua

SEQ ID NO: 688635 - RNA, 23 nt, Haemophilus influenzae Rd
auuuucuaaaaaacguauuauac

SEQ ID NO: 688636 - RNA, 15 nt, Haemophilus influenzae Rd
auuuucuaaugaaau

SEQ ID NO: 688637 - RNA, 16 nt, Haemophilus influenzae Rd
auuuucuaauuuucac

SEQ ID NO: 688638 - RNA, 19 nt, Haemophilus influenzae Rd
auuuucaaauucauccaaa

SEQ ID NO: 688639 - RNA, 18 nt, Haemophilus influenzae Rd
auuuucaaauugaaaaga

SEQ ID NO: 688640 - RNA, 20 nt, Haemophilus influenzae Rd
auuuucaaauugaaaagaaa

SEQ ID NO: 688641 - RNA, 21 nt, Haemophilus influenzae Rd
auuuucaaauuguccuuugcc

SEQ ID NO: 688642 - RNA, 15 nt, Haemophilus influenzae Rd
auuuucaaccacuuc

SEQ ID NO: 688643 - RNA, 23 nt, Haemophilus influenzae Rd
auuuucaacaaacggucgaguuu

SEQ ID NO: 688644 - RNA, 11 nt, Haemophilus influenzae Rd
auuuucaagcc

SEQ ID NO: 688645 - RNA, 18 nt, Haemophilus influenzae Rd
auuuucaagccaccagag

SEQ ID NO: 688646 - RNA, 18 nt, Haemophilus influenzae Rd
auuuucaaauaaguuuga

SEQ ID NO: 688647 - RNA, 22 nt, Haemophilus influenzae Rd
auuuuaucuaaucauuaacaaa

SEQ ID NO: 688648 - RNA, 14 nt, Haemophilus influenzae Rd
auuuuauuuagaaa

SEQ ID NO: 688649 - RNA, 19 nt, Haemophilus influenzae Rd
auuuucaaagcguuuuaaa

SEQ ID NO: 688650 - RNA, 17 nt, Haemophilus influenzae Rd
auuuucucaucauuauu

SEQ ID NO: 688651 - RNA, 12 nt, Haemophilus influenzae Rd
auuuugaacaau

SEQ ID NO: 688652 - RNA, 19 nt, Haemophilus influenzae Rd
auuuugaacaaugucagaa

SEQ ID NO: 688653 - RNA, 23 nt, Haemophilus influenzae Rd
auuuucuuuuucaagaacagaaa

SEQ ID NO: 688654 - RNA, 15 nt, Haemophilus influenzae Rd
auuuucuuguucucc

SEQ ID NO: 688655 - RNA, 17 nt, Haemophilus influenzae Rd
auuuugcaugauauuuu

SEQ ID NO: 688656 - RNA, 22 nt, Haemophilus influenzae Rd
auuuugcaugauauuuuacguu

SEQ ID NO: 688657 - RNA, 20 nt, Haemophilus influenzae Rd
auuuugcauguuauucuccu

SEQ ID NO: 688658 - RNA, 20 nt, Haemophilus influenzae Rd
auuuugcccaauucucugca

SEQ ID NO: 688659 - RNA, 11 nt, Haemophilus influenzae Rd
auuuugcauau

SEQ ID NO: 688660 - RNA, 19 nt, Haemophilus influenzae Rd
auuuuuaaccgcacuuuua

SEQ ID NO: 688661 - RNA, 23 nt, Haemophilus influenzae Rd
auuuuuaaccgcacuuuuuaaua

SEQ ID NO: 688662 - RNA, 18 nt, Haemophilus influenzae Rd
auuuuggcuuaauuacua

SEQ ID NO: 688663 - RNA, 21 nt, Haemophilus influenzae Rd
auuuuggcuuaauuacuauau

SEQ ID NO: 688664 - RNA, 21 nt, Haemophilus influenzae Rd
auuuuggcacuggaaauggcu

SEQ ID NO: 688665 - RNA, 22 nt, Haemophilus influenzae Rd
auuuuggaucauuagcaacuuc

SEQ ID NO: 688666 - RNA, 19 nt, Haemophilus influenzae Rd
auuuugcuuuaaaucaaau

SEQ ID NO: 688667 - RNA, 20 nt, Haemophilus influenzae Rd
auuuugcuuuaaaucaaaua

SEQ ID NO: 688668 - RNA, 13 nt, Haemophilus influenzae Rd
auuuugcuuugcc

SEQ ID NO: 688669 - RNA, 20 nt, Haemophilus influenzae Rd
auuuuggaaugguugcaaag

SEQ ID NO: 688670 - RNA, 23 nt, Haemophilus influenzae Rd
auuuuggaaugguugcaaaggca

SEQ ID NO: 688671 - RNA, 17 nt, Haemophilus influenzae Rd
auuuuuaauuuugaagu

SEQ ID NO: 688672 - RNA, 18 nt, Haemophilus influenzae Rd
auuuuuaccauauccauu

SEQ ID NO: 688673 - RNA, 14 nt, Haemophilus influenzae Rd
auuuuuaccccacc

SEQ ID NO: 688674 - RNA, 17 nt, Haemophilus influenzae Rd
auuuuuacuauuaaugc

SEQ ID NO: 688675 - RNA, 23 nt, Haemophilus influenzae Rd
auuuuuacucguccaaauucauu

SEQ ID NO: 688676 - RNA, 19 nt, Haemophilus influenzae Rd
auuuuuagaagagauuauu

SEQ ID NO: 688677 - RNA, 22 nt, Haemophilus influenzae Rd
auuuuuagugauuuuaaauccc

SEQ ID NO: 688678 - RNA, 15 nt, Haemophilus influenzae Rd
auuuuuaauucuuca

SEQ ID NO: 688679 - RNA, 16 nt, Haemophilus influenzae Rd
auuuugguauuuuugu

SEQ ID NO: 688680 - RNA, 15 nt, Haemophilus influenzae Rd
auuuuuaaucaaaua

SEQ ID NO: 688681 - RNA, 13 nt, Haemophilus influenzae Rd
auuuuuaaugaac

SEQ ID NO: 688682 - RNA, 18 nt, Haemophilus influenzae Rd
auuuuuaaugcguuuuau

SEQ ID NO: 688683 - RNA, 20 nt, Haemophilus influenzae Rd
auuucuuucgccaguuuaga

SEQ ID NO: 688684 - RNA, 21 nt, Haemophilus influenzae Rd
auuucuuucguucaacccauu

SEQ ID NO: 688685 - RNA, 18 nt, Haemophilus influenzae Rd
auuucuuugaguaaaaaa

SEQ ID NO: 688686 - RNA, 19 nt, Haemophilus influenzae Rd
auuucuuugaguaaaaaau

SEQ ID NO: 688687 - RNA, 20 nt, Haemophilus influenzae Rd
auuucuuuaauugauuaaaa

SEQ ID NO: 688688 - RNA, 18 nt, Haemophilus influenzae Rd
auuucuuuacaaauuucg

SEQ ID NO: 688689 - RNA, 18 nt, Haemophilus influenzae Rd
auuucuuguuuaaauuca

SEQ ID NO: 688690 - RNA, 19 nt, Haemophilus influenzae Rd
auuucuuguuuaaauucag

SEQ ID NO: 688691 - RNA, 14 nt, Haemophilus influenzae Rd
auuucuuagauuuc

SEQ ID NO: 688692 - RNA, 17 nt, Haemophilus influenzae Rd
auuucuuaaaagaaauu

SEQ ID NO: 688693 - RNA, 16 nt, Haemophilus influenzae Rd
auuucuguuacuaaau

SEQ ID NO: 688694 - RNA, 15 nt, Haemophilus influenzae Rd
auuucuguauuuuuu

SEQ ID NO: 688695 - RNA, 17 nt, Haemophilus influenzae Rd
auuucuguauuuuuuau

SEQ ID NO: 688696 - RNA, 22 nt, Haemophilus influenzae Rd
auuucugccucuguauuuuuca

SEQ ID NO: 688697 - RNA, 14 nt, Haemophilus influenzae Rd
auuucuauccauuu

SEQ ID NO: 688698 - RNA, 16 nt, Haemophilus influenzae Rd
auuucuauccauuucu

SEQ ID NO: 688699 - RNA, 17 nt, Haemophilus influenzae Rd
auuucuaucgcauuuua

SEQ ID NO: 688700 - RNA, 18 nt, Haemophilus influenzae Rd
auuucuaucgcauuuuac

SEQ ID NO: 688701 - RNA, 14 nt, Haemophilus influenzae Rd
auuucuauagauuu

SEQ ID NO: 688702 - RNA, 20 nt, Haemophilus influenzae Rd
auuucugacgcauugcaggg

SEQ ID NO: 688703 - RNA, 16 nt, Haemophilus influenzae Rd
auuucucugauucgug

SEQ ID NO: 688704 - RNA, 19 nt, Haemophilus influenzae Rd
auuucguccaguuauaaua

SEQ ID NO: 688705 - RNA, 14 nt, Haemophilus influenzae Rd
auuucgugcaauaa

SEQ ID NO: 688706 - RNA, 16 nt, Haemophilus influenzae Rd
auuucgugcaauaaca

SEQ ID NO: 688707 - RNA, 23 nt, Haemophilus influenzae Rd
auuucgugcaauaacaagcacaa

SEQ ID NO: 688708 - RNA, 14 nt, Haemophilus influenzae Rd
auuucuaaucauuu

SEQ ID NO: 688709 - RNA, 22 nt, Haemophilus influenzae Rd
auuucuagcaacgacacacuau

SEQ ID NO: 688710 - RNA, 14 nt, Haemophilus influenzae Rd
auuucgucaaaaau

SEQ ID NO: 688711 - RNA, 12 nt, Haemophilus influenzae Rd
auuucgguuuca

SEQ ID NO: 688712 - RNA, 23 nt, Haemophilus influenzae Rd
auuugcugcugcugucgcuucua

SEQ ID NO: 688713 - RNA, 13 nt, Haemophilus influenzae Rd
auuugcugcugcu

SEQ ID NO: 688714 - RNA, 22 nt, Haemophilus influenzae Rd
auuugcuuacauugcuuaacau

SEQ ID NO: 688715 - RNA, 14 nt, Haemophilus influenzae Rd
auuugcuuggaaua

SEQ ID NO: 688716 - RNA, 17 nt, Haemophilus influenzae Rd
auuugcuuggaauaaau

SEQ ID NO: 688717 - RNA, 22 nt, Haemophilus influenzae Rd
auuugcauaaaaccagcauuga

SEQ ID NO: 688718 - RNA, 14 nt, Haemophilus influenzae Rd
auuugcauauguug

SEQ ID NO: 688719 - RNA, 11 nt, Haemophilus influenzae Rd
auuugcauauu

SEQ ID NO: 688720 - RNA, 21 nt, Haemophilus influenzae Rd
auuugcaccuuguaaccaagc

SEQ ID NO: 688721 - RNA, 22 nt, Haemophilus influenzae Rd
auuugccaaaacgcaauuucca

SEQ ID NO: 688722 - RNA, 16 nt, Haemophilus influenzae Rd
auuugccaaaaucacg

SEQ ID NO: 688723 - RNA, 13 nt, Haemophilus influenzae Rd
auuugcccauacc

SEQ ID NO: 688724 - RNA, 19 nt, Haemophilus influenzae Rd
auuugcccacauagcuuga

SEQ ID NO: 688725 - RNA, 22 nt, Haemophilus influenzae Rd
auuugcaaggcucgcgauuaau

SEQ ID NO: 688726 - RNA, 15 nt, Haemophilus influenzae Rd
auuugagcaagauga

SEQ ID NO: 688727 - RNA, 21 nt, Haemophilus influenzae Rd
auuugaaucaauuagaugacu

SEQ ID NO: 688728 - RNA, 20 nt, Haemophilus influenzae Rd
auuugaaucucacguacuuu

SEQ ID NO: 688729 - RNA, 14 nt, Haemophilus influenzae Rd
auuugaauguaaaa

SEQ ID NO: 688730 - RNA, 18 nt, Haemophilus influenzae Rd
auuugaauguaaaaauaa

SEQ ID NO: 688731 - RNA, 15 nt, Haemophilus influenzae Rd
auuugaauuuuacuu

SEQ ID NO: 688732 - RNA, 18 nt, Haemophilus influenzae Rd
auuugaauuuuacuucuu

SEQ ID NO: 688733 - RNA, 16 nt, Haemophilus influenzae Rd
auuugacgaaauaaau

SEQ ID NO: 688734 - RNA, 15 nt, Haemophilus influenzae Rd
auuugacuuauucca

SEQ ID NO: 688735 - RNA, 19 nt, Haemophilus influenzae Rd
auuugcuuuuugauuuugu

SEQ ID NO: 688736 - RNA, 16 nt, Haemophilus influenzae Rd
auuugcuuuuuguuac

SEQ ID NO: 688737 - RNA, 14 nt, Haemophilus influenzae Rd
auuuggaauaaacu

SEQ ID NO: 688738 - RNA, 13 nt, Haemophilus influenzae Rd
auuuggaauacuc

SEQ ID NO: 688739 - RNA, 19 nt, Haemophilus influenzae Rd
auuuggauaacaaauugcu

SEQ ID NO: 688740 - RNA, 13 nt, Haemophilus influenzae Rd
auuuggugagaua

SEQ ID NO: 688741 - RNA, 18 nt, Haemophilus influenzae Rd
auuugguuaguuguuuca

SEQ ID NO: 688742 - RNA, 14 nt, Haemophilus influenzae Rd
auuuguaccaccaa

SEQ ID NO: 688743 - RNA, 15 nt, Haemophilus influenzae Rd
auuuguaccaccaaa

SEQ ID NO: 688744 - RNA, 16 nt, Haemophilus influenzae Rd
auuuguaccaccaaaa

SEQ ID NO: 688745 - RNA, 14 nt, Haemophilus influenzae Rd
auuuguaccauugu

SEQ ID NO: 688746 - RNA, 21 nt, Haemophilus influenzae Rd
auuuguugaucugcaaauggu

SEQ ID NO: 688747 - RNA, 22 nt, Haemophilus influenzae Rd
auuuguugguaaaucuaacaau

SEQ ID NO: 688748 - RNA, 17 nt, Haemophilus influenzae Rd
auuuguuguucuccuug

SEQ ID NO: 688749 - RNA, 18 nt, Haemophilus influenzae Rd
auuuguuuuccguauuuu

SEQ ID NO: 688750 - RNA, 23 nt, Haemophilus influenzae Rd
auuuguuuuuaguuuuuuuauaa

SEQ ID NO: 688751 - RNA, 12 nt, Haemophilus influenzae Rd
auuuguuuuuua

SEQ ID NO: 688752 - RNA, 13 nt, Haemophilus influenzae Rd
auuuuaaaacaug

SEQ ID NO: 688753 - RNA, 16 nt, Haemophilus influenzae Rd
auuuuaaaaaauaauu

SEQ ID NO: 688754 - RNA, 14 nt, Haemophilus influenzae Rd
auuuuaaaauaaau

SEQ ID NO: 688755 - RNA, 14 nt, Haemophilus influenzae Rd
auuuuaaaauauca

SEQ ID NO: 688756 - RNA, 13 nt, Haemophilus influenzae Rd
auuuuaaugaaag

SEQ ID NO: 688757 - RNA, 12 nt, Haemophilus influenzae Rd
auuuuaaugcug

SEQ ID NO: 688758 - RNA, 22 nt, Haemophilus influenzae Rd
auuuuaaugcugaguaccaaaa

SEQ ID NO: 688759 - RNA, 15 nt, Haemophilus influenzae Rd
auucuucauaaaaaa

SEQ ID NO: 688760 - RNA, 17 nt, Haemophilus influenzae Rd
auucuucuaacauuucu

SEQ ID NO: 688761 - RNA, 17 nt, Haemophilus influenzae Rd
auucuucuaauucagug

SEQ ID NO: 688762 - RNA, 15 nt, Haemophilus influenzae Rd
auucuucuauuuuau

SEQ ID NO: 688763 - RNA, 23 nt, Haemophilus influenzae Rd
auucuucgaaaauaacuucaucc

SEQ ID NO: 688764 - RNA, 16 nt, Haemophilus influenzae Rd
auucuucccagcguaa

SEQ ID NO: 688765 - RNA, 23 nt, Haemophilus influenzae Rd
auucuuccguugcauuuaacuua

SEQ ID NO: 688766 - RNA, 17 nt, Haemophilus influenzae Rd
auucugcacgacgugcu

SEQ ID NO: 688767 - RNA, 18 nt, Haemophilus influenzae Rd
auucugcauaaaauaauu

SEQ ID NO: 688768 - RNA, 18 nt, Haemophilus influenzae Rd
auucugaaugaucgagua

SEQ ID NO: 688769 - RNA, 23 nt, Haemophilus influenzae Rd
auucugaaugaucgaguaaaaau

SEQ ID NO: 688770 - RNA, 11 nt, Haemophilus influenzae Rd
auugaaauuuu

SEQ ID NO: 688771 - RNA, 20 nt, Haemophilus influenzae Rd
auugaaauuuuaauuuaguu

SEQ ID NO: 688772 - RNA, 19 nt, Haemophilus influenzae Rd
auugaaauuggaauccagc

SEQ ID NO: 688773 - RNA, 18 nt, Haemophilus influenzae Rd
auugaacugaauuaaaaa

SEQ ID NO: 688774 - RNA, 15 nt, Haemophilus influenzae Rd
auugaacuguuugau

SEQ ID NO: 688775 - RNA, 16 nt, Haemophilus influenzae Rd
auucuuuugccauaua

SEQ ID NO: 688776 - RNA, 17 nt, Haemophilus influenzae Rd
auucuuugccuugaugc

SEQ ID NO: 688777 - RNA, 14 nt, Haemophilus influenzae Rd
auucuuuccucucc

SEQ ID NO: 688778 - RNA, 17 nt, Haemophilus influenzae Rd
auucuuuaugaauuacc

SEQ ID NO: 688779 - RNA, 19 nt, Haemophilus influenzae Rd
auucuuucaauaauuuuuc

SEQ ID NO: 688780 - RNA, 20 nt, Haemophilus influenzae Rd
auucuuucaauaauuuuucu

SEQ ID NO: 688781 - RNA, 23 nt, Haemophilus influenzae Rd
auucuuguuuaauauuuuuuuca

SEQ ID NO: 688782 - RNA, 11 nt, Haemophilus influenzae Rd
auucuuuaaaa

SEQ ID NO: 688783 - RNA, 15 nt, Haemophilus influenzae Rd
auucuuuaaaacauu

SEQ ID NO: 688784 - RNA, 13 nt, Haemophilus influenzae Rd
auucuugucuuuu

SEQ ID NO: 688785 - RNA, 15 nt, Haemophilus influenzae Rd
auucuugucuuuuaa

SEQ ID NO: 688786 - RNA, 22 nt, Haemophilus influenzae Rd
auucuugucuuuuaaguuagga

SEQ ID NO: 688787 - RNA, 12 nt, Haemophilus influenzae Rd
auucuuguucug

SEQ ID NO: 688788 - RNA, 20 nt, Haemophilus influenzae Rd
auucuuuaaagagcaaauuu

SEQ ID NO: 688789 - RNA, 21 nt, Haemophilus influenzae Rd
auucuuuaaagagcaaauuua

SEQ ID NO: 688790 - RNA, 13 nt, Haemophilus influenzae Rd
auucuuuaaauau

SEQ ID NO: 688791 - RNA, 16 nt, Haemophilus influenzae Rd
auucuugccagauuuu

SEQ ID NO: 688792 - RNA, 20 nt, Haemophilus influenzae Rd
auucuugcguaaccaaagaa

SEQ ID NO: 688793 - RNA, 22 nt, Haemophilus influenzae Rd
auucuugcuugaucauccauuu

SEQ ID NO: 688794 - RNA, 16 nt, Haemophilus influenzae Rd
auucucaaaugaggaa

SEQ ID NO: 688795 - RNA, 23 nt, Haemophilus influenzae Rd
auucucaagaauauauuuuauca

SEQ ID NO: 688796 - RNA, 18 nt, Haemophilus influenzae Rd
auucucacaucaucaagu

SEQ ID NO: 688797 - RNA, 12 nt, Haemophilus influenzae Rd
auucuacauaau

SEQ ID NO: 688798 - RNA, 15 nt, Haemophilus influenzae Rd
auucuacgccauuuu

SEQ ID NO: 688799 - RNA, 21 nt, Haemophilus influenzae Rd
auucuacguauugaacuaaaa

SEQ ID NO: 688800 - RNA, 20 nt, Haemophilus influenzae Rd
auucuacgucaaagccauau

SEQ ID NO: 688801 - RNA, 13 nt, Haemophilus influenzae Rd
auucucauuuuag

SEQ ID NO: 688802 - RNA, 21 nt, Haemophilus influenzae Rd
auucucucgcugaauuauugu

SEQ ID NO: 688803 - RNA, 24 nt, Haemophilus influenzae Rd
auucucucgcugaauuauugucuu

SEQ ID NO: 688804 - RNA, 15 nt, Haemophilus influenzae Rd
auucucucguaaaau

SEQ ID NO: 688805 - RNA, 20 nt, Haemophilus influenzae Rd
auucugaaaccacuaaaaac

SEQ ID NO: 688806 - RNA, 17 nt, Haemophilus influenzae Rd
auucgugcaaauuuuuu

SEQ ID NO: 688807 - RNA, 18 nt, Haemophilus influenzae Rd
auucguggcaauuuuucu

SEQ ID NO: 688808 - RNA, 20 nt, Haemophilus influenzae Rd
auucguguagaucagccccu

SEQ ID NO: 688809 - RNA, 21 nt, Haemophilus influenzae Rd
auucguuguaccaaucaaagu

SEQ ID NO: 688810 - RNA, 13 nt, Haemophilus influenzae Rd
auucguuucagua

SEQ ID NO: 688811 - RNA, 15 nt, Haemophilus influenzae Rd
auucgguuuuucuua

SEQ ID NO: 688812 - RNA, 19 nt, Haemophilus influenzae Rd
auucguaucaacuuuugag

SEQ ID NO: 688813 - RNA, 15 nt, Haemophilus influenzae Rd
auucguauaaauauu

SEQ ID NO: 688814 - RNA, 14 nt, Haemophilus influenzae Rd
auucuaaauucuca

SEQ ID NO: 688815 - RNA, 22 nt, Haemophilus influenzae Rd
auucuaaauucucaagaauaua

SEQ ID NO: 688816 - RNA, 13 nt, Haemophilus influenzae Rd
auucuaaaaacuc

SEQ ID NO: 688817 - RNA, 20 nt, Haemophilus influenzae Rd
auucuaaaaagaagcucacu

SEQ ID NO: 688818 - RNA, 16 nt, Haemophilus influenzae Rd
auucuaaaaaaaucac

SEQ ID NO: 688819 - RNA, 13 nt, Haemophilus influenzae Rd
auucuaauuaacu

SEQ ID NO: 688820 - RNA, 23 nt, Haemophilus influenzae Rd
auucuaauuccccuucaaauaua

SEQ ID NO: 688821 - RNA, 23 nt, Haemophilus influenzae Rd
auucuaagguucgauaguauuuu

SEQ ID NO: 688822 - RNA, 10 nt, Haemophilus influenzae Rd
auucuaauga

SEQ ID NO: 688823 - RNA, 18 nt, Haemophilus influenzae Rd
auugauucuuuaugaauu

SEQ ID NO: 688824 - RNA, 14 nt, Haemophilus influenzae Rd
auugauugcuaaau

SEQ ID NO: 688825 - RNA, 15 nt, Haemophilus influenzae Rd
auugauugcuaaaua

SEQ ID NO: 688826 - RNA, 16 nt, Haemophilus influenzae Rd
auugauugcuaaauaa

SEQ ID NO: 688827 - RNA, 13 nt, Haemophilus influenzae Rd
auugauuuacauu

SEQ ID NO: 688828 - RNA, 17 nt, Haemophilus influenzae Rd
auugauuuacauuaauu

SEQ ID NO: 688829 - RNA, 23 nt, Haemophilus influenzae Rd
auugauuuacauuaauuuuuccg

SEQ ID NO: 688830 - RNA, 20 nt, Haemophilus influenzae Rd
auugcaggcuuagcaauaau

SEQ ID NO: 688831 - RNA, 15 nt, Haemophilus influenzae Rd
auugcagggaauaag

SEQ ID NO: 688832 - RNA, 17 nt, Haemophilus influenzae Rd
auugcagggauauugcc

SEQ ID NO: 688833 - RNA, 13 nt, Haemophilus influenzae Rd
auugaugaaaugg

SEQ ID NO: 688834 - RNA, 13 nt, Haemophilus influenzae Rd
auugaugcuaaau

SEQ ID NO: 688835 - RNA, 23 nt, Haemophilus influenzae Rd
auugaugcccacuuuuccuaaag

SEQ ID NO: 688836 - RNA, 15 nt, Haemophilus influenzae Rd
auugauggaauuuau

SEQ ID NO: 688837 - RNA, 22 nt, Haemophilus influenzae Rd
auugauguaaaagauaaaacag

SEQ ID NO: 688838 - RNA, 15 nt, Haemophilus influenzae Rd
auugauucuaaaaac

SEQ ID NO: 688839 - RNA, 22 nt, Haemophilus influenzae Rd
auugaagagauugauuuucuuu

SEQ ID NO: 688840 - RNA, 13 nt, Haemophilus influenzae Rd
auugaauuuuucu

SEQ ID NO: 688841 - RNA, 20 nt, Haemophilus influenzae Rd
auugaauuuuucuaagguau

SEQ ID NO: 688842 - RNA, 16 nt, Haemophilus influenzae Rd
auugacaauguuuuag

SEQ ID NO: 688843 - RNA, 17 nt, Haemophilus influenzae Rd
auugaccauuucaucua

SEQ ID NO: 688844 - RNA, 20 nt, Haemophilus influenzae Rd
auugauauauucuucuucaa

SEQ ID NO: 688845 - RNA, 23 nt, Haemophilus influenzae Rd
auugauccuagauguaacugaaa

SEQ ID NO: 688846 - RNA, 14 nt, Haemophilus influenzae Rd
auugaucagaaguu

SEQ ID NO: 688847 - RNA, 13 nt, Haemophilus influenzae Rd
auugaucuaaauu

SEQ ID NO: 688848 - RNA, 16 nt, Haemophilus influenzae Rd
auugcauuuuuauaaa

SEQ ID NO: 688849 - RNA, 17 nt, Haemophilus influenzae Rd
auugcauuuuuuauaaa

SEQ ID NO: 688850 - RNA, 20 nt, Haemophilus influenzae Rd
auugcauuuuuuauaaaugg

SEQ ID NO: 688851 - RNA, 16 nt, Haemophilus influenzae Rd
auugcaugaaauguag

SEQ ID NO: 688852 - RNA, 20 nt, Haemophilus influenzae Rd
auugcauugccuaaauacau

SEQ ID NO: 688853 - RNA, 18 nt, Haemophilus influenzae Rd
auugcaucuuggcauuuu

SEQ ID NO: 688854 - RNA, 21 nt, Haemophilus influenzae Rd
auugcaucuuggcauuuuugc

SEQ ID NO: 688855 - RNA, 15 nt, Haemophilus influenzae Rd
auugcauaguuuuau

SEQ ID NO: 688856 - RNA, 21 nt, Haemophilus influenzae Rd
auugccauauaagcaaagaaa

SEQ ID NO: 688857 - RNA, 19 nt, Haemophilus influenzae Rd
auugccauaauaaucacaa

SEQ ID NO: 688858 - RNA, 19 nt, Haemophilus influenzae Rd
auugccaacuuagauuuuc

SEQ ID NO: 688859 - RNA, 15 nt, Haemophilus influenzae Rd
auugcgguuucaguu

SEQ ID NO: 688860 - RNA, 13 nt, Haemophilus influenzae Rd
auuggaaaaguaa

SEQ ID NO: 688861 - RNA, 15 nt, Haemophilus influenzae Rd
auuggaaaauaaaau

SEQ ID NO: 688862 - RNA, 15 nt, Haemophilus influenzae Rd
auuggaaaauucaaa

SEQ ID NO: 688863 - RNA, 11 nt, Haemophilus influenzae Rd
auuggaaagua

SEQ ID NO: 688864 - RNA, 20 nt, Haemophilus influenzae Rd
auugcugcuuuaauuucauu

SEQ ID NO: 688865 - RNA, 16 nt, Haemophilus influenzae Rd
auuggacggcaaaaau

SEQ ID NO: 688866 - RNA, 13 nt, Haemophilus influenzae Rd
auuggaagauuuc

SEQ ID NO: 688867 - RNA, 18 nt, Haemophilus influenzae Rd
auuggaacgauuaaaaau

SEQ ID NO: 688868 - RNA, 20 nt, Haemophilus influenzae Rd
auuggaacgauuaaaaaugc

SEQ ID NO: 688869 - RNA, 14 nt, Haemophilus influenzae Rd
auuggaaguuuuuc

SEQ ID NO: 688870 - RNA, 14 nt, Haemophilus influenzae Rd
auucauguuuuuua

SEQ ID NO: 688871 - RNA, 17 nt, Haemophilus influenzae Rd
auucauguuuuuuagau

SEQ ID NO: 688872 - RNA, 21 nt, Haemophilus influenzae Rd
auucaucguaauuaaacaaaa

SEQ ID NO: 688873 - RNA, 16 nt, Haemophilus influenzae Rd
auucaucuaaaaaacu

SEQ ID NO: 688874 - RNA, 23 nt, Haemophilus influenzae Rd
auucaucuucugcugauaaucca

SEQ ID NO: 688875 - RNA, 14 nt, Haemophilus influenzae Rd
auucaucacuucuu

SEQ ID NO: 688876 - RNA, 13 nt, Haemophilus influenzae Rd
auucaucagaaag

SEQ ID NO: 688877 - RNA, 15 nt, Haemophilus influenzae Rd
auucaucagaaagug

SEQ ID NO: 688878 - RNA, 15 nt, Haemophilus influenzae Rd
auucaucaaaucauu

SEQ ID NO: 688879 - RNA, 19 nt, Haemophilus influenzae Rd
auguugcaaguauuagcug

SEQ ID NO: 688880 - RNA, 22 nt, Haemophilus influenzae Rd
auucaguaucaaauacacaaau

SEQ ID NO: 688881 - RNA, 20 nt, Haemophilus influenzae Rd
auguucuuuguugaugauuu

SEQ ID NO: 688882 - RNA, 17 nt, Haemophilus influenzae Rd
auguucuuuuaaaagac

SEQ ID NO: 688883 - RNA, 14 nt, Haemophilus influenzae Rd
auguugaauuuuca

SEQ ID NO: 688884 - RNA, 16 nt, Haemophilus influenzae Rd
auucaguguaguuuuc

SEQ ID NO: 688885 - RNA, 21 nt, Haemophilus influenzae Rd
auucaguccaugcguuuuauu

SEQ ID NO: 688886 - RNA, 16 nt, Haemophilus influenzae Rd
auucaguccgcauuga

SEQ ID NO: 688887 - RNA, 16 nt, Haemophilus influenzae Rd
auucagugcuuuuuca

SEQ ID NO: 688888 - RNA, 20 nt, Haemophilus influenzae Rd
auucagugcuuuuucaagga

SEQ ID NO: 688889 - RNA, 22 nt, Haemophilus influenzae Rd
auucagugcuuuuucaaggaaa

SEQ ID NO: 688890 - RNA, 22 nt, Haemophilus influenzae Rd
auucauaauccguuaaauuuag

SEQ ID NO: 688891 - RNA, 16 nt, Haemophilus influenzae Rd
auucauaccgauaaca

SEQ ID NO: 688892 - RNA, 14 nt, Haemophilus influenzae Rd
auuccacuuuuuca

SEQ ID NO: 688893 - RNA, 21 nt, Haemophilus influenzae Rd
auuccagccccucagauaaug

SEQ ID NO: 688894 - RNA, 16 nt, Haemophilus influenzae Rd
auuccaguucuccuuc

SEQ ID NO: 688895 - RNA, 17 nt, Haemophilus influenzae Rd
auuccaguucuccuucu

SEQ ID NO: 688896 - RNA, 16 nt, Haemophilus influenzae Rd
auuccauaauaucuuu

SEQ ID NO: 688897 - RNA, 18 nt, Haemophilus influenzae Rd
auuccauaguucacuaaa

SEQ ID NO: 688898 - RNA, 13 nt, Haemophilus influenzae Rd
auuccauuaacua

SEQ ID NO: 688899 - RNA, 18 nt, Haemophilus influenzae Rd
auuccauucacuuucaca

SEQ ID NO: 688900 - RNA, 16 nt, Haemophilus influenzae Rd
auucccaauuccguuu

SEQ ID NO: 688901 - RNA, 23 nt, Haemophilus influenzae Rd
auuccauuugaagaauuuguugu

SEQ ID NO: 688902 - RNA, 17 nt, Haemophilus influenzae Rd
auuccaacgauuuugca

SEQ ID NO: 688903 - RNA, 18 nt, Haemophilus influenzae Rd
auuccaacgauuuugcaa

SEQ ID NO: 688904 - RNA, 14 nt, Haemophilus influenzae Rd
auuccaaaguuuag

SEQ ID NO: 688905 - RNA, 12 nt, Haemophilus influenzae Rd
auuccaagguuu

SEQ ID NO: 688906 - RNA, 19 nt, Haemophilus influenzae Rd
auuccaaacuggaauaaag

SEQ ID NO: 688907 - RNA, 22 nt, Haemophilus influenzae Rd
auuccaaacuggaauaaagcaa

SEQ ID NO: 688908 - RNA, 18 nt, Haemophilus influenzae Rd
auucauuuuuuauuuuuu

SEQ ID NO: 688909 - RNA, 21 nt, Haemophilus influenzae Rd
auucauuuuuuauuuuuucua

SEQ ID NO: 688910 - RNA, 13 nt, Haemophilus influenzae Rd
auucauucauuuu

SEQ ID NO: 688911 - RNA, 21 nt, Haemophilus influenzae Rd
auucauuauuacuuuuuuaag

SEQ ID NO: 688912 - RNA, 20 nt, Haemophilus influenzae Rd
auucauuaaggcuuuucuuu

SEQ ID NO: 688913 - RNA, 18 nt, Haemophilus influenzae Rd
auucauuaaguuuucuac

SEQ ID NO: 688914 - RNA, 17 nt, Haemophilus influenzae Rd
auucauuugcaaaucaa

SEQ ID NO: 688915 - RNA, 15 nt, Haemophilus influenzae Rd
auucauuuaaaacaa

SEQ ID NO: 688916 - RNA, 21 nt, Haemophilus influenzae Rd
auucauuuaaaauauauauua

SEQ ID NO: 688917 - RNA, 14 nt, Haemophilus influenzae Rd
auucauucuugcuu

SEQ ID NO: 688918 - RNA, 15 nt, Haemophilus influenzae Rd
auucauugcauuuuu

SEQ ID NO: 688919 - RNA, 16 nt, Haemophilus influenzae Rd
auucauugcauuuuua

SEQ ID NO: 688920 - RNA, 14 nt, Haemophilus influenzae Rd
auucgcuucuuuua

SEQ ID NO: 688921 - RNA, 23 nt, Haemophilus influenzae Rd
auucggcuucaguauccgccaau

SEQ ID NO: 688922 - RNA, 17 nt, Haemophilus influenzae Rd
auucgcuuucauaaauu

SEQ ID NO: 688923 - RNA, 14 nt, Haemophilus influenzae Rd
auucgcuuuucuuu

SEQ ID NO: 688924 - RNA, 17 nt, Haemophilus influenzae Rd
auucgcuuggaguucuu

SEQ ID NO: 688925 - RNA, 14 nt, Haemophilus influenzae Rd
auucgcugauuuau

SEQ ID NO: 688926 - RNA, 21 nt, Haemophilus influenzae Rd
auucgcccgaaacucaccauu

SEQ ID NO: 688927 - RNA, 12 nt, Haemophilus influenzae Rd
auucgcaccuuc

SEQ ID NO: 688928 - RNA, 16 nt, Haemophilus influenzae Rd
auucgcauauuuuugc

SEQ ID NO: 688929 - RNA, 19 nt, Haemophilus influenzae Rd
auucgcauauuuuugcaag

SEQ ID NO: 688930 - RNA, 17 nt, Haemophilus influenzae Rd
auucgccuugcuuuuaa

SEQ ID NO: 688931 - RNA, 22 nt, Haemophilus influenzae Rd
auuccuuauucaaauaacguaa

SEQ ID NO: 688932 - RNA, 22 nt, Haemophilus influenzae Rd
auuccuucaaauucuacauggc

SEQ ID NO: 688933 - RNA, 14 nt, Haemophilus influenzae Rd
auuccuuacaacaa

SEQ ID NO: 688934 - RNA, 15 nt, Haemophilus influenzae Rd
auuccuuacaacaaa

SEQ ID NO: 688935 - RNA, 16 nt, Haemophilus influenzae Rd
auuccuuuauuuugca

SEQ ID NO: 688936 - RNA, 23 nt, Haemophilus influenzae Rd
auuccuucgccuucggcucccau

SEQ ID NO: 688937 - RNA, 22 nt, Haemophilus influenzae Rd
auuccuuuugaacuuuuaacug

SEQ ID NO: 688938 - RNA, 15 nt, Haemophilus influenzae Rd
auuccuauucuaaau

SEQ ID NO: 688939 - RNA, 19 nt, Haemophilus influenzae Rd
auuccuccgccaucaauuu

SEQ ID NO: 688940 - RNA, 17 nt, Haemophilus influenzae Rd
auucccuuuacauuugg

SEQ ID NO: 688941 - RNA, 13 nt, Haemophilus influenzae Rd
auuccgauuuuac

SEQ ID NO: 688942 - RNA, 23 nt, Haemophilus influenzae Rd
auuccguaguuauuuauuuaaga

SEQ ID NO: 688943 - RNA, 20 nt, Haemophilus influenzae Rd
auucccauuucuaaugcaau

SEQ ID NO: 688944 - RNA, 23 nt, Haemophilus influenzae Rd
auuccccgcuuucgcuucugcuu

SEQ ID NO: 688945 - RNA, 16 nt, Haemophilus influenzae Rd
auucccuagccuuuuc

SEQ ID NO: 688946 - RNA, 17 nt, Haemophilus influenzae Rd
auucccuagccuuuucu

SEQ ID NO: 688947 - RNA, 14 nt, Haemophilus influenzae Rd
aucuguaaaccauu

SEQ ID NO: 688948 - RNA, 21 nt, Haemophilus influenzae Rd
aucuguaaaccuuuuggcauu

SEQ ID NO: 688949 - RNA, 19 nt, Haemophilus influenzae Rd
aucuggugagugagcauuu

SEQ ID NO: 688950 - RNA, 15 nt, Haemophilus influenzae Rd
aucugugauauauau

SEQ ID NO: 688951 - RNA, 21 nt, Haemophilus influenzae Rd
aucugugauauauaucacaga

SEQ ID NO: 688952 - RNA, 22 nt, Haemophilus influenzae Rd
aucugucaucgauguaaagugu

SEQ ID NO: 688953 - RNA, 17 nt, Haemophilus influenzae Rd
aucuaagauacccauuu

SEQ ID NO: 688954 - RNA, 19 nt, Haemophilus influenzae Rd
aucuaagauacccauuucg

SEQ ID NO: 688955 - RNA, 14 nt, Haemophilus influenzae Rd
aucuaacucuuggc

SEQ ID NO: 688956 - RNA, 12 nt, Haemophilus influenzae Rd
aucuaaggucau

SEQ ID NO: 688957 - RNA, 20 nt, Haemophilus influenzae Rd
aucuaagcucggaauguuuu

SEQ ID NO: 688958 - RNA, 13 nt, Haemophilus influenzae Rd
aucuaagauuuua

SEQ ID NO: 688959 - RNA, 14 nt, Haemophilus influenzae Rd
aucuaagauuuuag

SEQ ID NO: 688960 - RNA, 16 nt, Haemophilus influenzae Rd
aucuaaugccuuuccu

SEQ ID NO: 688961 - RNA, 17 nt, Haemophilus influenzae Rd
aucuaauccuaaaaugc

SEQ ID NO: 688962 - RNA, 21 nt, Haemophilus influenzae Rd
aucuaaucgggcuuuaucaua

SEQ ID NO: 688963 - RNA, 15 nt, Haemophilus influenzae Rd
aucuacaaaacauaa

SEQ ID NO: 688964 - RNA, 17 nt, Haemophilus influenzae Rd
aucuaauugauucaaau

SEQ ID NO: 688965 - RNA, 18 nt, Haemophilus influenzae Rd
aucuaauugauucaaauc

SEQ ID NO: 688966 - RNA, 23 nt, Haemophilus influenzae Rd
aucuaauugggucguuagcucag

SEQ ID NO: 688967 - RNA, 13 nt, Haemophilus influenzae Rd
aucuaauucuucc

SEQ ID NO: 688968 - RNA, 13 nt, Haemophilus influenzae Rd
aucugcuuuucuu

SEQ ID NO: 688969 - RNA, 16 nt, Haemophilus influenzae Rd
aucuggauauugcuca

SEQ ID NO: 688970 - RNA, 16 nt, Haemophilus influenzae Rd
aucugcucuugaaaua

SEQ ID NO: 688971 - RNA, 15 nt, Haemophilus influenzae Rd
aucuucauauccacc

SEQ ID NO: 688972 - RNA, 12 nt, Haemophilus influenzae Rd
aucuucaucaau

SEQ ID NO: 688973 - RNA, 20 nt, Haemophilus influenzae Rd
aucuucauacuuagauaaau

SEQ ID NO: 688974 - RNA, 23 nt, Haemophilus influenzae Rd
aucuucaguacgcaccacuucgc

SEQ ID NO: 688975 - RNA, 17 nt, Haemophilus influenzae Rd
aucuucagcauuuacca

SEQ ID NO: 688976 - RNA, 13 nt, Haemophilus influenzae Rd
aucuucaaucauc

SEQ ID NO: 688977 - RNA, 22 nt, Haemophilus influenzae Rd
aucuucaaucaucauuuauuaa

SEQ ID NO: 688978 - RNA, 15 nt, Haemophilus influenzae Rd
aucuucaauuucuac

SEQ ID NO: 688979 - RNA, 16 nt, Haemophilus influenzae Rd
aucuuauuucaauauu

SEQ ID NO: 688980 - RNA, 17 nt, Haemophilus influenzae Rd
aucuuauuucaauauug

SEQ ID NO: 688981 - RNA, 16 nt, Haemophilus influenzae Rd
aucuucaacgauaaca

SEQ ID NO: 688982 - RNA, 15 nt, Haemophilus influenzae Rd
aucuuaugaaacagc

SEQ ID NO: 688983 - RNA, 17 nt, Haemophilus influenzae Rd
aucuuaccuuuuucuac

SEQ ID NO: 688984 - RNA, 20 nt, Haemophilus influenzae Rd
aucuuagacaaauuaaauua

SEQ ID NO: 688985 - RNA, 14 nt, Haemophilus influenzae Rd
aucuuaguauuuua

SEQ ID NO: 688986 - RNA, 15 nt, Haemophilus influenzae Rd
aucuuaguauuuuau

SEQ ID NO: 688987 - RNA, 23 nt, Haemophilus influenzae Rd
aucuuaguauuuuauuuaagcuu

SEQ ID NO: 688988 - RNA, 23 nt, Haemophilus influenzae Rd
aucuguugaaucucagcaagcug

SEQ ID NO: 688989 - RNA, 22 nt, Haemophilus influenzae Rd
aucugugugggcacuuguugau

SEQ ID NO: 688990 - RNA, 16 nt, Haemophilus influenzae Rd
aucuuaaaaaagauga

SEQ ID NO: 688991 - RNA, 17 nt, Haemophilus influenzae Rd
aucuucggauuuuucaa

SEQ ID NO: 688992 - RNA, 23 nt, Haemophilus influenzae Rd
aucuucgcucguuguagcccaau

SEQ ID NO: 688993 - RNA, 21 nt, Haemophilus influenzae Rd
aucuucgaugugcauuuuuca

SEQ ID NO: 688994 - RNA, 22 nt, Haemophilus influenzae Rd
aucuucgaugugcauuuuucau

SEQ ID NO: 688995 - RNA, 18 nt, Haemophilus influenzae Rd
aucuuccguuuuuuucac

SEQ ID NO: 688996 - RNA, 15 nt, Haemophilus influenzae Rd
aucuucccccaaaaa

SEQ ID NO: 688997 - RNA, 21 nt, Haemophilus influenzae Rd
aucuucccccaaaaaguuaga

SEQ ID NO: 688998 - RNA, 21 nt, Haemophilus influenzae Rd
aucuuccauaucacauuuuau

SEQ ID NO: 688999 - RNA, 17 nt, Haemophilus influenzae Rd
aucuucaugauuuucca

SEQ ID NO: 689000 - RNA, 22 nt, Haemophilus influenzae Rd
aucuucaugauuuuccaaaauu

SEQ ID NO: 689001 - RNA, 23 nt, Haemophilus influenzae Rd
aucuucaugauuuuccaaaauuu

SEQ ID NO: 689002 - RNA, 13 nt, Haemophilus influenzae Rd
aucuuccaaagca

SEQ ID NO: 689003 - RNA, 17 nt, Haemophilus influenzae Rd
aucuuccaauaauucuu

SEQ ID NO: 689004 - RNA, 18 nt, Haemophilus influenzae Rd
aucuuccaauaauucuuu

SEQ ID NO: 689005 - RNA, 14 nt, Haemophilus influenzae Rd
aucuuccaauacaa

SEQ ID NO: 689006 - RNA, 15 nt, Haemophilus influenzae Rd
aucuuccaauacaau

SEQ ID NO: 689007 - RNA, 22 nt, Haemophilus influenzae Rd
aucuucuacuguuaauuugcca

SEQ ID NO: 689008 - RNA, 19 nt, Haemophilus influenzae Rd
aucuugcguuaaaucaaaa

SEQ ID NO: 689009 - RNA, 16 nt, Haemophilus influenzae Rd
aucuugcuuuuuuaau

SEQ ID NO: 689010 - RNA, 15 nt, Haemophilus influenzae Rd
aucuuguaauuuuuu

SEQ ID NO: 689011 - RNA, 14 nt, Haemophilus influenzae Rd
aucuuuuuuugcuu

SEQ ID NO: 689012 - RNA, 21 nt, Haemophilus influenzae Rd
aucuuuuuguaauuucucacc

SEQ ID NO: 689013 - RNA, 12 nt, Haemophilus influenzae Rd
augaaaaauaau

SEQ ID NO: 689014 - RNA, 13 nt, Haemophilus influenzae Rd
augaaaaaaagaa

SEQ ID NO: 689015 - RNA, 21 nt, Haemophilus influenzae Rd
augaaaugccgauaauagaca

SEQ ID NO: 689016 - RNA, 18 nt, Haemophilus influenzae Rd
augaaauuagguuauuuu

SEQ ID NO: 689017 - RNA, 22 nt, Haemophilus influenzae Rd
augaaauuagguuauuuuuuca

SEQ ID NO: 689018 - RNA, 13 nt, Haemophilus influenzae Rd
augaaauuaucau

SEQ ID NO: 689019 - RNA, 13 nt, Haemophilus influenzae Rd
augaacaagcacc

SEQ ID NO: 689020 - RNA, 17 nt, Haemophilus influenzae Rd
augaacaagcacccauu

SEQ ID NO: 689021 - RNA, 12 nt, Haemophilus influenzae Rd
augaacaaaaaa

SEQ ID NO: 689022 - RNA, 18 nt, Haemophilus influenzae Rd
augaaauuuauuauaaaa

SEQ ID NO: 689023 - RNA, 21 nt, Haemophilus influenzae Rd
augaaauuaaccccagaaaug

SEQ ID NO: 689024 - RNA, 12 nt, Haemophilus influenzae Rd
augaaauugcug

SEQ ID NO: 689025 - RNA, 17 nt, Haemophilus influenzae Rd
augaaauuugaauauaa

SEQ ID NO: 689026 - RNA, 23 nt, Haemophilus influenzae Rd
aucuuuagugagcaaacaaguuu

SEQ ID NO: 689027 - RNA, 19 nt, Haemophilus influenzae Rd
aucuuguuggaucuuccaa

SEQ ID NO: 689028 - RNA, 23 nt, Haemophilus influenzae Rd
aucuuuacguugugcgauuuucu

SEQ ID NO: 689029 - RNA, 22 nt, Haemophilus influenzae Rd
aucuuuagcuaaugcaaaauua

SEQ ID NO: 689030 - RNA, 21 nt, Haemophilus influenzae Rd
aucuuugauuuucuuauuaau

SEQ ID NO: 689031 - RNA, 11 nt, Haemophilus influenzae Rd
aucuuugccaa

SEQ ID NO: 689032 - RNA, 12 nt, Haemophilus influenzae Rd
aucuuugauuuu

SEQ ID NO: 689033 - RNA, 12 nt, Haemophilus influenzae Rd
aucuuuuucuug

SEQ ID NO: 689034 - RNA, 14 nt, Haemophilus influenzae Rd
augacuauuuagaa

SEQ ID NO: 689035 - RNA, 16 nt, Haemophilus influenzae Rd
augacuauuuagaaau

SEQ ID NO: 689036 - RNA, 13 nt, Haemophilus influenzae Rd
augagcuucaaaa

SEQ ID NO: 689037 - RNA, 17 nt, Haemophilus influenzae Rd
augauacaaucgguuaa

SEQ ID NO: 689038 - RNA, 15 nt, Haemophilus influenzae Rd
augauaaucuuccca

SEQ ID NO: 689039 - RNA, 16 nt, Haemophilus influenzae Rd
augauaaucuucccau

SEQ ID NO: 689040 - RNA, 23 nt, Haemophilus influenzae Rd
augaggauuuucaugcauuaaaa

SEQ ID NO: 689041 - RNA, 14 nt, Haemophilus influenzae Rd
augagcuuugcuuu

SEQ ID NO: 689042 - RNA, 14 nt, Haemophilus influenzae Rd
augaggaaaauaaa

SEQ ID NO: 689043 - RNA, 15 nt, Haemophilus influenzae Rd
augaggaaaauaaag

SEQ ID NO: 689044 - RNA, 16 nt, Haemophilus influenzae Rd
augacaccuuuaaaaa

SEQ ID NO: 689045 - RNA, 19 nt, Haemophilus influenzae Rd
augacaccuuuaaaaauua

SEQ ID NO: 689046 - RNA, 23 nt, Haemophilus influenzae Rd
augacaguuuguaauccugcauu

SEQ ID NO: 689047 - RNA, 15 nt, Haemophilus influenzae Rd
augacauauaauauu

SEQ ID NO: 689048 - RNA, 21 nt, Haemophilus influenzae Rd
augaccauuggcuuucauuac

SEQ ID NO: 689049 - RNA, 15 nt, Haemophilus influenzae Rd
augaccugcagagaa

SEQ ID NO: 689050 - RNA, 14 nt, Haemophilus influenzae Rd
augcacauuuuuac

SEQ ID NO: 689051 - RNA, 13 nt, Haemophilus influenzae Rd
augcaaacaagau

SEQ ID NO: 689052 - RNA, 16 nt, Haemophilus influenzae Rd
augcaccaauaccaau

SEQ ID NO: 689053 - RNA, 22 nt, Haemophilus influenzae Rd
augcaaaaacaagugguggaau

SEQ ID NO: 689054 - RNA, 14 nt, Haemophilus influenzae Rd
augauuuuccaaaa

SEQ ID NO: 689055 - RNA, 16 nt, Haemophilus influenzae Rd
augauuuuccaaaauu

SEQ ID NO: 689056 - RNA, 16 nt, Haemophilus influenzae Rd
augauugacgaaaaau

SEQ ID NO: 689057 - RNA, 17 nt, Haemophilus influenzae Rd
augauuccaaaguuuag

SEQ ID NO: 689058 - RNA, 22 nt, Haemophilus influenzae Rd
augcagauccuuucacaaaaua

SEQ ID NO: 689059 - RNA, 23 nt, Haemophilus influenzae Rd
augcagauuaauuuuuuauaaaa

SEQ ID NO: 689060 - RNA, 13 nt, Haemophilus influenzae Rd
augcaucauuaau

SEQ ID NO: 689061 - RNA, 17 nt, Haemophilus influenzae Rd
augcaucagauuuuucg

SEQ ID NO: 689062 - RNA, 15 nt, Haemophilus influenzae Rd
augcagaaucagaau

SEQ ID NO: 689063 - RNA, 23 nt, Haemophilus influenzae Rd
augauauuucaauuuaagcccug

SEQ ID NO: 689064 - RNA, 19 nt, Haemophilus influenzae Rd
augaucaaaucaaauuuuc

SEQ ID NO: 689065 - RNA, 13 nt, Haemophilus influenzae Rd
augauccaaaaau

SEQ ID NO: 689066 - RNA, 17 nt, Haemophilus influenzae Rd
augaucgaguaaaaaua

SEQ ID NO: 689067 - RNA, 22 nt, Haemophilus influenzae Rd
augaucgaguaaaaauaaaaug

SEQ ID NO: 689068 - RNA, 11 nt, Haemophilus influenzae Rd
augaucuacac

SEQ ID NO: 689069 - RNA, 14 nt, Haemophilus influenzae Rd
augaugcaggaaag

SEQ ID NO: 689070 - RNA, 15 nt, Haemophilus influenzae Rd
augaucuucaaucau

SEQ ID NO: 689071 - RNA, 17 nt, Haemophilus influenzae Rd
augaucuuuaauuaaaa

SEQ ID NO: 689072 - RNA, 23 nt, Haemophilus influenzae Rd
augauuauccacuaaaaaacuaa

SEQ ID NO: 689073 - RNA, 14 nt, Haemophilus influenzae Rd
augauuaauuaaau

SEQ ID NO: 689074 - RNA, 12 nt, Haemophilus influenzae Rd
augauuaaguua

SEQ ID NO: 689075 - RNA, 15 nt, Haemophilus influenzae Rd
augauuaauaucacu

SEQ ID NO: 689076 - RNA, 18 nt, Haemophilus influenzae Rd
augugcauugaauuuuuc

SEQ ID NO: 689077 - RNA, 22 nt, Haemophilus influenzae Rd
augucuggcugaguaaauaauu

SEQ ID NO: 689078 - RNA, 13 nt, Haemophilus influenzae Rd
auguguaggcaua

SEQ ID NO: 689079 - RNA, 14 nt, Haemophilus influenzae Rd
auguguuaaauaac

SEQ ID NO: 689080 - RNA, 15 nt, Haemophilus influenzae Rd
auguuaauuuuaaau

SEQ ID NO: 689081 - RNA, 16 nt, Haemophilus influenzae Rd
auguucccuauaaaua

SEQ ID NO: 689082 - RNA, 16 nt, Haemophilus influenzae Rd
auguucgauuuuacuu

SEQ ID NO: 689083 - RNA, 13 nt, Haemophilus influenzae Rd
auguagauaauga

SEQ ID NO: 689084 - RNA, 13 nt, Haemophilus influenzae Rd
auguaccaaaaug

SEQ ID NO: 689085 - RNA, 22 nt, Haemophilus influenzae Rd
auguagcaguugcuaaaucacc

SEQ ID NO: 689086 - RNA, 22 nt, Haemophilus influenzae Rd
auguagcacgaucuaauugcgg

SEQ ID NO: 689087 - RNA, 17 nt, Haemophilus influenzae Rd
auguaacugaaacuaac

SEQ ID NO: 689088 - RNA, 21 nt, Haemophilus influenzae Rd
auguaauuccuuguagagcag

SEQ ID NO: 689089 - RNA, 13 nt, Haemophilus influenzae Rd
auguaaauuauuu

SEQ ID NO: 689090 - RNA, 22 nt, Haemophilus influenzae Rd
auguacauuaauguaaucaauu

SEQ ID NO: 689091 - RNA, 19 nt, Haemophilus influenzae Rd
augucaggcgauuuuacgu

SEQ ID NO: 689092 - RNA, 21 nt, Haemophilus influenzae Rd
auguauuucuaacaaaugauu

SEQ ID NO: 689093 - RNA, 20 nt, Haemophilus influenzae Rd
auggggcuuuuuuuuauuca

SEQ ID NO: 689094 - RNA, 17 nt, Haemophilus influenzae Rd
augguuguaaauuuuca

SEQ ID NO: 689095 - RNA, 18 nt, Haemophilus influenzae Rd
augguuguaaauuuucaa

SEQ ID NO: 689096 - RNA, 20 nt, Haemophilus influenzae Rd
augguuguaaauuuucaaua

SEQ ID NO: 689097 - RNA, 14 nt, Haemophilus influenzae Rd
augguuguaauaau

SEQ ID NO: 689098 - RNA, 16 nt, Haemophilus influenzae Rd
auguaaacaaaaauac

SEQ ID NO: 689099 - RNA, 21 nt, Haemophilus influenzae Rd
auguaaacaaaaauacagcca

SEQ ID NO: 689100 - RNA, 22 nt, Haemophilus influenzae Rd
auguaaacaaaaauacagccac

SEQ ID NO: 689101 - RNA, 16 nt, Haemophilus influenzae Rd
auguaaauaguuauuu

SEQ ID NO: 689102 - RNA, 22 nt, Haemophilus influenzae Rd
auguaaauaguuauuuauuccu

SEQ ID NO: 689103 - RNA, 22 nt, Haemophilus influenzae Rd
augguucgagaaacuuucaaaa

SEQ ID NO: 689104 - RNA, 22 nt, Haemophilus influenzae Rd
augguuggaagaaaagcauuaa

SEQ ID NO: 689105 - RNA, 19 nt, Haemophilus influenzae Rd
auggcaaaauuuaguccuu

SEQ ID NO: 689106 - RNA, 15 nt, Haemophilus influenzae Rd
auggcaaacaaaaua

SEQ ID NO: 689107 - RNA, 18 nt, Haemophilus influenzae Rd
auggcaaacaaaauaaau

SEQ ID NO: 689108 - RNA, 14 nt, Haemophilus influenzae Rd
auggcaaucacaaa

SEQ ID NO: 689109 - RNA, 19 nt, Haemophilus influenzae Rd
auggcaaucacaaauccau

SEQ ID NO: 689110 - RNA, 20 nt, Haemophilus influenzae Rd
auggauuauaaauagaauau

SEQ ID NO: 689111 - RNA, 17 nt, Haemophilus influenzae Rd
auggauuuuucuucuag

SEQ ID NO: 689112 - RNA, 15 nt, Haemophilus influenzae Rd
auggcaacaaauauu

SEQ ID NO: 689113 - RNA, 13 nt, Haemophilus influenzae Rd
auggcuaaagaaa

SEQ ID NO: 689114 - RNA, 19 nt, Haemophilus influenzae Rd
auggcugggauuucaaaca

SEQ ID NO: 689115 - RNA, 12 nt, Haemophilus influenzae Rd
auggcgaccauu

SEQ ID NO: 689116 - RNA, 18 nt, Haemophilus influenzae Rd
auggcgguaaaaaaguaa

SEQ ID NO: 689117 - RNA, 14 nt, Haemophilus influenzae Rd
auggacagaauaac

SEQ ID NO: 689118 - RNA, 20 nt, Haemophilus influenzae Rd
auggagagaauagcuauuuu

SEQ ID NO: 689119 - RNA, 18 nt, Haemophilus influenzae Rd
auggauauagaaaucaua

SEQ ID NO: 689120 - RNA, 22 nt, Haemophilus influenzae Rd
auggaucacccauuaaauaaaa

SEQ ID NO: 689121 - RNA, 17 nt, Haemophilus influenzae Rd
auggaugaauacaaguc

SEQ ID NO: 689122 - RNA, 12 nt, Haemophilus influenzae Rd
auggaaauaaau

SEQ ID NO: 689123 - RNA, 14 nt, Haemophilus influenzae Rd
auggaacguuuuuu

SEQ ID NO: 689124 - RNA, 19 nt, Haemophilus influenzae Rd
auggaacguuuuuuacuug

SEQ ID NO: 689125 - RNA, 16 nt, Haemophilus influenzae Rd
auggaauguagauaau

SEQ ID NO: 689126 - RNA, 23 nt, Haemophilus influenzae Rd
auggaauguagauaaugauauua

SEQ ID NO: 689127 - RNA, 13 nt, Haemophilus influenzae Rd
auggaauaaaaac

SEQ ID NO: 689128 - RNA, 12 nt, Haemophilus influenzae Rd
augcuuucagau

SEQ ID NO: 689129 - RNA, 17 nt, Haemophilus influenzae Rd
augcuuuugaugccaag

SEQ ID NO: 689130 - RNA, 19 nt, Haemophilus influenzae Rd
augcuggggacgcaccuuu

SEQ ID NO: 689131 - RNA, 12 nt, Haemophilus influenzae Rd
augcugaguaau

SEQ ID NO: 689132 - RNA, 17 nt, Haemophilus influenzae Rd
augcugaguaccaaaag

SEQ ID NO: 689133 - RNA, 20 nt, Haemophilus influenzae Rd
augcuucagcguugucauca

SEQ ID NO: 689134 - RNA, 23 nt, Haemophilus influenzae Rd
augcuucagcguugucaucagaa

SEQ ID NO: 689135 - RNA, 15 nt, Haemophilus influenzae Rd
augcuuauaaaacag

SEQ ID NO: 689136 - RNA, 16 nt, Haemophilus influenzae Rd
augcuuauaaaacaga

SEQ ID NO: 689137 - RNA, 15 nt, Haemophilus influenzae Rd
augcuuacaaaauua

SEQ ID NO: 689138 - RNA, 14 nt, Haemophilus influenzae Rd
augcuucuaauccc

SEQ ID NO: 689139 - RNA, 16 nt, Haemophilus influenzae Rd
augcuucuaaucccau

SEQ ID NO: 689140 - RNA, 14 nt, Haemophilus influenzae Rd
augcuuuaacacca

SEQ ID NO: 689141 - RNA, 15 nt, Haemophilus influenzae Rd
augcuuuaacaccaa

SEQ ID NO: 689142 - RNA, 20 nt, Haemophilus influenzae Rd
augcuuuauuuaaauuaaaa

SEQ ID NO: 689143 - RNA, 22 nt, Haemophilus influenzae Rd
augcuuuauuuaaauuaaaaag

SEQ ID NO: 689144 - RNA, 20 nt, Haemophilus influenzae Rd
augcuugguuuuauauucau

SEQ ID NO: 689145 - RNA, 15 nt, Haemophilus influenzae Rd
augcgugaacugcuu

SEQ ID NO: 689146 - RNA, 18 nt, Haemophilus influenzae Rd
augcguucgauaacaauu

SEQ ID NO: 689147 - RNA, 24 nt, Haemophilus influenzae Rd
augcguucgauaacaauuuuugca

SEQ ID NO: 689148 - RNA, 17 nt, Haemophilus influenzae Rd
augcuaaaccaauuucu

SEQ ID NO: 689149 - RNA, 16 nt, Haemophilus influenzae Rd
augcuaaauauauauc

SEQ ID NO: 689150 - RNA, 20 nt, Haemophilus influenzae Rd
augcguuuuuaauuuuaugc

SEQ ID NO: 689151 - RNA, 21 nt, Haemophilus influenzae Rd
augcuccauugcaauuucagc

SEQ ID NO: 689152 - RNA, 21 nt, Haemophilus influenzae Rd
augcgcccuuuaaauuacauu

SEQ ID NO: 689153 - RNA, 15 nt, Haemophilus influenzae Rd
augccaaauaaaauu

SEQ ID NO: 689154 - RNA, 19 nt, Haemophilus influenzae Rd
augccaaauaaaauuacaa

SEQ ID NO: 689155 - RNA, 13 nt, Haemophilus influenzae Rd
augcgaaaauggc

SEQ ID NO: 689156 - RNA, 18 nt, Haemophilus influenzae Rd
augcauuggcugaauuua

SEQ ID NO: 689157 - RNA, 18 nt, Haemophilus influenzae Rd
augcauugaugacugcau

SEQ ID NO: 689158 - RNA, 23 nt, Haemophilus influenzae Rd
augcauugauugcuuuaacugaa

SEQ ID NO: 689159 - RNA, 16 nt, Haemophilus influenzae Rd
augcauuaaaaaacau

SEQ ID NO: 689160 - RNA, 15 nt, Haemophilus influenzae Rd
augcauucaaauuuc

SEQ ID NO: 689161 - RNA, 16 nt, Haemophilus influenzae Rd
augcaugugguaauua

SEQ ID NO: 689162 - RNA, 15 nt, Haemophilus influenzae Rd
augcgauccaaaauu

SEQ ID NO: 689163 - RNA, 15 nt, Haemophilus influenzae Rd
augcgagcaucggua

SEQ ID NO: 689164 - RNA, 22 nt, Haemophilus influenzae Rd
aucauauacucguucguuauuu

SEQ ID NO: 689165 - RNA, 23 nt, Haemophilus influenzae Rd
aucauagcaacgcccuucuuuga

SEQ ID NO: 689166 - RNA, 23 nt, Haemophilus influenzae Rd
aucauaggcuucuuguuuacauu

SEQ ID NO: 689167 - RNA, 16 nt, Haemophilus influenzae Rd
aucauagccuuuucua

SEQ ID NO: 689168 - RNA, 12 nt, Haemophilus influenzae Rd
aucauagaaauc

SEQ ID NO: 689169 - RNA, 22 nt, Haemophilus influenzae Rd
aucauagaaccgucuuuaaaua

SEQ ID NO: 689170 - RNA, 21 nt, Haemophilus influenzae Rd
aucauacuaaaaaauuaaauu

SEQ ID NO: 689171 - RNA, 21 nt, Haemophilus influenzae Rd
aucauacuaaauacauuuuua

SEQ ID NO: 689172 - RNA, 19 nt, Haemophilus influenzae Rd
aucauacauauccaacgca

SEQ ID NO: 689173 - RNA, 22 nt, Haemophilus influenzae Rd
aucauaacgggcauuuuucuuc

SEQ ID NO: 689174 - RNA, 12 nt, Haemophilus influenzae Rd
aucauaaauaug

SEQ ID NO: 689175 - RNA, 17 nt, Haemophilus influenzae Rd
aucauaagauaaggcaa

SEQ ID NO: 689176 - RNA, 17 nt, Haemophilus influenzae Rd
aucauaauccacuaaaa

SEQ ID NO: 689177 - RNA, 16 nt, Haemophilus influenzae Rd
aucauaauuuauucaa

SEQ ID NO: 689178 - RNA, 15 nt, Haemophilus influenzae Rd
aucaguuaccauaca

SEQ ID NO: 689179 - RNA, 16 nt, Haemophilus influenzae Rd
aucauaaaaaaaugua

SEQ ID NO: 689180 - RNA, 13 nt, Haemophilus influenzae Rd
aucauaaaaacaa

SEQ ID NO: 689181 - RNA, 11 nt, Haemophilus influenzae Rd
aucauaaaauu

SEQ ID NO: 689182 - RNA, 14 nt, Haemophilus influenzae Rd
aucauaaaauuucc

SEQ ID NO: 689183 - RNA, 17 nt, Haemophilus influenzae Rd
aucagguauaaagaugg

SEQ ID NO: 689184 - RNA, 23 nt, Haemophilus influenzae Rd
aucaguaaugauucguggcaauu

SEQ ID NO: 689185 - RNA, 19 nt, Haemophilus influenzae Rd
aucagguaauuggugugca

SEQ ID NO: 689186 - RNA, 20 nt, Haemophilus influenzae Rd
aucaggcugugcauaauccc

SEQ ID NO: 689187 - RNA, 16 nt, Haemophilus influenzae Rd
aucaggaggaauaaug

SEQ ID NO: 689188 - RNA, 21 nt, Haemophilus influenzae Rd
aucaaucggcaauucugcucu

SEQ ID NO: 689189 - RNA, 16 nt, Haemophilus influenzae Rd
aucaaucgguuucaca

SEQ ID NO: 689190 - RNA, 17 nt, Haemophilus influenzae Rd
aucaucaaauugaugcu

SEQ ID NO: 689191 - RNA, 23 nt, Haemophilus influenzae Rd
aucaucagaaauauaaucaauuu

SEQ ID NO: 689192 - RNA, 17 nt, Haemophilus influenzae Rd
aucaucagaauaauuaa

SEQ ID NO: 689193 - RNA, 23 nt, Haemophilus influenzae Rd
aucaucagaauaauuaacaaaua

SEQ ID NO: 689194 - RNA, 15 nt, Haemophilus influenzae Rd
aucaucaagcaaacu

SEQ ID NO: 689195 - RNA, 14 nt, Haemophilus influenzae Rd
aucaucauuuuuau

SEQ ID NO: 689196 - RNA, 13 nt, Haemophilus influenzae Rd
aucaucaucauuu

SEQ ID NO: 689197 - RNA, 14 nt, Haemophilus influenzae Rd
aucaucaucauuuu

SEQ ID NO: 689198 - RNA, 21 nt, Haemophilus influenzae Rd
aucaucuagauuucuauccau

SEQ ID NO: 689199 - RNA, 18 nt, Haemophilus influenzae Rd
aucaucugauacugccaa

SEQ ID NO: 689200 - RNA, 18 nt, Haemophilus influenzae Rd
aucaucugcugguuuuag

SEQ ID NO: 689201 - RNA, 16 nt, Haemophilus influenzae Rd
aucaucuguaaaccau

SEQ ID NO: 689202 - RNA, 21 nt, Haemophilus influenzae Rd
aucaucuucaucugcaucaca

SEQ ID NO: 689203 - RNA, 15 nt, Haemophilus influenzae Rd
aucaucgcccgcuuc

SEQ ID NO: 689204 - RNA, 20 nt, Haemophilus influenzae Rd
aucaucccuguauaaagaua

SEQ ID NO: 689205 - RNA, 22 nt, Haemophilus influenzae Rd
aucauccgcuucguuguaaucu

SEQ ID NO: 689206 - RNA, 20 nt, Haemophilus influenzae Rd
aucauccgcuuguaauuuca

SEQ ID NO: 689207 - RNA, 17 nt, Haemophilus influenzae Rd
aucauggcacaaaauaa

SEQ ID NO: 689208 - RNA, 19 nt, Haemophilus influenzae Rd
aucauggcucagauugaac

SEQ ID NO: 689209 - RNA, 18 nt, Haemophilus influenzae Rd
aucaugaauaauuuuguu

SEQ ID NO: 689210 - RNA, 17 nt, Haemophilus influenzae Rd
aucauuaacuuaccacg

SEQ ID NO: 689211 - RNA, 22 nt, Haemophilus influenzae Rd
aucauuaaauuuaguuaauaua

SEQ ID NO: 689212 - RNA, 14 nt, Haemophilus influenzae Rd
aucauuaaauauaa

SEQ ID NO: 689213 - RNA, 15 nt, Haemophilus influenzae Rd
aucauuagcaacuuc

SEQ ID NO: 689214 - RNA, 13 nt, Haemophilus influenzae Rd
aucauuacuuuaa

SEQ ID NO: 689215 - RNA, 14 nt, Haemophilus influenzae Rd
aucauuuuuuuaaa

SEQ ID NO: 689216 - RNA, 22 nt, Haemophilus influenzae Rd
aucauuuuuuuaaauauuuuua

SEQ ID NO: 689217 - RNA, 13 nt, Haemophilus influenzae Rd
aucauuuuuaacc

SEQ ID NO: 689218 - RNA, 21 nt, Haemophilus influenzae Rd
aucauuuuuuaacuugauuuu

SEQ ID NO: 689219 - RNA, 14 nt, Haemophilus influenzae Rd
auccaaaaauauaa

SEQ ID NO: 689220 - RNA, 16 nt, Haemophilus influenzae Rd
auccaaaaauauaaac

SEQ ID NO: 689221 - RNA, 15 nt, Haemophilus influenzae Rd
aucauuuucacuccg

SEQ ID NO: 689222 - RNA, 22 nt, Haemophilus influenzae Rd
aucauuuucaaguaacuuucac

SEQ ID NO: 689223 - RNA, 19 nt, Haemophilus influenzae Rd
aucauuuggaucuaaaaaa

SEQ ID NO: 689224 - RNA, 22 nt, Haemophilus influenzae Rd
aucauuuguuuuccguauuuuc

SEQ ID NO: 689225 - RNA, 17 nt, Haemophilus influenzae Rd
auccaagaaguuuucca

SEQ ID NO: 689226 - RNA, 23 nt, Haemophilus influenzae Rd
auccaaccgauaaggaaaauacu

SEQ ID NO: 689227 - RNA, 20 nt, Haemophilus influenzae Rd
auccaaccuaauaacggcac

SEQ ID NO: 689228 - RNA, 22 nt, Haemophilus influenzae Rd
auccaaggaauuggauuugaac

SEQ ID NO: 689229 - RNA, 14 nt, Haemophilus influenzae Rd
auccaaaucaaaaa

SEQ ID NO: 689230 - RNA, 16 nt, Haemophilus influenzae Rd
auccaaacuuucugca

SEQ ID NO: 689231 - RNA, 22 nt, Haemophilus influenzae Rd
auccaaacuuucugcaauuaaa

SEQ ID NO: 689232 - RNA, 11 nt, Haemophilus influenzae Rd
auccaaaauuc

SEQ ID NO: 689233 - RNA, 16 nt, Haemophilus influenzae Rd
aucauuuuucgcaaaa

SEQ ID NO: 689234 - RNA, 18 nt, Haemophilus influenzae Rd
aucauucugguaauuugc

SEQ ID NO: 689235 - RNA, 13 nt, Haemophilus influenzae Rd
aucauugaaaugu

SEQ ID NO: 689236 - RNA, 17 nt, Haemophilus influenzae Rd
aucauuggauaauugcc

SEQ ID NO: 689237 - RNA, 15 nt, Haemophilus influenzae Rd
aucauuucuuuaugu

SEQ ID NO: 689238 - RNA, 16 nt, Haemophilus influenzae Rd
aucauuucuuuauguu

SEQ ID NO: 689239 - RNA, 17 nt, Haemophilus influenzae Rd
aucauuucuuuauguuc

SEQ ID NO: 689240 - RNA, 21 nt, Haemophilus influenzae Rd
aucauuugacgauuaauacca

SEQ ID NO: 689241 - RNA, 16 nt, Haemophilus influenzae Rd
aucauuucaauaucaa

SEQ ID NO: 689242 - RNA, 22 nt, Haemophilus influenzae Rd
aucauuuaacggggauuuuuua

SEQ ID NO: 689243 - RNA, 12 nt, Haemophilus influenzae Rd
aucauuuaacuu

SEQ ID NO: 689244 - RNA, 16 nt, Haemophilus influenzae Rd
aucauuuaacuugcaa

SEQ ID NO: 689245 - RNA, 17 nt, Haemophilus influenzae Rd
auccacgccccaacaua

SEQ ID NO: 689246 - RNA, 16 nt, Haemophilus influenzae Rd
auccaccaaaugcaca

SEQ ID NO: 689247 - RNA, 17 nt, Haemophilus influenzae Rd
auccacuucauccauug

SEQ ID NO: 689248 - RNA, 20 nt, Haemophilus influenzae Rd
auccacuucauccauuggau

SEQ ID NO: 689249 - RNA, 17 nt, Haemophilus influenzae Rd
auccacuaaaaaacuaa

SEQ ID NO: 689250 - RNA, 13 nt, Haemophilus influenzae Rd
auccagacgcauu

SEQ ID NO: 689251 - RNA, 18 nt, Haemophilus influenzae Rd
auccagacgcauucuuuc

SEQ ID NO: 689252 - RNA, 18 nt, Haemophilus influenzae Rd
auccagauaacaaacccu

SEQ ID NO: 689253 - RNA, 20 nt, Haemophilus influenzae Rd
auccagauuaaaaauucaau

SEQ ID NO: 689254 - RNA, 12 nt, Haemophilus influenzae Rd
auccaccagcac

SEQ ID NO: 689255 - RNA, 20 nt, Haemophilus influenzae Rd
auccacauuuuuuguaauuc

SEQ ID NO: 689256 - RNA, 17 nt, Haemophilus influenzae Rd
auccacaugauauauuu

SEQ ID NO: 689257 - RNA, 13 nt, Haemophilus influenzae Rd
auccacaaauaau

SEQ ID NO: 689258 - RNA, 17 nt, Haemophilus influenzae Rd
auccacaauucuuaaau

SEQ ID NO: 689259 - RNA, 18 nt, Haemophilus influenzae Rd
auccaauccuaaaucugc

SEQ ID NO: 689260 - RNA, 15 nt, Haemophilus influenzae Rd
auccacaaaauuccg

SEQ ID NO: 689261 - RNA, 18 nt, Haemophilus influenzae Rd
auccaauagauaaaauaa

SEQ ID NO: 689262 - RNA, 11 nt, Haemophilus influenzae Rd
auccaagugca

SEQ ID NO: 689263 - RNA, 23 nt, Haemophilus influenzae Rd
auccaagugcaugagcuuugcuu

SEQ ID NO: 689264 - RNA, 18 nt, Haemophilus influenzae Rd
auccaucaaacgcuccau

SEQ ID NO: 689265 - RNA, 16 nt, Haemophilus influenzae Rd
auccaucaagaaaguu

SEQ ID NO: 689266 - RNA, 15 nt, Haemophilus influenzae Rd
auccauaucccauug

SEQ ID NO: 689267 - RNA, 21 nt, Haemophilus influenzae Rd
auccaucauuuuucgcaaaau

SEQ ID NO: 689268 - RNA, 18 nt, Haemophilus influenzae Rd
auccaucgcaagauaaga

SEQ ID NO: 689269 - RNA, 13 nt, Haemophilus influenzae Rd
auccauuguuguu

SEQ ID NO: 689270 - RNA, 13 nt, Haemophilus influenzae Rd
auccauucucaaa

SEQ ID NO: 689271 - RNA, 16 nt, Haemophilus influenzae Rd
auccauuccugcaaga

SEQ ID NO: 689272 - RNA, 21 nt, Haemophilus influenzae Rd
auccauuccugcaagaaaaau

SEQ ID NO: 689273 - RNA, 13 nt, Haemophilus influenzae Rd
auccaugaugaug

SEQ ID NO: 689274 - RNA, 19 nt, Haemophilus influenzae Rd
aucccauaacagauggauc

SEQ ID NO: 689275 - RNA, 24 nt, Haemophilus influenzae Rd
aucccauauacuugccaaaacgac

SEQ ID NO: 689276 - RNA, 13 nt, Haemophilus influenzae Rd
aucccaaauuaaa

SEQ ID NO: 689277 - RNA, 14 nt, Haemophilus influenzae Rd
auccauuuugaaca

SEQ ID NO: 689278 - RNA, 20 nt, Haemophilus influenzae Rd
auccauuuugaacaagguuu

SEQ ID NO: 689279 - RNA, 23 nt, Haemophilus influenzae Rd
auccauuucuaaaggcaauuccc

SEQ ID NO: 689280 - RNA, 13 nt, Haemophilus influenzae Rd
aucccaaucuucg

SEQ ID NO: 689281 - RNA, 22 nt, Haemophilus influenzae Rd
auccagcguaaccaauggcaau

SEQ ID NO: 689282 - RNA, 16 nt, Haemophilus influenzae Rd
auccauaacaaccauu

SEQ ID NO: 689283 - RNA, 18 nt, Haemophilus influenzae Rd
auccauaacaaccauugu

SEQ ID NO: 689284 - RNA, 19 nt, Haemophilus influenzae Rd
auccauaacggcaagcaaa

SEQ ID NO: 689285 - RNA, 18 nt, Haemophilus influenzae Rd
auccauaaaauacaggua

SEQ ID NO: 689286 - RNA, 13 nt, Haemophilus influenzae Rd
auccgcugcaaau

SEQ ID NO: 689287 - RNA, 13 nt, Haemophilus influenzae Rd
auccgcugcuaau

SEQ ID NO: 689288 - RNA, 13 nt, Haemophilus influenzae Rd
auccgcuaaaauu

SEQ ID NO: 689289 - RNA, 20 nt, Haemophilus influenzae Rd
auccgcuuucugacacccaa

SEQ ID NO: 689290 - RNA, 16 nt, Haemophilus influenzae Rd
auccgcaauaauuaag

SEQ ID NO: 689291 - RNA, 20 nt, Haemophilus influenzae Rd
auccgcaauaauuaagaaaa

SEQ ID NO: 689292 - RNA, 13 nt, Haemophilus influenzae Rd
auccgagagaaag

SEQ ID NO: 689293 - RNA, 20 nt, Haemophilus influenzae Rd
auccccauacaaguauuuuc

SEQ ID NO: 689294 - RNA, 21 nt, Haemophilus influenzae Rd
auccccauugaauuaaaaaug

SEQ ID NO: 689295 - RNA, 22 nt, Haemophilus influenzae Rd
aucccauuuagguuagaauaaa

SEQ ID NO: 689296 - RNA, 16 nt, Haemophilus influenzae Rd
aucccauugcaaaaua

SEQ ID NO: 689297 - RNA, 15 nt, Haemophilus influenzae Rd
aucccauuucaucuu

SEQ ID NO: 689298 - RNA, 16 nt, Haemophilus influenzae Rd
auccccuaaacuaagc

SEQ ID NO: 689299 - RNA, 18 nt, Haemophilus influenzae Rd
auccuauuaauuuaauuc

SEQ ID NO: 689300 - RNA, 16 nt, Haemophilus influenzae Rd
auccucagcaauuucu

SEQ ID NO: 689301 - RNA, 22 nt, Haemophilus influenzae Rd
auccguugucacagaaaccaac

SEQ ID NO: 689302 - RNA, 16 nt, Haemophilus influenzae Rd
auccuaacuuuucuuc

SEQ ID NO: 689303 - RNA, 15 nt, Haemophilus influenzae Rd
auccuaagaauccca

SEQ ID NO: 689304 - RNA, 16 nt, Haemophilus influenzae Rd
auccuaaauaaagauu

SEQ ID NO: 689305 - RNA, 12 nt, Haemophilus influenzae Rd
auccuaaaaaac

SEQ ID NO: 689306 - RNA, 19 nt, Haemophilus influenzae Rd
auccguaauauuugacgaa

SEQ ID NO: 689307 - RNA, 18 nt, Haemophilus influenzae Rd
auccgguuggaaaagccu

SEQ ID NO: 689308 - RNA, 14 nt, Haemophilus influenzae Rd
auccugcacauccu

SEQ ID NO: 689309 - RNA, 15 nt, Haemophilus influenzae Rd
auccugaagauuuug

SEQ ID NO: 689310 - RNA, 15 nt, Haemophilus influenzae Rd
auccucuuuaaaauu

SEQ ID NO: 689311 - RNA, 15 nt, Haemophilus influenzae Rd
auccucucaaucugu

SEQ ID NO: 689312 - RNA, 20 nt, Haemophilus influenzae Rd
auccugccuugcauucgguu

SEQ ID NO: 689313 - RNA, 15 nt, Haemophilus influenzae Rd
auccugcgugaauga

SEQ ID NO: 689314 - RNA, 22 nt, Haemophilus influenzae Rd
auccugcgugaaugacuuucac

SEQ ID NO: 689315 - RNA, 17 nt, Haemophilus influenzae Rd
aucgguuggauuuuaac

SEQ ID NO: 689316 - RNA, 16 nt, Haemophilus influenzae Rd
aucgucaaauuuaaau

SEQ ID NO: 689317 - RNA, 20 nt, Haemophilus influenzae Rd
aucguauugcauaaaagcac

SEQ ID NO: 689318 - RNA, 21 nt, Haemophilus influenzae Rd
aucguaaucuuuacccauugc

SEQ ID NO: 689319 - RNA, 18 nt, Haemophilus influenzae Rd
aucguaauuuuaaaacca

SEQ ID NO: 689320 - RNA, 13 nt, Haemophilus influenzae Rd
aucguauaagccc

SEQ ID NO: 689321 - RNA, 12 nt, Haemophilus influenzae Rd
aucguagaaauc

SEQ ID NO: 689322 - RNA, 13 nt, Haemophilus influenzae Rd
aucgucuaucuaa

SEQ ID NO: 689323 - RNA, 16 nt, Haemophilus influenzae Rd
aucgugacaauaacug

SEQ ID NO: 689324 - RNA, 21 nt, Haemophilus influenzae Rd
aucgucuuguuuucaauaguu

SEQ ID NO: 689325 - RNA, 17 nt, Haemophilus influenzae Rd
aucgugaugauuuucau

SEQ ID NO: 689326 - RNA, 14 nt, Haemophilus influenzae Rd
aucuaacacaauaa

SEQ ID NO: 689327 - RNA, 11 nt, Haemophilus influenzae Rd
aucuaaaaaag

SEQ ID NO: 689328 - RNA, 19 nt, Haemophilus influenzae Rd
aucuaaaaaagaguaaaua

SEQ ID NO: 689329 - RNA, 12 nt, Haemophilus influenzae Rd
aucguuuucucg

SEQ ID NO: 689330 - RNA, 21 nt, Haemophilus influenzae Rd
aucguuugaacaaauucagcu

SEQ ID NO: 689331 - RNA, 22 nt, Haemophilus influenzae Rd
aucguuugauauaccauucuuu

SEQ ID NO: 689332 - RNA, 18 nt, Haemophilus influenzae Rd
aucguuuacaucacguaa

SEQ ID NO: 689333 - RNA, 14 nt, Haemophilus influenzae Rd
aucggcagaauuac

SEQ ID NO: 689334 - RNA, 16 nt, Haemophilus influenzae Rd
aucggcaauguuuuaa

SEQ ID NO: 689335 - RNA, 22 nt, Haemophilus influenzae Rd
aucggcaauguuuuaaguucaa

SEQ ID NO: 689336 - RNA, 16 nt, Haemophilus influenzae Rd
aucggacgaaucacaa

SEQ ID NO: 689337 - RNA, 22 nt, Haemophilus influenzae Rd
aucgcuugccagucauuuuuua

SEQ ID NO: 689338 - RNA, 20 nt, Haemophilus influenzae Rd
aucgcuuaggguaauuuuuu

SEQ ID NO: 689339 - RNA, 21 nt, Haemophilus influenzae Rd
aucgcuucagaaguggaagga

SEQ ID NO: 689340 - RNA, 22 nt, Haemophilus influenzae Rd
aucgcugggauuuugucaccaa

SEQ ID NO: 689341 - RNA, 23 nt, Haemophilus influenzae Rd
aucgcugggauuuugucaccaaa

SEQ ID NO: 689342 - RNA, 17 nt, Haemophilus influenzae Rd
aucgcugccuaauucca

SEQ ID NO: 689343 - RNA, 22 nt, Haemophilus influenzae Rd
aucgcugcgaugguggauaaac

SEQ ID NO: 689344 - RNA, 20 nt, Haemophilus influenzae Rd
aucgccuuaucccauaccgu

SEQ ID NO: 689345 - RNA, 16 nt, Haemophilus influenzae Rd
aucgauccucccuaau

SEQ ID NO: 689346 - RNA, 22 nt, Haemophilus influenzae Rd
aucgauccucccuaaugauuaa

SEQ ID NO: 689347 - RNA, 16 nt, Haemophilus influenzae Rd
aucgccauccacuacu

SEQ ID NO: 689348 - RNA, 14 nt, Haemophilus influenzae Rd
auccuugcucacgg

SEQ ID NO: 689349 - RNA, 14 nt, Haemophilus influenzae Rd
auccuuguuuuuca

SEQ ID NO: 689350 - RNA, 18 nt, Haemophilus influenzae Rd
auccuuguuuuucaaaaa

SEQ ID NO: 689351 - RNA, 21 nt, Haemophilus influenzae Rd
auccuuguuuuucaaaaagau

SEQ ID NO: 689352 - RNA, 19 nt, Haemophilus influenzae Rd
auccuucaugguuuguucc

SEQ ID NO: 689353 - RNA, 14 nt, Haemophilus influenzae Rd
auccuuccaaaucc

SEQ ID NO: 689354 - RNA, 18 nt, Haemophilus influenzae Rd
auccugucaucuguaaac

SEQ ID NO: 689355 - RNA, 15 nt, Haemophilus influenzae Rd
auccuguucagcuuu

SEQ ID NO: 689356 - RNA, 15 nt, Haemophilus influenzae Rd
auccuuaccuuccac

SEQ ID NO: 689357 - RNA, 14 nt, Haemophilus influenzae Rd
auccuguuuauuuu

SEQ ID NO: 689358 - RNA, 16 nt, Haemophilus influenzae Rd
aucgaaugauucaauu

SEQ ID NO: 689359 - RNA, 21 nt, Haemophilus influenzae Rd
aucgacauaacauuguuuuaa

SEQ ID NO: 689360 - RNA, 17 nt, Haemophilus influenzae Rd
auaaucugauugagaaa

SEQ ID NO: 689361 - RNA, 15 nt, Haemophilus influenzae Rd
auaaucucuucuaaa

SEQ ID NO: 689362 - RNA, 22 nt, Haemophilus influenzae Rd
auaaucuacaaaacauaauaaa

SEQ ID NO: 689363 - RNA, 17 nt, Haemophilus influenzae Rd
auaauccucuuuaaaau

SEQ ID NO: 689364 - RNA, 18 nt, Haemophilus influenzae Rd
auaauccucuuuaaaauu

SEQ ID NO: 689365 - RNA, 13 nt, Haemophilus influenzae Rd
auaauccuuuuuu

SEQ ID NO: 689366 - RNA, 14 nt, Haemophilus influenzae Rd
auaaucuuaaauaa

SEQ ID NO: 689367 - RNA, 17 nt, Haemophilus influenzae Rd
auaaucuuaaauaauua

SEQ ID NO: 689368 - RNA, 18 nt, Haemophilus influenzae Rd
auaaucuuaaauaauuaa

SEQ ID NO: 689369 - RNA, 17 nt, Haemophilus influenzae Rd
auaaugcaaaaacaagu

SEQ ID NO: 689370 - RNA, 19 nt, Haemophilus influenzae Rd
auaaugcaaccaaacaaaa

SEQ ID NO: 689371 - RNA, 21 nt, Haemophilus influenzae Rd
auaauccagcuacauucauca

SEQ ID NO: 689372 - RNA, 18 nt, Haemophilus influenzae Rd
auaauccuagaguaagua

SEQ ID NO: 689373 - RNA, 16 nt, Haemophilus influenzae Rd
auaauccauucagccc

SEQ ID NO: 689374 - RNA, 15 nt, Haemophilus influenzae Rd
auaauccacuaaaaa

SEQ ID NO: 689375 - RNA, 20 nt, Haemophilus influenzae Rd
auaacguauuuucucaucau

SEQ ID NO: 689376 - RNA, 14 nt, Haemophilus influenzae Rd
auaacggcaagcaa

SEQ ID NO: 689377 - RNA, 16 nt, Haemophilus influenzae Rd
auaacggcaagcaaac

SEQ ID NO: 689378 - RNA, 18 nt, Haemophilus influenzae Rd
auaacgcuugaauaaauc

SEQ ID NO: 689379 - RNA, 21 nt, Haemophilus influenzae Rd
auaacgcuugaauaaaucccc

SEQ ID NO: 689380 - RNA, 20 nt, Haemophilus influenzae Rd
auaacgcugcuuaaagcaau

SEQ ID NO: 689381 - RNA, 24 nt, Haemophilus influenzae Rd
auaacgcccuacgccuaauucauc

SEQ ID NO: 689382 - RNA, 14 nt, Haemophilus influenzae Rd
auaaugucaucuag

SEQ ID NO: 689383 - RNA, 22 nt, Haemophilus influenzae Rd
auaaugguuacagaaauauuau

SEQ ID NO: 689384 - RNA, 22 nt, Haemophilus influenzae Rd
auaauuauggugaauaaaaccg

SEQ ID NO: 689385 - RNA, 10 nt, Haemophilus influenzae Rd
auaauuauua

SEQ ID NO: 689386 - RNA, 18 nt, Haemophilus influenzae Rd
auaaugugagaauaacca

SEQ ID NO: 689387 - RNA, 21 nt, Haemophilus influenzae Rd
auaauucuugggcaacaguca

SEQ ID NO: 689388 - RNA, 12 nt, Haemophilus influenzae Rd
auaauuccuuuu

SEQ ID NO: 689389 - RNA, 23 nt, Haemophilus influenzae Rd
auaauucagcgagagaauauuua

SEQ ID NO: 689390 - RNA, 12 nt, Haemophilus influenzae Rd
auaauuauuauc

SEQ ID NO: 689391 - RNA, 15 nt, Haemophilus influenzae Rd
auaauucaagaugau

SEQ ID NO: 689392 - RNA, 21 nt, Haemophilus influenzae Rd
auaauucaagaugauauuuaa

SEQ ID NO: 689393 - RNA, 22 nt, Haemophilus influenzae Rd
auaauucaagaugauauuuaau

SEQ ID NO: 689394 - RNA, 20 nt, Haemophilus influenzae Rd
auaauucagcaagaaacuca

SEQ ID NO: 689395 - RNA, 15 nt, Haemophilus influenzae Rd
auaauugaugcuaaa

SEQ ID NO: 689396 - RNA, 14 nt, Haemophilus influenzae Rd
auaauucuuuaauc

SEQ ID NO: 689397 - RNA, 15 nt, Haemophilus influenzae Rd
auaauuuaagcaaaa

SEQ ID NO: 689398 - RNA, 23 nt, Haemophilus influenzae Rd
auaauuuacuguuuaaauaguga

SEQ ID NO: 689399 - RNA, 20 nt, Haemophilus influenzae Rd
auaauuuagcccgaaaauua

SEQ ID NO: 689400 - RNA, 19 nt, Haemophilus influenzae Rd
auaauuggaguggacauaa

SEQ ID NO: 689401 - RNA, 23 nt, Haemophilus influenzae Rd
auaauuuccuauacuaauuuuag

SEQ ID NO: 689402 - RNA, 22 nt, Haemophilus influenzae Rd
auaauuucaucgcguuuuuucu

SEQ ID NO: 689403 - RNA, 13 nt, Haemophilus influenzae Rd
auaauuucaucua

SEQ ID NO: 689404 - RNA, 17 nt, Haemophilus influenzae Rd
auaauuucauuguuaaa

SEQ ID NO: 689405 - RNA, 22 nt, Haemophilus influenzae Rd
auaauuucaauauaaguuguag

SEQ ID NO: 689406 - RNA, 14 nt, Haemophilus influenzae Rd
auaauuuauucaaa

SEQ ID NO: 689407 - RNA, 24 nt, Haemophilus influenzae Rd
auaauuuauucaaaauaaaaccau

SEQ ID NO: 689408 - RNA, 17 nt, Haemophilus influenzae Rd
auaauuuaguuauaugc

SEQ ID NO: 689409 - RNA, 24 nt, Haemophilus influenzae Rd
auaauuuuacguuucauuuuugca

SEQ ID NO: 689410 - RNA, 12 nt, Haemophilus influenzae Rd
auaauuuuagaa

SEQ ID NO: 689411 - RNA, 13 nt, Haemophilus influenzae Rd
auaauuugguuag

SEQ ID NO: 689412 - RNA, 20 nt, Haemophilus influenzae Rd
auaauuucuuguuuaaauuc

SEQ ID NO: 689413 - RNA, 15 nt, Haemophilus influenzae Rd
auaauuucuuuugca

SEQ ID NO: 689414 - RNA, 19 nt, Haemophilus influenzae Rd
auacaagguacuugaacuu

SEQ ID NO: 689415 - RNA, 13 nt, Haemophilus influenzae Rd
auacaaguauuuu

SEQ ID NO: 689416 - RNA, 16 nt, Haemophilus influenzae Rd
auacaaguauuuuccu

SEQ ID NO: 689417 - RNA, 21 nt, Haemophilus influenzae Rd
auacaaguggcgguaaaaaug

SEQ ID NO: 689418 - RNA, 13 nt, Haemophilus influenzae Rd
auacaaguuuuac

SEQ ID NO: 689419 - RNA, 18 nt, Haemophilus influenzae Rd
auaauuuucuuugccaca

SEQ ID NO: 689420 - RNA, 20 nt, Haemophilus influenzae Rd
auaauuuugaugugauuauu

SEQ ID NO: 689421 - RNA, 10 nt, Haemophilus influenzae Rd
auaauuuuuc

SEQ ID NO: 689422 - RNA, 11 nt, Haemophilus influenzae Rd
auaauuuuuca

SEQ ID NO: 689423 - RNA, 15 nt, Haemophilus influenzae Rd
auaauuuuucacaua

SEQ ID NO: 689424 - RNA, 15 nt, Haemophilus influenzae Rd
auaauuuuucaccug

SEQ ID NO: 689425 - RNA, 13 nt, Haemophilus influenzae Rd
auaauuuuucuuc

SEQ ID NO: 689426 - RNA, 18 nt, Haemophilus influenzae Rd
auaauuuuucuucagcau

SEQ ID NO: 689427 - RNA, 23 nt, Haemophilus influenzae Rd
auaauuuuucuucagcaucaaca

SEQ ID NO: 689428 - RNA, 13 nt, Haemophilus influenzae Rd
auacaaaacuaaa

SEQ ID NO: 689429 - RNA, 11 nt, Haemophilus influenzae Rd
auacaaaauuu

SEQ ID NO: 689430 - RNA, 14 nt, Haemophilus influenzae Rd
auacaaaauuuugu

SEQ ID NO: 689431 - RNA, 20 nt, Haemophilus influenzae Rd
auacacucacuuuuccuugu

SEQ ID NO: 689432 - RNA, 14 nt, Haemophilus influenzae Rd
auacacuucuaaaa

SEQ ID NO: 689433 - RNA, 16 nt, Haemophilus influenzae Rd
auacacuuuaaauuuu

SEQ ID NO: 689434 - RNA, 17 nt, Haemophilus influenzae Rd
auacacuuuaaauuuuc

SEQ ID NO: 689435 - RNA, 19 nt, Haemophilus influenzae Rd
auacagaaaccagaaauag

SEQ ID NO: 689436 - RNA, 15 nt, Haemophilus influenzae Rd
auacaccccaaaauc

SEQ ID NO: 689437 - RNA, 14 nt, Haemophilus influenzae Rd
auacacaccaucaa

SEQ ID NO: 689438 - RNA, 20 nt, Haemophilus influenzae Rd
auacaaucucuagauuuuuu

SEQ ID NO: 689439 - RNA, 15 nt, Haemophilus influenzae Rd
auacaaucuguccau

SEQ ID NO: 689440 - RNA, 21 nt, Haemophilus influenzae Rd
auacaauucuuguuuaauauu

SEQ ID NO: 689441 - RNA, 14 nt, Haemophilus influenzae Rd
auacaauuuucuuu

SEQ ID NO: 689442 - RNA, 19 nt, Haemophilus influenzae Rd
auacaauuuucuuuucaaa

SEQ ID NO: 689443 - RNA, 14 nt, Haemophilus influenzae Rd
auacacaaaucaca

SEQ ID NO: 689444 - RNA, 12 nt, Haemophilus influenzae Rd
auacauaauauu

SEQ ID NO: 689445 - RNA, 18 nt, Haemophilus influenzae Rd
auacauaauuaaauuaag

SEQ ID NO: 689446 - RNA, 14 nt, Haemophilus influenzae Rd
auacaguaaaaaua

SEQ ID NO: 689447 - RNA, 17 nt, Haemophilus influenzae Rd
auacagugacaaauuuu

SEQ ID NO: 689448 - RNA, 14 nt, Haemophilus influenzae Rd
auacagccacuauu

SEQ ID NO: 689449 - RNA, 23 nt, Haemophilus influenzae Rd
auacaucaggaggaauaaugaau

SEQ ID NO: 689450 - RNA, 18 nt, Haemophilus influenzae Rd
auacaucuacuguggcaa

SEQ ID NO: 689451 - RNA, 21 nt, Haemophilus influenzae Rd
auacaucucauaaaguauacu

SEQ ID NO: 689452 - RNA, 22 nt, Haemophilus influenzae Rd
auacauggaacguuuuuuacuu

SEQ ID NO: 689453 - RNA, 23 nt, Haemophilus influenzae Rd
auacauugcuauggcaaugaaua

SEQ ID NO: 689454 - RNA, 22 nt, Haemophilus influenzae Rd
auacauuggguuacggcuaaau

SEQ ID NO: 689455 - RNA, 17 nt, Haemophilus influenzae Rd
auacauuucuaaaauaa

SEQ ID NO: 689456 - RNA, 18 nt, Haemophilus influenzae Rd
auacauuucuaaaauaau

SEQ ID NO: 689457 - RNA, 19 nt, Haemophilus influenzae Rd
auagauaugugaauaaaau

SEQ ID NO: 689458 - RNA, 20 nt, Haemophilus influenzae Rd
auagauaugugaauaaaauc

SEQ ID NO: 689459 - RNA, 16 nt, Haemophilus influenzae Rd
auagauugaaaaguaa

SEQ ID NO: 689460 - RNA, 21 nt, Haemophilus influenzae Rd
auagauaacuucuucauuccc

SEQ ID NO: 689461 - RNA, 22 nt, Haemophilus influenzae Rd
auagauaagaaguuaucauuug

SEQ ID NO: 689462 - RNA, 15 nt, Haemophilus influenzae Rd
auagauaaauauauc

SEQ ID NO: 689463 - RNA, 20 nt, Haemophilus influenzae Rd
auagauaaauaucaaaauua

SEQ ID NO: 689464 - RNA, 16 nt, Haemophilus influenzae Rd
auagacauagaaaguu

SEQ ID NO: 689465 - RNA, 21 nt, Haemophilus influenzae Rd
auagaccacaugaauuucuaa

SEQ ID NO: 689466 - RNA, 19 nt, Haemophilus influenzae Rd
auagcauuaaagucuaaua

SEQ ID NO: 689467 - RNA, 19 nt, Haemophilus influenzae Rd
auagccuauaauuaaaguu

SEQ ID NO: 689468 - RNA, 13 nt, Haemophilus influenzae Rd
auagauuugacuu

SEQ ID NO: 689469 - RNA, 14 nt, Haemophilus influenzae Rd
auagauuuccuuug

SEQ ID NO: 689470 - RNA, 13 nt, Haemophilus influenzae Rd
auagauuuaauau

SEQ ID NO: 689471 - RNA, 19 nt, Haemophilus influenzae Rd
auagauuuauacuuaauuu

SEQ ID NO: 689472 - RNA, 15 nt, Haemophilus influenzae Rd
auagcauaaguuaau

SEQ ID NO: 689473 - RNA, 18 nt, Haemophilus influenzae Rd
auacuuaauagcugggca

SEQ ID NO: 689474 - RNA, 15 nt, Haemophilus influenzae Rd
auacuuaauuucuca

SEQ ID NO: 689475 - RNA, 16 nt, Haemophilus influenzae Rd
auacuuaauuucucag

SEQ ID NO: 689476 - RNA, 15 nt, Haemophilus influenzae Rd
auacuuacucaauau

SEQ ID NO: 689477 - RNA, 16 nt, Haemophilus influenzae Rd
auacuuacucaauaug

SEQ ID NO: 689478 - RNA, 22 nt, Haemophilus influenzae Rd
auacuaauuuuaguauucuuua

SEQ ID NO: 689479 - RNA, 16 nt, Haemophilus influenzae Rd
auacuguuuggcaaau

SEQ ID NO: 689480 - RNA, 13 nt, Haemophilus influenzae Rd
auacuuuugcuuc

SEQ ID NO: 689481 - RNA, 14 nt, Haemophilus influenzae Rd
auagaaaagacaau

SEQ ID NO: 689482 - RNA, 12 nt, Haemophilus influenzae Rd
auagaaaagccc

SEQ ID NO: 689483 - RNA, 18 nt, Haemophilus influenzae Rd
auagaaaaaugccacuaa

SEQ ID NO: 689484 - RNA, 17 nt, Haemophilus influenzae Rd
auagaaaguuuaacuuu

SEQ ID NO: 689485 - RNA, 15 nt, Haemophilus influenzae Rd
auagaaaucauaaac

SEQ ID NO: 689486 - RNA, 17 nt, Haemophilus influenzae Rd
auagaagauuuaaaaca

SEQ ID NO: 689487 - RNA, 18 nt, Haemophilus influenzae Rd
auagaauaacgccaugaa

SEQ ID NO: 689488 - RNA, 20 nt, Haemophilus influenzae Rd
auagaaggcuaguucuuccu

SEQ ID NO: 689489 - RNA, 14 nt, Haemophilus influenzae Rd
auagaaugaaaaac

SEQ ID NO: 689490 - RNA, 23 nt, Haemophilus influenzae Rd
auagaaugaaaaacauucaaucu

SEQ ID NO: 689491 - RNA, 21 nt, Haemophilus influenzae Rd
auacgaauugcgguuucaguu

SEQ ID NO: 689492 - RNA, 20 nt, Haemophilus influenzae Rd
auacgcuucuugaauaugau

SEQ ID NO: 689493 - RNA, 19 nt, Haemophilus influenzae Rd
auacuaaauacauuuuuau

SEQ ID NO: 689494 - RNA, 14 nt, Haemophilus influenzae Rd
auacuaacucaaaa

SEQ ID NO: 689495 - RNA, 19 nt, Haemophilus influenzae Rd
auacuaacucaaaauacuc

SEQ ID NO: 689496 - RNA, 19 nt, Haemophilus influenzae Rd
auacuaaggguauacuuua

SEQ ID NO: 689497 - RNA, 20 nt, Haemophilus influenzae Rd
auacuaaaaaauuaaauugu

SEQ ID NO: 689498 - RNA, 22 nt, Haemophilus influenzae Rd
auaccgaguaacguuaaacccu

SEQ ID NO: 689499 - RNA, 13 nt, Haemophilus influenzae Rd
auaccgcccauuc

SEQ ID NO: 689500 - RNA, 14 nt, Haemophilus influenzae Rd
auaccgcccauucc

SEQ ID NO: 689501 - RNA, 15 nt, Haemophilus influenzae Rd
auaccgcccauucca

SEQ ID NO: 689502 - RNA, 22 nt, Haemophilus influenzae Rd
auaccguguaaugcuuuuguag

SEQ ID NO: 689503 - RNA, 22 nt, Haemophilus influenzae Rd
auaccuagucccgcuuuugcca

SEQ ID NO: 689504 - RNA, 13 nt, Haemophilus influenzae Rd
auacgaaaaauua

SEQ ID NO: 689505 - RNA, 16 nt, Haemophilus influenzae Rd
auacgaaaaauuacuu

SEQ ID NO: 689506 - RNA, 21 nt, Haemophilus influenzae Rd
auacgaauguuugaucgguuu

SEQ ID NO: 689507 - RNA, 15 nt, Haemophilus influenzae Rd
auaccagaggaauau

SEQ ID NO: 689508 - RNA, 15 nt, Haemophilus influenzae Rd
auaccacgcgugaaa

SEQ ID NO: 689509 - RNA, 13 nt, Haemophilus influenzae Rd
auaccacauaaau

SEQ ID NO: 689510 - RNA, 13 nt, Haemophilus influenzae Rd
auaccacauucca

SEQ ID NO: 689511 - RNA, 14 nt, Haemophilus influenzae Rd
auaccacauuccau

SEQ ID NO: 689512 - RNA, 18 nt, Haemophilus influenzae Rd
auaccaaggcauuuuuuc

SEQ ID NO: 689513 - RNA, 23 nt, Haemophilus influenzae Rd
auaccaaggcauuuuuucugcau

SEQ ID NO: 689514 - RNA, 19 nt, Haemophilus influenzae Rd
auacauuuuguuucuaaau

SEQ ID NO: 689515 - RNA, 22 nt, Haemophilus influenzae Rd
auacauuuuguuucuaaauuau

SEQ ID NO: 689516 - RNA, 18 nt, Haemophilus influenzae Rd
auaccauacauaaaaucu

SEQ ID NO: 689517 - RNA, 21 nt, Haemophilus influenzae Rd
auaccauuuaaaaguaaaaau

SEQ ID NO: 689518 - RNA, 23 nt, Haemophilus influenzae Rd
auaccauuuaaaaguaaaaauaa

SEQ ID NO: 689519 - RNA, 20 nt, Haemophilus influenzae Rd
auauaaucgcauuguuuuau

SEQ ID NO: 689520 - RNA, 21 nt, Haemophilus influenzae Rd
auauaaguuauuuauauaauu

SEQ ID NO: 689521 - RNA, 20 nt, Haemophilus influenzae Rd
auauaagcaaagaaauuuaa

SEQ ID NO: 689522 - RNA, 15 nt, Haemophilus influenzae Rd
auauaaaggauuuua

SEQ ID NO: 689523 - RNA, 18 nt, Haemophilus influenzae Rd
auauaaauccguaaaaua

SEQ ID NO: 689524 - RNA, 15 nt, Haemophilus influenzae Rd
auauaaauaaaacaa

SEQ ID NO: 689525 - RNA, 23 nt, Haemophilus influenzae Rd
auauaaggcacagggcugauaaa

SEQ ID NO: 689526 - RNA, 13 nt, Haemophilus influenzae Rd
auauacaguucac

SEQ ID NO: 689527 - RNA, 13 nt, Haemophilus influenzae Rd
auauaccauucuu

SEQ ID NO: 689528 - RNA, 15 nt, Haemophilus influenzae Rd
auauaccauucuuuc

SEQ ID NO: 689529 - RNA, 17 nt, Haemophilus influenzae Rd
auauacucguucguuau

SEQ ID NO: 689530 - RNA, 19 nt, Haemophilus influenzae Rd
auauagccuagaaauaucu

SEQ ID NO: 689531 - RNA, 17 nt, Haemophilus influenzae Rd
auauagguuaauaguug

SEQ ID NO: 689532 - RNA, 18 nt, Haemophilus influenzae Rd
auauagggcucaaauuuu

SEQ ID NO: 689533 - RNA, 14 nt, Haemophilus influenzae Rd
auauagucaaauaa

SEQ ID NO: 689534 - RNA, 14 nt, Haemophilus influenzae Rd
auauauaucacaga

SEQ ID NO: 689535 - RNA, 13 nt, Haemophilus influenzae Rd
auauauaaaauau

SEQ ID NO: 689536 - RNA, 15 nt, Haemophilus influenzae Rd
auauauaaaauauau

SEQ ID NO: 689537 - RNA, 13 nt, Haemophilus influenzae Rd
auagucaaauaac

SEQ ID NO: 689538 - RNA, 17 nt, Haemophilus influenzae Rd
auaguauggcucuaaau

SEQ ID NO: 689539 - RNA, 20 nt, Haemophilus influenzae Rd
auaguauggcucuaaauuaa

SEQ ID NO: 689540 - RNA, 21 nt, Haemophilus influenzae Rd
auaguauggcucuaaauuaau

SEQ ID NO: 689541 - RNA, 15 nt, Haemophilus influenzae Rd
auagccuucugccau

SEQ ID NO: 689542 - RNA, 16 nt, Haemophilus influenzae Rd
auagccuguaaauuua

SEQ ID NO: 689543 - RNA, 13 nt, Haemophilus influenzae Rd
auagccucuaaga

SEQ ID NO: 689544 - RNA, 16 nt, Haemophilus influenzae Rd
auagccucuucuuuug

SEQ ID NO: 689545 - RNA, 17 nt, Haemophilus influenzae Rd
auagccucuucuuuuga

SEQ ID NO: 689546 - RNA, 20 nt, Haemophilus influenzae Rd
auagccucuucuuuugauaa

SEQ ID NO: 689547 - RNA, 13 nt, Haemophilus influenzae Rd
auagccuuuucua

SEQ ID NO: 689548 - RNA, 21 nt, Haemophilus influenzae Rd
auauaaacggagcgauguuuu

SEQ ID NO: 689549 - RNA, 16 nt, Haemophilus influenzae Rd
auauaaacguugugaa

SEQ ID NO: 689550 - RNA, 12 nt, Haemophilus influenzae Rd
auauaaauaaaa

SEQ ID NO: 689551 - RNA, 21 nt, Haemophilus influenzae Rd
auauaaauaacuaccuaauaa

SEQ ID NO: 689552 - RNA, 14 nt, Haemophilus influenzae Rd
auaguuauuuauuc

SEQ ID NO: 689553 - RNA, 15 nt, Haemophilus influenzae Rd
auauaaacaauuccc

SEQ ID NO: 689554 - RNA, 20 nt, Haemophilus influenzae Rd
auagucgcuggaacuucuaa

SEQ ID NO: 689555 - RNA, 15 nt, Haemophilus influenzae Rd
auagucguuuaacca

SEQ ID NO: 689556 - RNA, 22 nt, Haemophilus influenzae Rd
auagucuaacuuuuucaaugaa

SEQ ID NO: 689557 - RNA, 18 nt, Haemophilus influenzae Rd
auagugaaaaaauaacca

SEQ ID NO: 689558 - RNA, 17 nt, Haemophilus influenzae Rd
auauccugcacauccug

SEQ ID NO: 689559 - RNA, 18 nt, Haemophilus influenzae Rd
auauaugguucauuauua

SEQ ID NO: 689560 - RNA, 15 nt, Haemophilus influenzae Rd
auauaugauuauaaa

SEQ ID NO: 689561 - RNA, 19 nt, Haemophilus influenzae Rd
auauaucucuaaaaaauaa

SEQ ID NO: 689562 - RNA, 15 nt, Haemophilus influenzae Rd
auauaugaaaaauaa

SEQ ID NO: 689563 - RNA, 13 nt, Haemophilus influenzae Rd
auauaucaagcag

SEQ ID NO: 689564 - RNA, 19 nt, Haemophilus influenzae Rd
auaucauggcacaaaauaa

SEQ ID NO: 689565 - RNA, 16 nt, Haemophilus influenzae Rd
auaucccaacuuuaug

SEQ ID NO: 689566 - RNA, 16 nt, Haemophilus influenzae Rd
auaugccuaaaaagaa

SEQ ID NO: 689567 - RNA, 20 nt, Haemophilus influenzae Rd
auaugccuguggaaacuaau

SEQ ID NO: 689568 - RNA, 19 nt, Haemophilus influenzae Rd
auaugccuuauauuucacu

SEQ ID NO: 689569 - RNA, 17 nt, Haemophilus influenzae Rd
auaugcgaucacugcac

SEQ ID NO: 689570 - RNA, 23 nt, Haemophilus influenzae Rd
auaugccaagauuucgcccaugc

SEQ ID NO: 689571 - RNA, 20 nt, Haemophilus influenzae Rd
auaugccaaggcucccgccc

SEQ ID NO: 689572 - RNA, 13 nt, Haemophilus influenzae Rd
auaugaaauuucu

SEQ ID NO: 689573 - RNA, 16 nt, Haemophilus influenzae Rd
auaugaaauuucuuua

SEQ ID NO: 689574 - RNA, 19 nt, Haemophilus influenzae Rd
auaugaccauuaaucacac

SEQ ID NO: 689575 - RNA, 22 nt, Haemophilus influenzae Rd
auaugaccauuaaucacacuug

SEQ ID NO: 689576 - RNA, 19 nt, Haemophilus influenzae Rd
auaugaaccuauuagaauu

SEQ ID NO: 689577 - RNA, 23 nt, Haemophilus influenzae Rd
auaugauuucuucaaagcuuaag

SEQ ID NO: 689578 - RNA, 21 nt, Haemophilus influenzae Rd
auaugcaaagguaauugccaa

SEQ ID NO: 689579 - RNA, 14 nt, Haemophilus influenzae Rd
auaugcaaauaauc

SEQ ID NO: 689580 - RNA, 15 nt, Haemophilus influenzae Rd
auaugauuuagaaca

SEQ ID NO: 689581 - RNA, 21 nt, Haemophilus influenzae Rd
auaugaaacgcgaguaaaaua

SEQ ID NO: 689582 - RNA, 19 nt, Haemophilus influenzae Rd
auaucugauacuuugcuug

SEQ ID NO: 689583 - RNA, 13 nt, Haemophilus influenzae Rd
auaucucugccau

SEQ ID NO: 689584 - RNA, 18 nt, Haemophilus influenzae Rd
auaucguuaucuuuaaag

SEQ ID NO: 689585 - RNA, 23 nt, Haemophilus influenzae Rd
auaucuauugagauuuaauuuau

SEQ ID NO: 689586 - RNA, 23 nt, Haemophilus influenzae Rd
auaugguucauuauuaauugaug

SEQ ID NO: 689587 - RNA, 16 nt, Haemophilus influenzae Rd
auaugguaauuagccu

SEQ ID NO: 689588 - RNA, 13 nt, Haemophilus influenzae Rd
auaugguaagaac

SEQ ID NO: 689589 - RNA, 22 nt, Haemophilus influenzae Rd
auauguucuaagguauaaauaa

SEQ ID NO: 689590 - RNA, 17 nt, Haemophilus influenzae Rd
auauguucuuuguugau

SEQ ID NO: 689591 - RNA, 15 nt, Haemophilus influenzae Rd
auauguugguaauuc

SEQ ID NO: 689592 - RNA, 19 nt, Haemophilus influenzae Rd
auauuacgcauaucacgau

SEQ ID NO: 689593 - RNA, 22 nt, Haemophilus influenzae Rd
auauuacuaauucauuacauaa

SEQ ID NO: 689594 - RNA, 14 nt, Haemophilus influenzae Rd
auauuacuuaacau

SEQ ID NO: 689595 - RNA, 20 nt, Haemophilus influenzae Rd
auauuacuuaacaucaucau

SEQ ID NO: 689596 - RNA, 13 nt, Haemophilus influenzae Rd
auauuaauuuuga

SEQ ID NO: 689597 - RNA, 22 nt, Haemophilus influenzae Rd
auauuacauaccaaucacaaca

SEQ ID NO: 689598 - RNA, 13 nt, Haemophilus influenzae Rd
auauuagcgaguu

SEQ ID NO: 689599 - RNA, 16 nt, Haemophilus influenzae Rd
auauuaguuagcuaaa

SEQ ID NO: 689600 - RNA, 20 nt, Haemophilus influenzae Rd
auauuaguaauauauucuac

SEQ ID NO: 689601 - RNA, 14 nt, Haemophilus influenzae Rd
auauuagaaucaau

SEQ ID NO: 689602 - RNA, 18 nt, Haemophilus influenzae Rd
auauuagaaucaauggcu

SEQ ID NO: 689603 - RNA, 23 nt, Haemophilus influenzae Rd
auauuaacuugcuauuuucuaau

SEQ ID NO: 689604 - RNA, 19 nt, Haemophilus influenzae Rd
auauuaagcaauugaauaa

SEQ ID NO: 689605 - RNA, 22 nt, Haemophilus influenzae Rd
auauuaauacuuggugcaauaa

SEQ ID NO: 689606 - RNA, 13 nt, Haemophilus influenzae Rd
auauucaugaauc

SEQ ID NO: 689607 - RNA, 20 nt, Haemophilus influenzae Rd
auauucaucgccaaauuuac

SEQ ID NO: 689608 - RNA, 19 nt, Haemophilus influenzae Rd
auauuccaacgauuuugca

SEQ ID NO: 689609 - RNA, 22 nt, Haemophilus influenzae Rd
auauuaucuucaugauuuucca

SEQ ID NO: 689610 - RNA, 19 nt, Haemophilus influenzae Rd
auauucuuuaaaacauucc

SEQ ID NO: 689611 - RNA, 14 nt, Haemophilus influenzae Rd
auauucuuuaaaua

SEQ ID NO: 689612 - RNA, 16 nt, Haemophilus influenzae Rd
auauucuuuaaauauu

SEQ ID NO: 689613 - RNA, 19 nt, Haemophilus influenzae Rd
auauucuuuuauuaacaaa

SEQ ID NO: 689614 - RNA, 20 nt, Haemophilus influenzae Rd
auauucuuuuauuaacaaaa

SEQ ID NO: 689615 - RNA, 23 nt, Haemophilus influenzae Rd
auauugaacgccuagauauuguu

SEQ ID NO: 689616 - RNA, 21 nt, Haemophilus influenzae Rd
auauugaccguuugaccauuc

SEQ ID NO: 689617 - RNA, 23 nt, Haemophilus influenzae Rd
auauugaaaacgucgauccauug

SEQ ID NO: 689618 - RNA, 14 nt, Haemophilus influenzae Rd
auauugaaaaguac

SEQ ID NO: 689619 - RNA, 14 nt, Haemophilus influenzae Rd
auauucuuuuuaaa

SEQ ID NO: 689620 - RNA, 15 nt, Haemophilus influenzae Rd
auauucuuuuuaaau

SEQ ID NO: 689621 - RNA, 22 nt, Haemophilus influenzae Rd
auauucuuuuuaaauauuuaaa

SEQ ID NO: 689622 - RNA, 22 nt, Haemophilus influenzae Rd
auauugaaauaagauuuuugau

SEQ ID NO: 689623 - RNA, 15 nt, Haemophilus influenzae Rd
auauugaaauuggaa

SEQ ID NO: 689624 - RNA, 22 nt, Haemophilus influenzae Rd
auauuguaggaagacaggauug

SEQ ID NO: 689625 - RNA, 16 nt, Haemophilus influenzae Rd
auauuggaguuagaau

SEQ ID NO: 689626 - RNA, 18 nt, Haemophilus influenzae Rd
auauuggaguuagaauaa

SEQ ID NO: 689627 - RNA, 16 nt, Haemophilus influenzae Rd
auauugaguauucccc

SEQ ID NO: 689628 - RNA, 20 nt, Haemophilus influenzae Rd
auauuuagauacaaaauguu

SEQ ID NO: 689629 - RNA, 17 nt, Haemophilus influenzae Rd
auauuuaggcuauuuua

SEQ ID NO: 689630 - RNA, 15 nt, Haemophilus influenzae Rd
auauuuaaugauaau

SEQ ID NO: 689631 - RNA, 22 nt, Haemophilus influenzae Rd
auauuuaaugauaaucuaaaaa

SEQ ID NO: 689632 - RNA, 14 nt, Haemophilus influenzae Rd
auauuuaauaaaau

SEQ ID NO: 689633 - RNA, 17 nt, Haemophilus influenzae Rd
auauuuaauguguagau

SEQ ID NO: 689634 - RNA, 12 nt, Haemophilus influenzae Rd
auauuuaacuaa

SEQ ID NO: 689635 - RNA, 17 nt, Haemophilus influenzae Rd
auauuuaccgcuuucaa

SEQ ID NO: 689636 - RNA, 13 nt, Haemophilus influenzae Rd
aucaaaguuccua

SEQ ID NO: 689637 - RNA, 23 nt, Haemophilus influenzae Rd
aucaaaguuccuagaauuaaaag

SEQ ID NO: 689638 - RNA, 16 nt, Haemophilus influenzae Rd
aucaaaggcuaauucu

SEQ ID NO: 689639 - RNA, 19 nt, Haemophilus influenzae Rd
aucaaagugcgguaaauuu

SEQ ID NO: 689640 - RNA, 13 nt, Haemophilus influenzae Rd
aucaaauaaaaua

SEQ ID NO: 689641 - RNA, 14 nt, Haemophilus influenzae Rd
aucaaauaaaauau

SEQ ID NO: 689642 - RNA, 16 nt, Haemophilus influenzae Rd
aucaaauaaaauauuu

SEQ ID NO: 689643 - RNA, 14 nt, Haemophilus influenzae Rd
aucaaagcucaccu

SEQ ID NO: 689644 - RNA, 16 nt, Haemophilus influenzae Rd
aucaaaauuauaaacc

SEQ ID NO: 689645 - RNA, 15 nt, Haemophilus influenzae Rd
aucaaaauucaaaau

SEQ ID NO: 689646 - RNA, 14 nt, Haemophilus influenzae Rd
aucaaagaaacugu

SEQ ID NO: 689647 - RNA, 16 nt, Haemophilus influenzae Rd
aucaaagaaacugucu

SEQ ID NO: 689648 - RNA, 19 nt, Haemophilus influenzae Rd
aucaaagaaacugucuacu

SEQ ID NO: 689649 - RNA, 15 nt, Haemophilus influenzae Rd
aucaaagaauuuuuu

SEQ ID NO: 689650 - RNA, 12 nt, Haemophilus influenzae Rd
aucaaagagaag

SEQ ID NO: 689651 - RNA, 20 nt, Haemophilus influenzae Rd
aucaaagcgagaaaaacgaa

SEQ ID NO: 689652 - RNA, 23 nt, Haemophilus influenzae Rd
aucaaagcguuuuucuacauaau

SEQ ID NO: 689653 - RNA, 14 nt, Haemophilus influenzae Rd
aucaaauucuaaaa

SEQ ID NO: 689654 - RNA, 16 nt, Haemophilus influenzae Rd
aucaaauucuaaaaca

SEQ ID NO: 689655 - RNA, 19 nt, Haemophilus influenzae Rd
aucaaauucucuguuucuu

SEQ ID NO: 689656 - RNA, 16 nt, Haemophilus influenzae Rd
aucaaauugaugcucu

SEQ ID NO: 689657 - RNA, 17 nt, Haemophilus influenzae Rd
aucaaauugaugcucug

SEQ ID NO: 689658 - RNA, 15 nt, Haemophilus influenzae Rd
aucaaauuuaggauu

SEQ ID NO: 689659 - RNA, 19 nt, Haemophilus influenzae Rd
aucaaauccgccaaucaua

SEQ ID NO: 689660 - RNA, 15 nt, Haemophilus influenzae Rd
aucaaaauaaauaaa

SEQ ID NO: 689661 - RNA, 19 nt, Haemophilus influenzae Rd
aucaaaauagcuuuuuaau

SEQ ID NO: 689662 - RNA, 20 nt, Haemophilus influenzae Rd
auauuucuuuucaaacacaa

SEQ ID NO: 689663 - RNA, 22 nt, Haemophilus influenzae Rd
auauuugaaguugccauagaca

SEQ ID NO: 689664 - RNA, 16 nt, Haemophilus influenzae Rd
aucaaaagaauuaaaa

SEQ ID NO: 689665 - RNA, 18 nt, Haemophilus influenzae Rd
aucaaaagaauuaaaaau

SEQ ID NO: 689666 - RNA, 19 nt, Haemophilus influenzae Rd
aucaaaagaauuaaaaaug

SEQ ID NO: 689667 - RNA, 12 nt, Haemophilus influenzae Rd
auauuucaguau

SEQ ID NO: 689668 - RNA, 18 nt, Haemophilus influenzae Rd
auauuucacuaaauccuu

SEQ ID NO: 689669 - RNA, 21 nt, Haemophilus influenzae Rd
auauuucacuucuaacuaaaa

SEQ ID NO: 689670 - RNA, 18 nt, Haemophilus influenzae Rd
auauuucgcccuuauaca

SEQ ID NO: 689671 - RNA, 19 nt, Haemophilus influenzae Rd
aucaagaauuccauugcau

SEQ ID NO: 689672 - RNA, 14 nt, Haemophilus influenzae Rd
aucaacuuuaucau

SEQ ID NO: 689673 - RNA, 12 nt, Haemophilus influenzae Rd
aucaauaacaag

SEQ ID NO: 689674 - RNA, 17 nt, Haemophilus influenzae Rd
aucaauaacacucauug

SEQ ID NO: 689675 - RNA, 20 nt, Haemophilus influenzae Rd
aucaauacgccuaaaacaag

SEQ ID NO: 689676 - RNA, 17 nt, Haemophilus influenzae Rd
aucaauaacugauuuug

SEQ ID NO: 689677 - RNA, 23 nt, Haemophilus influenzae Rd
aucaauacuugaucggcuacuau

SEQ ID NO: 689678 - RNA, 21 nt, Haemophilus influenzae Rd
aucaauagaacgaaccccuug

SEQ ID NO: 689679 - RNA, 16 nt, Haemophilus influenzae Rd
aucaaucaaauucaac

SEQ ID NO: 689680 - RNA, 17 nt, Haemophilus influenzae Rd
aucaaucaaauucaaca

SEQ ID NO: 689681 - RNA, 14 nt, Haemophilus influenzae Rd
aucaaucauuaacu

SEQ ID NO: 689682 - RNA, 22 nt, Haemophilus influenzae Rd
aucaauccagaacgaacaauuu

SEQ ID NO: 689683 - RNA, 19 nt, Haemophilus influenzae Rd
aucaaucaggcuuucauuu

SEQ ID NO: 689684 - RNA, 15 nt, Haemophilus influenzae Rd
aucaaucauaaaaac

SEQ ID NO: 689685 - RNA, 16 nt, Haemophilus influenzae Rd
aucaaucauaaaaaca

SEQ ID NO: 689686 - RNA, 19 nt, Haemophilus influenzae Rd
aucaacugcaacaauuuca

SEQ ID NO: 689687 - RNA, 17 nt, Haemophilus influenzae Rd
aucaacuagugcuguug

SEQ ID NO: 689688 - RNA, 15 nt, Haemophilus influenzae Rd
aucaacuaaaaaaua

SEQ ID NO: 689689 - RNA, 14 nt, Haemophilus influenzae Rd
aucaacaucaacua

SEQ ID NO: 689690 - RNA, 23 nt, Haemophilus influenzae Rd
aucaacauaacguuuaucuaaua

SEQ ID NO: 689691 - RNA, 17 nt, Haemophilus influenzae Rd
aucaacaauccauuucg

SEQ ID NO: 689692 - RNA, 13 nt, Haemophilus influenzae Rd
aucaacaacuaaa

SEQ ID NO: 689693 - RNA, 18 nt, Haemophilus influenzae Rd
aguacgaauuaagcgaac

SEQ ID NO: 689694 - RNA, 22 nt, Haemophilus influenzae Rd
aguacgauugcaauaaucacag

SEQ ID NO: 689695 - RNA, 16 nt, Haemophilus influenzae Rd
aguagauuuuuauuca

SEQ ID NO: 689696 - RNA, 22 nt, Haemophilus influenzae Rd
aguagauuacacauuaacagaa

SEQ ID NO: 689697 - RNA, 14 nt, Haemophilus influenzae Rd
aguagaaaucacaa

SEQ ID NO: 689698 - RNA, 17 nt, Haemophilus influenzae Rd
aguagaaaucacaauaa

SEQ ID NO: 689699 - RNA, 23 nt, Haemophilus influenzae Rd
aguauagucauucaaugcagaaa

SEQ ID NO: 689700 - RNA, 16 nt, Haemophilus influenzae Rd
aguauagcuuuuugca

SEQ ID NO: 689701 - RNA, 19 nt, Haemophilus influenzae Rd
aguauagggaauaaaaaag

SEQ ID NO: 689702 - RNA, 13 nt, Haemophilus influenzae Rd
aguauaaauuugu

SEQ ID NO: 689703 - RNA, 21 nt, Haemophilus influenzae Rd
aguauaacguagcgauaaaau

SEQ ID NO: 689704 - RNA, 23 nt, Haemophilus influenzae Rd
aguauaacguagcgauaaaauau

SEQ ID NO: 689705 - RNA, 14 nt, Haemophilus influenzae Rd
aguauaaaccgcau

SEQ ID NO: 689706 - RNA, 16 nt, Haemophilus influenzae Rd
aguauaaaaaaucccu

SEQ ID NO: 689707 - RNA, 14 nt, Haemophilus influenzae Rd
aguauaaacuuuau

SEQ ID NO: 689708 - RNA, 18 nt, Haemophilus influenzae Rd
aguaguagcguaaaucaa

SEQ ID NO: 689709 - RNA, 21 nt, Haemophilus influenzae Rd
aguaggagcaaucuuuuucuu

SEQ ID NO: 689710 - RNA, 12 nt, Haemophilus influenzae Rd
aguauuuuccuu

SEQ ID NO: 689711 - RNA, 19 nt, Haemophilus influenzae Rd
aguauuuugcagaauacug

SEQ ID NO: 689712 - RNA, 15 nt, Haemophilus influenzae Rd
aguauuuuauuuaua

SEQ ID NO: 689713 - RNA, 17 nt, Haemophilus influenzae Rd
aguauuuaagcugaaau

SEQ ID NO: 689714 - RNA, 20 nt, Haemophilus influenzae Rd
aguauuccccgcuuucgcuu

SEQ ID NO: 689715 - RNA, 20 nt, Haemophilus influenzae Rd
aguauucagugccuaaauuu

SEQ ID NO: 689716 - RNA, 21 nt, Haemophilus influenzae Rd
aguauucauauaauucauuag

SEQ ID NO: 689717 - RNA, 15 nt, Haemophilus influenzae Rd
aguauuaaauuuuua

SEQ ID NO: 689718 - RNA, 13 nt, Haemophilus influenzae Rd
aguauguuuugau

SEQ ID NO: 689719 - RNA, 22 nt, Haemophilus influenzae Rd
aguaucacgcacaccaccugau

SEQ ID NO: 689720 - RNA, 22 nt, Haemophilus influenzae Rd
aguauauucgccuucacaaacc

SEQ ID NO: 689721 - RNA, 17 nt, Haemophilus influenzae Rd
aguaucaaaacuugcua

SEQ ID NO: 689722 - RNA, 14 nt, Haemophilus influenzae Rd
aguaucaaauacac

SEQ ID NO: 689723 - RNA, 22 nt, Haemophilus influenzae Rd
aguaucagauuuaggcaauaaa

SEQ ID NO: 689724 - RNA, 20 nt, Haemophilus influenzae Rd
aguaucccaaauuaaauccu

SEQ ID NO: 689725 - RNA, 16 nt, Haemophilus influenzae Rd
aguaugccauaaaaua

SEQ ID NO: 689726 - RNA, 21 nt, Haemophilus influenzae Rd
agucaggaauaaaagauuuug

SEQ ID NO: 689727 - RNA, 15 nt, Haemophilus influenzae Rd
agucagcgcagcaau

SEQ ID NO: 689728 - RNA, 14 nt, Haemophilus influenzae Rd
agucagcucaagca

SEQ ID NO: 689729 - RNA, 21 nt, Haemophilus influenzae Rd
agucaguaaaccaagugaaau

SEQ ID NO: 689730 - RNA, 15 nt, Haemophilus influenzae Rd
agucagcauaaacaa

SEQ ID NO: 689731 - RNA, 19 nt, Haemophilus influenzae Rd
agucagcauaaacaaaaua

SEQ ID NO: 689732 - RNA, 12 nt, Haemophilus influenzae Rd
agucacaacaau

SEQ ID NO: 689733 - RNA, 23 nt, Haemophilus influenzae Rd
agucaauuugaccgacaagauaa

SEQ ID NO: 689734 - RNA, 20 nt, Haemophilus influenzae Rd
agucaagguugcaacaucaa

SEQ ID NO: 689735 - RNA, 14 nt, Haemophilus influenzae Rd
agucaaauaacccu

SEQ ID NO: 689736 - RNA, 22 nt, Haemophilus influenzae Rd
aguccacaucagguauaaagau

SEQ ID NO: 689737 - RNA, 20 nt, Haemophilus influenzae Rd
agucaucuaauugauucaaa

SEQ ID NO: 689738 - RNA, 18 nt, Haemophilus influenzae Rd
agucauauugauuucucu

SEQ ID NO: 689739 - RNA, 13 nt, Haemophilus influenzae Rd
agucauugauuua

SEQ ID NO: 689740 - RNA, 15 nt, Haemophilus influenzae Rd
agucauuuuuuacau

SEQ ID NO: 689741 - RNA, 22 nt, Haemophilus influenzae Rd
agucauuuuuuacauuaagugc

SEQ ID NO: 689742 - RNA, 20 nt, Haemophilus influenzae Rd
agucauucaaugcagaaaua

SEQ ID NO: 689743 - RNA, 23 nt, Haemophilus influenzae Rd
agucgaugccaagggcugaagcu

SEQ ID NO: 689744 - RNA, 15 nt, Haemophilus influenzae Rd
agucgauucaaauaa

SEQ ID NO: 689745 - RNA, 16 nt, Haemophilus influenzae Rd
agucgauucaaauaac

SEQ ID NO: 689746 - RNA, 14 nt, Haemophilus influenzae Rd
agucgguagagcag

SEQ ID NO: 689747 - RNA, 15 nt, Haemophilus influenzae Rd
agucgcuuucaacac

SEQ ID NO: 689748 - RNA, 22 nt, Haemophilus influenzae Rd
agucccuguucaaauucugcuu

SEQ ID NO: 689749 - RNA, 16 nt, Haemophilus influenzae Rd
aguccugcagccgcca

SEQ ID NO: 689750 - RNA, 14 nt, Haemophilus influenzae Rd
aguccgccuugaga

SEQ ID NO: 689751 - RNA, 16 nt, Haemophilus influenzae Rd
agugaguauaaauuug

SEQ ID NO: 689752 - RNA, 16 nt, Haemophilus influenzae Rd
agugaguauguugcuu

SEQ ID NO: 689753 - RNA, 16 nt, Haemophilus influenzae Rd
agugaguugauuuaaa

SEQ ID NO: 689754 - RNA, 23 nt, Haemophilus influenzae Rd
agugaguugauuuaaauugaaaa

SEQ ID NO: 689755 - RNA, 21 nt, Haemophilus influenzae Rd
agugaguugauuuuaaaauau

SEQ ID NO: 689756 - RNA, 20 nt, Haemophilus influenzae Rd
agugaaucauuauauugugc

SEQ ID NO: 689757 - RNA, 14 nt, Haemophilus influenzae Rd
agugaaguuauagu

SEQ ID NO: 689758 - RNA, 18 nt, Haemophilus influenzae Rd
agugaacuucauuuaguu

SEQ ID NO: 689759 - RNA, 17 nt, Haemophilus influenzae Rd
agugaaaaaauaaccac

SEQ ID NO: 689760 - RNA, 13 nt, Haemophilus influenzae Rd
agugaaaagaaaa

SEQ ID NO: 689761 - RNA, 19 nt, Haemophilus influenzae Rd
agugaaaccugcuugaaug

SEQ ID NO: 689762 - RNA, 20 nt, Haemophilus influenzae Rd
agugaaacuggcauuuucuu

SEQ ID NO: 689763 - RNA, 13 nt, Haemophilus influenzae Rd
agugaaagauaaa

SEQ ID NO: 689764 - RNA, 15 nt, Haemophilus influenzae Rd
agucucaaauuuuuc

SEQ ID NO: 689765 - RNA, 14 nt, Haemophilus influenzae Rd
agugccaaucaaga

SEQ ID NO: 689766 - RNA, 23 nt, Haemophilus influenzae Rd
agugauuucuauguuauuaaaau

SEQ ID NO: 689767 - RNA, 18 nt, Haemophilus influenzae Rd
agugauuuuaaaucccaa

SEQ ID NO: 689768 - RNA, 21 nt, Haemophilus influenzae Rd
agugcaagccccugaagccaa

SEQ ID NO: 689769 - RNA, 16 nt, Haemophilus influenzae Rd
agugcaacaacaaagu

SEQ ID NO: 689770 - RNA, 20 nt, Haemophilus influenzae Rd
agugauuuuugcaacuucag

SEQ ID NO: 689771 - RNA, 14 nt, Haemophilus influenzae Rd
agugcgguaagaaa

SEQ ID NO: 689772 - RNA, 18 nt, Haemophilus influenzae Rd
agugcggucaauaaaaau

SEQ ID NO: 689773 - RNA, 19 nt, Haemophilus influenzae Rd
agugcggucaauuuucaaa

SEQ ID NO: 689774 - RNA, 16 nt, Haemophilus influenzae Rd
agugcggucaauuuuu

SEQ ID NO: 689775 - RNA, 19 nt, Haemophilus influenzae Rd
agugcggcuucauuuugag

SEQ ID NO: 689776 - RNA, 13 nt, Haemophilus influenzae Rd
agugcgguaaaaa

SEQ ID NO: 689777 - RNA, 21 nt, Haemophilus influenzae Rd
agugcgguaaaaauucaccgc

SEQ ID NO: 689778 - RNA, 18 nt, Haemophilus influenzae Rd
agugcgguaaaaauuucu

SEQ ID NO: 689779 - RNA, 17 nt, Haemophilus influenzae Rd
agugcgguaaaaucacc

SEQ ID NO: 689780 - RNA, 17 nt, Haemophilus influenzae Rd
agugcgguaaaauuuuu

SEQ ID NO: 689781 - RNA, 16 nt, Haemophilus influenzae Rd
agugcgguaaauuuuu

SEQ ID NO: 689782 - RNA, 19 nt, Haemophilus influenzae Rd
agugcccgcuacaaauaag

SEQ ID NO: 689783 - RNA, 17 nt, Haemophilus influenzae Rd
agugcugguagcaauaa

SEQ ID NO: 689784 - RNA, 21 nt, Haemophilus influenzae Rd
agugcggugaaauuucaccgc

SEQ ID NO: 689785 - RNA, 22 nt, Haemophilus influenzae Rd
agugcgguuaaauauuucagua

SEQ ID NO: 689786 - RNA, 14 nt, Haemophilus influenzae Rd
agugcgguuaaauu

SEQ ID NO: 689787 - RNA, 13 nt, Haemophilus influenzae Rd
agugcuuuaccug

SEQ ID NO: 689788 - RNA, 20 nt, Haemophilus influenzae Rd
aguuaauccuaaauuaugcu

SEQ ID NO: 689789 - RNA, 16 nt, Haemophilus influenzae Rd
aguuaaugcaguuuug

SEQ ID NO: 689790 - RNA, 19 nt, Haemophilus influenzae Rd
aguuaauuauuuuaaauaa

SEQ ID NO: 689791 - RNA, 20 nt, Haemophilus influenzae Rd
aguuaagcuaccugccauaa

SEQ ID NO: 689792 - RNA, 15 nt, Haemophilus influenzae Rd
aguuaagaaaauaau

SEQ ID NO: 689793 - RNA, 15 nt, Haemophilus influenzae Rd
aguggcauaaagaaa

SEQ ID NO: 689794 - RNA, 19 nt, Haemophilus influenzae Rd
aguggcauaaagaaacagg

SEQ ID NO: 689795 - RNA, 15 nt, Haemophilus influenzae Rd
aguggcgguaaaaau

SEQ ID NO: 689796 - RNA, 22 nt, Haemophilus influenzae Rd
aguggcggcguauugggcggau

SEQ ID NO: 689797 - RNA, 19 nt, Haemophilus influenzae Rd
aguuaaauccucagcaauu

SEQ ID NO: 689798 - RNA, 17 nt, Haemophilus influenzae Rd
aguuacaaacaaucuua

SEQ ID NO: 689799 - RNA, 11 nt, Haemophilus influenzae Rd
aguuacaagua

SEQ ID NO: 689800 - RNA, 19 nt, Haemophilus influenzae Rd
aguuaccgcucgccaauaa

SEQ ID NO: 689801 - RNA, 19 nt, Haemophilus influenzae Rd
aguuaugggcugacauaaa

SEQ ID NO: 689802 - RNA, 21 nt, Haemophilus influenzae Rd
aguuaugggcugacauaaaua

SEQ ID NO: 689803 - RNA, 17 nt, Haemophilus influenzae Rd
aguuaucgccaauaaua

SEQ ID NO: 689804 - RNA, 17 nt, Haemophilus influenzae Rd
aguucagcgauuuuaac

SEQ ID NO: 689805 - RNA, 23 nt, Haemophilus influenzae Rd
aguucagaaagagacucuguucc

SEQ ID NO: 689806 - RNA, 23 nt, Haemophilus influenzae Rd
aguuauuuauauaauuuaacaua

SEQ ID NO: 689807 - RNA, 22 nt, Haemophilus influenzae Rd
aguuauuuuuaaucaaauaaaa

SEQ ID NO: 689808 - RNA, 14 nt, Haemophilus influenzae Rd
aguucauauaaaua

SEQ ID NO: 689809 - RNA, 21 nt, Haemophilus influenzae Rd
aguucucguugcaucuucuau

SEQ ID NO: 689810 - RNA, 15 nt, Haemophilus influenzae Rd
aguucuaaaauuaua

SEQ ID NO: 689811 - RNA, 14 nt, Haemophilus influenzae Rd
aguucuaaauaaac

SEQ ID NO: 689812 - RNA, 17 nt, Haemophilus influenzae Rd
aguucucaaaaaguuaa

SEQ ID NO: 689813 - RNA, 14 nt, Haemophilus influenzae Rd
aguucuacccauuc

SEQ ID NO: 689814 - RNA, 19 nt, Haemophilus influenzae Rd
aguucuacccauucaaaug

SEQ ID NO: 689815 - RNA, 15 nt, Haemophilus influenzae Rd
aguucuaauucauuu

SEQ ID NO: 689816 - RNA, 18 nt, Haemophilus influenzae Rd
aguuuacuuuugauuuua

SEQ ID NO: 689817 - RNA, 13 nt, Haemophilus influenzae Rd
aguuuauaaaaaa

SEQ ID NO: 689818 - RNA, 15 nt, Haemophilus influenzae Rd
aguuuauaaaaaaau

SEQ ID NO: 689819 - RNA, 13 nt, Haemophilus influenzae Rd
aguuuaucucuuu

SEQ ID NO: 689820 - RNA, 16 nt, Haemophilus influenzae Rd
aguuuaucucuuucuu

SEQ ID NO: 689821 - RNA, 22 nt, Haemophilus influenzae Rd
aguuuaucucuuucuuaaaaua

SEQ ID NO: 689822 - RNA, 14 nt, Haemophilus influenzae Rd
aguugguuuugcaa

SEQ ID NO: 689823 - RNA, 14 nt, Haemophilus influenzae Rd
aguuguaaaagugc

SEQ ID NO: 689824 - RNA, 17 nt, Haemophilus influenzae Rd
aguuggguaaucaaauu

SEQ ID NO: 689825 - RNA, 15 nt, Haemophilus influenzae Rd
aguuggguuaaauau

SEQ ID NO: 689826 - RNA, 23 nt, Haemophilus influenzae Rd
aguugguugcacuuggguaaaua

SEQ ID NO: 689827 - RNA, 17 nt, Haemophilus influenzae Rd
aguuguaauaaagcuga

SEQ ID NO: 689828 - RNA, 14 nt, Haemophilus influenzae Rd
aguuguacuauuuu

SEQ ID NO: 689829 - RNA, 22 nt, Haemophilus influenzae Rd
aguuguaggauguucaaguaaa

SEQ ID NO: 689830 - RNA, 21 nt, Haemophilus influenzae Rd
aguugucccgcauauaaaaua

SEQ ID NO: 689831 - RNA, 18 nt, Haemophilus influenzae Rd
aguugagaauuuuuucuu

SEQ ID NO: 689832 - RNA, 20 nt, Haemophilus influenzae Rd
aguugggcuuauuuguuuua

SEQ ID NO: 689833 - RNA, 14 nt, Haemophilus influenzae Rd
aguugggauuuauc

SEQ ID NO: 689834 - RNA, 23 nt, Haemophilus influenzae Rd
aguugggcaagucccuguucaaa

SEQ ID NO: 689835 - RNA, 19 nt, Haemophilus influenzae Rd
aguuuuucagugaguucau

SEQ ID NO: 689836 - RNA, 13 nt, Haemophilus influenzae Rd
aguuuuucaccca

SEQ ID NO: 689837 - RNA, 21 nt, Haemophilus influenzae Rd
aguuuuccuuuuucuaacauc

SEQ ID NO: 689838 - RNA, 19 nt, Haemophilus influenzae Rd
aguuuuccgacaacacuug

SEQ ID NO: 689839 - RNA, 19 nt, Haemophilus influenzae Rd
aguuuuucaaaaauuuuug

SEQ ID NO: 689840 - RNA, 14 nt, Haemophilus influenzae Rd
aguuuuccuuucuu

SEQ ID NO: 689841 - RNA, 12 nt, Haemophilus influenzae Rd
aguuuucacgcu

SEQ ID NO: 689842 - RNA, 24 nt, Haemophilus influenzae Rd
aguuuucacgcugacuuaaugcaa

SEQ ID NO: 689843 - RNA, 22 nt, Haemophilus influenzae Rd
aguuuucaauaucaaagaaaaa

SEQ ID NO: 689844 - RNA, 14 nt, Haemophilus influenzae Rd
aguuuuuuaaguuu

SEQ ID NO: 689845 - RNA, 19 nt, Haemophilus influenzae Rd
aguuuuuuaaguuuccaag

SEQ ID NO: 689846 - RNA, 12 nt, Haemophilus influenzae Rd
aguuuuuucacu

SEQ ID NO: 689847 - RNA, 21 nt, Haemophilus influenzae Rd
aguuuuuuacguaauaaguuu

SEQ ID NO: 689848 - RNA, 16 nt, Haemophilus influenzae Rd
auaaaaaagaaauuuu

SEQ ID NO: 689849 - RNA, 14 nt, Haemophilus influenzae Rd
auaaaaaccagaua

SEQ ID NO: 689850 - RNA, 19 nt, Haemophilus influenzae Rd
auaaaaaccagauaaaaac

SEQ ID NO: 689851 - RNA, 13 nt, Haemophilus influenzae Rd
auaaaaaauaaag

SEQ ID NO: 689852 - RNA, 15 nt, Haemophilus influenzae Rd
auaaaaaauccacac

SEQ ID NO: 689853 - RNA, 21 nt, Haemophilus influenzae Rd
auaaaaaaucggugcaacaau

SEQ ID NO: 689854 - RNA, 11 nt, Haemophilus influenzae Rd
auaaaaacaau

SEQ ID NO: 689855 - RNA, 19 nt, Haemophilus influenzae Rd
aguuugcuuugauaaaugg

SEQ ID NO: 689856 - RNA, 20 nt, Haemophilus influenzae Rd
aguuuggaaagaguaagcaa

SEQ ID NO: 689857 - RNA, 14 nt, Haemophilus influenzae Rd
aguuuuauuuucca

SEQ ID NO: 689858 - RNA, 18 nt, Haemophilus influenzae Rd
aguuuuauuuuccaucau

SEQ ID NO: 689859 - RNA, 20 nt, Haemophilus influenzae Rd
aguuuuauccaugaugaaau

SEQ ID NO: 689860 - RNA, 16 nt, Haemophilus influenzae Rd
aguuuuaucuucaaaa

SEQ ID NO: 689861 - RNA, 21 nt, Haemophilus influenzae Rd
aguuuuauuaucaacaguaaa

SEQ ID NO: 689862 - RNA, 16 nt, Haemophilus influenzae Rd
aguuuguaauccugca

SEQ ID NO: 689863 - RNA, 17 nt, Haemophilus influenzae Rd
aguuuuagggaagauua

SEQ ID NO: 689864 - RNA, 18 nt, Haemophilus influenzae Rd
aguuuuagggaagauuaa

SEQ ID NO: 689865 - RNA, 22 nt, Haemophilus influenzae Rd
aguuuguagcgauauucuuuug

SEQ ID NO: 689866 - RNA, 17 nt, Haemophilus influenzae Rd
aguuugcgaucaucacg

SEQ ID NO: 689867 - RNA, 19 nt, Haemophilus influenzae Rd
aguuuccacguuuucaacu

SEQ ID NO: 689868 - RNA, 22 nt, Haemophilus influenzae Rd
aguuucaguaucacgcacacca

SEQ ID NO: 689869 - RNA, 23 nt, Haemophilus influenzae Rd
aguuucacucuaccaucuaaagu

SEQ ID NO: 689870 - RNA, 21 nt, Haemophilus influenzae Rd
aguuucaagucguuauuuucu

SEQ ID NO: 689871 - RNA, 22 nt, Haemophilus influenzae Rd
aguuucaagucguuauuuucua

SEQ ID NO: 689872 - RNA, 18 nt, Haemophilus influenzae Rd
auaaccauucccauucca

SEQ ID NO: 689873 - RNA, 22 nt, Haemophilus influenzae Rd
auaaccauucccauuccaguaa

SEQ ID NO: 689874 - RNA, 13 nt, Haemophilus influenzae Rd
auaaccaucuaua

SEQ ID NO: 689875 - RNA, 17 nt, Haemophilus influenzae Rd
auaaccauaucugaaaa

SEQ ID NO: 689876 - RNA, 19 nt, Haemophilus influenzae Rd
auaaccugcggauuucacu

SEQ ID NO: 689877 - RNA, 22 nt, Haemophilus influenzae Rd
auaaccuugcugauaaauuccu

SEQ ID NO: 689878 - RNA, 21 nt, Haemophilus influenzae Rd
auaaccuuuaccgucaauaaa

SEQ ID NO: 689879 - RNA, 16 nt, Haemophilus influenzae Rd
auaaccuuuagacaac

SEQ ID NO: 689880 - RNA, 16 nt, Haemophilus influenzae Rd
auaacgauaacugaau

SEQ ID NO: 689881 - RNA, 19 nt, Haemophilus influenzae Rd
auaacgauaagauuugcuu

SEQ ID NO: 689882 - RNA, 19 nt, Haemophilus influenzae Rd
auaacgcaucaccacaaaa

SEQ ID NO: 689883 - RNA, 21 nt, Haemophilus influenzae Rd
auaacgcaucaccacaaaaua

SEQ ID NO: 689884 - RNA, 23 nt, Haemophilus influenzae Rd
auaaccaauccacucuuuuaaua

SEQ ID NO: 689885 - RNA, 21 nt, Haemophilus influenzae Rd
auaaccagauucaucaaagua

SEQ ID NO: 689886 - RNA, 19 nt, Haemophilus influenzae Rd
auaacauaauugcaaugua

SEQ ID NO: 689887 - RNA, 22 nt, Haemophilus influenzae Rd
auaacauaccuagauugcuuug

SEQ ID NO: 689888 - RNA, 21 nt, Haemophilus influenzae Rd
auaaauuggggaaguaauauu

SEQ ID NO: 689889 - RNA, 17 nt, Haemophilus influenzae Rd
auaaauuucaauuaaau

SEQ ID NO: 689890 - RNA, 21 nt, Haemophilus influenzae Rd
auaaauuucaauuaaaucaaa

SEQ ID NO: 689891 - RNA, 16 nt, Haemophilus influenzae Rd
auaaauuguuuuuccc

SEQ ID NO: 689892 - RNA, 21 nt, Haemophilus influenzae Rd
auaaauuuaaccacuaaaaaa

SEQ ID NO: 689893 - RNA, 14 nt, Haemophilus influenzae Rd
auaacaacccuauu

SEQ ID NO: 689894 - RNA, 19 nt, Haemophilus influenzae Rd
auaacaacuggaauuugua

SEQ ID NO: 689895 - RNA, 15 nt, Haemophilus influenzae Rd
auaacaacuaaaaau

SEQ ID NO: 689896 - RNA, 22 nt, Haemophilus influenzae Rd
auaaaucacccggcacauaaau

SEQ ID NO: 689897 - RNA, 21 nt, Haemophilus influenzae Rd
auaaaucaaaagaauuaaaaa

SEQ ID NO: 689898 - RNA, 16 nt, Haemophilus influenzae Rd
auaaaucacuuaauuu

SEQ ID NO: 689899 - RNA, 20 nt, Haemophilus influenzae Rd
auaaaugcaucauuaauaca

SEQ ID NO: 689900 - RNA, 16 nt, Haemophilus influenzae Rd
auaaaugauuauccac

SEQ ID NO: 689901 - RNA, 22 nt, Haemophilus influenzae Rd
auaaaugauuauccacuaaaaa

SEQ ID NO: 689902 - RNA, 16 nt, Haemophilus influenzae Rd
auaaaugcacauuuuu

SEQ ID NO: 689903 - RNA, 21 nt, Haemophilus influenzae Rd
auaaaucccaauagguuugua

SEQ ID NO: 689904 - RNA, 12 nt, Haemophilus influenzae Rd
auaaauccaauc

SEQ ID NO: 689905 - RNA, 17 nt, Haemophilus influenzae Rd
auaaauccaauccaacu

SEQ ID NO: 689906 - RNA, 17 nt, Haemophilus influenzae Rd
auaaauggcucaaguau

SEQ ID NO: 689907 - RNA, 21 nt, Haemophilus influenzae Rd
auaaaugggcaaacauuuuuu

SEQ ID NO: 689908 - RNA, 19 nt, Haemophilus influenzae Rd
auaaaugccgccuuuuaau

SEQ ID NO: 689909 - RNA, 11 nt, Haemophilus influenzae Rd
auaaauggaaa

SEQ ID NO: 689910 - RNA, 15 nt, Haemophilus influenzae Rd
auaaaugcuaaaauu

SEQ ID NO: 689911 - RNA, 17 nt, Haemophilus influenzae Rd
auaaaugcuaaaauuaa

SEQ ID NO: 689912 - RNA, 16 nt, Haemophilus influenzae Rd
auaaauuauauuuuua

SEQ ID NO: 689913 - RNA, 17 nt, Haemophilus influenzae Rd
auaaauuauauuuuuaa

SEQ ID NO: 689914 - RNA, 20 nt, Haemophilus influenzae Rd
auaaauuauguuaaauugca

SEQ ID NO: 689915 - RNA, 23 nt, Haemophilus influenzae Rd
auaaauuauucuucaucuucuuu

SEQ ID NO: 689916 - RNA, 12 nt, Haemophilus influenzae Rd
auaaauucaucu

SEQ ID NO: 689917 - RNA, 18 nt, Haemophilus influenzae Rd
auaaauucguacaaauga

SEQ ID NO: 689918 - RNA, 23 nt, Haemophilus influenzae Rd
auaaauucucgccauaauaaaaa

SEQ ID NO: 689919 - RNA, 13 nt, Haemophilus influenzae Rd
auaaauuccuuuu

SEQ ID NO: 689920 - RNA, 19 nt, Haemophilus influenzae Rd
auaaagaauaauuuucaaa

SEQ ID NO: 689921 - RNA, 17 nt, Haemophilus influenzae Rd
auaaagaauuggcgaac

SEQ ID NO: 689922 - RNA, 19 nt, Haemophilus influenzae Rd
auaaagacgcuguuucuuu

SEQ ID NO: 689923 - RNA, 19 nt, Haemophilus influenzae Rd
auaaaguugagaauuuuuu

SEQ ID NO: 689924 - RNA, 13 nt, Haemophilus influenzae Rd
auaaagagaauau

SEQ ID NO: 689925 - RNA, 18 nt, Haemophilus influenzae Rd
auaaagugcgguaaaauu

SEQ ID NO: 689926 - RNA, 22 nt, Haemophilus influenzae Rd
auaaagugcgguaaaauucuau

SEQ ID NO: 689927 - RNA, 23 nt, Haemophilus influenzae Rd
auaaaguggaugaccaacaccau

SEQ ID NO: 689928 - RNA, 18 nt, Haemophilus influenzae Rd
auaaaguuuuuucaauaa

SEQ ID NO: 689929 - RNA, 15 nt, Haemophilus influenzae Rd
auaaaguuugcaauu

SEQ ID NO: 689930 - RNA, 17 nt, Haemophilus influenzae Rd
auaaauaguuaaagccu

SEQ ID NO: 689931 - RNA, 17 nt, Haemophilus influenzae Rd
auaaauaucaaaauuau

SEQ ID NO: 689932 - RNA, 18 nt, Haemophilus influenzae Rd
auaaauaucaaaauuaug

SEQ ID NO: 689933 - RNA, 20 nt, Haemophilus influenzae Rd
auaaauagcccgauugaauc

SEQ ID NO: 689934 - RNA, 21 nt, Haemophilus influenzae Rd
auaaauaggaaaggcauuuuu

SEQ ID NO: 689935 - RNA, 17 nt, Haemophilus influenzae Rd
auaaauaggcucauuuu

SEQ ID NO: 689936 - RNA, 20 nt, Haemophilus influenzae Rd
auaaaacacaguuauuuuuu

SEQ ID NO: 689937 - RNA, 20 nt, Haemophilus influenzae Rd
auaaaacagagaaaaaaaua

SEQ ID NO: 689938 - RNA, 13 nt, Haemophilus influenzae Rd
auaaaacagagcg

SEQ ID NO: 689939 - RNA, 12 nt, Haemophilus influenzae Rd
auaaaaauuagg

SEQ ID NO: 689940 - RNA, 14 nt, Haemophilus influenzae Rd
auaaaaauuaggua

SEQ ID NO: 689941 - RNA, 12 nt, Haemophilus influenzae Rd
auaaaaauuauu

SEQ ID NO: 689942 - RNA, 14 nt, Haemophilus influenzae Rd
auaaaaauuauuuu

SEQ ID NO: 689943 - RNA, 17 nt, Haemophilus influenzae Rd
auaaaaaugagauuauu

SEQ ID NO: 689944 - RNA, 21 nt, Haemophilus influenzae Rd
auaaaaaugaugauaauuuuu

SEQ ID NO: 689945 - RNA, 14 nt, Haemophilus influenzae Rd
auaaaaauauauuu

SEQ ID NO: 689946 - RNA, 12 nt, Haemophilus influenzae Rd
auaaaaauccuu

SEQ ID NO: 689947 - RNA, 18 nt, Haemophilus influenzae Rd
auaaaacgggaucuauuu

SEQ ID NO: 689948 - RNA, 14 nt, Haemophilus influenzae Rd
auaaaacgaacaau

SEQ ID NO: 689949 - RNA, 20 nt, Haemophilus influenzae Rd
auaaaacgaacaauuucuuu

SEQ ID NO: 689950 - RNA, 22 nt, Haemophilus influenzae Rd
auaaaaccauccgaaauuaauu

SEQ ID NO: 689951 - RNA, 19 nt, Haemophilus influenzae Rd
auaaaaccccguucaauuu

SEQ ID NO: 689952 - RNA, 14 nt, Haemophilus influenzae Rd
auaaaaccuaaaau

SEQ ID NO: 689953 - RNA, 20 nt, Haemophilus influenzae Rd
auaaaagugcgguauuuuuu

SEQ ID NO: 689954 - RNA, 13 nt, Haemophilus influenzae Rd
auaaaauaaaauu

SEQ ID NO: 689955 - RNA, 11 nt, Haemophilus influenzae Rd
auaaaauaaac

SEQ ID NO: 689956 - RNA, 20 nt, Haemophilus influenzae Rd
auaaaauaaacauuuuucau

SEQ ID NO: 689957 - RNA, 17 nt, Haemophilus influenzae Rd
auaaaauaaagaaacgu

SEQ ID NO: 689958 - RNA, 12 nt, Haemophilus influenzae Rd
auaaaauaacuu

SEQ ID NO: 689959 - RNA, 18 nt, Haemophilus influenzae Rd
auaaaauaauauauuaug

SEQ ID NO: 689960 - RNA, 19 nt, Haemophilus influenzae Rd
auaaaagucaguaaaccaa

SEQ ID NO: 689961 - RNA, 16 nt, Haemophilus influenzae Rd
auaaaacuuccuaaug

SEQ ID NO: 689962 - RNA, 21 nt, Haemophilus influenzae Rd
auaaaacuuuauuuuauucug

SEQ ID NO: 689963 - RNA, 13 nt, Haemophilus influenzae Rd
auaaaagcaauaa

SEQ ID NO: 689964 - RNA, 17 nt, Haemophilus influenzae Rd
auaaaagaccucucuag

SEQ ID NO: 689965 - RNA, 19 nt, Haemophilus influenzae Rd
auaaaagagagcuucucuu

SEQ ID NO: 689966 - RNA, 20 nt, Haemophilus influenzae Rd
auaaaagagagcuucucuuu

SEQ ID NO: 689967 - RNA, 14 nt, Haemophilus influenzae Rd
auaaaauauuuuuu

SEQ ID NO: 689968 - RNA, 13 nt, Haemophilus influenzae Rd
auaaaaucaaaau

SEQ ID NO: 689969 - RNA, 11 nt, Haemophilus influenzae Rd
auaaaauagcc

SEQ ID NO: 689970 - RNA, 21 nt, Haemophilus influenzae Rd
auaaaauauaugggaaacaau

SEQ ID NO: 689971 - RNA, 16 nt, Haemophilus influenzae Rd
auaaaauauauuaauu

SEQ ID NO: 689972 - RNA, 15 nt, Haemophilus influenzae Rd
auaaaaucuucuaag

SEQ ID NO: 689973 - RNA, 18 nt, Haemophilus influenzae Rd
auaaaauuacaaaaccaa

SEQ ID NO: 689974 - RNA, 14 nt, Haemophilus influenzae Rd
auaaacauuuuuuc

SEQ ID NO: 689975 - RNA, 22 nt, Haemophilus influenzae Rd
auaaacauuucuaucgcauuuu

SEQ ID NO: 689976 - RNA, 11 nt, Haemophilus influenzae Rd
auaaacauuuu

SEQ ID NO: 689977 - RNA, 14 nt, Haemophilus influenzae Rd
auaaacauuuuuca

SEQ ID NO: 689978 - RNA, 21 nt, Haemophilus influenzae Rd
auaaacaucuugcauaaacca

SEQ ID NO: 689979 - RNA, 15 nt, Haemophilus influenzae Rd
auaaacauuaugaaa

SEQ ID NO: 689980 - RNA, 18 nt, Haemophilus influenzae Rd
auaaacauuaugaaaaaa

SEQ ID NO: 689981 - RNA, 20 nt, Haemophilus influenzae Rd
auaaacauuaugaaaaaaac

SEQ ID NO: 689982 - RNA, 23 nt, Haemophilus influenzae Rd
auaaacaucagugauuuucacau

SEQ ID NO: 689983 - RNA, 19 nt, Haemophilus influenzae Rd
auaaaauuuauuacaaaca

SEQ ID NO: 689984 - RNA, 21 nt, Haemophilus influenzae Rd
auaaaauuuauuacaaacaaa

SEQ ID NO: 689985 - RNA, 23 nt, Haemophilus influenzae Rd
auaaacgaugggcaauggcaauc

SEQ ID NO: 689986 - RNA, 14 nt, Haemophilus influenzae Rd
auaaacgguauuuu

SEQ ID NO: 689987 - RNA, 20 nt, Haemophilus influenzae Rd
auaaacgguauuuucucgau

SEQ ID NO: 689988 - RNA, 22 nt, Haemophilus influenzae Rd
auaaacggcugccgcaucaacu

SEQ ID NO: 689989 - RNA, 15 nt, Haemophilus influenzae Rd
auaaacgcauagaaa

SEQ ID NO: 689990 - RNA, 23 nt, Haemophilus influenzae Rd
auaaacuuuauccccuacaguga

SEQ ID NO: 689991 - RNA, 19 nt, Haemophilus influenzae Rd
agcccauuccauauuggaa

SEQ ID NO: 689992 - RNA, 13 nt, Haemophilus influenzae Rd
agccauuaacauu

SEQ ID NO: 689993 - RNA, 15 nt, Haemophilus influenzae Rd
agcccaagcuuuuuc

SEQ ID NO: 689994 - RNA, 17 nt, Haemophilus influenzae Rd
agcccaaguaauacacc

SEQ ID NO: 689995 - RNA, 22 nt, Haemophilus influenzae Rd
agcccaacuuaaguugggcuua

SEQ ID NO: 689996 - RNA, 15 nt, Haemophilus influenzae Rd
agccccucagauaau

SEQ ID NO: 689997 - RNA, 19 nt, Haemophilus influenzae Rd
agccccucagauaaugaua

SEQ ID NO: 689998 - RNA, 14 nt, Haemophilus influenzae Rd
agcccgaauucuga

SEQ ID NO: 689999 - RNA, 15 nt, Haemophilus influenzae Rd
agcccgaauucugag

SEQ ID NO: 690000 - RNA, 16 nt, Haemophilus influenzae Rd
agcccgaauucugagc

SEQ ID NO: 690001 - RNA, 14 nt, Haemophilus influenzae Rd
agccgccuuuuuca

SEQ ID NO: 690002 - RNA, 18 nt, Haemophilus influenzae Rd
agccgccuuuuucauauu

SEQ ID NO: 690003 - RNA, 15 nt, Haemophilus influenzae Rd
agccgcuggaaacaa

SEQ ID NO: 690004 - RNA, 13 nt, Haemophilus influenzae Rd
agccgcucuuuuu

SEQ ID NO: 690005 - RNA, 15 nt, Haemophilus influenzae Rd
agccgcuauuucacu

SEQ ID NO: 690006 - RNA, 17 nt, Haemophilus influenzae Rd
agccgcaguaaugcaga

SEQ ID NO: 690007 - RNA, 21 nt, Haemophilus influenzae Rd
agccgaacaagccccacaggu

SEQ ID NO: 690008 - RNA, 15 nt, Haemophilus influenzae Rd
agcccuuuguuuuaa

SEQ ID NO: 690009 - RNA, 20 nt, Haemophilus influenzae Rd
agcccuuuuaguuuccccug

SEQ ID NO: 690010 - RNA, 14 nt, Haemophilus influenzae Rd
agcccuuauuuuuu

SEQ ID NO: 690011 - RNA, 20 nt, Haemophilus influenzae Rd
agccugaauggcgaauuuca

SEQ ID NO: 690012 - RNA, 20 nt, Haemophilus influenzae Rd
agccugaaaaagcuaaaaaa

SEQ ID NO: 690013 - RNA, 20 nt, Haemophilus influenzae Rd
agccucugcagggaaaaauu

SEQ ID NO: 690014 - RNA, 17 nt, Haemophilus influenzae Rd
agccugcaaagccuuca

SEQ ID NO: 690015 - RNA, 19 nt, Haemophilus influenzae Rd
agccuaaaccaaauauggu

SEQ ID NO: 690016 - RNA, 14 nt, Haemophilus influenzae Rd
agccuaaauauuua

SEQ ID NO: 690017 - RNA, 22 nt, Haemophilus influenzae Rd
agccuaagauuuuaucuaacuc

SEQ ID NO: 690018 - RNA, 18 nt, Haemophilus influenzae Rd
agccuagugcuaaaauaa

SEQ ID NO: 690019 - RNA, 23 nt, Haemophilus influenzae Rd
agccuagugcuaaaauaaaaccu

SEQ ID NO: 690020 - RNA, 13 nt, Haemophilus influenzae Rd
agccuauuuuuag

SEQ ID NO: 690021 - RNA, 15 nt, Haemophilus influenzae Rd
agccuauuuuuagaa

SEQ ID NO: 690022 - RNA, 19 nt, Haemophilus influenzae Rd
agccuauuuuuagaaaauc

SEQ ID NO: 690023 - RNA, 21 nt, Haemophilus influenzae Rd
agccucaucuaaggucauuaa

SEQ ID NO: 690024 - RNA, 17 nt, Haemophilus influenzae Rd
agccuccacaagcaaca

SEQ ID NO: 690025 - RNA, 20 nt, Haemophilus influenzae Rd
agccguaaguuaaaccaaca

SEQ ID NO: 690026 - RNA, 16 nt, Haemophilus influenzae Rd
agccugcuacagaagc

SEQ ID NO: 690027 - RNA, 13 nt, Haemophilus influenzae Rd
agccugcuacauu

SEQ ID NO: 690028 - RNA, 18 nt, Haemophilus influenzae Rd
agccuguugauguuuuaa

SEQ ID NO: 690029 - RNA, 14 nt, Haemophilus influenzae Rd
agccuguucuucca

SEQ ID NO: 690030 - RNA, 20 nt, Haemophilus influenzae Rd
agccuucaucacaaaucuuc

SEQ ID NO: 690031 - RNA, 12 nt, Haemophilus influenzae Rd
agccuucugcca

SEQ ID NO: 690032 - RNA, 21 nt, Haemophilus influenzae Rd
agccuugacgaauaccccaag

SEQ ID NO: 690033 - RNA, 19 nt, Haemophilus influenzae Rd
agccuucuaaaauaagaau

SEQ ID NO: 690034 - RNA, 18 nt, Haemophilus influenzae Rd
agccuucgcuauuuuucg

SEQ ID NO: 690035 - RNA, 19 nt, Haemophilus influenzae Rd
agccuugauucuacugaaa

SEQ ID NO: 690036 - RNA, 20 nt, Haemophilus influenzae Rd
agccuugauucuacugaaau

SEQ ID NO: 690037 - RNA, 19 nt, Haemophilus influenzae Rd
agccuuguaaaauuggugg

SEQ ID NO: 690038 - RNA, 14 nt, Haemophilus influenzae Rd
agccuuuuaaaaug

SEQ ID NO: 690039 - RNA, 15 nt, Haemophilus influenzae Rd
agccuuuuaaaauga

SEQ ID NO: 690040 - RNA, 20 nt, Haemophilus influenzae Rd
agccuuuaugacuauuuuuu

SEQ ID NO: 690041 - RNA, 12 nt, Haemophilus influenzae Rd
agccuuuucuac

SEQ ID NO: 690042 - RNA, 21 nt, Haemophilus influenzae Rd
agcgaaaucgcacucacaaua

SEQ ID NO: 690043 - RNA, 16 nt, Haemophilus influenzae Rd
agcgaauuaaagugca

SEQ ID NO: 690044 - RNA, 18 nt, Haemophilus influenzae Rd
agcgaauuuaagaaaaaa

SEQ ID NO: 690045 - RNA, 19 nt, Haemophilus influenzae Rd
agcgaauuuaagaaaaaau

SEQ ID NO: 690046 - RNA, 21 nt, Haemophilus influenzae Rd
agcgaacauuuuugguuucau

SEQ ID NO: 690047 - RNA, 14 nt, Haemophilus influenzae Rd
agcgaccaccaaug

SEQ ID NO: 690048 - RNA, 22 nt, Haemophilus influenzae Rd
agcgacuuuguuucuaaaaaug

SEQ ID NO: 690049 - RNA, 20 nt, Haemophilus influenzae Rd
agcugcugcuuuaacaauua

SEQ ID NO: 690050 - RNA, 13 nt, Haemophilus influenzae Rd
agcuggauuaaau

SEQ ID NO: 690051 - RNA, 21 nt, Haemophilus influenzae Rd
agcuggauuaaauaaccaacu

SEQ ID NO: 690052 - RNA, 19 nt, Haemophilus influenzae Rd
agcugauucuucauaaaua

SEQ ID NO: 690053 - RNA, 13 nt, Haemophilus influenzae Rd
agcugauauaaaa

SEQ ID NO: 690054 - RNA, 15 nt, Haemophilus influenzae Rd
agcugauauaaaaau

SEQ ID NO: 690055 - RNA, 15 nt, Haemophilus influenzae Rd
agcucgguaaaaauc

SEQ ID NO: 690056 - RNA, 18 nt, Haemophilus influenzae Rd
agcucguaaagaucauuc

SEQ ID NO: 690057 - RNA, 15 nt, Haemophilus influenzae Rd
agcucguauaauauu

SEQ ID NO: 690058 - RNA, 23 nt, Haemophilus influenzae Rd
agcucguugccauaaaaaauuaa

SEQ ID NO: 690059 - RNA, 12 nt, Haemophilus influenzae Rd
agcucggaaugu

SEQ ID NO: 690060 - RNA, 16 nt, Haemophilus influenzae Rd
agcucgcuauuuugag

SEQ ID NO: 690061 - RNA, 23 nt, Haemophilus influenzae Rd
agcucccagugcugaaauauagc

SEQ ID NO: 690062 - RNA, 19 nt, Haemophilus influenzae Rd
agcgugaauauaagaaauc

SEQ ID NO: 690063 - RNA, 16 nt, Haemophilus influenzae Rd
agcguugaaaauaaau

SEQ ID NO: 690064 - RNA, 13 nt, Haemophilus influenzae Rd
agcguugaguaaa

SEQ ID NO: 690065 - RNA, 15 nt, Haemophilus influenzae Rd
agcguugaguaaaua

SEQ ID NO: 690066 - RNA, 14 nt, Haemophilus influenzae Rd
agcguuugcugccu

SEQ ID NO: 690067 - RNA, 16 nt, Haemophilus influenzae Rd
agcguuuacgugcgau

SEQ ID NO: 690068 - RNA, 20 nt, Haemophilus influenzae Rd
agcuaaaauuaccccaauuc

SEQ ID NO: 690069 - RNA, 17 nt, Haemophilus influenzae Rd
agcuacauucaucaaaa

SEQ ID NO: 690070 - RNA, 21 nt, Haemophilus influenzae Rd
agcuaccaauauucuuuaaaa

SEQ ID NO: 690071 - RNA, 14 nt, Haemophilus influenzae Rd
agcuaaaaauaauu

SEQ ID NO: 690072 - RNA, 13 nt, Haemophilus influenzae Rd
agcuaaagaaagc

SEQ ID NO: 690073 - RNA, 12 nt, Haemophilus influenzae Rd
agcuaguccugc

SEQ ID NO: 690074 - RNA, 21 nt, Haemophilus influenzae Rd
agcuaggaaugaucugcaccc

SEQ ID NO: 690075 - RNA, 16 nt, Haemophilus influenzae Rd
agcuagaggcugaagc

SEQ ID NO: 690076 - RNA, 16 nt, Haemophilus influenzae Rd
agcuagaaagcaaugu

SEQ ID NO: 690077 - RNA, 17 nt, Haemophilus influenzae Rd
agcuacgguuauuuuuu

SEQ ID NO: 690078 - RNA, 20 nt, Haemophilus influenzae Rd
agcguauuuuguucuaauuu

SEQ ID NO: 690079 - RNA, 19 nt, Haemophilus influenzae Rd
agcguaaucacauagauuu

SEQ ID NO: 690080 - RNA, 15 nt, Haemophilus influenzae Rd
agcguaaugcacuuu

SEQ ID NO: 690081 - RNA, 22 nt, Haemophilus influenzae Rd
agcgguuggcuuccagaaaauu

SEQ ID NO: 690082 - RNA, 17 nt, Haemophilus influenzae Rd
agcgguuguaauuguug

SEQ ID NO: 690083 - RNA, 15 nt, Haemophilus influenzae Rd
agcguaaaaaugcug

SEQ ID NO: 690084 - RNA, 16 nt, Haemophilus influenzae Rd
agcguccuacuacagc

SEQ ID NO: 690085 - RNA, 19 nt, Haemophilus influenzae Rd
agcgcuguuacuucuuuca

SEQ ID NO: 690086 - RNA, 15 nt, Haemophilus influenzae Rd
agcggauaaccaaaa

SEQ ID NO: 690087 - RNA, 22 nt, Haemophilus influenzae Rd
agcgcauuauggaauggcauaa

SEQ ID NO: 690088 - RNA, 21 nt, Haemophilus influenzae Rd
agcgaugucuaaaugugccca

SEQ ID NO: 690089 - RNA, 16 nt, Haemophilus influenzae Rd
agcgauccuaaaaaac

SEQ ID NO: 690090 - RNA, 18 nt, Haemophilus influenzae Rd
agcgauccuaaaaaaccc

SEQ ID NO: 690091 - RNA, 22 nt, Haemophilus influenzae Rd
agcgaucugcacgauagcaaug

SEQ ID NO: 690092 - RNA, 13 nt, Haemophilus influenzae Rd
agcgauaaauauu

SEQ ID NO: 690093 - RNA, 18 nt, Haemophilus influenzae Rd
agcgaguaagggcaaaaa

SEQ ID NO: 690094 - RNA, 15 nt, Haemophilus influenzae Rd
agcgauagaaauaaa

SEQ ID NO: 690095 - RNA, 21 nt, Haemophilus influenzae Rd
agcauggauuuuucuucuaga

SEQ ID NO: 690096 - RNA, 15 nt, Haemophilus influenzae Rd
agcaugaauaaaaau

SEQ ID NO: 690097 - RNA, 18 nt, Haemophilus influenzae Rd
agcauuaaauauugagca

SEQ ID NO: 690098 - RNA, 15 nt, Haemophilus influenzae Rd
agcauuaaaaauuua

SEQ ID NO: 690099 - RNA, 11 nt, Haemophilus influenzae Rd
agcauuaaguu

SEQ ID NO: 690100 - RNA, 18 nt, Haemophilus influenzae Rd
agcauuguaagacgcauu

SEQ ID NO: 690101 - RNA, 22 nt, Haemophilus influenzae Rd
agcauuggcuagguaacauaau

SEQ ID NO: 690102 - RNA, 14 nt, Haemophilus influenzae Rd
agcauuuaaauauu

SEQ ID NO: 690103 - RNA, 13 nt, Haemophilus influenzae Rd
agcauuuaccauc

SEQ ID NO: 690104 - RNA, 18 nt, Haemophilus influenzae Rd
agcauuuagucaauuuac

SEQ ID NO: 690105 - RNA, 20 nt, Haemophilus influenzae Rd
agcauuucaagcuuugcaac

SEQ ID NO: 690106 - RNA, 21 nt, Haemophilus influenzae Rd
agcauuucaagcuuugcaaca

SEQ ID NO: 690107 - RNA, 16 nt, Haemophilus influenzae Rd
agccaaauuuaaaaaa

SEQ ID NO: 690108 - RNA, 14 nt, Haemophilus influenzae Rd
agccaaauuuuucu

SEQ ID NO: 690109 - RNA, 23 nt, Haemophilus influenzae Rd
agccaaauuuuucuuuucuucua

SEQ ID NO: 690110 - RNA, 13 nt, Haemophilus influenzae Rd
agccaaauacaau

SEQ ID NO: 690111 - RNA, 20 nt, Haemophilus influenzae Rd
agcauuuuuuauuaaaaaag

SEQ ID NO: 690112 - RNA, 14 nt, Haemophilus influenzae Rd
agccaauaacuucu

SEQ ID NO: 690113 - RNA, 18 nt, Haemophilus influenzae Rd
agccaauaauuucuuguu

SEQ ID NO: 690114 - RNA, 12 nt, Haemophilus influenzae Rd
agccaauaugga

SEQ ID NO: 690115 - RNA, 14 nt, Haemophilus influenzae Rd
agccaaugaacgaa

SEQ ID NO: 690116 - RNA, 18 nt, Haemophilus influenzae Rd
agccaaugcaacuugcau

SEQ ID NO: 690117 - RNA, 17 nt, Haemophilus influenzae Rd
agccaaugccaaaacca

SEQ ID NO: 690118 - RNA, 18 nt, Haemophilus influenzae Rd
agccaagaucaagcacuu

SEQ ID NO: 690119 - RNA, 20 nt, Haemophilus influenzae Rd
agccaacucgaacaugaagu

SEQ ID NO: 690120 - RNA, 23 nt, Haemophilus influenzae Rd
agccaaggcgauuaaucgaagua

SEQ ID NO: 690121 - RNA, 13 nt, Haemophilus influenzae Rd
agccaagugcagc

SEQ ID NO: 690122 - RNA, 22 nt, Haemophilus influenzae Rd
agccaagugcggucagcauaaa

SEQ ID NO: 690123 - RNA, 17 nt, Haemophilus influenzae Rd
agccacauaauaagaaa

SEQ ID NO: 690124 - RNA, 13 nt, Haemophilus influenzae Rd
agccaauuuucuc

SEQ ID NO: 690125 - RNA, 16 nt, Haemophilus influenzae Rd
agccaccgauagucac

SEQ ID NO: 690126 - RNA, 22 nt, Haemophilus influenzae Rd
agccaccgauagucaccaucac

SEQ ID NO: 690127 - RNA, 21 nt, Haemophilus influenzae Rd
agccacuugcuguuaagacca

SEQ ID NO: 690128 - RNA, 15 nt, Haemophilus influenzae Rd
agccacuugugcauc

SEQ ID NO: 690129 - RNA, 13 nt, Haemophilus influenzae Rd
agccauaaauaaa

SEQ ID NO: 690130 - RNA, 18 nt, Haemophilus influenzae Rd
agccauaaauaaaucaau

SEQ ID NO: 690131 - RNA, 14 nt, Haemophilus influenzae Rd
agccauaaaugcua

SEQ ID NO: 690132 - RNA, 21 nt, Haemophilus influenzae Rd
agccaguuggguuaaauauaa

SEQ ID NO: 690133 - RNA, 16 nt, Haemophilus influenzae Rd
agccauccccaaaaca

SEQ ID NO: 690134 - RNA, 20 nt, Haemophilus influenzae Rd
agccauauccguaucauuua

SEQ ID NO: 690135 - RNA, 22 nt, Haemophilus influenzae Rd
agccauagcgaagcguaaaagu

SEQ ID NO: 690136 - RNA, 19 nt, Haemophilus influenzae Rd
agcaggaaaaccacaagau

SEQ ID NO: 690137 - RNA, 12 nt, Haemophilus influenzae Rd
agcaggaagaac

SEQ ID NO: 690138 - RNA, 22 nt, Haemophilus influenzae Rd
agcagggauuuuaaguuucacu

SEQ ID NO: 690139 - RNA, 15 nt, Haemophilus influenzae Rd
agcagggauuuucau

SEQ ID NO: 690140 - RNA, 23 nt, Haemophilus influenzae Rd
agcagguuuuccuacagugacua

SEQ ID NO: 690141 - RNA, 15 nt, Haemophilus influenzae Rd
agcagguuuuucuuu

SEQ ID NO: 690142 - RNA, 21 nt, Haemophilus influenzae Rd
agcagguuuuuuauuucucau

SEQ ID NO: 690143 - RNA, 18 nt, Haemophilus influenzae Rd
agcagcuaauaggcuuaa

SEQ ID NO: 690144 - RNA, 13 nt, Haemophilus influenzae Rd
agcagcuaaaagu

SEQ ID NO: 690145 - RNA, 17 nt, Haemophilus influenzae Rd
agcagcuaacaaaauua

SEQ ID NO: 690146 - RNA, 16 nt, Haemophilus influenzae Rd
agcaucggcuaaauaa

SEQ ID NO: 690147 - RNA, 17 nt, Haemophilus influenzae Rd
agcaucuagcuuaacaa

SEQ ID NO: 690148 - RNA, 12 nt, Haemophilus influenzae Rd
agcaucugccac

SEQ ID NO: 690149 - RNA, 17 nt, Haemophilus influenzae Rd
agcaucugccacuucuu

SEQ ID NO: 690150 - RNA, 14 nt, Haemophilus influenzae Rd
agcauauugaaauu

SEQ ID NO: 690151 - RNA, 15 nt, Haemophilus influenzae Rd
agcaucaaaauaaau

SEQ ID NO: 690152 - RNA, 16 nt, Haemophilus influenzae Rd
agcaucaacauaaaua

SEQ ID NO: 690153 - RNA, 20 nt, Haemophilus influenzae Rd
agcagugccaaccacccaaa

SEQ ID NO: 690154 - RNA, 13 nt, Haemophilus influenzae Rd
agcauaauguuug

SEQ ID NO: 690155 - RNA, 18 nt, Haemophilus influenzae Rd
agcaguugcuaaaucacc

SEQ ID NO: 690156 - RNA, 21 nt, Haemophilus influenzae Rd
agcaguuuggcaagucuuaau

SEQ ID NO: 690157 - RNA, 12 nt, Haemophilus influenzae Rd
agcauaaaacag

SEQ ID NO: 690158 - RNA, 16 nt, Haemophilus influenzae Rd
agcauaaacuaaaaua

SEQ ID NO: 690159 - RNA, 20 nt, Haemophilus influenzae Rd
agcauaaacuaaaauaucug

SEQ ID NO: 690160 - RNA, 19 nt, Haemophilus influenzae Rd
agcauaacguauuuucuca

SEQ ID NO: 690161 - RNA, 13 nt, Haemophilus influenzae Rd
agcauaaggacca

SEQ ID NO: 690162 - RNA, 20 nt, Haemophilus influenzae Rd
agcauaaggaccaagcaaug

SEQ ID NO: 690163 - RNA, 15 nt, Haemophilus influenzae Rd
agcauaauaaaaaaa

SEQ ID NO: 690164 - RNA, 16 nt, Haemophilus influenzae Rd
agcaccuaaaaauuuu

SEQ ID NO: 690165 - RNA, 16 nt, Haemophilus influenzae Rd
agcacccauuugccaa

SEQ ID NO: 690166 - RNA, 21 nt, Haemophilus influenzae Rd
agcaccaaaauuuguuaagug

SEQ ID NO: 690167 - RNA, 16 nt, Haemophilus influenzae Rd
agcaccaaauaucgca

SEQ ID NO: 690168 - RNA, 15 nt, Haemophilus influenzae Rd
agcaccaaauuaaaa

SEQ ID NO: 690169 - RNA, 16 nt, Haemophilus influenzae Rd
agcaccaaauuaaaaa

SEQ ID NO: 690170 - RNA, 21 nt, Haemophilus influenzae Rd
agcaccacguucauaaacucu

SEQ ID NO: 690171 - RNA, 18 nt, Haemophilus influenzae Rd
agcacacuaauaagaaua

SEQ ID NO: 690172 - RNA, 18 nt, Haemophilus influenzae Rd
agcacaagauuugccaaa

SEQ ID NO: 690173 - RNA, 14 nt, Haemophilus influenzae Rd
agcacacaagguug

SEQ ID NO: 690174 - RNA, 16 nt, Haemophilus influenzae Rd
agcaauugccgacacu

SEQ ID NO: 690175 - RNA, 20 nt, Haemophilus influenzae Rd
agcaauugccgacacuaaaa

SEQ ID NO: 690176 - RNA, 14 nt, Haemophilus influenzae Rd
agcaauuucacgau

SEQ ID NO: 690177 - RNA, 16 nt, Haemophilus influenzae Rd
agcaauuucaucacau

SEQ ID NO: 690178 - RNA, 16 nt, Haemophilus influenzae Rd
agcaauuuucugcaga

SEQ ID NO: 690179 - RNA, 17 nt, Haemophilus influenzae Rd
agcaauuuucugcagaa

SEQ ID NO: 690180 - RNA, 15 nt, Haemophilus influenzae Rd
agcacaaagaaaaac

SEQ ID NO: 690181 - RNA, 21 nt, Haemophilus influenzae Rd
agcacuaauuuguggaaauug

SEQ ID NO: 690182 - RNA, 15 nt, Haemophilus influenzae Rd
agcacuggugugacu

SEQ ID NO: 690183 - RNA, 20 nt, Haemophilus influenzae Rd
agcacuggcagacaaguuua

SEQ ID NO: 690184 - RNA, 19 nt, Haemophilus influenzae Rd
agcacgaccuugccaaggu

SEQ ID NO: 690185 - RNA, 14 nt, Haemophilus influenzae Rd
agcacgauuuucaa

SEQ ID NO: 690186 - RNA, 22 nt, Haemophilus influenzae Rd
agcacgauuuucaauacaucag

SEQ ID NO: 690187 - RNA, 15 nt, Haemophilus influenzae Rd
agcacgcgaacuuua

SEQ ID NO: 690188 - RNA, 15 nt, Haemophilus influenzae Rd
agcagaacauuguga

SEQ ID NO: 690189 - RNA, 12 nt, Haemophilus influenzae Rd
agcagacauuaa

SEQ ID NO: 690190 - RNA, 23 nt, Haemophilus influenzae Rd
agcagaaaauaacgcaucaccac

SEQ ID NO: 690191 - RNA, 15 nt, Haemophilus influenzae Rd
agcacuuguuuuuag

SEQ ID NO: 690192 - RNA, 14 nt, Haemophilus influenzae Rd
agcacuuaauacga

SEQ ID NO: 690193 - RNA, 20 nt, Haemophilus influenzae Rd
agauaaguggggaaaaauau

SEQ ID NO: 690194 - RNA, 14 nt, Haemophilus influenzae Rd
agauaauaaaaaaa

SEQ ID NO: 690195 - RNA, 15 nt, Haemophilus influenzae Rd
agauaauaaaaaaac

SEQ ID NO: 690196 - RNA, 14 nt, Haemophilus influenzae Rd
agauaauaaaaugg

SEQ ID NO: 690197 - RNA, 12 nt, Haemophilus influenzae Rd
agauaauaaaua

SEQ ID NO: 690198 - RNA, 15 nt, Haemophilus influenzae Rd
agauaauauuccaaa

SEQ ID NO: 690199 - RNA, 17 nt, Haemophilus influenzae Rd
agauaauauuccaaaaa

SEQ ID NO: 690200 - RNA, 19 nt, Haemophilus influenzae Rd
agauaauauuccaaaaaau

SEQ ID NO: 690201 - RNA, 22 nt, Haemophilus influenzae Rd
agauaauauuccaaaaaauaag

SEQ ID NO: 690202 - RNA, 20 nt, Haemophilus influenzae Rd
agauaaucgcaaagaauuug

SEQ ID NO: 690203 - RNA, 19 nt, Haemophilus influenzae Rd
agauaaucuacaaaacaua

SEQ ID NO: 690204 - RNA, 20 nt, Haemophilus influenzae Rd
agauaaucuacaaaacauaa

SEQ ID NO: 690205 - RNA, 23 nt, Haemophilus influenzae Rd
agauaaucuacaaaacauaauaa

SEQ ID NO: 690206 - RNA, 14 nt, Haemophilus influenzae Rd
agauugugaaauuu

SEQ ID NO: 690207 - RNA, 23 nt, Haemophilus influenzae Rd
agauuguuuuuucauauuuuaaa

SEQ ID NO: 690208 - RNA, 12 nt, Haemophilus influenzae Rd
agauuuaaaaca

SEQ ID NO: 690209 - RNA, 21 nt, Haemophilus influenzae Rd
agauaaugguuacagaaauau

SEQ ID NO: 690210 - RNA, 20 nt, Haemophilus influenzae Rd
agauaaucagugauuauauu

SEQ ID NO: 690211 - RNA, 16 nt, Haemophilus influenzae Rd
agauaauuaaaauccc

SEQ ID NO: 690212 - RNA, 17 nt, Haemophilus influenzae Rd
agauuguaugaaaaaug

SEQ ID NO: 690213 - RNA, 22 nt, Haemophilus influenzae Rd
agauuuauuuugguauuuuugu

SEQ ID NO: 690214 - RNA, 22 nt, Haemophilus influenzae Rd
agauuugaaccuucacagauuu

SEQ ID NO: 690215 - RNA, 13 nt, Haemophilus influenzae Rd
agauuugcugcug

SEQ ID NO: 690216 - RNA, 16 nt, Haemophilus influenzae Rd
agauuuuauucauaaa

SEQ ID NO: 690217 - RNA, 15 nt, Haemophilus influenzae Rd
agauuuuauuucgcu

SEQ ID NO: 690218 - RNA, 15 nt, Haemophilus influenzae Rd
agauuuaagcaauaa

SEQ ID NO: 690219 - RNA, 21 nt, Haemophilus influenzae Rd
agauuuaagcaauaaacaaag

SEQ ID NO: 690220 - RNA, 18 nt, Haemophilus influenzae Rd
agauuuaauucugcccuu

SEQ ID NO: 690221 - RNA, 16 nt, Haemophilus influenzae Rd
agauuuacagaacaaa

SEQ ID NO: 690222 - RNA, 15 nt, Haemophilus influenzae Rd
agauuuacccaacaa

SEQ ID NO: 690223 - RNA, 19 nt, Haemophilus influenzae Rd
agauuuccuccccacacuu

SEQ ID NO: 690224 - RNA, 20 nt, Haemophilus influenzae Rd
agauuuccuccccacacuuu

SEQ ID NO: 690225 - RNA, 23 nt, Haemophilus influenzae Rd
agcaaaaaagugcgguaaaaauu

SEQ ID NO: 690226 - RNA, 14 nt, Haemophilus influenzae Rd
agauuuuuugaccg

SEQ ID NO: 690227 - RNA, 14 nt, Haemophilus influenzae Rd
agauuuuuuuauga

SEQ ID NO: 690228 - RNA, 17 nt, Haemophilus influenzae Rd
agauuuuuuuuauaucu

SEQ ID NO: 690229 - RNA, 17 nt, Haemophilus influenzae Rd
agauuuuuuaggacuaa

SEQ ID NO: 690230 - RNA, 22 nt, Haemophilus influenzae Rd
agauuuuuuauuaauaaacugc

SEQ ID NO: 690231 - RNA, 20 nt, Haemophilus influenzae Rd
agauuuuuuauuuauuaaga

SEQ ID NO: 690232 - RNA, 14 nt, Haemophilus influenzae Rd
agauuuuuauucaa

SEQ ID NO: 690233 - RNA, 13 nt, Haemophilus influenzae Rd
agauuuuuaaauc

SEQ ID NO: 690234 - RNA, 18 nt, Haemophilus influenzae Rd
agauuuuuaccaauagau

SEQ ID NO: 690235 - RNA, 17 nt, Haemophilus influenzae Rd
agauuuugcagauagau

SEQ ID NO: 690236 - RNA, 16 nt, Haemophilus influenzae Rd
agauuuucuuauuaua

SEQ ID NO: 690237 - RNA, 18 nt, Haemophilus influenzae Rd
agauuuucuuauuauaca

SEQ ID NO: 690238 - RNA, 20 nt, Haemophilus influenzae Rd
agcaaaaagucaaaauaagu

SEQ ID NO: 690239 - RNA, 14 nt, Haemophilus influenzae Rd
agcaaaacugaaag

SEQ ID NO: 690240 - RNA, 14 nt, Haemophilus influenzae Rd
agcaaaaucauauu

SEQ ID NO: 690241 - RNA, 12 nt, Haemophilus influenzae Rd
agcaaaagaaau

SEQ ID NO: 690242 - RNA, 13 nt, Haemophilus influenzae Rd
agcaaaagaaaua

SEQ ID NO: 690243 - RNA, 20 nt, Haemophilus influenzae Rd
agcaaaagcaagaucuaaaa

SEQ ID NO: 690244 - RNA, 18 nt, Haemophilus influenzae Rd
agcaaaauaugcuugagc

SEQ ID NO: 690245 - RNA, 18 nt, Haemophilus influenzae Rd
agcaaacuuaaauacauu

SEQ ID NO: 690246 - RNA, 16 nt, Haemophilus influenzae Rd
agcaaagaaauuuuaa

SEQ ID NO: 690247 - RNA, 15 nt, Haemophilus influenzae Rd
agcaaacagcaauaa

SEQ ID NO: 690248 - RNA, 18 nt, Haemophilus influenzae Rd
agcaaacagcaauaaaua

SEQ ID NO: 690249 - RNA, 18 nt, Haemophilus influenzae Rd
agcaaacaaguuucuaaa

SEQ ID NO: 690250 - RNA, 19 nt, Haemophilus influenzae Rd
agcaagaccccaagcaaau

SEQ ID NO: 690251 - RNA, 14 nt, Haemophilus influenzae Rd
agcaagaucaauau

SEQ ID NO: 690252 - RNA, 22 nt, Haemophilus influenzae Rd
agcaagaucaauauaaccuugu

SEQ ID NO: 690253 - RNA, 21 nt, Haemophilus influenzae Rd
agcaaggcuugugcgguucau

SEQ ID NO: 690254 - RNA, 22 nt, Haemophilus influenzae Rd
agcaaguacaacugagcccaca

SEQ ID NO: 690255 - RNA, 17 nt, Haemophilus influenzae Rd
agcaauaaccaauaacg

SEQ ID NO: 690256 - RNA, 12 nt, Haemophilus influenzae Rd
agcaauaauauc

SEQ ID NO: 690257 - RNA, 15 nt, Haemophilus influenzae Rd
agcaauaaacaaaga

SEQ ID NO: 690258 - RNA, 15 nt, Haemophilus influenzae Rd
agcaauaaauaauag

SEQ ID NO: 690259 - RNA, 17 nt, Haemophilus influenzae Rd
agcaagggauuuucuua

SEQ ID NO: 690260 - RNA, 14 nt, Haemophilus influenzae Rd
agcaauccaaucag

SEQ ID NO: 690261 - RNA, 20 nt, Haemophilus influenzae Rd
agcaauaucugcuaauacug

SEQ ID NO: 690262 - RNA, 15 nt, Haemophilus influenzae Rd
agcaaucaaaaauga

SEQ ID NO: 690263 - RNA, 14 nt, Haemophilus influenzae Rd
agcaaucaacacac

SEQ ID NO: 690264 - RNA, 18 nt, Haemophilus influenzae Rd
agcaaugccaaucuaaac

SEQ ID NO: 690265 - RNA, 18 nt, Haemophilus influenzae Rd
agcaaugcuuuaaucauu

SEQ ID NO: 690266 - RNA, 23 nt, Haemophilus influenzae Rd
agcaaugcuuuaaucauuuucac

SEQ ID NO: 690267 - RNA, 22 nt, Haemophilus influenzae Rd
agcaaucuugcccaucuugcca

SEQ ID NO: 690268 - RNA, 23 nt, Haemophilus influenzae Rd
agcaaucuuuggcaaaaaauaca

SEQ ID NO: 690269 - RNA, 11 nt, Haemophilus influenzae Rd
agcaauguuuu

SEQ ID NO: 690270 - RNA, 18 nt, Haemophilus influenzae Rd
agcaauggcaauucucug

SEQ ID NO: 690271 - RNA, 17 nt, Haemophilus influenzae Rd
agcaacgacacacuauu

SEQ ID NO: 690272 - RNA, 23 nt, Haemophilus influenzae Rd
agcaacgcaucgcccaauuuggc

SEQ ID NO: 690273 - RNA, 22 nt, Haemophilus influenzae Rd
agcaacgguguggaaagaucca

SEQ ID NO: 690274 - RNA, 15 nt, Haemophilus influenzae Rd
agcaagaacagccag

SEQ ID NO: 690275 - RNA, 20 nt, Haemophilus influenzae Rd
agcaagaacuugauaaucau

SEQ ID NO: 690276 - RNA, 21 nt, Haemophilus influenzae Rd
agcaagaacuugauaaucauu

SEQ ID NO: 690277 - RNA, 22 nt, Haemophilus influenzae Rd
agcaacuugagcguaacccaaa

SEQ ID NO: 690278 - RNA, 22 nt, Haemophilus influenzae Rd
agcaacuuuacgugcaauagau

SEQ ID NO: 690279 - RNA, 23 nt, Haemophilus influenzae Rd
agcaaauuguuugaaaucaaauu

SEQ ID NO: 690280 - RNA, 12 nt, Haemophilus influenzae Rd
agcaaauuaucu

SEQ ID NO: 690281 - RNA, 13 nt, Haemophilus influenzae Rd
agcaaauuaucug

SEQ ID NO: 690282 - RNA, 14 nt, Haemophilus influenzae Rd
agcaacaauauuag

SEQ ID NO: 690283 - RNA, 23 nt, Haemophilus influenzae Rd
agcaacaucauaagguacaacag

SEQ ID NO: 690284 - RNA, 22 nt, Haemophilus influenzae Rd
agaaggaauauucuuuaaauau

SEQ ID NO: 690285 - RNA, 21 nt, Haemophilus influenzae Rd
agaagugcguucauauuugaa

SEQ ID NO: 690286 - RNA, 15 nt, Haemophilus influenzae Rd
agaagugaaauuacu

SEQ ID NO: 690287 - RNA, 21 nt, Haemophilus influenzae Rd
agaaggcuaguucuuccuugg

SEQ ID NO: 690288 - RNA, 15 nt, Haemophilus influenzae Rd
agaagacgauuuuag

SEQ ID NO: 690289 - RNA, 20 nt, Haemophilus influenzae Rd
agaaaugcuuacaggaaagu

SEQ ID NO: 690290 - RNA, 13 nt, Haemophilus influenzae Rd
agaaugaucauuu

SEQ ID NO: 690291 - RNA, 13 nt, Haemophilus influenzae Rd
agaaugcaacaag

SEQ ID NO: 690292 - RNA, 21 nt, Haemophilus influenzae Rd
agaaugacuggcuugugaaau

SEQ ID NO: 690293 - RNA, 14 nt, Haemophilus influenzae Rd
agaaucauuuucac

SEQ ID NO: 690294 - RNA, 16 nt, Haemophilus influenzae Rd
agaauccaaaauuacu

SEQ ID NO: 690295 - RNA, 20 nt, Haemophilus influenzae Rd
agaaucaucuucaucugcau

SEQ ID NO: 690296 - RNA, 22 nt, Haemophilus influenzae Rd
agaaucaucuucaucugcauca

SEQ ID NO: 690297 - RNA, 16 nt, Haemophilus influenzae Rd
agaauauaaauaaaac

SEQ ID NO: 690298 - RNA, 19 nt, Haemophilus influenzae Rd
agaauauaaauaaaacaag

SEQ ID NO: 690299 - RNA, 13 nt, Haemophilus influenzae Rd
agaauaauauuaa

SEQ ID NO: 690300 - RNA, 13 nt, Haemophilus influenzae Rd
agaauaaucagga

SEQ ID NO: 690301 - RNA, 15 nt, Haemophilus influenzae Rd
agaauaacaacaaaa

SEQ ID NO: 690302 - RNA, 23 nt, Haemophilus influenzae Rd
agaauaaccacauauagugaaaa

SEQ ID NO: 690303 - RNA, 14 nt, Haemophilus influenzae Rd
agaauaaagggaag

SEQ ID NO: 690304 - RNA, 12 nt, Haemophilus influenzae Rd
agaauaaagaaa

SEQ ID NO: 690305 - RNA, 12 nt, Haemophilus influenzae Rd
agaauaaauuaa

SEQ ID NO: 690306 - RNA, 12 nt, Haemophilus influenzae Rd
agaauaaaaugu

SEQ ID NO: 690307 - RNA, 14 nt, Haemophilus influenzae Rd
agaauaaaauguaa

SEQ ID NO: 690308 - RNA, 20 nt, Haemophilus influenzae Rd
agaauaaaccaaugagaaaa

SEQ ID NO: 690309 - RNA, 21 nt, Haemophilus influenzae Rd
agaaguuuuccagauuuuacg

SEQ ID NO: 690310 - RNA, 16 nt, Haemophilus influenzae Rd
agaaguuuaagaaaag

SEQ ID NO: 690311 - RNA, 17 nt, Haemophilus influenzae Rd
agaaguuuaagaaaagu

SEQ ID NO: 690312 - RNA, 22 nt, Haemophilus influenzae Rd
agacagcgaguacgaaauacgc

SEQ ID NO: 690313 - RNA, 16 nt, Haemophilus influenzae Rd
agacagcuauuaaaaa

SEQ ID NO: 690314 - RNA, 17 nt, Haemophilus influenzae Rd
agacagcuauuaaaaaa

SEQ ID NO: 690315 - RNA, 13 nt, Haemophilus influenzae Rd
agacaauggcuuu

SEQ ID NO: 690316 - RNA, 16 nt, Haemophilus influenzae Rd
agaauuaguaaagaaa

SEQ ID NO: 690317 - RNA, 17 nt, Haemophilus influenzae Rd
agaauuaguaaagaaau

SEQ ID NO: 690318 - RNA, 20 nt, Haemophilus influenzae Rd
agaauuaguuuuuuauuucu

SEQ ID NO: 690319 - RNA, 18 nt, Haemophilus influenzae Rd
agaauuaccgcacuuuaa

SEQ ID NO: 690320 - RNA, 21 nt, Haemophilus influenzae Rd
agaauuaccgcacuuuaaacu

SEQ ID NO: 690321 - RNA, 16 nt, Haemophilus influenzae Rd
agaauuaccacaagau

SEQ ID NO: 690322 - RNA, 17 nt, Haemophilus influenzae Rd
agaauuuugguuaaacu

SEQ ID NO: 690323 - RNA, 20 nt, Haemophilus influenzae Rd
agaauuuucaucaauuuuga

SEQ ID NO: 690324 - RNA, 13 nt, Haemophilus influenzae Rd
agaauuuuuucuu

SEQ ID NO: 690325 - RNA, 17 nt, Haemophilus influenzae Rd
agacaacaacuuuucua

SEQ ID NO: 690326 - RNA, 18 nt, Haemophilus influenzae Rd
agacaacaacuuuucuaa

SEQ ID NO: 690327 - RNA, 13 nt, Haemophilus influenzae Rd
agacaaauuaaau

SEQ ID NO: 690328 - RNA, 14 nt, Haemophilus influenzae Rd
agacaaauuaaauu

SEQ ID NO: 690329 - RNA, 18 nt, Haemophilus influenzae Rd
agacaaauuuguugcauu

SEQ ID NO: 690330 - RNA, 20 nt, Haemophilus influenzae Rd
agacaaauuuguugcauuuc

SEQ ID NO: 690331 - RNA, 19 nt, Haemophilus influenzae Rd
agaccacaugaauuucuaa

SEQ ID NO: 690332 - RNA, 23 nt, Haemophilus influenzae Rd
agaccgcacuuuaaaagugcggu

SEQ ID NO: 690333 - RNA, 16 nt, Haemophilus influenzae Rd
agacgaagaaacaacc

SEQ ID NO: 690334 - RNA, 22 nt, Haemophilus influenzae Rd
agacugcauugcacgagcaaua

SEQ ID NO: 690335 - RNA, 15 nt, Haemophilus influenzae Rd
agacuuaaccaaaua

SEQ ID NO: 690336 - RNA, 18 nt, Haemophilus influenzae Rd
agacuuaaccaaauaggc

SEQ ID NO: 690337 - RNA, 21 nt, Haemophilus influenzae Rd
agacugaaaaaagugcgauau

SEQ ID NO: 690338 - RNA, 18 nt, Haemophilus influenzae Rd
agacucuguuccacaggu

SEQ ID NO: 690339 - RNA, 17 nt, Haemophilus influenzae Rd
agacucuugcacuuggu

SEQ ID NO: 690340 - RNA, 19 nt, Haemophilus influenzae Rd
agacugaauuuuacaggug

SEQ ID NO: 690341 - RNA, 19 nt, Haemophilus influenzae Rd
agacgcuguuucuuuucau

SEQ ID NO: 690342 - RNA, 22 nt, Haemophilus influenzae Rd
agacgcuguuucuuuucaucuu

SEQ ID NO: 690343 - RNA, 14 nt, Haemophilus influenzae Rd
agacgccuuuaaaa

SEQ ID NO: 690344 - RNA, 17 nt, Haemophilus influenzae Rd
agacgccuuuaaaacgc

SEQ ID NO: 690345 - RNA, 21 nt, Haemophilus influenzae Rd
agagaauagcuauuuuucaau

SEQ ID NO: 690346 - RNA, 17 nt, Haemophilus influenzae Rd
agagaauauuuagauua

SEQ ID NO: 690347 - RNA, 22 nt, Haemophilus influenzae Rd
agagaauauuuagauuacuuuu

SEQ ID NO: 690348 - RNA, 17 nt, Haemophilus influenzae Rd
agagaauuuucaucaau

SEQ ID NO: 690349 - RNA, 23 nt, Haemophilus influenzae Rd
agagaaaacggcgugaguugcau

SEQ ID NO: 690350 - RNA, 17 nt, Haemophilus influenzae Rd
agacuuguaaauaccag

SEQ ID NO: 690351 - RNA, 20 nt, Haemophilus influenzae Rd
agacuuucaagcaagccaca

SEQ ID NO: 690352 - RNA, 14 nt, Haemophilus influenzae Rd
agagccaaauacaa

SEQ ID NO: 690353 - RNA, 15 nt, Haemophilus influenzae Rd
agagccaaauacaau

SEQ ID NO: 690354 - RNA, 15 nt, Haemophilus influenzae Rd
agagaccagcagagg

SEQ ID NO: 690355 - RNA, 22 nt, Haemophilus influenzae Rd
agagaccagcagaggcugaacu

SEQ ID NO: 690356 - RNA, 19 nt, Haemophilus influenzae Rd
agagacucuguuccacagg

SEQ ID NO: 690357 - RNA, 17 nt, Haemophilus influenzae Rd
agagcaggggauugaaa

SEQ ID NO: 690358 - RNA, 22 nt, Haemophilus influenzae Rd
agagcaggggauugaaaauccc

SEQ ID NO: 690359 - RNA, 13 nt, Haemophilus influenzae Rd
agagcgucaaaau

SEQ ID NO: 690360 - RNA, 20 nt, Haemophilus influenzae Rd
agaggcauuauguaauauaa

SEQ ID NO: 690361 - RNA, 21 nt, Haemophilus influenzae Rd
agaggaaucgugucaguaacu

SEQ ID NO: 690362 - RNA, 14 nt, Haemophilus influenzae Rd
agaggaaucuaaua

SEQ ID NO: 690363 - RNA, 11 nt, Haemophilus influenzae Rd
agaggccucua

SEQ ID NO: 690364 - RNA, 13 nt, Haemophilus influenzae Rd
agaguaauccaag

SEQ ID NO: 690365 - RNA, 24 nt, Haemophilus influenzae Rd
agaguacgcccauugaaaauacag

SEQ ID NO: 690366 - RNA, 18 nt, Haemophilus influenzae Rd
agauaaacaaaccuaaac

SEQ ID NO: 690367 - RNA, 12 nt, Haemophilus influenzae Rd
agauaaaaaccu

SEQ ID NO: 690368 - RNA, 13 nt, Haemophilus influenzae Rd
agauaaaaaccua

SEQ ID NO: 690369 - RNA, 12 nt, Haemophilus influenzae Rd
agauaaacgcau

SEQ ID NO: 690370 - RNA, 20 nt, Haemophilus influenzae Rd
agauaaaauaaaacccaguu

SEQ ID NO: 690371 - RNA, 12 nt, Haemophilus influenzae Rd
agauaaauaaag

SEQ ID NO: 690372 - RNA, 16 nt, Haemophilus influenzae Rd
agauaacaaugaaauc

SEQ ID NO: 690373 - RNA, 21 nt, Haemophilus influenzae Rd
agauaacguaaguaaugaaaa

SEQ ID NO: 690374 - RNA, 12 nt, Haemophilus influenzae Rd
agauaagaaaau

SEQ ID NO: 690375 - RNA, 17 nt, Haemophilus influenzae Rd
agauaagcauuuuauca

SEQ ID NO: 690376 - RNA, 23 nt, Haemophilus influenzae Rd
agauaagccauuaacauuuaaca

SEQ ID NO: 690377 - RNA, 18 nt, Haemophilus influenzae Rd
agaaaagacaauaauuca

SEQ ID NO: 690378 - RNA, 22 nt, Haemophilus influenzae Rd
agaaaaccaaaacauaagaaau

SEQ ID NO: 690379 - RNA, 13 nt, Haemophilus influenzae Rd
agaaaacuuauaa

SEQ ID NO: 690380 - RNA, 16 nt, Haemophilus influenzae Rd
agaaaacucgacuuuu

SEQ ID NO: 690381 - RNA, 17 nt, Haemophilus influenzae Rd
agaaaauacaauaucua

SEQ ID NO: 690382 - RNA, 21 nt, Haemophilus influenzae Rd
agaaaauagaagccaaaucau

SEQ ID NO: 690383 - RNA, 14 nt, Haemophilus influenzae Rd
agaaaauaauauaa

SEQ ID NO: 690384 - RNA, 12 nt, Haemophilus influenzae Rd
agaaaacaauaa

SEQ ID NO: 690385 - RNA, 15 nt, Haemophilus influenzae Rd
agaaaaagaaaaccu

SEQ ID NO: 690386 - RNA, 17 nt, Haemophilus influenzae Rd
agaaaaagaaaaccugc

SEQ ID NO: 690387 - RNA, 15 nt, Haemophilus influenzae Rd
acuuuucgauagaac

SEQ ID NO: 690388 - RNA, 17 nt, Haemophilus influenzae Rd
acuuuucgauagaacaa

SEQ ID NO: 690389 - RNA, 18 nt, Haemophilus influenzae Rd
acuuuuccuaaaguuuuu

SEQ ID NO: 690390 - RNA, 15 nt, Haemophilus influenzae Rd
acuuuuaucuauaaa

SEQ ID NO: 690391 - RNA, 19 nt, Haemophilus influenzae Rd
acuuuuaucuauaaaaaga

SEQ ID NO: 690392 - RNA, 21 nt, Haemophilus influenzae Rd
acuuuuaucuauaaaaagaac

SEQ ID NO: 690393 - RNA, 17 nt, Haemophilus influenzae Rd
acuuuuauuauuuaaau

SEQ ID NO: 690394 - RNA, 20 nt, Haemophilus influenzae Rd
acuuuuauugguaaaugucu

SEQ ID NO: 690395 - RNA, 13 nt, Haemophilus influenzae Rd
agaaaaaauauaa

SEQ ID NO: 690396 - RNA, 23 nt, Haemophilus influenzae Rd
agaaaguuucacggauuucggcu

SEQ ID NO: 690397 - RNA, 23 nt, Haemophilus influenzae Rd
agaaauaaaagauaaacaaaccu

SEQ ID NO: 690398 - RNA, 20 nt, Haemophilus influenzae Rd
agaaaguuuaacuuucaaca

SEQ ID NO: 690399 - RNA, 22 nt, Haemophilus influenzae Rd
agaaaguuguacuauuuuauaa

SEQ ID NO: 690400 - RNA, 14 nt, Haemophilus influenzae Rd
agaaauaaauuuau

SEQ ID NO: 690401 - RNA, 23 nt, Haemophilus influenzae Rd
agaaauaacgauaagauuugcuu

SEQ ID NO: 690402 - RNA, 21 nt, Haemophilus influenzae Rd
agaaauaaacgcaucaacuuu

SEQ ID NO: 690403 - RNA, 14 nt, Haemophilus influenzae Rd
agaaaguucuaauu

SEQ ID NO: 690404 - RNA, 22 nt, Haemophilus influenzae Rd
agaaaguuaagccugauagcau

SEQ ID NO: 690405 - RNA, 15 nt, Haemophilus influenzae Rd
agaaaguuaaucaaa

SEQ ID NO: 690406 - RNA, 15 nt, Haemophilus influenzae Rd
agaaacaggacaccg

SEQ ID NO: 690407 - RNA, 17 nt, Haemophilus influenzae Rd
agaaaccagaaauagag

SEQ ID NO: 690408 - RNA, 14 nt, Haemophilus influenzae Rd
agaaacauuuuucc

SEQ ID NO: 690409 - RNA, 16 nt, Haemophilus influenzae Rd
agaaacagaaauaaca

SEQ ID NO: 690410 - RNA, 12 nt, Haemophilus influenzae Rd
agaaacagaagu

SEQ ID NO: 690411 - RNA, 14 nt, Haemophilus influenzae Rd
agaaagaauauaaa

SEQ ID NO: 690412 - RNA, 16 nt, Haemophilus influenzae Rd
agaaagaauauaaaua

SEQ ID NO: 690413 - RNA, 23 nt, Haemophilus influenzae Rd
agaaagaauauaaauaaaacaag

SEQ ID NO: 690414 - RNA, 14 nt, Haemophilus influenzae Rd
agaaauccacaaaa

SEQ ID NO: 690415 - RNA, 13 nt, Haemophilus influenzae Rd
agaaaucccaccu

SEQ ID NO: 690416 - RNA, 22 nt, Haemophilus influenzae Rd
agaaaucucuuucaauuucaaa

SEQ ID NO: 690417 - RNA, 18 nt, Haemophilus influenzae Rd
agaaaucguuugauauac

SEQ ID NO: 690418 - RNA, 18 nt, Haemophilus influenzae Rd
agaaaucacuaaauuuca

SEQ ID NO: 690419 - RNA, 21 nt, Haemophilus influenzae Rd
agaaaucacuaaauuucagcu

SEQ ID NO: 690420 - RNA, 22 nt, Haemophilus influenzae Rd
agaaaucacuaaauuucagcuu

SEQ ID NO: 690421 - RNA, 13 nt, Haemophilus influenzae Rd
agaaaucacaaua

SEQ ID NO: 690422 - RNA, 17 nt, Haemophilus influenzae Rd
agaaaucacaauaaaag

SEQ ID NO: 690423 - RNA, 13 nt, Haemophilus influenzae Rd
agaaaucaucaaa

SEQ ID NO: 690424 - RNA, 18 nt, Haemophilus influenzae Rd
agaaaucaucucuaaccu

SEQ ID NO: 690425 - RNA, 13 nt, Haemophilus influenzae Rd
agaaaucauuuca

SEQ ID NO: 690426 - RNA, 15 nt, Haemophilus influenzae Rd
agaaaucauuucaau

SEQ ID NO: 690427 - RNA, 17 nt, Haemophilus influenzae Rd
agaaauacgagaaagcu

SEQ ID NO: 690428 - RNA, 18 nt, Haemophilus influenzae Rd
agaaauacauuauuaaaa

SEQ ID NO: 690429 - RNA, 18 nt, Haemophilus influenzae Rd
agaaauaccgauaauaug

SEQ ID NO: 690430 - RNA, 22 nt, Haemophilus influenzae Rd
agaaauaccgauaauauguuuu

SEQ ID NO: 690431 - RNA, 12 nt, Haemophilus influenzae Rd
agaaauaauaua

SEQ ID NO: 690432 - RNA, 24 nt, Haemophilus influenzae Rd
agaaauaaucucuuuauagccuau

SEQ ID NO: 690433 - RNA, 19 nt, Haemophilus influenzae Rd
agaaauauaauaaauaugu

SEQ ID NO: 690434 - RNA, 23 nt, Haemophilus influenzae Rd
agaaauauaauaaauauguugaa

SEQ ID NO: 690435 - RNA, 21 nt, Haemophilus influenzae Rd
agaaauauugucuauuugcuu

SEQ ID NO: 690436 - RNA, 13 nt, Haemophilus influenzae Rd
agaaauaucuacu

SEQ ID NO: 690437 - RNA, 16 nt, Haemophilus influenzae Rd
agaaauaucuucaauu

SEQ ID NO: 690438 - RNA, 18 nt, Haemophilus influenzae Rd
agaaauaugauuuagaac

SEQ ID NO: 690439 - RNA, 21 nt, Haemophilus influenzae Rd
acuuuaccgaucgcuuucauu

SEQ ID NO: 690440 - RNA, 23 nt, Haemophilus influenzae Rd
acuuuaccgaucgcuuucauuuc

SEQ ID NO: 690441 - RNA, 23 nt, Haemophilus influenzae Rd
acuuuaauucgcugauuuauuca

SEQ ID NO: 690442 - RNA, 15 nt, Haemophilus influenzae Rd
acuuuaaauuuuccu

SEQ ID NO: 690443 - RNA, 19 nt, Haemophilus influenzae Rd
acuuuaaacuguugccaua

SEQ ID NO: 690444 - RNA, 16 nt, Haemophilus influenzae Rd
acuuuaaagaaauaaa

SEQ ID NO: 690445 - RNA, 23 nt, Haemophilus influenzae Rd
acuuuaaagaauauucuuuucuc

SEQ ID NO: 690446 - RNA, 16 nt, Haemophilus influenzae Rd
acuuuaaauauuuaaa

SEQ ID NO: 690447 - RNA, 17 nt, Haemophilus influenzae Rd
acuuguuuuaaaacuau

SEQ ID NO: 690448 - RNA, 15 nt, Haemophilus influenzae Rd
acuuguuuuccaaac

SEQ ID NO: 690449 - RNA, 18 nt, Haemophilus influenzae Rd
acuuguuuuccaaacauu

SEQ ID NO: 690450 - RNA, 23 nt, Haemophilus influenzae Rd
acuuguuuuccaaacauuuuuau

SEQ ID NO: 690451 - RNA, 14 nt, Haemophilus influenzae Rd
acuuguuggauauc

SEQ ID NO: 690452 - RNA, 16 nt, Haemophilus influenzae Rd
acuuguuggcauugaa

SEQ ID NO: 690453 - RNA, 21 nt, Haemophilus influenzae Rd
acuuguucaggugucaucacu

SEQ ID NO: 690454 - RNA, 16 nt, Haemophilus influenzae Rd
acuugucauuaaaaaa

SEQ ID NO: 690455 - RNA, 13 nt, Haemophilus influenzae Rd
acuuguucaaaaa

SEQ ID NO: 690456 - RNA, 14 nt, Haemophilus influenzae Rd
acuuguucaaaaau

SEQ ID NO: 690457 - RNA, 21 nt, Haemophilus influenzae Rd
acuuucauucguauaaauauu

SEQ ID NO: 690458 - RNA, 23 nt, Haemophilus influenzae Rd
acuuucauuccugccguaaugcu

SEQ ID NO: 690459 - RNA, 15 nt, Haemophilus influenzae Rd
acuuucauaaagaua

SEQ ID NO: 690460 - RNA, 20 nt, Haemophilus influenzae Rd
acuuucaaucgaaaguggcu

SEQ ID NO: 690461 - RNA, 18 nt, Haemophilus influenzae Rd
acuuucaacuguucuucu

SEQ ID NO: 690462 - RNA, 19 nt, Haemophilus influenzae Rd
acuuucaacuguucuucug

SEQ ID NO: 690463 - RNA, 16 nt, Haemophilus influenzae Rd
acuuucacaacuacca

SEQ ID NO: 690464 - RNA, 20 nt, Haemophilus influenzae Rd
acuuuauacuaaaaguacca

SEQ ID NO: 690465 - RNA, 17 nt, Haemophilus influenzae Rd
acuuuauauugacaaag

SEQ ID NO: 690466 - RNA, 21 nt, Haemophilus influenzae Rd
acuuuauccccuacagugacc

SEQ ID NO: 690467 - RNA, 23 nt, Haemophilus influenzae Rd
acuuuaucuagacaaaaccugca

SEQ ID NO: 690468 - RNA, 22 nt, Haemophilus influenzae Rd
acuuuauguccauaacugucaa

SEQ ID NO: 690469 - RNA, 15 nt, Haemophilus influenzae Rd
acuuuauuacuuuua

SEQ ID NO: 690470 - RNA, 15 nt, Haemophilus influenzae Rd
acuuuauuagaaaua

SEQ ID NO: 690471 - RNA, 21 nt, Haemophilus influenzae Rd
acuuuacggauaauuucccua

SEQ ID NO: 690472 - RNA, 21 nt, Haemophilus influenzae Rd
acuuuacguaaaguaaaugcu

SEQ ID NO: 690473 - RNA, 22 nt, Haemophilus influenzae Rd
acuuuagaaauucgauugcauu

SEQ ID NO: 690474 - RNA, 15 nt, Haemophilus influenzae Rd
acuuuauaaaugauu

SEQ ID NO: 690475 - RNA, 17 nt, Haemophilus influenzae Rd
acuuuauaacuugcuug

SEQ ID NO: 690476 - RNA, 17 nt, Haemophilus influenzae Rd
acuuuccaucauugcuc

SEQ ID NO: 690477 - RNA, 20 nt, Haemophilus influenzae Rd
acuuucauccucucgccaaa

SEQ ID NO: 690478 - RNA, 16 nt, Haemophilus influenzae Rd
acuuuccguuuacuac

SEQ ID NO: 690479 - RNA, 19 nt, Haemophilus influenzae Rd
acuuucuaacuuuuaauuc

SEQ ID NO: 690480 - RNA, 21 nt, Haemophilus influenzae Rd
acuuucuacgacauuuuuaac

SEQ ID NO: 690481 - RNA, 16 nt, Haemophilus influenzae Rd
acuuuccuucuaacau

SEQ ID NO: 690482 - RNA, 20 nt, Haemophilus influenzae Rd
acuuucuuguauugccacuu

SEQ ID NO: 690483 - RNA, 21 nt, Haemophilus influenzae Rd
acuuucuuuuuguuuaaaagc

SEQ ID NO: 690484 - RNA, 23 nt, Haemophilus influenzae Rd
acuuucuauuaaaaaaucaucaa

SEQ ID NO: 690485 - RNA, 12 nt, Haemophilus influenzae Rd
acuuucuucuuu

SEQ ID NO: 690486 - RNA, 14 nt, Haemophilus influenzae Rd
acuuucuucuuuua

SEQ ID NO: 690487 - RNA, 13 nt, Haemophilus influenzae Rd
acuuuuagauaaa

SEQ ID NO: 690488 - RNA, 17 nt, Haemophilus influenzae Rd
acuuuuagcuaaaacua

SEQ ID NO: 690489 - RNA, 15 nt, Haemophilus influenzae Rd
acuuuuauaucuaua

SEQ ID NO: 690490 - RNA, 23 nt, Haemophilus influenzae Rd
acuuuuauccacaugauauauuu

SEQ ID NO: 690491 - RNA, 14 nt, Haemophilus influenzae Rd
acuuuuaauuaaua

SEQ ID NO: 690492 - RNA, 17 nt, Haemophilus influenzae Rd
acuuuuaauuaauauua

SEQ ID NO: 690493 - RNA, 14 nt, Haemophilus influenzae Rd
acuuuuaauucauu

SEQ ID NO: 690494 - RNA, 13 nt, Haemophilus influenzae Rd
acuuuuacaucau

SEQ ID NO: 690495 - RNA, 20 nt, Haemophilus influenzae Rd
acuuuuacgacuaauuuuuu

SEQ ID NO: 690496 - RNA, 20 nt, Haemophilus influenzae Rd
acuuuuacgcuuggaaaugu

SEQ ID NO: 690497 - RNA, 23 nt, Haemophilus influenzae Rd
acuuuuacgcuuggaaauguuua

SEQ ID NO: 690498 - RNA, 20 nt, Haemophilus influenzae Rd
acuuuuagaauaaauuaaaa

SEQ ID NO: 690499 - RNA, 23 nt, Haemophilus influenzae Rd
acuuuguuuuugcuuucagauuc

SEQ ID NO: 690500 - RNA, 18 nt, Haemophilus influenzae Rd
acuuugucaauauaaagu

SEQ ID NO: 690501 - RNA, 14 nt, Haemophilus influenzae Rd
acuuugcacuuuaa

SEQ ID NO: 690502 - RNA, 22 nt, Haemophilus influenzae Rd
acuuugcagugcauuaaugccu

SEQ ID NO: 690503 - RNA, 17 nt, Haemophilus influenzae Rd
acuuuggaauauucuuu

SEQ ID NO: 690504 - RNA, 18 nt, Haemophilus influenzae Rd
acuucgggcgaaaccuuu

SEQ ID NO: 690505 - RNA, 19 nt, Haemophilus influenzae Rd
acuuccacaggcuugaguu

SEQ ID NO: 690506 - RNA, 18 nt, Haemophilus influenzae Rd
acuuccaaaguauaaggu

SEQ ID NO: 690507 - RNA, 21 nt, Haemophilus influenzae Rd
acuuccacuucugaauccaau

SEQ ID NO: 690508 - RNA, 18 nt, Haemophilus influenzae Rd
acuuccacuaguucauca

SEQ ID NO: 690509 - RNA, 19 nt, Haemophilus influenzae Rd
acuucuaaaagcuguucug

SEQ ID NO: 690510 - RNA, 19 nt, Haemophilus influenzae Rd
acuucuaaacgaaugaagu

SEQ ID NO: 690511 - RNA, 18 nt, Haemophilus influenzae Rd
acuucuaaaggcuaaaua

SEQ ID NO: 690512 - RNA, 13 nt, Haemophilus influenzae Rd
acuucuaaaacca

SEQ ID NO: 690513 - RNA, 15 nt, Haemophilus influenzae Rd
acuucuaaaaccaau

SEQ ID NO: 690514 - RNA, 22 nt, Haemophilus influenzae Rd
acuucuauguuugcaucaauca

SEQ ID NO: 690515 - RNA, 16 nt, Haemophilus influenzae Rd
acuucuacuucuugug

SEQ ID NO: 690516 - RNA, 21 nt, Haemophilus influenzae Rd
acuucuaugaagaacaagggg

SEQ ID NO: 690517 - RNA, 14 nt, Haemophilus influenzae Rd
acuucuuccacuuu

SEQ ID NO: 690518 - RNA, 23 nt, Haemophilus influenzae Rd
acuucuuacguuuaaauuuauga

SEQ ID NO: 690519 - RNA, 16 nt, Haemophilus influenzae Rd
acuucuuguggagauu

SEQ ID NO: 690520 - RNA, 12 nt, Haemophilus influenzae Rd
acuucugcugca

SEQ ID NO: 690521 - RNA, 18 nt, Haemophilus influenzae Rd
acuucugaauccaaugca

SEQ ID NO: 690522 - RNA, 14 nt, Haemophilus influenzae Rd
acuugccaaacauu

SEQ ID NO: 690523 - RNA, 17 nt, Haemophilus influenzae Rd
acuugccaaacauuacc

SEQ ID NO: 690524 - RNA, 22 nt, Haemophilus influenzae Rd
acuugccacaacugaagcuucu

SEQ ID NO: 690525 - RNA, 15 nt, Haemophilus influenzae Rd
acuugcaucuaaaaa

SEQ ID NO: 690526 - RNA, 20 nt, Haemophilus influenzae Rd
acuugcaucuaaaaauaauu

SEQ ID NO: 690527 - RNA, 14 nt, Haemophilus influenzae Rd
acuugcaccaccaa

SEQ ID NO: 690528 - RNA, 19 nt, Haemophilus influenzae Rd
acuugcaagggauuugaaa

SEQ ID NO: 690529 - RNA, 21 nt, Haemophilus influenzae Rd
acuugcaagggauuugaaaau

SEQ ID NO: 690530 - RNA, 22 nt, Haemophilus influenzae Rd
acuugcaagggauuugaaaauc

SEQ ID NO: 690531 - RNA, 23 nt, Haemophilus influenzae Rd
acuugaucggcuacuauacacau

SEQ ID NO: 690532 - RNA, 22 nt, Haemophilus influenzae Rd
acuugauuugcuuggaauaaau

SEQ ID NO: 690533 - RNA, 16 nt, Haemophilus influenzae Rd
acuugaacgauuuugu

SEQ ID NO: 690534 - RNA, 16 nt, Haemophilus influenzae Rd
acuugaagucuauaaa

SEQ ID NO: 690535 - RNA, 15 nt, Haemophilus influenzae Rd
acuugaauugaagag

SEQ ID NO: 690536 - RNA, 15 nt, Haemophilus influenzae Rd
acuugaucaccuauc

SEQ ID NO: 690537 - RNA, 18 nt, Haemophilus influenzae Rd
acuugaucaccuaucaca

SEQ ID NO: 690538 - RNA, 19 nt, Haemophilus influenzae Rd
acuugauaaucauugaaau

SEQ ID NO: 690539 - RNA, 13 nt, Haemophilus influenzae Rd
acuugagauuuuu

SEQ ID NO: 690540 - RNA, 20 nt, Haemophilus influenzae Rd
acuugaauagcaagaacaau

SEQ ID NO: 690541 - RNA, 21 nt, Haemophilus influenzae Rd
acuugaccagagccaaauaca

SEQ ID NO: 690542 - RNA, 22 nt, Haemophilus influenzae Rd
acuugaccagagccaaauacaa

SEQ ID NO: 690543 - RNA, 20 nt, Haemophilus influenzae Rd
acuugcuauuuucuaauuuu

SEQ ID NO: 690544 - RNA, 16 nt, Haemophilus influenzae Rd
acuugccucuuuccuu

SEQ ID NO: 690545 - RNA, 15 nt, Haemophilus influenzae Rd
acuugcgauaucuuc

SEQ ID NO: 690546 - RNA, 15 nt, Haemophilus influenzae Rd
acuuggaugaaauca

SEQ ID NO: 690547 - RNA, 17 nt, Haemophilus influenzae Rd
acuuggaugaaaucaaa

SEQ ID NO: 690548 - RNA, 19 nt, Haemophilus influenzae Rd
acuuggaauaucaucuaga

SEQ ID NO: 690549 - RNA, 20 nt, Haemophilus influenzae Rd
acuuggacauuguuguuuaa

SEQ ID NO: 690550 - RNA, 16 nt, Haemophilus influenzae Rd
acuugcuuaugcaaag

SEQ ID NO: 690551 - RNA, 14 nt, Haemophilus influenzae Rd
acuugguguaauuu

SEQ ID NO: 690552 - RNA, 17 nt, Haemophilus influenzae Rd
acuuggugaucaccgaa

SEQ ID NO: 690553 - RNA, 17 nt, Haemophilus influenzae Rd
acuuggugcaauaaaau

SEQ ID NO: 690554 - RNA, 14 nt, Haemophilus influenzae Rd
acuugguggauugu

SEQ ID NO: 690555 - RNA, 19 nt, Haemophilus influenzae Rd
acuuguacaguaauuguug

SEQ ID NO: 690556 - RNA, 21 nt, Haemophilus influenzae Rd
acuuggauugcaugaaaugua

SEQ ID NO: 690557 - RNA, 15 nt, Haemophilus influenzae Rd
acuugggcugcauga

SEQ ID NO: 690558 - RNA, 18 nt, Haemophilus influenzae Rd
acuuggggcuaauuuuua

SEQ ID NO: 690559 - RNA, 20 nt, Haemophilus influenzae Rd
acuuggggcuaauuuuuaaa

SEQ ID NO: 690560 - RNA, 19 nt, Haemophilus influenzae Rd
acuuggcguucauaucuuu

SEQ ID NO: 690561 - RNA, 15 nt, Haemophilus influenzae Rd
acuucaaccacuuca

SEQ ID NO: 690562 - RNA, 16 nt, Haemophilus influenzae Rd
acuucaaccacuucaa

SEQ ID NO: 690563 - RNA, 17 nt, Haemophilus influenzae Rd
acuucaaauaccucaau

SEQ ID NO: 690564 - RNA, 18 nt, Haemophilus influenzae Rd
acuucaaauuguacuuuu

SEQ ID NO: 690565 - RNA, 18 nt, Haemophilus influenzae Rd
acuuauuugacuuaaaug

SEQ ID NO: 690566 - RNA, 22 nt, Haemophilus influenzae Rd
acuuauuugacuuaaaugaagu

SEQ ID NO: 690567 - RNA, 10 nt, Haemophilus influenzae Rd
acuucaucca

SEQ ID NO: 690568 - RNA, 15 nt, Haemophilus influenzae Rd
acuucauccauugga

SEQ ID NO: 690569 - RNA, 22 nt, Haemophilus influenzae Rd
acuucaucccauuuuugcgauu

SEQ ID NO: 690570 - RNA, 13 nt, Haemophilus influenzae Rd
acuucaucgaaaa

SEQ ID NO: 690571 - RNA, 13 nt, Haemophilus influenzae Rd
acuucaucaaaac

SEQ ID NO: 690572 - RNA, 17 nt, Haemophilus influenzae Rd
acuucaucaaaaccauc

SEQ ID NO: 690573 - RNA, 16 nt, Haemophilus influenzae Rd
acuucauaaauccaau

SEQ ID NO: 690574 - RNA, 20 nt, Haemophilus influenzae Rd
acuuauuaucuucuaaaaga

SEQ ID NO: 690575 - RNA, 18 nt, Haemophilus influenzae Rd
acuuauucaaacgcccuu

SEQ ID NO: 690576 - RNA, 16 nt, Haemophilus influenzae Rd
acuuaugugcaccuuc

SEQ ID NO: 690577 - RNA, 17 nt, Haemophilus influenzae Rd
acuuaugugcaccuuca

SEQ ID NO: 690578 - RNA, 22 nt, Haemophilus influenzae Rd
acuuaaugcaguaauaaauccu

SEQ ID NO: 690579 - RNA, 18 nt, Haemophilus influenzae Rd
acuuaccaugccauuucc

SEQ ID NO: 690580 - RNA, 19 nt, Haemophilus influenzae Rd
acuuacuacguguucauca

SEQ ID NO: 690581 - RNA, 17 nt, Haemophilus influenzae Rd
acuuacgccagcuaaag

SEQ ID NO: 690582 - RNA, 23 nt, Haemophilus influenzae Rd
acuuacgccagcuaaagaaagca

SEQ ID NO: 690583 - RNA, 12 nt, Haemophilus influenzae Rd
acuguuugaacg

SEQ ID NO: 690584 - RNA, 21 nt, Haemophilus influenzae Rd
acuguugugaaguuuuuuaag

SEQ ID NO: 690585 - RNA, 22 nt, Haemophilus influenzae Rd
acuguugccauaaauuuggaua

SEQ ID NO: 690586 - RNA, 13 nt, Haemophilus influenzae Rd
acuuaauguuaau

SEQ ID NO: 690587 - RNA, 20 nt, Haemophilus influenzae Rd
acuuaauugacguaaaaguu

SEQ ID NO: 690588 - RNA, 18 nt, Haemophilus influenzae Rd
acuuaauuucuuaauuaa

SEQ ID NO: 690589 - RNA, 21 nt, Haemophilus influenzae Rd
acuuaauuuugcuaaacccac

SEQ ID NO: 690590 - RNA, 18 nt, Haemophilus influenzae Rd
acuguuugauaacuuuaa

SEQ ID NO: 690591 - RNA, 17 nt, Haemophilus influenzae Rd
acugugcggucuguugc

SEQ ID NO: 690592 - RNA, 18 nt, Haemophilus influenzae Rd
acugugcauuaaaucaaa

SEQ ID NO: 690593 - RNA, 23 nt, Haemophilus influenzae Rd
acugugcauuaaaucaaauuuag

SEQ ID NO: 690594 - RNA, 22 nt, Haemophilus influenzae Rd
acugugagauugccuaaaucau

SEQ ID NO: 690595 - RNA, 19 nt, Haemophilus influenzae Rd
acugucaccucguaaaaua

SEQ ID NO: 690596 - RNA, 20 nt, Haemophilus influenzae Rd
acuguaucuuuuuguaauuu

SEQ ID NO: 690597 - RNA, 19 nt, Haemophilus influenzae Rd
acuguauauuguuugcuuu

SEQ ID NO: 690598 - RNA, 13 nt, Haemophilus influenzae Rd
acgcacaccaccu

SEQ ID NO: 690599 - RNA, 18 nt, Haemophilus influenzae Rd
acgcacuugauuugcuug

SEQ ID NO: 690600 - RNA, 18 nt, Haemophilus influenzae Rd
acgcauagaaauucacgc

SEQ ID NO: 690601 - RNA, 21 nt, Haemophilus influenzae Rd
acgcaucaccacaaaauaaau

SEQ ID NO: 690602 - RNA, 16 nt, Haemophilus influenzae Rd
acgcaucgcccaauuu

SEQ ID NO: 690603 - RNA, 17 nt, Haemophilus influenzae Rd
acgcauuuaaauaaaau

SEQ ID NO: 690604 - RNA, 18 nt, Haemophilus influenzae Rd
acgccaacgcuuaaugaa

SEQ ID NO: 690605 - RNA, 21 nt, Haemophilus influenzae Rd
acgccagucacuucuucaaua

SEQ ID NO: 690606 - RNA, 14 nt, Haemophilus influenzae Rd
acgccaucaaccau

SEQ ID NO: 690607 - RNA, 21 nt, Haemophilus influenzae Rd
acgccauuuucgguuaaguaa

SEQ ID NO: 690608 - RNA, 15 nt, Haemophilus influenzae Rd
acgccauuaccacug

SEQ ID NO: 690609 - RNA, 16 nt, Haemophilus influenzae Rd
acgccauuaccacugc

SEQ ID NO: 690610 - RNA, 17 nt, Haemophilus influenzae Rd
acgccauuaccacugca

SEQ ID NO: 690611 - RNA, 15 nt, Haemophilus influenzae Rd
acgccaucuuuaaag

SEQ ID NO: 690612 - RNA, 20 nt, Haemophilus influenzae Rd
acgcccuacaaugcucacuu

SEQ ID NO: 690613 - RNA, 21 nt, Haemophilus influenzae Rd
acgcccucgccuugcaaauuu

SEQ ID NO: 690614 - RNA, 17 nt, Haemophilus influenzae Rd
acgccccuacuuuaaag

SEQ ID NO: 690615 - RNA, 17 nt, Haemophilus influenzae Rd
acgccgccgauuccuac

SEQ ID NO: 690616 - RNA, 16 nt, Haemophilus influenzae Rd
acgccuucgaaugcuu

SEQ ID NO: 690617 - RNA, 11 nt, Haemophilus influenzae Rd
acgccuuggau

SEQ ID NO: 690618 - RNA, 19 nt, Haemophilus influenzae Rd
acgccuuuaaaacgcgcau

SEQ ID NO: 690619 - RNA, 17 nt, Haemophilus influenzae Rd
acgccugcccaaguugu

SEQ ID NO: 690620 - RNA, 15 nt, Haemophilus influenzae Rd
acgccugcgaugccg

SEQ ID NO: 690621 - RNA, 18 nt, Haemophilus influenzae Rd
acgccugcgaugccgaau

SEQ ID NO: 690622 - RNA, 12 nt, Haemophilus influenzae Rd
acgccugcugca

SEQ ID NO: 690623 - RNA, 15 nt, Haemophilus influenzae Rd
acgccuaauucaucu

SEQ ID NO: 690624 - RNA, 16 nt, Haemophilus influenzae Rd
acgccuaauucaucuu

SEQ ID NO: 690625 - RNA, 17 nt, Haemophilus influenzae Rd
acgccuaauucaucuuc

SEQ ID NO: 690626 - RNA, 20 nt, Haemophilus influenzae Rd
acgccuaaacacauaauauu

SEQ ID NO: 690627 - RNA, 20 nt, Haemophilus influenzae Rd
acgccguuagauacuuuacg

SEQ ID NO: 690628 - RNA, 15 nt, Haemophilus influenzae Rd
acggcguagaaugca

SEQ ID NO: 690629 - RNA, 12 nt, Haemophilus influenzae Rd
acggcuaaaucg

SEQ ID NO: 690630 - RNA, 18 nt, Haemophilus influenzae Rd
acggcuucagaaaauaaa

SEQ ID NO: 690631 - RNA, 24 nt, Haemophilus influenzae Rd
acgcuucuuuaacuugcucugguu

SEQ ID NO: 690632 - RNA, 15 nt, Haemophilus influenzae Rd
acgcuuggaaauguu

SEQ ID NO: 690633 - RNA, 21 nt, Haemophilus influenzae Rd
acgcugacguacaauuucaaa

SEQ ID NO: 690634 - RNA, 21 nt, Haemophilus influenzae Rd
acgcucaacauaaguaagggu

SEQ ID NO: 690635 - RNA, 22 nt, Haemophilus influenzae Rd
acgcucaaucucuuuacuguuc

SEQ ID NO: 690636 - RNA, 18 nt, Haemophilus influenzae Rd
acgcuacccguauuaaau

SEQ ID NO: 690637 - RNA, 22 nt, Haemophilus influenzae Rd
acgcuaaggcaaaaaaaucaua

SEQ ID NO: 690638 - RNA, 17 nt, Haemophilus influenzae Rd
acgcucguuaaaucacg

SEQ ID NO: 690639 - RNA, 21 nt, Haemophilus influenzae Rd
acgcucgaggguuaagauuau

SEQ ID NO: 690640 - RNA, 23 nt, Haemophilus influenzae Rd
acgcggucagaaauauguuuuac

SEQ ID NO: 690641 - RNA, 23 nt, Haemophilus influenzae Rd
acgcgcaauuucagcacccacau

SEQ ID NO: 690642 - RNA, 14 nt, Haemophilus influenzae Rd
acgugauuuaccaa

SEQ ID NO: 690643 - RNA, 17 nt, Haemophilus influenzae Rd
acgugcaaaguuauaaa

SEQ ID NO: 690644 - RNA, 14 nt, Haemophilus influenzae Rd
acgugcaaauaaau

SEQ ID NO: 690645 - RNA, 20 nt, Haemophilus influenzae Rd
acgugcaauuaauucuuuug

SEQ ID NO: 690646 - RNA, 18 nt, Haemophilus influenzae Rd
acgucuuuuggcguuaaa

SEQ ID NO: 690647 - RNA, 20 nt, Haemophilus influenzae Rd
acgugaaccaacccaauuua

SEQ ID NO: 690648 - RNA, 16 nt, Haemophilus influenzae Rd
acguggcgucaagccu

SEQ ID NO: 690649 - RNA, 13 nt, Haemophilus influenzae Rd
acguuaaaucacu

SEQ ID NO: 690650 - RNA, 13 nt, Haemophilus influenzae Rd
acguuaaauuuag

SEQ ID NO: 690651 - RNA, 14 nt, Haemophilus influenzae Rd
acguguuguggcau

SEQ ID NO: 690652 - RNA, 18 nt, Haemophilus influenzae Rd
acguucacguaaguagua

SEQ ID NO: 690653 - RNA, 16 nt, Haemophilus influenzae Rd
acguucagcuuuacuc

SEQ ID NO: 690654 - RNA, 15 nt, Haemophilus influenzae Rd
acgucaauugcuaaa

SEQ ID NO: 690655 - RNA, 17 nt, Haemophilus influenzae Rd
acguauguauuuucaac

SEQ ID NO: 690656 - RNA, 22 nt, Haemophilus influenzae Rd
acgucauaguauggcucuaaau

SEQ ID NO: 690657 - RNA, 16 nt, Haemophilus influenzae Rd
acguaguuaaaccaaa

SEQ ID NO: 690658 - RNA, 17 nt, Haemophilus influenzae Rd
acguaguaaauuuucca

SEQ ID NO: 690659 - RNA, 12 nt, Haemophilus influenzae Rd
acguacuuuuaa

SEQ ID NO: 690660 - RNA, 13 nt, Haemophilus influenzae Rd
acgggaaauccag

SEQ ID NO: 690661 - RNA, 12 nt, Haemophilus influenzae Rd
acuaacuuuccu

SEQ ID NO: 690662 - RNA, 15 nt, Haemophilus influenzae Rd
acuaacguuucuaau

SEQ ID NO: 690663 - RNA, 14 nt, Haemophilus influenzae Rd
acuaacucaaaaua

SEQ ID NO: 690664 - RNA, 22 nt, Haemophilus influenzae Rd
acuaaggccgcucuuuggaaug

SEQ ID NO: 690665 - RNA, 17 nt, Haemophilus influenzae Rd
acuaaggugcagauuuu

SEQ ID NO: 690666 - RNA, 19 nt, Haemophilus influenzae Rd
acuaaggugcagauuuuuu

SEQ ID NO: 690667 - RNA, 18 nt, Haemophilus influenzae Rd
acuaauacuucauaguga

SEQ ID NO: 690668 - RNA, 12 nt, Haemophilus influenzae Rd
acuaauaaaagc

SEQ ID NO: 690669 - RNA, 14 nt, Haemophilus influenzae Rd
acuaauaaaccaau

SEQ ID NO: 690670 - RNA, 15 nt, Haemophilus influenzae Rd
acuaauaaaccaaua

SEQ ID NO: 690671 - RNA, 17 nt, Haemophilus influenzae Rd
acuaauaaauagaaauu

SEQ ID NO: 690672 - RNA, 16 nt, Haemophilus influenzae Rd
acuaauaggaguaaaa

SEQ ID NO: 690673 - RNA, 20 nt, Haemophilus influenzae Rd
acuaauaggaguaaaaauau

SEQ ID NO: 690674 - RNA, 16 nt, Haemophilus influenzae Rd
acuaauaccgcagcag

SEQ ID NO: 690675 - RNA, 21 nt, Haemophilus influenzae Rd
acuaacccaccuaacagggca

SEQ ID NO: 690676 - RNA, 20 nt, Haemophilus influenzae Rd
acuaaccgcacuuuuucuug

SEQ ID NO: 690677 - RNA, 20 nt, Haemophilus influenzae Rd
acuaaauuuaguugguaaag

SEQ ID NO: 690678 - RNA, 19 nt, Haemophilus influenzae Rd
acuaacacacgaucaccaa

SEQ ID NO: 690679 - RNA, 22 nt, Haemophilus influenzae Rd
acuaaaucaugaauaauuuugu

SEQ ID NO: 690680 - RNA, 20 nt, Haemophilus influenzae Rd
acuaaaucuugcuuuugguu

SEQ ID NO: 690681 - RNA, 14 nt, Haemophilus influenzae Rd
acuaaaugaaguuc

SEQ ID NO: 690682 - RNA, 17 nt, Haemophilus influenzae Rd
acuaaaugaaguucacu

SEQ ID NO: 690683 - RNA, 21 nt, Haemophilus influenzae Rd
acuaaaugugacauuguaaag

SEQ ID NO: 690684 - RNA, 23 nt, Haemophilus influenzae Rd
acuaaaugcuguagaaauuaaua

SEQ ID NO: 690685 - RNA, 22 nt, Haemophilus influenzae Rd
acuaaauuagcucuaguccuaa

SEQ ID NO: 690686 - RNA, 22 nt, Haemophilus influenzae Rd
acuaaauucaguaagaaaccaa

SEQ ID NO: 690687 - RNA, 18 nt, Haemophilus influenzae Rd
acguucuaaacuuacuac

SEQ ID NO: 690688 - RNA, 17 nt, Haemophilus influenzae Rd
acguucuuggaaaucuu

SEQ ID NO: 690689 - RNA, 23 nt, Haemophilus influenzae Rd
acuagauuuucuucaucauacaa

SEQ ID NO: 690690 - RNA, 18 nt, Haemophilus influenzae Rd
acuacuaacguuucuaau

SEQ ID NO: 690691 - RNA, 23 nt, Haemophilus influenzae Rd
acuacuaacguuucuaauaccaa

SEQ ID NO: 690692 - RNA, 20 nt, Haemophilus influenzae Rd
acuaaucuaaacuuguuaaa

SEQ ID NO: 690693 - RNA, 14 nt, Haemophilus influenzae Rd
acuaauuugcacac

SEQ ID NO: 690694 - RNA, 19 nt, Haemophilus influenzae Rd
acuaauuugcacacuuaaa

SEQ ID NO: 690695 - RNA, 20 nt, Haemophilus influenzae Rd
acuaauuugcacacuuaaac

SEQ ID NO: 690696 - RNA, 15 nt, Haemophilus influenzae Rd
acuaauuugcuuuuu

SEQ ID NO: 690697 - RNA, 13 nt, Haemophilus influenzae Rd
acuacaaacaaau

SEQ ID NO: 690698 - RNA, 18 nt, Haemophilus influenzae Rd
acuacaaacaaauuuuua

SEQ ID NO: 690699 - RNA, 19 nt, Haemophilus influenzae Rd
acuacaaacaaauuuuuac

SEQ ID NO: 690700 - RNA, 18 nt, Haemophilus influenzae Rd
acuacaacuucaucaaug

SEQ ID NO: 690701 - RNA, 17 nt, Haemophilus influenzae Rd
acuacacagcaaggcuu

SEQ ID NO: 690702 - RNA, 16 nt, Haemophilus influenzae Rd
acuauaauuagaucau

SEQ ID NO: 690703 - RNA, 16 nt, Haemophilus influenzae Rd
acuagugaaauauuua

SEQ ID NO: 690704 - RNA, 13 nt, Haemophilus influenzae Rd
acuauacacauca

SEQ ID NO: 690705 - RNA, 22 nt, Haemophilus influenzae Rd
acuauaugauauauaaaacccc

SEQ ID NO: 690706 - RNA, 23 nt, Haemophilus influenzae Rd
acuauaggaauaucauuagcaua

SEQ ID NO: 690707 - RNA, 17 nt, Haemophilus influenzae Rd
acuauauccaaaucaaa

SEQ ID NO: 690708 - RNA, 21 nt, Haemophilus influenzae Rd
acuauauccaaaucaaaaagc

SEQ ID NO: 690709 - RNA, 22 nt, Haemophilus influenzae Rd
acuauauccaaaucaaaaagcu

SEQ ID NO: 690710 - RNA, 17 nt, Haemophilus influenzae Rd
acuauauacauuaacaa

SEQ ID NO: 690711 - RNA, 14 nt, Haemophilus influenzae Rd
acuagccaaucaua

SEQ ID NO: 690712 - RNA, 14 nt, Haemophilus influenzae Rd
acuagccauaaaua

SEQ ID NO: 690713 - RNA, 13 nt, Haemophilus influenzae Rd
acucaucauauaa

SEQ ID NO: 690714 - RNA, 17 nt, Haemophilus influenzae Rd
acucauucgucaauguu

SEQ ID NO: 690715 - RNA, 21 nt, Haemophilus influenzae Rd
acuccaaaaguuggauuaaac

SEQ ID NO: 690716 - RNA, 16 nt, Haemophilus influenzae Rd
acucaugaguuguuuu

SEQ ID NO: 690717 - RNA, 16 nt, Haemophilus influenzae Rd
acuccacuauaaaaua

SEQ ID NO: 690718 - RNA, 17 nt, Haemophilus influenzae Rd
acucacuauaacuuuuc

SEQ ID NO: 690719 - RNA, 21 nt, Haemophilus influenzae Rd
acucacucguggaauuucaua

SEQ ID NO: 690720 - RNA, 14 nt, Haemophilus influenzae Rd
acucacggcaauaa

SEQ ID NO: 690721 - RNA, 15 nt, Haemophilus influenzae Rd
acucacggcaauaau

SEQ ID NO: 690722 - RNA, 17 nt, Haemophilus influenzae Rd
acucacuggcucaagua

SEQ ID NO: 690723 - RNA, 13 nt, Haemophilus influenzae Rd
acucagaauauaa

SEQ ID NO: 690724 - RNA, 16 nt, Haemophilus influenzae Rd
acucaccgcaauaaua

SEQ ID NO: 690725 - RNA, 16 nt, Haemophilus influenzae Rd
acucaccauuuugccc

SEQ ID NO: 690726 - RNA, 21 nt, Haemophilus influenzae Rd
acucaccauuuugcccaauuc

SEQ ID NO: 690727 - RNA, 13 nt, Haemophilus influenzae Rd
acucacauugcca

SEQ ID NO: 690728 - RNA, 16 nt, Haemophilus influenzae Rd
acucacauugccauuu

SEQ ID NO: 690729 - RNA, 16 nt, Haemophilus influenzae Rd
acuaugaaaucaagga

SEQ ID NO: 690730 - RNA, 20 nt, Haemophilus influenzae Rd
acucacaagucuguaauuuu

SEQ ID NO: 690731 - RNA, 16 nt, Haemophilus influenzae Rd
acucacaauaccaagu

SEQ ID NO: 690732 - RNA, 17 nt, Haemophilus influenzae Rd
acucacaauaccaagug

SEQ ID NO: 690733 - RNA, 19 nt, Haemophilus influenzae Rd
acucacaauugauguaaaa

SEQ ID NO: 690734 - RNA, 14 nt, Haemophilus influenzae Rd
acucacaacaaaga

SEQ ID NO: 690735 - RNA, 19 nt, Haemophilus influenzae Rd
acuaugcagaaucagaaua

SEQ ID NO: 690736 - RNA, 16 nt, Haemophilus influenzae Rd
acucguagaguuuuuu

SEQ ID NO: 690737 - RNA, 19 nt, Haemophilus influenzae Rd
acucgguuuauuuucagcc

SEQ ID NO: 690738 - RNA, 19 nt, Haemophilus influenzae Rd
acucguccaaauucauuuu

SEQ ID NO: 690739 - RNA, 16 nt, Haemophilus influenzae Rd
acucguccaucaaaaa

SEQ ID NO: 690740 - RNA, 15 nt, Haemophilus influenzae Rd
acucguuuacuauuu

SEQ ID NO: 690741 - RNA, 12 nt, Haemophilus influenzae Rd
acucucagaauu

SEQ ID NO: 690742 - RNA, 15 nt, Haemophilus influenzae Rd
acucgcaucaauauc

SEQ ID NO: 690743 - RNA, 22 nt, Haemophilus influenzae Rd
acugaauuggacggcaaaaaua

SEQ ID NO: 690744 - RNA, 12 nt, Haemophilus influenzae Rd
acugaauuucau

SEQ ID NO: 690745 - RNA, 19 nt, Haemophilus influenzae Rd
acugacaucaagcacauca

SEQ ID NO: 690746 - RNA, 21 nt, Haemophilus influenzae Rd
acugacaucaagcacaucaua

SEQ ID NO: 690747 - RNA, 17 nt, Haemophilus influenzae Rd
acugaagcaaucgcauu

SEQ ID NO: 690748 - RNA, 22 nt, Haemophilus influenzae Rd
acugaaguauaagccgcaccaa

SEQ ID NO: 690749 - RNA, 13 nt, Haemophilus influenzae Rd
acugaauaaaaaa

SEQ ID NO: 690750 - RNA, 18 nt, Haemophilus influenzae Rd
acugaagcuucuucaccu

SEQ ID NO: 690751 - RNA, 14 nt, Haemophilus influenzae Rd
acugaaccagccau

SEQ ID NO: 690752 - RNA, 16 nt, Haemophilus influenzae Rd
acucuccccuuguucu

SEQ ID NO: 690753 - RNA, 20 nt, Haemophilus influenzae Rd
acucuuccauuuuuauuccu

SEQ ID NO: 690754 - RNA, 15 nt, Haemophilus influenzae Rd
acucuugauaaccuu

SEQ ID NO: 690755 - RNA, 14 nt, Haemophilus influenzae Rd
acucuuugaaguuc

SEQ ID NO: 690756 - RNA, 22 nt, Haemophilus influenzae Rd
acucuuggcuaacuucuuccac

SEQ ID NO: 690757 - RNA, 14 nt, Haemophilus influenzae Rd
aauuauaauauuua

SEQ ID NO: 690758 - RNA, 16 nt, Haemophilus influenzae Rd
aauuaguaaagaaaua

SEQ ID NO: 690759 - RNA, 20 nt, Haemophilus influenzae Rd
aauuauagaaaagacaauaa

SEQ ID NO: 690760 - RNA, 23 nt, Haemophilus influenzae Rd
aauuauagaaaagacaauaauuc

SEQ ID NO: 690761 - RNA, 23 nt, Haemophilus influenzae Rd
aauuucauaguuuucugauuuaa

SEQ ID NO: 690762 - RNA, 16 nt, Haemophilus influenzae Rd
aauuaguuugauuaca

SEQ ID NO: 690763 - RNA, 21 nt, Haemophilus influenzae Rd
aauuaguuugauuacaguaca

SEQ ID NO: 690764 - RNA, 21 nt, Haemophilus influenzae Rd
aauuaguuggacuacauaacc

SEQ ID NO: 690765 - RNA, 17 nt, Haemophilus influenzae Rd
aauuaguuuuuuauuuc

SEQ ID NO: 690766 - RNA, 18 nt, Haemophilus influenzae Rd
aauuuccgcuuccugcug

SEQ ID NO: 690767 - RNA, 21 nt, Haemophilus influenzae Rd
aauuuccgugagcaaccacua

SEQ ID NO: 690768 - RNA, 14 nt, Haemophilus influenzae Rd
aauuuccuauacua

SEQ ID NO: 690769 - RNA, 13 nt, Haemophilus influenzae Rd
aauuucaucuguu

SEQ ID NO: 690770 - RNA, 19 nt, Haemophilus influenzae Rd
aauuucaucgcgcaaaaua

SEQ ID NO: 690771 - RNA, 22 nt, Haemophilus influenzae Rd
aauuucaucgcgcaaaauaaua

SEQ ID NO: 690772 - RNA, 19 nt, Haemophilus influenzae Rd
aauuucaucgcguuuuuuc

SEQ ID NO: 690773 - RNA, 17 nt, Haemophilus influenzae Rd
aauuucauuguuaaaua

SEQ ID NO: 690774 - RNA, 17 nt, Haemophilus influenzae Rd
aauuucgacauauucua

SEQ ID NO: 690775 - RNA, 19 nt, Haemophilus influenzae Rd
aauuucgcauaauauaaau

SEQ ID NO: 690776 - RNA, 13 nt, Haemophilus influenzae Rd
aauuucgccagaa

SEQ ID NO: 690777 - RNA, 20 nt, Haemophilus influenzae Rd
aauuucgccagaacuuuuua

SEQ ID NO: 690778 - RNA, 19 nt, Haemophilus influenzae Rd
aauuucgccauuuuuuccu

SEQ ID NO: 690779 - RNA, 22 nt, Haemophilus influenzae Rd
aauuucgccauuuuuuccuaug

SEQ ID NO: 690780 - RNA, 15 nt, Haemophilus influenzae Rd
aauuucgucaaaaau

SEQ ID NO: 690781 - RNA, 16 nt, Haemophilus influenzae Rd
aauuucgucaaaaaug

SEQ ID NO: 690782 - RNA, 15 nt, Haemophilus influenzae Rd
aauuucuaauuuuug

SEQ ID NO: 690783 - RNA, 19 nt, Haemophilus influenzae Rd
aauuucuucaacuaacugg

SEQ ID NO: 690784 - RNA, 22 nt, Haemophilus influenzae Rd
aauuucuucauacgaccuucaa

SEQ ID NO: 690785 - RNA, 19 nt, Haemophilus influenzae Rd
aauuucuuguuuaaauuca

SEQ ID NO: 690786 - RNA, 19 nt, Haemophilus influenzae Rd
aauuucucugcgcacuuuu

SEQ ID NO: 690787 - RNA, 14 nt, Haemophilus influenzae Rd
aauuucugaacaca

SEQ ID NO: 690788 - RNA, 14 nt, Haemophilus influenzae Rd
aauuucucaccaaa

SEQ ID NO: 690789 - RNA, 18 nt, Haemophilus influenzae Rd
aauuuuaggugcuuuuaa

SEQ ID NO: 690790 - RNA, 21 nt, Haemophilus influenzae Rd
aauuuuaguaauagacuuaau

SEQ ID NO: 690791 - RNA, 21 nt, Haemophilus influenzae Rd
aauuuuaguuuguuucucaag

SEQ ID NO: 690792 - RNA, 10 nt, Haemophilus influenzae Rd
aauuuuauag

SEQ ID NO: 690793 - RNA, 14 nt, Haemophilus influenzae Rd
aauuuuauuauguu

SEQ ID NO: 690794 - RNA, 18 nt, Haemophilus influenzae Rd
aauuuuacguuuuaaauu

SEQ ID NO: 690795 - RNA, 17 nt, Haemophilus influenzae Rd
aauuuuaccaagaaaua

SEQ ID NO: 690796 - RNA, 21 nt, Haemophilus influenzae Rd
aauuuuaccuaaaagcggcgc

SEQ ID NO: 690797 - RNA, 13 nt, Haemophilus influenzae Rd
aauuuguccuuua

SEQ ID NO: 690798 - RNA, 14 nt, Haemophilus influenzae Rd
aauuuguccuuuau

SEQ ID NO: 690799 - RNA, 22 nt, Haemophilus influenzae Rd
aauuuguccuuuaucaagcaca

SEQ ID NO: 690800 - RNA, 22 nt, Haemophilus influenzae Rd
aauuuguuagaucaaauuugau

SEQ ID NO: 690801 - RNA, 21 nt, Haemophilus influenzae Rd
aauuuguggaaauugccaaaa

SEQ ID NO: 690802 - RNA, 13 nt, Haemophilus influenzae Rd
aauuuuaaaauuu

SEQ ID NO: 690803 - RNA, 21 nt, Haemophilus influenzae Rd
aauuuuaaaccgucauuuaua

SEQ ID NO: 690804 - RNA, 16 nt, Haemophilus influenzae Rd
aauuuguggugcauaa

SEQ ID NO: 690805 - RNA, 21 nt, Haemophilus influenzae Rd
  misc_feature (6)..(8): n is a, c, g or u
aauuunnngcaaaaaguacuu

SEQ ID NO: 690806 - RNA, 12 nt, Haemophilus influenzae Rd
aauuuuaaauaa

SEQ ID NO: 690807 - RNA, 11 nt, Haemophilus influenzae Rd
aauuuuaaauu

SEQ ID NO: 690808 - RNA, 10 nt, Haemophilus influenzae Rd
aauuuuaacg

SEQ ID NO: 690809 - RNA, 15 nt, Haemophilus influenzae Rd
aauuugaaaauuuau

SEQ ID NO: 690810 - RNA, 17 nt, Haemophilus influenzae Rd
aauuugaacaaacgcca

SEQ ID NO: 690811 - RNA, 14 nt, Haemophilus influenzae Rd
aauuugaauguaaa

SEQ ID NO: 690812 - RNA, 23 nt, Haemophilus influenzae Rd
aauuugaccuugaaguuugauuc

SEQ ID NO: 690813 - RNA, 21 nt, Haemophilus influenzae Rd
aauuugagucucaaauuuuuc

SEQ ID NO: 690814 - RNA, 17 nt, Haemophilus influenzae Rd
aauuugacgcgcacaua

SEQ ID NO: 690815 - RNA, 14 nt, Haemophilus influenzae Rd
aauuugcaucauuu

SEQ ID NO: 690816 - RNA, 21 nt, Haemophilus influenzae Rd
aauuugccccaauauuuuuca

SEQ ID NO: 690817 - RNA, 18 nt, Haemophilus influenzae Rd
aauuugcuguggugaagu

SEQ ID NO: 690818 - RNA, 17 nt, Haemophilus influenzae Rd
aauuugcucaaaguucg

SEQ ID NO: 690819 - RNA, 20 nt, Haemophilus influenzae Rd
aauuuggucuguuucuucua

SEQ ID NO: 690820 - RNA, 22 nt, Haemophilus influenzae Rd
aauuuggucuguuucuucuacu

SEQ ID NO: 690821 - RNA, 16 nt, Haemophilus influenzae Rd
aauuuggugcucuggg

SEQ ID NO: 690822 - RNA, 19 nt, Haemophilus influenzae Rd
aauuugguuccccuuucug

SEQ ID NO: 690823 - RNA, 16 nt, Haemophilus influenzae Rd
aauuuucggcaagaaa

SEQ ID NO: 690824 - RNA, 22 nt, Haemophilus influenzae Rd
aauuuuccuucuauaucagaaa

SEQ ID NO: 690825 - RNA, 23 nt, Haemophilus influenzae Rd
aauuuuccuucuauaucagaaaa

SEQ ID NO: 690826 - RNA, 16 nt, Haemophilus influenzae Rd
aauuuuccuaacaaua

SEQ ID NO: 690827 - RNA, 22 nt, Haemophilus influenzae Rd
aauuuucuguugggauagauuu

SEQ ID NO: 690828 - RNA, 23 nt, Haemophilus influenzae Rd
aauuuucaaagcguuuuaaaauc

SEQ ID NO: 690829 - RNA, 17 nt, Haemophilus influenzae Rd
aauuuucacauaauaaa

SEQ ID NO: 690830 - RNA, 18 nt, Haemophilus influenzae Rd
aauuuuauuccaccacag

SEQ ID NO: 690831 - RNA, 17 nt, Haemophilus influenzae Rd
aauuuugccaucaauaa

SEQ ID NO: 690832 - RNA, 19 nt, Haemophilus influenzae Rd
aauuuuggcuuaauuacua

SEQ ID NO: 690833 - RNA, 18 nt, Haemophilus influenzae Rd
aauuuuguccgaaaaaac

SEQ ID NO: 690834 - RNA, 16 nt, Haemophilus influenzae Rd
aauuuuuaaaguuauu

SEQ ID NO: 690835 - RNA, 13 nt, Haemophilus influenzae Rd
aauuuuuaaaaua

SEQ ID NO: 690836 - RNA, 21 nt, Haemophilus influenzae Rd
aauuuucuuuucaaacaacaa

SEQ ID NO: 690837 - RNA, 17 nt, Haemophilus influenzae Rd
aauuuugaagucuuaau

SEQ ID NO: 690838 - RNA, 17 nt, Haemophilus influenzae Rd
aauuuugaugaaaguug

SEQ ID NO: 690839 - RNA, 17 nt, Haemophilus influenzae Rd
aauuuugcaagccaaua

SEQ ID NO: 690840 - RNA, 21 nt, Haemophilus influenzae Rd
aauuuuuuuaguuuuguauaa

SEQ ID NO: 690841 - RNA, 22 nt, Haemophilus influenzae Rd
aauuuuuucagauaaucaaaaa

SEQ ID NO: 690842 - RNA, 17 nt, Haemophilus influenzae Rd
aauuuuuuguucauuuu

SEQ ID NO: 690843 - RNA, 20 nt, Haemophilus influenzae Rd
aauuuuuuguucauuuuaaa

SEQ ID NO: 690844 - RNA, 20 nt, Haemophilus influenzae Rd
aauuuuuuugcuggaaaaau

SEQ ID NO: 690845 - RNA, 17 nt, Haemophilus influenzae Rd
aauuuuuucgguuuuuc

SEQ ID NO: 690846 - RNA, 16 nt, Haemophilus influenzae Rd
aauuuuuucaaaaguu

SEQ ID NO: 690847 - RNA, 22 nt, Haemophilus influenzae Rd
aauuuuuuauagugauuauuua

SEQ ID NO: 690848 - RNA, 20 nt, Haemophilus influenzae Rd
aauuuuuuauucaaaauuug

SEQ ID NO: 690849 - RNA, 21 nt, Haemophilus influenzae Rd
aauuuuuucuccacaaaccaa

SEQ ID NO: 690850 - RNA, 20 nt, Haemophilus influenzae Rd
aauuuuuuaauuaguuugau

SEQ ID NO: 690851 - RNA, 21 nt, Haemophilus influenzae Rd
aauuuuuuacguaauguacca

SEQ ID NO: 690852 - RNA, 13 nt, Haemophilus influenzae Rd
aauuuuuggauuu

SEQ ID NO: 690853 - RNA, 17 nt, Haemophilus influenzae Rd
aauuuuugcaaaaagua

SEQ ID NO: 690854 - RNA, 16 nt, Haemophilus influenzae Rd
aauuuuugcauuuuca

SEQ ID NO: 690855 - RNA, 19 nt, Haemophilus influenzae Rd
aauuuuuauaauuuugaug

SEQ ID NO: 690856 - RNA, 20 nt, Haemophilus influenzae Rd
aauuuuuaucuuuaaagaau

SEQ ID NO: 690857 - RNA, 21 nt, Haemophilus influenzae Rd
aauuuuuaucuuuaaagaaua

SEQ ID NO: 690858 - RNA, 21 nt, Haemophilus influenzae Rd
aauuuuucaccugugauaagu

SEQ ID NO: 690859 - RNA, 11 nt, Haemophilus influenzae Rd
aauuuuucacu

SEQ ID NO: 690860 - RNA, 14 nt, Haemophilus influenzae Rd
aauuuuuagaagag

SEQ ID NO: 690861 - RNA, 17 nt, Haemophilus influenzae Rd
aauuuuuagaagagauu

SEQ ID NO: 690862 - RNA, 19 nt, Haemophilus influenzae Rd
aauuuuuaaccgcacuuuu

SEQ ID NO: 690863 - RNA, 13 nt, Haemophilus influenzae Rd
aauuuuucauucu

SEQ ID NO: 690864 - RNA, 15 nt, Haemophilus influenzae Rd
aauuuuucauucugu

SEQ ID NO: 690865 - RNA, 21 nt, Haemophilus influenzae Rd
aauuuuuccgaauauccacuu

SEQ ID NO: 690866 - RNA, 22 nt, Haemophilus influenzae Rd
aauuuuucgcaagauagcaaaa

SEQ ID NO: 690867 - RNA, 19 nt, Haemophilus influenzae Rd
aauuuuugacggcuugcuu

SEQ ID NO: 690868 - RNA, 16 nt, Haemophilus influenzae Rd
acaaaauuuuaaauaa

SEQ ID NO: 690869 - RNA, 22 nt, Haemophilus influenzae Rd
acaaaauuuuaaauaaaauauu

SEQ ID NO: 690870 - RNA, 14 nt, Haemophilus influenzae Rd
acaaacaaauuuuu

SEQ ID NO: 690871 - RNA, 20 nt, Haemophilus influenzae Rd
acaaaauggcaaacaaaaua

SEQ ID NO: 690872 - RNA, 21 nt, Haemophilus influenzae Rd
acaaaauggcaaacaaaauaa

SEQ ID NO: 690873 - RNA, 23 nt, Haemophilus influenzae Rd
acaaaauggcaaacaaaauaaau

SEQ ID NO: 690874 - RNA, 22 nt, Haemophilus influenzae Rd
acaaaauggcuuuuuugccuuu

SEQ ID NO: 690875 - RNA, 16 nt, Haemophilus influenzae Rd
acaaaauuaaugccaa

SEQ ID NO: 690876 - RNA, 18 nt, Haemophilus influenzae Rd
acaaaauuagacuuucuu

SEQ ID NO: 690877 - RNA, 12 nt, Haemophilus influenzae Rd
acaaaauauuag

SEQ ID NO: 690878 - RNA, 14 nt, Haemophilus influenzae Rd
acaaaauaaaugau

SEQ ID NO: 690879 - RNA, 20 nt, Haemophilus influenzae Rd
acaaaauccacacuuuaaaa

SEQ ID NO: 690880 - RNA, 23 nt, Haemophilus influenzae Rd
acaaaaucugauacgaauguuug

SEQ ID NO: 690881 - RNA, 22 nt, Haemophilus influenzae Rd
acaaaaucugcuccgcuacuuu

SEQ ID NO: 690882 - RNA, 17 nt, Haemophilus influenzae Rd
acaaaaggcaagcuagg

SEQ ID NO: 690883 - RNA, 23 nt, Haemophilus influenzae Rd
acaaaagugcgguaaauuuuuac

SEQ ID NO: 690884 - RNA, 18 nt, Haemophilus influenzae Rd
acaaaagugcgguuaauu

SEQ ID NO: 690885 - RNA, 19 nt, Haemophilus influenzae Rd
acaaaagugcgguuuauuu

SEQ ID NO: 690886 - RNA, 15 nt, Haemophilus influenzae Rd
acaaaaccaaucaua

SEQ ID NO: 690887 - RNA, 22 nt, Haemophilus influenzae Rd
acaaaaagugcgguuaaaaauu

SEQ ID NO: 690888 - RNA, 13 nt, Haemophilus influenzae Rd
acaaaacauaaua

SEQ ID NO: 690889 - RNA, 17 nt, Haemophilus influenzae Rd
acaaaacuaaaaaaauu

SEQ ID NO: 690890 - RNA, 18 nt, Haemophilus influenzae Rd
acaaaaaauucuuugccu

SEQ ID NO: 690891 - RNA, 17 nt, Haemophilus influenzae Rd
acaaaaaaguacuugca

SEQ ID NO: 690892 - RNA, 20 nt, Haemophilus influenzae Rd
acaaaccuaaaccuuauuuu

SEQ ID NO: 690893 - RNA, 14 nt, Haemophilus influenzae Rd
acaaacauaccuaa

SEQ ID NO: 690894 - RNA, 21 nt, Haemophilus influenzae Rd
acaaacaacguaaaaguaaau

SEQ ID NO: 690895 - RNA, 20 nt, Haemophilus influenzae Rd
acaaacgguuucaauaugac

SEQ ID NO: 690896 - RNA, 21 nt, Haemophilus influenzae Rd
acaaacuuaccgaucauuucu

SEQ ID NO: 690897 - RNA, 17 nt, Haemophilus influenzae Rd
acaaagauuuucucgug

SEQ ID NO: 690898 - RNA, 11 nt, Haemophilus influenzae Rd
acaaagcaaau

SEQ ID NO: 690899 - RNA, 20 nt, Haemophilus influenzae Rd
acaaagaaucuuaaauucau

SEQ ID NO: 690900 - RNA, 18 nt, Haemophilus influenzae Rd
acaaagguaaaacuuucu

SEQ ID NO: 690901 - RNA, 20 nt, Haemophilus influenzae Rd
acaaagggcugauauuuaaa

SEQ ID NO: 690902 - RNA, 22 nt, Haemophilus influenzae Rd
acaaagggcugauauuuaaaau

SEQ ID NO: 690903 - RNA, 19 nt, Haemophilus influenzae Rd
acaaaguguuuuauuuauc

SEQ ID NO: 690904 - RNA, 17 nt, Haemophilus influenzae Rd
acaaaguugauaaucau

SEQ ID NO: 690905 - RNA, 13 nt, Haemophilus influenzae Rd
acaaagucaauuu

SEQ ID NO: 690906 - RNA, 15 nt, Haemophilus influenzae Rd
acaacaacuuuucua

SEQ ID NO: 690907 - RNA, 15 nt, Haemophilus influenzae Rd
acaacaagaaauuuu

SEQ ID NO: 690908 - RNA, 16 nt, Haemophilus influenzae Rd
acaaauuuccauauga

SEQ ID NO: 690909 - RNA, 20 nt, Haemophilus influenzae Rd
acaaauuuguugaucugcaa

SEQ ID NO: 690910 - RNA, 22 nt, Haemophilus influenzae Rd
acaaauuuguugcauuucuaaa

SEQ ID NO: 690911 - RNA, 20 nt, Haemophilus influenzae Rd
acaaauuuuauauauccaaa

SEQ ID NO: 690912 - RNA, 21 nt, Haemophilus influenzae Rd
acaaauuuuauauauccaaau

SEQ ID NO: 690913 - RNA, 19 nt, Haemophilus influenzae Rd
acaacaaauugugucacau

SEQ ID NO: 690914 - RNA, 15 nt, Haemophilus influenzae Rd
acaaaugucauugau

SEQ ID NO: 690915 - RNA, 19 nt, Haemophilus influenzae Rd
acaaauuagcgauuaaagu

SEQ ID NO: 690916 - RNA, 17 nt, Haemophilus influenzae Rd
acaaauuaauaagaaaa

SEQ ID NO: 690917 - RNA, 22 nt, Haemophilus influenzae Rd
acaaauuaauaagaaaaucaaa

SEQ ID NO: 690918 - RNA, 14 nt, Haemophilus influenzae Rd
acaaauuuaaauga

SEQ ID NO: 690919 - RNA, 15 nt, Haemophilus influenzae Rd
acaaauuuaaaugau

SEQ ID NO: 690920 - RNA, 14 nt, Haemophilus influenzae Rd
acaaauuuaauauu

SEQ ID NO: 690921 - RNA, 13 nt, Haemophilus influenzae Rd
acaaauuuagaua

SEQ ID NO: 690922 - RNA, 17 nt, Haemophilus influenzae Rd
acaaauuuagauaacaa

SEQ ID NO: 690923 - RNA, 13 nt, Haemophilus influenzae Rd
acaaauaagccaa

SEQ ID NO: 690924 - RNA, 17 nt, Haemophilus influenzae Rd
acaaauauugguuauuu

SEQ ID NO: 690925 - RNA, 12 nt, Haemophilus influenzae Rd
acaaauaaaaag

SEQ ID NO: 690926 - RNA, 14 nt, Haemophilus influenzae Rd
acaaauaaaaagug

SEQ ID NO: 690927 - RNA, 17 nt, Haemophilus influenzae Rd
acaaauaaacaaacuuu

SEQ ID NO: 690928 - RNA, 14 nt, Haemophilus influenzae Rd
acaaauaauuauua

SEQ ID NO: 690929 - RNA, 15 nt, Haemophilus influenzae Rd
acaaauaauuauuau

SEQ ID NO: 690930 - RNA, 17 nt, Haemophilus influenzae Rd
acaaaucugccugauuu

SEQ ID NO: 690931 - RNA, 18 nt, Haemophilus influenzae Rd
acaaaugaucauuuuggg

SEQ ID NO: 690932 - RNA, 22 nt, Haemophilus influenzae Rd
acaaauccauaaggaaauugca

SEQ ID NO: 690933 - RNA, 16 nt, Haemophilus influenzae Rd
acaagcacaagauuug

SEQ ID NO: 690934 - RNA, 14 nt, Haemophilus influenzae Rd
acaagcaacaauau

SEQ ID NO: 690935 - RNA, 16 nt, Haemophilus influenzae Rd
acaagaugucaaaugu

SEQ ID NO: 690936 - RNA, 22 nt, Haemophilus influenzae Rd
acaagacucucgccuuauuacc

SEQ ID NO: 690937 - RNA, 22 nt, Haemophilus influenzae Rd
acaagaaucaucgcgaugacua

SEQ ID NO: 690938 - RNA, 14 nt, Haemophilus influenzae Rd
acaagacaaaauaa

SEQ ID NO: 690939 - RNA, 13 nt, Haemophilus influenzae Rd
acaagccacauca

SEQ ID NO: 690940 - RNA, 19 nt, Haemophilus influenzae Rd
acaacuggaauuuguaaga

SEQ ID NO: 690941 - RNA, 20 nt, Haemophilus influenzae Rd
acaacuggacgcucuacauu

SEQ ID NO: 690942 - RNA, 16 nt, Haemophilus influenzae Rd
acaacugcaaaugaaa

SEQ ID NO: 690943 - RNA, 17 nt, Haemophilus influenzae Rd
acaacugcaaaugaaac

SEQ ID NO: 690944 - RNA, 14 nt, Haemophilus influenzae Rd
acaagaaauaauaa

SEQ ID NO: 690945 - RNA, 17 nt, Haemophilus influenzae Rd
acaagaaauaauaaaau

SEQ ID NO: 690946 - RNA, 15 nt, Haemophilus influenzae Rd
acaagaaauuuuguu

SEQ ID NO: 690947 - RNA, 21 nt, Haemophilus influenzae Rd
acaagaaauuuuguuuuguuc

SEQ ID NO: 690948 - RNA, 23 nt, Haemophilus influenzae Rd
acaacuuuuuauuuucugcaguu

SEQ ID NO: 690949 - RNA, 17 nt, Haemophilus influenzae Rd
acaacuuuuucaucuuu

SEQ ID NO: 690950 - RNA, 21 nt, Haemophilus influenzae Rd
acaacugagcccacaacuaca

SEQ ID NO: 690951 - RNA, 12 nt, Haemophilus influenzae Rd
acaacuaauccc

SEQ ID NO: 690952 - RNA, 13 nt, Haemophilus influenzae Rd
acaacuaauccca

SEQ ID NO: 690953 - RNA, 14 nt, Haemophilus influenzae Rd
acaacucacaauaa

SEQ ID NO: 690954 - RNA, 21 nt, Haemophilus influenzae Rd
acaaccaucuucaacgauaac

SEQ ID NO: 690955 - RNA, 23 nt, Haemophilus influenzae Rd
acaaccauauuaaucgcaauaac

SEQ ID NO: 690956 - RNA, 23 nt, Haemophilus influenzae Rd
acaacaucagauggaauauuugc

SEQ ID NO: 690957 - RNA, 17 nt, Haemophilus influenzae Rd
acaacaucuuguuuuaa

SEQ ID NO: 690958 - RNA, 16 nt, Haemophilus influenzae Rd
acaacagcgaaauauu

SEQ ID NO: 690959 - RNA, 19 nt, Haemophilus influenzae Rd
acaacagcgaaauauuuca

SEQ ID NO: 690960 - RNA, 21 nt, Haemophilus influenzae Rd
acaacagcgaaauauuucacu

SEQ ID NO: 690961 - RNA, 19 nt, Haemophilus influenzae Rd
acaacagauugauaaguuu

SEQ ID NO: 690962 - RNA, 12 nt, Haemophilus influenzae Rd
acaacagcaaua

SEQ ID NO: 690963 - RNA, 18 nt, Haemophilus influenzae Rd
acaacagcuaccaauuca

SEQ ID NO: 690964 - RNA, 23 nt, Haemophilus influenzae Rd
acaacaguagaaaucacaauaaa

SEQ ID NO: 690965 - RNA, 21 nt, Haemophilus influenzae Rd
acaacccuauucgcugauaaa

SEQ ID NO: 690966 - RNA, 15 nt, Haemophilus influenzae Rd
acaacgcgacuaaau

SEQ ID NO: 690967 - RNA, 20 nt, Haemophilus influenzae Rd
acaacgcgacuaaaucuuau

SEQ ID NO: 690968 - RNA, 22 nt, Haemophilus influenzae Rd
acaacgcccucgccuugcaaau

SEQ ID NO: 690969 - RNA, 13 nt, Haemophilus influenzae Rd
acaacgugaagua

SEQ ID NO: 690970 - RNA, 16 nt, Haemophilus influenzae Rd
acaacgugaaguaaau

SEQ ID NO: 690971 - RNA, 16 nt, Haemophilus influenzae Rd
acaacgguugaaauug

SEQ ID NO: 690972 - RNA, 15 nt, Haemophilus influenzae Rd
acaacguaaaaguaa

SEQ ID NO: 690973 - RNA, 17 nt, Haemophilus influenzae Rd
acaacguaaaaguaaau

SEQ ID NO: 690974 - RNA, 15 nt, Haemophilus influenzae Rd
acacaccuauuuuuu

SEQ ID NO: 690975 - RNA, 17 nt, Haemophilus influenzae Rd
acacacgaucaccaaga

SEQ ID NO: 690976 - RNA, 11 nt, Haemophilus influenzae Rd
acacacaccau

SEQ ID NO: 690977 - RNA, 21 nt, Haemophilus influenzae Rd
acacacaccauccaugacaga

SEQ ID NO: 690978 - RNA, 13 nt, Haemophilus influenzae Rd
acacaagcaccag

SEQ ID NO: 690979 - RNA, 14 nt, Haemophilus influenzae Rd
acacaaucgguaac

SEQ ID NO: 690980 - RNA, 15 nt, Haemophilus influenzae Rd
acacaauaauauagg

SEQ ID NO: 690981 - RNA, 21 nt, Haemophilus influenzae Rd
acacaagaaaguuuaugacga

SEQ ID NO: 690982 - RNA, 17 nt, Haemophilus influenzae Rd
acacaacauagcugaaa

SEQ ID NO: 690983 - RNA, 12 nt, Haemophilus influenzae Rd
acacaacaucag

SEQ ID NO: 690984 - RNA, 16 nt, Haemophilus influenzae Rd
acacaucagaaaauca

SEQ ID NO: 690985 - RNA, 16 nt, Haemophilus influenzae Rd
acacaucgcuugcauu

SEQ ID NO: 690986 - RNA, 18 nt, Haemophilus influenzae Rd
acacauaauauuuuuacu

SEQ ID NO: 690987 - RNA, 17 nt, Haemophilus influenzae Rd
acacaguuauacacaag

SEQ ID NO: 690988 - RNA, 22 nt, Haemophilus influenzae Rd
acacaguuauacacaaguuaca

SEQ ID NO: 690989 - RNA, 16 nt, Haemophilus influenzae Rd
acacaaacugguuaaa

SEQ ID NO: 690990 - RNA, 17 nt, Haemophilus influenzae Rd
acacaaacugguuaaaa

SEQ ID NO: 690991 - RNA, 15 nt, Haemophilus influenzae Rd
acaauuuuuggauuu

SEQ ID NO: 690992 - RNA, 19 nt, Haemophilus influenzae Rd
acaauuucauuaauuuuau

SEQ ID NO: 690993 - RNA, 15 nt, Haemophilus influenzae Rd
acaauugauguaaaa

SEQ ID NO: 690994 - RNA, 17 nt, Haemophilus influenzae Rd
acaauugcagcccaaau

SEQ ID NO: 690995 - RNA, 12 nt, Haemophilus influenzae Rd
acaauuccccuu

SEQ ID NO: 690996 - RNA, 18 nt, Haemophilus influenzae Rd
acaauuccccuuccuuga

SEQ ID NO: 690997 - RNA, 18 nt, Haemophilus influenzae Rd
acaaugcucacuucgcuu

SEQ ID NO: 690998 - RNA, 22 nt, Haemophilus influenzae Rd
acaaugcccucaggaacaucac

SEQ ID NO: 690999 - RNA, 17 nt, Haemophilus influenzae Rd
acaaugcuauaaaaccu

SEQ ID NO: 691000 - RNA, 18 nt, Haemophilus influenzae Rd
acaaugcggagaaaagca

SEQ ID NO: 691001 - RNA, 20 nt, Haemophilus influenzae Rd
acaauuacugcaaaugcagg

SEQ ID NO: 691002 - RNA, 18 nt, Haemophilus influenzae Rd
acaauguucguagaauga

SEQ ID NO: 691003 - RNA, 16 nt, Haemophilus influenzae Rd
acaauguuuaauccaa

SEQ ID NO: 691004 - RNA, 19 nt, Haemophilus influenzae Rd
acaauguaguuucuucuuu

SEQ ID NO: 691005 - RNA, 18 nt, Haemophilus influenzae Rd
acaaucgcaucgucuuua

SEQ ID NO: 691006 - RNA, 19 nt, Haemophilus influenzae Rd
acaauccuaacuuuucuuc

SEQ ID NO: 691007 - RNA, 21 nt, Haemophilus influenzae Rd
acaauccuauagcccaacgca

SEQ ID NO: 691008 - RNA, 20 nt, Haemophilus influenzae Rd
acaaucugcuguugcagcug

SEQ ID NO: 691009 - RNA, 22 nt, Haemophilus influenzae Rd
acaaucuguggcguauuuagaa

SEQ ID NO: 691010 - RNA, 17 nt, Haemophilus influenzae Rd
acaaucgguuaaaagua

SEQ ID NO: 691011 - RNA, 23 nt, Haemophilus influenzae Rd
acaaugaguguuauugaugaaga

SEQ ID NO: 691012 - RNA, 21 nt, Haemophilus influenzae Rd
acaaugauuaaacgcaacauc

SEQ ID NO: 691013 - RNA, 18 nt, Haemophilus influenzae Rd
acaaucacgaucugcaac

SEQ ID NO: 691014 - RNA, 19 nt, Haemophilus influenzae Rd
acaaucacugaaaaaugga

SEQ ID NO: 691015 - RNA, 20 nt, Haemophilus influenzae Rd
acaaucagcgagcaguggua

SEQ ID NO: 691016 - RNA, 18 nt, Haemophilus influenzae Rd
acaaucagcugcucuuua

SEQ ID NO: 691017 - RNA, 20 nt, Haemophilus influenzae Rd
acaaucauacacaccaucaa

SEQ ID NO: 691018 - RNA, 18 nt, Haemophilus influenzae Rd
acaaucauagaaaucccu

SEQ ID NO: 691019 - RNA, 19 nt, Haemophilus influenzae Rd
acaauaugugcuuggcaca

SEQ ID NO: 691020 - RNA, 20 nt, Haemophilus influenzae Rd
acaauauugaaauaagauuu

SEQ ID NO: 691021 - RNA, 22 nt, Haemophilus influenzae Rd
acaauauuugguugaacuucua

SEQ ID NO: 691022 - RNA, 22 nt, Haemophilus influenzae Rd
acaauacguugaguauagucau

SEQ ID NO: 691023 - RNA, 20 nt, Haemophilus influenzae Rd
acaauauauucggaaaaaau

SEQ ID NO: 691024 - RNA, 15 nt, Haemophilus influenzae Rd
acaauauaaccagcc

SEQ ID NO: 691025 - RNA, 16 nt, Haemophilus influenzae Rd
acaagcucuagaaaau

SEQ ID NO: 691026 - RNA, 17 nt, Haemophilus influenzae Rd
acaagcucuagaaaauc

SEQ ID NO: 691027 - RNA, 20 nt, Haemophilus influenzae Rd
acaagcuuguccaugaaaaa

SEQ ID NO: 691028 - RNA, 22 nt, Haemophilus influenzae Rd
acaagcuuguccaugaaaaacu

SEQ ID NO: 691029 - RNA, 19 nt, Haemophilus influenzae Rd
acaaggcaaauaaaauaga

SEQ ID NO: 691030 - RNA, 20 nt, Haemophilus influenzae Rd
acaaguaagucgugaucugc

SEQ ID NO: 691031 - RNA, 21 nt, Haemophilus influenzae Rd
acaaguacgauugcaauaauc

SEQ ID NO: 691032 - RNA, 15 nt, Haemophilus influenzae Rd
acaaguauuuuccuu

SEQ ID NO: 691033 - RNA, 15 nt, Haemophilus influenzae Rd
acaaguauaaaaaau

SEQ ID NO: 691034 - RNA, 19 nt, Haemophilus influenzae Rd
acaagugguggaauaaaag

SEQ ID NO: 691035 - RNA, 11 nt, Haemophilus influenzae Rd
acaagucucua

SEQ ID NO: 691036 - RNA, 19 nt, Haemophilus influenzae Rd
acaauaauuugccaaaucc

SEQ ID NO: 691037 - RNA, 21 nt, Haemophilus influenzae Rd
acaauaauaggcgaaucaaaa

SEQ ID NO: 691038 - RNA, 21 nt, Haemophilus influenzae Rd
acaauacgauucguuucagua

SEQ ID NO: 691039 - RNA, 13 nt, Haemophilus influenzae Rd
acaauacuuauca

SEQ ID NO: 691040 - RNA, 19 nt, Haemophilus influenzae Rd
acaauacuuaucacugcgc

SEQ ID NO: 691041 - RNA, 20 nt, Haemophilus influenzae Rd
acaauaacugcgccaauaua

SEQ ID NO: 691042 - RNA, 13 nt, Haemophilus influenzae Rd
acaauaaaucaac

SEQ ID NO: 691043 - RNA, 12 nt, Haemophilus influenzae Rd
acaauaaaacuu

SEQ ID NO: 691044 - RNA, 21 nt, Haemophilus influenzae Rd
acaauaaaacuuuauuuuauu

SEQ ID NO: 691045 - RNA, 14 nt, Haemophilus influenzae Rd
acaauaaaauaaua

SEQ ID NO: 691046 - RNA, 20 nt, Haemophilus influenzae Rd
acaaguuucuaaaaucacuu

SEQ ID NO: 691047 - RNA, 16 nt, Haemophilus influenzae Rd
acaaguuuaauacaau

SEQ ID NO: 691048 - RNA, 14 nt, Haemophilus influenzae Rd
acaccuuuuuccuu

SEQ ID NO: 691049 - RNA, 17 nt, Haemophilus influenzae Rd
acaccuauuuuuuccug

SEQ ID NO: 691050 - RNA, 15 nt, Haemophilus influenzae Rd
acaccgauuucuuua

SEQ ID NO: 691051 - RNA, 14 nt, Haemophilus influenzae Rd
acaccgagaugcau

SEQ ID NO: 691052 - RNA, 22 nt, Haemophilus influenzae Rd
acaccgucuugccauaguacua

SEQ ID NO: 691053 - RNA, 15 nt, Haemophilus influenzae Rd
acaccuaaaugagaa

SEQ ID NO: 691054 - RNA, 22 nt, Haemophilus influenzae Rd
acaccuaaguaagucgcaucaa

SEQ ID NO: 691055 - RNA, 17 nt, Haemophilus influenzae Rd
acaccagcuuuaaccau

SEQ ID NO: 691056 - RNA, 22 nt, Haemophilus influenzae Rd
acacccaugaaucgaacacugu

SEQ ID NO: 691057 - RNA, 14 nt, Haemophilus influenzae Rd
acacccaaauuaaa

SEQ ID NO: 691058 - RNA, 16 nt, Haemophilus influenzae Rd
acacccaaauuaaaaa

SEQ ID NO: 691059 - RNA, 22 nt, Haemophilus influenzae Rd
acacccaaauuaaaaaagcaaa

SEQ ID NO: 691060 - RNA, 15 nt, Haemophilus influenzae Rd
acaccaaaaaugccg

SEQ ID NO: 691061 - RNA, 21 nt, Haemophilus influenzae Rd
acacauuucuucuaguuuucc

SEQ ID NO: 691062 - RNA, 15 nt, Haemophilus influenzae Rd
acacauggccaauuu

SEQ ID NO: 691063 - RNA, 17 nt, Haemophilus influenzae Rd
acaccaacggcauuucc

SEQ ID NO: 691064 - RNA, 18 nt, Haemophilus influenzae Rd
acaccaacggcauuuccg

SEQ ID NO: 691065 - RNA, 18 nt, Haemophilus influenzae Rd
acaccaccugaugcuuua

SEQ ID NO: 691066 - RNA, 20 nt, Haemophilus influenzae Rd
acaccaccugaugcuuuaac

SEQ ID NO: 691067 - RNA, 21 nt, Haemophilus influenzae Rd
acagaagugcguucauauuug

SEQ ID NO: 691068 - RNA, 21 nt, Haemophilus influenzae Rd
acagaaguugaaaauaagcau

SEQ ID NO: 691069 - RNA, 20 nt, Haemophilus influenzae Rd
acagaaguauuuacugauuu

SEQ ID NO: 691070 - RNA, 16 nt, Haemophilus influenzae Rd
acagacuaaauucagu

SEQ ID NO: 691071 - RNA, 17 nt, Haemophilus influenzae Rd
acagacuaaauucagua

SEQ ID NO: 691072 - RNA, 14 nt, Haemophilus influenzae Rd
acagauacagaagg

SEQ ID NO: 691073 - RNA, 15 nt, Haemophilus influenzae Rd
acagauacauuuaau

SEQ ID NO: 691074 - RNA, 13 nt, Haemophilus influenzae Rd
acagacugaaauu

SEQ ID NO: 691075 - RNA, 22 nt, Haemophilus influenzae Rd
acagcaagcaucgcuggauaaa

SEQ ID NO: 691076 - RNA, 16 nt, Haemophilus influenzae Rd
acagcagcuaaaagug

SEQ ID NO: 691077 - RNA, 16 nt, Haemophilus influenzae Rd
acagcaauaaauaaua

SEQ ID NO: 691078 - RNA, 22 nt, Haemophilus influenzae Rd
acagauuuuuacuucaucaaaa

SEQ ID NO: 691079 - RNA, 17 nt, Haemophilus influenzae Rd
acagauuuuuuauuaau

SEQ ID NO: 691080 - RNA, 15 nt, Haemophilus influenzae Rd
acagcaaaagaaaua

SEQ ID NO: 691081 - RNA, 16 nt, Haemophilus influenzae Rd
acagcaaaagaaauaa

SEQ ID NO: 691082 - RNA, 14 nt, Haemophilus influenzae Rd
acagcaaaagcaau

SEQ ID NO: 691083 - RNA, 22 nt, Haemophilus influenzae Rd
acagcaaaagugcuuaaaugca

SEQ ID NO: 691084 - RNA, 16 nt, Haemophilus influenzae Rd
acagcaaacuuaaaua

SEQ ID NO: 691085 - RNA, 20 nt, Haemophilus influenzae Rd
acagcaaacuuaaauacauu

SEQ ID NO: 691086 - RNA, 18 nt, Haemophilus influenzae Rd
acacggccguaaugaauu

SEQ ID NO: 691087 - RNA, 12 nt, Haemophilus influenzae Rd
acacgcgcugcu

SEQ ID NO: 691088 - RNA, 19 nt, Haemophilus influenzae Rd
acacguccgcaaccagcag

SEQ ID NO: 691089 - RNA, 24 nt, Haemophilus influenzae Rd
acacgguaguaaauaacacaucag

SEQ ID NO: 691090 - RNA, 20 nt, Haemophilus influenzae Rd
acacgguauaaucagguacu

SEQ ID NO: 691091 - RNA, 18 nt, Haemophilus influenzae Rd
acacguuugccagaaagc

SEQ ID NO: 691092 - RNA, 22 nt, Haemophilus influenzae Rd
acacgugcuuuaaguugcucac

SEQ ID NO: 691093 - RNA, 14 nt, Haemophilus influenzae Rd
acacuaaaaagccc

SEQ ID NO: 691094 - RNA, 18 nt, Haemophilus influenzae Rd
acacuaccgcccgcauca

SEQ ID NO: 691095 - RNA, 19 nt, Haemophilus influenzae Rd
acacuauuaauuacuuuua

SEQ ID NO: 691096 - RNA, 12 nt, Haemophilus influenzae Rd
acagaacaaaau

SEQ ID NO: 691097 - RNA, 16 nt, Haemophilus influenzae Rd
acagaaaucauuucaa

SEQ ID NO: 691098 - RNA, 17 nt, Haemophilus influenzae Rd
acagaaauaugaaauuu

SEQ ID NO: 691099 - RNA, 18 nt, Haemophilus influenzae Rd
acauagaaaguuuaacuu

SEQ ID NO: 691100 - RNA, 19 nt, Haemophilus influenzae Rd
acauagauuuaagcuuauu

SEQ ID NO: 691101 - RNA, 18 nt, Haemophilus influenzae Rd
acauagccuuuuucuuuc

SEQ ID NO: 691102 - RNA, 21 nt, Haemophilus influenzae Rd
acauagcugaaaaauaaaaaa

SEQ ID NO: 691103 - RNA, 21 nt, Haemophilus influenzae Rd
acauagucgcuggaacuucua

SEQ ID NO: 691104 - RNA, 18 nt, Haemophilus influenzae Rd
acauaggguguucaacuu

SEQ ID NO: 691105 - RNA, 17 nt, Haemophilus influenzae Rd
acauaaaaaacacagcu

SEQ ID NO: 691106 - RNA, 16 nt, Haemophilus influenzae Rd
acaguuuaucucuuuc

SEQ ID NO: 691107 - RNA, 13 nt, Haemophilus influenzae Rd
acauaauaagaaa

SEQ ID NO: 691108 - RNA, 15 nt, Haemophilus influenzae Rd
acauaauaagaaagu

SEQ ID NO: 691109 - RNA, 20 nt, Haemophilus influenzae Rd
acauaauaagaaaguaauug

SEQ ID NO: 691110 - RNA, 18 nt, Haemophilus influenzae Rd
acauaauacuggcacuaa

SEQ ID NO: 691111 - RNA, 20 nt, Haemophilus influenzae Rd
acauaauacuugaacgauuu

SEQ ID NO: 691112 - RNA, 13 nt, Haemophilus influenzae Rd
acauaauaaacau

SEQ ID NO: 691113 - RNA, 20 nt, Haemophilus influenzae Rd
acaucaucggacgaaucaca

SEQ ID NO: 691114 - RNA, 17 nt, Haemophilus influenzae Rd
acauccauuccugcaag

SEQ ID NO: 691115 - RNA, 21 nt, Haemophilus influenzae Rd
acaucaccuguaaacaaauau

SEQ ID NO: 691116 - RNA, 23 nt, Haemophilus influenzae Rd
acaucaccuguaaacaaauauuc

SEQ ID NO: 691117 - RNA, 19 nt, Haemophilus influenzae Rd
acaucacgaggauuuuugc

SEQ ID NO: 691118 - RNA, 17 nt, Haemophilus influenzae Rd
acaucagugauuuucac

SEQ ID NO: 691119 - RNA, 19 nt, Haemophilus influenzae Rd
acaucaauuugauaauuug

SEQ ID NO: 691120 - RNA, 15 nt, Haemophilus influenzae Rd
acaucaauaagaauu

SEQ ID NO: 691121 - RNA, 15 nt, Haemophilus influenzae Rd
acaucaagcacauca

SEQ ID NO: 691122 - RNA, 10 nt, Haemophilus influenzae Rd
acauauaaag

SEQ ID NO: 691123 - RNA, 15 nt, Haemophilus influenzae Rd
acauaucaauuugcc

SEQ ID NO: 691124 - RNA, 15 nt, Haemophilus influenzae Rd
acauauggagaaucu

SEQ ID NO: 691125 - RNA, 20 nt, Haemophilus influenzae Rd
acauauggauagaugaaaug

SEQ ID NO: 691126 - RNA, 19 nt, Haemophilus influenzae Rd
acauaugacagauagcaua

SEQ ID NO: 691127 - RNA, 13 nt, Haemophilus influenzae Rd
acauaugauuauu

SEQ ID NO: 691128 - RNA, 16 nt, Haemophilus influenzae Rd
acauuaugauauuuca

SEQ ID NO: 691129 - RNA, 21 nt, Haemophilus influenzae Rd
acauuauugaagcacugaaau

SEQ ID NO: 691130 - RNA, 18 nt, Haemophilus influenzae Rd
acauuauugccaauuauc

SEQ ID NO: 691131 - RNA, 17 nt, Haemophilus influenzae Rd
acauuauuuuuacaaau

SEQ ID NO: 691132 - RNA, 21 nt, Haemophilus influenzae Rd
acauuaccuucuguuuucaau

SEQ ID NO: 691133 - RNA, 16 nt, Haemophilus influenzae Rd
acauuaguaucuucca

SEQ ID NO: 691134 - RNA, 19 nt, Haemophilus influenzae Rd
acauuagugaaugaugcca

SEQ ID NO: 691135 - RNA, 15 nt, Haemophilus influenzae Rd
acauucccuuuccaa

SEQ ID NO: 691136 - RNA, 23 nt, Haemophilus influenzae Rd
acauuccguuuuuaaucucccaa

SEQ ID NO: 691137 - RNA, 12 nt, Haemophilus influenzae Rd
acauuccuauuc

SEQ ID NO: 691138 - RNA, 15 nt, Haemophilus influenzae Rd
acauucaucaaaaca

SEQ ID NO: 691139 - RNA, 15 nt, Haemophilus influenzae Rd
acauucacuaacaaa

SEQ ID NO: 691140 - RNA, 16 nt, Haemophilus influenzae Rd
acauucaagccuucua

SEQ ID NO: 691141 - RNA, 23 nt, Haemophilus influenzae Rd
acauucaagccuucuaaaauaag

SEQ ID NO: 691142 - RNA, 20 nt, Haemophilus influenzae Rd
acauugcucgugauuaucua

SEQ ID NO: 691143 - RNA, 20 nt, Haemophilus influenzae Rd
acauugcuauggcaaugaau

SEQ ID NO: 691144 - RNA, 16 nt, Haemophilus influenzae Rd
acauugcaucagccac

SEQ ID NO: 691145 - RNA, 12 nt, Haemophilus influenzae Rd
acauugccaaag

SEQ ID NO: 691146 - RNA, 14 nt, Haemophilus influenzae Rd
acauucuuuuaaau

SEQ ID NO: 691147 - RNA, 15 nt, Haemophilus influenzae Rd
acauucuuuuaaaua

SEQ ID NO: 691148 - RNA, 16 nt, Haemophilus influenzae Rd
acauucuauagaauua

SEQ ID NO: 691149 - RNA, 22 nt, Haemophilus influenzae Rd
acauucuccagacugcauugca

SEQ ID NO: 691150 - RNA, 13 nt, Haemophilus influenzae Rd
acauuaaagcaau

SEQ ID NO: 691151 - RNA, 21 nt, Haemophilus influenzae Rd
acauuaacaaugcggagaaaa

SEQ ID NO: 691152 - RNA, 23 nt, Haemophilus influenzae Rd
acauuaagugcguguauauauuu

SEQ ID NO: 691153 - RNA, 15 nt, Haemophilus influenzae Rd
acauuaauaaaccaa

SEQ ID NO: 691154 - RNA, 20 nt, Haemophilus influenzae Rd
acauuaauaacguguaaauu

SEQ ID NO: 691155 - RNA, 15 nt, Haemophilus influenzae Rd
acauuaaucauuuca

SEQ ID NO: 691156 - RNA, 21 nt, Haemophilus influenzae Rd
acauuaaucgaucuauauucg

SEQ ID NO: 691157 - RNA, 23 nt, Haemophilus influenzae Rd
acauuaaucaccauaucaauuuc

SEQ ID NO: 691158 - RNA, 13 nt, Haemophilus influenzae Rd
acauuaauguaau

SEQ ID NO: 691159 - RNA, 16 nt, Haemophilus influenzae Rd
acauuaauguaaucaa

SEQ ID NO: 691160 - RNA, 20 nt, Haemophilus influenzae Rd
acauuaauugacaauuaaua

SEQ ID NO: 691161 - RNA, 12 nt, Haemophilus influenzae Rd
acauuaauuugu

SEQ ID NO: 691162 - RNA, 17 nt, Haemophilus influenzae Rd
acauguugcaaguauua

SEQ ID NO: 691163 - RNA, 15 nt, Haemophilus influenzae Rd
acaucgcuucaucau

SEQ ID NO: 691164 - RNA, 21 nt, Haemophilus influenzae Rd
acaucgcuugcauuucuucag

SEQ ID NO: 691165 - RNA, 15 nt, Haemophilus influenzae Rd
acaucuugcguuaaa

SEQ ID NO: 691166 - RNA, 21 nt, Haemophilus influenzae Rd
acaucuugcauaaaccaacua

SEQ ID NO: 691167 - RNA, 19 nt, Haemophilus influenzae Rd
accaaaaucguaauuuuaa

SEQ ID NO: 691168 - RNA, 13 nt, Haemophilus influenzae Rd
accaaaauguaau

SEQ ID NO: 691169 - RNA, 20 nt, Haemophilus influenzae Rd
accaaaaugucgccauuuaa

SEQ ID NO: 691170 - RNA, 17 nt, Haemophilus influenzae Rd
accaaaagauccuucca

SEQ ID NO: 691171 - RNA, 17 nt, Haemophilus influenzae Rd
acauuuuuauuuuuacu

SEQ ID NO: 691172 - RNA, 18 nt, Haemophilus influenzae Rd
acauuuugucuaaagagc

SEQ ID NO: 691173 - RNA, 18 nt, Haemophilus influenzae Rd
acauuuuucauuuucgca

SEQ ID NO: 691174 - RNA, 20 nt, Haemophilus influenzae Rd
acauuuuugauugcaccuaa

SEQ ID NO: 691175 - RNA, 13 nt, Haemophilus influenzae Rd
accaacaacgaua

SEQ ID NO: 691176 - RNA, 21 nt, Haemophilus influenzae Rd
accaaauuuuccgcauaaaua

SEQ ID NO: 691177 - RNA, 15 nt, Haemophilus influenzae Rd
accaacaaauucuaa

SEQ ID NO: 691178 - RNA, 16 nt, Haemophilus influenzae Rd
accaacaaauucuaau

SEQ ID NO: 691179 - RNA, 18 nt, Haemophilus influenzae Rd
accaaaugguggcuuuug

SEQ ID NO: 691180 - RNA, 15 nt, Haemophilus influenzae Rd
accaaauuaaaaaua

SEQ ID NO: 691181 - RNA, 14 nt, Haemophilus influenzae Rd
accaaaauuuaaaa

SEQ ID NO: 691182 - RNA, 15 nt, Haemophilus influenzae Rd
accaaacgagaaaau

SEQ ID NO: 691183 - RNA, 16 nt, Haemophilus influenzae Rd
accaaacgagaaaauu

SEQ ID NO: 691184 - RNA, 22 nt, Haemophilus influenzae Rd
acauuguaaagugauugauuug

SEQ ID NO: 691185 - RNA, 15 nt, Haemophilus influenzae Rd
acauuucuaaaauaa

SEQ ID NO: 691186 - RNA, 16 nt, Haemophilus influenzae Rd
acauuucuaaaauaau

SEQ ID NO: 691187 - RNA, 20 nt, Haemophilus influenzae Rd
acauuuccuuuacauuuaaa

SEQ ID NO: 691188 - RNA, 13 nt, Haemophilus influenzae Rd
acauuugacgaau

SEQ ID NO: 691189 - RNA, 22 nt, Haemophilus influenzae Rd
acauuugacgaauggcacgcgc

SEQ ID NO: 691190 - RNA, 16 nt, Haemophilus influenzae Rd
acauuugagaugaaaa

SEQ ID NO: 691191 - RNA, 19 nt, Haemophilus influenzae Rd
acauuuuacuacguaaaga

SEQ ID NO: 691192 - RNA, 20 nt, Haemophilus influenzae Rd
acauuuuacuuuagcaaugc

SEQ ID NO: 691193 - RNA, 15 nt, Haemophilus influenzae Rd
accacacaagcacca

SEQ ID NO: 691194 - RNA, 16 nt, Haemophilus influenzae Rd
accacagccaagguuu

SEQ ID NO: 691195 - RNA, 15 nt, Haemophilus influenzae Rd
accacagcccaaaau

SEQ ID NO: 691196 - RNA, 16 nt, Haemophilus influenzae Rd
accacaauaaaauaau

SEQ ID NO: 691197 - RNA, 17 nt, Haemophilus influenzae Rd
accacaagaugguaauu

SEQ ID NO: 691198 - RNA, 18 nt, Haemophilus influenzae Rd
accacaagaugguaauuu

SEQ ID NO: 691199 - RNA, 22 nt, Haemophilus influenzae Rd
accacaagcugaccacuuucaa

SEQ ID NO: 691200 - RNA, 15 nt, Haemophilus influenzae Rd
accaauuaagcaaua

SEQ ID NO: 691201 - RNA, 14 nt, Haemophilus influenzae Rd
accaaugcaacagg

SEQ ID NO: 691202 - RNA, 14 nt, Haemophilus influenzae Rd
accaaugagaaaaa

SEQ ID NO: 691203 - RNA, 20 nt, Haemophilus influenzae Rd
accaagagccuccacaagca

SEQ ID NO: 691204 - RNA, 12 nt, Haemophilus influenzae Rd
accaagaaauaa

SEQ ID NO: 691205 - RNA, 14 nt, Haemophilus influenzae Rd
accaagaaauaagg

SEQ ID NO: 691206 - RNA, 16 nt, Haemophilus influenzae Rd
accaagccauuuaacu

SEQ ID NO: 691207 - RNA, 20 nt, Haemophilus influenzae Rd
accaagcgcgugugaaauuc

SEQ ID NO: 691208 - RNA, 22 nt, Haemophilus influenzae Rd
accaagcgcgugugaaauuccu

SEQ ID NO: 691209 - RNA, 12 nt, Haemophilus influenzae Rd
accaagcaaugc

SEQ ID NO: 691210 - RNA, 19 nt, Haemophilus influenzae Rd
accaauacgauaauuaaag

SEQ ID NO: 691211 - RNA, 11 nt, Haemophilus influenzae Rd
accaauaccaa

SEQ ID NO: 691212 - RNA, 13 nt, Haemophilus influenzae Rd
accaauaauuaau

SEQ ID NO: 691213 - RNA, 23 nt, Haemophilus influenzae Rd
accaauaauuaaugcuaaaccaa

SEQ ID NO: 691214 - RNA, 17 nt, Haemophilus influenzae Rd
accaauaauugaugcua

SEQ ID NO: 691215 - RNA, 14 nt, Haemophilus influenzae Rd
accagcagaaaaua

SEQ ID NO: 691216 - RNA, 18 nt, Haemophilus influenzae Rd
accacuuucaauuugagu

SEQ ID NO: 691217 - RNA, 20 nt, Haemophilus influenzae Rd
accacuugagccugaaucga

SEQ ID NO: 691218 - RNA, 16 nt, Haemophilus influenzae Rd
accacuugccaaacau

SEQ ID NO: 691219 - RNA, 13 nt, Haemophilus influenzae Rd
accacaucaaauu

SEQ ID NO: 691220 - RNA, 20 nt, Haemophilus influenzae Rd
accaccugaugcuuuaacac

SEQ ID NO: 691221 - RNA, 22 nt, Haemophilus influenzae Rd
accaccugaugcuuuaacacca

SEQ ID NO: 691222 - RNA, 20 nt, Haemophilus influenzae Rd
accacuucauauaaauuagc

SEQ ID NO: 691223 - RNA, 21 nt, Haemophilus influenzae Rd
accacuaaaacacguuugcca

SEQ ID NO: 691224 - RNA, 21 nt, Haemophilus influenzae Rd
accacguuuucaacagugaaa

SEQ ID NO: 691225 - RNA, 14 nt, Haemophilus influenzae Rd
accacguucuuuua

SEQ ID NO: 691226 - RNA, 18 nt, Haemophilus influenzae Rd
accacgcuggaauuuuca

SEQ ID NO: 691227 - RNA, 19 nt, Haemophilus influenzae Rd
accaucuaauacgucuaau

SEQ ID NO: 691228 - RNA, 23 nt, Haemophilus influenzae Rd
accaucuacacggagauauugua

SEQ ID NO: 691229 - RNA, 17 nt, Haemophilus influenzae Rd
accaucccuuuuuacau

SEQ ID NO: 691230 - RNA, 15 nt, Haemophilus influenzae Rd
accauccgaaauuaa

SEQ ID NO: 691231 - RNA, 15 nt, Haemophilus influenzae Rd
acccaucaaaucuuu

SEQ ID NO: 691232 - RNA, 16 nt, Haemophilus influenzae Rd
acccauacuuuaacuu

SEQ ID NO: 691233 - RNA, 12 nt, Haemophilus influenzae Rd
acccauaaaauu

SEQ ID NO: 691234 - RNA, 20 nt, Haemophilus influenzae Rd
acccaggaguaaccacaaaa

SEQ ID NO: 691235 - RNA, 12 nt, Haemophilus influenzae Rd
acccacuaagua

SEQ ID NO: 691236 - RNA, 16 nt, Haemophilus influenzae Rd
acccacuaaguauuaa

SEQ ID NO: 691237 - RNA, 23 nt, Haemophilus influenzae Rd
acccaccgcaaaagccaauaaga

SEQ ID NO: 691238 - RNA, 19 nt, Haemophilus influenzae Rd
acccaaauauuaugguuuu

SEQ ID NO: 691239 - RNA, 18 nt, Haemophilus influenzae Rd
accauuuaauaaaacaaa

SEQ ID NO: 691240 - RNA, 19 nt, Haemophilus influenzae Rd
accauuuaauaaaacaaau

SEQ ID NO: 691241 - RNA, 13 nt, Haemophilus influenzae Rd
accauuuugccca

SEQ ID NO: 691242 - RNA, 21 nt, Haemophilus influenzae Rd
accauuuuuccagcaaaaaaa

SEQ ID NO: 691243 - RNA, 21 nt, Haemophilus influenzae Rd
accauuugguggcuuuuuuau

SEQ ID NO: 691244 - RNA, 14 nt, Haemophilus influenzae Rd
accauuaagcgcaa

SEQ ID NO: 691245 - RNA, 15 nt, Haemophilus influenzae Rd
accauuaauaaauuu

SEQ ID NO: 691246 - RNA, 16 nt, Haemophilus influenzae Rd
accauguaaucacaaa

SEQ ID NO: 691247 - RNA, 13 nt, Haemophilus influenzae Rd
acccguaauuaaa

SEQ ID NO: 691248 - RNA, 15 nt, Haemophilus influenzae Rd
acccguaucaacuaa

SEQ ID NO: 691249 - RNA, 18 nt, Haemophilus influenzae Rd
acccgcuuguuucaauau

SEQ ID NO: 691250 - RNA, 18 nt, Haemophilus influenzae Rd
acccggcacauaaaucau

SEQ ID NO: 691251 - RNA, 16 nt, Haemophilus influenzae Rd
acccgauuauucuuag

SEQ ID NO: 691252 - RNA, 16 nt, Haemophilus influenzae Rd
acccgaaccgauuuua

SEQ ID NO: 691253 - RNA, 19 nt, Haemophilus influenzae Rd
acccgaaccgauuuuaaau

SEQ ID NO: 691254 - RNA, 19 nt, Haemophilus influenzae Rd
acccauuuugauugcuaca

SEQ ID NO: 691255 - RNA, 16 nt, Haemophilus influenzae Rd
acccauuggaagauuu

SEQ ID NO: 691256 - RNA, 15 nt, Haemophilus influenzae Rd
acccauucaaauggu

SEQ ID NO: 691257 - RNA, 19 nt, Haemophilus influenzae Rd
accgaaaaaauaguuuaau

SEQ ID NO: 691258 - RNA, 16 nt, Haemophilus influenzae Rd
accgacucguccauca

SEQ ID NO: 691259 - RNA, 19 nt, Haemophilus influenzae Rd
acccuuguuacaccuuggc

SEQ ID NO: 691260 - RNA, 16 nt, Haemophilus influenzae Rd
acccucaguuaccaua

SEQ ID NO: 691261 - RNA, 22 nt, Haemophilus influenzae Rd
acccucaguuaccauacagccu

SEQ ID NO: 691262 - RNA, 15 nt, Haemophilus influenzae Rd
acccuauuacuuucc

SEQ ID NO: 691263 - RNA, 16 nt, Haemophilus influenzae Rd
acccuacgauacuuuu

SEQ ID NO: 691264 - RNA, 22 nt, Haemophilus influenzae Rd
acccuacgauacuuuuaauuaa

SEQ ID NO: 691265 - RNA, 21 nt, Haemophilus influenzae Rd
acccuacaggcuuccaacaaa

SEQ ID NO: 691266 - RNA, 17 nt, Haemophilus influenzae Rd
accgcgaucuguuuuaa

SEQ ID NO: 691267 - RNA, 15 nt, Haemophilus influenzae Rd
accgcuuucaauuaa

SEQ ID NO: 691268 - RNA, 19 nt, Haemophilus influenzae Rd
accgcuuucaauuaaugaa

SEQ ID NO: 691269 - RNA, 15 nt, Haemophilus influenzae Rd
accgcuauuuuuaau

SEQ ID NO: 691270 - RNA, 19 nt, Haemophilus influenzae Rd
accgcucaacuuaaacaag

SEQ ID NO: 691271 - RNA, 22 nt, Haemophilus influenzae Rd
accgcucaacuuaaacaagcuc

SEQ ID NO: 691272 - RNA, 22 nt, Haemophilus influenzae Rd
accgcuugaauaucuuguuuua

SEQ ID NO: 691273 - RNA, 16 nt, Haemophilus influenzae Rd
accgcuugcaaccauc

SEQ ID NO: 691274 - RNA, 22 nt, Haemophilus influenzae Rd
accgcaucaaaauuauaaacca

SEQ ID NO: 691275 - RNA, 16 nt, Haemophilus influenzae Rd
accgcagcuaauccaa

SEQ ID NO: 691276 - RNA, 14 nt, Haemophilus influenzae Rd
accgcaaaagccaa

SEQ ID NO: 691277 - RNA, 15 nt, Haemophilus influenzae Rd
accgcaaaauuauuu

SEQ ID NO: 691278 - RNA, 17 nt, Haemophilus influenzae Rd
accgcaaucuucacaaa

SEQ ID NO: 691279 - RNA, 18 nt, Haemophilus influenzae Rd
accgcacuuuuuuguuuu

SEQ ID NO: 691280 - RNA, 16 nt, Haemophilus influenzae Rd
accgcacuuuuuuuau

SEQ ID NO: 691281 - RNA, 13 nt, Haemophilus influenzae Rd
accgauagcuuuu

SEQ ID NO: 691282 - RNA, 16 nt, Haemophilus influenzae Rd
aaucauaaaaaaaucu

SEQ ID NO: 691283 - RNA, 13 nt, Haemophilus influenzae Rd
aaucauaaaaaug

SEQ ID NO: 691284 - RNA, 15 nt, Haemophilus influenzae Rd
aaucagugucuuaac

SEQ ID NO: 691285 - RNA, 18 nt, Haemophilus influenzae Rd
aaucagugucuuaacuua

SEQ ID NO: 691286 - RNA, 13 nt, Haemophilus influenzae Rd
aaucauaaaaaaa

SEQ ID NO: 691287 - RNA, 15 nt, Haemophilus influenzae Rd
aaucaucaaacaccc

SEQ ID NO: 691288 - RNA, 21 nt, Haemophilus influenzae Rd
aaucauauuucugcaaauaaa

SEQ ID NO: 691289 - RNA, 20 nt, Haemophilus influenzae Rd
aaucagcccaagcuuuuucu

SEQ ID NO: 691290 - RNA, 18 nt, Haemophilus influenzae Rd
aaucacuucucugacuaa

SEQ ID NO: 691291 - RNA, 20 nt, Haemophilus influenzae Rd
aaucacugaauaaugugcaa

SEQ ID NO: 691292 - RNA, 13 nt, Haemophilus influenzae Rd
aaucacugaauuu

SEQ ID NO: 691293 - RNA, 18 nt, Haemophilus influenzae Rd
aaucagaauagccgcaau

SEQ ID NO: 691294 - RNA, 24 nt, Haemophilus influenzae Rd
aaucagaauagccgcaaucacaaa

SEQ ID NO: 691295 - RNA, 12 nt, Haemophilus influenzae Rd
aaucacuugaag

SEQ ID NO: 691296 - RNA, 19 nt, Haemophilus influenzae Rd
aaucagaacaagcauuuuu

SEQ ID NO: 691297 - RNA, 17 nt, Haemophilus influenzae Rd
aaucacgcucaaucucu

SEQ ID NO: 691298 - RNA, 19 nt, Haemophilus influenzae Rd
aaucacgccagauaaaauu

SEQ ID NO: 691299 - RNA, 14 nt, Haemophilus influenzae Rd
aaucacuagccaua

SEQ ID NO: 691300 - RNA, 15 nt, Haemophilus influenzae Rd
aaucacuaaauuuca

SEQ ID NO: 691301 - RNA, 17 nt, Haemophilus influenzae Rd
aaucacgaucugcaaca

SEQ ID NO: 691302 - RNA, 20 nt, Haemophilus influenzae Rd
aaucaacgcuguacaaagca

SEQ ID NO: 691303 - RNA, 21 nt, Haemophilus influenzae Rd
aaucaacgcuguacaaagcac

SEQ ID NO: 691304 - RNA, 17 nt, Haemophilus influenzae Rd
aaucaagcuaagauuga

SEQ ID NO: 691305 - RNA, 14 nt, Haemophilus influenzae Rd
aaucaagaauucca

SEQ ID NO: 691306 - RNA, 22 nt, Haemophilus influenzae Rd
aaucaagaugacgaaaugaaau

SEQ ID NO: 691307 - RNA, 16 nt, Haemophilus influenzae Rd
aaucaaguuaaaaaau

SEQ ID NO: 691308 - RNA, 21 nt, Haemophilus influenzae Rd
aaucaaguuaaaaaaugauua

SEQ ID NO: 691309 - RNA, 22 nt, Haemophilus influenzae Rd
aaucaaguuaaaaaaugauuaa

SEQ ID NO: 691310 - RNA, 21 nt, Haemophilus influenzae Rd
aaucaauguuuucagcuucaa

SEQ ID NO: 691311 - RNA, 15 nt, Haemophilus influenzae Rd
aaucaaucuuuaaaa

SEQ ID NO: 691312 - RNA, 17 nt, Haemophilus influenzae Rd
aaucaaucuuuaaaacu

SEQ ID NO: 691313 - RNA, 15 nt, Haemophilus influenzae Rd
aaucaauuaaagaaa

SEQ ID NO: 691314 - RNA, 23 nt, Haemophilus influenzae Rd
aaucaauuaaguagauaacaaaa

SEQ ID NO: 691315 - RNA, 14 nt, Haemophilus influenzae Rd
aaucaauuauuuca

SEQ ID NO: 691316 - RNA, 20 nt, Haemophilus influenzae Rd
aaucaauuauuucagcugca

SEQ ID NO: 691317 - RNA, 22 nt, Haemophilus influenzae Rd
aaucaauucaucuugauccaua

SEQ ID NO: 691318 - RNA, 23 nt, Haemophilus influenzae Rd
aaucacaucgccaacuugaauac

SEQ ID NO: 691319 - RNA, 16 nt, Haemophilus influenzae Rd
aaucacauagauuuaa

SEQ ID NO: 691320 - RNA, 18 nt, Haemophilus influenzae Rd
aaucacauagauuuaagc

SEQ ID NO: 691321 - RNA, 19 nt, Haemophilus influenzae Rd
aaucacagccgcauuuuua

SEQ ID NO: 691322 - RNA, 20 nt, Haemophilus influenzae Rd
aaucacagccgcauuuuuac

SEQ ID NO: 691323 - RNA, 18 nt, Haemophilus influenzae Rd
aaucacaaugagacuuaa

SEQ ID NO: 691324 - RNA, 14 nt, Haemophilus influenzae Rd
aaucacacgugcuu

SEQ ID NO: 691325 - RNA, 18 nt, Haemophilus influenzae Rd
aaucacaauuuuuaacgc

SEQ ID NO: 691326 - RNA, 15 nt, Haemophilus influenzae Rd
aaucaauuugaucau

SEQ ID NO: 691327 - RNA, 12 nt, Haemophilus influenzae Rd
aaucaauuuuuu

SEQ ID NO: 691328 - RNA, 15 nt, Haemophilus influenzae Rd
aaucaauuuuuucuc

SEQ ID NO: 691329 - RNA, 21 nt, Haemophilus influenzae Rd
aaucacaaaauggcaaacaaa

SEQ ID NO: 691330 - RNA, 14 nt, Haemophilus influenzae Rd
aaucacaaauauua

SEQ ID NO: 691331 - RNA, 15 nt, Haemophilus influenzae Rd
aaucacaaauccaua

SEQ ID NO: 691332 - RNA, 15 nt, Haemophilus influenzae Rd
aaucacaacacaauc

SEQ ID NO: 691333 - RNA, 16 nt, Haemophilus influenzae Rd
aaucacaacuugacca

SEQ ID NO: 691334 - RNA, 22 nt, Haemophilus influenzae Rd
aauauugccauaauaaucacaa

SEQ ID NO: 691335 - RNA, 16 nt, Haemophilus influenzae Rd
aauauugcggacaaua

SEQ ID NO: 691336 - RNA, 22 nt, Haemophilus influenzae Rd
aauauugauguuuguaggaaau

SEQ ID NO: 691337 - RNA, 21 nt, Haemophilus influenzae Rd
aauauugauuauguaaacuuc

SEQ ID NO: 691338 - RNA, 23 nt, Haemophilus influenzae Rd
aauauugauuauguaaacuucca

SEQ ID NO: 691339 - RNA, 22 nt, Haemophilus influenzae Rd
aauauugcucucccuugcccag

SEQ ID NO: 691340 - RNA, 20 nt, Haemophilus influenzae Rd
aauauugguagcuaaaaaua

SEQ ID NO: 691341 - RNA, 21 nt, Haemophilus influenzae Rd
aauauugguagcuaaaaauaa

SEQ ID NO: 691342 - RNA, 15 nt, Haemophilus influenzae Rd
aauauuuaaaaagaa

SEQ ID NO: 691343 - RNA, 22 nt, Haemophilus influenzae Rd
aauauuuaaaaagaauauucca

SEQ ID NO: 691344 - RNA, 20 nt, Haemophilus influenzae Rd
aauauuuaggcuauuuuaua

SEQ ID NO: 691345 - RNA, 18 nt, Haemophilus influenzae Rd
aauauuuacgacuaaaau

SEQ ID NO: 691346 - RNA, 22 nt, Haemophilus influenzae Rd
aauauuuacgacuaaaauuaga

SEQ ID NO: 691347 - RNA, 15 nt, Haemophilus influenzae Rd
aauauuuaauauauu

SEQ ID NO: 691348 - RNA, 19 nt, Haemophilus influenzae Rd
aauauucgccuaauugcug

SEQ ID NO: 691349 - RNA, 16 nt, Haemophilus influenzae Rd
aauauucuuuuuaaau

SEQ ID NO: 691350 - RNA, 21 nt, Haemophilus influenzae Rd
aauauucugcauuaaauucau

SEQ ID NO: 691351 - RNA, 17 nt, Haemophilus influenzae Rd
aauauucuucauaaaaa

SEQ ID NO: 691352 - RNA, 17 nt, Haemophilus influenzae Rd
aauauucuuuaaaacau

SEQ ID NO: 691353 - RNA, 16 nt, Haemophilus influenzae Rd
aauauucuuuaaauau

SEQ ID NO: 691354 - RNA, 22 nt, Haemophilus influenzae Rd
aauauugaccguuugaccauuc

SEQ ID NO: 691355 - RNA, 12 nt, Haemophilus influenzae Rd
aauauugagcaa

SEQ ID NO: 691356 - RNA, 13 nt, Haemophilus influenzae Rd
aauauuccaaaaa

SEQ ID NO: 691357 - RNA, 15 nt, Haemophilus influenzae Rd
aauauuccaaaaaau

SEQ ID NO: 691358 - RNA, 16 nt, Haemophilus influenzae Rd
aauauuccaaaaaaua

SEQ ID NO: 691359 - RNA, 16 nt, Haemophilus influenzae Rd
aauauucgcuucuuuu

SEQ ID NO: 691360 - RNA, 23 nt, Haemophilus influenzae Rd
aauauucgcuucuuuuaaugggg

SEQ ID NO: 691361 - RNA, 16 nt, Haemophilus influenzae Rd
aauaugauguggcuuu

SEQ ID NO: 691362 - RNA, 24 nt, Haemophilus influenzae Rd
aauaugauuagucuacaagaaacc

SEQ ID NO: 691363 - RNA, 22 nt, Haemophilus influenzae Rd
aauaugauucugugcaauauuu

SEQ ID NO: 691364 - RNA, 19 nt, Haemophilus influenzae Rd
aauaugauuucuucaaagc

SEQ ID NO: 691365 - RNA, 23 nt, Haemophilus influenzae Rd
aauaugcaaagguaauugccaau

SEQ ID NO: 691366 - RNA, 23 nt, Haemophilus influenzae Rd
aauaugaaucguugaucagcaau

SEQ ID NO: 691367 - RNA, 18 nt, Haemophilus influenzae Rd
aauaugauaaaugcaaua

SEQ ID NO: 691368 - RNA, 21 nt, Haemophilus influenzae Rd
aauauuaagcaauugaauaaa

SEQ ID NO: 691369 - RNA, 13 nt, Haemophilus influenzae Rd
aauauuauuaagu

SEQ ID NO: 691370 - RNA, 21 nt, Haemophilus influenzae Rd
aauauuaguuagcuaaaaaaa

SEQ ID NO: 691371 - RNA, 15 nt, Haemophilus influenzae Rd
aaucaaaagaaauua

SEQ ID NO: 691372 - RNA, 14 nt, Haemophilus influenzae Rd
aaucaaaauagcuu

SEQ ID NO: 691373 - RNA, 15 nt, Haemophilus influenzae Rd
aaucaaaauagcuuu

SEQ ID NO: 691374 - RNA, 15 nt, Haemophilus influenzae Rd
aaucaaaaaugcuuu

SEQ ID NO: 691375 - RNA, 23 nt, Haemophilus influenzae Rd
aaucaaaaaugcuuuugccgaaa

SEQ ID NO: 691376 - RNA, 11 nt, Haemophilus influenzae Rd
aaucaaacaac

SEQ ID NO: 691377 - RNA, 13 nt, Haemophilus influenzae Rd
aaucaaaccaaua

SEQ ID NO: 691378 - RNA, 15 nt, Haemophilus influenzae Rd
aaucaaauuuuccuu

SEQ ID NO: 691379 - RNA, 14 nt, Haemophilus influenzae Rd
aaucaaauugauca

SEQ ID NO: 691380 - RNA, 12 nt, Haemophilus influenzae Rd
aaucaaauaaaa

SEQ ID NO: 691381 - RNA, 22 nt, Haemophilus influenzae Rd
aaucaaauaaaauauuuuuuau

SEQ ID NO: 691382 - RNA, 17 nt, Haemophilus influenzae Rd
aaucaacaauuucugca

SEQ ID NO: 691383 - RNA, 23 nt, Haemophilus influenzae Rd
aaucaacacaccuauuuuuuccu

SEQ ID NO: 691384 - RNA, 23 nt, Haemophilus influenzae Rd
aauauuuauuucuauagauuuau

SEQ ID NO: 691385 - RNA, 19 nt, Haemophilus influenzae Rd
aauauuuauuugaaacaau

SEQ ID NO: 691386 - RNA, 18 nt, Haemophilus influenzae Rd
aauauuucacuauucagc

SEQ ID NO: 691387 - RNA, 13 nt, Haemophilus influenzae Rd
aauauuucaguau

SEQ ID NO: 691388 - RNA, 16 nt, Haemophilus influenzae Rd
aauauuugacgaaaua

SEQ ID NO: 691389 - RNA, 21 nt, Haemophilus influenzae Rd
aauauuuccucuaaauaaaaa

SEQ ID NO: 691390 - RNA, 14 nt, Haemophilus influenzae Rd
aauauuuuaauaaa

SEQ ID NO: 691391 - RNA, 18 nt, Haemophilus influenzae Rd
aauauuuuaaugaaagua

SEQ ID NO: 691392 - RNA, 21 nt, Haemophilus influenzae Rd
aauauuuuagcaagugcgcca

SEQ ID NO: 691393 - RNA, 14 nt, Haemophilus influenzae Rd
aauauuuucaaaua

SEQ ID NO: 691394 - RNA, 22 nt, Haemophilus influenzae Rd
aauauuuucaaauaaguuugau

SEQ ID NO: 691395 - RNA, 16 nt, Haemophilus influenzae Rd
aauauuuuguugaaga

SEQ ID NO: 691396 - RNA, 18 nt, Haemophilus influenzae Rd
aauauuuuguugaagaaa

SEQ ID NO: 691397 - RNA, 14 nt, Haemophilus influenzae Rd
aauauuuucuuuua

SEQ ID NO: 691398 - RNA, 18 nt, Haemophilus influenzae Rd
aauauuuuccccuuucca

SEQ ID NO: 691399 - RNA, 20 nt, Haemophilus influenzae Rd
aauauuuuugccaauuuuuu

SEQ ID NO: 691400 - RNA, 21 nt, Haemophilus influenzae Rd
aauauuuuuuugcuuuucccu

SEQ ID NO: 691401 - RNA, 22 nt, Haemophilus influenzae Rd
aauauuuuuuugcuuuucccuu

SEQ ID NO: 691402 - RNA, 17 nt, Haemophilus influenzae Rd
aauaucguaaaaaauua

SEQ ID NO: 691403 - RNA, 19 nt, Haemophilus influenzae Rd
aauaucuuccguuuuuuuc

SEQ ID NO: 691404 - RNA, 14 nt, Haemophilus influenzae Rd
aauaucuuucucuu

SEQ ID NO: 691405 - RNA, 16 nt, Haemophilus influenzae Rd
aauaucuuucucuugc

SEQ ID NO: 691406 - RNA, 15 nt, Haemophilus influenzae Rd
aauaucuuugacuaa

SEQ ID NO: 691407 - RNA, 14 nt, Haemophilus influenzae Rd
aauaugaaauuucu

SEQ ID NO: 691408 - RNA, 17 nt, Haemophilus influenzae Rd
aauaugaaauuucuuua

SEQ ID NO: 691409 - RNA, 22 nt, Haemophilus influenzae Rd
aauaucacuucuguaagcagcu

SEQ ID NO: 691410 - RNA, 17 nt, Haemophilus influenzae Rd
aauaucacgccuuuuuu

SEQ ID NO: 691411 - RNA, 15 nt, Haemophilus influenzae Rd
aauaucaagucaaaa

SEQ ID NO: 691412 - RNA, 18 nt, Haemophilus influenzae Rd
aauaucaagucaaaaacc

SEQ ID NO: 691413 - RNA, 14 nt, Haemophilus influenzae Rd
aauaucaaucacuu

SEQ ID NO: 691414 - RNA, 19 nt, Haemophilus influenzae Rd
aauaucaaugcucucuuuu

SEQ ID NO: 691415 - RNA, 16 nt, Haemophilus influenzae Rd
aauauaagugauuaaa

SEQ ID NO: 691416 - RNA, 15 nt, Haemophilus influenzae Rd
aauauaaagauaauu

SEQ ID NO: 691417 - RNA, 15 nt, Haemophilus influenzae Rd
aauauaaauaaaaca

SEQ ID NO: 691418 - RNA, 16 nt, Haemophilus influenzae Rd
aauauaaauaaaacaa

SEQ ID NO: 691419 - RNA, 13 nt, Haemophilus influenzae Rd
aauauaaauggaa

SEQ ID NO: 691420 - RNA, 19 nt, Haemophilus influenzae Rd
aauauaaauggaaaccauu

SEQ ID NO: 691421 - RNA, 21 nt, Haemophilus influenzae Rd
aauauaaauggaaaccauuga

SEQ ID NO: 691422 - RNA, 12 nt, Haemophilus influenzae Rd
aauauaaauuau

SEQ ID NO: 691423 - RNA, 16 nt, Haemophilus influenzae Rd
aauauaaauuauguua

SEQ ID NO: 691424 - RNA, 17 nt, Haemophilus influenzae Rd
aauauaaacugacagaa

SEQ ID NO: 691425 - RNA, 12 nt, Haemophilus influenzae Rd
aauauaaaaaau

SEQ ID NO: 691426 - RNA, 13 nt, Haemophilus influenzae Rd
aauauauucugcu

SEQ ID NO: 691427 - RNA, 23 nt, Haemophilus influenzae Rd
aauauauucacgcuaaggcaaaa

SEQ ID NO: 691428 - RNA, 17 nt, Haemophilus influenzae Rd
aauauaugguucauuau

SEQ ID NO: 691429 - RNA, 19 nt, Haemophilus influenzae Rd
aauauauuaauuauuuuag

SEQ ID NO: 691430 - RNA, 12 nt, Haemophilus influenzae Rd
aauaucaaaauu

SEQ ID NO: 691431 - RNA, 15 nt, Haemophilus influenzae Rd
aauaucaaaauuaug

SEQ ID NO: 691432 - RNA, 12 nt, Haemophilus influenzae Rd
aauaucaaagaa

SEQ ID NO: 691433 - RNA, 14 nt, Haemophilus influenzae Rd
aauaucaaagaaaa

SEQ ID NO: 691434 - RNA, 19 nt, Haemophilus influenzae Rd
aauauauuucuaauaaagu

SEQ ID NO: 691435 - RNA, 20 nt, Haemophilus influenzae Rd
aauauauuucuuuucaaaca

SEQ ID NO: 691436 - RNA, 16 nt, Haemophilus influenzae Rd
aauaucaaaaaaauuu

SEQ ID NO: 691437 - RNA, 22 nt, Haemophilus influenzae Rd
aauagcuacgguuauuuuuuuc

SEQ ID NO: 691438 - RNA, 16 nt, Haemophilus influenzae Rd
aauagcuaacaaauuu

SEQ ID NO: 691439 - RNA, 15 nt, Haemophilus influenzae Rd
aauagaguaccaaaa

SEQ ID NO: 691440 - RNA, 14 nt, Haemophilus influenzae Rd
aauagacucuugca

SEQ ID NO: 691441 - RNA, 18 nt, Haemophilus influenzae Rd
aauagacauagaaaguuu

SEQ ID NO: 691442 - RNA, 21 nt, Haemophilus influenzae Rd
aauagaauuggugcgucuuuu

SEQ ID NO: 691443 - RNA, 20 nt, Haemophilus influenzae Rd
aauagaauuuugcaagccaa

SEQ ID NO: 691444 - RNA, 18 nt, Haemophilus influenzae Rd
aauagacuuaauaauaua

SEQ ID NO: 691445 - RNA, 17 nt, Haemophilus influenzae Rd
aauagagcaaauauaaa

SEQ ID NO: 691446 - RNA, 18 nt, Haemophilus influenzae Rd
aauagcuguaagauaaac

SEQ ID NO: 691447 - RNA, 12 nt, Haemophilus influenzae Rd
aauagcugauaa

SEQ ID NO: 691448 - RNA, 21 nt, Haemophilus influenzae Rd
aauagcuuccgcuuuuuucgc

SEQ ID NO: 691449 - RNA, 20 nt, Haemophilus influenzae Rd
aauaggaguaaaaauauuau

SEQ ID NO: 691450 - RNA, 18 nt, Haemophilus influenzae Rd
aauaggaagcauuucuaa

SEQ ID NO: 691451 - RNA, 14 nt, Haemophilus influenzae Rd
aauagcuucuuuua

SEQ ID NO: 691452 - RNA, 14 nt, Haemophilus influenzae Rd
aauaguaaagaaua

SEQ ID NO: 691453 - RNA, 14 nt, Haemophilus influenzae Rd
aauagguugcaaau

SEQ ID NO: 691454 - RNA, 22 nt, Haemophilus influenzae Rd
aauaguuguuugugaaguuuau

SEQ ID NO: 691455 - RNA, 15 nt, Haemophilus influenzae Rd
aauaguugaaauuug

SEQ ID NO: 691456 - RNA, 21 nt, Haemophilus influenzae Rd
aauaguuuucacaaucgccaa

SEQ ID NO: 691457 - RNA, 16 nt, Haemophilus influenzae Rd
aauagucauaaaggcu

SEQ ID NO: 691458 - RNA, 18 nt, Haemophilus influenzae Rd
aauaguaucagcuguugc

SEQ ID NO: 691459 - RNA, 20 nt, Haemophilus influenzae Rd
aauaguaucagcuguugcaa

SEQ ID NO: 691460 - RNA, 23 nt, Haemophilus influenzae Rd
aauacguuguuguucuuuccauu

SEQ ID NO: 691461 - RNA, 20 nt, Haemophilus influenzae Rd
aauacgucuaauuuagucau

SEQ ID NO: 691462 - RNA, 17 nt, Haemophilus influenzae Rd
aauacgucaauugcuaa

SEQ ID NO: 691463 - RNA, 22 nt, Haemophilus influenzae Rd
aauacguaaucccauuucaucu

SEQ ID NO: 691464 - RNA, 14 nt, Haemophilus influenzae Rd
aauacgaucugcau

SEQ ID NO: 691465 - RNA, 15 nt, Haemophilus influenzae Rd
aauacgaucugcauc

SEQ ID NO: 691466 - RNA, 17 nt, Haemophilus influenzae Rd
aauacgauaauuaaagu

SEQ ID NO: 691467 - RNA, 20 nt, Haemophilus influenzae Rd
aauacgauaauuaaagucag

SEQ ID NO: 691468 - RNA, 22 nt, Haemophilus influenzae Rd
aauacgaugauaagcccgaaca

SEQ ID NO: 691469 - RNA, 23 nt, Haemophilus influenzae Rd
aauacgaugauaagcccgaacag

SEQ ID NO: 691470 - RNA, 17 nt, Haemophilus influenzae Rd
aauacgagcugauuuac

SEQ ID NO: 691471 - RNA, 17 nt, Haemophilus influenzae Rd
aauacgacaucugguuu

SEQ ID NO: 691472 - RNA, 19 nt, Haemophilus influenzae Rd
aauacuguuuuaugcuaaa

SEQ ID NO: 691473 - RNA, 11 nt, Haemophilus influenzae Rd
aauacuuagcg

SEQ ID NO: 691474 - RNA, 21 nt, Haemophilus influenzae Rd
aauacuuggugcaauaaaauc

SEQ ID NO: 691475 - RNA, 14 nt, Haemophilus influenzae Rd
aauacguuuaauau

SEQ ID NO: 691476 - RNA, 14 nt, Haemophilus influenzae Rd
aauacuaacuggaa

SEQ ID NO: 691477 - RNA, 20 nt, Haemophilus influenzae Rd
aauacucacaagucuguaau

SEQ ID NO: 691478 - RNA, 15 nt, Haemophilus influenzae Rd
aauacucacagagcc

SEQ ID NO: 691479 - RNA, 18 nt, Haemophilus influenzae Rd
aauacucacagagccuuu

SEQ ID NO: 691480 - RNA, 20 nt, Haemophilus influenzae Rd
aauacuagcucguaaagauc

SEQ ID NO: 691481 - RNA, 15 nt, Haemophilus influenzae Rd
aauacauauuuuuag

SEQ ID NO: 691482 - RNA, 21 nt, Haemophilus influenzae Rd
aauacauaauuaaauuaagga

SEQ ID NO: 691483 - RNA, 16 nt, Haemophilus influenzae Rd
aauacauuauuaaaag

SEQ ID NO: 691484 - RNA, 17 nt, Haemophilus influenzae Rd
aauacauuauuaaaagc

SEQ ID NO: 691485 - RNA, 15 nt, Haemophilus influenzae Rd
aauacauuuucauaa

SEQ ID NO: 691486 - RNA, 19 nt, Haemophilus influenzae Rd
aauacaucuucacaaaaca

SEQ ID NO: 691487 - RNA, 22 nt, Haemophilus influenzae Rd
aauacauaaagaauaauuuuca

SEQ ID NO: 691488 - RNA, 21 nt, Haemophilus influenzae Rd
aauacacuuuaaauuuuccug

SEQ ID NO: 691489 - RNA, 17 nt, Haemophilus influenzae Rd
aauacacuucuaaaaua

SEQ ID NO: 691490 - RNA, 16 nt, Haemophilus influenzae Rd
aauacaauuuucuuuu

SEQ ID NO: 691491 - RNA, 20 nt, Haemophilus influenzae Rd
aauacaauuuuuuucaagca

SEQ ID NO: 691492 - RNA, 17 nt, Haemophilus influenzae Rd
aauacaccaauaauuaa

SEQ ID NO: 691493 - RNA, 18 nt, Haemophilus influenzae Rd
aauacaccaauaauuaaa

SEQ ID NO: 691494 - RNA, 20 nt, Haemophilus influenzae Rd
aauacaccaauaauuaaaca

SEQ ID NO: 691495 - RNA, 16 nt, Haemophilus influenzae Rd
aauacaagaccaauau

SEQ ID NO: 691496 - RNA, 13 nt, Haemophilus influenzae Rd
aauaaagcuugaa

SEQ ID NO: 691497 - RNA, 17 nt, Haemophilus influenzae Rd
aauacaaauacugaccu

SEQ ID NO: 691498 - RNA, 16 nt, Haemophilus influenzae Rd
aauaaagcuccuugaa

SEQ ID NO: 691499 - RNA, 11 nt, Haemophilus influenzae Rd
aauaaagauag

SEQ ID NO: 691500 - RNA, 13 nt, Haemophilus influenzae Rd
aauacaaagcacu

SEQ ID NO: 691501 - RNA, 20 nt, Haemophilus influenzae Rd
aauaaagugcggucaauuuu

SEQ ID NO: 691502 - RNA, 15 nt, Haemophilus influenzae Rd
aauaaaggauuaaau

SEQ ID NO: 691503 - RNA, 17 nt, Haemophilus influenzae Rd
aauaaaggauuaaauaa

SEQ ID NO: 691504 - RNA, 18 nt, Haemophilus influenzae Rd
aauaaaggauuaaauaac

SEQ ID NO: 691505 - RNA, 20 nt, Haemophilus influenzae Rd
aauaaagggcgguuaaaaau

SEQ ID NO: 691506 - RNA, 11 nt, Haemophilus influenzae Rd
aauaaaguaaa

SEQ ID NO: 691507 - RNA, 12 nt, Haemophilus influenzae Rd
aauaaaguaaaa

SEQ ID NO: 691508 - RNA, 14 nt, Haemophilus influenzae Rd
aauaaaguaaaaua

SEQ ID NO: 691509 - RNA, 15 nt, Haemophilus influenzae Rd
aauaaaguaaaauau

SEQ ID NO: 691510 - RNA, 16 nt, Haemophilus influenzae Rd
aauaaaguaaaauauu

SEQ ID NO: 691511 - RNA, 13 nt, Haemophilus influenzae Rd
aaucuuuaccaaa

SEQ ID NO: 691512 - RNA, 17 nt, Haemophilus influenzae Rd
aaucuuuaccaaaaaau

SEQ ID NO: 691513 - RNA, 20 nt, Haemophilus influenzae Rd
aaucuuuaccuuguaaacuu

SEQ ID NO: 691514 - RNA, 23 nt, Haemophilus influenzae Rd
aaucuuuaaguguuguuccaccu

SEQ ID NO: 691515 - RNA, 21 nt, Haemophilus influenzae Rd
aaucuuuaaaacuauaaaaau

SEQ ID NO: 691516 - RNA, 17 nt, Haemophilus influenzae Rd
aaucuuuaaauuuugcu

SEQ ID NO: 691517 - RNA, 17 nt, Haemophilus influenzae Rd
aaucuuggugccaaucc

SEQ ID NO: 691518 - RNA, 22 nt, Haemophilus influenzae Rd
aaucuugguuuaaauuuuaaaa

SEQ ID NO: 691519 - RNA, 19 nt, Haemophilus influenzae Rd
aaucuuggcucauuuuaaa

SEQ ID NO: 691520 - RNA, 22 nt, Haemophilus influenzae Rd
aaucuuucgauucgccuugcuu

SEQ ID NO: 691521 - RNA, 21 nt, Haemophilus influenzae Rd
aaugaaguuagaaacagaagu

SEQ ID NO: 691522 - RNA, 21 nt, Haemophilus influenzae Rd
aaugacagucgauuacaaaaa

SEQ ID NO: 691523 - RNA, 22 nt, Haemophilus influenzae Rd
aaugacagucgauuacaaaaac

SEQ ID NO: 691524 - RNA, 15 nt, Haemophilus influenzae Rd
aaugacagaaacaaa

SEQ ID NO: 691525 - RNA, 18 nt, Haemophilus influenzae Rd
aaugacagaaacaaaucc

SEQ ID NO: 691526 - RNA, 21 nt, Haemophilus influenzae Rd
aaugacagaaucuaaagaaaa

SEQ ID NO: 691527 - RNA, 15 nt, Haemophilus influenzae Rd
aaugaagugaaagau

SEQ ID NO: 691528 - RNA, 21 nt, Haemophilus influenzae Rd
aaugaagugaaagauaaauua

SEQ ID NO: 691529 - RNA, 19 nt, Haemophilus influenzae Rd
aaugaaguaauaaucuucu

SEQ ID NO: 691530 - RNA, 18 nt, Haemophilus influenzae Rd
aaucugcauucuaaaagu

SEQ ID NO: 691531 - RNA, 20 nt, Haemophilus influenzae Rd
aaucugcauucuaaaaguuu

SEQ ID NO: 691532 - RNA, 15 nt, Haemophilus influenzae Rd
aaucugcacuuuaau

SEQ ID NO: 691533 - RNA, 17 nt, Haemophilus influenzae Rd
aaucugcacuuuaauuc

SEQ ID NO: 691534 - RNA, 20 nt, Haemophilus influenzae Rd
aaucugaugggaauucauaa

SEQ ID NO: 691535 - RNA, 14 nt, Haemophilus influenzae Rd
aaucugcuguugca

SEQ ID NO: 691536 - RNA, 18 nt, Haemophilus influenzae Rd
aaucugcuguugcagcug

SEQ ID NO: 691537 - RNA, 20 nt, Haemophilus influenzae Rd
aaucugcuguugcagcugga

SEQ ID NO: 691538 - RNA, 15 nt, Haemophilus influenzae Rd
aaucuucuucuuuuu

SEQ ID NO: 691539 - RNA, 13 nt, Haemophilus influenzae Rd
aaucuucuuccca

SEQ ID NO: 691540 - RNA, 19 nt, Haemophilus influenzae Rd
aaucuugaacgcaaauacc

SEQ ID NO: 691541 - RNA, 14 nt, Haemophilus influenzae Rd
aaucuucacaaaua

SEQ ID NO: 691542 - RNA, 21 nt, Haemophilus influenzae Rd
aaucuucagcaguuuggcaag

SEQ ID NO: 691543 - RNA, 12 nt, Haemophilus influenzae Rd
aaucuucauacu

SEQ ID NO: 691544 - RNA, 17 nt, Haemophilus influenzae Rd
aaucuucuaauuugcca

SEQ ID NO: 691545 - RNA, 10 nt, Haemophilus influenzae Rd
aaugauaauc

SEQ ID NO: 691546 - RNA, 19 nt, Haemophilus influenzae Rd
aaugauaaauuuuauucca

SEQ ID NO: 691547 - RNA, 19 nt, Haemophilus influenzae Rd
aaugaguguuauugaugaa

SEQ ID NO: 691548 - RNA, 22 nt, Haemophilus influenzae Rd
aaugaguguuauugaugaagau

SEQ ID NO: 691549 - RNA, 13 nt, Haemophilus influenzae Rd
aaugauaaaaauc

SEQ ID NO: 691550 - RNA, 17 nt, Haemophilus influenzae Rd
aaugagaaaaagucgcu

SEQ ID NO: 691551 - RNA, 17 nt, Haemophilus influenzae Rd
aaugagguauaaaaugg

SEQ ID NO: 691552 - RNA, 22 nt, Haemophilus influenzae Rd
aaugacuggcuugugaaauaaa

SEQ ID NO: 691553 - RNA, 12 nt, Haemophilus influenzae Rd
aaugacuuucac

SEQ ID NO: 691554 - RNA, 14 nt, Haemophilus influenzae Rd
aaugacuuucacua

SEQ ID NO: 691555 - RNA, 21 nt, Haemophilus influenzae Rd
aaugacauuaaagcaauugcu

SEQ ID NO: 691556 - RNA, 23 nt, Haemophilus influenzae Rd
aaugacauuaaagcaauugcuaa

SEQ ID NO: 691557 - RNA, 18 nt, Haemophilus influenzae Rd
aaugauucaauuugaccu

SEQ ID NO: 691558 - RNA, 20 nt, Haemophilus influenzae Rd
aaugauuaaccauuaauaaa

SEQ ID NO: 691559 - RNA, 14 nt, Haemophilus influenzae Rd
aaugauuaauuaaa

SEQ ID NO: 691560 - RNA, 16 nt, Haemophilus influenzae Rd
aaugauuagaaguaaa

SEQ ID NO: 691561 - RNA, 20 nt, Haemophilus influenzae Rd
aaugauuauccacuaaaaaa

SEQ ID NO: 691562 - RNA, 13 nt, Haemophilus influenzae Rd
aaugcacauaaca

SEQ ID NO: 691563 - RNA, 20 nt, Haemophilus influenzae Rd
aaugcaauauuauucagcac

SEQ ID NO: 691564 - RNA, 16 nt, Haemophilus influenzae Rd
aaugcaauauucaccc

SEQ ID NO: 691565 - RNA, 15 nt, Haemophilus influenzae Rd
aaugcaagcaccgcu

SEQ ID NO: 691566 - RNA, 19 nt, Haemophilus influenzae Rd
aaugauugagcgauagaaa

SEQ ID NO: 691567 - RNA, 23 nt, Haemophilus influenzae Rd
aaugauugagcgauagaaauaaa

SEQ ID NO: 691568 - RNA, 15 nt, Haemophilus influenzae Rd
aaugauaccuuguua

SEQ ID NO: 691569 - RNA, 17 nt, Haemophilus influenzae Rd
aaugauguaccaaaaug

SEQ ID NO: 691570 - RNA, 17 nt, Haemophilus influenzae Rd
aaugauguaggcaaaaa

SEQ ID NO: 691571 - RNA, 20 nt, Haemophilus influenzae Rd
aaugauguaggcaaaaacac

SEQ ID NO: 691572 - RNA, 21 nt, Haemophilus influenzae Rd
aaugauguaggcaaaaacacu

SEQ ID NO: 691573 - RNA, 22 nt, Haemophilus influenzae Rd
aaugaucaaaucaaauuuuccu

SEQ ID NO: 691574 - RNA, 16 nt, Haemophilus influenzae Rd
aaucucuucuaaaaau

SEQ ID NO: 691575 - RNA, 16 nt, Haemophilus influenzae Rd
aaucugaguauguugu

SEQ ID NO: 691576 - RNA, 19 nt, Haemophilus influenzae Rd
aaucugauacgaauguuug

SEQ ID NO: 691577 - RNA, 16 nt, Haemophilus influenzae Rd
aaucugauugagaaaa

SEQ ID NO: 691578 - RNA, 15 nt, Haemophilus influenzae Rd
aaucugaauuuccau

SEQ ID NO: 691579 - RNA, 17 nt, Haemophilus influenzae Rd
aaucucuaccacaguca

SEQ ID NO: 691580 - RNA, 13 nt, Haemophilus influenzae Rd
aaucucucaaaaa

SEQ ID NO: 691581 - RNA, 17 nt, Haemophilus influenzae Rd
aaucucaaaaucagcaa

SEQ ID NO: 691582 - RNA, 21 nt, Haemophilus influenzae Rd
aaucuaaucgggcuuuaucau

SEQ ID NO: 691583 - RNA, 12 nt, Haemophilus influenzae Rd
aaucuaaaaaac

SEQ ID NO: 691584 - RNA, 13 nt, Haemophilus influenzae Rd
aaucuaaaaaacc

SEQ ID NO: 691585 - RNA, 14 nt, Haemophilus influenzae Rd
aaucuaaaaaaccu

SEQ ID NO: 691586 - RNA, 15 nt, Haemophilus influenzae Rd
aaucuaaaacuauau

SEQ ID NO: 691587 - RNA, 20 nt, Haemophilus influenzae Rd
aaucguuuguucugacacuu

SEQ ID NO: 691588 - RNA, 16 nt, Haemophilus influenzae Rd
aaucguuuguaaaagu

SEQ ID NO: 691589 - RNA, 17 nt, Haemophilus influenzae Rd
aaucuaauccuaaaaug

SEQ ID NO: 691590 - RNA, 13 nt, Haemophilus influenzae Rd
aaucuaaagcgau

SEQ ID NO: 691591 - RNA, 16 nt, Haemophilus influenzae Rd
aaucuaaaaauaugua

SEQ ID NO: 691592 - RNA, 12 nt, Haemophilus influenzae Rd
aaucuaaaccag

SEQ ID NO: 691593 - RNA, 17 nt, Haemophilus influenzae Rd
aaucuaaacuuguuaaa

SEQ ID NO: 691594 - RNA, 22 nt, Haemophilus influenzae Rd
aauccuuuuguuuuaucagaau

SEQ ID NO: 691595 - RNA, 23 nt, Haemophilus influenzae Rd
aauccuuuuguuuuaucagaaug

SEQ ID NO: 691596 - RNA, 14 nt, Haemophilus influenzae Rd
aaucgaaauuaaaa

SEQ ID NO: 691597 - RNA, 17 nt, Haemophilus influenzae Rd
aaucgaaauuaaaauaa

SEQ ID NO: 691598 - RNA, 21 nt, Haemophilus influenzae Rd
aaucgaacacuguaaauaaac

SEQ ID NO: 691599 - RNA, 22 nt, Haemophilus influenzae Rd
aaucaucauuuauuaaaaguaa

SEQ ID NO: 691600 - RNA, 22 nt, Haemophilus influenzae Rd
aaucaucgaaaucuaauuugcu

SEQ ID NO: 691601 - RNA, 20 nt, Haemophilus influenzae Rd
aaucaucccuguauaaagau

SEQ ID NO: 691602 - RNA, 15 nt, Haemophilus influenzae Rd
aaucggauguuugaa

SEQ ID NO: 691603 - RNA, 23 nt, Haemophilus influenzae Rd
aaucgugaguuugugcaagcaca

SEQ ID NO: 691604 - RNA, 20 nt, Haemophilus influenzae Rd
aaucgcaucauucaaugcaa

SEQ ID NO: 691605 - RNA, 20 nt, Haemophilus influenzae Rd
aaucgcacucacaauaccaa

SEQ ID NO: 691606 - RNA, 15 nt, Haemophilus influenzae Rd
aaucgcacuuaaaaa

SEQ ID NO: 691607 - RNA, 16 nt, Haemophilus influenzae Rd
aaucgcacuuaaaaga

SEQ ID NO: 691608 - RNA, 16 nt, Haemophilus influenzae Rd
aaucgcuugcgguuca

SEQ ID NO: 691609 - RNA, 20 nt, Haemophilus influenzae Rd
aaucgcaaagaauuugccug

SEQ ID NO: 691610 - RNA, 18 nt, Haemophilus influenzae Rd
aaucgaucacuuaauaaa

SEQ ID NO: 691611 - RNA, 15 nt, Haemophilus influenzae Rd
aauggcaauuuuaua

SEQ ID NO: 691612 - RNA, 17 nt, Haemophilus influenzae Rd
aauggcaaucacaguuu

SEQ ID NO: 691613 - RNA, 14 nt, Haemophilus influenzae Rd
aauggcaaaauuuu

SEQ ID NO: 691614 - RNA, 15 nt, Haemophilus influenzae Rd
aauggcaaacaaaau

SEQ ID NO: 691615 - RNA, 23 nt, Haemophilus influenzae Rd
aauggcaaacaaaauaaaugaug

SEQ ID NO: 691616 - RNA, 21 nt, Haemophilus influenzae Rd
aauggcgucugcaauuagaaa

SEQ ID NO: 691617 - RNA, 19 nt, Haemophilus influenzae Rd
aauggcgugccauuacaag

SEQ ID NO: 691618 - RNA, 20 nt, Haemophilus influenzae Rd
aauggcgguaaaaaaguaac

SEQ ID NO: 691619 - RNA, 17 nt, Haemophilus influenzae Rd
aauggcgguuuuuuaau

SEQ ID NO: 691620 - RNA, 18 nt, Haemophilus influenzae Rd
aauggcggcggaauucau

SEQ ID NO: 691621 - RNA, 16 nt, Haemophilus influenzae Rd
aaugcucuaaaucccc

SEQ ID NO: 691622 - RNA, 9 nt, Haemophilus influenzae Rd
aaugcugag

SEQ ID NO: 691623 - RNA, 13 nt, Haemophilus influenzae Rd
aaugcugagugca

SEQ ID NO: 691624 - RNA, 15 nt, Haemophilus influenzae Rd
aaugcuggagcaguu

SEQ ID NO: 691625 - RNA, 21 nt, Haemophilus influenzae Rd
aaugcuggaucggcuauuuca

SEQ ID NO: 691626 - RNA, 16 nt, Haemophilus influenzae Rd
aaugcuguaaugauca

SEQ ID NO: 691627 - RNA, 19 nt, Haemophilus influenzae Rd
aaugcuguaaugaucacuu

SEQ ID NO: 691628 - RNA, 15 nt, Haemophilus influenzae Rd
aaugcuguuuaaauc

SEQ ID NO: 691629 - RNA, 18 nt, Haemophilus influenzae Rd
aaugcuguuuaaaucuaa

SEQ ID NO: 691630 - RNA, 18 nt, Haemophilus influenzae Rd
aaugcuguagaaauuaau

SEQ ID NO: 691631 - RNA, 22 nt, Haemophilus influenzae Rd
aaugcucgcacuuggcgaacau

SEQ ID NO: 691632 - RNA, 23 nt, Haemophilus influenzae Rd
aaugcucgcacuuggcgaacauu

SEQ ID NO: 691633 - RNA, 19 nt, Haemophilus influenzae Rd
aaugcccgcacuuuuaacc

SEQ ID NO: 691634 - RNA, 17 nt, Haemophilus influenzae Rd
aaugcuaaauauauauc

SEQ ID NO: 691635 - RNA, 23 nt, Haemophilus influenzae Rd
aaugcagauccuuucacaaaaua

SEQ ID NO: 691636 - RNA, 14 nt, Haemophilus influenzae Rd
aaugcacuuguggc

SEQ ID NO: 691637 - RNA, 15 nt, Haemophilus influenzae Rd
aaugcagaccaacgu

SEQ ID NO: 691638 - RNA, 21 nt, Haemophilus influenzae Rd
aaugcagaccaacguaaaauc

SEQ ID NO: 691639 - RNA, 18 nt, Haemophilus influenzae Rd
aaugcaccagaugcaaua

SEQ ID NO: 691640 - RNA, 16 nt, Haemophilus influenzae Rd
aaugccauuuuuuaua

SEQ ID NO: 691641 - RNA, 14 nt, Haemophilus influenzae Rd
aaugcccagcaauu

SEQ ID NO: 691642 - RNA, 19 nt, Haemophilus influenzae Rd
aauggugcuuuuuacaaca

SEQ ID NO: 691643 - RNA, 17 nt, Haemophilus influenzae Rd
aaugguacaucuggaua

SEQ ID NO: 691644 - RNA, 22 nt, Haemophilus influenzae Rd
aaugggauuuucacuaauuugc

SEQ ID NO: 691645 - RNA, 21 nt, Haemophilus influenzae Rd
aauggcuuuucucaaaacauc

SEQ ID NO: 691646 - RNA, 18 nt, Haemophilus influenzae Rd
aaugucuuaaagauaaaa

SEQ ID NO: 691647 - RNA, 22 nt, Haemophilus influenzae Rd
aaugucgcauuuguaccaccaa

SEQ ID NO: 691648 - RNA, 21 nt, Haemophilus influenzae Rd
aaugucgccauuuaagccuuu

SEQ ID NO: 691649 - RNA, 18 nt, Haemophilus influenzae Rd
aauguauuucuaacaaau

SEQ ID NO: 691650 - RNA, 16 nt, Haemophilus influenzae Rd
aauuaccgcacuuuaa

SEQ ID NO: 691651 - RNA, 14 nt, Haemophilus influenzae Rd
aauuaccugccaaa

SEQ ID NO: 691652 - RNA, 17 nt, Haemophilus influenzae Rd
aauuacuuuuauaucua

SEQ ID NO: 691653 - RNA, 13 nt, Haemophilus influenzae Rd
aauuacuuuuaua

SEQ ID NO: 691654 - RNA, 22 nt, Haemophilus influenzae Rd
aauuacuuggggcuaauuuuua

SEQ ID NO: 691655 - RNA, 16 nt, Haemophilus influenzae Rd
aauuacuugaaucuaa

SEQ ID NO: 691656 - RNA, 11 nt, Haemophilus influenzae Rd
aauuagaauuu

SEQ ID NO: 691657 - RNA, 16 nt, Haemophilus influenzae Rd
aauuagagagaaaaau

SEQ ID NO: 691658 - RNA, 12 nt, Haemophilus influenzae Rd
aauuagaauaac

SEQ ID NO: 691659 - RNA, 14 nt, Haemophilus influenzae Rd
aauuagaauaacaa

SEQ ID NO: 691660 - RNA, 20 nt, Haemophilus influenzae Rd
aauuaauacgucaauugcua

SEQ ID NO: 691661 - RNA, 14 nt, Haemophilus influenzae Rd
aauuaauacugaaa

SEQ ID NO: 691662 - RNA, 18 nt, Haemophilus influenzae Rd
aauuaauacugaaaugau

SEQ ID NO: 691663 - RNA, 18 nt, Haemophilus influenzae Rd
aauuaaugcuaaaccaau

SEQ ID NO: 691664 - RNA, 21 nt, Haemophilus influenzae Rd
aauuacaucauuccgcccauu

SEQ ID NO: 691665 - RNA, 22 nt, Haemophilus influenzae Rd
aauuacauuuuuucuacgguuu

SEQ ID NO: 691666 - RNA, 15 nt, Haemophilus influenzae Rd
aauuaccaauuccaa

SEQ ID NO: 691667 - RNA, 13 nt, Haemophilus influenzae Rd
aauuaccacauca

SEQ ID NO: 691668 - RNA, 22 nt, Haemophilus influenzae Rd
aauuaccacaucauuauugccu

SEQ ID NO: 691669 - RNA, 24 nt, Haemophilus influenzae Rd
aauuaccacguucauuucguauaa

SEQ ID NO: 691670 - RNA, 15 nt, Haemophilus influenzae Rd
aauuaauaaaaaauc

SEQ ID NO: 691671 - RNA, 16 nt, Haemophilus influenzae Rd
aauuaaguuugagcaa

SEQ ID NO: 691672 - RNA, 19 nt, Haemophilus influenzae Rd
aauuaaguuugagcaaauc

SEQ ID NO: 691673 - RNA, 22 nt, Haemophilus influenzae Rd
aauuaaguuugagcaaaucaaa

SEQ ID NO: 691674 - RNA, 14 nt, Haemophilus influenzae Rd
aauuaauaagaaaa

SEQ ID NO: 691675 - RNA, 16 nt, Haemophilus influenzae Rd
aauuaauaagaaaauc

SEQ ID NO: 691676 - RNA, 23 nt, Haemophilus influenzae Rd
aauuaauaauaagccgaagaaga

SEQ ID NO: 691677 - RNA, 16 nt, Haemophilus influenzae Rd
aauuaaggauuuauuu

SEQ ID NO: 691678 - RNA, 20 nt, Haemophilus influenzae Rd
aauuaaggauuuauuuaaca

SEQ ID NO: 691679 - RNA, 22 nt, Haemophilus influenzae Rd
aauuaaggauuucuuaugaaaa

SEQ ID NO: 691680 - RNA, 15 nt, Haemophilus influenzae Rd
aauuaaggcauuuuc

SEQ ID NO: 691681 - RNA, 19 nt, Haemophilus influenzae Rd
aauuaaguagauaacaaaa

SEQ ID NO: 691682 - RNA, 16 nt, Haemophilus influenzae Rd
aauuaagucaaaaauu

SEQ ID NO: 691683 - RNA, 20 nt, Haemophilus influenzae Rd
aauuaagacgggaaacaaua

SEQ ID NO: 691684 - RNA, 21 nt, Haemophilus influenzae Rd
aauuaacgugcauuuuuauga

SEQ ID NO: 691685 - RNA, 20 nt, Haemophilus influenzae Rd
aauuaacguuauaaacaaca

SEQ ID NO: 691686 - RNA, 13 nt, Haemophilus influenzae Rd
aauuaaauuacca

SEQ ID NO: 691687 - RNA, 16 nt, Haemophilus influenzae Rd
aauuaacgcucaaaaa

SEQ ID NO: 691688 - RNA, 19 nt, Haemophilus influenzae Rd
aauuaagaaaauaauauaa

SEQ ID NO: 691689 - RNA, 21 nt, Haemophilus influenzae Rd
aauuaagaaauuuucuuuucu

SEQ ID NO: 691690 - RNA, 17 nt, Haemophilus influenzae Rd
aauuaaacaaaaucuua

SEQ ID NO: 691691 - RNA, 12 nt, Haemophilus influenzae Rd
aauuaaacauuu

SEQ ID NO: 691692 - RNA, 14 nt, Haemophilus influenzae Rd
aauuaaacauuucc

SEQ ID NO: 691693 - RNA, 12 nt, Haemophilus influenzae Rd
aauuaaaaguuu

SEQ ID NO: 691694 - RNA, 13 nt, Haemophilus influenzae Rd
aauuaaaauaaua

SEQ ID NO: 691695 - RNA, 16 nt, Haemophilus influenzae Rd
aauuaaaauauuuuua

SEQ ID NO: 691696 - RNA, 19 nt, Haemophilus influenzae Rd
aauuaaaaucacauaaaaa

SEQ ID NO: 691697 - RNA, 13 nt, Haemophilus influenzae Rd
aauuaaauacaaa

SEQ ID NO: 691698 - RNA, 16 nt, Haemophilus influenzae Rd
aauuaaaucaaaaauu

SEQ ID NO: 691699 - RNA, 16 nt, Haemophilus influenzae Rd
aauuaaauccaucaau

SEQ ID NO: 691700 - RNA, 13 nt, Haemophilus influenzae Rd
aauuaaagaaauu

SEQ ID NO: 691701 - RNA, 15 nt, Haemophilus influenzae Rd
aauuaaagaaauuuc

SEQ ID NO: 691702 - RNA, 22 nt, Haemophilus influenzae Rd
aauuaaagaaauuucauauuuc

SEQ ID NO: 691703 - RNA, 22 nt, Haemophilus influenzae Rd
aauuaaacgugauuuaccaaua

SEQ ID NO: 691704 - RNA, 14 nt, Haemophilus influenzae Rd
aauuaaacuuucaa

SEQ ID NO: 691705 - RNA, 18 nt, Haemophilus influenzae Rd
aauuaaagacguuugauu

SEQ ID NO: 691706 - RNA, 12 nt, Haemophilus influenzae Rd
aauguucgauuu

SEQ ID NO: 691707 - RNA, 22 nt, Haemophilus influenzae Rd
aauguuccaccacucacuggcu

SEQ ID NO: 691708 - RNA, 17 nt, Haemophilus influenzae Rd
aauguucauuuuuauga

SEQ ID NO: 691709 - RNA, 17 nt, Haemophilus influenzae Rd
aauguucacguguuaaa

SEQ ID NO: 691710 - RNA, 19 nt, Haemophilus influenzae Rd
aauguuauugccuaauaaa

SEQ ID NO: 691711 - RNA, 20 nt, Haemophilus influenzae Rd
aauguuauugccuaauaaaa

SEQ ID NO: 691712 - RNA, 21 nt, Haemophilus influenzae Rd
aauguuauugccuaauaaaaa

SEQ ID NO: 691713 - RNA, 16 nt, Haemophilus influenzae Rd
aaugugcgguagauuu

SEQ ID NO: 691714 - RNA, 18 nt, Haemophilus influenzae Rd
aaugugcaaucagcaaca

SEQ ID NO: 691715 - RNA, 13 nt, Haemophilus influenzae Rd
aauguguugauuu

SEQ ID NO: 691716 - RNA, 13 nt, Haemophilus influenzae Rd
aauguggugcugu

SEQ ID NO: 691717 - RNA, 14 nt, Haemophilus influenzae Rd
aauguuucacuuug

SEQ ID NO: 691718 - RNA, 16 nt, Haemophilus influenzae Rd
aauguuugaaggcaaa

SEQ ID NO: 691719 - RNA, 17 nt, Haemophilus influenzae Rd
aauguuuaauuauagaa

SEQ ID NO: 691720 - RNA, 14 nt, Haemophilus influenzae Rd
aauguuuaaaguaa

SEQ ID NO: 691721 - RNA, 15 nt, Haemophilus influenzae Rd
aauguuuaaaguaag

SEQ ID NO: 691722 - RNA, 16 nt, Haemophilus influenzae Rd
aauguuggaucccaau

SEQ ID NO: 691723 - RNA, 20 nt, Haemophilus influenzae Rd
aauguuggauuuucaauacg

SEQ ID NO: 691724 - RNA, 13 nt, Haemophilus influenzae Rd
aauguugaauaua

SEQ ID NO: 691725 - RNA, 19 nt, Haemophilus influenzae Rd
aauuaaaaaaauaguuaau

SEQ ID NO: 691726 - RNA, 21 nt, Haemophilus influenzae Rd
aauguuuucgaucauuugacg

SEQ ID NO: 691727 - RNA, 23 nt, Haemophilus influenzae Rd
aauguuuucgaucauuugacgau

SEQ ID NO: 691728 - RNA, 17 nt, Haemophilus influenzae Rd
aauguuugguauaaaua

SEQ ID NO: 691729 - RNA, 18 nt, Haemophilus influenzae Rd
aauguuuuaaagaauauu

SEQ ID NO: 691730 - RNA, 11 nt, Haemophilus influenzae Rd
aauuaaaaaug

SEQ ID NO: 691731 - RNA, 14 nt, Haemophilus influenzae Rd
aauuaaaaagacua

SEQ ID NO: 691732 - RNA, 14 nt, Haemophilus influenzae Rd
aauuaaaacguucu

SEQ ID NO: 691733 - RNA, 17 nt, Haemophilus influenzae Rd
aagcggcacucucuugg

SEQ ID NO: 691734 - RNA, 12 nt, Haemophilus influenzae Rd
aagccaacuugu

SEQ ID NO: 691735 - RNA, 19 nt, Haemophilus influenzae Rd
aagccaaucauugcuaaac

SEQ ID NO: 691736 - RNA, 22 nt, Haemophilus influenzae Rd
aagccaaggcgauuaaucgaag

SEQ ID NO: 691737 - RNA, 15 nt, Haemophilus influenzae Rd
aagccaaugccaaaa

SEQ ID NO: 691738 - RNA, 21 nt, Haemophilus influenzae Rd
aagccaccagagaaaucauca

SEQ ID NO: 691739 - RNA, 16 nt, Haemophilus influenzae Rd
aagcuaccugccauaa

SEQ ID NO: 691740 - RNA, 16 nt, Haemophilus influenzae Rd
aagcuaauucuucuau

SEQ ID NO: 691741 - RNA, 21 nt, Haemophilus influenzae Rd
aagcuaaugguuggaagaaaa

SEQ ID NO: 691742 - RNA, 13 nt, Haemophilus influenzae Rd
aagcgugauuuuu

SEQ ID NO: 691743 - RNA, 18 nt, Haemophilus influenzae Rd
aagcugauucuucauaaa

SEQ ID NO: 691744 - RNA, 15 nt, Haemophilus influenzae Rd
aagcucguauaauau

SEQ ID NO: 691745 - RNA, 15 nt, Haemophilus influenzae Rd
aagcucgguaaaaau

SEQ ID NO: 691746 - RNA, 16 nt, Haemophilus influenzae Rd
aagcucgguaaaaauc

SEQ ID NO: 691747 - RNA, 14 nt, Haemophilus influenzae Rd
aagcuuaauauguu

SEQ ID NO: 691748 - RNA, 19 nt, Haemophilus influenzae Rd
aagcuuguccaugaaaaac

SEQ ID NO: 691749 - RNA, 23 nt, Haemophilus influenzae Rd
aagcuuugcaacaaagugcggca

SEQ ID NO: 691750 - RNA, 23 nt, Haemophilus influenzae Rd
aagcuuuaccgucagccaaauuu

SEQ ID NO: 691751 - RNA, 17 nt, Haemophilus influenzae Rd
aagcugcaucaauauug

SEQ ID NO: 691752 - RNA, 19 nt, Haemophilus influenzae Rd
aagcugcgaauugcaaugc

SEQ ID NO: 691753 - RNA, 16 nt, Haemophilus influenzae Rd
aaggauuuauuuaaca

SEQ ID NO: 691754 - RNA, 17 nt, Haemophilus influenzae Rd
aaggagcuaguuuaguu

SEQ ID NO: 691755 - RNA, 19 nt, Haemophilus influenzae Rd
aaggaaucccauauuuaaa

SEQ ID NO: 691756 - RNA, 21 nt, Haemophilus influenzae Rd
aaggcuuuaccuuuuaauuca

SEQ ID NO: 691757 - RNA, 13 nt, Haemophilus influenzae Rd
aagguaauuuaag

SEQ ID NO: 691758 - RNA, 12 nt, Haemophilus influenzae Rd
aagguacaacag

SEQ ID NO: 691759 - RNA, 16 nt, Haemophilus influenzae Rd
aagguauaaauaauuu

SEQ ID NO: 691760 - RNA, 13 nt, Haemophilus influenzae Rd
aagguauccacuu

SEQ ID NO: 691761 - RNA, 15 nt, Haemophilus influenzae Rd
aagguauccacuuuu

SEQ ID NO: 691762 - RNA, 17 nt, Haemophilus influenzae Rd
aagguuuuaauuuuguc

SEQ ID NO: 691763 - RNA, 21 nt, Haemophilus influenzae Rd
aagguuucgauauuaauacuu

SEQ ID NO: 691764 - RNA, 22 nt, Haemophilus influenzae Rd
aagguuuaguggguaaaccaaa

SEQ ID NO: 691765 - RNA, 23 nt, Haemophilus influenzae Rd
aagguuuaguggguaaaccaaac

SEQ ID NO: 691766 - RNA, 19 nt, Haemophilus influenzae Rd
aagguuauuucuugccaaa

SEQ ID NO: 691767 - RNA, 19 nt, Haemophilus influenzae Rd
aaggugguuuugcaaacca

SEQ ID NO: 691768 - RNA, 15 nt, Haemophilus influenzae Rd
aaggugguuuuuguu

SEQ ID NO: 691769 - RNA, 14 nt, Haemophilus influenzae Rd
aagguuaaauucac

SEQ ID NO: 691770 - RNA, 19 nt, Haemophilus influenzae Rd
aaggugcaacgugugccag

SEQ ID NO: 691771 - RNA, 18 nt, Haemophilus influenzae Rd
aaggugcagauuaaauau

SEQ ID NO: 691772 - RNA, 16 nt, Haemophilus influenzae Rd
aaggugcguucuacac

SEQ ID NO: 691773 - RNA, 18 nt, Haemophilus influenzae Rd
aaggcgagggauuuuaaa

SEQ ID NO: 691774 - RNA, 14 nt, Haemophilus influenzae Rd
aaggcgauuuaagu

SEQ ID NO: 691775 - RNA, 17 nt, Haemophilus influenzae Rd
aaggcgaacauaacuuu

SEQ ID NO: 691776 - RNA, 20 nt, Haemophilus influenzae Rd
aaggccuccgccaagugcgg

SEQ ID NO: 691777 - RNA, 13 nt, Haemophilus influenzae Rd
aaggccauauuuu

SEQ ID NO: 691778 - RNA, 23 nt, Haemophilus influenzae Rd
aaggcaagguaucuauaauuucg

SEQ ID NO: 691779 - RNA, 20 nt, Haemophilus influenzae Rd
aaggcaauuuuuaaugccau

SEQ ID NO: 691780 - RNA, 20 nt, Haemophilus influenzae Rd
aaggcacagggcugauaaau

SEQ ID NO: 691781 - RNA, 15 nt, Haemophilus influenzae Rd
aaggcaaagcaaaau

SEQ ID NO: 691782 - RNA, 17 nt, Haemophilus influenzae Rd
aaggcaaagcaaaauca

SEQ ID NO: 691783 - RNA, 21 nt, Haemophilus influenzae Rd
aaggcaaagcaaaaucaaagu

SEQ ID NO: 691784 - RNA, 20 nt, Haemophilus influenzae Rd
aaggauuuuugaauuucacu

SEQ ID NO: 691785 - RNA, 22 nt, Haemophilus influenzae Rd
aaggauuucuuaugaaaaaaaa

SEQ ID NO: 691786 - RNA, 21 nt, Haemophilus influenzae Rd
aaguuuucauuaaagaagaaa

SEQ ID NO: 691787 - RNA, 15 nt, Haemophilus influenzae Rd
aaguuuuaaaccaag

SEQ ID NO: 691788 - RNA, 12 nt, Haemophilus influenzae Rd
aaguuuuaagug

SEQ ID NO: 691789 - RNA, 23 nt, Haemophilus influenzae Rd
aaguuuuaccuucaguuuucauu

SEQ ID NO: 691790 - RNA, 19 nt, Haemophilus influenzae Rd
aaguuuugucugaaauuuu

SEQ ID NO: 691791 - RNA, 22 nt, Haemophilus influenzae Rd
aaguuuugucugaaauuuuuau

SEQ ID NO: 691792 - RNA, 22 nt, Haemophilus influenzae Rd
aaguuuuuccguugucacaaua

SEQ ID NO: 691793 - RNA, 19 nt, Haemophilus influenzae Rd
aaguuugcuaauuuaucca

SEQ ID NO: 691794 - RNA, 23 nt, Haemophilus influenzae Rd
aaguuugcuaucuuaccuuuuuc

SEQ ID NO: 691795 - RNA, 12 nt, Haemophilus influenzae Rd
aaguuugcaaca

SEQ ID NO: 691796 - RNA, 21 nt, Haemophilus influenzae Rd
aaguuugauccacaaauaaua

SEQ ID NO: 691797 - RNA, 18 nt, Haemophilus influenzae Rd
aaguuugagcaaaucaaa

SEQ ID NO: 691798 - RNA, 22 nt, Haemophilus influenzae Rd
aaguuucuuuuacauuuggaua

SEQ ID NO: 691799 - RNA, 13 nt, Haemophilus influenzae Rd
aaguuuaugaucu

SEQ ID NO: 691800 - RNA, 23 nt, Haemophilus influenzae Rd
aaguuuaguccuuaauuuaauua

SEQ ID NO: 691801 - RNA, 21 nt, Haemophilus influenzae Rd
aaguuuagauuagugugauuu

SEQ ID NO: 691802 - RNA, 19 nt, Haemophilus influenzae Rd
aaguuuacuauuaaagugu

SEQ ID NO: 691803 - RNA, 20 nt, Haemophilus influenzae Rd
aaguugguuuugcaauuuuu

SEQ ID NO: 691804 - RNA, 20 nt, Haemophilus influenzae Rd
aaguugugaguaaaccacaa

SEQ ID NO: 691805 - RNA, 13 nt, Haemophilus influenzae Rd
aaguuuaagaaaa

SEQ ID NO: 691806 - RNA, 11 nt, Haemophilus influenzae Rd
aaguuggauua

SEQ ID NO: 691807 - RNA, 14 nt, Haemophilus influenzae Rd
aaguuggauucauu

SEQ ID NO: 691808 - RNA, 14 nt, Haemophilus influenzae Rd
aaguuggcuuacag

SEQ ID NO: 691809 - RNA, 17 nt, Haemophilus influenzae Rd
aaguucuacccauucaa

SEQ ID NO: 691810 - RNA, 17 nt, Haemophilus influenzae Rd
aaguucuauaauuuuag

SEQ ID NO: 691811 - RNA, 17 nt, Haemophilus influenzae Rd
aaguuagacuaugaaau

SEQ ID NO: 691812 - RNA, 11 nt, Haemophilus influenzae Rd
aaguucuuauc

SEQ ID NO: 691813 - RNA, 21 nt, Haemophilus influenzae Rd
aaguucuuucugucaucacau

SEQ ID NO: 691814 - RNA, 12 nt, Haemophilus influenzae Rd
aauaaaaauggu

SEQ ID NO: 691815 - RNA, 22 nt, Haemophilus influenzae Rd
aauaaaaccauauugcuauuca

SEQ ID NO: 691816 - RNA, 19 nt, Haemophilus influenzae Rd
aauaaaaccgcucaacuua

SEQ ID NO: 691817 - RNA, 13 nt, Haemophilus influenzae Rd
aauaaaagcaaua

SEQ ID NO: 691818 - RNA, 15 nt, Haemophilus influenzae Rd
aauaaaagcaauaau

SEQ ID NO: 691819 - RNA, 18 nt, Haemophilus influenzae Rd
aauaaaagauaacaaaua

SEQ ID NO: 691820 - RNA, 13 nt, Haemophilus influenzae Rd
aauaaaaaaacac

SEQ ID NO: 691821 - RNA, 12 nt, Haemophilus influenzae Rd
aauaaaaaaacc

SEQ ID NO: 691822 - RNA, 22 nt, Haemophilus influenzae Rd
aauaaaaaaacccaguuuuaaa

SEQ ID NO: 691823 - RNA, 14 nt, Haemophilus influenzae Rd
aaguuuuuuaaguu

SEQ ID NO: 691824 - RNA, 16 nt, Haemophilus influenzae Rd
aaguuuuuuaaguuuc

SEQ ID NO: 691825 - RNA, 18 nt, Haemophilus influenzae Rd
aaguuuuuuaaguuucca

SEQ ID NO: 691826 - RNA, 11 nt, Haemophilus influenzae Rd
aauaaaaaaua

SEQ ID NO: 691827 - RNA, 13 nt, Haemophilus influenzae Rd
aauaaaaaauauu

SEQ ID NO: 691828 - RNA, 11 nt, Haemophilus influenzae Rd
aauaaaaaauc

SEQ ID NO: 691829 - RNA, 18 nt, Haemophilus influenzae Rd
aauaaaaaggaaauaauu

SEQ ID NO: 691830 - RNA, 12 nt, Haemophilus influenzae Rd
aauaaaaauccu

SEQ ID NO: 691831 - RNA, 16 nt, Haemophilus influenzae Rd
aauaaaaaugaauaaa

SEQ ID NO: 691832 - RNA, 19 nt, Haemophilus influenzae Rd
aauaaaaaugaauaaaauu

SEQ ID NO: 691833 - RNA, 17 nt, Haemophilus influenzae Rd
aauaaaaacauugccaa

SEQ ID NO: 691834 - RNA, 23 nt, Haemophilus influenzae Rd
aauaaaauauaugggaaacaaua

SEQ ID NO: 691835 - RNA, 12 nt, Haemophilus influenzae Rd
aauaaaauaaca

SEQ ID NO: 691836 - RNA, 22 nt, Haemophilus influenzae Rd
aauaaaauaaucuggcaagcca

SEQ ID NO: 691837 - RNA, 14 nt, Haemophilus influenzae Rd
aauaaaauuuuuaa

SEQ ID NO: 691838 - RNA, 15 nt, Haemophilus influenzae Rd
aauaaaauuuuuaaa

SEQ ID NO: 691839 - RNA, 14 nt, Haemophilus influenzae Rd
aauaaacaaagaau

SEQ ID NO: 691840 - RNA, 13 nt, Haemophilus influenzae Rd
aauaaaauuugcg

SEQ ID NO: 691841 - RNA, 13 nt, Haemophilus influenzae Rd
aauaaaauguuua

SEQ ID NO: 691842 - RNA, 18 nt, Haemophilus influenzae Rd
aauaaaauguaagaguga

SEQ ID NO: 691843 - RNA, 13 nt, Haemophilus influenzae Rd
aauaaaauugcuu

SEQ ID NO: 691844 - RNA, 14 nt, Haemophilus influenzae Rd
aauaaaauugcuuu

SEQ ID NO: 691845 - RNA, 21 nt, Haemophilus influenzae Rd
aauaaaauugcuuuguuaauu

SEQ ID NO: 691846 - RNA, 14 nt, Haemophilus influenzae Rd
aauaaaccaacaua

SEQ ID NO: 691847 - RNA, 13 nt, Haemophilus influenzae Rd
aauaaaccaauaa

SEQ ID NO: 691848 - RNA, 22 nt, Haemophilus influenzae Rd
aauaaaccaccgauuaauaaaa

SEQ ID NO: 691849 - RNA, 18 nt, Haemophilus influenzae Rd
aauaaacauauugaugau

SEQ ID NO: 691850 - RNA, 19 nt, Haemophilus influenzae Rd
aauaaacauacaucuaauu

SEQ ID NO: 691851 - RNA, 16 nt, Haemophilus influenzae Rd
aauaaacagaaauauu

SEQ ID NO: 691852 - RNA, 20 nt, Haemophilus influenzae Rd
aauaaacagaaauauugucu

SEQ ID NO: 691853 - RNA, 20 nt, Haemophilus influenzae Rd
aauaaaccgcaucaaaauua

SEQ ID NO: 691854 - RNA, 17 nt, Haemophilus influenzae Rd
aauaaaccguuagguuu

SEQ ID NO: 691855 - RNA, 23 nt, Haemophilus influenzae Rd
aauaaacgagauaagcauuuuau

SEQ ID NO: 691856 - RNA, 20 nt, Haemophilus influenzae Rd
aauaaacucauugaacuguu

SEQ ID NO: 691857 - RNA, 13 nt, Haemophilus influenzae Rd
aagugcuuuaccu

SEQ ID NO: 691858 - RNA, 14 nt, Haemophilus influenzae Rd
aaguggcauaaaga

SEQ ID NO: 691859 - RNA, 15 nt, Haemophilus influenzae Rd
aaguggcauaaagaa

SEQ ID NO: 691860 - RNA, 16 nt, Haemophilus influenzae Rd
aaguggcauaaagaaa

SEQ ID NO: 691861 - RNA, 22 nt, Haemophilus influenzae Rd
aaguguucgugauauccauuca

SEQ ID NO: 691862 - RNA, 15 nt, Haemophilus influenzae Rd
aaguggggaaaaaua

SEQ ID NO: 691863 - RNA, 18 nt, Haemophilus influenzae Rd
aaguuaaaaaaugauuaa

SEQ ID NO: 691864 - RNA, 13 nt, Haemophilus influenzae Rd
aaguuaaaccaac

SEQ ID NO: 691865 - RNA, 16 nt, Haemophilus influenzae Rd
aaguuaaaccaacaac

SEQ ID NO: 691866 - RNA, 18 nt, Haemophilus influenzae Rd
aaguuaaaccaacaacug

SEQ ID NO: 691867 - RNA, 23 nt, Haemophilus influenzae Rd
aaguuaaagcacccaucacauuu

SEQ ID NO: 691868 - RNA, 15 nt, Haemophilus influenzae Rd
aaguuacaaguacua

SEQ ID NO: 691869 - RNA, 22 nt, Haemophilus influenzae Rd
aaguuaccgcucgccaauaaaa

SEQ ID NO: 691870 - RNA, 18 nt, Haemophilus influenzae Rd
aaguuaccgcuucuuccu

SEQ ID NO: 691871 - RNA, 19 nt, Haemophilus influenzae Rd
aaguuacuuaauuuugcua

SEQ ID NO: 691872 - RNA, 17 nt, Haemophilus influenzae Rd
aagugaaugaagguuuc

SEQ ID NO: 691873 - RNA, 19 nt, Haemophilus influenzae Rd
aagugaauaauguuuucau

SEQ ID NO: 691874 - RNA, 19 nt, Haemophilus influenzae Rd
aagugcaagccccugaagc

SEQ ID NO: 691875 - RNA, 22 nt, Haemophilus influenzae Rd
aagugcaagccccugaagccaa

SEQ ID NO: 691876 - RNA, 21 nt, Haemophilus influenzae Rd
aagugcagaucgcuauuuaau

SEQ ID NO: 691877 - RNA, 22 nt, Haemophilus influenzae Rd
aagugcagaucgcuauuuaaua

SEQ ID NO: 691878 - RNA, 19 nt, Haemophilus influenzae Rd
aagugcguguauauauuuu

SEQ ID NO: 691879 - RNA, 17 nt, Haemophilus influenzae Rd
aagugcuaucuuaaaua

SEQ ID NO: 691880 - RNA, 20 nt, Haemophilus influenzae Rd
aagugcaugagcuuugcuuu

SEQ ID NO: 691881 - RNA, 22 nt, Haemophilus influenzae Rd
aagugcaugagcuuugcuuucg

SEQ ID NO: 691882 - RNA, 17 nt, Haemophilus influenzae Rd
aagucagcauaaacaaa

SEQ ID NO: 691883 - RNA, 19 nt, Haemophilus influenzae Rd
aagucagcauaaacaaaau

SEQ ID NO: 691884 - RNA, 20 nt, Haemophilus influenzae Rd
aagucagcauaaacaaaaua

SEQ ID NO: 691885 - RNA, 14 nt, Haemophilus influenzae Rd
aagucaggaauaaa

SEQ ID NO: 691886 - RNA, 18 nt, Haemophilus influenzae Rd
aagucccaaaagcaaaug

SEQ ID NO: 691887 - RNA, 20 nt, Haemophilus influenzae Rd
aaguccccauuuguagaaag

SEQ ID NO: 691888 - RNA, 18 nt, Haemophilus influenzae Rd
aagucguuauuuucuaga

SEQ ID NO: 691889 - RNA, 18 nt, Haemophilus influenzae Rd
aagucgguuuuuaauuca

SEQ ID NO: 691890 - RNA, 13 nt, Haemophilus influenzae Rd
aagucguuucauc

SEQ ID NO: 691891 - RNA, 17 nt, Haemophilus influenzae Rd
aagucuauaaaagaagg

SEQ ID NO: 691892 - RNA, 21 nt, Haemophilus influenzae Rd
aaguaaggugcagauuuuuua

SEQ ID NO: 691893 - RNA, 23 nt, Haemophilus influenzae Rd
aaguaacuuuagaacauugauaa

SEQ ID NO: 691894 - RNA, 22 nt, Haemophilus influenzae Rd
aaguaagaauuaggaucguuga

SEQ ID NO: 691895 - RNA, 12 nt, Haemophilus influenzae Rd
aaguaaaaaaau

SEQ ID NO: 691896 - RNA, 16 nt, Haemophilus influenzae Rd
aagguuuuauuuucaa

SEQ ID NO: 691897 - RNA, 15 nt, Haemophilus influenzae Rd
aagguuuucuuuguu

SEQ ID NO: 691898 - RNA, 15 nt, Haemophilus influenzae Rd
aaguaagucaagcua

SEQ ID NO: 691899 - RNA, 17 nt, Haemophilus influenzae Rd
aaguaauacaccaauaa

SEQ ID NO: 691900 - RNA, 23 nt, Haemophilus influenzae Rd
aaguaauacaccaauaauuaaac

SEQ ID NO: 691901 - RNA, 18 nt, Haemophilus influenzae Rd
aaguaauacuuuuuauuu

SEQ ID NO: 691902 - RNA, 14 nt, Haemophilus influenzae Rd
aaguaugugaugua

SEQ ID NO: 691903 - RNA, 19 nt, Haemophilus influenzae Rd
aagucacauauuguuucuu

SEQ ID NO: 691904 - RNA, 14 nt, Haemophilus influenzae Rd
aaguaucuaccaug

SEQ ID NO: 691905 - RNA, 17 nt, Haemophilus influenzae Rd
aagaaugucaucuaauu

SEQ ID NO: 691906 - RNA, 22 nt, Haemophilus influenzae Rd
aagaauguuugaaaauucuucu

SEQ ID NO: 691907 - RNA, 16 nt, Haemophilus influenzae Rd
aagaauguuuugauug

SEQ ID NO: 691908 - RNA, 20 nt, Haemophilus influenzae Rd
aagaauguuuugauugagau

SEQ ID NO: 691909 - RNA, 16 nt, Haemophilus influenzae Rd
aagaauagucacacca

SEQ ID NO: 691910 - RNA, 14 nt, Haemophilus influenzae Rd
aagaauauuuuaau

SEQ ID NO: 691911 - RNA, 19 nt, Haemophilus influenzae Rd
aagaauauuuuaaugaaag

SEQ ID NO: 691912 - RNA, 13 nt, Haemophilus influenzae Rd
aagaaucaucuuc

SEQ ID NO: 691913 - RNA, 14 nt, Haemophilus influenzae Rd
aagaaucaucuuca

SEQ ID NO: 691914 - RNA, 20 nt, Haemophilus influenzae Rd
aaauugacggcuucagaaaa

SEQ ID NO: 691915 - RNA, 15 nt, Haemophilus influenzae Rd
aaauugacuugcaca

SEQ ID NO: 691916 - RNA, 23 nt, Haemophilus influenzae Rd
aaauugacuugcacaauuacuuc

SEQ ID NO: 691917 - RNA, 11 nt, Haemophilus influenzae Rd
aagaauaaaau

SEQ ID NO: 691918 - RNA, 14 nt, Haemophilus influenzae Rd
aaauugagauaacg

SEQ ID NO: 691919 - RNA, 18 nt, Haemophilus influenzae Rd
aagaauacuuaauagcug

SEQ ID NO: 691920 - RNA, 20 nt, Haemophilus influenzae Rd
aagaauaauauuaaagaaaa

SEQ ID NO: 691921 - RNA, 14 nt, Haemophilus influenzae Rd
aaauucuuuugcca

SEQ ID NO: 691922 - RNA, 20 nt, Haemophilus influenzae Rd
aaauucuuugccuugaugcu

SEQ ID NO: 691923 - RNA, 18 nt, Haemophilus influenzae Rd
aaauucuuuuuucuuccu

SEQ ID NO: 691924 - RNA, 21 nt, Haemophilus influenzae Rd
aaauucuuuuuucuuccuaug

SEQ ID NO: 691925 - RNA, 15 nt, Haemophilus influenzae Rd
aaauugaaaaaauaa

SEQ ID NO: 691926 - RNA, 15 nt, Haemophilus influenzae Rd
aaauugaaaaaaucu

SEQ ID NO: 691927 - RNA, 22 nt, Haemophilus influenzae Rd
aaauucugagaucgaaauuagg

SEQ ID NO: 691928 - RNA, 17 nt, Haemophilus influenzae Rd
aagaauuucaucgcauu

SEQ ID NO: 691929 - RNA, 21 nt, Haemophilus influenzae Rd
aagaauuucaucgcauuuuua

SEQ ID NO: 691930 - RNA, 19 nt, Haemophilus influenzae Rd
aagaauugaucaaaauuau

SEQ ID NO: 691931 - RNA, 23 nt, Haemophilus influenzae Rd
aagaauuggcgaaccuucacuua

SEQ ID NO: 691932 - RNA, 19 nt, Haemophilus influenzae Rd
aagacagaagaaguaaaaa

SEQ ID NO: 691933 - RNA, 18 nt, Haemophilus influenzae Rd
aagacagcuauuaaaaaa

SEQ ID NO: 691934 - RNA, 19 nt, Haemophilus influenzae Rd
aagacagcuauuaaaaaaa

SEQ ID NO: 691935 - RNA, 20 nt, Haemophilus influenzae Rd
aagacagcuauuaaaaaaag

SEQ ID NO: 691936 - RNA, 23 nt, Haemophilus influenzae Rd
aagacagcuauuaaaaaaagcaa

SEQ ID NO: 691937 - RNA, 14 nt, Haemophilus influenzae Rd
aagacaauggcuuu

SEQ ID NO: 691938 - RNA, 17 nt, Haemophilus influenzae Rd
aagacaauggcuuugcc

SEQ ID NO: 691939 - RNA, 15 nt, Haemophilus influenzae Rd
aagaauuuuuucaca

SEQ ID NO: 691940 - RNA, 13 nt, Haemophilus influenzae Rd
aagaauuuuuugc

SEQ ID NO: 691941 - RNA, 14 nt, Haemophilus influenzae Rd
aagacaaauuuguu

SEQ ID NO: 691942 - RNA, 17 nt, Haemophilus influenzae Rd
aagaccgcacuuuaaaa

SEQ ID NO: 691943 - RNA, 19 nt, Haemophilus influenzae Rd
aagacgaagaaacaaccag

SEQ ID NO: 691944 - RNA, 22 nt, Haemophilus influenzae Rd
aagagaucacuguaaauaauag

SEQ ID NO: 691945 - RNA, 17 nt, Haemophilus influenzae Rd
aagagauucuaauuccc

SEQ ID NO: 691946 - RNA, 15 nt, Haemophilus influenzae Rd
aagagacucuguucc

SEQ ID NO: 691947 - RNA, 18 nt, Haemophilus influenzae Rd
aagagaagcugaauaaaa

SEQ ID NO: 691948 - RNA, 17 nt, Haemophilus influenzae Rd
aagacuaugcguagaaa

SEQ ID NO: 691949 - RNA, 20 nt, Haemophilus influenzae Rd
aagacuaugcguagaaagau

SEQ ID NO: 691950 - RNA, 15 nt, Haemophilus influenzae Rd
aagacuauuaaguuc

SEQ ID NO: 691951 - RNA, 15 nt, Haemophilus influenzae Rd
aagacgcuguuucuu

SEQ ID NO: 691952 - RNA, 22 nt, Haemophilus influenzae Rd
aagacgcuguuucuuuucaucu

SEQ ID NO: 691953 - RNA, 18 nt, Haemophilus influenzae Rd
aagacggcgcguucuucu

SEQ ID NO: 691954 - RNA, 17 nt, Haemophilus influenzae Rd
aagacgggaaacaauau

SEQ ID NO: 691955 - RNA, 19 nt, Haemophilus influenzae Rd
aagacguuugauuguaaaa

SEQ ID NO: 691956 - RNA, 14 nt, Haemophilus influenzae Rd
aagagcaaauuuaa

SEQ ID NO: 691957 - RNA, 17 nt, Haemophilus influenzae Rd
aagagcaaauuuaaaua

SEQ ID NO: 691958 - RNA, 23 nt, Haemophilus influenzae Rd
aagaggaaguuaauggguuaaaa

SEQ ID NO: 691959 - RNA, 16 nt, Haemophilus influenzae Rd
aagaggagguagaaaa

SEQ ID NO: 691960 - RNA, 14 nt, Haemophilus influenzae Rd
aagaguaaaacuaa

SEQ ID NO: 691961 - RNA, 11 nt, Haemophilus influenzae Rd
aagaguaaaua

SEQ ID NO: 691962 - RNA, 15 nt, Haemophilus influenzae Rd
aagaguaaauauugu

SEQ ID NO: 691963 - RNA, 11 nt, Haemophilus influenzae Rd
aagaguaaauu

SEQ ID NO: 691964 - RNA, 16 nt, Haemophilus influenzae Rd
aagauaacgauauguu

SEQ ID NO: 691965 - RNA, 17 nt, Haemophilus influenzae Rd
aagauaaauuauauuuu

SEQ ID NO: 691966 - RNA, 13 nt, Haemophilus influenzae Rd
aagauaaauuuaa

SEQ ID NO: 691967 - RNA, 19 nt, Haemophilus influenzae Rd
aagauaaauuuaaaggacu

SEQ ID NO: 691968 - RNA, 21 nt, Haemophilus influenzae Rd
aagauaaguggggaaaaauau

SEQ ID NO: 691969 - RNA, 13 nt, Haemophilus influenzae Rd
aagauaauaaagu

SEQ ID NO: 691970 - RNA, 14 nt, Haemophilus influenzae Rd
aagauaauaaaguu

SEQ ID NO: 691971 - RNA, 19 nt, Haemophilus influenzae Rd
aagauaacuuagaaaauau

SEQ ID NO: 691972 - RNA, 21 nt, Haemophilus influenzae Rd
aagauaaaacagagaaaaaaa

SEQ ID NO: 691973 - RNA, 21 nt, Haemophilus influenzae Rd
aagaguuuuaaccguuauaac

SEQ ID NO: 691974 - RNA, 19 nt, Haemophilus influenzae Rd
aagaguucguccaaaaucu

SEQ ID NO: 691975 - RNA, 17 nt, Haemophilus influenzae Rd
aagcaauagauucuaag

SEQ ID NO: 691976 - RNA, 19 nt, Haemophilus influenzae Rd
aagcaauagauucuaaggu

SEQ ID NO: 691977 - RNA, 12 nt, Haemophilus influenzae Rd
aagcaacaauau

SEQ ID NO: 691978 - RNA, 11 nt, Haemophilus influenzae Rd
aagcaacacag

SEQ ID NO: 691979 - RNA, 12 nt, Haemophilus influenzae Rd
aagcaacacaga

SEQ ID NO: 691980 - RNA, 22 nt, Haemophilus influenzae Rd
aagcaaccgcacuucuaugaag

SEQ ID NO: 691981 - RNA, 23 nt, Haemophilus influenzae Rd
aagcaaccuaaacccgcaauuaa

SEQ ID NO: 691982 - RNA, 23 nt, Haemophilus influenzae Rd
aagcaacgcaucgcccaauuugg

SEQ ID NO: 691983 - RNA, 18 nt, Haemophilus influenzae Rd
aagcaaauggcaucaaua

SEQ ID NO: 691984 - RNA, 19 nt, Haemophilus influenzae Rd
aagcaaauggcaucaauau

SEQ ID NO: 691985 - RNA, 22 nt, Haemophilus influenzae Rd
aagcaaauagacuaauucguuu

SEQ ID NO: 691986 - RNA, 20 nt, Haemophilus influenzae Rd
aagauuuuucuugcuauucu

SEQ ID NO: 691987 - RNA, 21 nt, Haemophilus influenzae Rd
aagauuuuuaaccgcacuuuu

SEQ ID NO: 691988 - RNA, 20 nt, Haemophilus influenzae Rd
aagauuuuugauaaaaaaga

SEQ ID NO: 691989 - RNA, 23 nt, Haemophilus influenzae Rd
aagauuuuugauaaaaaagaaau

SEQ ID NO: 691990 - RNA, 13 nt, Haemophilus influenzae Rd
aagcaaaaucaaa

SEQ ID NO: 691991 - RNA, 16 nt, Haemophilus influenzae Rd
aagcaaacagcaauaa

SEQ ID NO: 691992 - RNA, 21 nt, Haemophilus influenzae Rd
aagcaaacagcaauaaauaau

SEQ ID NO: 691993 - RNA, 22 nt, Haemophilus influenzae Rd
aagcaaacagcaauaaauaaua

SEQ ID NO: 691994 - RNA, 19 nt, Haemophilus influenzae Rd
aagcacaggcguaauuaag

SEQ ID NO: 691995 - RNA, 15 nt, Haemophilus influenzae Rd
aagcacauuaaucau

SEQ ID NO: 691996 - RNA, 16 nt, Haemophilus influenzae Rd
aagcacaaagaaaaac

SEQ ID NO: 691997 - RNA, 13 nt, Haemophilus influenzae Rd
aagcacaaggggu

SEQ ID NO: 691998 - RNA, 17 nt, Haemophilus influenzae Rd
aagcacguuucaucagc

SEQ ID NO: 691999 - RNA, 18 nt, Haemophilus influenzae Rd
aagcacccauuugccaag

SEQ ID NO: 692000 - RNA, 21 nt, Haemophilus influenzae Rd
aagcacuucaucacccaucaa

SEQ ID NO: 692001 - RNA, 22 nt, Haemophilus influenzae Rd
aagcacuucaucacccaucaaa

SEQ ID NO: 692002 - RNA, 16 nt, Haemophilus influenzae Rd
aagcacuuuauuuaau

SEQ ID NO: 692003 - RNA, 14 nt, Haemophilus influenzae Rd
aagcacugaaauau

SEQ ID NO: 692004 - RNA, 13 nt, Haemophilus influenzae Rd
aagcagaagaauc

SEQ ID NO: 692005 - RNA, 16 nt, Haemophilus influenzae Rd
aagcaguuaaacagcu

SEQ ID NO: 692006 - RNA, 12 nt, Haemophilus influenzae Rd
aagcauuuugaa

SEQ ID NO: 692007 - RNA, 23 nt, Haemophilus influenzae Rd
aagcauugcuggugcaauuugau

SEQ ID NO: 692008 - RNA, 20 nt, Haemophilus influenzae Rd
aagcauuuugauaauuuuuc

SEQ ID NO: 692009 - RNA, 13 nt, Haemophilus influenzae Rd
aagcauuacaaag

SEQ ID NO: 692010 - RNA, 18 nt, Haemophilus influenzae Rd
aagcauguggcucuguua

SEQ ID NO: 692011 - RNA, 14 nt, Haemophilus influenzae Rd
aagcaugaauaaaa

SEQ ID NO: 692012 - RNA, 15 nt, Haemophilus influenzae Rd
aagcauaaaucuuua

SEQ ID NO: 692013 - RNA, 17 nt, Haemophilus influenzae Rd
aagaugaagcuaagaaa

SEQ ID NO: 692014 - RNA, 19 nt, Haemophilus influenzae Rd
aagaugaagcuaagaaaau

SEQ ID NO: 692015 - RNA, 18 nt, Haemophilus influenzae Rd
aagaugacgaaaugaaau

SEQ ID NO: 692016 - RNA, 20 nt, Haemophilus influenzae Rd
aagaugacgaaaugaaauua

SEQ ID NO: 692017 - RNA, 17 nt, Haemophilus influenzae Rd
aagaugaggcguuuuuc

SEQ ID NO: 692018 - RNA, 21 nt, Haemophilus influenzae Rd
aagauguuccuacagaacccg

SEQ ID NO: 692019 - RNA, 21 nt, Haemophilus influenzae Rd
aagauuagagccaucacguuc

SEQ ID NO: 692020 - RNA, 15 nt, Haemophilus influenzae Rd
aagauuaauuuuccu

SEQ ID NO: 692021 - RNA, 21 nt, Haemophilus influenzae Rd
aagauguuguaaaaucucuau

SEQ ID NO: 692022 - RNA, 18 nt, Haemophilus influenzae Rd
aagauuguccuuuugcca

SEQ ID NO: 692023 - RNA, 15 nt, Haemophilus influenzae Rd
aagauuuauguugaa

SEQ ID NO: 692024 - RNA, 17 nt, Haemophilus influenzae Rd
aagauuuauuccugcuu

SEQ ID NO: 692025 - RNA, 18 nt, Haemophilus influenzae Rd
aagauuuacagaacaaaa

SEQ ID NO: 692026 - RNA, 22 nt, Haemophilus influenzae Rd
aagauuuucucgugugaaauua

SEQ ID NO: 692027 - RNA, 17 nt, Haemophilus influenzae Rd
aagauuuuaugaaaucu

SEQ ID NO: 692028 - RNA, 18 nt, Haemophilus influenzae Rd
aagauuuuaaaauuuauu

SEQ ID NO: 692029 - RNA, 16 nt, Haemophilus influenzae Rd
aagauuugauuuuuau

SEQ ID NO: 692030 - RNA, 15 nt, Haemophilus influenzae Rd
aagauuugcaaggcu

SEQ ID NO: 692031 - RNA, 13 nt, Haemophilus influenzae Rd
aagauuugccaaa

SEQ ID NO: 692032 - RNA, 22 nt, Haemophilus influenzae Rd
aagauugaccucguggcaaaag

SEQ ID NO: 692033 - RNA, 21 nt, Haemophilus influenzae Rd
aagaugaacgaguaaauuaau

SEQ ID NO: 692034 - RNA, 21 nt, Haemophilus influenzae Rd
aagaucuucuacuguuaauuu

SEQ ID NO: 692035 - RNA, 14 nt, Haemophilus influenzae Rd
aagaucuaaaaacu

SEQ ID NO: 692036 - RNA, 14 nt, Haemophilus influenzae Rd
aagaucuaaaccua

SEQ ID NO: 692037 - RNA, 21 nt, Haemophilus influenzae Rd
aagaucuaaaccuaagcaacc

SEQ ID NO: 692038 - RNA, 21 nt, Haemophilus influenzae Rd
aagauccuuccaccacaacag

SEQ ID NO: 692039 - RNA, 23 nt, Haemophilus influenzae Rd
aagaucgauugcaucuuggcauu

SEQ ID NO: 692040 - RNA, 22 nt, Haemophilus influenzae Rd
aagaucagauuuuuuucagaaa

SEQ ID NO: 692041 - RNA, 20 nt, Haemophilus influenzae Rd
aagaucaggaucaaaaauau

SEQ ID NO: 692042 - RNA, 14 nt, Haemophilus influenzae Rd
aagaucaagcacuu

SEQ ID NO: 692043 - RNA, 21 nt, Haemophilus influenzae Rd
aagaucaagcacuuuuccuuu

SEQ ID NO: 692044 - RNA, 22 nt, Haemophilus influenzae Rd
aagaucaagcacuuuuccuuuu

SEQ ID NO: 692045 - RNA, 12 nt, Haemophilus influenzae Rd
aagauaauuuuu

SEQ ID NO: 692046 - RNA, 17 nt, Haemophilus influenzae Rd
aagauacacucacuuuu

SEQ ID NO: 692047 - RNA, 12 nt, Haemophilus influenzae Rd
aagauaccaaua

SEQ ID NO: 692048 - RNA, 21 nt, Haemophilus influenzae Rd
aagauaccaauaaucaauacu

SEQ ID NO: 692049 - RNA, 22 nt, Haemophilus influenzae Rd
aagauacuacacccaaaugcca

SEQ ID NO: 692050 - RNA, 21 nt, Haemophilus influenzae Rd
aagauaggauuccacuugaaa

SEQ ID NO: 692051 - RNA, 17 nt, Haemophilus influenzae Rd
aagauagggcugcaugu

SEQ ID NO: 692052 - RNA, 13 nt, Haemophilus influenzae Rd
aagauauaaacug

SEQ ID NO: 692053 - RNA, 20 nt, Haemophilus influenzae Rd
aagauauaaacugauuuuga

SEQ ID NO: 692054 - RNA, 13 nt, Haemophilus influenzae Rd
aagauauuuuuac

SEQ ID NO: 692055 - RNA, 23 nt, Haemophilus influenzae Rd
aagauaugcucgccucgcuuucc

SEQ ID NO: 692056 - RNA, 21 nt, Haemophilus influenzae Rd
uuuguaagauacguaaguucc

SEQ ID NO: 692057 - RNA, 17 nt, Haemophilus influenzae Rd
uuuguaagcaacacaga

SEQ ID NO: 692058 - RNA, 17 nt, Haemophilus influenzae Rd
uuuguaauaaauuuuau

SEQ ID NO: 692059 - RNA, 14 nt, Haemophilus influenzae Rd
uuuguaauuucuca

SEQ ID NO: 692060 - RNA, 14 nt, Haemophilus influenzae Rd
uuuguagccauuuu

SEQ ID NO: 692061 - RNA, 23 nt, Haemophilus influenzae Rd
uuuguagcgauauucuuuugaau

SEQ ID NO: 692062 - RNA, 15 nt, Haemophilus influenzae Rd
uuuguaucuaaauau

SEQ ID NO: 692063 - RNA, 23 nt, Haemophilus influenzae Rd
uuuguaucuaaauauauuuuuau

SEQ ID NO: 692064 - RNA, 19 nt, Haemophilus influenzae Rd
uuugucagugguuucuguu

SEQ ID NO: 692065 - RNA, 19 nt, Haemophilus influenzae Rd
uuugugcaagcacauuaau

SEQ ID NO: 692066 - RNA, 17 nt, Haemophilus influenzae Rd
uuugugauugacauuuu

SEQ ID NO: 692067 - RNA, 13 nt, Haemophilus influenzae Rd
uuugugauuucaa

SEQ ID NO: 692068 - RNA, 15 nt, Haemophilus influenzae Rd
uuugugauuucaauu

SEQ ID NO: 692069 - RNA, 21 nt, Haemophilus influenzae Rd
uuugugccagcuggaaauucc

SEQ ID NO: 692070 - RNA, 14 nt, Haemophilus influenzae Rd
uuugugccauuucu

SEQ ID NO: 692071 - RNA, 23 nt, Haemophilus influenzae Rd
uuuguuaaaugaaaagcaccuuu

SEQ ID NO: 692072 - RNA, 19 nt, Haemophilus influenzae Rd
uuugugugauguauuuucu

SEQ ID NO: 692073 - RNA, 17 nt, Haemophilus influenzae Rd
uuugugagugauuucau

SEQ ID NO: 692074 - RNA, 21 nt, Haemophilus influenzae Rd
uuugugaggaaguuaaaauac

SEQ ID NO: 692075 - RNA, 17 nt, Haemophilus influenzae Rd
uuuggcacuaaagcaau

SEQ ID NO: 692076 - RNA, 23 nt, Haemophilus influenzae Rd
uuuggcaaauagcaaaaccgaua

SEQ ID NO: 692077 - RNA, 20 nt, Haemophilus influenzae Rd
uuuggcguaaauuauuuauu

SEQ ID NO: 692078 - RNA, 24 nt, Haemophilus influenzae Rd
uuuggcucuucuuuaauuucuuca

SEQ ID NO: 692079 - RNA, 15 nt, Haemophilus influenzae Rd
uuugggaaugccauu

SEQ ID NO: 692080 - RNA, 15 nt, Haemophilus influenzae Rd
uuuggcucacaagac

SEQ ID NO: 692081 - RNA, 22 nt, Haemophilus influenzae Rd
uuugguguauuuauaacacaga

SEQ ID NO: 692082 - RNA, 16 nt, Haemophilus influenzae Rd
uuugguucgauaaaca

SEQ ID NO: 692083 - RNA, 22 nt, Haemophilus influenzae Rd
uuugguucgauaaacauuuuuu

SEQ ID NO: 692084 - RNA, 22 nt, Haemophilus influenzae Rd
uuugguaagcaauagauucuaa

SEQ ID NO: 692085 - RNA, 17 nt, Haemophilus influenzae Rd
uuugcuuggaauaaauu

SEQ ID NO: 692086 - RNA, 19 nt, Haemophilus influenzae Rd
uuugcuuggaauaaauuaa

SEQ ID NO: 692087 - RNA, 18 nt, Haemophilus influenzae Rd
uuugcuugaguauuuacu

SEQ ID NO: 692088 - RNA, 18 nt, Haemophilus influenzae Rd
uuugcuuccuuauugccu

SEQ ID NO: 692089 - RNA, 20 nt, Haemophilus influenzae Rd
uuugcuggucacuugugauu

SEQ ID NO: 692090 - RNA, 20 nt, Haemophilus influenzae Rd
uuugcuuuuuguuacaucuu

SEQ ID NO: 692091 - RNA, 19 nt, Haemophilus influenzae Rd
uuugcuuuuuuaauuuggg

SEQ ID NO: 692092 - RNA, 18 nt, Haemophilus influenzae Rd
uuuggaaagaguaagcaa

SEQ ID NO: 692093 - RNA, 22 nt, Haemophilus influenzae Rd
uuuggacuuuauuugauuguug

SEQ ID NO: 692094 - RNA, 13 nt, Haemophilus influenzae Rd
uuuggaauaaacu

SEQ ID NO: 692095 - RNA, 19 nt, Haemophilus influenzae Rd
uuuggauugguguuuaaau

SEQ ID NO: 692096 - RNA, 20 nt, Haemophilus influenzae Rd
uuuggaucauuagcaacuuc

SEQ ID NO: 692097 - RNA, 21 nt, Haemophilus influenzae Rd
uuuggaucauuagcaacuucc

SEQ ID NO: 692098 - RNA, 18 nt, Haemophilus influenzae Rd
uuuggaguuguuuaaaau

SEQ ID NO: 692099 - RNA, 22 nt, Haemophilus influenzae Rd
uuuggaugaaacgagauuuauu

SEQ ID NO: 692100 - RNA, 12 nt, Haemophilus influenzae Rd
uuuguucauuuu

SEQ ID NO: 692101 - RNA, 13 nt, Haemophilus influenzae Rd
uuuguuauuaaau

SEQ ID NO: 692102 - RNA, 15 nt, Haemophilus influenzae Rd
uuuguuauuaaauaa

SEQ ID NO: 692103 - RNA, 19 nt, Haemophilus influenzae Rd
uuuguuagaaauacauuau

SEQ ID NO: 692104 - RNA, 17 nt, Haemophilus influenzae Rd
uuuguuacaacgccuca

SEQ ID NO: 692105 - RNA, 23 nt, Haemophilus influenzae Rd
uuuguuacaucuucaaaaacaua

SEQ ID NO: 692106 - RNA, 20 nt, Haemophilus influenzae Rd
uuuguuaagcucacuugcau

SEQ ID NO: 692107 - RNA, 22 nt, Haemophilus influenzae Rd
uuuguugagcugcuuguaacca

SEQ ID NO: 692108 - RNA, 18 nt, Haemophilus influenzae Rd
uuuguugguugaguucuu

SEQ ID NO: 692109 - RNA, 20 nt, Haemophilus influenzae Rd
uuuguugauaaacauaaccu

SEQ ID NO: 692110 - RNA, 12 nt, Haemophilus influenzae Rd
uuuguuuaauug

SEQ ID NO: 692111 - RNA, 19 nt, Haemophilus influenzae Rd
uuuguuuuauagccuucug

SEQ ID NO: 692112 - RNA, 13 nt, Haemophilus influenzae Rd
uuuguuuucagga

SEQ ID NO: 692113 - RNA, 21 nt, Haemophilus influenzae Rd
uuuuaaaaaauaaauuuaaau

SEQ ID NO: 692114 - RNA, 18 nt, Haemophilus influenzae Rd
uuuuaaaaaauaauuuag

SEQ ID NO: 692115 - RNA, 21 nt, Haemophilus influenzae Rd
uuuuaaaacacgaaaaaaacc

SEQ ID NO: 692116 - RNA, 22 nt, Haemophilus influenzae Rd
uuuuaaaaccacaauaaaauaa

SEQ ID NO: 692117 - RNA, 14 nt, Haemophilus influenzae Rd
uuuuaaaacuauuu

SEQ ID NO: 692118 - RNA, 15 nt, Haemophilus influenzae Rd
uuuuaaaacuauuuu

SEQ ID NO: 692119 - RNA, 17 nt, Haemophilus influenzae Rd
uuuuaaaacuauuuuua

SEQ ID NO: 692120 - RNA, 18 nt, Haemophilus influenzae Rd
uuuuaaaaucuuuggauu

SEQ ID NO: 692121 - RNA, 15 nt, Haemophilus influenzae Rd
uuuuaaaauuuauuu

SEQ ID NO: 692122 - RNA, 12 nt, Haemophilus influenzae Rd
uuuuaaaauuug

SEQ ID NO: 692123 - RNA, 16 nt, Haemophilus influenzae Rd
uuuuaaacaauauauu

SEQ ID NO: 692124 - RNA, 18 nt, Haemophilus influenzae Rd
uuuuaaaaucucucaaaa

SEQ ID NO: 692125 - RNA, 19 nt, Haemophilus influenzae Rd
uuuuaaaauaaauuuuaaa

SEQ ID NO: 692126 - RNA, 13 nt, Haemophilus influenzae Rd
uuuuaaaauauca

SEQ ID NO: 692127 - RNA, 14 nt, Haemophilus influenzae Rd
uuuuaaaaucaucu

SEQ ID NO: 692128 - RNA, 12 nt, Haemophilus influenzae Rd
uuuuaaagaguu

SEQ ID NO: 692129 - RNA, 19 nt, Haemophilus influenzae Rd
uuuuaaaguaaauuuuaaa

SEQ ID NO: 692130 - RNA, 17 nt, Haemophilus influenzae Rd
uuuuaaaucccaaucuc

SEQ ID NO: 692131 - RNA, 13 nt, Haemophilus influenzae Rd
uuuuaaauaaaaa

SEQ ID NO: 692132 - RNA, 18 nt, Haemophilus influenzae Rd
uuuuaaauacagcucaaa

SEQ ID NO: 692133 - RNA, 23 nt, Haemophilus influenzae Rd
uuuuaaauacagcucaaaaugcu

SEQ ID NO: 692134 - RNA, 18 nt, Haemophilus influenzae Rd
uuuuaacuuaaucauuuu

SEQ ID NO: 692135 - RNA, 20 nt, Haemophilus influenzae Rd
uuuuaaccgcacuuuuaauu

SEQ ID NO: 692136 - RNA, 21 nt, Haemophilus influenzae Rd
uuuuaaccgcacuuuuuaaua

SEQ ID NO: 692137 - RNA, 23 nt, Haemophilus influenzae Rd
uuuuaaccgcacuuuuuaauaaa

SEQ ID NO: 692138 - RNA, 14 nt, Haemophilus influenzae Rd
uuuuaacaaaagcu

SEQ ID NO: 692139 - RNA, 16 nt, Haemophilus influenzae Rd
uuuuaacacuuuuuca

SEQ ID NO: 692140 - RNA, 13 nt, Haemophilus influenzae Rd
uuuuaauaucuuc

SEQ ID NO: 692141 - RNA, 15 nt, Haemophilus influenzae Rd
uuuuaauaaagauaa

SEQ ID NO: 692142 - RNA, 19 nt, Haemophilus influenzae Rd
uuuuaauaaaguaaaauau

SEQ ID NO: 692143 - RNA, 21 nt, Haemophilus influenzae Rd
uuuuaauaaaauguuuauauu

SEQ ID NO: 692144 - RNA, 13 nt, Haemophilus influenzae Rd
uuuuaaguuucac

SEQ ID NO: 692145 - RNA, 13 nt, Haemophilus influenzae Rd
uuuuaaguuuuca

SEQ ID NO: 692146 - RNA, 17 nt, Haemophilus influenzae Rd
uuuuaagguuuuuuccg

SEQ ID NO: 692147 - RNA, 21 nt, Haemophilus influenzae Rd
uuuuaagucgcuaauuuuuuu

SEQ ID NO: 692148 - RNA, 19 nt, Haemophilus influenzae Rd
uuuuacgaacuaauaagcu

SEQ ID NO: 692149 - RNA, 23 nt, Haemophilus influenzae Rd
uuuuacgagaaagguguaauucc

SEQ ID NO: 692150 - RNA, 13 nt, Haemophilus influenzae Rd
uuuuaccauaucc

SEQ ID NO: 692151 - RNA, 23 nt, Haemophilus influenzae Rd
uuuuaccgcacuuuucaacaaaa

SEQ ID NO: 692152 - RNA, 18 nt, Haemophilus influenzae Rd
uuuuaccgcacuuuuguu

SEQ ID NO: 692153 - RNA, 22 nt, Haemophilus influenzae Rd
uuuuaccgcacuuuuuuuauau

SEQ ID NO: 692154 - RNA, 21 nt, Haemophilus influenzae Rd
uuuuacaccguccaagguuuu

SEQ ID NO: 692155 - RNA, 14 nt, Haemophilus influenzae Rd
uuuuacauauaaaa

SEQ ID NO: 692156 - RNA, 16 nt, Haemophilus influenzae Rd
uuuuaccaagaaauaa

SEQ ID NO: 692157 - RNA, 17 nt, Haemophilus influenzae Rd
uuuuaccaagaaauaag

SEQ ID NO: 692158 - RNA, 20 nt, Haemophilus influenzae Rd
uuuuaccaauugauuuuuca

SEQ ID NO: 692159 - RNA, 19 nt, Haemophilus influenzae Rd
uuuuacaacauuaccuucu

SEQ ID NO: 692160 - RNA, 14 nt, Haemophilus influenzae Rd
uuuuaauuguucuu

SEQ ID NO: 692161 - RNA, 12 nt, Haemophilus influenzae Rd
uuuuaauuuagc

SEQ ID NO: 692162 - RNA, 17 nt, Haemophilus influenzae Rd
uuuuaauuuuauagaaa

SEQ ID NO: 692163 - RNA, 19 nt, Haemophilus influenzae Rd
uuuuaaugcuuacaaaauu

SEQ ID NO: 692164 - RNA, 17 nt, Haemophilus influenzae Rd
uuuuaaugggauuuuua

SEQ ID NO: 692165 - RNA, 22 nt, Haemophilus influenzae Rd
uuuuaaucgcacuuaaaagauu

SEQ ID NO: 692166 - RNA, 20 nt, Haemophilus influenzae Rd
uuuuaauugguuuugugcuu

SEQ ID NO: 692167 - RNA, 18 nt, Haemophilus influenzae Rd
uuuuaauguaauaaaaaa

SEQ ID NO: 692168 - RNA, 19 nt, Haemophilus influenzae Rd
uuuuacuacguaaagagag

SEQ ID NO: 692169 - RNA, 14 nt, Haemophilus influenzae Rd
uuuuacuucaucaa

SEQ ID NO: 692170 - RNA, 15 nt, Haemophilus influenzae Rd
uuuuacgauuucugc

SEQ ID NO: 692171 - RNA, 23 nt, Haemophilus influenzae Rd
uuuuacgccauucuuuauucguu

SEQ ID NO: 692172 - RNA, 15 nt, Haemophilus influenzae Rd
uuuuacguuuuaaau

SEQ ID NO: 692173 - RNA, 21 nt, Haemophilus influenzae Rd
uuuuacuaaaugcuguagaaa

SEQ ID NO: 692174 - RNA, 23 nt, Haemophilus influenzae Rd
uuuuacuaaaugcuguagaaauu

SEQ ID NO: 692175 - RNA, 16 nt, Haemophilus influenzae Rd
uuuuacgugcgaauuu

SEQ ID NO: 692176 - RNA, 18 nt, Haemophilus influenzae Rd
uuuuacgugcgaauuuuu

SEQ ID NO: 692177 - RNA, 23 nt, Haemophilus influenzae Rd
uuuuagaaagcuggcgaccuuug

SEQ ID NO: 692178 - RNA, 20 nt, Haemophilus influenzae Rd
uuuuagacggucaaauucag

SEQ ID NO: 692179 - RNA, 17 nt, Haemophilus influenzae Rd
uuuuauacuuacucaau

SEQ ID NO: 692180 - RNA, 20 nt, Haemophilus influenzae Rd
uuuuauaaccaguuauucuu

SEQ ID NO: 692181 - RNA, 15 nt, Haemophilus influenzae Rd
uuuuaguuucuaauu

SEQ ID NO: 692182 - RNA, 19 nt, Haemophilus influenzae Rd
uuuuaguuuuuuuauaaaa

SEQ ID NO: 692183 - RNA, 13 nt, Haemophilus influenzae Rd
uuuuauaaaaaaa

SEQ ID NO: 692184 - RNA, 15 nt, Haemophilus influenzae Rd
uuuuauaaaaaaaca

SEQ ID NO: 692185 - RNA, 19 nt, Haemophilus influenzae Rd
uuuuagugcuguauauuuu

SEQ ID NO: 692186 - RNA, 20 nt, Haemophilus influenzae Rd
uuuuaguuagaagugaaaua

SEQ ID NO: 692187 - RNA, 22 nt, Haemophilus influenzae Rd
uuuuaguuaucuguauaaauga

SEQ ID NO: 692188 - RNA, 14 nt, Haemophilus influenzae Rd
uuuuaguuaaauaa

SEQ ID NO: 692189 - RNA, 17 nt, Haemophilus influenzae Rd
uuuuaguaauuuuaauu

SEQ ID NO: 692190 - RNA, 21 nt, Haemophilus influenzae Rd
uuuuaggugcuuuuaaauuuu

SEQ ID NO: 692191 - RNA, 22 nt, Haemophilus influenzae Rd
uuuuagcugaaaucccuuagaa

SEQ ID NO: 692192 - RNA, 16 nt, Haemophilus influenzae Rd
uuuuagcugauuuuuu

SEQ ID NO: 692193 - RNA, 17 nt, Haemophilus influenzae Rd
uuuuagcugauuuuuua

SEQ ID NO: 692194 - RNA, 20 nt, Haemophilus influenzae Rd
uuuuagcugauuuuuuaaag

SEQ ID NO: 692195 - RNA, 23 nt, Haemophilus influenzae Rd
uuuuagcugauuuuuuaaaguaa

SEQ ID NO: 692196 - RNA, 13 nt, Haemophilus influenzae Rd
uuuuauuaacaaa

SEQ ID NO: 692197 - RNA, 13 nt, Haemophilus influenzae Rd
uuuuauuacaaaa

SEQ ID NO: 692198 - RNA, 15 nt, Haemophilus influenzae Rd
uuuuauuacccuauu

SEQ ID NO: 692199 - RNA, 13 nt, Haemophilus influenzae Rd
uuuuauuaucaaa

SEQ ID NO: 692200 - RNA, 14 nt, Haemophilus influenzae Rd
uuuuauuaucaaaa

SEQ ID NO: 692201 - RNA, 16 nt, Haemophilus influenzae Rd
uuuuauggcuugugcu

SEQ ID NO: 692202 - RNA, 23 nt, Haemophilus influenzae Rd
uuuuauggcuugugcuauacaaa

SEQ ID NO: 692203 - RNA, 17 nt, Haemophilus influenzae Rd
uuuuauguguuuuuaau

SEQ ID NO: 692204 - RNA, 22 nt, Haemophilus influenzae Rd
uuuuauucuccaaauauaaaau

SEQ ID NO: 692205 - RNA, 19 nt, Haemophilus influenzae Rd
uuuuauugaaauuuuaauu

SEQ ID NO: 692206 - RNA, 16 nt, Haemophilus influenzae Rd
uuuuauugaacuguuu

SEQ ID NO: 692207 - RNA, 12 nt, Haemophilus influenzae Rd
uuuuauuucuaa

SEQ ID NO: 692208 - RNA, 21 nt, Haemophilus influenzae Rd
uuuuauuucuaaucauuuguu

SEQ ID NO: 692209 - RNA, 14 nt, Haemophilus influenzae Rd
uuuuauuucucauu

SEQ ID NO: 692210 - RNA, 17 nt, Haemophilus influenzae Rd
uuuuauuuguuaauaaa

SEQ ID NO: 692211 - RNA, 13 nt, Haemophilus influenzae Rd
uuuuauuuuaauu

SEQ ID NO: 692212 - RNA, 13 nt, Haemophilus influenzae Rd
uuuuauuuuacua

SEQ ID NO: 692213 - RNA, 15 nt, Haemophilus influenzae Rd
uuuuauuuuacuaau

SEQ ID NO: 692214 - RNA, 12 nt, Haemophilus influenzae Rd
uuuuauuuacuu

SEQ ID NO: 692215 - RNA, 11 nt, Haemophilus influenzae Rd
uuuuauuuauu

SEQ ID NO: 692216 - RNA, 15 nt, Haemophilus influenzae Rd
uuuuauuuaauauaa

SEQ ID NO: 692217 - RNA, 14 nt, Haemophilus influenzae Rd
uuuuauuuauauaa

SEQ ID NO: 692218 - RNA, 12 nt, Haemophilus influenzae Rd
uuuuaugaagaa

SEQ ID NO: 692219 - RNA, 15 nt, Haemophilus influenzae Rd
uuuuaucuaaaaaag

SEQ ID NO: 692220 - RNA, 21 nt, Haemophilus influenzae Rd
uuuuaucgagaaaauuaaaaa

SEQ ID NO: 692221 - RNA, 14 nt, Haemophilus influenzae Rd
uuuuaucuauaaaa

SEQ ID NO: 692222 - RNA, 18 nt, Haemophilus influenzae Rd
uuuuaucuauaaaaagaa

SEQ ID NO: 692223 - RNA, 19 nt, Haemophilus influenzae Rd
uuuuaucuauaaaaagaac

SEQ ID NO: 692224 - RNA, 13 nt, Haemophilus influenzae Rd
uuuuauauuuuuu

SEQ ID NO: 692225 - RNA, 16 nt, Haemophilus influenzae Rd
uuuuauauuuuuuacu

SEQ ID NO: 692226 - RNA, 19 nt, Haemophilus influenzae Rd
uuuuaucaaaaaucuuauu

SEQ ID NO: 692227 - RNA, 22 nt, Haemophilus influenzae Rd
uuuuauagugauuauuuacaau

SEQ ID NO: 692228 - RNA, 23 nt, Haemophilus influenzae Rd
uuuuaucauugcuccacuucuua

SEQ ID NO: 692229 - RNA, 17 nt, Haemophilus influenzae Rd
uuuuaucaacuaaaaaa

SEQ ID NO: 692230 - RNA, 23 nt, Haemophilus influenzae Rd
uuuuauccgaguuaaacgcuguu

SEQ ID NO: 692231 - RNA, 13 nt, Haemophilus influenzae Rd
uuuuauccaaccu

SEQ ID NO: 692232 - RNA, 21 nt, Haemophilus influenzae Rd
uuuuauccaaccuacauuaau

SEQ ID NO: 692233 - RNA, 15 nt, Haemophilus influenzae Rd
uuuuauccuauuaau

SEQ ID NO: 692234 - RNA, 18 nt, Haemophilus influenzae Rd
uuuuaucgacaaauuaau

SEQ ID NO: 692235 - RNA, 20 nt, Haemophilus influenzae Rd
uuuuaucgacaaauuaauaa

SEQ ID NO: 692236 - RNA, 14 nt, Haemophilus influenzae Rd
uuuucgcaaaaucu

SEQ ID NO: 692237 - RNA, 22 nt, Haemophilus influenzae Rd
uuuucgcaagauagcaaaauau

SEQ ID NO: 692238 - RNA, 17 nt, Haemophilus influenzae Rd
uuuucgcaauaucauca

SEQ ID NO: 692239 - RNA, 23 nt, Haemophilus influenzae Rd
uuuucgacauucgcauauuuuug

SEQ ID NO: 692240 - RNA, 16 nt, Haemophilus influenzae Rd
uuuuccuuaaucugaa

SEQ ID NO: 692241 - RNA, 15 nt, Haemophilus influenzae Rd
uuuuccuucugccau

SEQ ID NO: 692242 - RNA, 21 nt, Haemophilus influenzae Rd
uuuucgcaggaucacaaucau

SEQ ID NO: 692243 - RNA, 20 nt, Haemophilus influenzae Rd
uuuucgcaucaaucacagca

SEQ ID NO: 692244 - RNA, 18 nt, Haemophilus influenzae Rd
uuuucgcauuuuaacuca

SEQ ID NO: 692245 - RNA, 18 nt, Haemophilus influenzae Rd
uuuucgccuaauucaaua

SEQ ID NO: 692246 - RNA, 23 nt, Haemophilus influenzae Rd
uuuucggacucgcuguaacauca

SEQ ID NO: 692247 - RNA, 14 nt, Haemophilus influenzae Rd
uuuucuaaaaaacg

SEQ ID NO: 692248 - RNA, 14 nt, Haemophilus influenzae Rd
uuuucguauuucgu

SEQ ID NO: 692249 - RNA, 16 nt, Haemophilus influenzae Rd
uuuuccgcguaaaguu

SEQ ID NO: 692250 - RNA, 16 nt, Haemophilus influenzae Rd
uuuuccuacagugacu

SEQ ID NO: 692251 - RNA, 13 nt, Haemophilus influenzae Rd
uuuuccuaaaguu

SEQ ID NO: 692252 - RNA, 15 nt, Haemophilus influenzae Rd
uuuuccuaaaguuuu

SEQ ID NO: 692253 - RNA, 18 nt, Haemophilus influenzae Rd
uuuucccaaugcaccaaa

SEQ ID NO: 692254 - RNA, 14 nt, Haemophilus influenzae Rd
uuuucccaguaaau

SEQ ID NO: 692255 - RNA, 17 nt, Haemophilus influenzae Rd
uuuucccaguaaauauc

SEQ ID NO: 692256 - RNA, 15 nt, Haemophilus influenzae Rd
uuuuccgaaaaaaca

SEQ ID NO: 692257 - RNA, 13 nt, Haemophilus influenzae Rd
uuuucccccagua

SEQ ID NO: 692258 - RNA, 17 nt, Haemophilus influenzae Rd
uuuuccagcaaaaaaau

SEQ ID NO: 692259 - RNA, 20 nt, Haemophilus influenzae Rd
uuuuccagcaaaaaaauuuc

SEQ ID NO: 692260 - RNA, 19 nt, Haemophilus influenzae Rd
uuuuccaccgcacuuugga

SEQ ID NO: 692261 - RNA, 13 nt, Haemophilus influenzae Rd
uuuuccauuuuug

SEQ ID NO: 692262 - RNA, 17 nt, Haemophilus influenzae Rd
uuuuccauaauaacgag

SEQ ID NO: 692263 - RNA, 16 nt, Haemophilus influenzae Rd
uuuuccaucaccuuca

SEQ ID NO: 692264 - RNA, 23 nt, Haemophilus influenzae Rd
uuuuccaucaccuucaacauaag

SEQ ID NO: 692265 - RNA, 13 nt, Haemophilus influenzae Rd
uuuucauuuuuug

SEQ ID NO: 692266 - RNA, 12 nt, Haemophilus influenzae Rd
uuuuccaaaauu

SEQ ID NO: 692267 - RNA, 17 nt, Haemophilus influenzae Rd
uuuucagauaaucaaaa

SEQ ID NO: 692268 - RNA, 15 nt, Haemophilus influenzae Rd
uuuucagcaaaaugc

SEQ ID NO: 692269 - RNA, 16 nt, Haemophilus influenzae Rd
uuuucagcaaaaugcg

SEQ ID NO: 692270 - RNA, 19 nt, Haemophilus influenzae Rd
uuuucacaccgucuaaaaa

SEQ ID NO: 692271 - RNA, 21 nt, Haemophilus influenzae Rd
uuuucaccaacaaauucuaau

SEQ ID NO: 692272 - RNA, 23 nt, Haemophilus influenzae Rd
uuuucacccaucuaaacuuauau

SEQ ID NO: 692273 - RNA, 13 nt, Haemophilus influenzae Rd
uuuucaccuugau

SEQ ID NO: 692274 - RNA, 17 nt, Haemophilus influenzae Rd
uuuucaccgcacuuucu

SEQ ID NO: 692275 - RNA, 16 nt, Haemophilus influenzae Rd
uuuucacgccuuuguc

SEQ ID NO: 692276 - RNA, 16 nt, Haemophilus influenzae Rd
uuuucagguacaacau

SEQ ID NO: 692277 - RNA, 15 nt, Haemophilus influenzae Rd
uuuucagcuaaaauu

SEQ ID NO: 692278 - RNA, 16 nt, Haemophilus influenzae Rd
uuuucaguuguuugaa

SEQ ID NO: 692279 - RNA, 18 nt, Haemophilus influenzae Rd
uuuucauaaauaucaaca

SEQ ID NO: 692280 - RNA, 21 nt, Haemophilus influenzae Rd
uuuucauacaaucucuagauu

SEQ ID NO: 692281 - RNA, 15 nt, Haemophilus influenzae Rd
uuuucauauucccaa

SEQ ID NO: 692282 - RNA, 12 nt, Haemophilus influenzae Rd
uuuucaucaaug

SEQ ID NO: 692283 - RNA, 17 nt, Haemophilus influenzae Rd
uuuucaucaaugcaaca

SEQ ID NO: 692284 - RNA, 22 nt, Haemophilus influenzae Rd
uuuucaucaaugccauuuuuua

SEQ ID NO: 692285 - RNA, 22 nt, Haemophilus influenzae Rd
uuuucauaucuuccguuguuuu

SEQ ID NO: 692286 - RNA, 18 nt, Haemophilus influenzae Rd
uuuucaucuuuuuauaaa

SEQ ID NO: 692287 - RNA, 19 nt, Haemophilus influenzae Rd
uuuucaucuuuuuauaaaa

SEQ ID NO: 692288 - RNA, 20 nt, Haemophilus influenzae Rd
uuuucauagaagaguuuuaa

SEQ ID NO: 692289 - RNA, 18 nt, Haemophilus influenzae Rd
uuuucaucguuaauuaau

SEQ ID NO: 692290 - RNA, 17 nt, Haemophilus influenzae Rd
uuuucauuauauuuaau

SEQ ID NO: 692291 - RNA, 15 nt, Haemophilus influenzae Rd
uuuucaaauaaguuu

SEQ ID NO: 692292 - RNA, 14 nt, Haemophilus influenzae Rd
uuuucaacacuucc

SEQ ID NO: 692293 - RNA, 15 nt, Haemophilus influenzae Rd
uuuucaaauugaaaa

SEQ ID NO: 692294 - RNA, 16 nt, Haemophilus influenzae Rd
uuuucaacaaaaaaca

SEQ ID NO: 692295 - RNA, 14 nt, Haemophilus influenzae Rd
uuuucaauaucaaa

SEQ ID NO: 692296 - RNA, 14 nt, Haemophilus influenzae Rd
uuuucaaugaaaua

SEQ ID NO: 692297 - RNA, 19 nt, Haemophilus influenzae Rd
uuuucaauggcaucaauaa

SEQ ID NO: 692298 - RNA, 21 nt, Haemophilus influenzae Rd
uuuucaauggcaucaauaaua

SEQ ID NO: 692299 - RNA, 15 nt, Haemophilus influenzae Rd
uuuucaauuuuaaaa

SEQ ID NO: 692300 - RNA, 22 nt, Haemophilus influenzae Rd
uuuucaaguaacuuucacaacu

SEQ ID NO: 692301 - RNA, 21 nt, Haemophilus influenzae Rd
uuuucaaaggcucuaccuaaa

SEQ ID NO: 692302 - RNA, 11 nt, Haemophilus influenzae Rd
uuuucaaacac

SEQ ID NO: 692303 - RNA, 18 nt, Haemophilus influenzae Rd
uuuucaaacacaaaauaa

SEQ ID NO: 692304 - RNA, 14 nt, Haemophilus influenzae Rd
uuuucaaaaguuuu

SEQ ID NO: 692305 - RNA, 16 nt, Haemophilus influenzae Rd
uuuuauuuuaucuauu

SEQ ID NO: 692306 - RNA, 18 nt, Haemophilus influenzae Rd
uuuuauuuuauuaucaau

SEQ ID NO: 692307 - RNA, 16 nt, Haemophilus influenzae Rd
uuuuauuuuuacuauu

SEQ ID NO: 692308 - RNA, 16 nt, Haemophilus influenzae Rd
uuuuauuuuccaucau

SEQ ID NO: 692309 - RNA, 12 nt, Haemophilus influenzae Rd
uuuuauuuugaa

SEQ ID NO: 692310 - RNA, 17 nt, Haemophilus influenzae Rd
uuuuucagcaagcauuu

SEQ ID NO: 692311 - RNA, 13 nt, Haemophilus influenzae Rd
uuuuucaucaaug

SEQ ID NO: 692312 - RNA, 14 nt, Haemophilus influenzae Rd
uuuuuccaauucuu

SEQ ID NO: 692313 - RNA, 14 nt, Haemophilus influenzae Rd
uuuuuccagcaaaa

SEQ ID NO: 692314 - RNA, 11 nt, Haemophilus influenzae Rd
uuuuuccucag

SEQ ID NO: 692315 - RNA, 18 nt, Haemophilus influenzae Rd
uuuuucaccgcacuuaau

SEQ ID NO: 692316 - RNA, 19 nt, Haemophilus influenzae Rd
uuuuucaccgcacuuucuu

SEQ ID NO: 692317 - RNA, 15 nt, Haemophilus influenzae Rd
uuuuucacaagcaua

SEQ ID NO: 692318 - RNA, 22 nt, Haemophilus influenzae Rd
uuuuucacaccgucuaaaaauc

SEQ ID NO: 692319 - RNA, 18 nt, Haemophilus influenzae Rd
uuuuucagugaguucaua

SEQ ID NO: 692320 - RNA, 12 nt, Haemophilus influenzae Rd
uuuuucauaaau

SEQ ID NO: 692321 - RNA, 24 nt, Haemophilus influenzae Rd
uuuuucagaagucacauauuguuu

SEQ ID NO: 692322 - RNA, 13 nt, Haemophilus influenzae Rd
uuuuuauuugguu

SEQ ID NO: 692323 - RNA, 14 nt, Haemophilus influenzae Rd
uuuuucaaaaauuu

SEQ ID NO: 692324 - RNA, 12 nt, Haemophilus influenzae Rd
uuuuucaaugcu

SEQ ID NO: 692325 - RNA, 17 nt, Haemophilus influenzae Rd
uuuuuagauuuauuucu

SEQ ID NO: 692326 - RNA, 13 nt, Haemophilus influenzae Rd
uuuuuagaauuaa

SEQ ID NO: 692327 - RNA, 12 nt, Haemophilus influenzae Rd
uuuuuagaaaau

SEQ ID NO: 692328 - RNA, 16 nt, Haemophilus influenzae Rd
uuuuuagaaaaucacu

SEQ ID NO: 692329 - RNA, 13 nt, Haemophilus influenzae Rd
uuuuuauaaagua

SEQ ID NO: 692330 - RNA, 23 nt, Haemophilus influenzae Rd
uuuuuaguuuuugcauagccacu

SEQ ID NO: 692331 - RNA, 13 nt, Haemophilus influenzae Rd
uuuuuauaaaaaa

SEQ ID NO: 692332 - RNA, 12 nt, Haemophilus influenzae Rd
uuuuuaguaucg

SEQ ID NO: 692333 - RNA, 19 nt, Haemophilus influenzae Rd
uuuuuaggugcuuuuugcu

SEQ ID NO: 692334 - RNA, 23 nt, Haemophilus influenzae Rd
uuuuuagcucguugccauaaaaa

SEQ ID NO: 692335 - RNA, 12 nt, Haemophilus influenzae Rd
uuuuuauauuuu

SEQ ID NO: 692336 - RNA, 17 nt, Haemophilus influenzae Rd
uuuuuauauuuuuuacu

SEQ ID NO: 692337 - RNA, 15 nt, Haemophilus influenzae Rd
uuuuuaucaauaacu

SEQ ID NO: 692338 - RNA, 17 nt, Haemophilus influenzae Rd
uuuuuauauaaauaacu

SEQ ID NO: 692339 - RNA, 15 nt, Haemophilus influenzae Rd
uuuuuauauguuccu

SEQ ID NO: 692340 - RNA, 12 nt, Haemophilus influenzae Rd
uuuuuauuaaaa

SEQ ID NO: 692341 - RNA, 16 nt, Haemophilus influenzae Rd
uuuuuauuaauaaacu

SEQ ID NO: 692342 - RNA, 20 nt, Haemophilus influenzae Rd
uuuuuaugaccaaauacaau

SEQ ID NO: 692343 - RNA, 18 nt, Haemophilus influenzae Rd
uuuuuauuuagaacaaua

SEQ ID NO: 692344 - RNA, 22 nt, Haemophilus influenzae Rd
uuuuuauuuagaacaauacucu

SEQ ID NO: 692345 - RNA, 12 nt, Haemophilus influenzae Rd
uuuuuauuucua

SEQ ID NO: 692346 - RNA, 19 nt, Haemophilus influenzae Rd
uuuuuauuaugcuaauaau

SEQ ID NO: 692347 - RNA, 12 nt, Haemophilus influenzae Rd
uuuuuauucaaa

SEQ ID NO: 692348 - RNA, 12 nt, Haemophilus influenzae Rd
uuuuuauucaau

SEQ ID NO: 692349 - RNA, 23 nt, Haemophilus influenzae Rd
uuuuuaaggaaacguaaaauauc

SEQ ID NO: 692350 - RNA, 16 nt, Haemophilus influenzae Rd
uuuuuaaguaguauuu

SEQ ID NO: 692351 - RNA, 14 nt, Haemophilus influenzae Rd
uuuuuaauaaagua

SEQ ID NO: 692352 - RNA, 21 nt, Haemophilus influenzae Rd
uuuuuaauaaaguaaaauauu

SEQ ID NO: 692353 - RNA, 14 nt, Haemophilus influenzae Rd
uuuuuaauaaauca

SEQ ID NO: 692354 - RNA, 21 nt, Haemophilus influenzae Rd
uuuuuaaccgcacuuuuuaau

SEQ ID NO: 692355 - RNA, 19 nt, Haemophilus influenzae Rd
uuuuuaaucaauuaaagaa

SEQ ID NO: 692356 - RNA, 20 nt, Haemophilus influenzae Rd
uuuuuaauuagagagaaaaa

SEQ ID NO: 692357 - RNA, 13 nt, Haemophilus influenzae Rd
uuuuuacauuaag

SEQ ID NO: 692358 - RNA, 16 nt, Haemophilus influenzae Rd
uuuuuacauuauugaa

SEQ ID NO: 692359 - RNA, 14 nt, Haemophilus influenzae Rd
uuuuuacagauaaa

SEQ ID NO: 692360 - RNA, 17 nt, Haemophilus influenzae Rd
uuuuuacaaaaaaguac

SEQ ID NO: 692361 - RNA, 16 nt, Haemophilus influenzae Rd
uuuuuacaaaaaguac

SEQ ID NO: 692362 - RNA, 12 nt, Haemophilus influenzae Rd
uuuuuaaaauag

SEQ ID NO: 692363 - RNA, 12 nt, Haemophilus influenzae Rd
uuuuguuuuguu

SEQ ID NO: 692364 - RNA, 13 nt, Haemophilus influenzae Rd
uuuuguaauuuuu

SEQ ID NO: 692365 - RNA, 12 nt, Haemophilus influenzae Rd
uuuuguacuucc

SEQ ID NO: 692366 - RNA, 19 nt, Haemophilus influenzae Rd
uuuuguauccaauccuaaa

SEQ ID NO: 692367 - RNA, 23 nt, Haemophilus influenzae Rd
uuuugucccaaaauauuuucaaa

SEQ ID NO: 692368 - RNA, 20 nt, Haemophilus influenzae Rd
uuuugucaccaaauacauuu

SEQ ID NO: 692369 - RNA, 22 nt, Haemophilus influenzae Rd
uuuuguaaucguucaaaaauuu

SEQ ID NO: 692370 - RNA, 17 nt, Haemophilus influenzae Rd
uuuugguggauuauaaa

SEQ ID NO: 692371 - RNA, 23 nt, Haemophilus influenzae Rd
uuuugguaauaaaucaaaagaau

SEQ ID NO: 692372 - RNA, 17 nt, Haemophilus influenzae Rd
uuuuguccgaaaaaacu

SEQ ID NO: 692373 - RNA, 16 nt, Haemophilus influenzae Rd
uuuugucugaaauuuu

SEQ ID NO: 692374 - RNA, 23 nt, Haemophilus influenzae Rd
uuuuguggcacgcccaaaggcuu

SEQ ID NO: 692375 - RNA, 23 nt, Haemophilus influenzae Rd
uuuuguuacaucuucaaaaacau

SEQ ID NO: 692376 - RNA, 16 nt, Haemophilus influenzae Rd
uuuuguugauaaacau

SEQ ID NO: 692377 - RNA, 22 nt, Haemophilus influenzae Rd
uuuuguugauuagcuaauauaa

SEQ ID NO: 692378 - RNA, 16 nt, Haemophilus influenzae Rd
uuuuguucauuuuaaa

SEQ ID NO: 692379 - RNA, 17 nt, Haemophilus influenzae Rd
uuuuguucauuuuaaaa

SEQ ID NO: 692380 - RNA, 16 nt, Haemophilus influenzae Rd
uuuucugcucuucauc

SEQ ID NO: 692381 - RNA, 22 nt, Haemophilus influenzae Rd
uuuucucugcgauuucuuuugg

SEQ ID NO: 692382 - RNA, 15 nt, Haemophilus influenzae Rd
uuuucucgugugaaa

SEQ ID NO: 692383 - RNA, 17 nt, Haemophilus influenzae Rd
uuuucugaacuaaaaua

SEQ ID NO: 692384 - RNA, 20 nt, Haemophilus influenzae Rd
uuuucugaauaaauuuuuua

SEQ ID NO: 692385 - RNA, 13 nt, Haemophilus influenzae Rd
uuuucugauaacu

SEQ ID NO: 692386 - RNA, 17 nt, Haemophilus influenzae Rd
uuuucugcaguuucugg

SEQ ID NO: 692387 - RNA, 13 nt, Haemophilus influenzae Rd
uuuucuauuuaaa

SEQ ID NO: 692388 - RNA, 22 nt, Haemophilus influenzae Rd
uuuucuaccccucuuuucucaa

SEQ ID NO: 692389 - RNA, 18 nt, Haemophilus influenzae Rd
uuuucuacgguuuuaaua

SEQ ID NO: 692390 - RNA, 13 nt, Haemophilus influenzae Rd
uuuucuaauaauc

SEQ ID NO: 692391 - RNA, 14 nt, Haemophilus influenzae Rd
uuuucuaaauuuua

SEQ ID NO: 692392 - RNA, 13 nt, Haemophilus influenzae Rd
uuuucuaaaauca

SEQ ID NO: 692393 - RNA, 23 nt, Haemophilus influenzae Rd
uuuucuaaauagcuaacaauauc

SEQ ID NO: 692394 - RNA, 13 nt, Haemophilus influenzae Rd
uuuucuuauuaau

SEQ ID NO: 692395 - RNA, 13 nt, Haemophilus influenzae Rd
uuuucuuauuucu

SEQ ID NO: 692396 - RNA, 12 nt, Haemophilus influenzae Rd
uuuucuuaugaa

SEQ ID NO: 692397 - RNA, 21 nt, Haemophilus influenzae Rd
uuuucugucacuucgcagaca

SEQ ID NO: 692398 - RNA, 17 nt, Haemophilus influenzae Rd
uuuucuguuuuuccauu

SEQ ID NO: 692399 - RNA, 19 nt, Haemophilus influenzae Rd
uuuucuuaauuuuauuaau

SEQ ID NO: 692400 - RNA, 12 nt, Haemophilus influenzae Rd
uuuucuuacaga

SEQ ID NO: 692401 - RNA, 15 nt, Haemophilus influenzae Rd
uuuucuugcuaaaaa

SEQ ID NO: 692402 - RNA, 11 nt, Haemophilus influenzae Rd
uuuucuucaau

SEQ ID NO: 692403 - RNA, 18 nt, Haemophilus influenzae Rd
uuuugaaguuaucaauaa

SEQ ID NO: 692404 - RNA, 17 nt, Haemophilus influenzae Rd
uuuugaauaaauauucu

SEQ ID NO: 692405 - RNA, 18 nt, Haemophilus influenzae Rd
uuuucuugccaaaauuca

SEQ ID NO: 692406 - RNA, 15 nt, Haemophilus influenzae Rd
uuuucuuuucuucua

SEQ ID NO: 692407 - RNA, 22 nt, Haemophilus influenzae Rd
uuuugauacuaacucaaaauac

SEQ ID NO: 692408 - RNA, 17 nt, Haemophilus influenzae Rd
uuuugaggccagcuuga

SEQ ID NO: 692409 - RNA, 22 nt, Haemophilus influenzae Rd
uuuugaggggaauuuuuuacug

SEQ ID NO: 692410 - RNA, 17 nt, Haemophilus influenzae Rd
uuuugaguuuucaucua

SEQ ID NO: 692411 - RNA, 17 nt, Haemophilus influenzae Rd
uuuugauaaaaaagaaa

SEQ ID NO: 692412 - RNA, 16 nt, Haemophilus influenzae Rd
uuuugagauaaauuuu

SEQ ID NO: 692413 - RNA, 17 nt, Haemophilus influenzae Rd
uuuugaaugguuguucu

SEQ ID NO: 692414 - RNA, 22 nt, Haemophilus influenzae Rd
uuuugcaaaaaguacuugcaag

SEQ ID NO: 692415 - RNA, 13 nt, Haemophilus influenzae Rd
uuuugcaaaccaa

SEQ ID NO: 692416 - RNA, 14 nt, Haemophilus influenzae Rd
uuuugcaagguuuc

SEQ ID NO: 692417 - RNA, 13 nt, Haemophilus influenzae Rd
uuuugcaauuuuu

SEQ ID NO: 692418 - RNA, 16 nt, Haemophilus influenzae Rd
uuuugcauauugaacu

SEQ ID NO: 692419 - RNA, 20 nt, Haemophilus influenzae Rd
uuuugcaccacguucuuuua

SEQ ID NO: 692420 - RNA, 23 nt, Haemophilus influenzae Rd
uuuugcaccacguucuuuuaaug

SEQ ID NO: 692421 - RNA, 15 nt, Haemophilus influenzae Rd
uuuugcacugguucu

SEQ ID NO: 692422 - RNA, 19 nt, Haemophilus influenzae Rd
uuuugcagaauacugagau

SEQ ID NO: 692423 - RNA, 18 nt, Haemophilus influenzae Rd
uuuugauugagauuuaau

SEQ ID NO: 692424 - RNA, 16 nt, Haemophilus influenzae Rd
uuuugauugcuacagc

SEQ ID NO: 692425 - RNA, 15 nt, Haemophilus influenzae Rd
uuuugauaugccacc

SEQ ID NO: 692426 - RNA, 22 nt, Haemophilus influenzae Rd
uuuugaugaaaguugaauauuu

SEQ ID NO: 692427 - RNA, 16 nt, Haemophilus influenzae Rd
uuuugaucucuuucua

SEQ ID NO: 692428 - RNA, 15 nt, Haemophilus influenzae Rd
uuuugcuuuucccuu

SEQ ID NO: 692429 - RNA, 16 nt, Haemophilus influenzae Rd
uuuugcuuguaaaaac

SEQ ID NO: 692430 - RNA, 14 nt, Haemophilus influenzae Rd
uuuuggaauauuau

SEQ ID NO: 692431 - RNA, 13 nt, Haemophilus influenzae Rd
uuuuggacuuuau

SEQ ID NO: 692432 - RNA, 15 nt, Haemophilus influenzae Rd
uuuuggauagcaucu

SEQ ID NO: 692433 - RNA, 22 nt, Haemophilus influenzae Rd
uuuuggcgaaccuuucauauaa

SEQ ID NO: 692434 - RNA, 18 nt, Haemophilus influenzae Rd
uuuugcauugagcacuuc

SEQ ID NO: 692435 - RNA, 15 nt, Haemophilus influenzae Rd
uuuugccaaaauucu

SEQ ID NO: 692436 - RNA, 18 nt, Haemophilus influenzae Rd
uuuugccaaaauucuguu

SEQ ID NO: 692437 - RNA, 21 nt, Haemophilus influenzae Rd
uuuugcgcugaccaauuucgc

SEQ ID NO: 692438 - RNA, 23 nt, Haemophilus influenzae Rd
uuuugccuuagcgugaauauauu

SEQ ID NO: 692439 - RNA, 17 nt, Haemophilus influenzae Rd
aaauucauuuaaaauau

SEQ ID NO: 692440 - RNA, 13 nt, Haemophilus influenzae Rd
aaauucaucagaa

SEQ ID NO: 692441 - RNA, 12 nt, Haemophilus influenzae Rd
aaauucauccaa

SEQ ID NO: 692442 - RNA, 22 nt, Haemophilus influenzae Rd
aaauucauucuugcuugaucau

SEQ ID NO: 692443 - RNA, 12 nt, Haemophilus influenzae Rd
aaauuccauuca

SEQ ID NO: 692444 - RNA, 19 nt, Haemophilus influenzae Rd
aaauucaguaagaaaccaa

SEQ ID NO: 692445 - RNA, 20 nt, Haemophilus influenzae Rd
aaauucaguaagaaaccaac

SEQ ID NO: 692446 - RNA, 22 nt, Haemophilus influenzae Rd
aaauucaguaagaaaccaacuu

SEQ ID NO: 692447 - RNA, 17 nt, Haemophilus influenzae Rd
aaauucaguaucaaaua

SEQ ID NO: 692448 - RNA, 19 nt, Haemophilus influenzae Rd
aaauucagugauuaagugc

SEQ ID NO: 692449 - RNA, 17 nt, Haemophilus influenzae Rd
aaauucaguuaagaaaa

SEQ ID NO: 692450 - RNA, 20 nt, Haemophilus influenzae Rd
aaauucaguuaagaaaauaa

SEQ ID NO: 692451 - RNA, 13 nt, Haemophilus influenzae Rd
aaauucacugaca

SEQ ID NO: 692452 - RNA, 15 nt, Haemophilus influenzae Rd
aaauucacuguguuu

SEQ ID NO: 692453 - RNA, 15 nt, Haemophilus influenzae Rd
aaauucaauuuuccc

SEQ ID NO: 692454 - RNA, 17 nt, Haemophilus influenzae Rd
aaauucaccgcacuuuu

SEQ ID NO: 692455 - RNA, 21 nt, Haemophilus influenzae Rd
aaauucaccgcacuuuucuuu

SEQ ID NO: 692456 - RNA, 12 nt, Haemophilus influenzae Rd
aaauucaauacu

SEQ ID NO: 692457 - RNA, 14 nt, Haemophilus influenzae Rd
aaauucaauagguu

SEQ ID NO: 692458 - RNA, 15 nt, Haemophilus influenzae Rd
aaauuauuuuaauaa

SEQ ID NO: 692459 - RNA, 13 nt, Haemophilus influenzae Rd
aaauuauuuucua

SEQ ID NO: 692460 - RNA, 22 nt, Haemophilus influenzae Rd
aaauucaaagaagcguucaaaa

SEQ ID NO: 692461 - RNA, 15 nt, Haemophilus influenzae Rd
aaauucaaagauuau

SEQ ID NO: 692462 - RNA, 19 nt, Haemophilus influenzae Rd
aaauucucgccauaauaaa

SEQ ID NO: 692463 - RNA, 23 nt, Haemophilus influenzae Rd
aaauucucgccauaauaaaaauu

SEQ ID NO: 692464 - RNA, 18 nt, Haemophilus influenzae Rd
aaauucucggcaaugguu

SEQ ID NO: 692465 - RNA, 20 nt, Haemophilus influenzae Rd
aaauucucggcaaugguuca

SEQ ID NO: 692466 - RNA, 19 nt, Haemophilus influenzae Rd
aaauucucgguuguuucau

SEQ ID NO: 692467 - RNA, 16 nt, Haemophilus influenzae Rd
aaauucuauuaaaaua

SEQ ID NO: 692468 - RNA, 18 nt, Haemophilus influenzae Rd
aaauucuguuuuugguaa

SEQ ID NO: 692469 - RNA, 18 nt, Haemophilus influenzae Rd
aaauucucuguuucuuua

SEQ ID NO: 692470 - RNA, 24 nt, Haemophilus influenzae Rd
aaauucucuguuucuuuaaauagu

SEQ ID NO: 692471 - RNA, 20 nt, Haemophilus influenzae Rd
aaauucuacgucaaagccau

SEQ ID NO: 692472 - RNA, 19 nt, Haemophilus influenzae Rd
aaauucguacaaaugaaaa

SEQ ID NO: 692473 - RNA, 16 nt, Haemophilus influenzae Rd
aaauuccgcaauauuu

SEQ ID NO: 692474 - RNA, 17 nt, Haemophilus influenzae Rd
aaauuccgcaauauuua

SEQ ID NO: 692475 - RNA, 21 nt, Haemophilus influenzae Rd
aaauuccuuauuuuacuucaa

SEQ ID NO: 692476 - RNA, 18 nt, Haemophilus influenzae Rd
aaauucgacgauaaccau

SEQ ID NO: 692477 - RNA, 16 nt, Haemophilus influenzae Rd
aaauucgcacacuuuc

SEQ ID NO: 692478 - RNA, 19 nt, Haemophilus influenzae Rd
aaauuauugcuuaugauuu

SEQ ID NO: 692479 - RNA, 14 nt, Haemophilus influenzae Rd
aaauuauuuauuua

SEQ ID NO: 692480 - RNA, 19 nt, Haemophilus influenzae Rd
aaauuauguuuuaucuuua

SEQ ID NO: 692481 - RNA, 14 nt, Haemophilus influenzae Rd
aaauuauauuuuua

SEQ ID NO: 692482 - RNA, 18 nt, Haemophilus influenzae Rd
aaauuaucaaagaauuuu

SEQ ID NO: 692483 - RNA, 15 nt, Haemophilus influenzae Rd
aaauuauauuuuccu

SEQ ID NO: 692484 - RNA, 15 nt, Haemophilus influenzae Rd
aaauuauaauauuua

SEQ ID NO: 692485 - RNA, 14 nt, Haemophilus influenzae Rd
aaauuauagauaaa

SEQ ID NO: 692486 - RNA, 16 nt, Haemophilus influenzae Rd
aaauuauagauaaaua

SEQ ID NO: 692487 - RNA, 19 nt, Haemophilus influenzae Rd
aaauuauagauaaauauca

SEQ ID NO: 692488 - RNA, 18 nt, Haemophilus influenzae Rd
aaauuaggaauuugauca

SEQ ID NO: 692489 - RNA, 15 nt, Haemophilus influenzae Rd
aaauuagcgauuaaa

SEQ ID NO: 692490 - RNA, 22 nt, Haemophilus influenzae Rd
aaauuagcguaaacauuuugua

SEQ ID NO: 692491 - RNA, 22 nt, Haemophilus influenzae Rd
aaauuagcucaauagauuuaau

SEQ ID NO: 692492 - RNA, 20 nt, Haemophilus influenzae Rd
aaauuagccccaaguaauuu

SEQ ID NO: 692493 - RNA, 12 nt, Haemophilus influenzae Rd
aaauuagacaaa

SEQ ID NO: 692494 - RNA, 12 nt, Haemophilus influenzae Rd
uuuuuucugaau

SEQ ID NO: 692495 - RNA, 18 nt, Haemophilus influenzae Rd
uuuuuucugcauuugauu

SEQ ID NO: 692496 - RNA, 12 nt, Haemophilus influenzae Rd
uuuuuugcuuca

SEQ ID NO: 692497 - RNA, 20 nt, Haemophilus influenzae Rd
aaauuaccguguuuuucacg

SEQ ID NO: 692498 - RNA, 17 nt, Haemophilus influenzae Rd
aaauuaccacguucauu

SEQ ID NO: 692499 - RNA, 19 nt, Haemophilus influenzae Rd
aaauuaccacguucauuuc

SEQ ID NO: 692500 - RNA, 22 nt, Haemophilus influenzae Rd
aaauuaccacguucauuucgua

SEQ ID NO: 692501 - RNA, 23 nt, Haemophilus influenzae Rd
aaauuacccaaaugaugaaacaa

SEQ ID NO: 692502 - RNA, 15 nt, Haemophilus influenzae Rd
aaauuaccccaauuc

SEQ ID NO: 692503 - RNA, 13 nt, Haemophilus influenzae Rd
uuuuuuuuuugcu

SEQ ID NO: 692504 - RNA, 12 nt, Haemophilus influenzae Rd
uuuuuuuuaaag

SEQ ID NO: 692505 - RNA, 16 nt, Haemophilus influenzae Rd
aaauuacucaucugaa

SEQ ID NO: 692506 - RNA, 21 nt, Haemophilus influenzae Rd
uuuuugggagguuucaagaag

SEQ ID NO: 692507 - RNA, 15 nt, Haemophilus influenzae Rd
uuuuugccuuuuaau

SEQ ID NO: 692508 - RNA, 13 nt, Haemophilus influenzae Rd
uuuuugcauagcc

SEQ ID NO: 692509 - RNA, 18 nt, Haemophilus influenzae Rd
uuuuugccaaaauucugu

SEQ ID NO: 692510 - RNA, 14 nt, Haemophilus influenzae Rd
uuuuugcaauggcu

SEQ ID NO: 692511 - RNA, 19 nt, Haemophilus influenzae Rd
uuuuugaggggaauuuuuu

SEQ ID NO: 692512 - RNA, 12 nt, Haemophilus influenzae Rd
uuuuuuaaauau

SEQ ID NO: 692513 - RNA, 13 nt, Haemophilus influenzae Rd
uuuuuuaaucaau

SEQ ID NO: 692514 - RNA, 23 nt, Haemophilus influenzae Rd
uuuuuuaaucaauuaaagaaauu

SEQ ID NO: 692515 - RNA, 14 nt, Haemophilus influenzae Rd
uuuuuguuuuuccg

SEQ ID NO: 692516 - RNA, 21 nt, Haemophilus influenzae Rd
uuuuuguauaaaaauuauuuu

SEQ ID NO: 692517 - RNA, 11 nt, Haemophilus influenzae Rd
uuuuugugauu

SEQ ID NO: 692518 - RNA, 19 nt, Haemophilus influenzae Rd
uuuuugaaacguccacaag

SEQ ID NO: 692519 - RNA, 14 nt, Haemophilus influenzae Rd
uuuuucuuuuuccu

SEQ ID NO: 692520 - RNA, 23 nt, Haemophilus influenzae Rd
uuuuugaauagcucgaugagaaa

SEQ ID NO: 692521 - RNA, 19 nt, Haemophilus influenzae Rd
uuuuugacccgcuuuuaau

SEQ ID NO: 692522 - RNA, 12 nt, Haemophilus influenzae Rd
uuuuugaccuuu

SEQ ID NO: 692523 - RNA, 14 nt, Haemophilus influenzae Rd
uuuuugaccuuuuc

SEQ ID NO: 692524 - RNA, 20 nt, Haemophilus influenzae Rd
uuuuucgugaggucugcaau

SEQ ID NO: 692525 - RNA, 17 nt, Haemophilus influenzae Rd
uuuuucgccuaauucaa

SEQ ID NO: 692526 - RNA, 18 nt, Haemophilus influenzae Rd
uuuuucgcaaaaucuugc

SEQ ID NO: 692527 - RNA, 23 nt, Haemophilus influenzae Rd
uuuuucuccacaaaccaagagcc

SEQ ID NO: 692528 - RNA, 14 nt, Haemophilus influenzae Rd
aaaugugauuucca

SEQ ID NO: 692529 - RNA, 15 nt, Haemophilus influenzae Rd
aaauguggucaaaga

SEQ ID NO: 692530 - RNA, 20 nt, Haemophilus influenzae Rd
aaaugugaccgcuuguuuau

SEQ ID NO: 692531 - RNA, 14 nt, Haemophilus influenzae Rd
uuuuuuauuuguuu

SEQ ID NO: 692532 - RNA, 13 nt, Haemophilus influenzae Rd
aaaugugaaaacu

SEQ ID NO: 692533 - RNA, 12 nt, Haemophilus influenzae Rd
uuuuuuauuuau

SEQ ID NO: 692534 - RNA, 13 nt, Haemophilus influenzae Rd
uuuuuucaaucau

SEQ ID NO: 692535 - RNA, 14 nt, Haemophilus influenzae Rd
uuuuuuaauuuuuu

SEQ ID NO: 692536 - RNA, 13 nt, Haemophilus influenzae Rd
uuuuuuacuugga

SEQ ID NO: 692537 - RNA, 22 nt, Haemophilus influenzae Rd
uuuuuuagauuaucauuaaaua

SEQ ID NO: 692538 - RNA, 16 nt, Haemophilus influenzae Rd
uuuuuuagauuuauuu

SEQ ID NO: 692539 - RNA, 17 nt, Haemophilus influenzae Rd
uuuuuuauaaaaaaauc

SEQ ID NO: 692540 - RNA, 17 nt, Haemophilus influenzae Rd
uuuuuuauaaaccaauu

SEQ ID NO: 692541 - RNA, 12 nt, Haemophilus influenzae Rd
uuuuuuauuaaa

SEQ ID NO: 692542 - RNA, 12 nt, Haemophilus influenzae Rd
uuuuuuauuaau

SEQ ID NO: 692543 - RNA, 23 nt, Haemophilus influenzae Rd
uuuuuuauuaauuauaaaauagc

SEQ ID NO: 692544 - RNA, 20 nt, Haemophilus influenzae Rd
aaauguguuucgauacuuuc

SEQ ID NO: 692545 - RNA, 22 nt, Haemophilus influenzae Rd
aaauguguuucgauacuuucuu

SEQ ID NO: 692546 - RNA, 17 nt, Haemophilus influenzae Rd
aaauguuuauauuucca

SEQ ID NO: 692547 - RNA, 15 nt, Haemophilus influenzae Rd
aaauuaaaaaaauag

SEQ ID NO: 692548 - RNA, 16 nt, Haemophilus influenzae Rd
aaauuaaaaagacuaa

SEQ ID NO: 692549 - RNA, 13 nt, Haemophilus influenzae Rd
aaauuaaaauaau

SEQ ID NO: 692550 - RNA, 15 nt, Haemophilus influenzae Rd
aaauuaaaaauauac

SEQ ID NO: 692551 - RNA, 17 nt, Haemophilus influenzae Rd
aaauuaacgguuuucga

SEQ ID NO: 692552 - RNA, 19 nt, Haemophilus influenzae Rd
aaauuaaccgcacuuuaaa

SEQ ID NO: 692553 - RNA, 21 nt, Haemophilus influenzae Rd
aaauuaaccgcacuuuaaaua

SEQ ID NO: 692554 - RNA, 19 nt, Haemophilus influenzae Rd
aaauuaaccgcacuuuaga

SEQ ID NO: 692555 - RNA, 17 nt, Haemophilus influenzae Rd
aaauuaaccgcacuuuc

SEQ ID NO: 692556 - RNA, 18 nt, Haemophilus influenzae Rd
aaauuaaccgcacuuuca

SEQ ID NO: 692557 - RNA, 15 nt, Haemophilus influenzae Rd
aaauuaaauugaaaa

SEQ ID NO: 692558 - RNA, 18 nt, Haemophilus influenzae Rd
aaauuaaauuguaacuau

SEQ ID NO: 692559 - RNA, 13 nt, Haemophilus influenzae Rd
aaauuaaggacua

SEQ ID NO: 692560 - RNA, 14 nt, Haemophilus influenzae Rd
aaauuaaggacuaa

SEQ ID NO: 692561 - RNA, 20 nt, Haemophilus influenzae Rd
aaauuaaggggauucgauuu

SEQ ID NO: 692562 - RNA, 19 nt, Haemophilus influenzae Rd
aaauuaauaaauauuauua

SEQ ID NO: 692563 - RNA, 20 nt, Haemophilus influenzae Rd
aaauuaauaagaaaaucaaa

SEQ ID NO: 692564 - RNA, 22 nt, Haemophilus influenzae Rd
aaauuaacuggcguuucuacca

SEQ ID NO: 692565 - RNA, 18 nt, Haemophilus influenzae Rd
aaauuaacuuaucuaaaa

SEQ ID NO: 692566 - RNA, 14 nt, Haemophilus influenzae Rd
aaauuaaucauaaa

SEQ ID NO: 692567 - RNA, 22 nt, Haemophilus influenzae Rd
aaauuaauuaaucaauaagaaa

SEQ ID NO: 692568 - RNA, 20 nt, Haemophilus influenzae Rd
aaauuaaugucgcauuugua

SEQ ID NO: 692569 - RNA, 16 nt, Haemophilus influenzae Rd
aaauuaauuaggacaa

SEQ ID NO: 692570 - RNA, 20 nt, Haemophilus influenzae Rd
aaauuaauucucauacaaaa

SEQ ID NO: 692571 - RNA, 24 nt, Haemophilus influenzae Rd
aaauuaauuuacucguucaucuua

SEQ ID NO: 692572 - RNA, 20 nt, Haemophilus influenzae Rd
uuuccauaauguucccuaua

SEQ ID NO: 692573 - RNA, 17 nt, Haemophilus influenzae Rd
uuuccauaugaccauua

SEQ ID NO: 692574 - RNA, 22 nt, Haemophilus influenzae Rd
uuuccaucaccuucaacauaag

SEQ ID NO: 692575 - RNA, 14 nt, Haemophilus influenzae Rd
uuuccccuuguucu

SEQ ID NO: 692576 - RNA, 19 nt, Haemophilus influenzae Rd
uuuccccuuguucuucaua

SEQ ID NO: 692577 - RNA, 16 nt, Haemophilus influenzae Rd
uuuccccgcucuuucc

SEQ ID NO: 692578 - RNA, 18 nt, Haemophilus influenzae Rd
uuucccauuugucucaaa

SEQ ID NO: 692579 - RNA, 16 nt, Haemophilus influenzae Rd
uuuccauuuuuuucua

SEQ ID NO: 692580 - RNA, 17 nt, Haemophilus influenzae Rd
uuuccauuuuuuucuau

SEQ ID NO: 692581 - RNA, 17 nt, Haemophilus influenzae Rd
uuuccgauuaauauacc

SEQ ID NO: 692582 - RNA, 13 nt, Haemophilus influenzae Rd
uuucccuuuucuu

SEQ ID NO: 692583 - RNA, 16 nt, Haemophilus influenzae Rd
uuucccuuuucuuauu

SEQ ID NO: 692584 - RNA, 23 nt, Haemophilus influenzae Rd
uuucccucaagacaaauuuguug

SEQ ID NO: 692585 - RNA, 16 nt, Haemophilus influenzae Rd
uuucgauagaacaaau

SEQ ID NO: 692586 - RNA, 20 nt, Haemophilus influenzae Rd
uuucgacauucgcauauuuu

SEQ ID NO: 692587 - RNA, 13 nt, Haemophilus influenzae Rd
uuuccuuuaauug

SEQ ID NO: 692588 - RNA, 14 nt, Haemophilus influenzae Rd
uuuccuuuccuuga

SEQ ID NO: 692589 - RNA, 21 nt, Haemophilus influenzae Rd
uuuccuuuggcuugaaaauau

SEQ ID NO: 692590 - RNA, 16 nt, Haemophilus influenzae Rd
uuuccuuuuauuuuau

SEQ ID NO: 692591 - RNA, 16 nt, Haemophilus influenzae Rd
uuucgccccauuauuu

SEQ ID NO: 692592 - RNA, 17 nt, Haemophilus influenzae Rd
uuucgauucgccuugcu

SEQ ID NO: 692593 - RNA, 15 nt, Haemophilus influenzae Rd
uuuccgugauuucuu

SEQ ID NO: 692594 - RNA, 22 nt, Haemophilus influenzae Rd
uuuccuacagugacuaaaacaa

SEQ ID NO: 692595 - RNA, 18 nt, Haemophilus influenzae Rd
uuuccuacucgagcauaa

SEQ ID NO: 692596 - RNA, 20 nt, Haemophilus influenzae Rd
uuuccuauuuacguaaaaaa

SEQ ID NO: 692597 - RNA, 19 nt, Haemophilus influenzae Rd
uuuccugccuugcaaaaac

SEQ ID NO: 692598 - RNA, 20 nt, Haemophilus influenzae Rd
uuuccuucuauaucagaaaa

SEQ ID NO: 692599 - RNA, 16 nt, Haemophilus influenzae Rd
uuuccuucgccauuuu

SEQ ID NO: 692600 - RNA, 18 nt, Haemophilus influenzae Rd
uuucgugaggucugcaau

SEQ ID NO: 692601 - RNA, 20 nt, Haemophilus influenzae Rd
uuucgugggaaagacagaau

SEQ ID NO: 692602 - RNA, 14 nt, Haemophilus influenzae Rd
uuucguguuuaguu

SEQ ID NO: 692603 - RNA, 12 nt, Haemophilus influenzae Rd
uuucuaaaauaa

SEQ ID NO: 692604 - RNA, 20 nt, Haemophilus influenzae Rd
uuucuaaaaucacuuuuaau

SEQ ID NO: 692605 - RNA, 19 nt, Haemophilus influenzae Rd
uuucuaacuuuuaauucuu

SEQ ID NO: 692606 - RNA, 21 nt, Haemophilus influenzae Rd
uuucuaacaaaugauuagaag

SEQ ID NO: 692607 - RNA, 23 nt, Haemophilus influenzae Rd
uuucuaacaucggcaaccaagua

SEQ ID NO: 692608 - RNA, 23 nt, Haemophilus influenzae Rd
uuucuaaccgcacucuuucaaaa

SEQ ID NO: 692609 - RNA, 18 nt, Haemophilus influenzae Rd
uuucuaacgcuuuuaaac

SEQ ID NO: 692610 - RNA, 13 nt, Haemophilus influenzae Rd
uuucuaaauuuua

SEQ ID NO: 692611 - RNA, 19 nt, Haemophilus influenzae Rd
uuucggugcuuacuuuauu

SEQ ID NO: 692612 - RNA, 15 nt, Haemophilus influenzae Rd
uuucgggcaaacgcu

SEQ ID NO: 692613 - RNA, 13 nt, Haemophilus influenzae Rd
uuucgcuuuuguu

SEQ ID NO: 692614 - RNA, 20 nt, Haemophilus influenzae Rd
uuucuacgacauuuuuaacu

SEQ ID NO: 692615 - RNA, 13 nt, Haemophilus influenzae Rd
uuucuacaacgcu

SEQ ID NO: 692616 - RNA, 17 nt, Haemophilus influenzae Rd
uuucuaauauuucuuga

SEQ ID NO: 692617 - RNA, 18 nt, Haemophilus influenzae Rd
uuucuaaugaaauuucuu

SEQ ID NO: 692618 - RNA, 23 nt, Haemophilus influenzae Rd
uuucuaaugguuguaaauuuuca

SEQ ID NO: 692619 - RNA, 14 nt, Haemophilus influenzae Rd
uuucuaauucuucc

SEQ ID NO: 692620 - RNA, 19 nt, Haemophilus influenzae Rd
uuucuaaguguuuccguga

SEQ ID NO: 692621 - RNA, 23 nt, Haemophilus influenzae Rd
uuucuaauaauccucuuuaaaau

SEQ ID NO: 692622 - RNA, 15 nt, Haemophilus influenzae Rd
uuucuaauaccaauu

SEQ ID NO: 692623 - RNA, 23 nt, Haemophilus influenzae Rd
uuucuagaugaugaaauuuuuca

SEQ ID NO: 692624 - RNA, 15 nt, Haemophilus influenzae Rd
uuucuaguaaaacua

SEQ ID NO: 692625 - RNA, 17 nt, Haemophilus influenzae Rd
uuucugcuucagauucu

SEQ ID NO: 692626 - RNA, 16 nt, Haemophilus influenzae Rd
uuucuggcucugcuga

SEQ ID NO: 692627 - RNA, 17 nt, Haemophilus influenzae Rd
uuucugaagguuuucuu

SEQ ID NO: 692628 - RNA, 17 nt, Haemophilus influenzae Rd
uuucugaauaaauuuuu

SEQ ID NO: 692629 - RNA, 22 nt, Haemophilus influenzae Rd
uuucugacacccaaauuaaaaa

SEQ ID NO: 692630 - RNA, 15 nt, Haemophilus influenzae Rd
uuucugcaguuucug

SEQ ID NO: 692631 - RNA, 22 nt, Haemophilus influenzae Rd
uuucuauuguuuuuuucuaaau

SEQ ID NO: 692632 - RNA, 18 nt, Haemophilus influenzae Rd
uuucucaauaaauaucua

SEQ ID NO: 692633 - RNA, 23 nt, Haemophilus influenzae Rd
uuucucauuuaaccguaauuuca

SEQ ID NO: 692634 - RNA, 18 nt, Haemophilus influenzae Rd
uuucucgggcugaaauac

SEQ ID NO: 692635 - RNA, 20 nt, Haemophilus influenzae Rd
uuucuccguuagcaauaacu

SEQ ID NO: 692636 - RNA, 20 nt, Haemophilus influenzae Rd
uuucucgaguaggcaauuca

SEQ ID NO: 692637 - RNA, 17 nt, Haemophilus influenzae Rd
uuucucgaucauuuuua

SEQ ID NO: 692638 - RNA, 12 nt, Haemophilus influenzae Rd
uuugaaaucaaa

SEQ ID NO: 692639 - RNA, 12 nt, Haemophilus influenzae Rd
uuugaaauuuau

SEQ ID NO: 692640 - RNA, 14 nt, Haemophilus influenzae Rd
uuugaacgaauuaa

SEQ ID NO: 692641 - RNA, 22 nt, Haemophilus influenzae Rd
uuugaacguuuuugucguucuu

SEQ ID NO: 692642 - RNA, 11 nt, Haemophilus influenzae Rd
uuugaauaauu

SEQ ID NO: 692643 - RNA, 16 nt, Haemophilus influenzae Rd
uuugaaucuaaaacua

SEQ ID NO: 692644 - RNA, 15 nt, Haemophilus influenzae Rd
uuugaauaucuacgc

SEQ ID NO: 692645 - RNA, 17 nt, Haemophilus influenzae Rd
uuugaaagauuuucuac

SEQ ID NO: 692646 - RNA, 17 nt, Haemophilus influenzae Rd
uuugaaaaauuaucaaa

SEQ ID NO: 692647 - RNA, 15 nt, Haemophilus influenzae Rd
uuugaaaaucucuau

SEQ ID NO: 692648 - RNA, 12 nt, Haemophilus influenzae Rd
uuucuuuuucaa

SEQ ID NO: 692649 - RNA, 13 nt, Haemophilus influenzae Rd
uuucuuuuuccug

SEQ ID NO: 692650 - RNA, 14 nt, Haemophilus influenzae Rd
uuugacauuccuau

SEQ ID NO: 692651 - RNA, 13 nt, Haemophilus influenzae Rd
uuugaccauuuca

SEQ ID NO: 692652 - RNA, 23 nt, Haemophilus influenzae Rd
uuugaccgacaagauaagagcuu

SEQ ID NO: 692653 - RNA, 21 nt, Haemophilus influenzae Rd
uuugaccuucauaaacuucua

SEQ ID NO: 692654 - RNA, 16 nt, Haemophilus influenzae Rd
uuugaauguaaaaaua

SEQ ID NO: 692655 - RNA, 17 nt, Haemophilus influenzae Rd
uuugaauuaaaacuuga

SEQ ID NO: 692656 - RNA, 19 nt, Haemophilus influenzae Rd
uuugaaugaaauucaguga

SEQ ID NO: 692657 - RNA, 19 nt, Haemophilus influenzae Rd
uuugaauugguguuuaaau

SEQ ID NO: 692658 - RNA, 22 nt, Haemophilus influenzae Rd
uuugacgagauuuuuugaauaa

SEQ ID NO: 692659 - RNA, 16 nt, Haemophilus influenzae Rd
uuugacgauaauauuu

SEQ ID NO: 692660 - RNA, 21 nt, Haemophilus influenzae Rd
uuugacgcagcaucugccacu

SEQ ID NO: 692661 - RNA, 21 nt, Haemophilus influenzae Rd
uuugacuaaaucaugaauaau

SEQ ID NO: 692662 - RNA, 20 nt, Haemophilus influenzae Rd
uuugagcggugaauucuuuu

SEQ ID NO: 692663 - RNA, 18 nt, Haemophilus influenzae Rd
uuugagauuuuauuucgc

SEQ ID NO: 692664 - RNA, 15 nt, Haemophilus influenzae Rd
uuugagcaaaucaaa

SEQ ID NO: 692665 - RNA, 17 nt, Haemophilus influenzae Rd
uuucuguugauuuauca

SEQ ID NO: 692666 - RNA, 15 nt, Haemophilus influenzae Rd
uuucuguuuuuccau

SEQ ID NO: 692667 - RNA, 16 nt, Haemophilus influenzae Rd
uuucuguuuuuccauu

SEQ ID NO: 692668 - RNA, 15 nt, Haemophilus influenzae Rd
uuucuguuacuaaau

SEQ ID NO: 692669 - RNA, 13 nt, Haemophilus influenzae Rd
uuucuuaaaauac

SEQ ID NO: 692670 - RNA, 23 nt, Haemophilus influenzae Rd
uuucuuagcuucaucuucaucaa

SEQ ID NO: 692671 - RNA, 22 nt, Haemophilus influenzae Rd
uuucuucagcuuguuuaaucac

SEQ ID NO: 692672 - RNA, 17 nt, Haemophilus influenzae Rd
uuucuuauauucaaauu

SEQ ID NO: 692673 - RNA, 15 nt, Haemophilus influenzae Rd
uuucuuaugaaaaaa

SEQ ID NO: 692674 - RNA, 16 nt, Haemophilus influenzae Rd
uuucuuauuucuuucg

SEQ ID NO: 692675 - RNA, 16 nt, Haemophilus influenzae Rd
uuucuucaaagcuuaa

SEQ ID NO: 692676 - RNA, 12 nt, Haemophilus influenzae Rd
uuucuuccauuu

SEQ ID NO: 692677 - RNA, 16 nt, Haemophilus influenzae Rd
uuucuuccauuucaau

SEQ ID NO: 692678 - RNA, 22 nt, Haemophilus influenzae Rd
uuucuucuuucauuugaacaau

SEQ ID NO: 692679 - RNA, 13 nt, Haemophilus influenzae Rd
uuucuugaccuuc

SEQ ID NO: 692680 - RNA, 17 nt, Haemophilus influenzae Rd
uuucuugccaaaauuca

SEQ ID NO: 692681 - RNA, 17 nt, Haemophilus influenzae Rd
uuucuugcccaauauaa

SEQ ID NO: 692682 - RNA, 15 nt, Haemophilus influenzae Rd
uuucuugcuaaaaua

SEQ ID NO: 692683 - RNA, 18 nt, Haemophilus influenzae Rd
uuucuugcuauucuuuag

SEQ ID NO: 692684 - RNA, 15 nt, Haemophilus influenzae Rd
uuucuugcucuaauu

SEQ ID NO: 692685 - RNA, 19 nt, Haemophilus influenzae Rd
uuucuugcuguugguuaaa

SEQ ID NO: 692686 - RNA, 14 nt, Haemophilus influenzae Rd
uuucuuuauuucau

SEQ ID NO: 692687 - RNA, 16 nt, Haemophilus influenzae Rd
uuucuuuaaaaaauaa

SEQ ID NO: 692688 - RNA, 14 nt, Haemophilus influenzae Rd
uuucuuuuccuugc

SEQ ID NO: 692689 - RNA, 12 nt, Haemophilus influenzae Rd
uuugauuuaauu

SEQ ID NO: 692690 - RNA, 22 nt, Haemophilus influenzae Rd
uuugcaaagugcgguaagaaaa

SEQ ID NO: 692691 - RNA, 13 nt, Haemophilus influenzae Rd
uuugcaacauaug

SEQ ID NO: 692692 - RNA, 18 nt, Haemophilus influenzae Rd
uuugauuuugcuuugccu

SEQ ID NO: 692693 - RNA, 15 nt, Haemophilus influenzae Rd
uuugauuuucuuauu

SEQ ID NO: 692694 - RNA, 22 nt, Haemophilus influenzae Rd
uuugcacccgccauaaaacaca

SEQ ID NO: 692695 - RNA, 22 nt, Haemophilus influenzae Rd
uuugcaaauacagugacaaauu

SEQ ID NO: 692696 - RNA, 18 nt, Haemophilus influenzae Rd
uuugcaauuuaacauaau

SEQ ID NO: 692697 - RNA, 17 nt, Haemophilus influenzae Rd
uuugcaauccagugcau

SEQ ID NO: 692698 - RNA, 20 nt, Haemophilus influenzae Rd
uuugcaagguuuccaagaau

SEQ ID NO: 692699 - RNA, 16 nt, Haemophilus influenzae Rd
uuugcacuuuaaagaa

SEQ ID NO: 692700 - RNA, 12 nt, Haemophilus influenzae Rd
uuugcacuuucu

SEQ ID NO: 692701 - RNA, 21 nt, Haemophilus influenzae Rd
uuugcaccugcaucaauuuua

SEQ ID NO: 692702 - RNA, 22 nt, Haemophilus influenzae Rd
uuugcacguuugcgaucguuuu

SEQ ID NO: 692703 - RNA, 23 nt, Haemophilus influenzae Rd
uuugauauuaagccauuggaaaa

SEQ ID NO: 692704 - RNA, 19 nt, Haemophilus influenzae Rd
uuugaucauggcucagauu

SEQ ID NO: 692705 - RNA, 13 nt, Haemophilus influenzae Rd
uuugaucuaauuu

SEQ ID NO: 692706 - RNA, 17 nt, Haemophilus influenzae Rd
uuugaugcucagaaaga

SEQ ID NO: 692707 - RNA, 21 nt, Haemophilus influenzae Rd
uuugauuaccacgaguauauu

SEQ ID NO: 692708 - RNA, 17 nt, Haemophilus influenzae Rd
uuugagguaauuuguua

SEQ ID NO: 692709 - RNA, 20 nt, Haemophilus influenzae Rd
uuugagccguuauauuuccu

SEQ ID NO: 692710 - RNA, 19 nt, Haemophilus influenzae Rd
uuugaggaucacacaaaau

SEQ ID NO: 692711 - RNA, 17 nt, Haemophilus influenzae Rd
uuugaguaaaaaaucua

SEQ ID NO: 692712 - RNA, 23 nt, Haemophilus influenzae Rd
uuugagucggggauuuuuuauau

SEQ ID NO: 692713 - RNA, 17 nt, Haemophilus influenzae Rd
uuugagucucaaauuuu

SEQ ID NO: 692714 - RNA, 21 nt, Haemophilus influenzae Rd
uuugagugcuguacacacacc

SEQ ID NO: 692715 - RNA, 20 nt, Haemophilus influenzae Rd
uuugauaaaguuuuuucaau

SEQ ID NO: 692716 - RNA, 14 nt, Haemophilus influenzae Rd
uuugauaauuucuu

SEQ ID NO: 692717 - RNA, 19 nt, Haemophilus influenzae Rd
uuugcuaccuucaaccacc

SEQ ID NO: 692718 - RNA, 17 nt, Haemophilus influenzae Rd
uuugcguugcuggaacu

SEQ ID NO: 692719 - RNA, 20 nt, Haemophilus influenzae Rd
uuugcgccacaauauuuaau

SEQ ID NO: 692720 - RNA, 16 nt, Haemophilus influenzae Rd
uuugcgauaauuugca

SEQ ID NO: 692721 - RNA, 13 nt, Haemophilus influenzae Rd
uuugcgauuuuau

SEQ ID NO: 692722 - RNA, 20 nt, Haemophilus influenzae Rd
uuugcggaaacauaucaaaa

SEQ ID NO: 692723 - RNA, 21 nt, Haemophilus influenzae Rd
uuugcggacgcuugggcuuuu

SEQ ID NO: 692724 - RNA, 15 nt, Haemophilus influenzae Rd
uuugcauuuucaggg

SEQ ID NO: 692725 - RNA, 13 nt, Haemophilus influenzae Rd
uuugcauuuugga

SEQ ID NO: 692726 - RNA, 13 nt, Haemophilus influenzae Rd
uuugccaaaauca

SEQ ID NO: 692727 - RNA, 21 nt, Haemophilus influenzae Rd
uuugcauuauugaaccauuuu

SEQ ID NO: 692728 - RNA, 23 nt, Haemophilus influenzae Rd
uuugccaauuuuuucugaauaaa

SEQ ID NO: 692729 - RNA, 21 nt, Haemophilus influenzae Rd
uuugccacaggauaaaaacca

SEQ ID NO: 692730 - RNA, 21 nt, Haemophilus influenzae Rd
uuugcauaaaaccagcauuga

SEQ ID NO: 692731 - RNA, 13 nt, Haemophilus influenzae Rd
uuugcauauaaaa

SEQ ID NO: 692732 - RNA, 12 nt, Haemophilus influenzae Rd
uuugccuaaaac

SEQ ID NO: 692733 - RNA, 13 nt, Haemophilus influenzae Rd
uuugcccaauucu

SEQ ID NO: 692734 - RNA, 19 nt, Haemophilus influenzae Rd
uuugccaucacgaccuuuu

SEQ ID NO: 692735 - RNA, 16 nt, Haemophilus influenzae Rd
uuguuaauaaaagaau

SEQ ID NO: 692736 - RNA, 15 nt, Haemophilus influenzae Rd
uugcugccacaagau

SEQ ID NO: 692737 - RNA, 16 nt, Haemophilus influenzae Rd
uugcugacaauuucua

SEQ ID NO: 692738 - RNA, 16 nt, Haemophilus influenzae Rd
uugcugauugcacauu

SEQ ID NO: 692739 - RNA, 13 nt, Haemophilus influenzae Rd
uugcugauaaauu

SEQ ID NO: 692740 - RNA, 16 nt, Haemophilus influenzae Rd
uuguuaccuuuuccaa

SEQ ID NO: 692741 - RNA, 18 nt, Haemophilus influenzae Rd
uuguuacguuucacuaca

SEQ ID NO: 692742 - RNA, 18 nt, Haemophilus influenzae Rd
uuguuggcuugauuuuaa

SEQ ID NO: 692743 - RNA, 19 nt, Haemophilus influenzae Rd
uuguuucauaaaaaaugcu

SEQ ID NO: 692744 - RNA, 12 nt, Haemophilus influenzae Rd
uuguuucucaau

SEQ ID NO: 692745 - RNA, 12 nt, Haemophilus influenzae Rd
uuguuucuaaau

SEQ ID NO: 692746 - RNA, 13 nt, Haemophilus influenzae Rd
uuguuucaccauu

SEQ ID NO: 692747 - RNA, 13 nt, Haemophilus influenzae Rd
uuguuuauaacgu

SEQ ID NO: 692748 - RNA, 17 nt, Haemophilus influenzae Rd
uuguuuauaucuuuauu

SEQ ID NO: 692749 - RNA, 22 nt, Haemophilus influenzae Rd
uuguuuacccacuucuucaagu

SEQ ID NO: 692750 - RNA, 12 nt, Haemophilus influenzae Rd
uuguuuaaagaa

SEQ ID NO: 692751 - RNA, 12 nt, Haemophilus influenzae Rd
uuguuguuugcu

SEQ ID NO: 692752 - RNA, 14 nt, Haemophilus influenzae Rd
uuguuuuguucauc

SEQ ID NO: 692753 - RNA, 11 nt, Haemophilus influenzae Rd
uuguuuuuccg

SEQ ID NO: 692754 - RNA, 23 nt, Haemophilus influenzae Rd
uuguuuuucgcguucuuucgcaa

SEQ ID NO: 692755 - RNA, 14 nt, Haemophilus influenzae Rd
uuguuuuucugcuu

SEQ ID NO: 692756 - RNA, 16 nt, Haemophilus influenzae Rd
uuguuuuuuucuaaau

SEQ ID NO: 692757 - RNA, 18 nt, Haemophilus influenzae Rd
uuuaaaaaaacguuaaau

SEQ ID NO: 692758 - RNA, 23 nt, Haemophilus influenzae Rd
uuuaaaaguaaaaauaaaaacau

SEQ ID NO: 692759 - RNA, 19 nt, Haemophilus influenzae Rd
uuuaaaaacggaaucaggu

SEQ ID NO: 692760 - RNA, 13 nt, Haemophilus influenzae Rd
uuuaaauaaaaaa

SEQ ID NO: 692761 - RNA, 22 nt, Haemophilus influenzae Rd
uuuaaauaaaacacaguuauuu

SEQ ID NO: 692762 - RNA, 23 nt, Haemophilus influenzae Rd
uuuaaauaaaacacaguuauuuu

SEQ ID NO: 692763 - RNA, 19 nt, Haemophilus influenzae Rd
uuuaaauaaaauaacaaaa

SEQ ID NO: 692764 - RNA, 14 nt, Haemophilus influenzae Rd
uuuaaauaaagcau

SEQ ID NO: 692765 - RNA, 13 nt, Haemophilus influenzae Rd
uuuaaauaaauaa

SEQ ID NO: 692766 - RNA, 15 nt, Haemophilus influenzae Rd
uuuaaauaaauaaua

SEQ ID NO: 692767 - RNA, 17 nt, Haemophilus influenzae Rd
uuuaaauaaauaauagu

SEQ ID NO: 692768 - RNA, 16 nt, Haemophilus influenzae Rd
uuuaaaggacuaaauu

SEQ ID NO: 692769 - RNA, 15 nt, Haemophilus influenzae Rd
uuuaaacguuuauuu

SEQ ID NO: 692770 - RNA, 19 nt, Haemophilus influenzae Rd
uuuaaacuggguuuuauuu

SEQ ID NO: 692771 - RNA, 21 nt, Haemophilus influenzae Rd
uuuaaagaacaucuugccauu

SEQ ID NO: 692772 - RNA, 21 nt, Haemophilus influenzae Rd
uuuaaagcaacugaaauauga

SEQ ID NO: 692773 - RNA, 12 nt, Haemophilus influenzae Rd
uuuaaaauuacc

SEQ ID NO: 692774 - RNA, 16 nt, Haemophilus influenzae Rd
uuuaaacaccaauuca

SEQ ID NO: 692775 - RNA, 11 nt, Haemophilus influenzae Rd
uuuaaaaguuu

SEQ ID NO: 692776 - RNA, 16 nt, Haemophilus influenzae Rd
uuuaaaaguuuacuau

SEQ ID NO: 692777 - RNA, 19 nt, Haemophilus influenzae Rd
uuuaaaauagaaugaaaaa

SEQ ID NO: 692778 - RNA, 17 nt, Haemophilus influenzae Rd
uuuaaaauaguuuuuau

SEQ ID NO: 692779 - RNA, 17 nt, Haemophilus influenzae Rd
uuuaaaaucaucuaauu

SEQ ID NO: 692780 - RNA, 18 nt, Haemophilus influenzae Rd
uuuaaaaucaucuaauug

SEQ ID NO: 692781 - RNA, 13 nt, Haemophilus influenzae Rd
uuuaaaaucccuc

SEQ ID NO: 692782 - RNA, 16 nt, Haemophilus influenzae Rd
uuuaaaaugaacaaaa

SEQ ID NO: 692783 - RNA, 22 nt, Haemophilus influenzae Rd
uuuaaauaauuagccuagauau

SEQ ID NO: 692784 - RNA, 21 nt, Haemophilus influenzae Rd
uuuaaauacagcucaaaaugc

SEQ ID NO: 692785 - RNA, 22 nt, Haemophilus influenzae Rd
uuuaaauacagcucaaaaugcu

SEQ ID NO: 692786 - RNA, 13 nt, Haemophilus influenzae Rd
uuuaaauaguugu

SEQ ID NO: 692787 - RNA, 15 nt, Haemophilus influenzae Rd
uuuaaauucuccccg

SEQ ID NO: 692788 - RNA, 17 nt, Haemophilus influenzae Rd
uuuaaauugaaaaaaua

SEQ ID NO: 692789 - RNA, 21 nt, Haemophilus influenzae Rd
uuuaaauuacauucccaaaua

SEQ ID NO: 692790 - RNA, 21 nt, Haemophilus influenzae Rd
uuuaaauuagcucaauagauu

SEQ ID NO: 692791 - RNA, 22 nt, Haemophilus influenzae Rd
uuuaaauggaacuuguuuucca

SEQ ID NO: 692792 - RNA, 13 nt, Haemophilus influenzae Rd
uuuaacaaauaca

SEQ ID NO: 692793 - RNA, 17 nt, Haemophilus influenzae Rd
uuuaacaaauucacugu

SEQ ID NO: 692794 - RNA, 15 nt, Haemophilus influenzae Rd
uuuaaauuuugcuuu

SEQ ID NO: 692795 - RNA, 17 nt, Haemophilus influenzae Rd
uuuaaccguaauuucaa

SEQ ID NO: 692796 - RNA, 17 nt, Haemophilus influenzae Rd
uuuaacaggaauuugcu

SEQ ID NO: 692797 - RNA, 17 nt, Haemophilus influenzae Rd
uuuagcggcgcaacuuc

SEQ ID NO: 692798 - RNA, 22 nt, Haemophilus influenzae Rd
uuuagcuaaacgcucaaauaaa

SEQ ID NO: 692799 - RNA, 20 nt, Haemophilus influenzae Rd
uuuagcuaauccuuuaccaa

SEQ ID NO: 692800 - RNA, 23 nt, Haemophilus influenzae Rd
uuuaggaugaaauuugaauauaa

SEQ ID NO: 692801 - RNA, 15 nt, Haemophilus influenzae Rd
uuuaggaauuuaugg

SEQ ID NO: 692802 - RNA, 17 nt, Haemophilus influenzae Rd
uuuagcguacagaccau

SEQ ID NO: 692803 - RNA, 13 nt, Haemophilus influenzae Rd
uuuacuuaaaauc

SEQ ID NO: 692804 - RNA, 12 nt, Haemophilus influenzae Rd
uuuacuuaaauc

SEQ ID NO: 692805 - RNA, 17 nt, Haemophilus influenzae Rd
uuuagccaguaauuuua

SEQ ID NO: 692806 - RNA, 14 nt, Haemophilus influenzae Rd
uuuacucaaagaaa

SEQ ID NO: 692807 - RNA, 22 nt, Haemophilus influenzae Rd
uuuacucguccaaauucauuuu

SEQ ID NO: 692808 - RNA, 18 nt, Haemophilus influenzae Rd
uuuacugauuuaaaaaaa

SEQ ID NO: 692809 - RNA, 13 nt, Haemophilus influenzae Rd
uuuacgauuaacu

SEQ ID NO: 692810 - RNA, 16 nt, Haemophilus influenzae Rd
uuuacgccauucuuua

SEQ ID NO: 692811 - RNA, 20 nt, Haemophilus influenzae Rd
uuuacgccccuacuuuaaag

SEQ ID NO: 692812 - RNA, 17 nt, Haemophilus influenzae Rd
uuuacuauuaauucucu

SEQ ID NO: 692813 - RNA, 11 nt, Haemophilus influenzae Rd
uuuauaaaauu

SEQ ID NO: 692814 - RNA, 12 nt, Haemophilus influenzae Rd
uuuaguuuuuuu

SEQ ID NO: 692815 - RNA, 19 nt, Haemophilus influenzae Rd
uuuaguuuuuuuauaaaaa

SEQ ID NO: 692816 - RNA, 11 nt, Haemophilus influenzae Rd
uuuauaaaaaa

SEQ ID NO: 692817 - RNA, 15 nt, Haemophilus influenzae Rd
uuuauaaaaaaacaa

SEQ ID NO: 692818 - RNA, 20 nt, Haemophilus influenzae Rd
uuuaguuuguuguacuuuag

SEQ ID NO: 692819 - RNA, 14 nt, Haemophilus influenzae Rd
uuuaguuguuuguu

SEQ ID NO: 692820 - RNA, 13 nt, Haemophilus influenzae Rd
uuuaguucaagga

SEQ ID NO: 692821 - RNA, 23 nt, Haemophilus influenzae Rd
uuuauaaaguaagccauugugau

SEQ ID NO: 692822 - RNA, 13 nt, Haemophilus influenzae Rd
uuuauaaauaaca

SEQ ID NO: 692823 - RNA, 14 nt, Haemophilus influenzae Rd
uuuagggugcauuu

SEQ ID NO: 692824 - RNA, 21 nt, Haemophilus influenzae Rd
uuuaguaauggguuaaagugc

SEQ ID NO: 692825 - RNA, 14 nt, Haemophilus influenzae Rd
uuuagucauacaga

SEQ ID NO: 692826 - RNA, 12 nt, Haemophilus influenzae Rd
uuuaguccuuaa

SEQ ID NO: 692827 - RNA, 18 nt, Haemophilus influenzae Rd
uuuagugcuguauauuuu

SEQ ID NO: 692828 - RNA, 21 nt, Haemophilus influenzae Rd
uuuagugcuguauauuuuuaa

SEQ ID NO: 692829 - RNA, 14 nt, Haemophilus influenzae Rd
uuuaguguauaaca

SEQ ID NO: 692830 - RNA, 17 nt, Haemophilus influenzae Rd
uuuaguguauaacaaau

SEQ ID NO: 692831 - RNA, 13 nt, Haemophilus influenzae Rd
uuuaguuaaauaa

SEQ ID NO: 692832 - RNA, 14 nt, Haemophilus influenzae Rd
uuuaguuaaauaau

SEQ ID NO: 692833 - RNA, 21 nt, Haemophilus influenzae Rd
uuuaauuuuguccgaaaaaac

SEQ ID NO: 692834 - RNA, 17 nt, Haemophilus influenzae Rd
uuuacacauugccauau

SEQ ID NO: 692835 - RNA, 13 nt, Haemophilus influenzae Rd
uuuaccaaaaaau

SEQ ID NO: 692836 - RNA, 20 nt, Haemophilus influenzae Rd
uuuaccaaccgguaaaauua

SEQ ID NO: 692837 - RNA, 21 nt, Haemophilus influenzae Rd
uuuacaacgccaucuuuaaag

SEQ ID NO: 692838 - RNA, 19 nt, Haemophilus influenzae Rd
uuuacaaggacaauaauaa

SEQ ID NO: 692839 - RNA, 22 nt, Haemophilus influenzae Rd
uuuaccuuguaaacuuuccuca

SEQ ID NO: 692840 - RNA, 16 nt, Haemophilus influenzae Rd
uuuacgauauuuuuau

SEQ ID NO: 692841 - RNA, 17 nt, Haemophilus influenzae Rd
uuuacccacuucauaua

SEQ ID NO: 692842 - RNA, 18 nt, Haemophilus influenzae Rd
uuuacccaaauuaucaaa

SEQ ID NO: 692843 - RNA, 19 nt, Haemophilus influenzae Rd
uuuaccaauugauuuuuca

SEQ ID NO: 692844 - RNA, 21 nt, Haemophilus influenzae Rd
uuuaauguucccacaaagacu

SEQ ID NO: 692845 - RNA, 15 nt, Haemophilus influenzae Rd
uuuaauuaaaauauu

SEQ ID NO: 692846 - RNA, 20 nt, Haemophilus influenzae Rd
uuuaauuaaagccacauaau

SEQ ID NO: 692847 - RNA, 15 nt, Haemophilus influenzae Rd
uuuaauuaaauacaa

SEQ ID NO: 692848 - RNA, 14 nt, Haemophilus influenzae Rd
uuuaauuauagaaa

SEQ ID NO: 692849 - RNA, 21 nt, Haemophilus influenzae Rd
uuuaauucgugcaaauuuuuu

SEQ ID NO: 692850 - RNA, 14 nt, Haemophilus influenzae Rd
uuuaauucuaaauu

SEQ ID NO: 692851 - RNA, 14 nt, Haemophilus influenzae Rd
uuuaauuccaacua

SEQ ID NO: 692852 - RNA, 20 nt, Haemophilus influenzae Rd
uuuaauucagggauuaagaa

SEQ ID NO: 692853 - RNA, 22 nt, Haemophilus influenzae Rd
uuuaauuucuuuuccuugcuga

SEQ ID NO: 692854 - RNA, 16 nt, Haemophilus influenzae Rd
uuuaauuuauuuucua

SEQ ID NO: 692855 - RNA, 17 nt, Haemophilus influenzae Rd
uuuaauuuauuuucuaa

SEQ ID NO: 692856 - RNA, 18 nt, Haemophilus influenzae Rd
uuuaauuuauuuucuaau

SEQ ID NO: 692857 - RNA, 13 nt, Haemophilus influenzae Rd
uuuaauuuuauag

SEQ ID NO: 692858 - RNA, 20 nt, Haemophilus influenzae Rd
uuucacauaauaaacauaca

SEQ ID NO: 692859 - RNA, 17 nt, Haemophilus influenzae Rd
uuucaccaacaaauucu

SEQ ID NO: 692860 - RNA, 12 nt, Haemophilus influenzae Rd
uuucaccauuaa

SEQ ID NO: 692861 - RNA, 21 nt, Haemophilus influenzae Rd
uuucacccaagauucuaaaua

SEQ ID NO: 692862 - RNA, 13 nt, Haemophilus influenzae Rd
uuucaauuuuucc

SEQ ID NO: 692863 - RNA, 13 nt, Haemophilus influenzae Rd
uuucaauuucacu

SEQ ID NO: 692864 - RNA, 13 nt, Haemophilus influenzae Rd
uuucacacugccc

SEQ ID NO: 692865 - RNA, 14 nt, Haemophilus influenzae Rd
uuucacacugcccu

SEQ ID NO: 692866 - RNA, 21 nt, Haemophilus influenzae Rd
uuucacaaguucuugcgcauu

SEQ ID NO: 692867 - RNA, 15 nt, Haemophilus influenzae Rd
uuucaccacuucauc

SEQ ID NO: 692868 - RNA, 16 nt, Haemophilus influenzae Rd
uuucaccgcacuuucu

SEQ ID NO: 692869 - RNA, 18 nt, Haemophilus influenzae Rd
uuucaccgcacuuuugug

SEQ ID NO: 692870 - RNA, 14 nt, Haemophilus influenzae Rd
uuucaccguauuuu

SEQ ID NO: 692871 - RNA, 17 nt, Haemophilus influenzae Rd
uuucaccguauuuuuua

SEQ ID NO: 692872 - RNA, 21 nt, Haemophilus influenzae Rd
uuucaccuugaucuacagaag

SEQ ID NO: 692873 - RNA, 22 nt, Haemophilus influenzae Rd
uuucacgcugacguuguucaau

SEQ ID NO: 692874 - RNA, 15 nt, Haemophilus influenzae Rd
uuucacgcccaaaua

SEQ ID NO: 692875 - RNA, 15 nt, Haemophilus influenzae Rd
uuucacgguuuucca

SEQ ID NO: 692876 - RNA, 17 nt, Haemophilus influenzae Rd
uuucacggcggauugca

SEQ ID NO: 692877 - RNA, 22 nt, Haemophilus influenzae Rd
uuucacguccgccgaugaauaa

SEQ ID NO: 692878 - RNA, 18 nt, Haemophilus influenzae Rd
uuucacuaaauaaauggu

SEQ ID NO: 692879 - RNA, 14 nt, Haemophilus influenzae Rd
uuucaauuccuuua

SEQ ID NO: 692880 - RNA, 16 nt, Haemophilus influenzae Rd
uuucaauuaaaugacc

SEQ ID NO: 692881 - RNA, 18 nt, Haemophilus influenzae Rd
uuucaaugucuuuuucuu

SEQ ID NO: 692882 - RNA, 19 nt, Haemophilus influenzae Rd
uuucaaugucuuuuucuua

SEQ ID NO: 692883 - RNA, 16 nt, Haemophilus influenzae Rd
uuucaaucauuucuaa

SEQ ID NO: 692884 - RNA, 15 nt, Haemophilus influenzae Rd
uuucaaugaaauauu

SEQ ID NO: 692885 - RNA, 20 nt, Haemophilus influenzae Rd
uuucaauauaaucaauuauu

SEQ ID NO: 692886 - RNA, 16 nt, Haemophilus influenzae Rd
uuucaagaagauuugu

SEQ ID NO: 692887 - RNA, 18 nt, Haemophilus influenzae Rd
uuucaagaacagaaacca

SEQ ID NO: 692888 - RNA, 18 nt, Haemophilus influenzae Rd
uuucaagcacuuuauuua

SEQ ID NO: 692889 - RNA, 21 nt, Haemophilus influenzae Rd
uuucaagcacuuuauuuaauu

SEQ ID NO: 692890 - RNA, 19 nt, Haemophilus influenzae Rd
uuucaagaggauaacccuc

SEQ ID NO: 692891 - RNA, 20 nt, Haemophilus influenzae Rd
uuucaaggccauauuuuccc

SEQ ID NO: 692892 - RNA, 19 nt, Haemophilus influenzae Rd
uuucaaguaacuuucacaa

SEQ ID NO: 692893 - RNA, 21 nt, Haemophilus influenzae Rd
uuucaaguaacuuucacaacu

SEQ ID NO: 692894 - RNA, 11 nt, Haemophilus influenzae Rd
uuucaauaauu

SEQ ID NO: 692895 - RNA, 16 nt, Haemophilus influenzae Rd
uuucaauaauuuuucu

SEQ ID NO: 692896 - RNA, 17 nt, Haemophilus influenzae Rd
uuucaauaauuuuucuu

SEQ ID NO: 692897 - RNA, 19 nt, Haemophilus influenzae Rd
uuucaauaauuuuucuuca

SEQ ID NO: 692898 - RNA, 21 nt, Haemophilus influenzae Rd
uuuauagcuaagcaguuuauu

SEQ ID NO: 692899 - RNA, 22 nt, Haemophilus influenzae Rd
uuuauagccaacgucuuacuuu

SEQ ID NO: 692900 - RNA, 18 nt, Haemophilus influenzae Rd
uuuauagccuucugccau

SEQ ID NO: 692901 - RNA, 12 nt, Haemophilus influenzae Rd
uuuauaguuuuu

SEQ ID NO: 692902 - RNA, 19 nt, Haemophilus influenzae Rd
uuuauauaauuuaacauaa

SEQ ID NO: 692903 - RNA, 13 nt, Haemophilus influenzae Rd
uuuauauaccauu

SEQ ID NO: 692904 - RNA, 20 nt, Haemophilus influenzae Rd
uuuauuagauggaaaacuua

SEQ ID NO: 692905 - RNA, 18 nt, Haemophilus influenzae Rd
uuuauucaauaauauauu

SEQ ID NO: 692906 - RNA, 12 nt, Haemophilus influenzae Rd
uuuauuaugcua

SEQ ID NO: 692907 - RNA, 13 nt, Haemophilus influenzae Rd
uuuauuauuuaau

SEQ ID NO: 692908 - RNA, 16 nt, Haemophilus influenzae Rd
uuuauuauauaaaaaa

SEQ ID NO: 692909 - RNA, 15 nt, Haemophilus influenzae Rd
uuuauuaucaaaaaa

SEQ ID NO: 692910 - RNA, 19 nt, Haemophilus influenzae Rd
uuuauuaucaacaguaaau

SEQ ID NO: 692911 - RNA, 15 nt, Haemophilus influenzae Rd
uuuauuaucuaaauc

SEQ ID NO: 692912 - RNA, 19 nt, Haemophilus influenzae Rd
uuuauuucccucaaaauua

SEQ ID NO: 692913 - RNA, 11 nt, Haemophilus influenzae Rd
uuuauuucuau

SEQ ID NO: 692914 - RNA, 18 nt, Haemophilus influenzae Rd
uuuauuuagaauuuuuau

SEQ ID NO: 692915 - RNA, 22 nt, Haemophilus influenzae Rd
uuuauucaguaaacaaguauaa

SEQ ID NO: 692916 - RNA, 22 nt, Haemophilus influenzae Rd
uuuauucugaaaccacuaaaaa

SEQ ID NO: 692917 - RNA, 22 nt, Haemophilus influenzae Rd
uuuauuuacugauuuaaaaaaa

SEQ ID NO: 692918 - RNA, 15 nt, Haemophilus influenzae Rd
uuuauuuagaaagua

SEQ ID NO: 692919 - RNA, 12 nt, Haemophilus influenzae Rd
uuuauuuggcau

SEQ ID NO: 692920 - RNA, 20 nt, Haemophilus influenzae Rd
uuuauuugcggacaguauau

SEQ ID NO: 692921 - RNA, 21 nt, Haemophilus influenzae Rd
uuuauuugcggacaguauauu

SEQ ID NO: 692922 - RNA, 21 nt, Haemophilus influenzae Rd
uuuauuucuauagauuuauuu

SEQ ID NO: 692923 - RNA, 13 nt, Haemophilus influenzae Rd
uuuauuucugaag

SEQ ID NO: 692924 - RNA, 16 nt, Haemophilus influenzae Rd
uuuauuuuauuaucaa

SEQ ID NO: 692925 - RNA, 13 nt, Haemophilus influenzae Rd
uuuauuuuacuaa

SEQ ID NO: 692926 - RNA, 11 nt, Haemophilus influenzae Rd
uuuauuuugaa

SEQ ID NO: 692927 - RNA, 14 nt, Haemophilus influenzae Rd
uuucaaacacaaca

SEQ ID NO: 692928 - RNA, 18 nt, Haemophilus influenzae Rd
uuucaaagcguuuuaaaa

SEQ ID NO: 692929 - RNA, 20 nt, Haemophilus influenzae Rd
uuucaaagcguuuuaaaauc

SEQ ID NO: 692930 - RNA, 20 nt, Haemophilus influenzae Rd
uuucaaaggcucuaccuaaa

SEQ ID NO: 692931 - RNA, 15 nt, Haemophilus influenzae Rd
uuucaaauaauugac

SEQ ID NO: 692932 - RNA, 13 nt, Haemophilus influenzae Rd
uuucaacaaaaaa

SEQ ID NO: 692933 - RNA, 13 nt, Haemophilus influenzae Rd
uuucaacacaaca

SEQ ID NO: 692934 - RNA, 14 nt, Haemophilus influenzae Rd
uuucaacacaacau

SEQ ID NO: 692935 - RNA, 20 nt, Haemophilus influenzae Rd
uuucaaccgcacuuaauaaa

SEQ ID NO: 692936 - RNA, 19 nt, Haemophilus influenzae Rd
uuucacuucuaacuaaaaa

SEQ ID NO: 692937 - RNA, 14 nt, Haemophilus influenzae Rd
uuucacuauuucau

SEQ ID NO: 692938 - RNA, 13 nt, Haemophilus influenzae Rd
uuucacucuacca

SEQ ID NO: 692939 - RNA, 22 nt, Haemophilus influenzae Rd
uuucacucuaccaucuaaaguu

SEQ ID NO: 692940 - RNA, 12 nt, Haemophilus influenzae Rd
uuucagaauaaa

SEQ ID NO: 692941 - RNA, 16 nt, Haemophilus influenzae Rd
uuucagaauaaagaaa

SEQ ID NO: 692942 - RNA, 23 nt, Haemophilus influenzae Rd
uuucagaccgcacuuuaaaagug

SEQ ID NO: 692943 - RNA, 17 nt, Haemophilus influenzae Rd
uuucagcguuuucaacu

SEQ ID NO: 692944 - RNA, 13 nt, Haemophilus influenzae Rd
uuucagcuaaaau

SEQ ID NO: 692945 - RNA, 16 nt, Haemophilus influenzae Rd
uuucagccuauuuuua

SEQ ID NO: 692946 - RNA, 16 nt, Haemophilus influenzae Rd
uuucagauaaucaaaa

SEQ ID NO: 692947 - RNA, 15 nt, Haemophilus influenzae Rd
uuucagauacuuucu

SEQ ID NO: 692948 - RNA, 16 nt, Haemophilus influenzae Rd
uuucagcaaaaugcgu

SEQ ID NO: 692949 - RNA, 19 nt, Haemophilus influenzae Rd
uuucagcaagcauuuugaa

SEQ ID NO: 692950 - RNA, 20 nt, Haemophilus influenzae Rd
uuucagaauuaguaaagaaa

SEQ ID NO: 692951 - RNA, 14 nt, Haemophilus influenzae Rd
uuucaguauuuuuu

SEQ ID NO: 692952 - RNA, 19 nt, Haemophilus influenzae Rd
uuucaggauuucuaaaguu

SEQ ID NO: 692953 - RNA, 23 nt, Haemophilus influenzae Rd
uuucagcugcaauaucaauccca

SEQ ID NO: 692954 - RNA, 15 nt, Haemophilus influenzae Rd
uuucauacaaucucu

SEQ ID NO: 692955 - RNA, 23 nt, Haemophilus influenzae Rd
uuucauacgcgcccauucauuuu

SEQ ID NO: 692956 - RNA, 22 nt, Haemophilus influenzae Rd
uuucaguggggaauaaaauaag

SEQ ID NO: 692957 - RNA, 16 nt, Haemophilus influenzae Rd
uuucauaaaaaaugcu

SEQ ID NO: 692958 - RNA, 18 nt, Haemophilus influenzae Rd
uuucauaaacgguauuuu

SEQ ID NO: 692959 - RNA, 14 nt, Haemophilus influenzae Rd
uuucauaaagauaa

SEQ ID NO: 692960 - RNA, 20 nt, Haemophilus influenzae Rd
uuucauaagauaacaagaaa

SEQ ID NO: 692961 - RNA, 17 nt, Haemophilus influenzae Rd
uuucauucaacaauuca

SEQ ID NO: 692962 - RNA, 19 nt, Haemophilus influenzae Rd
uuucauucaacaauucaua

SEQ ID NO: 692963 - RNA, 12 nt, Haemophilus influenzae Rd
uuucauucaaaa

SEQ ID NO: 692964 - RNA, 13 nt, Haemophilus influenzae Rd
uuucauucaaaaa

SEQ ID NO: 692965 - RNA, 15 nt, Haemophilus influenzae Rd
uuucauuaauuuuau

SEQ ID NO: 692966 - RNA, 20 nt, Haemophilus influenzae Rd
uuucauuaauuuuauuuuuu

SEQ ID NO: 692967 - RNA, 20 nt, Haemophilus influenzae Rd
uuucauuccuucacuuggcg

SEQ ID NO: 692968 - RNA, 12 nt, Haemophilus influenzae Rd
uuucauucuauu

SEQ ID NO: 692969 - RNA, 16 nt, Haemophilus influenzae Rd
uuucaucguauuuccu

SEQ ID NO: 692970 - RNA, 18 nt, Haemophilus influenzae Rd
uuucaucguauuuccuau

SEQ ID NO: 692971 - RNA, 22 nt, Haemophilus influenzae Rd
uuucaucgcgcaaaauaauauc

SEQ ID NO: 692972 - RNA, 16 nt, Haemophilus influenzae Rd
uuucaucgcguuuuuu

SEQ ID NO: 692973 - RNA, 19 nt, Haemophilus influenzae Rd
uuucaucgcguuuuuucuu

SEQ ID NO: 692974 - RNA, 16 nt, Haemophilus influenzae Rd
uuucaucgcauuuuua

SEQ ID NO: 692975 - RNA, 13 nt, Haemophilus influenzae Rd
uuucauauuucug

SEQ ID NO: 692976 - RNA, 17 nt, Haemophilus influenzae Rd
uuucauauuuuaaauaa

SEQ ID NO: 692977 - RNA, 19 nt, Haemophilus influenzae Rd
uuucauauuuuaaauaauu

SEQ ID NO: 692978 - RNA, 19 nt, Haemophilus influenzae Rd
uuucaucaaucuucucauu

SEQ ID NO: 692979 - RNA, 20 nt, Haemophilus influenzae Rd
uuucaucaaugccauuuuuu

SEQ ID NO: 692980 - RNA, 18 nt, Haemophilus influenzae Rd
uuucaucacaucaauacu

SEQ ID NO: 692981 - RNA, 14 nt, Haemophilus influenzae Rd
uuucaucacuucaa

SEQ ID NO: 692982 - RNA, 20 nt, Haemophilus influenzae Rd
uuucaucaggcauugcgccu

SEQ ID NO: 692983 - RNA, 23 nt, Haemophilus influenzae Rd
uuucaucauucugguaauuugcu

SEQ ID NO: 692984 - RNA, 14 nt, Haemophilus influenzae Rd
uuucauccaaugcu

SEQ ID NO: 692985 - RNA, 22 nt, Haemophilus influenzae Rd
uuuccacgccuguggcaaaauc

SEQ ID NO: 692986 - RNA, 19 nt, Haemophilus influenzae Rd
uuuccacguuguaagcaaa

SEQ ID NO: 692987 - RNA, 12 nt, Haemophilus influenzae Rd
uuucauuuucca

SEQ ID NO: 692988 - RNA, 14 nt, Haemophilus influenzae Rd
uuucauuugaacaa

SEQ ID NO: 692989 - RNA, 15 nt, Haemophilus influenzae Rd
uuuccaaaauuucug

SEQ ID NO: 692990 - RNA, 21 nt, Haemophilus influenzae Rd
uuuccaaaauuucugaacaca

SEQ ID NO: 692991 - RNA, 21 nt, Haemophilus influenzae Rd
uuuccaaacauuuuuauuuuu

SEQ ID NO: 692992 - RNA, 22 nt, Haemophilus influenzae Rd
uuuccaaauuccgcaauauuua

SEQ ID NO: 692993 - RNA, 20 nt, Haemophilus influenzae Rd
uuaacuaaaccauuuaauaa

SEQ ID NO: 692994 - RNA, 22 nt, Haemophilus influenzae Rd
uuaacuaaaccauuuaauaaaa

SEQ ID NO: 692995 - RNA, 22 nt, Haemophilus influenzae Rd
uuaacgugcauuuuuaugauua

SEQ ID NO: 692996 - RNA, 23 nt, Haemophilus influenzae Rd
uuaacuauucaaaugaaauguuu

SEQ ID NO: 692997 - RNA, 17 nt, Haemophilus influenzae Rd
uuaacuauuuuuuauuu

SEQ ID NO: 692998 - RNA, 23 nt, Haemophilus influenzae Rd
uuaacuauuuuuuauuuauauaa

SEQ ID NO: 692999 - RNA, 20 nt, Haemophilus influenzae Rd
uuaacucaggugugccauca

SEQ ID NO: 693000 - RNA, 14 nt, Haemophilus influenzae Rd
uuaagccugauagc

SEQ ID NO: 693001 - RNA, 16 nt, Haemophilus influenzae Rd
uuaagcgugcuuugcu

SEQ ID NO: 693002 - RNA, 14 nt, Haemophilus influenzae Rd
uuaagaccaauucu

SEQ ID NO: 693003 - RNA, 23 nt, Haemophilus influenzae Rd
uuaacccaggaguaaccacaaaa

SEQ ID NO: 693004 - RNA, 16 nt, Haemophilus influenzae Rd
uuaacccauuuauuua

SEQ ID NO: 693005 - RNA, 13 nt, Haemophilus influenzae Rd
uuaacguaaaaac

SEQ ID NO: 693006 - RNA, 20 nt, Haemophilus influenzae Rd
uuaacguaagaaauaacgau

SEQ ID NO: 693007 - RNA, 18 nt, Haemophilus influenzae Rd
uuaaccugauuaaucaaa

SEQ ID NO: 693008 - RNA, 19 nt, Haemophilus influenzae Rd
uuaaccugauuaaucaaaa

SEQ ID NO: 693009 - RNA, 22 nt, Haemophilus influenzae Rd
uuaaccugauuaaucaaaaauu

SEQ ID NO: 693010 - RNA, 14 nt, Haemophilus influenzae Rd
uuaaccuacaacaa

SEQ ID NO: 693011 - RNA, 16 nt, Haemophilus influenzae Rd
uuaaccgcacuuucau

SEQ ID NO: 693012 - RNA, 19 nt, Haemophilus influenzae Rd
uuaaccgcacuuuuuguuu

SEQ ID NO: 693013 - RNA, 19 nt, Haemophilus influenzae Rd
uuaaucaaauaaaauauuu

SEQ ID NO: 693014 - RNA, 12 nt, Haemophilus influenzae Rd
uuaaucaauuug

SEQ ID NO: 693015 - RNA, 21 nt, Haemophilus influenzae Rd
uuaaucacacuugcaccacca

SEQ ID NO: 693016 - RNA, 14 nt, Haemophilus influenzae Rd
uuaauccugucauc

SEQ ID NO: 693017 - RNA, 23 nt, Haemophilus influenzae Rd
uuaaucggauguuugaacuauau

SEQ ID NO: 693018 - RNA, 22 nt, Haemophilus influenzae Rd
uuaaucggcaauguuuuaaguu

SEQ ID NO: 693019 - RNA, 18 nt, Haemophilus influenzae Rd
uuaaucguuaccaagaaa

SEQ ID NO: 693020 - RNA, 17 nt, Haemophilus influenzae Rd
uuaaucgcccuuuuguu

SEQ ID NO: 693021 - RNA, 19 nt, Haemophilus influenzae Rd
uuaauacuuggugcaauaa

SEQ ID NO: 693022 - RNA, 21 nt, Haemophilus influenzae Rd
uuaauacuuggugcaauaaaa

SEQ ID NO: 693023 - RNA, 14 nt, Haemophilus influenzae Rd
uuaauagaauauaa

SEQ ID NO: 693024 - RNA, 16 nt, Haemophilus influenzae Rd
uuaauagagaauaauu

SEQ ID NO: 693025 - RNA, 17 nt, Haemophilus influenzae Rd
uuaauaguaaacuuuua

SEQ ID NO: 693026 - RNA, 22 nt, Haemophilus influenzae Rd
uuaauagcgugcauuccuaaaa

SEQ ID NO: 693027 - RNA, 15 nt, Haemophilus influenzae Rd
uuaauagcugggcaa

SEQ ID NO: 693028 - RNA, 11 nt, Haemophilus influenzae Rd
uuaauaugcau

SEQ ID NO: 693029 - RNA, 20 nt, Haemophilus influenzae Rd
uuaauaugccaaauaaaauu

SEQ ID NO: 693030 - RNA, 23 nt, Haemophilus influenzae Rd
uuaauaugccaaauaaaauuaca

SEQ ID NO: 693031 - RNA, 19 nt, Haemophilus influenzae Rd
uuaauauugccauaauaau

SEQ ID NO: 693032 - RNA, 15 nt, Haemophilus influenzae Rd
uuaaguguuuacuau

SEQ ID NO: 693033 - RNA, 15 nt, Haemophilus influenzae Rd
uuaauaacugaauaa

SEQ ID NO: 693034 - RNA, 13 nt, Haemophilus influenzae Rd
uuaauaacgugua

SEQ ID NO: 693035 - RNA, 21 nt, Haemophilus influenzae Rd
uuaauaagaaaaucaaagaua

SEQ ID NO: 693036 - RNA, 14 nt, Haemophilus influenzae Rd
uuaauaagaaagaa

SEQ ID NO: 693037 - RNA, 15 nt, Haemophilus influenzae Rd
uuaauaauauauuca

SEQ ID NO: 693038 - RNA, 17 nt, Haemophilus influenzae Rd
uuaauaaucuuaaauaa

SEQ ID NO: 693039 - RNA, 18 nt, Haemophilus influenzae Rd
uuaauaaucuuaaauaau

SEQ ID NO: 693040 - RNA, 19 nt, Haemophilus influenzae Rd
uuaagcuggcguucugucu

SEQ ID NO: 693041 - RNA, 17 nt, Haemophilus influenzae Rd
uuaagucgauaaagaau

SEQ ID NO: 693042 - RNA, 20 nt, Haemophilus influenzae Rd
uuaagucagcauaaacaaaa

SEQ ID NO: 693043 - RNA, 14 nt, Haemophilus influenzae Rd
uuaagucaaaaauu

SEQ ID NO: 693044 - RNA, 20 nt, Haemophilus influenzae Rd
uuaaggaaagccccauuucu

SEQ ID NO: 693045 - RNA, 15 nt, Haemophilus influenzae Rd
uuaaguuuccaagug

SEQ ID NO: 693046 - RNA, 21 nt, Haemophilus influenzae Rd
uuaagugaucuugauccccau

SEQ ID NO: 693047 - RNA, 22 nt, Haemophilus influenzae Rd
uuaagugcgguauuuuuauuua

SEQ ID NO: 693048 - RNA, 19 nt, Haemophilus influenzae Rd
uuaagugcgguugaaaauu

SEQ ID NO: 693049 - RNA, 19 nt, Haemophilus influenzae Rd
uuaagugcguguauauauu

SEQ ID NO: 693050 - RNA, 13 nt, Haemophilus influenzae Rd
uuacagcaaaagc

SEQ ID NO: 693051 - RNA, 15 nt, Haemophilus influenzae Rd
uuacaaugaguguua

SEQ ID NO: 693052 - RNA, 18 nt, Haemophilus influenzae Rd
uuacaauccuaacuuuuc

SEQ ID NO: 693053 - RNA, 15 nt, Haemophilus influenzae Rd
uuacaaguauaaaga

SEQ ID NO: 693054 - RNA, 14 nt, Haemophilus influenzae Rd
uuaauuugccauca

SEQ ID NO: 693055 - RNA, 15 nt, Haemophilus influenzae Rd
uuaauuuuauagaaa

SEQ ID NO: 693056 - RNA, 20 nt, Haemophilus influenzae Rd
uuaauuugucgauaaaagaa

SEQ ID NO: 693057 - RNA, 17 nt, Haemophilus influenzae Rd
uuaauuucuuuuccuug

SEQ ID NO: 693058 - RNA, 21 nt, Haemophilus influenzae Rd
uuaauuucgccagaacuuuuu

SEQ ID NO: 693059 - RNA, 19 nt, Haemophilus influenzae Rd
uuaauuucauucaacaauu

SEQ ID NO: 693060 - RNA, 17 nt, Haemophilus influenzae Rd
uuacaucugugauaacu

SEQ ID NO: 693061 - RNA, 14 nt, Haemophilus influenzae Rd
uuacaucuucaaaa

SEQ ID NO: 693062 - RNA, 24 nt, Haemophilus influenzae Rd
uuacauuaagugcguguauauauu

SEQ ID NO: 693063 - RNA, 16 nt, Haemophilus influenzae Rd
uuacauuauuuaauuu

SEQ ID NO: 693064 - RNA, 22 nt, Haemophilus influenzae Rd
uuacauuuggcaaaauaaucag

SEQ ID NO: 693065 - RNA, 19 nt, Haemophilus influenzae Rd
uuacauuuccuuuacauuu

SEQ ID NO: 693066 - RNA, 18 nt, Haemophilus influenzae Rd
uuaccacccaaaauuuca

SEQ ID NO: 693067 - RNA, 19 nt, Haemophilus influenzae Rd
uuaccacccaaaauuucag

SEQ ID NO: 693068 - RNA, 21 nt, Haemophilus influenzae Rd
uuaccacccaaaauuucagcu

SEQ ID NO: 693069 - RNA, 16 nt, Haemophilus influenzae Rd
uuaccaccgauaaaca

SEQ ID NO: 693070 - RNA, 19 nt, Haemophilus influenzae Rd
uuaccaagaaaccaacaga

SEQ ID NO: 693071 - RNA, 13 nt, Haemophilus influenzae Rd
uuaccaagaaaua

SEQ ID NO: 693072 - RNA, 23 nt, Haemophilus influenzae Rd
uuaccaauaggaagcauuucuaa

SEQ ID NO: 693073 - RNA, 19 nt, Haemophilus influenzae Rd
uuaauggguuaaaagccaa

SEQ ID NO: 693074 - RNA, 17 nt, Haemophilus influenzae Rd
uuaauggaaugauauuc

SEQ ID NO: 693075 - RNA, 16 nt, Haemophilus influenzae Rd
uuaaugcuaaaccaau

SEQ ID NO: 693076 - RNA, 17 nt, Haemophilus influenzae Rd
uuaaugcuaaaccaauu

SEQ ID NO: 693077 - RNA, 18 nt, Haemophilus influenzae Rd
uuaaugccccuaauuauu

SEQ ID NO: 693078 - RNA, 14 nt, Haemophilus influenzae Rd
uuaaugauaaauuu

SEQ ID NO: 693079 - RNA, 16 nt, Haemophilus influenzae Rd
uuaaugcaaaaucuuu

SEQ ID NO: 693080 - RNA, 22 nt, Haemophilus influenzae Rd
uuaaugcaaaaucuuuacgaau

SEQ ID NO: 693081 - RNA, 19 nt, Haemophilus influenzae Rd
uuaauugauggaauuuaua

SEQ ID NO: 693082 - RNA, 13 nt, Haemophilus influenzae Rd
uuaauucuuuauc

SEQ ID NO: 693083 - RNA, 20 nt, Haemophilus influenzae Rd
uuaauugacaauuaauauaa

SEQ ID NO: 693084 - RNA, 22 nt, Haemophilus influenzae Rd
uuaauuauuuuaaauaaauaau

SEQ ID NO: 693085 - RNA, 20 nt, Haemophilus influenzae Rd
uuaauucagggauuaagaaa

SEQ ID NO: 693086 - RNA, 18 nt, Haemophilus influenzae Rd
uuaauucgcugauuuauu

SEQ ID NO: 693087 - RNA, 21 nt, Haemophilus influenzae Rd
uuaauuaaacguugugcauca

SEQ ID NO: 693088 - RNA, 22 nt, Haemophilus influenzae Rd
uuaauuaacgcucaaaaauuuc

SEQ ID NO: 693089 - RNA, 22 nt, Haemophilus influenzae Rd
uuaauuaaauaugauaaaugca

SEQ ID NO: 693090 - RNA, 17 nt, Haemophilus influenzae Rd
uuaauuaccacaugcau

SEQ ID NO: 693091 - RNA, 13 nt, Haemophilus influenzae Rd
uuaauuaaucuuu

SEQ ID NO: 693092 - RNA, 15 nt, Haemophilus influenzae Rd
uuaauuaauugcucu

SEQ ID NO: 693093 - RNA, 13 nt, Haemophilus influenzae Rd
uuaauuacuuuua

SEQ ID NO: 693094 - RNA, 15 nt, Haemophilus influenzae Rd
uuaauuacuuuuaua

SEQ ID NO: 693095 - RNA, 22 nt, Haemophilus influenzae Rd
uuaauuaucaaaaagaaauauu

SEQ ID NO: 693096 - RNA, 18 nt, Haemophilus influenzae Rd
uuaauuaucuaaauuaca

SEQ ID NO: 693097 - RNA, 21 nt, Haemophilus influenzae Rd
uuaguuagcuaaaaaaacuag

SEQ ID NO: 693098 - RNA, 20 nt, Haemophilus influenzae Rd
uuaguucaaggacugaguuc

SEQ ID NO: 693099 - RNA, 16 nt, Haemophilus influenzae Rd
uuaguuagaagugaaa

SEQ ID NO: 693100 - RNA, 20 nt, Haemophilus influenzae Rd
uuaguuagaagugaaauauu

SEQ ID NO: 693101 - RNA, 17 nt, Haemophilus influenzae Rd
uuagugguuucagaaua

SEQ ID NO: 693102 - RNA, 21 nt, Haemophilus influenzae Rd
uuagugguuucagaauaaaga

SEQ ID NO: 693103 - RNA, 15 nt, Haemophilus influenzae Rd
uuagugguuugcaaa

SEQ ID NO: 693104 - RNA, 15 nt, Haemophilus influenzae Rd
uuauaaaaauauuuu

SEQ ID NO: 693105 - RNA, 19 nt, Haemophilus influenzae Rd
uuauaaaaauauuuuaaua

SEQ ID NO: 693106 - RNA, 20 nt, Haemophilus influenzae Rd
uuauaaaaauauuuuaauaa

SEQ ID NO: 693107 - RNA, 16 nt, Haemophilus influenzae Rd
uuaguugguaaagauu

SEQ ID NO: 693108 - RNA, 14 nt, Haemophilus influenzae Rd
uuaguucuggucag

SEQ ID NO: 693109 - RNA, 23 nt, Haemophilus influenzae Rd
uuaguuguuucaccauuuccuuu

SEQ ID NO: 693110 - RNA, 18 nt, Haemophilus influenzae Rd
uuaguuuccccugaaugc

SEQ ID NO: 693111 - RNA, 12 nt, Haemophilus influenzae Rd
uuauaaaaaaac

SEQ ID NO: 693112 - RNA, 21 nt, Haemophilus influenzae Rd
uuauaaaaaaacaaguucuua

SEQ ID NO: 693113 - RNA, 12 nt, Haemophilus influenzae Rd
uuauaaaaaaau

SEQ ID NO: 693114 - RNA, 21 nt, Haemophilus influenzae Rd
uuaguuuuguauaagggcgaa

SEQ ID NO: 693115 - RNA, 16 nt, Haemophilus influenzae Rd
uuaguccuuaauuuaa

SEQ ID NO: 693116 - RNA, 14 nt, Haemophilus influenzae Rd
uuagucaauuuacc

SEQ ID NO: 693117 - RNA, 15 nt, Haemophilus influenzae Rd
uuaguauuuuugaau

SEQ ID NO: 693118 - RNA, 16 nt, Haemophilus influenzae Rd
uuaguauuuuugaaug

SEQ ID NO: 693119 - RNA, 21 nt, Haemophilus influenzae Rd
uuaguaguuagaauuuuaacu

SEQ ID NO: 693120 - RNA, 16 nt, Haemophilus influenzae Rd
uuaguauaaacaucag

SEQ ID NO: 693121 - RNA, 13 nt, Haemophilus influenzae Rd
uuagguaaaaauc

SEQ ID NO: 693122 - RNA, 13 nt, Haemophilus influenzae Rd
uuagguuuaaaag

SEQ ID NO: 693123 - RNA, 17 nt, Haemophilus influenzae Rd
uuagguuuaaaagauac

SEQ ID NO: 693124 - RNA, 19 nt, Haemophilus influenzae Rd
uuaguaauggguuaaagug

SEQ ID NO: 693125 - RNA, 14 nt, Haemophilus influenzae Rd
uuaguaauuuuaau

SEQ ID NO: 693126 - RNA, 14 nt, Haemophilus influenzae Rd
uuauaccacauaaa

SEQ ID NO: 693127 - RNA, 20 nt, Haemophilus influenzae Rd
uuauacgaguaaaaaaucua

SEQ ID NO: 693128 - RNA, 18 nt, Haemophilus influenzae Rd
uuauagaaaagacaauaa

SEQ ID NO: 693129 - RNA, 19 nt, Haemophilus influenzae Rd
uuauagaaaagacaauaau

SEQ ID NO: 693130 - RNA, 16 nt, Haemophilus influenzae Rd
uuauagacuucaagug

SEQ ID NO: 693131 - RNA, 17 nt, Haemophilus influenzae Rd
uuauagacuucaaguga

SEQ ID NO: 693132 - RNA, 19 nt, Haemophilus influenzae Rd
uuauagagaaauaaucacu

SEQ ID NO: 693133 - RNA, 16 nt, Haemophilus influenzae Rd
uuauagauaaauauca

SEQ ID NO: 693134 - RNA, 19 nt, Haemophilus influenzae Rd
uuauacugccuuuaaagaa

SEQ ID NO: 693135 - RNA, 13 nt, Haemophilus influenzae Rd
uuauacaacaaaa

SEQ ID NO: 693136 - RNA, 20 nt, Haemophilus influenzae Rd
uuauacaacaaaaaggcuaa

SEQ ID NO: 693137 - RNA, 16 nt, Haemophilus influenzae Rd
uuauaaugucaucuag

SEQ ID NO: 693138 - RNA, 13 nt, Haemophilus influenzae Rd
uuauaauuaaauu

SEQ ID NO: 693139 - RNA, 14 nt, Haemophilus influenzae Rd
uuauaauuaaauuc

SEQ ID NO: 693140 - RNA, 13 nt, Haemophilus influenzae Rd
uuauaauuaauaa

SEQ ID NO: 693141 - RNA, 18 nt, Haemophilus influenzae Rd
uuauaauuaauaaaaaau

SEQ ID NO: 693142 - RNA, 15 nt, Haemophilus influenzae Rd
uuauaaucuuuaaaa

SEQ ID NO: 693143 - RNA, 16 nt, Haemophilus influenzae Rd
uuauaaucuuuaaauu

SEQ ID NO: 693144 - RNA, 18 nt, Haemophilus influenzae Rd
uuauaaugcaaccaaaca

SEQ ID NO: 693145 - RNA, 14 nt, Haemophilus influenzae Rd
uuauaauagacuga

SEQ ID NO: 693146 - RNA, 18 nt, Haemophilus influenzae Rd
uuauaaaccaguuaaauc

SEQ ID NO: 693147 - RNA, 23 nt, Haemophilus influenzae Rd
uuauaaaauagccuaaauauuua

SEQ ID NO: 693148 - RNA, 15 nt, Haemophilus influenzae Rd
uuauaaaauuucagu

SEQ ID NO: 693149 - RNA, 22 nt, Haemophilus influenzae Rd
uuauaaccaguuauucuucaga

SEQ ID NO: 693150 - RNA, 12 nt, Haemophilus influenzae Rd
uuauaacauaau

SEQ ID NO: 693151 - RNA, 11 nt, Haemophilus influenzae Rd
uuauaacauaa

SEQ ID NO: 693152 - RNA, 12 nt, Haemophilus influenzae Rd
uuauaaauuacc

SEQ ID NO: 693153 - RNA, 16 nt, Haemophilus influenzae Rd
uuauaacguuuaaaaa

SEQ ID NO: 693154 - RNA, 22 nt, Haemophilus influenzae Rd
uuauaagccuaaaccaaauaug

SEQ ID NO: 693155 - RNA, 23 nt, Haemophilus influenzae Rd
uuauaagcugugguaaaaauaau

SEQ ID NO: 693156 - RNA, 18 nt, Haemophilus influenzae Rd
uuagacggucaaauucag

SEQ ID NO: 693157 - RNA, 21 nt, Haemophilus influenzae Rd
uuagagauuuuauucauaaau

SEQ ID NO: 693158 - RNA, 22 nt, Haemophilus influenzae Rd
uuacuuggggcuaauuuuuaaa

SEQ ID NO: 693159 - RNA, 22 nt, Haemophilus influenzae Rd
uuagcagguuuuuuauuucuca

SEQ ID NO: 693160 - RNA, 14 nt, Haemophilus influenzae Rd
uuagagagaaaaau

SEQ ID NO: 693161 - RNA, 18 nt, Haemophilus influenzae Rd
uuagcccaccaauuaacc

SEQ ID NO: 693162 - RNA, 16 nt, Haemophilus influenzae Rd
uuagccaaaucaucua

SEQ ID NO: 693163 - RNA, 13 nt, Haemophilus influenzae Rd
uuaggguauuuau

SEQ ID NO: 693164 - RNA, 13 nt, Haemophilus influenzae Rd
uuagcuccuaaau

SEQ ID NO: 693165 - RNA, 14 nt, Haemophilus influenzae Rd
uuagcuccuaaauu

SEQ ID NO: 693166 - RNA, 23 nt, Haemophilus influenzae Rd
uuagcuccuaaauuaggcauuug

SEQ ID NO: 693167 - RNA, 16 nt, Haemophilus influenzae Rd
uuagcugguuuauuua

SEQ ID NO: 693168 - RNA, 18 nt, Haemophilus influenzae Rd
uuagcugguuuauuuauu

SEQ ID NO: 693169 - RNA, 15 nt, Haemophilus influenzae Rd
uuacucauucuaaug

SEQ ID NO: 693170 - RNA, 19 nt, Haemophilus influenzae Rd
uuacucauuuaucaaacaa

SEQ ID NO: 693171 - RNA, 16 nt, Haemophilus influenzae Rd
uuacucacuauaacuu

SEQ ID NO: 693172 - RNA, 14 nt, Haemophilus influenzae Rd
uuacucacaacaaa

SEQ ID NO: 693173 - RNA, 15 nt, Haemophilus influenzae Rd
uuacuauucuucaau

SEQ ID NO: 693174 - RNA, 19 nt, Haemophilus influenzae Rd
uuacucaaagaaauagauu

SEQ ID NO: 693175 - RNA, 16 nt, Haemophilus influenzae Rd
uuacguuucauuuuug

SEQ ID NO: 693176 - RNA, 13 nt, Haemophilus influenzae Rd
uuacuaaugccgc

SEQ ID NO: 693177 - RNA, 14 nt, Haemophilus influenzae Rd
uuacuaauuaaaag

SEQ ID NO: 693178 - RNA, 21 nt, Haemophilus influenzae Rd
uuaccgcacuuuaccauuaca

SEQ ID NO: 693179 - RNA, 15 nt, Haemophilus influenzae Rd
uuaccgcacuuuuua

SEQ ID NO: 693180 - RNA, 19 nt, Haemophilus influenzae Rd
uuacuuuauacuaaaagua

SEQ ID NO: 693181 - RNA, 20 nt, Haemophilus influenzae Rd
uuacuuggaauaucaucuag

SEQ ID NO: 693182 - RNA, 16 nt, Haemophilus influenzae Rd
uuacuuuauuuaacug

SEQ ID NO: 693183 - RNA, 21 nt, Haemophilus influenzae Rd
uuacuuuuagauaaauuucaa

SEQ ID NO: 693184 - RNA, 17 nt, Haemophilus influenzae Rd
uuacuuuucgauagaac

SEQ ID NO: 693185 - RNA, 12 nt, Haemophilus influenzae Rd
uuacuuuuuaau

SEQ ID NO: 693186 - RNA, 19 nt, Haemophilus influenzae Rd
uuagaacaauacucuuaac

SEQ ID NO: 693187 - RNA, 22 nt, Haemophilus influenzae Rd
uuagaacaauacucuuaacaaa

SEQ ID NO: 693188 - RNA, 17 nt, Haemophilus influenzae Rd
uuagaacaauauuuaua

SEQ ID NO: 693189 - RNA, 15 nt, Haemophilus influenzae Rd
uuacugcaacgcuuu

SEQ ID NO: 693190 - RNA, 21 nt, Haemophilus influenzae Rd
uuacugacuuucuaacuuuua

SEQ ID NO: 693191 - RNA, 18 nt, Haemophilus influenzae Rd
uuaucuaauagauuuugu

SEQ ID NO: 693192 - RNA, 16 nt, Haemophilus influenzae Rd
uuaucuacaaucaaaa

SEQ ID NO: 693193 - RNA, 19 nt, Haemophilus influenzae Rd
uuaucuacugcuucauaaa

SEQ ID NO: 693194 - RNA, 18 nt, Haemophilus influenzae Rd
uuaucuaaauaauuuccu

SEQ ID NO: 693195 - RNA, 23 nt, Haemophilus influenzae Rd
uuaucuaacucuuggcuaacuuc

SEQ ID NO: 693196 - RNA, 15 nt, Haemophilus influenzae Rd
uuaucuauaaaaaga

SEQ ID NO: 693197 - RNA, 16 nt, Haemophilus influenzae Rd
uuaucuauaaaaagaa

SEQ ID NO: 693198 - RNA, 18 nt, Haemophilus influenzae Rd
uuaucuauugauucuaaa

SEQ ID NO: 693199 - RNA, 22 nt, Haemophilus influenzae Rd
uuaucuauuggauaaauuauuc

SEQ ID NO: 693200 - RNA, 20 nt, Haemophilus influenzae Rd
uuaucucggcuaaaaucugu

SEQ ID NO: 693201 - RNA, 23 nt, Haemophilus influenzae Rd
uuaucucggcuaaaaucugugca

SEQ ID NO: 693202 - RNA, 13 nt, Haemophilus influenzae Rd
uuaucucuuucuu

SEQ ID NO: 693203 - RNA, 22 nt, Haemophilus influenzae Rd
uuaucgguauaggggauuuuau

SEQ ID NO: 693204 - RNA, 20 nt, Haemophilus influenzae Rd
uuaucgucugcacgaauaau

SEQ ID NO: 693205 - RNA, 22 nt, Haemophilus influenzae Rd
uuaucgucugcacgaauaauua

SEQ ID NO: 693206 - RNA, 19 nt, Haemophilus influenzae Rd
uuaucuaaaccuuguaaag

SEQ ID NO: 693207 - RNA, 13 nt, Haemophilus influenzae Rd
uuaucuaaaaaag

SEQ ID NO: 693208 - RNA, 16 nt, Haemophilus influenzae Rd
uuaugagcaaauacaa

SEQ ID NO: 693209 - RNA, 13 nt, Haemophilus influenzae Rd
uuaugaccaaaua

SEQ ID NO: 693210 - RNA, 16 nt, Haemophilus influenzae Rd
uuaugaauguuucaaa

SEQ ID NO: 693211 - RNA, 23 nt, Haemophilus influenzae Rd
uuaugaaauugcuguaaugugcu

SEQ ID NO: 693212 - RNA, 23 nt, Haemophilus influenzae Rd
uuaugaaacagcuaaaaaugaau

SEQ ID NO: 693213 - RNA, 15 nt, Haemophilus influenzae Rd
uuaugaaaaaaagaa

SEQ ID NO: 693214 - RNA, 23 nt, Haemophilus influenzae Rd
uuaucuguauaaaugacauauaa

SEQ ID NO: 693215 - RNA, 19 nt, Haemophilus influenzae Rd
uuaucuggauguaacacaa

SEQ ID NO: 693216 - RNA, 21 nt, Haemophilus influenzae Rd
uuaucuggcaaucgccaaugu

SEQ ID NO: 693217 - RNA, 15 nt, Haemophilus influenzae Rd
uuaucuucuaaaaga

SEQ ID NO: 693218 - RNA, 23 nt, Haemophilus influenzae Rd
uuaucugauccacgguauuuucu

SEQ ID NO: 693219 - RNA, 15 nt, Haemophilus influenzae Rd
uuauguugcccauau

SEQ ID NO: 693220 - RNA, 19 nt, Haemophilus influenzae Rd
uuauguugcccauauuauu

SEQ ID NO: 693221 - RNA, 21 nt, Haemophilus influenzae Rd
uuauguuuacggaugcaaucc

SEQ ID NO: 693222 - RNA, 13 nt, Haemophilus influenzae Rd
uuauguuucucuc

SEQ ID NO: 693223 - RNA, 20 nt, Haemophilus influenzae Rd
uuauguuauuuugauaacgc

SEQ ID NO: 693224 - RNA, 21 nt, Haemophilus influenzae Rd
uuaugugcuugggcaauuaau

SEQ ID NO: 693225 - RNA, 14 nt, Haemophilus influenzae Rd
uuauuaccuacuaa

SEQ ID NO: 693226 - RNA, 15 nt, Haemophilus influenzae Rd
uuauuaccuacuaau

SEQ ID NO: 693227 - RNA, 12 nt, Haemophilus influenzae Rd
uuauuaaugcgu

SEQ ID NO: 693228 - RNA, 13 nt, Haemophilus influenzae Rd
uuauuaagucuau

SEQ ID NO: 693229 - RNA, 13 nt, Haemophilus influenzae Rd
uuauguaaauuua

SEQ ID NO: 693230 - RNA, 13 nt, Haemophilus influenzae Rd
uuauguaauauaa

SEQ ID NO: 693231 - RNA, 18 nt, Haemophilus influenzae Rd
uuaugguaaauauuguau

SEQ ID NO: 693232 - RNA, 21 nt, Haemophilus influenzae Rd
uuauggcugacuagauaaacg

SEQ ID NO: 693233 - RNA, 18 nt, Haemophilus influenzae Rd
uuauggcuuucaauuuca

SEQ ID NO: 693234 - RNA, 21 nt, Haemophilus influenzae Rd
uuaugcaacgagcaauauuca

SEQ ID NO: 693235 - RNA, 18 nt, Haemophilus influenzae Rd
uuaugccuacuuuuuauu

SEQ ID NO: 693236 - RNA, 23 nt, Haemophilus influenzae Rd
uuaugcuucuucugcaggaaaaa

SEQ ID NO: 693237 - RNA, 17 nt, Haemophilus influenzae Rd
uuaugcguuuuuaauuu

SEQ ID NO: 693238 - RNA, 16 nt, Haemophilus influenzae Rd
uuaugcuaaaggguuu

SEQ ID NO: 693239 - RNA, 21 nt, Haemophilus influenzae Rd
uuaugcuaaaggguuuacuuu

SEQ ID NO: 693240 - RNA, 23 nt, Haemophilus influenzae Rd
uuaugcuccauugcaauuucagc

SEQ ID NO: 693241 - RNA, 22 nt, Haemophilus influenzae Rd
uuauggaucacccauuaaauaa

SEQ ID NO: 693242 - RNA, 22 nt, Haemophilus influenzae Rd
uuaucgaauagauuuuuaccaa

SEQ ID NO: 693243 - RNA, 19 nt, Haemophilus influenzae Rd
uuauccgguuggaaaagcc

SEQ ID NO: 693244 - RNA, 19 nt, Haemophilus influenzae Rd
uuauccguuacauuauuua

SEQ ID NO: 693245 - RNA, 21 nt, Haemophilus influenzae Rd
uuauccauccagaaaauugca

SEQ ID NO: 693246 - RNA, 22 nt, Haemophilus influenzae Rd
uuauccauccagaaaauugcac

SEQ ID NO: 693247 - RNA, 15 nt, Haemophilus influenzae Rd
uuauccaugacuaau

SEQ ID NO: 693248 - RNA, 19 nt, Haemophilus influenzae Rd
uuauccaugaugaaauaau

SEQ ID NO: 693249 - RNA, 22 nt, Haemophilus influenzae Rd
uuauccaugaugaaauaauuca

SEQ ID NO: 693250 - RNA, 18 nt, Haemophilus influenzae Rd
uuauccaccagcacaguu

SEQ ID NO: 693251 - RNA, 14 nt, Haemophilus influenzae Rd
uuauccaacauuaa

SEQ ID NO: 693252 - RNA, 20 nt, Haemophilus influenzae Rd
uuauccaaccuacauuaauc

SEQ ID NO: 693253 - RNA, 16 nt, Haemophilus influenzae Rd
uuaucaucugcauaac

SEQ ID NO: 693254 - RNA, 19 nt, Haemophilus influenzae Rd
uuaucaggcggguauuuau

SEQ ID NO: 693255 - RNA, 13 nt, Haemophilus influenzae Rd
uuaucauaacuau

SEQ ID NO: 693256 - RNA, 14 nt, Haemophilus influenzae Rd
uuaucaucaauauc

SEQ ID NO: 693257 - RNA, 22 nt, Haemophilus influenzae Rd
uuaucaucauuuuuauuuaaug

SEQ ID NO: 693258 - RNA, 13 nt, Haemophilus influenzae Rd
uuaucaauaacug

SEQ ID NO: 693259 - RNA, 18 nt, Haemophilus influenzae Rd
uuaucaauaacugauuuu

SEQ ID NO: 693260 - RNA, 16 nt, Haemophilus influenzae Rd
uuaucaaucaagaauu

SEQ ID NO: 693261 - RNA, 22 nt, Haemophilus influenzae Rd
uuaucaaucaagcauaaaucuu

SEQ ID NO: 693262 - RNA, 14 nt, Haemophilus influenzae Rd
uuaucaauguuugu

SEQ ID NO: 693263 - RNA, 17 nt, Haemophilus influenzae Rd
uuaucacaaguuaaaac

SEQ ID NO: 693264 - RNA, 13 nt, Haemophilus influenzae Rd
uuaucaaaugcca

SEQ ID NO: 693265 - RNA, 20 nt, Haemophilus influenzae Rd
uuaucaaguaauacuuuuua

SEQ ID NO: 693266 - RNA, 15 nt, Haemophilus influenzae Rd
uuaucaaacaagccc

SEQ ID NO: 693267 - RNA, 19 nt, Haemophilus influenzae Rd
uuaucaaagaaacugucua

SEQ ID NO: 693268 - RNA, 20 nt, Haemophilus influenzae Rd
uuaucaaagaauuuuuucac

SEQ ID NO: 693269 - RNA, 13 nt, Haemophilus influenzae Rd
uuaucaaaaaacg

SEQ ID NO: 693270 - RNA, 13 nt, Haemophilus influenzae Rd
uuauauuuucuua

SEQ ID NO: 693271 - RNA, 18 nt, Haemophilus influenzae Rd
uuauauuuuuaauuuaua

SEQ ID NO: 693272 - RNA, 22 nt, Haemophilus influenzae Rd
uuauauuuuccuguuaauucuu

SEQ ID NO: 693273 - RNA, 15 nt, Haemophilus influenzae Rd
uuauauuuucuaaag

SEQ ID NO: 693274 - RNA, 20 nt, Haemophilus influenzae Rd
uuauauuguugcacauuaau

SEQ ID NO: 693275 - RNA, 14 nt, Haemophilus influenzae Rd
uuauaucuaaauaa

SEQ ID NO: 693276 - RNA, 17 nt, Haemophilus influenzae Rd
uuauauucauuuaaaac

SEQ ID NO: 693277 - RNA, 18 nt, Haemophilus influenzae Rd
uuauauuccuuauucaaa

SEQ ID NO: 693278 - RNA, 15 nt, Haemophilus influenzae Rd
uuauauacuuccaca

SEQ ID NO: 693279 - RNA, 21 nt, Haemophilus influenzae Rd
uuauaucaagcugugcaaaac

SEQ ID NO: 693280 - RNA, 23 nt, Haemophilus influenzae Rd
uuauauaaagcucuaauugaaau

SEQ ID NO: 693281 - RNA, 13 nt, Haemophilus influenzae Rd
uuauauaacauac

SEQ ID NO: 693282 - RNA, 12 nt, Haemophilus influenzae Rd
uuauauaaacaa

SEQ ID NO: 693283 - RNA, 12 nt, Haemophilus influenzae Rd
uuauauaccauu

SEQ ID NO: 693284 - RNA, 13 nt, Haemophilus influenzae Rd
uuauaguauauuu

SEQ ID NO: 693285 - RNA, 16 nt, Haemophilus influenzae Rd
uuauagugauuauuua

SEQ ID NO: 693286 - RNA, 15 nt, Haemophilus influenzae Rd
uucaccguuuuuccu

SEQ ID NO: 693287 - RNA, 19 nt, Haemophilus influenzae Rd
uucacgacccaccacuuaa

SEQ ID NO: 693288 - RNA, 20 nt, Haemophilus influenzae Rd
uucacguguuuuuucaccuu

SEQ ID NO: 693289 - RNA, 13 nt, Haemophilus influenzae Rd
uucacgauuugca

SEQ ID NO: 693290 - RNA, 22 nt, Haemophilus influenzae Rd
uucacccaagauucuaaauauu

SEQ ID NO: 693291 - RNA, 15 nt, Haemophilus influenzae Rd
uucacccaucuaaac

SEQ ID NO: 693292 - RNA, 16 nt, Haemophilus influenzae Rd
uucacagauuucaauu

SEQ ID NO: 693293 - RNA, 19 nt, Haemophilus influenzae Rd
uucacagauuucaauuaaa

SEQ ID NO: 693294 - RNA, 15 nt, Haemophilus influenzae Rd
uucacauaauaaaca

SEQ ID NO: 693295 - RNA, 12 nt, Haemophilus influenzae Rd
uucaaucauuuc

SEQ ID NO: 693296 - RNA, 20 nt, Haemophilus influenzae Rd
uucaaucaucauuuauuaaa

SEQ ID NO: 693297 - RNA, 15 nt, Haemophilus influenzae Rd
uucaauccuauuuuu

SEQ ID NO: 693298 - RNA, 18 nt, Haemophilus influenzae Rd
uucacaccgucuaaaaau

SEQ ID NO: 693299 - RNA, 22 nt, Haemophilus influenzae Rd
uucaauagaacguaauaauuca

SEQ ID NO: 693300 - RNA, 13 nt, Haemophilus influenzae Rd
uucaauagucguu

SEQ ID NO: 693301 - RNA, 16 nt, Haemophilus influenzae Rd
uucaauaguuuuucag

SEQ ID NO: 693302 - RNA, 14 nt, Haemophilus influenzae Rd
uucaauauaaaaaa

SEQ ID NO: 693303 - RNA, 17 nt, Haemophilus influenzae Rd
uucaauauaaaaaauaa

SEQ ID NO: 693304 - RNA, 16 nt, Haemophilus influenzae Rd
uucaauauaaucaauu

SEQ ID NO: 693305 - RNA, 17 nt, Haemophilus influenzae Rd
uucaauaucaaagaaaa

SEQ ID NO: 693306 - RNA, 19 nt, Haemophilus influenzae Rd
uucaauaucaaagaaaaau

SEQ ID NO: 693307 - RNA, 14 nt, Haemophilus influenzae Rd
uucaauaucugcac

SEQ ID NO: 693308 - RNA, 15 nt, Haemophilus influenzae Rd
uucagcaauuucucu

SEQ ID NO: 693309 - RNA, 22 nt, Haemophilus influenzae Rd
uucagcagcaaaaucuucuucu

SEQ ID NO: 693310 - RNA, 17 nt, Haemophilus influenzae Rd
uucagcaagaaacucaa

SEQ ID NO: 693311 - RNA, 13 nt, Haemophilus influenzae Rd
uucagcaacauca

SEQ ID NO: 693312 - RNA, 18 nt, Haemophilus influenzae Rd
uucagcaacaucauaagg

SEQ ID NO: 693313 - RNA, 17 nt, Haemophilus influenzae Rd
uucacuacuugaacuaa

SEQ ID NO: 693314 - RNA, 19 nt, Haemophilus influenzae Rd
uucagaauuaguaaagaaa

SEQ ID NO: 693315 - RNA, 20 nt, Haemophilus influenzae Rd
uucagaauuaguaaagaaau

SEQ ID NO: 693316 - RNA, 17 nt, Haemophilus influenzae Rd
uucagacaaaacuuauc

SEQ ID NO: 693317 - RNA, 20 nt, Haemophilus influenzae Rd
uucacuaauugcucugcuuu

SEQ ID NO: 693318 - RNA, 20 nt, Haemophilus influenzae Rd
uucacuacagguugcucgcc

SEQ ID NO: 693319 - RNA, 13 nt, Haemophilus influenzae Rd
uucacuaaagaac

SEQ ID NO: 693320 - RNA, 17 nt, Haemophilus influenzae Rd
uucacguaguuaaacca

SEQ ID NO: 693321 - RNA, 20 nt, Haemophilus influenzae Rd
uucacguucuuuaauaucau

SEQ ID NO: 693322 - RNA, 19 nt, Haemophilus influenzae Rd
uucaggauagagaaacuaa

SEQ ID NO: 693323 - RNA, 16 nt, Haemophilus influenzae Rd
uucagccaauuuuuca

SEQ ID NO: 693324 - RNA, 14 nt, Haemophilus influenzae Rd
uucagcauuuacca

SEQ ID NO: 693325 - RNA, 22 nt, Haemophilus influenzae Rd
uucagcauaauguuugcgagua

SEQ ID NO: 693326 - RNA, 12 nt, Haemophilus influenzae Rd
uucagcaucaga

SEQ ID NO: 693327 - RNA, 18 nt, Haemophilus influenzae Rd
uucaaaaagaacggucaa

SEQ ID NO: 693328 - RNA, 14 nt, Haemophilus influenzae Rd
uuauuuuuaucaua

SEQ ID NO: 693329 - RNA, 19 nt, Haemophilus influenzae Rd
uuauuuuucucauaauaga

SEQ ID NO: 693330 - RNA, 14 nt, Haemophilus influenzae Rd
uuauuuuuuaugau

SEQ ID NO: 693331 - RNA, 16 nt, Haemophilus influenzae Rd
uuauuuuuccacuguu

SEQ ID NO: 693332 - RNA, 14 nt, Haemophilus influenzae Rd
uuauuugacuuaaa

SEQ ID NO: 693333 - RNA, 19 nt, Haemophilus influenzae Rd
uuauuugaaacaauaaaac

SEQ ID NO: 693334 - RNA, 18 nt, Haemophilus influenzae Rd
uuauuuggcaaaugauaa

SEQ ID NO: 693335 - RNA, 18 nt, Haemophilus influenzae Rd
uuauuuggcauagaaaag

SEQ ID NO: 693336 - RNA, 19 nt, Haemophilus influenzae Rd
uuauuuggcauuugaauua

SEQ ID NO: 693337 - RNA, 16 nt, Haemophilus influenzae Rd
uuauuugcuaaaauua

SEQ ID NO: 693338 - RNA, 21 nt, Haemophilus influenzae Rd
uuauuuggaacaguaaauuua

SEQ ID NO: 693339 - RNA, 17 nt, Haemophilus influenzae Rd
uuauuuaagccagaaca

SEQ ID NO: 693340 - RNA, 23 nt, Haemophilus influenzae Rd
uuauuuaagcuuuccuauucuaa

SEQ ID NO: 693341 - RNA, 13 nt, Haemophilus influenzae Rd
uuauuuaauaaua

SEQ ID NO: 693342 - RNA, 16 nt, Haemophilus influenzae Rd
uuauuuaauaauauca

SEQ ID NO: 693343 - RNA, 14 nt, Haemophilus influenzae Rd
uuauuucugaaggu

SEQ ID NO: 693344 - RNA, 13 nt, Haemophilus influenzae Rd
uuauuucuuagau

SEQ ID NO: 693345 - RNA, 17 nt, Haemophilus influenzae Rd
uuauugaagaguaaaac

SEQ ID NO: 693346 - RNA, 22 nt, Haemophilus influenzae Rd
uuauugaagcacugaaauauca

SEQ ID NO: 693347 - RNA, 21 nt, Haemophilus influenzae Rd
uuauugaguagcugaauauca

SEQ ID NO: 693348 - RNA, 15 nt, Haemophilus influenzae Rd
uuauuaguaaaauaa

SEQ ID NO: 693349 - RNA, 23 nt, Haemophilus influenzae Rd
uuauuauaaaaauauuuuaauaa

SEQ ID NO: 693350 - RNA, 18 nt, Haemophilus influenzae Rd
uuauuagugauauuguuu

SEQ ID NO: 693351 - RNA, 21 nt, Haemophilus influenzae Rd
uuauucuaauuaacugaaaau

SEQ ID NO: 693352 - RNA, 21 nt, Haemophilus influenzae Rd
uuauucuccaaauauaaaaua

SEQ ID NO: 693353 - RNA, 13 nt, Haemophilus influenzae Rd
uuauuauacauuu

SEQ ID NO: 693354 - RNA, 12 nt, Haemophilus influenzae Rd
uuauuauauaaa

SEQ ID NO: 693355 - RNA, 14 nt, Haemophilus influenzae Rd
uuauuauauaaaaa

SEQ ID NO: 693356 - RNA, 16 nt, Haemophilus influenzae Rd
uuauucuucaucuucu

SEQ ID NO: 693357 - RNA, 18 nt, Haemophilus influenzae Rd
uucaaacgcguuaaauca

SEQ ID NO: 693358 - RNA, 15 nt, Haemophilus influenzae Rd
uucaaacacaaaaua

SEQ ID NO: 693359 - RNA, 16 nt, Haemophilus influenzae Rd
uucaaacacaaaauaa

SEQ ID NO: 693360 - RNA, 18 nt, Haemophilus influenzae Rd
uucaaacacaacauaauu

SEQ ID NO: 693361 - RNA, 12 nt, Haemophilus influenzae Rd
uucaaacaacaa

SEQ ID NO: 693362 - RNA, 16 nt, Haemophilus influenzae Rd
uucaaccacuucaaau

SEQ ID NO: 693363 - RNA, 17 nt, Haemophilus influenzae Rd
uucaaccacuucaaaua

SEQ ID NO: 693364 - RNA, 18 nt, Haemophilus influenzae Rd
uucaacccauuuuccauu

SEQ ID NO: 693365 - RNA, 18 nt, Haemophilus influenzae Rd
uucaaccgcacuuaauaa

SEQ ID NO: 693366 - RNA, 19 nt, Haemophilus influenzae Rd
uucaaccgcacuuaauaaa

SEQ ID NO: 693367 - RNA, 17 nt, Haemophilus influenzae Rd
uucaacgaauaauuuca

SEQ ID NO: 693368 - RNA, 23 nt, Haemophilus influenzae Rd
uucaaaaauuugaauguaaaaau

SEQ ID NO: 693369 - RNA, 19 nt, Haemophilus influenzae Rd
uucaaaacaguuuucaaau

SEQ ID NO: 693370 - RNA, 17 nt, Haemophilus influenzae Rd
uucaaaaccaaauuuuc

SEQ ID NO: 693371 - RNA, 19 nt, Haemophilus influenzae Rd
uucaaaacgcucaacauaa

SEQ ID NO: 693372 - RNA, 16 nt, Haemophilus influenzae Rd
uucaaaacuaucaaaa

SEQ ID NO: 693373 - RNA, 17 nt, Haemophilus influenzae Rd
uucaaaacuaucaaaau

SEQ ID NO: 693374 - RNA, 21 nt, Haemophilus influenzae Rd
uucaaaacuaucaaaaucaaa

SEQ ID NO: 693375 - RNA, 15 nt, Haemophilus influenzae Rd
uucaaaauaaaacca

SEQ ID NO: 693376 - RNA, 12 nt, Haemophilus influenzae Rd
uucaauacauca

SEQ ID NO: 693377 - RNA, 19 nt, Haemophilus influenzae Rd
uucaauaacucuauaaaau

SEQ ID NO: 693378 - RNA, 16 nt, Haemophilus influenzae Rd
uucaauaauagccaua

SEQ ID NO: 693379 - RNA, 19 nt, Haemophilus influenzae Rd
uucaauaauagccauauua

SEQ ID NO: 693380 - RNA, 22 nt, Haemophilus influenzae Rd
uucaauaagcaaguaauuuaaa

SEQ ID NO: 693381 - RNA, 21 nt, Haemophilus influenzae Rd
uucaauaagcucgccuuuuuc

SEQ ID NO: 693382 - RNA, 22 nt, Haemophilus influenzae Rd
uucaauaaaaauauauuuagau

SEQ ID NO: 693383 - RNA, 14 nt, Haemophilus influenzae Rd
uucaagaacagaaa

SEQ ID NO: 693384 - RNA, 13 nt, Haemophilus influenzae Rd
uucaagauaauua

SEQ ID NO: 693385 - RNA, 20 nt, Haemophilus influenzae Rd
uucaagaugauauuuaauaa

SEQ ID NO: 693386 - RNA, 19 nt, Haemophilus influenzae Rd
uucaagccuucuaaaauaa

SEQ ID NO: 693387 - RNA, 18 nt, Haemophilus influenzae Rd
uugaaauuuaucuaaaag

SEQ ID NO: 693388 - RNA, 12 nt, Haemophilus influenzae Rd
uugaaauuuaug

SEQ ID NO: 693389 - RNA, 23 nt, Haemophilus influenzae Rd
uugaacagggaacgguucgccug

SEQ ID NO: 693390 - RNA, 15 nt, Haemophilus influenzae Rd
uugaacacucuaauc

SEQ ID NO: 693391 - RNA, 18 nt, Haemophilus influenzae Rd
uugaaaggguugcagaac

SEQ ID NO: 693392 - RNA, 18 nt, Haemophilus influenzae Rd
uugaaauaguuaaagaaa

SEQ ID NO: 693393 - RNA, 13 nt, Haemophilus influenzae Rd
uugaaagacugcu

SEQ ID NO: 693394 - RNA, 21 nt, Haemophilus influenzae Rd
uugaaacuaaagaaucaaauu

SEQ ID NO: 693395 - RNA, 22 nt, Haemophilus influenzae Rd
uugaaaccuaaacuugauauaa

SEQ ID NO: 693396 - RNA, 14 nt, Haemophilus influenzae Rd
uugaaaauuuauuu

SEQ ID NO: 693397 - RNA, 19 nt, Haemophilus influenzae Rd
uugaaaauucuucuaacau

SEQ ID NO: 693398 - RNA, 20 nt, Haemophilus influenzae Rd
uugaaaauucuucuaacauu

SEQ ID NO: 693399 - RNA, 13 nt, Haemophilus influenzae Rd
uucuuuuuuucuu

SEQ ID NO: 693400 - RNA, 10 nt, Haemophilus influenzae Rd
uugaaaaacu

SEQ ID NO: 693401 - RNA, 21 nt, Haemophilus influenzae Rd
uucuuuuuugcuuauuuuguu

SEQ ID NO: 693402 - RNA, 14 nt, Haemophilus influenzae Rd
uugaaaauuauugu

SEQ ID NO: 693403 - RNA, 19 nt, Haemophilus influenzae Rd
uugaaaauaagcauaaaag

SEQ ID NO: 693404 - RNA, 21 nt, Haemophilus influenzae Rd
uugaaaauacagugucaaaug

SEQ ID NO: 693405 - RNA, 21 nt, Haemophilus influenzae Rd
uugaaaagcugauauaaaaau

SEQ ID NO: 693406 - RNA, 11 nt, Haemophilus influenzae Rd
uugaaaaguac

SEQ ID NO: 693407 - RNA, 18 nt, Haemophilus influenzae Rd
uugaaaaauuauugcauu

SEQ ID NO: 693408 - RNA, 19 nt, Haemophilus influenzae Rd
uucuuuugguaauaaauca

SEQ ID NO: 693409 - RNA, 14 nt, Haemophilus influenzae Rd
uucuuuuucaguuu

SEQ ID NO: 693410 - RNA, 12 nt, Haemophilus influenzae Rd
uucuuuuuccug

SEQ ID NO: 693411 - RNA, 14 nt, Haemophilus influenzae Rd
uucuuuuuccugaa

SEQ ID NO: 693412 - RNA, 21 nt, Haemophilus influenzae Rd
uucuuuuagugguucagauuu

SEQ ID NO: 693413 - RNA, 23 nt, Haemophilus influenzae Rd
uucuuuuauaaccaguuauucuu

SEQ ID NO: 693414 - RNA, 19 nt, Haemophilus influenzae Rd
uucuuuuauacuuacucaa

SEQ ID NO: 693415 - RNA, 13 nt, Haemophilus influenzae Rd
uucuuuuaauaag

SEQ ID NO: 693416 - RNA, 12 nt, Haemophilus influenzae Rd
uucuuuucuucu

SEQ ID NO: 693417 - RNA, 17 nt, Haemophilus influenzae Rd
uucuuuguuaccuuuuc

SEQ ID NO: 693418 - RNA, 18 nt, Haemophilus influenzae Rd
uucuuugaguaaaaaauc

SEQ ID NO: 693419 - RNA, 18 nt, Haemophilus influenzae Rd
uucuuugauauaaauugu

SEQ ID NO: 693420 - RNA, 18 nt, Haemophilus influenzae Rd
uucuuuccauuuuuuucu

SEQ ID NO: 693421 - RNA, 19 nt, Haemophilus influenzae Rd
uucuuuauuaaacaaaaac

SEQ ID NO: 693422 - RNA, 20 nt, Haemophilus influenzae Rd
uucuuuauuaaacaaaaacc

SEQ ID NO: 693423 - RNA, 20 nt, Haemophilus influenzae Rd
uucuuuauucguuugcaaug

SEQ ID NO: 693424 - RNA, 19 nt, Haemophilus influenzae Rd
uucuuuagcuauuaaauua

SEQ ID NO: 693425 - RNA, 15 nt, Haemophilus influenzae Rd
uucuuuacaaauugc

SEQ ID NO: 693426 - RNA, 14 nt, Haemophilus influenzae Rd
uucuuuaauugauu

SEQ ID NO: 693427 - RNA, 17 nt, Haemophilus influenzae Rd
uucugcgcgcaauccaa

SEQ ID NO: 693428 - RNA, 14 nt, Haemophilus influenzae Rd
uucugccucuguau

SEQ ID NO: 693429 - RNA, 16 nt, Haemophilus influenzae Rd
uucugcgccuaaucca

SEQ ID NO: 693430 - RNA, 17 nt, Haemophilus influenzae Rd
uucugcaucaauaauuc

SEQ ID NO: 693431 - RNA, 14 nt, Haemophilus influenzae Rd
uucugccauuucag

SEQ ID NO: 693432 - RNA, 20 nt, Haemophilus influenzae Rd
uucugccgcugcaacaaaua

SEQ ID NO: 693433 - RNA, 21 nt, Haemophilus influenzae Rd
uucugccgcugcaacaaauaa

SEQ ID NO: 693434 - RNA, 22 nt, Haemophilus influenzae Rd
uucugccgcugcaacaaauaaa

SEQ ID NO: 693435 - RNA, 19 nt, Haemophilus influenzae Rd
uucuugaccuuucaauaau

SEQ ID NO: 693436 - RNA, 15 nt, Haemophilus influenzae Rd
uucuugauuauuuaa

SEQ ID NO: 693437 - RNA, 12 nt, Haemophilus influenzae Rd
uucuuuaaaauu

SEQ ID NO: 693438 - RNA, 20 nt, Haemophilus influenzae Rd
uucuuuaaauucaauaaacc

SEQ ID NO: 693439 - RNA, 13 nt, Haemophilus influenzae Rd
uucuuuaauagcg

SEQ ID NO: 693440 - RNA, 12 nt, Haemophilus influenzae Rd
uucuuuaaauau

SEQ ID NO: 693441 - RNA, 17 nt, Haemophilus influenzae Rd
uucuugcucuaauuuua

SEQ ID NO: 693442 - RNA, 15 nt, Haemophilus influenzae Rd
uucuugcuaaaaaga

SEQ ID NO: 693443 - RNA, 17 nt, Haemophilus influenzae Rd
uucuugcuaaaauaucu

SEQ ID NO: 693444 - RNA, 21 nt, Haemophilus influenzae Rd
uucuugcuguugguuaaaaau

SEQ ID NO: 693445 - RNA, 21 nt, Haemophilus influenzae Rd
uucuugaugauaaucuuccca

SEQ ID NO: 693446 - RNA, 11 nt, Haemophilus influenzae Rd
uucuugccaua

SEQ ID NO: 693447 - RNA, 22 nt, Haemophilus influenzae Rd
uucuugcccgcaccgcuucuuu

SEQ ID NO: 693448 - RNA, 19 nt, Haemophilus influenzae Rd
uucuugccgaaaauuuacc

SEQ ID NO: 693449 - RNA, 17 nt, Haemophilus influenzae Rd
uugaauaauaaauuggg

SEQ ID NO: 693450 - RNA, 18 nt, Haemophilus influenzae Rd
uugaauaucuaaaugacg

SEQ ID NO: 693451 - RNA, 14 nt, Haemophilus influenzae Rd
uugaauaguaaaga

SEQ ID NO: 693452 - RNA, 16 nt, Haemophilus influenzae Rd
uugaaugcuauucucu

SEQ ID NO: 693453 - RNA, 16 nt, Haemophilus influenzae Rd
uugaauguaaaaauaa

SEQ ID NO: 693454 - RNA, 19 nt, Haemophilus influenzae Rd
uugaaugucuuaaagauaa

SEQ ID NO: 693455 - RNA, 23 nt, Haemophilus influenzae Rd
uugaaugcacuuucgcggaauuu

SEQ ID NO: 693456 - RNA, 22 nt, Haemophilus influenzae Rd
uugaauggcuaaagaaauacga

SEQ ID NO: 693457 - RNA, 18 nt, Haemophilus influenzae Rd
uugaauauuuuguugaag

SEQ ID NO: 693458 - RNA, 21 nt, Haemophilus influenzae Rd
uugaauauuuuguugaagaaa

SEQ ID NO: 693459 - RNA, 16 nt, Haemophilus influenzae Rd
uugaauauuugggaaa

SEQ ID NO: 693460 - RNA, 16 nt, Haemophilus influenzae Rd
uugaaucauuucaucu

SEQ ID NO: 693461 - RNA, 16 nt, Haemophilus influenzae Rd
uugaacuucuaaaaaa

SEQ ID NO: 693462 - RNA, 17 nt, Haemophilus influenzae Rd
uugaacuucuaaaaaac

SEQ ID NO: 693463 - RNA, 21 nt, Haemophilus influenzae Rd
uugaacucacaauugauguaa

SEQ ID NO: 693464 - RNA, 17 nt, Haemophilus influenzae Rd
uugaagcacugaaauau

SEQ ID NO: 693465 - RNA, 17 nt, Haemophilus influenzae Rd
uugaagccgaugaaagc

SEQ ID NO: 693466 - RNA, 18 nt, Haemophilus influenzae Rd
uugaagccgaugaaagcu

SEQ ID NO: 693467 - RNA, 21 nt, Haemophilus influenzae Rd
uugaagagaauuuucaucaau

SEQ ID NO: 693468 - RNA, 17 nt, Haemophilus influenzae Rd
uugaagauuaaauguau

SEQ ID NO: 693469 - RNA, 15 nt, Haemophilus influenzae Rd
uugaagccugacuca

SEQ ID NO: 693470 - RNA, 21 nt, Haemophilus influenzae Rd
uugaaggcaccggucuugaaa

SEQ ID NO: 693471 - RNA, 15 nt, Haemophilus influenzae Rd
uugaaguaaaaaaau

SEQ ID NO: 693472 - RNA, 15 nt, Haemophilus influenzae Rd
uugaagucuauaaaa

SEQ ID NO: 693473 - RNA, 17 nt, Haemophilus influenzae Rd
uugaagucuauaaaaga

SEQ ID NO: 693474 - RNA, 18 nt, Haemophilus influenzae Rd
uugaccgcggaaaauauc

SEQ ID NO: 693475 - RNA, 19 nt, Haemophilus influenzae Rd
uugaccucguggcaaaaga

SEQ ID NO: 693476 - RNA, 23 nt, Haemophilus influenzae Rd
uugaccugcagccauaauauuua

SEQ ID NO: 693477 - RNA, 16 nt, Haemophilus influenzae Rd
uugacgguuuuuauua

SEQ ID NO: 693478 - RNA, 18 nt, Haemophilus influenzae Rd
uugacggcuucagaaaau

SEQ ID NO: 693479 - RNA, 15 nt, Haemophilus influenzae Rd
uugacggcuugcuuu

SEQ ID NO: 693480 - RNA, 12 nt, Haemophilus influenzae Rd
uugacugaaucg

SEQ ID NO: 693481 - RNA, 16 nt, Haemophilus influenzae Rd
uugacuaucuguuuua

SEQ ID NO: 693482 - RNA, 20 nt, Haemophilus influenzae Rd
uugaccaccgccaauacaaa

SEQ ID NO: 693483 - RNA, 18 nt, Haemophilus influenzae Rd
uugacauacuuuguugaa

SEQ ID NO: 693484 - RNA, 15 nt, Haemophilus influenzae Rd
uugacauauuuucua

SEQ ID NO: 693485 - RNA, 17 nt, Haemophilus influenzae Rd
uugacauauuuucuaaa

SEQ ID NO: 693486 - RNA, 12 nt, Haemophilus influenzae Rd
uugaauugcucc

SEQ ID NO: 693487 - RNA, 15 nt, Haemophilus influenzae Rd
uugaauugcauuuuc

SEQ ID NO: 693488 - RNA, 22 nt, Haemophilus influenzae Rd
uugaauugcauuuucuuccaau

SEQ ID NO: 693489 - RNA, 19 nt, Haemophilus influenzae Rd
uugaauugcuuuaauuucu

SEQ ID NO: 693490 - RNA, 21 nt, Haemophilus influenzae Rd
uugaauugcuuuaauuucuuu

SEQ ID NO: 693491 - RNA, 23 nt, Haemophilus influenzae Rd
uugaauuggaaguuuuuccguug

SEQ ID NO: 693492 - RNA, 14 nt, Haemophilus influenzae Rd
uugagcaauaaauu

SEQ ID NO: 693493 - RNA, 21 nt, Haemophilus influenzae Rd
uugagcaauccaaucagcaaa

SEQ ID NO: 693494 - RNA, 20 nt, Haemophilus influenzae Rd
uugagaugccauuucgcuug

SEQ ID NO: 693495 - RNA, 16 nt, Haemophilus influenzae Rd
uugaguugucacaaca

SEQ ID NO: 693496 - RNA, 15 nt, Haemophilus influenzae Rd
uugaguuuagucuuu

SEQ ID NO: 693497 - RNA, 15 nt, Haemophilus influenzae Rd
uugauaaaaaagaaa

SEQ ID NO: 693498 - RNA, 23 nt, Haemophilus influenzae Rd
uugauaaaggcauuuauuucaau

SEQ ID NO: 693499 - RNA, 21 nt, Haemophilus influenzae Rd
uugauaaaguuuuuucaauaa

SEQ ID NO: 693500 - RNA, 23 nt, Haemophilus influenzae Rd
uugacuuauuccagucuacacuu

SEQ ID NO: 693501 - RNA, 18 nt, Haemophilus influenzae Rd
uugauauucaauuacuau

SEQ ID NO: 693502 - RNA, 20 nt, Haemophilus influenzae Rd
uugauauuuggauaacaaau

SEQ ID NO: 693503 - RNA, 21 nt, Haemophilus influenzae Rd
uugauauuuggauaacaaauu

SEQ ID NO: 693504 - RNA, 22 nt, Haemophilus influenzae Rd
uugauaacuuuaaguaaucaga

SEQ ID NO: 693505 - RNA, 13 nt, Haemophilus influenzae Rd
uugauaaacauaa

SEQ ID NO: 693506 - RNA, 12 nt, Haemophilus influenzae Rd
uugaucaucucg

SEQ ID NO: 693507 - RNA, 15 nt, Haemophilus influenzae Rd
uugauccauauauug

SEQ ID NO: 693508 - RNA, 20 nt, Haemophilus influenzae Rd
uugauccauauauugaacau

SEQ ID NO: 693509 - RNA, 13 nt, Haemophilus influenzae Rd
uugauccacaaau

SEQ ID NO: 693510 - RNA, 23 nt, Haemophilus influenzae Rd
uugcaaaaacccucaagaaacug

SEQ ID NO: 693511 - RNA, 19 nt, Haemophilus influenzae Rd
uugcaaaaucacacgugcu

SEQ ID NO: 693512 - RNA, 12 nt, Haemophilus influenzae Rd
uugauuuuucaa

SEQ ID NO: 693513 - RNA, 13 nt, Haemophilus influenzae Rd
uugauuuugucua

SEQ ID NO: 693514 - RNA, 14 nt, Haemophilus influenzae Rd
uugauuuuuaugua

SEQ ID NO: 693515 - RNA, 13 nt, Haemophilus influenzae Rd
uugauugagaugc

SEQ ID NO: 693516 - RNA, 13 nt, Haemophilus influenzae Rd
uugauuuaaaaau

SEQ ID NO: 693517 - RNA, 14 nt, Haemophilus influenzae Rd
uugauuuaaaaauc

SEQ ID NO: 693518 - RNA, 19 nt, Haemophilus influenzae Rd
uugaugauuaacuauucaa

SEQ ID NO: 693519 - RNA, 17 nt, Haemophilus influenzae Rd
uugaugauuugcauaaa

SEQ ID NO: 693520 - RNA, 19 nt, Haemophilus influenzae Rd
uugaugauuugcauaaaac

SEQ ID NO: 693521 - RNA, 15 nt, Haemophilus influenzae Rd
uugaugcacaacgau

SEQ ID NO: 693522 - RNA, 21 nt, Haemophilus influenzae Rd
uugaugcacaacgaucacgaa

SEQ ID NO: 693523 - RNA, 18 nt, Haemophilus influenzae Rd
uugauuauuuaauuucaa

SEQ ID NO: 693524 - RNA, 16 nt, Haemophilus influenzae Rd
uugauuauuuuuuaac

SEQ ID NO: 693525 - RNA, 21 nt, Haemophilus influenzae Rd
uugauuauuuuuuaacguacc

SEQ ID NO: 693526 - RNA, 19 nt, Haemophilus influenzae Rd
uugcacaauagcuuccgcu

SEQ ID NO: 693527 - RNA, 21 nt, Haemophilus influenzae Rd
uugcacaauuacuucuuacaa

SEQ ID NO: 693528 - RNA, 23 nt, Haemophilus influenzae Rd
uugcaauaaauucguacaaauga

SEQ ID NO: 693529 - RNA, 19 nt, Haemophilus influenzae Rd
uugcaagggauuugaaaau

SEQ ID NO: 693530 - RNA, 14 nt, Haemophilus influenzae Rd
uugcaagugagcua

SEQ ID NO: 693531 - RNA, 23 nt, Haemophilus influenzae Rd
uugcaagugagcuaagcauuuca

SEQ ID NO: 693532 - RNA, 17 nt, Haemophilus influenzae Rd
uugcaagugcaguuuca

SEQ ID NO: 693533 - RNA, 20 nt, Haemophilus influenzae Rd
uugcaacaucaauaacaagc

SEQ ID NO: 693534 - RNA, 16 nt, Haemophilus influenzae Rd
uugcaacuucgccuug

SEQ ID NO: 693535 - RNA, 13 nt, Haemophilus influenzae Rd
uugcaacuuuuuu

SEQ ID NO: 693536 - RNA, 15 nt, Haemophilus influenzae Rd
uugcaaaccaaauca

SEQ ID NO: 693537 - RNA, 19 nt, Haemophilus influenzae Rd
uugcaaaccaaaucacaau

SEQ ID NO: 693538 - RNA, 23 nt, Haemophilus influenzae Rd
uugcaaaccaaaucacaauaagc

SEQ ID NO: 693539 - RNA, 18 nt, Haemophilus influenzae Rd
uugcaaauuuucagcuug

SEQ ID NO: 693540 - RNA, 22 nt, Haemophilus influenzae Rd
uugcaaauuuucagcuugugcu

SEQ ID NO: 693541 - RNA, 17 nt, Haemophilus influenzae Rd
uugcaaauuuucgacuu

SEQ ID NO: 693542 - RNA, 12 nt, Haemophilus influenzae Rd
uugcguucuccg

SEQ ID NO: 693543 - RNA, 11 nt, Haemophilus influenzae Rd
uugcuaaaaag

SEQ ID NO: 693544 - RNA, 17 nt, Haemophilus influenzae Rd
uugcucaauaauuucaa

SEQ ID NO: 693545 - RNA, 14 nt, Haemophilus influenzae Rd
uugcuaaauuuauu

SEQ ID NO: 693546 - RNA, 21 nt, Haemophilus influenzae Rd
uugcuaaaucaccuaaaucuu

SEQ ID NO: 693547 - RNA, 23 nt, Haemophilus influenzae Rd
uugcucacguaaccguucuaguu

SEQ ID NO: 693548 - RNA, 15 nt, Haemophilus influenzae Rd
uugcuccuacuuuua

SEQ ID NO: 693549 - RNA, 22 nt, Haemophilus influenzae Rd
uugcucugcguucaagccuuug

SEQ ID NO: 693550 - RNA, 15 nt, Haemophilus influenzae Rd
uugcucuuucaaguu

SEQ ID NO: 693551 - RNA, 20 nt, Haemophilus influenzae Rd
uugcucuuuaacaauauauc

SEQ ID NO: 693552 - RNA, 21 nt, Haemophilus influenzae Rd
uugcucuuuaacaauauauca

SEQ ID NO: 693553 - RNA, 15 nt, Haemophilus influenzae Rd
uugcgucuucaaguc

SEQ ID NO: 693554 - RNA, 18 nt, Haemophilus influenzae Rd
uugcgucuucaagucuuu

SEQ ID NO: 693555 - RNA, 14 nt, Haemophilus influenzae Rd
uugcguguuuauau

SEQ ID NO: 693556 - RNA, 13 nt, Haemophilus influenzae Rd
uugcgugcgaauu

SEQ ID NO: 693557 - RNA, 18 nt, Haemophilus influenzae Rd
uugcgccuaaaccaaaac

SEQ ID NO: 693558 - RNA, 14 nt, Haemophilus influenzae Rd
uugccaauuccuug

SEQ ID NO: 693559 - RNA, 18 nt, Haemophilus influenzae Rd
uugccaauugaauuaaaa

SEQ ID NO: 693560 - RNA, 22 nt, Haemophilus influenzae Rd
uugccaauuuuuucugaauaaa

SEQ ID NO: 693561 - RNA, 20 nt, Haemophilus influenzae Rd
uugccaacuuagauuuucuu

SEQ ID NO: 693562 - RNA, 21 nt, Haemophilus influenzae Rd
uugccaacgcagguacacguu

SEQ ID NO: 693563 - RNA, 21 nt, Haemophilus influenzae Rd
uugccaaugccaaauuucucc

SEQ ID NO: 693564 - RNA, 18 nt, Haemophilus influenzae Rd
uugccacaggauaaaaac

SEQ ID NO: 693565 - RNA, 22 nt, Haemophilus influenzae Rd
uugcccagaaauuggcuuguug

SEQ ID NO: 693566 - RNA, 17 nt, Haemophilus influenzae Rd
uugcacgagcaauaaua

SEQ ID NO: 693567 - RNA, 12 nt, Haemophilus influenzae Rd
uugcaccuaauu

SEQ ID NO: 693568 - RNA, 20 nt, Haemophilus influenzae Rd
uugcaccaucguuaaaccaa

SEQ ID NO: 693569 - RNA, 18 nt, Haemophilus influenzae Rd
uugcaccacguucuuuua

SEQ ID NO: 693570 - RNA, 16 nt, Haemophilus influenzae Rd
uugcauuuuggaaaau

SEQ ID NO: 693571 - RNA, 20 nt, Haemophilus influenzae Rd
uugcauuuuggaaaauagaa

SEQ ID NO: 693572 - RNA, 14 nt, Haemophilus influenzae Rd
uugcauuuuuuaua

SEQ ID NO: 693573 - RNA, 12 nt, Haemophilus influenzae Rd
uugccaaaaauu

SEQ ID NO: 693574 - RNA, 13 nt, Haemophilus influenzae Rd
uugcauuuacaua

SEQ ID NO: 693575 - RNA, 15 nt, Haemophilus influenzae Rd
uugcauuucuaaaua

SEQ ID NO: 693576 - RNA, 17 nt, Haemophilus influenzae Rd
uugcauuucuaaauaaa

SEQ ID NO: 693577 - RNA, 23 nt, Haemophilus influenzae Rd
uugcacggcgcguaaaucagaac

SEQ ID NO: 693578 - RNA, 17 nt, Haemophilus influenzae Rd
uugcccuagugcaacca

SEQ ID NO: 693579 - RNA, 17 nt, Haemophilus influenzae Rd
uugcccgugaguaaaau

SEQ ID NO: 693580 - RNA, 22 nt, Haemophilus influenzae Rd
uugcccgcuucuucgauaaaau

SEQ ID NO: 693581 - RNA, 21 nt, Haemophilus influenzae Rd
uugcccgcaccgcuucuuugu

SEQ ID NO: 693582 - RNA, 23 nt, Haemophilus influenzae Rd
uugccgcuuccacaccaaaaaug

SEQ ID NO: 693583 - RNA, 15 nt, Haemophilus influenzae Rd
uuccgcuuccugcug

SEQ ID NO: 693584 - RNA, 15 nt, Haemophilus influenzae Rd
uuccgcuaauacuag

SEQ ID NO: 693585 - RNA, 20 nt, Haemophilus influenzae Rd
uuccgcuggugggaauaauu

SEQ ID NO: 693586 - RNA, 15 nt, Haemophilus influenzae Rd
uuccgcuuuaauaau

SEQ ID NO: 693587 - RNA, 18 nt, Haemophilus influenzae Rd
uuccgcuuuaauaaucaa

SEQ ID NO: 693588 - RNA, 13 nt, Haemophilus influenzae Rd
uuccucagcaaaa

SEQ ID NO: 693589 - RNA, 16 nt, Haemophilus influenzae Rd
uuccucagcaaaagac

SEQ ID NO: 693590 - RNA, 14 nt, Haemophilus influenzae Rd
uuccuaugaauaag

SEQ ID NO: 693591 - RNA, 19 nt, Haemophilus influenzae Rd
uuccuaugccuuuugucac

SEQ ID NO: 693592 - RNA, 17 nt, Haemophilus influenzae Rd
uuccucgacauaaaaac

SEQ ID NO: 693593 - RNA, 12 nt, Haemophilus influenzae Rd
uuccucugcagg

SEQ ID NO: 693594 - RNA, 19 nt, Haemophilus influenzae Rd
uucccagcguaaaaaugcu

SEQ ID NO: 693595 - RNA, 13 nt, Haemophilus influenzae Rd
uucccaaauuuuu

SEQ ID NO: 693596 - RNA, 11 nt, Haemophilus influenzae Rd
uuccauuuuuu

SEQ ID NO: 693597 - RNA, 15 nt, Haemophilus influenzae Rd
uuccauuuugcauau

SEQ ID NO: 693598 - RNA, 17 nt, Haemophilus influenzae Rd
uucccauuucuaaugca

SEQ ID NO: 693599 - RNA, 20 nt, Haemophilus influenzae Rd
uuccgcaagaggaauuucga

SEQ ID NO: 693600 - RNA, 20 nt, Haemophilus influenzae Rd
uuccgacuaaaaccaagaaa

SEQ ID NO: 693601 - RNA, 17 nt, Haemophilus influenzae Rd
uuccgaaaaaacaagag

SEQ ID NO: 693602 - RNA, 22 nt, Haemophilus influenzae Rd
uuccgacaacacuugcuguuuu

SEQ ID NO: 693603 - RNA, 14 nt, Haemophilus influenzae Rd
uuccaggaaaauuu

SEQ ID NO: 693604 - RNA, 19 nt, Haemophilus influenzae Rd
uuccaguauagugcgcaua

SEQ ID NO: 693605 - RNA, 22 nt, Haemophilus influenzae Rd
uuccaguaaugguuacuuuauc

SEQ ID NO: 693606 - RNA, 17 nt, Haemophilus influenzae Rd
uuccagugguaaaccua

SEQ ID NO: 693607 - RNA, 14 nt, Haemophilus influenzae Rd
uuccauaauagaau

SEQ ID NO: 693608 - RNA, 20 nt, Haemophilus influenzae Rd
uuccauaauguucccuauaa

SEQ ID NO: 693609 - RNA, 23 nt, Haemophilus influenzae Rd
uuccauaauguucccuauaaaua

SEQ ID NO: 693610 - RNA, 12 nt, Haemophilus influenzae Rd
uuccauaaaaga

SEQ ID NO: 693611 - RNA, 16 nt, Haemophilus influenzae Rd
uuccauaaaagaccuc

SEQ ID NO: 693612 - RNA, 22 nt, Haemophilus influenzae Rd
uuccauugggaagcuggaagua

SEQ ID NO: 693613 - RNA, 14 nt, Haemophilus influenzae Rd
uuccauugcaucca

SEQ ID NO: 693614 - RNA, 21 nt, Haemophilus influenzae Rd
uuccauugcauccacuucauc

SEQ ID NO: 693615 - RNA, 15 nt, Haemophilus influenzae Rd
uuccauuaauucaua

SEQ ID NO: 693616 - RNA, 13 nt, Haemophilus influenzae Rd
uuccaugccuaau

SEQ ID NO: 693617 - RNA, 18 nt, Haemophilus influenzae Rd
uuccauagauuaucgccu

SEQ ID NO: 693618 - RNA, 17 nt, Haemophilus influenzae Rd
uuccauaccaaaauguc

SEQ ID NO: 693619 - RNA, 19 nt, Haemophilus influenzae Rd
uuccauaguucacuaaaaa

SEQ ID NO: 693620 - RNA, 20 nt, Haemophilus influenzae Rd
uuccauaucacauuuuauug

SEQ ID NO: 693621 - RNA, 20 nt, Haemophilus influenzae Rd
uuccauauuguuucaauuua

SEQ ID NO: 693622 - RNA, 12 nt, Haemophilus influenzae Rd
uuccaucaaaac

SEQ ID NO: 693623 - RNA, 21 nt, Haemophilus influenzae Rd
uuccaucgcacuguuauauaa

SEQ ID NO: 693624 - RNA, 19 nt, Haemophilus influenzae Rd
uuccacgcguuuuuacaua

SEQ ID NO: 693625 - RNA, 20 nt, Haemophilus influenzae Rd
uuccacuucauaaauccaau

SEQ ID NO: 693626 - RNA, 22 nt, Haemophilus influenzae Rd
uuccagccuaagcuaaagucgu

SEQ ID NO: 693627 - RNA, 18 nt, Haemophilus influenzae Rd
uucagggauuaagaaaau

SEQ ID NO: 693628 - RNA, 22 nt, Haemophilus influenzae Rd
uucagggcgaaguaaaaaguca

SEQ ID NO: 693629 - RNA, 14 nt, Haemophilus influenzae Rd
uuccacaacaacca

SEQ ID NO: 693630 - RNA, 19 nt, Haemophilus influenzae Rd
uuccaauucuaguucuucc

SEQ ID NO: 693631 - RNA, 22 nt, Haemophilus influenzae Rd
uuccaauucuuuuaaauguguu

SEQ ID NO: 693632 - RNA, 13 nt, Haemophilus influenzae Rd
uuccaauuaauuc

SEQ ID NO: 693633 - RNA, 22 nt, Haemophilus influenzae Rd
uuccacccgguacgcaaccuug

SEQ ID NO: 693634 - RNA, 22 nt, Haemophilus influenzae Rd
uuccaccacagcccaaaauuca

SEQ ID NO: 693635 - RNA, 16 nt, Haemophilus influenzae Rd
uuccaccuugaauaau

SEQ ID NO: 693636 - RNA, 16 nt, Haemophilus influenzae Rd
uucucaauugcaaaau

SEQ ID NO: 693637 - RNA, 17 nt, Haemophilus influenzae Rd
uucucaauugcaaaauc

SEQ ID NO: 693638 - RNA, 20 nt, Haemophilus influenzae Rd
uucuauuugaauuaaaacuu

SEQ ID NO: 693639 - RNA, 14 nt, Haemophilus influenzae Rd
uucuauuuuaaaaa

SEQ ID NO: 693640 - RNA, 21 nt, Haemophilus influenzae Rd
uucuauucucuguugcucagc

SEQ ID NO: 693641 - RNA, 14 nt, Haemophilus influenzae Rd
uucuauuaaaauau

SEQ ID NO: 693642 - RNA, 15 nt, Haemophilus influenzae Rd
uucuauuaaaauauu

SEQ ID NO: 693643 - RNA, 20 nt, Haemophilus influenzae Rd
uucuacgaauugguucuaaa

SEQ ID NO: 693644 - RNA, 21 nt, Haemophilus influenzae Rd
uucuacguauugaacuaaaau

SEQ ID NO: 693645 - RNA, 20 nt, Haemophilus influenzae Rd
uucuacggucgcaccaccuu

SEQ ID NO: 693646 - RNA, 21 nt, Haemophilus influenzae Rd
uucuacggucgcaccaccuuu

SEQ ID NO: 693647 - RNA, 15 nt, Haemophilus influenzae Rd
uucuacgguuuuaau

SEQ ID NO: 693648 - RNA, 17 nt, Haemophilus influenzae Rd
uucuacguaauuuaauu

SEQ ID NO: 693649 - RNA, 18 nt, Haemophilus influenzae Rd
uucuacgccuaaugcauu

SEQ ID NO: 693650 - RNA, 20 nt, Haemophilus influenzae Rd
uucuagcuuaccuuaauuaa

SEQ ID NO: 693651 - RNA, 19 nt, Haemophilus influenzae Rd
uucuaguaaaacuaauacu

SEQ ID NO: 693652 - RNA, 13 nt, Haemophilus influenzae Rd
uucuaguuuuucc

SEQ ID NO: 693653 - RNA, 15 nt, Haemophilus influenzae Rd
uucuaguucuucccc

SEQ ID NO: 693654 - RNA, 20 nt, Haemophilus influenzae Rd
uucuauaauccgcagaauuu

SEQ ID NO: 693655 - RNA, 16 nt, Haemophilus influenzae Rd
uucuaccgcauuuuua

SEQ ID NO: 693656 - RNA, 14 nt, Haemophilus influenzae Rd
uucuaauuuuugca

SEQ ID NO: 693657 - RNA, 15 nt, Haemophilus influenzae Rd
uucuaauuuuugcaa

SEQ ID NO: 693658 - RNA, 13 nt, Haemophilus influenzae Rd
uucuaauugcugc

SEQ ID NO: 693659 - RNA, 16 nt, Haemophilus influenzae Rd
uucuacacuuaaauua

SEQ ID NO: 693660 - RNA, 15 nt, Haemophilus influenzae Rd
uucuaauuugccauc

SEQ ID NO: 693661 - RNA, 16 nt, Haemophilus influenzae Rd
uucuaauuuuaaaaca

SEQ ID NO: 693662 - RNA, 13 nt, Haemophilus influenzae Rd
uucuaauuuucac

SEQ ID NO: 693663 - RNA, 16 nt, Haemophilus influenzae Rd
uucuaauuaacugaaa

SEQ ID NO: 693664 - RNA, 19 nt, Haemophilus influenzae Rd
uucuaauguuaauuuuaaa

SEQ ID NO: 693665 - RNA, 22 nt, Haemophilus influenzae Rd
uucuaaugaaauuucuugcucu

SEQ ID NO: 693666 - RNA, 22 nt, Haemophilus influenzae Rd
uucuaauucacgcauuuaaaua

SEQ ID NO: 693667 - RNA, 19 nt, Haemophilus influenzae Rd
uucuaauuccccuucaaau

SEQ ID NO: 693668 - RNA, 20 nt, Haemophilus influenzae Rd
uucuaauuccccuucaaaua

SEQ ID NO: 693669 - RNA, 21 nt, Haemophilus influenzae Rd
uucuaauucggcuucaguauc

SEQ ID NO: 693670 - RNA, 13 nt, Haemophilus influenzae Rd
uucuaauucugca

SEQ ID NO: 693671 - RNA, 14 nt, Haemophilus influenzae Rd
uucuaauaaaauau

SEQ ID NO: 693672 - RNA, 15 nt, Haemophilus influenzae Rd
uucuaauaaaauaua

SEQ ID NO: 693673 - RNA, 11 nt, Haemophilus influenzae Rd
uucuaauccag

SEQ ID NO: 693674 - RNA, 21 nt, Haemophilus influenzae Rd
uucuaauccagauugguauuc

SEQ ID NO: 693675 - RNA, 18 nt, Haemophilus influenzae Rd
uucuaaggcagcaagaaa

SEQ ID NO: 693676 - RNA, 19 nt, Haemophilus influenzae Rd
uucuaagguauccacuuuu

SEQ ID NO: 693677 - RNA, 20 nt, Haemophilus influenzae Rd
uucuaagguauccacuuuuc

SEQ ID NO: 693678 - RNA, 21 nt, Haemophilus influenzae Rd
uucuaagguuaugccaaugcu

SEQ ID NO: 693679 - RNA, 23 nt, Haemophilus influenzae Rd
uucuaagguugcucgaacaauau

SEQ ID NO: 693680 - RNA, 15 nt, Haemophilus influenzae Rd
uucucaccaaauugu

SEQ ID NO: 693681 - RNA, 16 nt, Haemophilus influenzae Rd
uucucaccaaauuguu

SEQ ID NO: 693682 - RNA, 19 nt, Haemophilus influenzae Rd
uucucaccaaauuguucua

SEQ ID NO: 693683 - RNA, 20 nt, Haemophilus influenzae Rd
uucucaccaccagauaaggu

SEQ ID NO: 693684 - RNA, 20 nt, Haemophilus influenzae Rd
uucucauaauagaaaacauu

SEQ ID NO: 693685 - RNA, 13 nt, Haemophilus influenzae Rd
uucucauacaaaa

SEQ ID NO: 693686 - RNA, 20 nt, Haemophilus influenzae Rd
uucucgucuuugaagccuga

SEQ ID NO: 693687 - RNA, 18 nt, Haemophilus influenzae Rd
uucucgugccuauuuauu

SEQ ID NO: 693688 - RNA, 18 nt, Haemophilus influenzae Rd
uucucuaacgcauucaaa

SEQ ID NO: 693689 - RNA, 22 nt, Haemophilus influenzae Rd
uucugcacgauggcccuccgua

SEQ ID NO: 693690 - RNA, 19 nt, Haemophilus influenzae Rd
uucugcaggaaaaauaaau

SEQ ID NO: 693691 - RNA, 23 nt, Haemophilus influenzae Rd
uucugcaauuaaacuaauuccga

SEQ ID NO: 693692 - RNA, 17 nt, Haemophilus influenzae Rd
uucugcagaaaaauguu

SEQ ID NO: 693693 - RNA, 21 nt, Haemophilus influenzae Rd
uucugcagcaagaucaauaua

SEQ ID NO: 693694 - RNA, 15 nt, Haemophilus influenzae Rd
uucucuuauuugugu

SEQ ID NO: 693695 - RNA, 12 nt, Haemophilus influenzae Rd
uucucuguuuua

SEQ ID NO: 693696 - RNA, 18 nt, Haemophilus influenzae Rd
uucucucgcugaauuauu

SEQ ID NO: 693697 - RNA, 18 nt, Haemophilus influenzae Rd
uucucuggcucgcucuuc

SEQ ID NO: 693698 - RNA, 12 nt, Haemophilus influenzae Rd
uucguauuguug

SEQ ID NO: 693699 - RNA, 13 nt, Haemophilus influenzae Rd
uucgugcaauaac

SEQ ID NO: 693700 - RNA, 15 nt, Haemophilus influenzae Rd
uucguuauaagccua

SEQ ID NO: 693701 - RNA, 13 nt, Haemophilus influenzae Rd
uucuaaauaaacu

SEQ ID NO: 693702 - RNA, 15 nt, Haemophilus influenzae Rd
uucuaaauaaacuac

SEQ ID NO: 693703 - RNA, 15 nt, Haemophilus influenzae Rd
uucuaaaugaauaaa

SEQ ID NO: 693704 - RNA, 18 nt, Haemophilus influenzae Rd
uucuaaaugaauaaaacu

SEQ ID NO: 693705 - RNA, 16 nt, Haemophilus influenzae Rd
uucuaaauauuuuuca

SEQ ID NO: 693706 - RNA, 17 nt, Haemophilus influenzae Rd
uucuaaauauuuuucaa

SEQ ID NO: 693707 - RNA, 20 nt, Haemophilus influenzae Rd
uucuaaaggaguaaguuuua

SEQ ID NO: 693708 - RNA, 17 nt, Haemophilus influenzae Rd
uucuaaaggcuaaauaa

SEQ ID NO: 693709 - RNA, 14 nt, Haemophilus influenzae Rd
uucuaacacagaaa

SEQ ID NO: 693710 - RNA, 20 nt, Haemophilus influenzae Rd
uucuaacaucggcaaccaag

SEQ ID NO: 693711 - RNA, 18 nt, Haemophilus influenzae Rd
uucuaacaucucuugaau

SEQ ID NO: 693712 - RNA, 14 nt, Haemophilus influenzae Rd
uucuaacauuugac

SEQ ID NO: 693713 - RNA, 23 nt, Haemophilus influenzae Rd
uucuaaccgcacuuuuuaauaaa

SEQ ID NO: 693714 - RNA, 14 nt, Haemophilus influenzae Rd
uucgguuaaagaag

SEQ ID NO: 693715 - RNA, 21 nt, Haemophilus influenzae Rd
uucgguugcgccgccuugcuc

SEQ ID NO: 693716 - RNA, 19 nt, Haemophilus influenzae Rd
uucgcuucauuauauuccu

SEQ ID NO: 693717 - RNA, 21 nt, Haemophilus influenzae Rd
uucggacucgcuguaacauca

SEQ ID NO: 693718 - RNA, 19 nt, Haemophilus influenzae Rd
uucggacuuugauaauaca

SEQ ID NO: 693719 - RNA, 19 nt, Haemophilus influenzae Rd
uucgccgaguaaauucacc

SEQ ID NO: 693720 - RNA, 20 nt, Haemophilus influenzae Rd
uucgcauauuuuugcaagau

SEQ ID NO: 693721 - RNA, 19 nt, Haemophilus influenzae Rd
uucgcaucaaucacagcac

SEQ ID NO: 693722 - RNA, 16 nt, Haemophilus influenzae Rd
uucgccugauuucgcu

SEQ ID NO: 693723 - RNA, 23 nt, Haemophilus influenzae Rd
uucgccuuagccuguucuuccac

SEQ ID NO: 693724 - RNA, 14 nt, Haemophilus influenzae Rd
uucgccuucauaag

SEQ ID NO: 693725 - RNA, 14 nt, Haemophilus influenzae Rd
uucgccguuaguuu

SEQ ID NO: 693726 - RNA, 17 nt, Haemophilus influenzae Rd
uucgcugcagcugcugc

SEQ ID NO: 693727 - RNA, 13 nt, Haemophilus influenzae Rd
uucgcugcaaaau

SEQ ID NO: 693728 - RNA, 16 nt, Haemophilus influenzae Rd
uucgcuuacaaaauau

SEQ ID NO: 693729 - RNA, 21 nt, Haemophilus influenzae Rd
uucgcuaauuuuuuuccaauu

SEQ ID NO: 693730 - RNA, 19 nt, Haemophilus influenzae Rd
uucgcuauguuuaaauauu

SEQ ID NO: 693731 - RNA, 16 nt, Haemophilus influenzae Rd
uucgcuauuuucuaau

SEQ ID NO: 693732 - RNA, 17 nt, Haemophilus influenzae Rd
uucgcuauuuucuaaug

SEQ ID NO: 693733 - RNA, 22 nt, Haemophilus influenzae Rd
uucgcucguuguagcccaaucu

SEQ ID NO: 693734 - RNA, 11 nt, Haemophilus influenzae Rd
uuccuuucacc

SEQ ID NO: 693735 - RNA, 17 nt, Haemophilus influenzae Rd
uuccuuuucauaaaaau

SEQ ID NO: 693736 - RNA, 19 nt, Haemophilus influenzae Rd
uucgcaguguuaaaugcag

SEQ ID NO: 693737 - RNA, 21 nt, Haemophilus influenzae Rd
uucgcaguguuaaaugcagua

SEQ ID NO: 693738 - RNA, 13 nt, Haemophilus influenzae Rd
uucgcacguuuuu

SEQ ID NO: 693739 - RNA, 17 nt, Haemophilus influenzae Rd
uggacuuuauuugauug

SEQ ID NO: 693740 - RNA, 23 nt, Haemophilus influenzae Rd
uggagaacuucaaauuguacuuu

SEQ ID NO: 693741 - RNA, 19 nt, Haemophilus influenzae Rd
uggagauaaauaaaguuau

SEQ ID NO: 693742 - RNA, 18 nt, Haemophilus influenzae Rd
uggagauaauauuccaaa

SEQ ID NO: 693743 - RNA, 20 nt, Haemophilus influenzae Rd
uggagcaguaugaugauugu

SEQ ID NO: 693744 - RNA, 18 nt, Haemophilus influenzae Rd
uggaucggcuauuucagc

SEQ ID NO: 693745 - RNA, 23 nt, Haemophilus influenzae Rd
uggaucacccauuaaauaaaaau

SEQ ID NO: 693746 - RNA, 16 nt, Haemophilus influenzae Rd
uggaucuucagcauuu

SEQ ID NO: 693747 - RNA, 11 nt, Haemophilus influenzae Rd
uggaugaaauc

SEQ ID NO: 693748 - RNA, 14 nt, Haemophilus influenzae Rd
uggaugaaaucaaa

SEQ ID NO: 693749 - RNA, 22 nt, Haemophilus influenzae Rd
uggaugaaaucauuuguaaguu

SEQ ID NO: 693750 - RNA, 14 nt, Haemophilus influenzae Rd
uggaucuaaaaaau

SEQ ID NO: 693751 - RNA, 14 nt, Haemophilus influenzae Rd
uggaucuaaaucug

SEQ ID NO: 693752 - RNA, 16 nt, Haemophilus influenzae Rd
uggauauagaaaucau

SEQ ID NO: 693753 - RNA, 22 nt, Haemophilus influenzae Rd
uggauauagaaaucauaaacug

SEQ ID NO: 693754 - RNA, 15 nt, Haemophilus influenzae Rd
uggauacacaaauug

SEQ ID NO: 693755 - RNA, 23 nt, Haemophilus influenzae Rd
uggauacacaaauugaagagauu

SEQ ID NO: 693756 - RNA, 18 nt, Haemophilus influenzae Rd
uggauaaauuauucugca

SEQ ID NO: 693757 - RNA, 17 nt, Haemophilus influenzae Rd
uggaguuguuuaaaauu

SEQ ID NO: 693758 - RNA, 21 nt, Haemophilus influenzae Rd
uggaguuauuucuuuaaaugg

SEQ ID NO: 693759 - RNA, 17 nt, Haemophilus influenzae Rd
uggaguucuugaauaca

SEQ ID NO: 693760 - RNA, 19 nt, Haemophilus influenzae Rd
uggcaucgugaugauuuuc

SEQ ID NO: 693761 - RNA, 13 nt, Haemophilus influenzae Rd
uggcauaucaauu

SEQ ID NO: 693762 - RNA, 19 nt, Haemophilus influenzae Rd
uggcauaucagcaucaauu

SEQ ID NO: 693763 - RNA, 14 nt, Haemophilus influenzae Rd
uggcauaauuuggu

SEQ ID NO: 693764 - RNA, 15 nt, Haemophilus influenzae Rd
uggcauagaaacaac

SEQ ID NO: 693765 - RNA, 20 nt, Haemophilus influenzae Rd
uggcauauucgcaccuucag

SEQ ID NO: 693766 - RNA, 23 nt, Haemophilus influenzae Rd
uggcauauucgcaccuucagcca

SEQ ID NO: 693767 - RNA, 18 nt, Haemophilus influenzae Rd
uggcacuggaaauggcua

SEQ ID NO: 693768 - RNA, 16 nt, Haemophilus influenzae Rd
uggcaacgccaauaaa

SEQ ID NO: 693769 - RNA, 15 nt, Haemophilus influenzae Rd
uggauuagagccauc

SEQ ID NO: 693770 - RNA, 15 nt, Haemophilus influenzae Rd
uggauuaaacaacca

SEQ ID NO: 693771 - RNA, 15 nt, Haemophilus influenzae Rd
uggauuaaauaacca

SEQ ID NO: 693772 - RNA, 14 nt, Haemophilus influenzae Rd
uggauguaaauuga

SEQ ID NO: 693773 - RNA, 14 nt, Haemophilus influenzae Rd
ugggccucuuuauc

SEQ ID NO: 693774 - RNA, 17 nt, Haemophilus influenzae Rd
ugggccucuuuaucuau

SEQ ID NO: 693775 - RNA, 23 nt, Haemophilus influenzae Rd
ugggccacgagcgugaaguuuuu

SEQ ID NO: 693776 - RNA, 23 nt, Haemophilus influenzae Rd
ugggcauccaaaguacacaagaa

SEQ ID NO: 693777 - RNA, 19 nt, Haemophilus influenzae Rd
ugggagaacuuuuaaaaca

SEQ ID NO: 693778 - RNA, 14 nt, Haemophilus influenzae Rd
uggggaaaaauauu

SEQ ID NO: 693779 - RNA, 18 nt, Haemophilus influenzae Rd
uggguaaucaaauucaau

SEQ ID NO: 693780 - RNA, 14 nt, Haemophilus influenzae Rd
ugggguuaaaaagc

SEQ ID NO: 693781 - RNA, 13 nt, Haemophilus influenzae Rd
uggguaaaauaau

SEQ ID NO: 693782 - RNA, 23 nt, Haemophilus influenzae Rd
ugggcgauaaaaauuaaggaaag

SEQ ID NO: 693783 - RNA, 19 nt, Haemophilus influenzae Rd
ugggacuggacuccaaggc

SEQ ID NO: 693784 - RNA, 17 nt, Haemophilus influenzae Rd
ugggaauaauuuuggau

SEQ ID NO: 693785 - RNA, 18 nt, Haemophilus influenzae Rd
ugggaauaauuuuggauc

SEQ ID NO: 693786 - RNA, 17 nt, Haemophilus influenzae Rd
uggcucauuuuaaagag

SEQ ID NO: 693787 - RNA, 19 nt, Haemophilus influenzae Rd
uggcucgcucuucagcuuc

SEQ ID NO: 693788 - RNA, 16 nt, Haemophilus influenzae Rd
uggcugaaauucuaaa

SEQ ID NO: 693789 - RNA, 18 nt, Haemophilus influenzae Rd
uggcugaaauucuaaaaa

SEQ ID NO: 693790 - RNA, 19 nt, Haemophilus influenzae Rd
uggcugaaauucuaaaaaa

SEQ ID NO: 693791 - RNA, 23 nt, Haemophilus influenzae Rd
uggcugagguuccccuaaaaaau

SEQ ID NO: 693792 - RNA, 16 nt, Haemophilus influenzae Rd
uggcuaacuucuucca

SEQ ID NO: 693793 - RNA, 13 nt, Haemophilus influenzae Rd
uggcuaaauucac

SEQ ID NO: 693794 - RNA, 16 nt, Haemophilus influenzae Rd
uggcucaaguauucag

SEQ ID NO: 693795 - RNA, 16 nt, Haemophilus influenzae Rd
uggcgguuuuuuaauu

SEQ ID NO: 693796 - RNA, 17 nt, Haemophilus influenzae Rd
uggcggcguauugggcg

SEQ ID NO: 693797 - RNA, 15 nt, Haemophilus influenzae Rd
uggcgaccauucucu

SEQ ID NO: 693798 - RNA, 15 nt, Haemophilus influenzae Rd
uguaaugcuuuuagu

SEQ ID NO: 693799 - RNA, 19 nt, Haemophilus influenzae Rd
uguaauguuuuaauacuuu

SEQ ID NO: 693800 - RNA, 17 nt, Haemophilus influenzae Rd
uguaauaaauuuuauua

SEQ ID NO: 693801 - RNA, 15 nt, Haemophilus influenzae Rd
uguaauaaaaaauac

SEQ ID NO: 693802 - RNA, 22 nt, Haemophilus influenzae Rd
uguaagacgcauuacgccuuca

SEQ ID NO: 693803 - RNA, 15 nt, Haemophilus influenzae Rd
uguaagcaacacaga

SEQ ID NO: 693804 - RNA, 19 nt, Haemophilus influenzae Rd
uguaagccaaauaaugcau

SEQ ID NO: 693805 - RNA, 19 nt, Haemophilus influenzae Rd
uguaagcagcuaacaaaau

SEQ ID NO: 693806 - RNA, 14 nt, Haemophilus influenzae Rd
uguacucaauaagg

SEQ ID NO: 693807 - RNA, 17 nt, Haemophilus influenzae Rd
uguacuaacgaacaagc

SEQ ID NO: 693808 - RNA, 20 nt, Haemophilus influenzae Rd
uguacguucaaaaagcuuaa

SEQ ID NO: 693809 - RNA, 16 nt, Haemophilus influenzae Rd
uguaauuucauuuuaa

SEQ ID NO: 693810 - RNA, 14 nt, Haemophilus influenzae Rd
uguaauugauuuuc

SEQ ID NO: 693811 - RNA, 21 nt, Haemophilus influenzae Rd
uguaauugcgcccccccagcg

SEQ ID NO: 693812 - RNA, 15 nt, Haemophilus influenzae Rd
ugguuuguuaaauga

SEQ ID NO: 693813 - RNA, 19 nt, Haemophilus influenzae Rd
ugguuugacauauuuucua

SEQ ID NO: 693814 - RNA, 17 nt, Haemophilus influenzae Rd
ugguuugcuuaaaagcu

SEQ ID NO: 693815 - RNA, 18 nt, Haemophilus influenzae Rd
uguaaacgaccuugcaaa

SEQ ID NO: 693816 - RNA, 16 nt, Haemophilus influenzae Rd
uguaaacugcuuucaa

SEQ ID NO: 693817 - RNA, 14 nt, Haemophilus influenzae Rd
uguaaacuaaaucu

SEQ ID NO: 693818 - RNA, 17 nt, Haemophilus influenzae Rd
uguaaagauuguccuuu

SEQ ID NO: 693819 - RNA, 24 nt, Haemophilus influenzae Rd
uguaaagcccacaugaacaagcac

SEQ ID NO: 693820 - RNA, 15 nt, Haemophilus influenzae Rd
uguaaaucuaaaaua

SEQ ID NO: 693821 - RNA, 23 nt, Haemophilus influenzae Rd
uguaaaucuuuacccauugucau

SEQ ID NO: 693822 - RNA, 14 nt, Haemophilus influenzae Rd
ugguucauuuguug

SEQ ID NO: 693823 - RNA, 21 nt, Haemophilus influenzae Rd
ugguucauaugcgaucacugc

SEQ ID NO: 693824 - RNA, 18 nt, Haemophilus influenzae Rd
ugguucauuauuaauuga

SEQ ID NO: 693825 - RNA, 21 nt, Haemophilus influenzae Rd
ugguucgagaaacuuucaaaa

SEQ ID NO: 693826 - RNA, 20 nt, Haemophilus influenzae Rd
ugguugcauaaaaucuucua

SEQ ID NO: 693827 - RNA, 19 nt, Haemophilus influenzae Rd
ugguuguaaauuuucaaua

SEQ ID NO: 693828 - RNA, 14 nt, Haemophilus influenzae Rd
ugguuguaauaaug

SEQ ID NO: 693829 - RNA, 15 nt, Haemophilus influenzae Rd
ugguggauuauaaac

SEQ ID NO: 693830 - RNA, 21 nt, Haemophilus influenzae Rd
ugguggaagcuucauauaauc

SEQ ID NO: 693831 - RNA, 19 nt, Haemophilus influenzae Rd
ugguguggagaaagaaauc

SEQ ID NO: 693832 - RNA, 23 nt, Haemophilus influenzae Rd
ugguucaauuuuaauugguuuug

SEQ ID NO: 693833 - RNA, 16 nt, Haemophilus influenzae Rd
ugguuauuugauuauc

SEQ ID NO: 693834 - RNA, 21 nt, Haemophilus influenzae Rd
ugguuacagaaauauuauuaa

SEQ ID NO: 693835 - RNA, 13 nt, Haemophilus influenzae Rd
ugguuaaaauauu

SEQ ID NO: 693836 - RNA, 16 nt, Haemophilus influenzae Rd
ugguuaaaaauagccu

SEQ ID NO: 693837 - RNA, 22 nt, Haemophilus influenzae Rd
uggugccguuugugcuaaauua

SEQ ID NO: 693838 - RNA, 21 nt, Haemophilus influenzae Rd
uggugauuuuaguuucuaauu

SEQ ID NO: 693839 - RNA, 13 nt, Haemophilus influenzae Rd
uggugcaauuuga

SEQ ID NO: 693840 - RNA, 23 nt, Haemophilus influenzae Rd
uggugcauguuuacuuaaaucuu

SEQ ID NO: 693841 - RNA, 22 nt, Haemophilus influenzae Rd
uggugccaauccauuuuuaaau

SEQ ID NO: 693842 - RNA, 14 nt, Haemophilus influenzae Rd
ugucacauaaucag

SEQ ID NO: 693843 - RNA, 15 nt, Haemophilus influenzae Rd
ugucacauuuuguca

SEQ ID NO: 693844 - RNA, 13 nt, Haemophilus influenzae Rd
ugucaauuuuucu

SEQ ID NO: 693845 - RNA, 12 nt, Haemophilus influenzae Rd
ugucaauaauag

SEQ ID NO: 693846 - RNA, 15 nt, Haemophilus influenzae Rd
uguauucgugaaucg

SEQ ID NO: 693847 - RNA, 18 nt, Haemophilus influenzae Rd
uguauuggaaaaguucag

SEQ ID NO: 693848 - RNA, 22 nt, Haemophilus influenzae Rd
uguauuucgucuuaauuuuuua

SEQ ID NO: 693849 - RNA, 22 nt, Haemophilus influenzae Rd
uguaucaauuccuucaaauucu

SEQ ID NO: 693850 - RNA, 16 nt, Haemophilus influenzae Rd
uguagccuguuucaca

SEQ ID NO: 693851 - RNA, 23 nt, Haemophilus influenzae Rd
uguagaucagccccuuaauuauu

SEQ ID NO: 693852 - RNA, 18 nt, Haemophilus influenzae Rd
uguacuggcucuucuuuc

SEQ ID NO: 693853 - RNA, 12 nt, Haemophilus influenzae Rd
uguauccacaaa

SEQ ID NO: 693854 - RNA, 23 nt, Haemophilus influenzae Rd
ugucagauuuauaaauaggcuca

SEQ ID NO: 693855 - RNA, 20 nt, Haemophilus influenzae Rd
ugucaccucguaaaauauua

SEQ ID NO: 693856 - RNA, 18 nt, Haemophilus influenzae Rd
ugucccgcauauaaaaua

SEQ ID NO: 693857 - RNA, 14 nt, Haemophilus influenzae Rd
uguccgaaaaaacu

SEQ ID NO: 693858 - RNA, 15 nt, Haemophilus influenzae Rd
uguccucccauucuu

SEQ ID NO: 693859 - RNA, 16 nt, Haemophilus influenzae Rd
uguccgccaccaaaau

SEQ ID NO: 693860 - RNA, 17 nt, Haemophilus influenzae Rd
uguccgauaguggcacc

SEQ ID NO: 693861 - RNA, 16 nt, Haemophilus influenzae Rd
ugucgcagaauggugc

SEQ ID NO: 693862 - RNA, 14 nt, Haemophilus influenzae Rd
ugucgcuuuuuccu

SEQ ID NO: 693863 - RNA, 14 nt, Haemophilus influenzae Rd
ugucggaaaauaau

SEQ ID NO: 693864 - RNA, 19 nt, Haemophilus influenzae Rd
ugucgcuucuaauucugca

SEQ ID NO: 693865 - RNA, 22 nt, Haemophilus influenzae Rd
ugucgcuucuaauucugcacga

SEQ ID NO: 693866 - RNA, 13 nt, Haemophilus influenzae Rd
ugucguucuuuuu

SEQ ID NO: 693867 - RNA, 14 nt, Haemophilus influenzae Rd
ugucguucuuuuuc

SEQ ID NO: 693868 - RNA, 15 nt, Haemophilus influenzae Rd
ugucguucuuuuucc

SEQ ID NO: 693869 - RNA, 11 nt, Haemophilus influenzae Rd
ugucugaaauu

SEQ ID NO: 693870 - RNA, 16 nt, Haemophilus influenzae Rd
ugucugaaauuuugau

SEQ ID NO: 693871 - RNA, 21 nt, Haemophilus influenzae Rd
ugucugaaauuuuuaucuaaa

SEQ ID NO: 693872 - RNA, 22 nt, Haemophilus influenzae Rd
ugugaucaugguuguaauaaug

SEQ ID NO: 693873 - RNA, 16 nt, Haemophilus influenzae Rd
ugugaugggaaacuga

SEQ ID NO: 693874 - RNA, 20 nt, Haemophilus influenzae Rd
ugugaugggaaacugaacga

SEQ ID NO: 693875 - RNA, 14 nt, Haemophilus influenzae Rd
ugugauuucaauuc

SEQ ID NO: 693876 - RNA, 16 nt, Haemophilus influenzae Rd
ugugccauguacauua

SEQ ID NO: 693877 - RNA, 17 nt, Haemophilus influenzae Rd
ugugccauguacauuaa

SEQ ID NO: 693878 - RNA, 18 nt, Haemophilus influenzae Rd
ugugccauguacauuaau

SEQ ID NO: 693879 - RNA, 16 nt, Haemophilus influenzae Rd
ugugccauuucuaaac

SEQ ID NO: 693880 - RNA, 21 nt, Haemophilus influenzae Rd
ugugcacccgccgcaccuaaa

SEQ ID NO: 693881 - RNA, 12 nt, Haemophilus influenzae Rd
ugugcaccuuca

SEQ ID NO: 693882 - RNA, 22 nt, Haemophilus influenzae Rd
ugugcaccuucaacauuuuuug

SEQ ID NO: 693883 - RNA, 20 nt, Haemophilus influenzae Rd
ugugcaagaaauugauauaa

SEQ ID NO: 693884 - RNA, 22 nt, Haemophilus influenzae Rd
ugucuugaguaccgcuaauaau

SEQ ID NO: 693885 - RNA, 21 nt, Haemophilus influenzae Rd
ugucuucgugcugaagaguua

SEQ ID NO: 693886 - RNA, 19 nt, Haemophilus influenzae Rd
ugugaacuuugugccauuu

SEQ ID NO: 693887 - RNA, 18 nt, Haemophilus influenzae Rd
ugugaaguuuuuuaaguu

SEQ ID NO: 693888 - RNA, 23 nt, Haemophilus influenzae Rd
ugugaaguuuuuuaaguuuccaa

SEQ ID NO: 693889 - RNA, 16 nt, Haemophilus influenzae Rd
ugucuuuucuauaauu

SEQ ID NO: 693890 - RNA, 14 nt, Haemophilus influenzae Rd
ugucuuuuucuuac

SEQ ID NO: 693891 - RNA, 18 nt, Haemophilus influenzae Rd
ugugaaaacgaugaaguu

SEQ ID NO: 693892 - RNA, 11 nt, Haemophilus influenzae Rd
ugugaaauucc

SEQ ID NO: 693893 - RNA, 20 nt, Haemophilus influenzae Rd
ugcucugcuagucguucuug

SEQ ID NO: 693894 - RNA, 18 nt, Haemophilus influenzae Rd
ugcucugguugagcaaug

SEQ ID NO: 693895 - RNA, 13 nt, Haemophilus influenzae Rd
ugcucuuuaacaa

SEQ ID NO: 693896 - RNA, 17 nt, Haemophilus influenzae Rd
ugcucuaccgacugagc

SEQ ID NO: 693897 - RNA, 19 nt, Haemophilus influenzae Rd
ugcucuaccgacugagcua

SEQ ID NO: 693898 - RNA, 13 nt, Haemophilus influenzae Rd
ugcucuaauucag

SEQ ID NO: 693899 - RNA, 20 nt, Haemophilus influenzae Rd
ugcucuaaccgacugagcua

SEQ ID NO: 693900 - RNA, 20 nt, Haemophilus influenzae Rd
ugcucgugcaggauaaaggu

SEQ ID NO: 693901 - RNA, 14 nt, Haemophilus influenzae Rd
ugcucuaaaagcug

SEQ ID NO: 693902 - RNA, 22 nt, Haemophilus influenzae Rd
ugcucgauuuuuaaaagcaccg

SEQ ID NO: 693903 - RNA, 22 nt, Haemophilus influenzae Rd
ugcucgauaaguaaugaaaauu

SEQ ID NO: 693904 - RNA, 20 nt, Haemophilus influenzae Rd
ugcucgauagcccaaggccu

SEQ ID NO: 693905 - RNA, 18 nt, Haemophilus influenzae Rd
ugcugcaauuguugcacc

SEQ ID NO: 693906 - RNA, 20 nt, Haemophilus influenzae Rd
ugcugcaauucaacaacgug

SEQ ID NO: 693907 - RNA, 14 nt, Haemophilus influenzae Rd
ugcugauuauuggg

SEQ ID NO: 693908 - RNA, 20 nt, Haemophilus influenzae Rd
ugcugcaaaagcuagaacac

SEQ ID NO: 693909 - RNA, 16 nt, Haemophilus influenzae Rd
ugcugcaccaaucaaa

SEQ ID NO: 693910 - RNA, 22 nt, Haemophilus influenzae Rd
ugcugcaagauuugcugcugcu

SEQ ID NO: 693911 - RNA, 20 nt, Haemophilus influenzae Rd
ugcugacgguucaguuucaa

SEQ ID NO: 693912 - RNA, 21 nt, Haemophilus influenzae Rd
ugcugaagaguuaagccgaua

SEQ ID NO: 693913 - RNA, 17 nt, Haemophilus influenzae Rd
ugcugagugcaagccac

SEQ ID NO: 693914 - RNA, 12 nt, Haemophilus influenzae Rd
ugcugauaaauu

SEQ ID NO: 693915 - RNA, 19 nt, Haemophilus influenzae Rd
ugcuggaucuucagcauuu

SEQ ID NO: 693916 - RNA, 15 nt, Haemophilus influenzae Rd
ugcugcuuuaauuuc

SEQ ID NO: 693917 - RNA, 21 nt, Haemophilus influenzae Rd
aaauguagagauaauaaauau

SEQ ID NO: 693918 - RNA, 14 nt, Haemophilus influenzae Rd
aaauguaaaacagu

SEQ ID NO: 693919 - RNA, 12 nt, Haemophilus influenzae Rd
ugcuguuuucaa

SEQ ID NO: 693920 - RNA, 14 nt, Haemophilus influenzae Rd
ugcuguuucuaauu

SEQ ID NO: 693921 - RNA, 16 nt, Haemophilus influenzae Rd
ugcuguugguuaaaaa

SEQ ID NO: 693922 - RNA, 19 nt, Haemophilus influenzae Rd
ugcuguugguuaaaaauag

SEQ ID NO: 693923 - RNA, 17 nt, Haemophilus influenzae Rd
ugcuguugguuuuccac

SEQ ID NO: 693924 - RNA, 13 nt, Haemophilus influenzae Rd
ugcuuaaaagcuu

SEQ ID NO: 693925 - RNA, 16 nt, Haemophilus influenzae Rd
ugcuuaacugaaaauu

SEQ ID NO: 693926 - RNA, 23 nt, Haemophilus influenzae Rd
ugcuuaacauuaauaaaccaaca

SEQ ID NO: 693927 - RNA, 21 nt, Haemophilus influenzae Rd
ugcuuaagugcgguauuuuua

SEQ ID NO: 693928 - RNA, 18 nt, Haemophilus influenzae Rd
ugcuuaaucggcacaaga

SEQ ID NO: 693929 - RNA, 17 nt, Haemophilus influenzae Rd
ugcuuaaauugacuugc

SEQ ID NO: 693930 - RNA, 22 nt, Haemophilus influenzae Rd
ugcuguauauuuuuaauuuggu

SEQ ID NO: 693931 - RNA, 15 nt, Haemophilus influenzae Rd
ugcuguagcauagau

SEQ ID NO: 693932 - RNA, 23 nt, Haemophilus influenzae Rd
ugcuguaacguuaaaugaacguu

SEQ ID NO: 693933 - RNA, 14 nt, Haemophilus influenzae Rd
ugcuguacacacac

SEQ ID NO: 693934 - RNA, 20 nt, Haemophilus influenzae Rd
ugcuguagaaauuaauaaug

SEQ ID NO: 693935 - RNA, 21 nt, Haemophilus influenzae Rd
ugcuguagaaauuaauaaugc

SEQ ID NO: 693936 - RNA, 15 nt, Haemophilus influenzae Rd
aaaugucgaaauuuu

SEQ ID NO: 693937 - RNA, 18 nt, Haemophilus influenzae Rd
aaaugucguaagaacgac

SEQ ID NO: 693938 - RNA, 21 nt, Haemophilus influenzae Rd
ugcuggguaagaagugaaauu

SEQ ID NO: 693939 - RNA, 15 nt, Haemophilus influenzae Rd
ugcuuauaaaacaga

SEQ ID NO: 693940 - RNA, 12 nt, Haemophilus influenzae Rd
ugcuuauuuugu

SEQ ID NO: 693941 - RNA, 17 nt, Haemophilus influenzae Rd
ugcuucaagaucuuuca

SEQ ID NO: 693942 - RNA, 20 nt, Haemophilus influenzae Rd
ugcuucuaauuuuaaaacau

SEQ ID NO: 693943 - RNA, 16 nt, Haemophilus influenzae Rd
ugcuucuguugcuuca

SEQ ID NO: 693944 - RNA, 18 nt, Haemophilus influenzae Rd
ugcuucuguugcuucaau

SEQ ID NO: 693945 - RNA, 23 nt, Haemophilus influenzae Rd
ugcuugagcugucuaauuuuuua

SEQ ID NO: 693946 - RNA, 11 nt, Haemophilus influenzae Rd
ugcuucuuuua

SEQ ID NO: 693947 - RNA, 12 nt, Haemophilus influenzae Rd
ugcuuuaaauug

SEQ ID NO: 693948 - RNA, 17 nt, Haemophilus influenzae Rd
ugcuuuaacaauuacug

SEQ ID NO: 693949 - RNA, 21 nt, Haemophilus influenzae Rd
ugcuuuaacccauuuauuuaa

SEQ ID NO: 693950 - RNA, 13 nt, Haemophilus influenzae Rd
ugcuuguuuuaaa

SEQ ID NO: 693951 - RNA, 18 nt, Haemophilus influenzae Rd
ugcuuuauuuaaauuaaa

SEQ ID NO: 693952 - RNA, 18 nt, Haemophilus influenzae Rd
ugcuuucauagaugauuc

SEQ ID NO: 693953 - RNA, 22 nt, Haemophilus influenzae Rd
ugcuuuaauucgugcaaauuuu

SEQ ID NO: 693954 - RNA, 19 nt, Haemophilus influenzae Rd
ugcuuuaauuucauucaac

SEQ ID NO: 693955 - RNA, 23 nt, Haemophilus influenzae Rd
ugcuugaguuugaucguauugca

SEQ ID NO: 693956 - RNA, 16 nt, Haemophilus influenzae Rd
ugcuugcguaguuaag

SEQ ID NO: 693957 - RNA, 13 nt, Haemophilus influenzae Rd
ugcuugguuuuau

SEQ ID NO: 693958 - RNA, 22 nt, Haemophilus influenzae Rd
ugcuugguuuuauauucauuua

SEQ ID NO: 693959 - RNA, 13 nt, Haemophilus influenzae Rd
ugcuuguaaaaac

SEQ ID NO: 693960 - RNA, 15 nt, Haemophilus influenzae Rd
ugcuugguaauaauc

SEQ ID NO: 693961 - RNA, 16 nt, Haemophilus influenzae Rd
ugcuugguaauaauca

SEQ ID NO: 693962 - RNA, 17 nt, Haemophilus influenzae Rd
ugcuuggucaaguuaua

SEQ ID NO: 693963 - RNA, 13 nt, Haemophilus influenzae Rd
ugcuuuuugcuau

SEQ ID NO: 693964 - RNA, 17 nt, Haemophilus influenzae Rd
ugcuuuuuuaaucaauu

SEQ ID NO: 693965 - RNA, 13 nt, Haemophilus influenzae Rd
ugcuuuuuuaauu

SEQ ID NO: 693966 - RNA, 19 nt, Haemophilus influenzae Rd
ugcuuuugccgaaaauggu

SEQ ID NO: 693967 - RNA, 20 nt, Haemophilus influenzae Rd
ugcuuugcugccacuucagc

SEQ ID NO: 693968 - RNA, 23 nt, Haemophilus influenzae Rd
ugcuuuuaaguugugauuugcaa

SEQ ID NO: 693969 - RNA, 12 nt, Haemophilus influenzae Rd
ugcuuucuucca

SEQ ID NO: 693970 - RNA, 13 nt, Haemophilus influenzae Rd
ugcuuucuuccaa

SEQ ID NO: 693971 - RNA, 13 nt, Haemophilus influenzae Rd
uggaagaaaagca

SEQ ID NO: 693972 - RNA, 17 nt, Haemophilus influenzae Rd
uggaagaaaagcauuaa

SEQ ID NO: 693973 - RNA, 21 nt, Haemophilus influenzae Rd
uggaacuggaccuaaucccau

SEQ ID NO: 693974 - RNA, 17 nt, Haemophilus influenzae Rd
uggaagaucaguuacca

SEQ ID NO: 693975 - RNA, 14 nt, Haemophilus influenzae Rd
uggaacaguugaaa

SEQ ID NO: 693976 - RNA, 21 nt, Haemophilus influenzae Rd
uggaaauuugagauuuuauuu

SEQ ID NO: 693977 - RNA, 18 nt, Haemophilus influenzae Rd
uggaaauuuaagugagua

SEQ ID NO: 693978 - RNA, 20 nt, Haemophilus influenzae Rd
uggaacgauuaaaaaugcuu

SEQ ID NO: 693979 - RNA, 21 nt, Haemophilus influenzae Rd
uggaaaguaacgcgcggacgu

SEQ ID NO: 693980 - RNA, 22 nt, Haemophilus influenzae Rd
uggaaacgguuaauaaauucuu

SEQ ID NO: 693981 - RNA, 15 nt, Haemophilus influenzae Rd
uggaaacgugcaauu

SEQ ID NO: 693982 - RNA, 13 nt, Haemophilus influenzae Rd
uggaaaugcuuaa

SEQ ID NO: 693983 - RNA, 12 nt, Haemophilus influenzae Rd
uggaaauguuua

SEQ ID NO: 693984 - RNA, 19 nt, Haemophilus influenzae Rd
uggaaagaguaagcaagua

SEQ ID NO: 693985 - RNA, 18 nt, Haemophilus influenzae Rd
uggaaauaauauucaaaa

SEQ ID NO: 693986 - RNA, 19 nt, Haemophilus influenzae Rd
uggaaauaauauucaaaac

SEQ ID NO: 693987 - RNA, 20 nt, Haemophilus influenzae Rd
uggaaaccauugaugaaaug

SEQ ID NO: 693988 - RNA, 21 nt, Haemophilus influenzae Rd
uggaaaagccuuaaccugcaa

SEQ ID NO: 693989 - RNA, 13 nt, Haemophilus influenzae Rd
uggaaaaguaaga

SEQ ID NO: 693990 - RNA, 14 nt, Haemophilus influenzae Rd
uggaaaaguaagaa

SEQ ID NO: 693991 - RNA, 16 nt, Haemophilus influenzae Rd
uggaaaaguaagaaac

SEQ ID NO: 693992 - RNA, 14 nt, Haemophilus influenzae Rd
ugcuuuuuucaaug

SEQ ID NO: 693993 - RNA, 12 nt, Haemophilus influenzae Rd
ugcuuuuucauc

SEQ ID NO: 693994 - RNA, 18 nt, Haemophilus influenzae Rd
uggacagaauaacuagca

SEQ ID NO: 693995 - RNA, 19 nt, Haemophilus influenzae Rd
uggacauuguuguuuaaua

SEQ ID NO: 693996 - RNA, 13 nt, Haemophilus influenzae Rd
uggaauauucuuu

SEQ ID NO: 693997 - RNA, 22 nt, Haemophilus influenzae Rd
uggaauaaagcaaccaaugcaa

SEQ ID NO: 693998 - RNA, 17 nt, Haemophilus influenzae Rd
uggaauaaauuaauuac

SEQ ID NO: 693999 - RNA, 15 nt, Haemophilus influenzae Rd
uggaauaccagagga

SEQ ID NO: 694000 - RNA, 14 nt, Haemophilus influenzae Rd
uggaaguuuuuccg

SEQ ID NO: 694001 - RNA, 16 nt, Haemophilus influenzae Rd
uggaauaaaagucagu

SEQ ID NO: 694002 - RNA, 23 nt, Haemophilus influenzae Rd
uggaauaaaagucaguaaaccaa

SEQ ID NO: 694003 - RNA, 22 nt, Haemophilus influenzae Rd
uggaaugguugcaaaggcagga

SEQ ID NO: 694004 - RNA, 12 nt, Haemophilus influenzae Rd
uggaauguaaaa

SEQ ID NO: 694005 - RNA, 18 nt, Haemophilus influenzae Rd
uggaauugugcuaaauuu

SEQ ID NO: 694006 - RNA, 11 nt, Haemophilus influenzae Rd
uggaauuugua

SEQ ID NO: 694007 - RNA, 21 nt, Haemophilus influenzae Rd
uggaauuuguaagauuuugcc

SEQ ID NO: 694008 - RNA, 13 nt, Haemophilus influenzae Rd
ugcgcuuuuaauu

SEQ ID NO: 694009 - RNA, 17 nt, Haemophilus influenzae Rd
ugcgugaauaucuguca

SEQ ID NO: 694010 - RNA, 17 nt, Haemophilus influenzae Rd
ugcgugaauuugauaau

SEQ ID NO: 694011 - RNA, 12 nt, Haemophilus influenzae Rd
ugcgucuuaaau

SEQ ID NO: 694012 - RNA, 16 nt, Haemophilus influenzae Rd
ugcguuucaaaugcuu

SEQ ID NO: 694013 - RNA, 22 nt, Haemophilus influenzae Rd
ugcguuugguucaucauuugcu

SEQ ID NO: 694014 - RNA, 16 nt, Haemophilus influenzae Rd
ugcguguguuuguaaa

SEQ ID NO: 694015 - RNA, 19 nt, Haemophilus influenzae Rd
ugcggugagauuucuugcu

SEQ ID NO: 694016 - RNA, 14 nt, Haemophilus influenzae Rd
ugcggugauuuuac

SEQ ID NO: 694017 - RNA, 12 nt, Haemophilus influenzae Rd
ugcggugcaauu

SEQ ID NO: 694018 - RNA, 21 nt, Haemophilus influenzae Rd
ugcggugcaauuugaaaagaa

SEQ ID NO: 694019 - RNA, 18 nt, Haemophilus influenzae Rd
ugcgggaauagcucaguu

SEQ ID NO: 694020 - RNA, 19 nt, Haemophilus influenzae Rd
ugcgggaauagcucaguug

SEQ ID NO: 694021 - RNA, 15 nt, Haemophilus influenzae Rd
ugcggucauuuuuca

SEQ ID NO: 694022 - RNA, 19 nt, Haemophilus influenzae Rd
ugcgguuaaaaaagaaaua

SEQ ID NO: 694023 - RNA, 13 nt, Haemophilus influenzae Rd
ugcgguuaaauuu

SEQ ID NO: 694024 - RNA, 13 nt, Haemophilus influenzae Rd
ugcgguuaauuuu

SEQ ID NO: 694025 - RNA, 15 nt, Haemophilus influenzae Rd
ugcgguuaauuuuua

SEQ ID NO: 694026 - RNA, 16 nt, Haemophilus influenzae Rd
ugcgguuauuuuauua

SEQ ID NO: 694027 - RNA, 19 nt, Haemophilus influenzae Rd
ugcgguugaaauuuaauaa

SEQ ID NO: 694028 - RNA, 13 nt, Haemophilus influenzae Rd
ugcuauucucucg

SEQ ID NO: 694029 - RNA, 12 nt, Haemophilus influenzae Rd
ugcuaugcccaa

SEQ ID NO: 694030 - RNA, 14 nt, Haemophilus influenzae Rd
ugcucaaaaucaag

SEQ ID NO: 694031 - RNA, 22 nt, Haemophilus influenzae Rd
ugcucaaaaucaaguuaaaaaa

SEQ ID NO: 694032 - RNA, 19 nt, Haemophilus influenzae Rd
ugcuauuuucuaauuuuca

SEQ ID NO: 694033 - RNA, 15 nt, Haemophilus influenzae Rd
ugcuagccaauaauc

SEQ ID NO: 694034 - RNA, 23 nt, Haemophilus influenzae Rd
ugcuauaaauccaacuaaaccac

SEQ ID NO: 694035 - RNA, 17 nt, Haemophilus influenzae Rd
ugcuaucaggcuuaacu

SEQ ID NO: 694036 - RNA, 19 nt, Haemophilus influenzae Rd
ugcuauccuuuguugucgu

SEQ ID NO: 694037 - RNA, 22 nt, Haemophilus influenzae Rd
ugcuauccuuuguugucguuau

SEQ ID NO: 694038 - RNA, 21 nt, Haemophilus influenzae Rd
ugcuaucuuaccuuuuucuac

SEQ ID NO: 694039 - RNA, 18 nt, Haemophilus influenzae Rd
ugcuauccaguaaagaau

SEQ ID NO: 694040 - RNA, 14 nt, Haemophilus influenzae Rd
ugcuaaauuaaauu

SEQ ID NO: 694041 - RNA, 12 nt, Haemophilus influenzae Rd
ugcuaaaccaau

SEQ ID NO: 694042 - RNA, 14 nt, Haemophilus influenzae Rd
ugcuaaacccacuu

SEQ ID NO: 694043 - RNA, 17 nt, Haemophilus influenzae Rd
ugcuaaaccugcaaguu

SEQ ID NO: 694044 - RNA, 22 nt, Haemophilus influenzae Rd
ugcuaaaggguuuacuuuaauu

SEQ ID NO: 694045 - RNA, 15 nt, Haemophilus influenzae Rd
ugcuaaauaaauucc

SEQ ID NO: 694046 - RNA, 22 nt, Haemophilus influenzae Rd
ugcguuuucgcaauaucaucau

SEQ ID NO: 694047 - RNA, 13 nt, Haemophilus influenzae Rd
ugcguuuuuuaau

SEQ ID NO: 694048 - RNA, 19 nt, Haemophilus influenzae Rd
ugcuaaaccagcaagauaa

SEQ ID NO: 694049 - RNA, 10 nt, Haemophilus influenzae Rd
ugcuaaaauu

SEQ ID NO: 694050 - RNA, 23 nt, Haemophilus influenzae Rd
ugcuaaaauuaaaggcauagcua

SEQ ID NO: 694051 - RNA, 18 nt, Haemophilus influenzae Rd
ugcuacagcuuguuucau

SEQ ID NO: 694052 - RNA, 14 nt, Haemophilus influenzae Rd
ugcuacacgaacac

SEQ ID NO: 694053 - RNA, 15 nt, Haemophilus influenzae Rd
ugcuaauaaucuauu

SEQ ID NO: 694054 - RNA, 20 nt, Haemophilus influenzae Rd
ugcuaaucguuuaauuucau

SEQ ID NO: 694055 - RNA, 19 nt, Haemophilus influenzae Rd
ugcuaauucugcuaaaucu

SEQ ID NO: 694056 - RNA, 21 nt, Haemophilus influenzae Rd
ugcuaauuuauccaauacugu

SEQ ID NO: 694057 - RNA, 19 nt, Haemophilus influenzae Rd
ugcuacaagugaaccaaua

SEQ ID NO: 694058 - RNA, 16 nt, Haemophilus influenzae Rd
ugcuaauagaacuguu

SEQ ID NO: 694059 - RNA, 17 nt, Haemophilus influenzae Rd
ugcucaugauuauaaac

SEQ ID NO: 694060 - RNA, 22 nt, Haemophilus influenzae Rd
ugcuccgcagucgcuuuuuuau

SEQ ID NO: 694061 - RNA, 17 nt, Haemophilus influenzae Rd
ugcuccuacuuuuacaa

SEQ ID NO: 694062 - RNA, 20 nt, Haemophilus influenzae Rd
ugcucagcgguuggcuucca

SEQ ID NO: 694063 - RNA, 23 nt, Haemophilus influenzae Rd
ugcucaauagcggcaugaauauc

SEQ ID NO: 694064 - RNA, 19 nt, Haemophilus influenzae Rd
ugcucaauccaaguauuuu

SEQ ID NO: 694065 - RNA, 17 nt, Haemophilus influenzae Rd
ugcucagccaguuuucu

SEQ ID NO: 694066 - RNA, 22 nt, Haemophilus influenzae Rd
ugcucacguaaccguucuaguu

SEQ ID NO: 694067 - RNA, 19 nt, Haemophilus influenzae Rd
ugcucacgggcagaaugaa

SEQ ID NO: 694068 - RNA, 14 nt, Haemophilus influenzae Rd
ugcucacuucgcuu

SEQ ID NO: 694069 - RNA, 22 nt, Haemophilus influenzae Rd
ugcucacgccgugauaacaacu

SEQ ID NO: 694070 - RNA, 16 nt, Haemophilus influenzae Rd
ugccuuuuaauaaacc

SEQ ID NO: 694071 - RNA, 12 nt, Haemophilus influenzae Rd
ugccuuuuauga

SEQ ID NO: 694072 - RNA, 17 nt, Haemophilus influenzae Rd
ugccuuuccugcaucau

SEQ ID NO: 694073 - RNA, 13 nt, Haemophilus influenzae Rd
ugccuugaugcuc

SEQ ID NO: 694074 - RNA, 21 nt, Haemophilus influenzae Rd
ugccuuuauggugugcaauaa

SEQ ID NO: 694075 - RNA, 21 nt, Haemophilus influenzae Rd
ugccuuuuucuucuuucauuu

SEQ ID NO: 694076 - RNA, 22 nt, Haemophilus influenzae Rd
ugcgaagcccgaauucugagca

SEQ ID NO: 694077 - RNA, 16 nt, Haemophilus influenzae Rd
ugcgacaccaccagcu

SEQ ID NO: 694078 - RNA, 22 nt, Haemophilus influenzae Rd
ugcgaauugcaucguuuacauc

SEQ ID NO: 694079 - RNA, 23 nt, Haemophilus influenzae Rd
ugcgaggcucggucgauggcugg

SEQ ID NO: 694080 - RNA, 15 nt, Haemophilus influenzae Rd
ugcgauccaaaauuc

SEQ ID NO: 694081 - RNA, 16 nt, Haemophilus influenzae Rd
ugcgauauuuuuucag

SEQ ID NO: 694082 - RNA, 13 nt, Haemophilus influenzae Rd
ugcgauaauauca

SEQ ID NO: 694083 - RNA, 20 nt, Haemophilus influenzae Rd
ugcgauaauuugcaucauuu

SEQ ID NO: 694084 - RNA, 18 nt, Haemophilus influenzae Rd
ugcgaugccgaaugaaga

SEQ ID NO: 694085 - RNA, 17 nt, Haemophilus influenzae Rd
ugcgaucuuuuguuacu

SEQ ID NO: 694086 - RNA, 19 nt, Haemophilus influenzae Rd
ugcgaugacaaaaaauauc

SEQ ID NO: 694087 - RNA, 12 nt, Haemophilus influenzae Rd
ugcgaugauaaa

SEQ ID NO: 694088 - RNA, 19 nt, Haemophilus influenzae Rd
ugcgaugauaaaguccaua

SEQ ID NO: 694089 - RNA, 17 nt, Haemophilus influenzae Rd
ugcgccacccacuaaug

SEQ ID NO: 694090 - RNA, 16 nt, Haemophilus influenzae Rd
ugcgccaguuucuugg

SEQ ID NO: 694091 - RNA, 16 nt, Haemophilus influenzae Rd
ugccaccgcgaucugu

SEQ ID NO: 694092 - RNA, 17 nt, Haemophilus influenzae Rd
ugccacgaauaagcacu

SEQ ID NO: 694093 - RNA, 17 nt, Haemophilus influenzae Rd
ugccacgaggucaaucu

SEQ ID NO: 694094 - RNA, 17 nt, Haemophilus influenzae Rd
ugccuuauauuucacug

SEQ ID NO: 694095 - RNA, 19 nt, Haemophilus influenzae Rd
ugccugccaccauggcacc

SEQ ID NO: 694096 - RNA, 16 nt, Haemophilus influenzae Rd
ugccucuuuccuuauu

SEQ ID NO: 694097 - RNA, 17 nt, Haemophilus influenzae Rd
ugccucuguauuuuuca

SEQ ID NO: 694098 - RNA, 19 nt, Haemophilus influenzae Rd
ugccucuguauuuuucaua

SEQ ID NO: 694099 - RNA, 21 nt, Haemophilus influenzae Rd
ugcaaaguaacuuuaauuaua

SEQ ID NO: 694100 - RNA, 15 nt, Haemophilus influenzae Rd
ugcaaaguauuuuuc

SEQ ID NO: 694101 - RNA, 23 nt, Haemophilus influenzae Rd
ugcaaaguauuuuucuaaaucgu

SEQ ID NO: 694102 - RNA, 21 nt, Haemophilus influenzae Rd
ugcaaagugcgguaagaaaau

SEQ ID NO: 694103 - RNA, 20 nt, Haemophilus influenzae Rd
ugcaaaguuaccauuuauuc

SEQ ID NO: 694104 - RNA, 16 nt, Haemophilus influenzae Rd
ugcaaaguuauaaagc

SEQ ID NO: 694105 - RNA, 19 nt, Haemophilus influenzae Rd
ugcaaauaaucucuucuaa

SEQ ID NO: 694106 - RNA, 13 nt, Haemophilus influenzae Rd
ugcaaauaaauuu

SEQ ID NO: 694107 - RNA, 12 nt, Haemophilus influenzae Rd
ugcaaaaauauc

SEQ ID NO: 694108 - RNA, 15 nt, Haemophilus influenzae Rd
ugcaaaaguaaauaa

SEQ ID NO: 694109 - RNA, 18 nt, Haemophilus influenzae Rd
ugcaaacgcaagcugugc

SEQ ID NO: 694110 - RNA, 11 nt, Haemophilus influenzae Rd
ugcaaaccaaa

SEQ ID NO: 694111 - RNA, 23 nt, Haemophilus influenzae Rd
ugcaaaccaaaucacaauaagca

SEQ ID NO: 694112 - RNA, 11 nt, Haemophilus influenzae Rd
ugcaaaccaac

SEQ ID NO: 694113 - RNA, 22 nt, Haemophilus influenzae Rd
ugcaaaccaacacccacaucaa

SEQ ID NO: 694114 - RNA, 19 nt, Haemophilus influenzae Rd
ugauuuugagauagagcuu

SEQ ID NO: 694115 - RNA, 14 nt, Haemophilus influenzae Rd
ugauuuugcauuaa

SEQ ID NO: 694116 - RNA, 16 nt, Haemophilus influenzae Rd
ugauuuugucuaaggu

SEQ ID NO: 694117 - RNA, 20 nt, Haemophilus influenzae Rd
ugauuuuuacaaguuaaagc

SEQ ID NO: 694118 - RNA, 19 nt, Haemophilus influenzae Rd
ugauuuucagcaaaaugcg

SEQ ID NO: 694119 - RNA, 12 nt, Haemophilus influenzae Rd
ugauuuucauuc

SEQ ID NO: 694120 - RNA, 22 nt, Haemophilus influenzae Rd
ugauuuuaguuucuaauucuuc

SEQ ID NO: 694121 - RNA, 13 nt, Haemophilus influenzae Rd
ugauuuucuuauu

SEQ ID NO: 694122 - RNA, 16 nt, Haemophilus influenzae Rd
ugauuuuccaaaauuu

SEQ ID NO: 694123 - RNA, 21 nt, Haemophilus influenzae Rd
ugauuuuccccgcucuuucca

SEQ ID NO: 694124 - RNA, 19 nt, Haemophilus influenzae Rd
ugauuuuccugaugaauuu

SEQ ID NO: 694125 - RNA, 14 nt, Haemophilus influenzae Rd
ugauuuuuuugccu

SEQ ID NO: 694126 - RNA, 15 nt, Haemophilus influenzae Rd
ugauuuuuuaaagua

SEQ ID NO: 694127 - RNA, 15 nt, Haemophilus influenzae Rd
ugauuccaaacugga

SEQ ID NO: 694128 - RNA, 15 nt, Haemophilus influenzae Rd
ugauucgauaaauua

SEQ ID NO: 694129 - RNA, 15 nt, Haemophilus influenzae Rd
ugaugauggccauga

SEQ ID NO: 694130 - RNA, 16 nt, Haemophilus influenzae Rd
ugaugaugguguucug

SEQ ID NO: 694131 - RNA, 16 nt, Haemophilus influenzae Rd
ugaugauuguuauugu

SEQ ID NO: 694132 - RNA, 20 nt, Haemophilus influenzae Rd
ugaugauuguuauugugaug

SEQ ID NO: 694133 - RNA, 12 nt, Haemophilus influenzae Rd
ugaugauuuuca

SEQ ID NO: 694134 - RNA, 15 nt, Haemophilus influenzae Rd
ugaugauuuucauuc

SEQ ID NO: 694135 - RNA, 11 nt, Haemophilus influenzae Rd
ugauucauuug

SEQ ID NO: 694136 - RNA, 22 nt, Haemophilus influenzae Rd
ugauuccaacaaguucuucuau

SEQ ID NO: 694137 - RNA, 19 nt, Haemophilus influenzae Rd
ugaugaguagauuuuuauu

SEQ ID NO: 694138 - RNA, 20 nt, Haemophilus influenzae Rd
ugaugaguagauuuuuauuc

SEQ ID NO: 694139 - RNA, 15 nt, Haemophilus influenzae Rd
ugaugaguucuguca

SEQ ID NO: 694140 - RNA, 17 nt, Haemophilus influenzae Rd
ugauugcaccuaauucu

SEQ ID NO: 694141 - RNA, 12 nt, Haemophilus influenzae Rd
ugauuuaaaaaa

SEQ ID NO: 694142 - RNA, 16 nt, Haemophilus influenzae Rd
ugauuuaaauugaaaa

SEQ ID NO: 694143 - RNA, 17 nt, Haemophilus influenzae Rd
ugauuuuaaaauaucaa

SEQ ID NO: 694144 - RNA, 12 nt, Haemophilus influenzae Rd
ugauuuuaaaga

SEQ ID NO: 694145 - RNA, 15 nt, Haemophilus influenzae Rd
ugauuuuaaagccau

SEQ ID NO: 694146 - RNA, 13 nt, Haemophilus influenzae Rd
ugauuuuaaauau

SEQ ID NO: 694147 - RNA, 12 nt, Haemophilus influenzae Rd
ugauuuuaaauc

SEQ ID NO: 694148 - RNA, 19 nt, Haemophilus influenzae Rd
ugauuuagaacaauauuua

SEQ ID NO: 694149 - RNA, 14 nt, Haemophilus influenzae Rd
ugauucgccaaaaa

SEQ ID NO: 694150 - RNA, 17 nt, Haemophilus influenzae Rd
ugauucgccaaaaauug

SEQ ID NO: 694151 - RNA, 17 nt, Haemophilus influenzae Rd
ugauucgccuuauaucc

SEQ ID NO: 694152 - RNA, 20 nt, Haemophilus influenzae Rd
ugauugacauuuuacuuuag

SEQ ID NO: 694153 - RNA, 15 nt, Haemophilus influenzae Rd
ugauugacgaaaaau

SEQ ID NO: 694154 - RNA, 21 nt, Haemophilus influenzae Rd
ugauugacgaaaaauuaacca

SEQ ID NO: 694155 - RNA, 21 nt, Haemophilus influenzae Rd
ugauugagaugccauuucgcu

SEQ ID NO: 694156 - RNA, 19 nt, Haemophilus influenzae Rd
ugcaaauuuucagcuugug

SEQ ID NO: 694157 - RNA, 13 nt, Haemophilus influenzae Rd
ugcaaccaaacaa

SEQ ID NO: 694158 - RNA, 14 nt, Haemophilus influenzae Rd
ugcaaccaaacaaa

SEQ ID NO: 694159 - RNA, 23 nt, Haemophilus influenzae Rd
ugcaacaaguacgauugcaauaa

SEQ ID NO: 694160 - RNA, 13 nt, Haemophilus influenzae Rd
ugcaaauuuuuca

SEQ ID NO: 694161 - RNA, 16 nt, Haemophilus influenzae Rd
ugcaaauuuuucauuc

SEQ ID NO: 694162 - RNA, 18 nt, Haemophilus influenzae Rd
ugcaaaucgagguuuucc

SEQ ID NO: 694163 - RNA, 19 nt, Haemophilus influenzae Rd
ugcaaaucgagguuuucca

SEQ ID NO: 694164 - RNA, 11 nt, Haemophilus influenzae Rd
ugcaacuuuuu

SEQ ID NO: 694165 - RNA, 16 nt, Haemophilus influenzae Rd
ugcaacuucagcagca

SEQ ID NO: 694166 - RNA, 14 nt, Haemophilus influenzae Rd
ugcaacgugugcca

SEQ ID NO: 694167 - RNA, 18 nt, Haemophilus influenzae Rd
ugcaacguuacucaucau

SEQ ID NO: 694168 - RNA, 14 nt, Haemophilus influenzae Rd
ugcaagcacauuaa

SEQ ID NO: 694169 - RNA, 18 nt, Haemophilus influenzae Rd
ugcaagcacauuaaucau

SEQ ID NO: 694170 - RNA, 13 nt, Haemophilus influenzae Rd
ugcaagccccuga

SEQ ID NO: 694171 - RNA, 11 nt, Haemophilus influenzae Rd
ugcaagaaauu

SEQ ID NO: 694172 - RNA, 17 nt, Haemophilus influenzae Rd
ugcaagaaauugauaua

SEQ ID NO: 694173 - RNA, 18 nt, Haemophilus influenzae Rd
ugcaauaaccguacauuc

SEQ ID NO: 694174 - RNA, 12 nt, Haemophilus influenzae Rd
ugcaauaaagcu

SEQ ID NO: 694175 - RNA, 19 nt, Haemophilus influenzae Rd
ugcaauaaagcuugaaaaa

SEQ ID NO: 694176 - RNA, 20 nt, Haemophilus influenzae Rd
ugcaauaaaguugagaauuu

SEQ ID NO: 694177 - RNA, 18 nt, Haemophilus influenzae Rd
ugcaauaaauucguacaa

SEQ ID NO: 694178 - RNA, 17 nt, Haemophilus influenzae Rd
ugcaauaucuauuggaa

SEQ ID NO: 694179 - RNA, 14 nt, Haemophilus influenzae Rd
ugcaauaucaaucc

SEQ ID NO: 694180 - RNA, 17 nt, Haemophilus influenzae Rd
ugcaauaaucacaguac

SEQ ID NO: 694181 - RNA, 24 nt, Haemophilus influenzae Rd
ugcaaugcagaacgagugacuuua

SEQ ID NO: 694182 - RNA, 21 nt, Haemophilus influenzae Rd
ugcaauuuaacauaauuuaua

SEQ ID NO: 694183 - RNA, 19 nt, Haemophilus influenzae Rd
ugcaauuggcaauauuaag

SEQ ID NO: 694184 - RNA, 17 nt, Haemophilus influenzae Rd
ugcaauucgccugcuug

SEQ ID NO: 694185 - RNA, 19 nt, Haemophilus influenzae Rd
ugcaauucccuuuacauuu

SEQ ID NO: 694186 - RNA, 12 nt, Haemophilus influenzae Rd
ugcaauuaucaa

SEQ ID NO: 694187 - RNA, 22 nt, Haemophilus influenzae Rd
ugcagccaucgcugaaauuaau

SEQ ID NO: 694188 - RNA, 15 nt, Haemophilus influenzae Rd
ugcagccauaauauu

SEQ ID NO: 694189 - RNA, 20 nt, Haemophilus influenzae Rd
ugcagccauaauauuuaaaa

SEQ ID NO: 694190 - RNA, 20 nt, Haemophilus influenzae Rd
ugcacugcaaugauaagaug

SEQ ID NO: 694191 - RNA, 22 nt, Haemophilus influenzae Rd
ugcacuccaaaaguuggauuaa

SEQ ID NO: 694192 - RNA, 17 nt, Haemophilus influenzae Rd
ugcacucgcucuaacaa

SEQ ID NO: 694193 - RNA, 15 nt, Haemophilus influenzae Rd
ugcagauugcugaca

SEQ ID NO: 694194 - RNA, 20 nt, Haemophilus influenzae Rd
ugcagauuuuuuauuaauaa

SEQ ID NO: 694195 - RNA, 11 nt, Haemophilus influenzae Rd
ugcagauuuuu

SEQ ID NO: 694196 - RNA, 24 nt, Haemophilus influenzae Rd
ugcagauuuuuauaucuaaauaau

SEQ ID NO: 694197 - RNA, 15 nt, Haemophilus influenzae Rd
ugcagauuaaauauu

SEQ ID NO: 694198 - RNA, 16 nt, Haemophilus influenzae Rd
ugcagauuaaauauuu

SEQ ID NO: 694199 - RNA, 14 nt, Haemophilus influenzae Rd
ugcagauuaauuau

SEQ ID NO: 694200 - RNA, 15 nt, Haemophilus influenzae Rd
ugcagauuaauuaua

SEQ ID NO: 694201 - RNA, 20 nt, Haemophilus influenzae Rd
ugcagaucgcuauuuaauaa

SEQ ID NO: 694202 - RNA, 22 nt, Haemophilus influenzae Rd
ugcacuuggguaaauauaaaug

SEQ ID NO: 694203 - RNA, 19 nt, Haemophilus influenzae Rd
ugcaccagugguugcgauu

SEQ ID NO: 694204 - RNA, 16 nt, Haemophilus influenzae Rd
ugcaccaauaauugau

SEQ ID NO: 694205 - RNA, 17 nt, Haemophilus influenzae Rd
ugcaccugcaucaauuu

SEQ ID NO: 694206 - RNA, 21 nt, Haemophilus influenzae Rd
ugcaccuuaaaggcugaauaa

SEQ ID NO: 694207 - RNA, 15 nt, Haemophilus influenzae Rd
ugcaccguuugacgu

SEQ ID NO: 694208 - RNA, 14 nt, Haemophilus influenzae Rd
ugcacguucuaaug

SEQ ID NO: 694209 - RNA, 22 nt, Haemophilus influenzae Rd
ugcacguucuaauguuaauuuu

SEQ ID NO: 694210 - RNA, 20 nt, Haemophilus influenzae Rd
ugcaccuucaccacuuggug

SEQ ID NO: 694211 - RNA, 15 nt, Haemophilus influenzae Rd
ugcacagaaaggaca

SEQ ID NO: 694212 - RNA, 13 nt, Haemophilus influenzae Rd
ugcacaaucaaac

SEQ ID NO: 694213 - RNA, 17 nt, Haemophilus influenzae Rd
ugcacaauuacuucuua

SEQ ID NO: 694214 - RNA, 23 nt, Haemophilus influenzae Rd
ugcacaauuacuucuuacaacaa

SEQ ID NO: 694215 - RNA, 17 nt, Haemophilus influenzae Rd
ugcaccaaaaauccuca

SEQ ID NO: 694216 - RNA, 18 nt, Haemophilus influenzae Rd
ugcaccaaaaauccucau

SEQ ID NO: 694217 - RNA, 15 nt, Haemophilus influenzae Rd
ugcacauaacaaaau

SEQ ID NO: 694218 - RNA, 23 nt, Haemophilus influenzae Rd
ugcaucagaaaguucuaauucau

SEQ ID NO: 694219 - RNA, 18 nt, Haemophilus influenzae Rd
ugcaucagauuuuucgca

SEQ ID NO: 694220 - RNA, 17 nt, Haemophilus influenzae Rd
ugcaucagccaccuuaa

SEQ ID NO: 694221 - RNA, 17 nt, Haemophilus influenzae Rd
ugcaucaggauuuuucg

SEQ ID NO: 694222 - RNA, 12 nt, Haemophilus influenzae Rd
ugcauagccaag

SEQ ID NO: 694223 - RNA, 19 nt, Haemophilus influenzae Rd
ugcaucaaccgauaaaucu

SEQ ID NO: 694224 - RNA, 20 nt, Haemophilus influenzae Rd
ugcaucaaccgauaaaucua

SEQ ID NO: 694225 - RNA, 13 nt, Haemophilus influenzae Rd
ugcaucaauaauu

SEQ ID NO: 694226 - RNA, 15 nt, Haemophilus influenzae Rd
ugcaucaaucauuaa

SEQ ID NO: 694227 - RNA, 21 nt, Haemophilus influenzae Rd
ugcauagaaugcaacaaguac

SEQ ID NO: 694228 - RNA, 14 nt, Haemophilus influenzae Rd
ugcauagccucuaa

SEQ ID NO: 694229 - RNA, 17 nt, Haemophilus influenzae Rd
ugcauaaagcucagcca

SEQ ID NO: 694230 - RNA, 18 nt, Haemophilus influenzae Rd
ugcauaauggcuuaauaa

SEQ ID NO: 694231 - RNA, 19 nt, Haemophilus influenzae Rd
ugcaguuucugguuccauu

SEQ ID NO: 694232 - RNA, 20 nt, Haemophilus influenzae Rd
ugcaguaacgcgauaaaucg

SEQ ID NO: 694233 - RNA, 14 nt, Haemophilus influenzae Rd
ugcaguaacuucug

SEQ ID NO: 694234 - RNA, 20 nt, Haemophilus influenzae Rd
ugcagguuuugcaaauacag

SEQ ID NO: 694235 - RNA, 19 nt, Haemophilus influenzae Rd
ugccacaaagcaaauggca

SEQ ID NO: 694236 - RNA, 16 nt, Haemophilus influenzae Rd
ugccaccauggcaccg

SEQ ID NO: 694237 - RNA, 14 nt, Haemophilus influenzae Rd
ugccaaugcaguaa

SEQ ID NO: 694238 - RNA, 13 nt, Haemophilus influenzae Rd
ugcauuucuaaau

SEQ ID NO: 694239 - RNA, 23 nt, Haemophilus influenzae Rd
ugcauuucuaaauaaaauugcuu

SEQ ID NO: 694240 - RNA, 20 nt, Haemophilus influenzae Rd
ugcauuuacauaaacggcug

SEQ ID NO: 694241 - RNA, 15 nt, Haemophilus influenzae Rd
ugccaaucaagauaa

SEQ ID NO: 694242 - RNA, 17 nt, Haemophilus influenzae Rd
ugccaauccauaaaaua

SEQ ID NO: 694243 - RNA, 18 nt, Haemophilus influenzae Rd
ugcauuucaauuucacug

SEQ ID NO: 694244 - RNA, 16 nt, Haemophilus influenzae Rd
ugcauuugauuucaga

SEQ ID NO: 694245 - RNA, 13 nt, Haemophilus influenzae Rd
ugcaucuaaaaau

SEQ ID NO: 694246 - RNA, 22 nt, Haemophilus influenzae Rd
ugcaucuaaaaauaauuuuacu

SEQ ID NO: 694247 - RNA, 21 nt, Haemophilus influenzae Rd
ugcauuggaaugguauaaaaa

SEQ ID NO: 694248 - RNA, 22 nt, Haemophilus influenzae Rd
ugcauuggaaugguauaaaaaa

SEQ ID NO: 694249 - RNA, 20 nt, Haemophilus influenzae Rd
ugaggaaguuaaaauacuuu

SEQ ID NO: 694250 - RNA, 24 nt, Haemophilus influenzae Rd
ugaggaauaaauugaauaucuaaa

SEQ ID NO: 694251 - RNA, 18 nt, Haemophilus influenzae Rd
ugagcguuuaacugcuuu

SEQ ID NO: 694252 - RNA, 21 nt, Haemophilus influenzae Rd
ugagcaauauaaucuuuuaca

SEQ ID NO: 694253 - RNA, 13 nt, Haemophilus influenzae Rd
ugagcaagaacuu

SEQ ID NO: 694254 - RNA, 15 nt, Haemophilus influenzae Rd
ugagcaaaucaaaac

SEQ ID NO: 694255 - RNA, 15 nt, Haemophilus influenzae Rd
ugagauuuaauuuau

SEQ ID NO: 694256 - RNA, 22 nt, Haemophilus influenzae Rd
ugagauuuuauuucgcuauugu

SEQ ID NO: 694257 - RNA, 17 nt, Haemophilus influenzae Rd
ugagauaugaaauaaag

SEQ ID NO: 694258 - RNA, 13 nt, Haemophilus influenzae Rd
ugagauaaauaaa

SEQ ID NO: 694259 - RNA, 19 nt, Haemophilus influenzae Rd
ugagauaaauaaauucauu

SEQ ID NO: 694260 - RNA, 13 nt, Haemophilus influenzae Rd
ugagugucuugag

SEQ ID NO: 694261 - RNA, 19 nt, Haemophilus influenzae Rd
ugauaaacgccuuuuaaac

SEQ ID NO: 694262 - RNA, 22 nt, Haemophilus influenzae Rd
ugauaagaacggcgauuuugcg

SEQ ID NO: 694263 - RNA, 16 nt, Haemophilus influenzae Rd
ugauaaacauaaccug

SEQ ID NO: 694264 - RNA, 14 nt, Haemophilus influenzae Rd
ugauaaaaaagaaa

SEQ ID NO: 694265 - RNA, 13 nt, Haemophilus influenzae Rd
ugauaaaaauaaa

SEQ ID NO: 694266 - RNA, 20 nt, Haemophilus influenzae Rd
ugaggcguuuuucuuaaauu

SEQ ID NO: 694267 - RNA, 18 nt, Haemophilus influenzae Rd
ugagguauuguccuucau

SEQ ID NO: 694268 - RNA, 15 nt, Haemophilus influenzae Rd
ugagucuugcuuuuu

SEQ ID NO: 694269 - RNA, 21 nt, Haemophilus influenzae Rd
ugagucuugcuuuuuaauuga

SEQ ID NO: 694270 - RNA, 20 nt, Haemophilus influenzae Rd
ugauaagauguuucacuaaa

SEQ ID NO: 694271 - RNA, 19 nt, Haemophilus influenzae Rd
ugauaagcccgaacagaaa

SEQ ID NO: 694272 - RNA, 17 nt, Haemophilus influenzae Rd
ugauaaguucauaaaag

SEQ ID NO: 694273 - RNA, 14 nt, Haemophilus influenzae Rd
ugauacgaauguuu

SEQ ID NO: 694274 - RNA, 14 nt, Haemophilus influenzae Rd
ugauacuaacucaa

SEQ ID NO: 694275 - RNA, 17 nt, Haemophilus influenzae Rd
ugauacuaacucaaaau

SEQ ID NO: 694276 - RNA, 15 nt, Haemophilus influenzae Rd
ugauagacaauauaa

SEQ ID NO: 694277 - RNA, 14 nt, Haemophilus influenzae Rd
ugauagaugaauua

SEQ ID NO: 694278 - RNA, 13 nt, Haemophilus influenzae Rd
ugauagaaccaau

SEQ ID NO: 694279 - RNA, 14 nt, Haemophilus influenzae Rd
ugauagaaccaaua

SEQ ID NO: 694280 - RNA, 22 nt, Haemophilus influenzae Rd
ugauagguauaaauggcaucug

SEQ ID NO: 694281 - RNA, 21 nt, Haemophilus influenzae Rd
ugauauaaguucuaaauaaac

SEQ ID NO: 694282 - RNA, 18 nt, Haemophilus influenzae Rd
ugauauaguggcuuuaaa

SEQ ID NO: 694283 - RNA, 22 nt, Haemophilus influenzae Rd
ugauauaguggcuuuaaagguu

SEQ ID NO: 694284 - RNA, 13 nt, Haemophilus influenzae Rd
ugauauaaaaaug

SEQ ID NO: 694285 - RNA, 19 nt, Haemophilus influenzae Rd
ugauauaaauuguuuuucc

SEQ ID NO: 694286 - RNA, 22 nt, Haemophilus influenzae Rd
ugaucauggcucagauugaacg

SEQ ID NO: 694287 - RNA, 22 nt, Haemophilus influenzae Rd
ugauccuuuauugauccuagau

SEQ ID NO: 694288 - RNA, 13 nt, Haemophilus influenzae Rd
ugauccuagaugu

SEQ ID NO: 694289 - RNA, 15 nt, Haemophilus influenzae Rd
ugauaugccaaggcu

SEQ ID NO: 694290 - RNA, 18 nt, Haemophilus influenzae Rd
ugauaugccaaggcuccc

SEQ ID NO: 694291 - RNA, 14 nt, Haemophilus influenzae Rd
ugaugaaugcuuuu

SEQ ID NO: 694292 - RNA, 22 nt, Haemophilus influenzae Rd
ugaucuucccagaaugguaaug

SEQ ID NO: 694293 - RNA, 20 nt, Haemophilus influenzae Rd
ugaucugcaccccaaaaguu

SEQ ID NO: 694294 - RNA, 20 nt, Haemophilus influenzae Rd
ugaucugcacuccaaaaguu

SEQ ID NO: 694295 - RNA, 21 nt, Haemophilus influenzae Rd
ugaucggacuuuuuucuuaaa

SEQ ID NO: 694296 - RNA, 19 nt, Haemophilus influenzae Rd
ugaucgccaucuucuucug

SEQ ID NO: 694297 - RNA, 19 nt, Haemophilus influenzae Rd
ugaucucuuucuauuugaa

SEQ ID NO: 694298 - RNA, 20 nt, Haemophilus influenzae Rd
ugacguguaaaucuaaaaua

SEQ ID NO: 694299 - RNA, 19 nt, Haemophilus influenzae Rd
ugacguuguucaauaauau

SEQ ID NO: 694300 - RNA, 15 nt, Haemophilus influenzae Rd
ugacuaaaguaaauu

SEQ ID NO: 694301 - RNA, 12 nt, Haemophilus influenzae Rd
ugacuaaaucau

SEQ ID NO: 694302 - RNA, 15 nt, Haemophilus influenzae Rd
ugacuaaaucaugaa

SEQ ID NO: 694303 - RNA, 21 nt, Haemophilus influenzae Rd
ugacguuuauuuuuauauguu

SEQ ID NO: 694304 - RNA, 15 nt, Haemophilus influenzae Rd
ugacuaccaauauua

SEQ ID NO: 694305 - RNA, 17 nt, Haemophilus influenzae Rd
ugacuaccaauauuauc

SEQ ID NO: 694306 - RNA, 16 nt, Haemophilus influenzae Rd
ugacguacaauuucaa

SEQ ID NO: 694307 - RNA, 14 nt, Haemophilus influenzae Rd
ugacguaauuugug

SEQ ID NO: 694308 - RNA, 13 nt, Haemophilus influenzae Rd
ugacguaaaaguu

SEQ ID NO: 694309 - RNA, 20 nt, Haemophilus influenzae Rd
ugacgguucaguuucaagca

SEQ ID NO: 694310 - RNA, 20 nt, Haemophilus influenzae Rd
ugacggcuucagaaaauaaa

SEQ ID NO: 694311 - RNA, 22 nt, Haemophilus influenzae Rd
ugacuuauuaucuucuaaaaga

SEQ ID NO: 694312 - RNA, 18 nt, Haemophilus influenzae Rd
ugacuucuguaugacuau

SEQ ID NO: 694313 - RNA, 19 nt, Haemophilus influenzae Rd
ugagaaauaauauaaccug

SEQ ID NO: 694314 - RNA, 20 nt, Haemophilus influenzae Rd
ugagaaagggauuuuaauua

SEQ ID NO: 694315 - RNA, 14 nt, Haemophilus influenzae Rd
ugacgauaauauuu

SEQ ID NO: 694316 - RNA, 22 nt, Haemophilus influenzae Rd
ugacgcgcacauacuucuucug

SEQ ID NO: 694317 - RNA, 16 nt, Haemophilus influenzae Rd
ugacgccauccaaaac

SEQ ID NO: 694318 - RNA, 16 nt, Haemophilus influenzae Rd
ugacgcauugcaggga

SEQ ID NO: 694319 - RNA, 17 nt, Haemophilus influenzae Rd
ugaccccaaaaaguuag

SEQ ID NO: 694320 - RNA, 13 nt, Haemophilus influenzae Rd
ugaccacuuucaa

SEQ ID NO: 694321 - RNA, 14 nt, Haemophilus influenzae Rd
ugaccacuuucaau

SEQ ID NO: 694322 - RNA, 19 nt, Haemophilus influenzae Rd
ugaauaacuacauaaacuu

SEQ ID NO: 694323 - RNA, 12 nt, Haemophilus influenzae Rd
ugaauaaauauu

SEQ ID NO: 694324 - RNA, 12 nt, Haemophilus influenzae Rd
ugacaugacagu

SEQ ID NO: 694325 - RNA, 18 nt, Haemophilus influenzae Rd
ugacauuggauuaaucaa

SEQ ID NO: 694326 - RNA, 20 nt, Haemophilus influenzae Rd
ugacauuggauuaaucaauu

SEQ ID NO: 694327 - RNA, 16 nt, Haemophilus influenzae Rd
ugacauuguaaaguga

SEQ ID NO: 694328 - RNA, 19 nt, Haemophilus influenzae Rd
ugacauuaaagcaauugcu

SEQ ID NO: 694329 - RNA, 20 nt, Haemophilus influenzae Rd
ugacauuaaagcaauugcua

SEQ ID NO: 694330 - RNA, 16 nt, Haemophilus influenzae Rd
ugaccaacaccauucc

SEQ ID NO: 694331 - RNA, 17 nt, Haemophilus influenzae Rd
ugaccaaguaaaccaaa

SEQ ID NO: 694332 - RNA, 12 nt, Haemophilus influenzae Rd
ucucuacuaauu

SEQ ID NO: 694333 - RNA, 15 nt, Haemophilus influenzae Rd
ucucuuauuugugug

SEQ ID NO: 694334 - RNA, 22 nt, Haemophilus influenzae Rd
aaaugcgucgcagccuuguucu

SEQ ID NO: 694335 - RNA, 23 nt, Haemophilus influenzae Rd
aaaugcgucgcagccuuguucug

SEQ ID NO: 694336 - RNA, 22 nt, Haemophilus influenzae Rd
ucgcaucaaaggcuaauucuac

SEQ ID NO: 694337 - RNA, 21 nt, Haemophilus influenzae Rd
ucgcaucaauaucgcccauuc

SEQ ID NO: 694338 - RNA, 16 nt, Haemophilus influenzae Rd
ucgcaugcggaauaau

SEQ ID NO: 694339 - RNA, 20 nt, Haemophilus influenzae Rd
ucgcauuaucaaaugccacu

SEQ ID NO: 694340 - RNA, 23 nt, Haemophilus influenzae Rd
ucucgucaggcaauguauucaaa

SEQ ID NO: 694341 - RNA, 14 nt, Haemophilus influenzae Rd
ucugaauaaauuuu

SEQ ID NO: 694342 - RNA, 19 nt, Haemophilus influenzae Rd
ucugaacuuuguucauuuu

SEQ ID NO: 694343 - RNA, 15 nt, Haemophilus influenzae Rd
aaaugcuacuugaau

SEQ ID NO: 694344 - RNA, 14 nt, Haemophilus influenzae Rd
aaaugcuaaaauua

SEQ ID NO: 694345 - RNA, 23 nt, Haemophilus influenzae Rd
aaaugcucuuugggaaugccauu

SEQ ID NO: 694346 - RNA, 21 nt, Haemophilus influenzae Rd
aaaugcuguagaaauuaauaa

SEQ ID NO: 694347 - RNA, 21 nt, Haemophilus influenzae Rd
ucugaaugaucgaguaaaaau

SEQ ID NO: 694348 - RNA, 22 nt, Haemophilus influenzae Rd
ucugaaugaucgaguaaaaaua

SEQ ID NO: 694349 - RNA, 20 nt, Haemophilus influenzae Rd
ucugaauccaaugcacuugu

SEQ ID NO: 694350 - RNA, 23 nt, Haemophilus influenzae Rd
ucugauccgugaacugaguuuuc

SEQ ID NO: 694351 - RNA, 16 nt, Haemophilus influenzae Rd
ucugcggucaucucuu

SEQ ID NO: 694352 - RNA, 18 nt, Haemophilus influenzae Rd
ucugcuaaucguuuaauu

SEQ ID NO: 694353 - RNA, 22 nt, Haemophilus influenzae Rd
ucugcuaaucguuuaauuucau

SEQ ID NO: 694354 - RNA, 14 nt, Haemophilus influenzae Rd
ucugcuaauguuaa

SEQ ID NO: 694355 - RNA, 14 nt, Haemophilus influenzae Rd
ucugcuacaaguga

SEQ ID NO: 694356 - RNA, 13 nt, Haemophilus influenzae Rd
ucugcugccauaa

SEQ ID NO: 694357 - RNA, 17 nt, Haemophilus influenzae Rd
ucugcuccacaaaaacg

SEQ ID NO: 694358 - RNA, 12 nt, Haemophilus influenzae Rd
ucugcucucauu

SEQ ID NO: 694359 - RNA, 17 nt, Haemophilus influenzae Rd
ucuggacugaaggugcg

SEQ ID NO: 694360 - RNA, 15 nt, Haemophilus influenzae Rd
ucuggacaagccauu

SEQ ID NO: 694361 - RNA, 16 nt, Haemophilus influenzae Rd
ucuggacaagccauuu

SEQ ID NO: 694362 - RNA, 14 nt, Haemophilus influenzae Rd
ucugcaaauggugu

SEQ ID NO: 694363 - RNA, 15 nt, Haemophilus influenzae Rd
ucugcaaaugguguu

SEQ ID NO: 694364 - RNA, 14 nt, Haemophilus influenzae Rd
ucugcaaaacuugg

SEQ ID NO: 694365 - RNA, 21 nt, Haemophilus influenzae Rd
ucugcaaauaaagaagaaaau

SEQ ID NO: 694366 - RNA, 22 nt, Haemophilus influenzae Rd
ucugauuauucucuauuaauuu

SEQ ID NO: 694367 - RNA, 12 nt, Haemophilus influenzae Rd
ucugauuuaaaa

SEQ ID NO: 694368 - RNA, 23 nt, Haemophilus influenzae Rd
ucugccuaauaagcuaucgucaa

SEQ ID NO: 694369 - RNA, 17 nt, Haemophilus influenzae Rd
ucugcgccuaaaauauu

SEQ ID NO: 694370 - RNA, 19 nt, Haemophilus influenzae Rd
ucugcgccuaaaauauuuu

SEQ ID NO: 694371 - RNA, 20 nt, Haemophilus influenzae Rd
ucugcgcuaaauaagcugaa

SEQ ID NO: 694372 - RNA, 15 nt, Haemophilus influenzae Rd
ucuucaucaauaaca

SEQ ID NO: 694373 - RNA, 13 nt, Haemophilus influenzae Rd
ucuucaucugcau

SEQ ID NO: 694374 - RNA, 14 nt, Haemophilus influenzae Rd
ucuucaucuuuaaa

SEQ ID NO: 694375 - RNA, 17 nt, Haemophilus influenzae Rd
ucuuccgcaucggcuaa

SEQ ID NO: 694376 - RNA, 13 nt, Haemophilus influenzae Rd
ucuuccaaaaguu

SEQ ID NO: 694377 - RNA, 19 nt, Haemophilus influenzae Rd
ucuuccaaagaaucaucuu

SEQ ID NO: 694378 - RNA, 15 nt, Haemophilus influenzae Rd
ucuucagcuucuuca

SEQ ID NO: 694379 - RNA, 17 nt, Haemophilus influenzae Rd
ucuucagcuuguuuaau

SEQ ID NO: 694380 - RNA, 13 nt, Haemophilus influenzae Rd
ucuucaggugcaa

SEQ ID NO: 694381 - RNA, 17 nt, Haemophilus influenzae Rd
ucuucaggugcaacuug

SEQ ID NO: 694382 - RNA, 19 nt, Haemophilus influenzae Rd
ucuucagcacuugcaucua

SEQ ID NO: 694383 - RNA, 23 nt, Haemophilus influenzae Rd
ucuucagaacugcuuucuuccaa

SEQ ID NO: 694384 - RNA, 20 nt, Haemophilus influenzae Rd
ucuucagacuagcaucaaaa

SEQ ID NO: 694385 - RNA, 20 nt, Haemophilus influenzae Rd
ucuucaaaauaguaaaaauu

SEQ ID NO: 694386 - RNA, 14 nt, Haemophilus influenzae Rd
ucuuauuaagguaa

SEQ ID NO: 694387 - RNA, 17 nt, Haemophilus influenzae Rd
ucuuauucaaacucuaa

SEQ ID NO: 694388 - RNA, 13 nt, Haemophilus influenzae Rd
ucuuauuucaaua

SEQ ID NO: 694389 - RNA, 17 nt, Haemophilus influenzae Rd
ucuuauuucaauauugu

SEQ ID NO: 694390 - RNA, 15 nt, Haemophilus influenzae Rd
ucuuagauuucuaau

SEQ ID NO: 694391 - RNA, 16 nt, Haemophilus influenzae Rd
ucuuagauuucuaaua

SEQ ID NO: 694392 - RNA, 22 nt, Haemophilus influenzae Rd
ucuuaauauaggauuuuaaugu

SEQ ID NO: 694393 - RNA, 17 nt, Haemophilus influenzae Rd
ucuuaauccacaauucu

SEQ ID NO: 694394 - RNA, 16 nt, Haemophilus influenzae Rd
ucuuaauguaggcucu

SEQ ID NO: 694395 - RNA, 18 nt, Haemophilus influenzae Rd
ucugguacaaauuuagau

SEQ ID NO: 694396 - RNA, 22 nt, Haemophilus influenzae Rd
ucuuaaaagugcggugcaauuu

SEQ ID NO: 694397 - RNA, 18 nt, Haemophilus influenzae Rd
ucuuaacugcaaguccgc

SEQ ID NO: 694398 - RNA, 20 nt, Haemophilus influenzae Rd
ucuuaaauucgcuuccagua

SEQ ID NO: 694399 - RNA, 19 nt, Haemophilus influenzae Rd
ucuuaaauauaucaagcag

SEQ ID NO: 694400 - RNA, 15 nt, Haemophilus influenzae Rd
ucuuaaaagaaauuc

SEQ ID NO: 694401 - RNA, 23 nt, Haemophilus influenzae Rd
ucuuaaaauacccauaaaauugu

SEQ ID NO: 694402 - RNA, 17 nt, Haemophilus influenzae Rd
ucuuaaagaauuucuuu

SEQ ID NO: 694403 - RNA, 22 nt, Haemophilus influenzae Rd
ucuuaaagaauuucuuucgcuu

SEQ ID NO: 694404 - RNA, 15 nt, Haemophilus influenzae Rd
ucuuaaagauaaaag

SEQ ID NO: 694405 - RNA, 11 nt, Haemophilus influenzae Rd
ucuucuuccca

SEQ ID NO: 694406 - RNA, 12 nt, Haemophilus influenzae Rd
ucuucuucccaa

SEQ ID NO: 694407 - RNA, 17 nt, Haemophilus influenzae Rd
ucuucuucauccacaua

SEQ ID NO: 694408 - RNA, 20 nt, Haemophilus influenzae Rd
ucuucuguuugguaagauuu

SEQ ID NO: 694409 - RNA, 19 nt, Haemophilus influenzae Rd
ucuucuggauuaucuguaa

SEQ ID NO: 694410 - RNA, 18 nt, Haemophilus influenzae Rd
ucuucugcggucaucucu

SEQ ID NO: 694411 - RNA, 23 nt, Haemophilus influenzae Rd
ucuucugcggucaucucuuguuu

SEQ ID NO: 694412 - RNA, 14 nt, Haemophilus influenzae Rd
ucuucucguuuuuu

SEQ ID NO: 694413 - RNA, 21 nt, Haemophilus influenzae Rd
ucuucgaugugcauuuuucau

SEQ ID NO: 694414 - RNA, 16 nt, Haemophilus influenzae Rd
ucuuccgcuguccaau

SEQ ID NO: 694415 - RNA, 17 nt, Haemophilus influenzae Rd
ucuucgacaucuccuaa

SEQ ID NO: 694416 - RNA, 18 nt, Haemophilus influenzae Rd
ucuucuaguuuuccuuuc

SEQ ID NO: 694417 - RNA, 19 nt, Haemophilus influenzae Rd
ucuucuaguuuuccuuucu

SEQ ID NO: 694418 - RNA, 13 nt, Haemophilus influenzae Rd
ucuucuauugaua

SEQ ID NO: 694419 - RNA, 18 nt, Haemophilus influenzae Rd
ucuucuauugauauuaau

SEQ ID NO: 694420 - RNA, 15 nt, Haemophilus influenzae Rd
ucuucuacuguuaau

SEQ ID NO: 694421 - RNA, 15 nt, Haemophilus influenzae Rd
ucuucuaauucuucc

SEQ ID NO: 694422 - RNA, 18 nt, Haemophilus influenzae Rd
ucuucuaauucuucccag

SEQ ID NO: 694423 - RNA, 20 nt, Haemophilus influenzae Rd
ucuucuaagguaacagguga

SEQ ID NO: 694424 - RNA, 16 nt, Haemophilus influenzae Rd
ucuucuuguucaaaua

SEQ ID NO: 694425 - RNA, 17 nt, Haemophilus influenzae Rd
ucuucuuguucaaauaa

SEQ ID NO: 694426 - RNA, 15 nt, Haemophilus influenzae Rd
ucuucuuggcaauau

SEQ ID NO: 694427 - RNA, 16 nt, Haemophilus influenzae Rd
ucuucuuuaauuucuu

SEQ ID NO: 694428 - RNA, 14 nt, Haemophilus influenzae Rd
ucuucuuuaccaac

SEQ ID NO: 694429 - RNA, 14 nt, Haemophilus influenzae Rd
ucuucuuuuuucuc

SEQ ID NO: 694430 - RNA, 21 nt, Haemophilus influenzae Rd
ucuucuuuugcccauucuaau

SEQ ID NO: 694431 - RNA, 14 nt, Haemophilus influenzae Rd
ucuucuuugcgauu

SEQ ID NO: 694432 - RNA, 22 nt, Haemophilus influenzae Rd
ucuucuuuuauaaccaguuauu

SEQ ID NO: 694433 - RNA, 17 nt, Haemophilus influenzae Rd
ucuugacauaauuucac

SEQ ID NO: 694434 - RNA, 21 nt, Haemophilus influenzae Rd
ucuugacauaauuucacaauu

SEQ ID NO: 694435 - RNA, 12 nt, Haemophilus influenzae Rd
ucuugaauacaa

SEQ ID NO: 694436 - RNA, 16 nt, Haemophilus influenzae Rd
ucuugaccaaauucca

SEQ ID NO: 694437 - RNA, 16 nt, Haemophilus influenzae Rd
ucuugaccugcagcca

SEQ ID NO: 694438 - RNA, 18 nt, Haemophilus influenzae Rd
ucuugcacggcaguaucu

SEQ ID NO: 694439 - RNA, 21 nt, Haemophilus influenzae Rd
ucuugcaacuuuuuuaggauu

SEQ ID NO: 694440 - RNA, 20 nt, Haemophilus influenzae Rd
ucuugauuauuuaauuucaa

SEQ ID NO: 694441 - RNA, 21 nt, Haemophilus influenzae Rd
ucuugauuauuuaauuucaaa

SEQ ID NO: 694442 - RNA, 22 nt, Haemophilus influenzae Rd
ucuugauaauagcguccuacua

SEQ ID NO: 694443 - RNA, 15 nt, Haemophilus influenzae Rd
ucuugaugauaaucu

SEQ ID NO: 694444 - RNA, 17 nt, Haemophilus influenzae Rd
ucuugcguaaccaaaga

SEQ ID NO: 694445 - RNA, 16 nt, Haemophilus influenzae Rd
ucuugcuaaaaagaaa

SEQ ID NO: 694446 - RNA, 17 nt, Haemophilus influenzae Rd
ucuugcuaaaauaucuu

SEQ ID NO: 694447 - RNA, 22 nt, Haemophilus influenzae Rd
ucuugcccgcaccgcuucuuug

SEQ ID NO: 694448 - RNA, 13 nt, Haemophilus influenzae Rd
ucuugccaaaauu

SEQ ID NO: 694449 - RNA, 23 nt, Haemophilus influenzae Rd
ucuugccaaugccaaauuucucc

SEQ ID NO: 694450 - RNA, 16 nt, Haemophilus influenzae Rd
ucuuguaacuauaacu

SEQ ID NO: 694451 - RNA, 18 nt, Haemophilus influenzae Rd
ucuugguuuaaauuuuaa

SEQ ID NO: 694452 - RNA, 21 nt, Haemophilus influenzae Rd
ucuuguaaacugcuuucaaaa

SEQ ID NO: 694453 - RNA, 18 nt, Haemophilus influenzae Rd
ucuuggcucauuuuaaag

SEQ ID NO: 694454 - RNA, 20 nt, Haemophilus influenzae Rd
ucuuggcucauuuuaaagag

SEQ ID NO: 694455 - RNA, 15 nt, Haemophilus influenzae Rd
ucuugggauuuugcc

SEQ ID NO: 694456 - RNA, 22 nt, Haemophilus influenzae Rd
ucuuguaagccaaauaaugcau

SEQ ID NO: 694457 - RNA, 23 nt, Haemophilus influenzae Rd
ucuuggauuuuuucuaauccaga

SEQ ID NO: 694458 - RNA, 15 nt, Haemophilus influenzae Rd
ucuuggcaauauuua

SEQ ID NO: 694459 - RNA, 13 nt, Haemophilus influenzae Rd
ucuuggauuuucu

SEQ ID NO: 694460 - RNA, 21 nt, Haemophilus influenzae Rd
ucuuggauuuucuuagcuuca

SEQ ID NO: 694461 - RNA, 20 nt, Haemophilus influenzae Rd
ucuugcugcuuugagguaaa

SEQ ID NO: 694462 - RNA, 14 nt, Haemophilus influenzae Rd
ucuuggaaaucuug

SEQ ID NO: 694463 - RNA, 21 nt, Haemophilus influenzae Rd
ucuugcuguugguuaaaaaua

SEQ ID NO: 694464 - RNA, 19 nt, Haemophilus influenzae Rd
ucuugcuugaucauccauu

SEQ ID NO: 694465 - RNA, 16 nt, Haemophilus influenzae Rd
ucuuguuuaaauucag

SEQ ID NO: 694466 - RNA, 18 nt, Haemophilus influenzae Rd
ucuuguuuaaauucaggc

SEQ ID NO: 694467 - RNA, 14 nt, Haemophilus influenzae Rd
ucuuguuuaauauu

SEQ ID NO: 694468 - RNA, 15 nt, Haemophilus influenzae Rd
ucuuguuuaauauuu

SEQ ID NO: 694469 - RNA, 16 nt, Haemophilus influenzae Rd
ucuuguuuaauauuuu

SEQ ID NO: 694470 - RNA, 22 nt, Haemophilus influenzae Rd
ucuuguuuaauauuuuuuucaa

SEQ ID NO: 694471 - RNA, 16 nt, Haemophilus influenzae Rd
ucuuguuuuaauauca

SEQ ID NO: 694472 - RNA, 13 nt, Haemophilus influenzae Rd
ucuuguuuuaauu

SEQ ID NO: 694473 - RNA, 15 nt, Haemophilus influenzae Rd
ucuuguucaaauaau

SEQ ID NO: 694474 - RNA, 18 nt, Haemophilus influenzae Rd
ucuuguucaaauaaugug

SEQ ID NO: 694475 - RNA, 22 nt, Haemophilus influenzae Rd
ucuuguucuaagaaaguuuuau

SEQ ID NO: 694476 - RNA, 15 nt, Haemophilus influenzae Rd
ucuuuaaauuuugcu

SEQ ID NO: 694477 - RNA, 15 nt, Haemophilus influenzae Rd
ucuuuaacaaaauca

SEQ ID NO: 694478 - RNA, 16 nt, Haemophilus influenzae Rd
ucuuuaacaaauucac

SEQ ID NO: 694479 - RNA, 14 nt, Haemophilus influenzae Rd
ucuuuaaauauuca

SEQ ID NO: 694480 - RNA, 16 nt, Haemophilus influenzae Rd
ucuuuaaauauucaau

SEQ ID NO: 694481 - RNA, 16 nt, Haemophilus influenzae Rd
ucuuuauaaauaacau

SEQ ID NO: 694482 - RNA, 15 nt, Haemophilus influenzae Rd
ucuuuauaacauaau

SEQ ID NO: 694483 - RNA, 17 nt, Haemophilus influenzae Rd
ucuuuauaagaaaguuu

SEQ ID NO: 694484 - RNA, 19 nt, Haemophilus influenzae Rd
ucuuuagcuauuaaauuag

SEQ ID NO: 694485 - RNA, 16 nt, Haemophilus influenzae Rd
ucuuuaggaucacuaa

SEQ ID NO: 694486 - RNA, 18 nt, Haemophilus influenzae Rd
ucuuuaggaucacuaauu

SEQ ID NO: 694487 - RNA, 17 nt, Haemophilus influenzae Rd
ucuuuacuguucaaaua

SEQ ID NO: 694488 - RNA, 16 nt, Haemophilus influenzae Rd
ucuuuaccaaaaaauu

SEQ ID NO: 694489 - RNA, 13 nt, Haemophilus influenzae Rd
ucuuuaaucguua

SEQ ID NO: 694490 - RNA, 13 nt, Haemophilus influenzae Rd
ucuuuaauuccaa

SEQ ID NO: 694491 - RNA, 19 nt, Haemophilus influenzae Rd
ucuuuaauugauuaaaaaa

SEQ ID NO: 694492 - RNA, 15 nt, Haemophilus influenzae Rd
ucuuuaauuaaaaua

SEQ ID NO: 694493 - RNA, 16 nt, Haemophilus influenzae Rd
ucuuuaauuaaaauau

SEQ ID NO: 694494 - RNA, 13 nt, Haemophilus influenzae Rd
ucuuuacaacugg

SEQ ID NO: 694495 - RNA, 16 nt, Haemophilus influenzae Rd
ucuuuacaacuggagc

SEQ ID NO: 694496 - RNA, 16 nt, Haemophilus influenzae Rd
ucuuuaucuauugauu

SEQ ID NO: 694497 - RNA, 17 nt, Haemophilus influenzae Rd
ucuuuaucugauuuaau

SEQ ID NO: 694498 - RNA, 23 nt, Haemophilus influenzae Rd
ucuuuaucugauuuaaucauuac

SEQ ID NO: 694499 - RNA, 18 nt, Haemophilus influenzae Rd
ucuuuaucuucuacaaau

SEQ ID NO: 694500 - RNA, 24 nt, Haemophilus influenzae Rd
ucuuuaucggcaaauacguauaau

SEQ ID NO: 694501 - RNA, 17 nt, Haemophilus influenzae Rd
ucuuuaugaauuaccaa

SEQ ID NO: 694502 - RNA, 15 nt, Haemophilus influenzae Rd
ucuuuauuauuucug

SEQ ID NO: 694503 - RNA, 14 nt, Haemophilus influenzae Rd
ucuuuauucugaaa

SEQ ID NO: 694504 - RNA, 14 nt, Haemophilus influenzae Rd
ucuuucaauaauuu

SEQ ID NO: 694505 - RNA, 17 nt, Haemophilus influenzae Rd
ucuuucaaguuugcaau

SEQ ID NO: 694506 - RNA, 20 nt, Haemophilus influenzae Rd
ucuuuauuuuuucaucauuu

SEQ ID NO: 694507 - RNA, 21 nt, Haemophilus influenzae Rd
ucuuuauuugagccaauaacu

SEQ ID NO: 694508 - RNA, 19 nt, Haemophilus influenzae Rd
ucuuuuauuaacaaaaaga

SEQ ID NO: 694509 - RNA, 17 nt, Haemophilus influenzae Rd
ucuuuucaauuugaaaa

SEQ ID NO: 694510 - RNA, 22 nt, Haemophilus influenzae Rd
ucuuuucaaacaacaagucauc

SEQ ID NO: 694511 - RNA, 11 nt, Haemophilus influenzae Rd
ucuuuuaauuu

SEQ ID NO: 694512 - RNA, 18 nt, Haemophilus influenzae Rd
ucuuuuagugguucagau

SEQ ID NO: 694513 - RNA, 14 nt, Haemophilus influenzae Rd
ucuuuuaauaagau

SEQ ID NO: 694514 - RNA, 21 nt, Haemophilus influenzae Rd
ucuuuuaauaagauaauaaau

SEQ ID NO: 694515 - RNA, 13 nt, Haemophilus influenzae Rd
ucuuuuaauucag

SEQ ID NO: 694516 - RNA, 14 nt, Haemophilus influenzae Rd
ucuuuuaauucucc

SEQ ID NO: 694517 - RNA, 19 nt, Haemophilus influenzae Rd
ucuuuuauagacuucaagu

SEQ ID NO: 694518 - RNA, 20 nt, Haemophilus influenzae Rd
ucuuuuaucucggcuaaaau

SEQ ID NO: 694519 - RNA, 23 nt, Haemophilus influenzae Rd
ucuuuuaucucggcuaaaaucug

SEQ ID NO: 694520 - RNA, 14 nt, Haemophilus influenzae Rd
ucuuuguugaugau

SEQ ID NO: 694521 - RNA, 21 nt, Haemophilus influenzae Rd
ucuuuguugaugauuugcaua

SEQ ID NO: 694522 - RNA, 15 nt, Haemophilus influenzae Rd
ucuuuuaaauaacca

SEQ ID NO: 694523 - RNA, 20 nt, Haemophilus influenzae Rd
ucuuuucuaacgcuuuuaaa

SEQ ID NO: 694524 - RNA, 17 nt, Haemophilus influenzae Rd
ucuuuucuauaauuaaa

SEQ ID NO: 694525 - RNA, 13 nt, Haemophilus influenzae Rd
ucuuuucuauaau

SEQ ID NO: 694526 - RNA, 18 nt, Haemophilus influenzae Rd
ucuuuuggcauuugcaua

SEQ ID NO: 694527 - RNA, 20 nt, Haemophilus influenzae Rd
ucuuuuggcauuugcauauu

SEQ ID NO: 694528 - RNA, 23 nt, Haemophilus influenzae Rd
ucuuuugguaauaaaucaaaaga

SEQ ID NO: 694529 - RNA, 12 nt, Haemophilus influenzae Rd
ucuuuuuaauuu

SEQ ID NO: 694530 - RNA, 17 nt, Haemophilus influenzae Rd
ucuuuuuaauuuaaaua

SEQ ID NO: 694531 - RNA, 16 nt, Haemophilus influenzae Rd
ucuuuuguuuuaaccg

SEQ ID NO: 694532 - RNA, 18 nt, Haemophilus influenzae Rd
ucuuuuuaaauauuuaaa

SEQ ID NO: 694533 - RNA, 15 nt, Haemophilus influenzae Rd
ucuuuuucacuauua

SEQ ID NO: 694534 - RNA, 22 nt, Haemophilus influenzae Rd
ucuuuuuauuuuacuaauuaaa

SEQ ID NO: 694535 - RNA, 14 nt, Haemophilus influenzae Rd
ucuuuuucuuggaa

SEQ ID NO: 694536 - RNA, 15 nt, Haemophilus influenzae Rd
ucuuuuuuaagauaa

SEQ ID NO: 694537 - RNA, 14 nt, Haemophilus influenzae Rd
ucuuuuuguuaaua

SEQ ID NO: 694538 - RNA, 19 nt, Haemophilus influenzae Rd
ucuuuuuguuaauaaaaga

SEQ ID NO: 694539 - RNA, 20 nt, Haemophilus influenzae Rd
ucuuuuuguuaauaaaagaa

SEQ ID NO: 694540 - RNA, 20 nt, Haemophilus influenzae Rd
ucuuucgccaguuuagaaag

SEQ ID NO: 694541 - RNA, 15 nt, Haemophilus influenzae Rd
ucuuucuauuugaau

SEQ ID NO: 694542 - RNA, 23 nt, Haemophilus influenzae Rd
ucuuucuaguaaaacuaauacuu

SEQ ID NO: 694543 - RNA, 14 nt, Haemophilus influenzae Rd
ucuuucacugcauu

SEQ ID NO: 694544 - RNA, 23 nt, Haemophilus influenzae Rd
ucuuucaguuuugcuuuuuuaau

SEQ ID NO: 694545 - RNA, 14 nt, Haemophilus influenzae Rd
ucuuuccaaccagg

SEQ ID NO: 694546 - RNA, 22 nt, Haemophilus influenzae Rd
ucuuuccacgcguuuuuacaua

SEQ ID NO: 694547 - RNA, 13 nt, Haemophilus influenzae Rd
ucuuugacuaaau

SEQ ID NO: 694548 - RNA, 15 nt, Haemophilus influenzae Rd
ucuuugaguaaaaaa

SEQ ID NO: 694549 - RNA, 21 nt, Haemophilus influenzae Rd
ucuuugaaaagcugauauaaa

SEQ ID NO: 694550 - RNA, 17 nt, Haemophilus influenzae Rd
ucuuugaauugaagcau

SEQ ID NO: 694551 - RNA, 23 nt, Haemophilus influenzae Rd
ucuuugaugaagcuaaacuuuag

SEQ ID NO: 694552 - RNA, 21 nt, Haemophilus influenzae Rd
ucuuugauuuucuuauuaauu

SEQ ID NO: 694553 - RNA, 15 nt, Haemophilus influenzae Rd
ucuuuggcuauguca

SEQ ID NO: 694554 - RNA, 22 nt, Haemophilus influenzae Rd
ucuuuggcuaugucaauuacug

SEQ ID NO: 694555 - RNA, 19 nt, Haemophilus influenzae Rd
ugaagcacugaaauaucag

SEQ ID NO: 694556 - RNA, 19 nt, Haemophilus influenzae Rd
ugaacuuaugugcaccuuc

SEQ ID NO: 694557 - RNA, 15 nt, Haemophilus influenzae Rd
ugaacuucauuuagu

SEQ ID NO: 694558 - RNA, 12 nt, Haemophilus influenzae Rd
ugaagacaucau

SEQ ID NO: 694559 - RNA, 15 nt, Haemophilus influenzae Rd
ugaagacaucauaua

SEQ ID NO: 694560 - RNA, 11 nt, Haemophilus influenzae Rd
ugaauaaaauu

SEQ ID NO: 694561 - RNA, 16 nt, Haemophilus influenzae Rd
ugaaguuuucauuaaa

SEQ ID NO: 694562 - RNA, 12 nt, Haemophilus influenzae Rd
ugaaguuuuuua

SEQ ID NO: 694563 - RNA, 13 nt, Haemophilus influenzae Rd
ugaagucuuaaua

SEQ ID NO: 694564 - RNA, 19 nt, Haemophilus influenzae Rd
ugaagucuauaaaagaagg

SEQ ID NO: 694565 - RNA, 15 nt, Haemophilus influenzae Rd
ugaaguaauaaucuu

SEQ ID NO: 694566 - RNA, 21 nt, Haemophilus influenzae Rd
ugaaguaauaaucuucuuccc

SEQ ID NO: 694567 - RNA, 15 nt, Haemophilus influenzae Rd
ugaaggcaaaauuga

SEQ ID NO: 694568 - RNA, 15 nt, Haemophilus influenzae Rd
ugaacggaucgccug

SEQ ID NO: 694569 - RNA, 17 nt, Haemophilus influenzae Rd
ugaacgcgcgccaauaa

SEQ ID NO: 694570 - RNA, 15 nt, Haemophilus influenzae Rd
ugaacuaauaucacu

SEQ ID NO: 694571 - RNA, 14 nt, Haemophilus influenzae Rd
ugaacuaaaauauc

SEQ ID NO: 694572 - RNA, 15 nt, Haemophilus influenzae Rd
ugaacucaauuccuu

SEQ ID NO: 694573 - RNA, 19 nt, Haemophilus influenzae Rd
ugaacccuacaggcuucca

SEQ ID NO: 694574 - RNA, 15 nt, Haemophilus influenzae Rd
ugaaccuauuagaau

SEQ ID NO: 694575 - RNA, 16 nt, Haemophilus influenzae Rd
ugaaaucgcaguuucu

SEQ ID NO: 694576 - RNA, 21 nt, Haemophilus influenzae Rd
ugaaaugaaguaauaaucuuc

SEQ ID NO: 694577 - RNA, 23 nt, Haemophilus influenzae Rd
ugaaagcgaaaucgcacucacaa

SEQ ID NO: 694578 - RNA, 13 nt, Haemophilus influenzae Rd
ugaaauaauucau

SEQ ID NO: 694579 - RNA, 21 nt, Haemophilus influenzae Rd
ugaaauaauucauguuuuuua

SEQ ID NO: 694580 - RNA, 17 nt, Haemophilus influenzae Rd
ugaaaucccuuagaaaa

SEQ ID NO: 694581 - RNA, 17 nt, Haemophilus influenzae Rd
ugaaauacaaagcacua

SEQ ID NO: 694582 - RNA, 21 nt, Haemophilus influenzae Rd
ugaaaguuugcuuagugaaaa

SEQ ID NO: 694583 - RNA, 13 nt, Haemophilus influenzae Rd
ugaaauaagauuu

SEQ ID NO: 694584 - RNA, 13 nt, Haemophilus influenzae Rd
ugaaauaaaauau

SEQ ID NO: 694585 - RNA, 15 nt, Haemophilus influenzae Rd
ugaaauaaaauauau

SEQ ID NO: 694586 - RNA, 19 nt, Haemophilus influenzae Rd
ugaaacagggcauucauug

SEQ ID NO: 694587 - RNA, 20 nt, Haemophilus influenzae Rd
ugaaacgagauuuauuuugg

SEQ ID NO: 694588 - RNA, 14 nt, Haemophilus influenzae Rd
ugaaacuaaagaau

SEQ ID NO: 694589 - RNA, 17 nt, Haemophilus influenzae Rd
ugaaacgggcucaucac

SEQ ID NO: 694590 - RNA, 21 nt, Haemophilus influenzae Rd
ugaaaauacagugucaaaugc

SEQ ID NO: 694591 - RNA, 21 nt, Haemophilus influenzae Rd
ugaaaauucucaggaaauuuc

SEQ ID NO: 694592 - RNA, 13 nt, Haemophilus influenzae Rd
ugaaaauguaaau

SEQ ID NO: 694593 - RNA, 18 nt, Haemophilus influenzae Rd
ugaaaauguaaauuggca

SEQ ID NO: 694594 - RNA, 13 nt, Haemophilus influenzae Rd
ucuuuuuuucaua

SEQ ID NO: 694595 - RNA, 14 nt, Haemophilus influenzae Rd
ucuuuuuuuuguuu

SEQ ID NO: 694596 - RNA, 22 nt, Haemophilus influenzae Rd
ugaaaaaacguaauagauaaag

SEQ ID NO: 694597 - RNA, 19 nt, Haemophilus influenzae Rd
ugaaaaaaagaaaaccaaa

SEQ ID NO: 694598 - RNA, 23 nt, Haemophilus influenzae Rd
ugaaaaaaagaaaaccaaaacau

SEQ ID NO: 694599 - RNA, 22 nt, Haemophilus influenzae Rd
ugaaaaaaagugcgguugaaau

SEQ ID NO: 694600 - RNA, 21 nt, Haemophilus influenzae Rd
ucuuuuuucuugcuaaaaaga

SEQ ID NO: 694601 - RNA, 17 nt, Haemophilus influenzae Rd
ucuuuuuuaucaaaaau

SEQ ID NO: 694602 - RNA, 22 nt, Haemophilus influenzae Rd
ugaaaaaagugcggaaaauuuu

SEQ ID NO: 694603 - RNA, 12 nt, Haemophilus influenzae Rd
ugaaaaaauaac

SEQ ID NO: 694604 - RNA, 14 nt, Haemophilus influenzae Rd
ugaaaaacauucaa

SEQ ID NO: 694605 - RNA, 20 nt, Haemophilus influenzae Rd
ugaaaaaaucuuccaauaca

SEQ ID NO: 694606 - RNA, 18 nt, Haemophilus influenzae Rd
ugaaaaaggcggcuacuu

SEQ ID NO: 694607 - RNA, 15 nt, Haemophilus influenzae Rd
ugaaaaaguuagacu

SEQ ID NO: 694608 - RNA, 23 nt, Haemophilus influenzae Rd
ugaaaaaguuagacuaugaaauc

SEQ ID NO: 694609 - RNA, 20 nt, Haemophilus influenzae Rd
ugaaaaagcuaaaaaaacag

SEQ ID NO: 694610 - RNA, 21 nt, Haemophilus influenzae Rd
ugaaaaagcuaaaaaaacagg

SEQ ID NO: 694611 - RNA, 17 nt, Haemophilus influenzae Rd
ugaaaaaugcuuguucu

SEQ ID NO: 694612 - RNA, 19 nt, Haemophilus influenzae Rd
ugaaaaauggacagaauaa

SEQ ID NO: 694613 - RNA, 14 nt, Haemophilus influenzae Rd
ugaaaaauuaucaa

SEQ ID NO: 694614 - RNA, 14 nt, Haemophilus influenzae Rd
ugaaaaauucaaag

SEQ ID NO: 694615 - RNA, 12 nt, Haemophilus influenzae Rd
ugaaaaauaaaa

SEQ ID NO: 694616 - RNA, 22 nt, Haemophilus influenzae Rd
ugaaaaguaaaugauaaaaauc

SEQ ID NO: 694617 - RNA, 16 nt, Haemophilus influenzae Rd
ugaaaacuacuuucca

SEQ ID NO: 694618 - RNA, 23 nt, Haemophilus influenzae Rd
ugaaaagaaaacuuauaaagaua

SEQ ID NO: 694619 - RNA, 20 nt, Haemophilus influenzae Rd
ugaaaagaaaguauuaaaua

SEQ ID NO: 694620 - RNA, 12 nt, Haemophilus influenzae Rd
ugaaaagaaaua

SEQ ID NO: 694621 - RNA, 23 nt, Haemophilus influenzae Rd
ugaaaagaauaauauuaaagaaa

SEQ ID NO: 694622 - RNA, 15 nt, Haemophilus influenzae Rd
ugaaaagaauuucau

SEQ ID NO: 694623 - RNA, 15 nt, Haemophilus influenzae Rd
ucauuccauuuugca

SEQ ID NO: 694624 - RNA, 22 nt, Haemophilus influenzae Rd
ucauuccauuuugcauauugaa

SEQ ID NO: 694625 - RNA, 14 nt, Haemophilus influenzae Rd
ucauugaaggucau

SEQ ID NO: 694626 - RNA, 19 nt, Haemophilus influenzae Rd
ucauugaaggucauacgau

SEQ ID NO: 694627 - RNA, 15 nt, Haemophilus influenzae Rd
ucauuauauuuaaua

SEQ ID NO: 694628 - RNA, 19 nt, Haemophilus influenzae Rd
ucauuauauuuaauacuuu

SEQ ID NO: 694629 - RNA, 17 nt, Haemophilus influenzae Rd
ucauuauccaacauuaa

SEQ ID NO: 694630 - RNA, 18 nt, Haemophilus influenzae Rd
ucauuauccaacauuaau

SEQ ID NO: 694631 - RNA, 19 nt, Haemophilus influenzae Rd
ucauuauccaacauuaaua

SEQ ID NO: 694632 - RNA, 16 nt, Haemophilus influenzae Rd
ucauucacucggaaug

SEQ ID NO: 694633 - RNA, 13 nt, Haemophilus influenzae Rd
ucauucauuuugu

SEQ ID NO: 694634 - RNA, 19 nt, Haemophilus influenzae Rd
ucauuacuuuaaagccgua

SEQ ID NO: 694635 - RNA, 21 nt, Haemophilus influenzae Rd
ucauuacgugcaaauaaauuu

SEQ ID NO: 694636 - RNA, 19 nt, Haemophilus influenzae Rd
ucauuaaaacaaagggcug

SEQ ID NO: 694637 - RNA, 14 nt, Haemophilus influenzae Rd
ucauuaaaaaauaa

SEQ ID NO: 694638 - RNA, 17 nt, Haemophilus influenzae Rd
ucauguucgaguuggcu

SEQ ID NO: 694639 - RNA, 21 nt, Haemophilus influenzae Rd
ucaguuuaagcuacagugagu

SEQ ID NO: 694640 - RNA, 16 nt, Haemophilus influenzae Rd
ucauuuggaucuaaaa

SEQ ID NO: 694641 - RNA, 17 nt, Haemophilus influenzae Rd
ucauuuggaucuaaaaa

SEQ ID NO: 694642 - RNA, 14 nt, Haemophilus influenzae Rd
ucauuugcccauac

SEQ ID NO: 694643 - RNA, 19 nt, Haemophilus influenzae Rd
ucauuugccgccaaaauga

SEQ ID NO: 694644 - RNA, 20 nt, Haemophilus influenzae Rd
ucauuugcgccaauaauaaa

SEQ ID NO: 694645 - RNA, 18 nt, Haemophilus influenzae Rd
ucauuugcucuaaaugug

SEQ ID NO: 694646 - RNA, 18 nt, Haemophilus influenzae Rd
ucauuugcuucuaucaga

SEQ ID NO: 694647 - RNA, 20 nt, Haemophilus influenzae Rd
ucauuugcuuuaacccauuu

SEQ ID NO: 694648 - RNA, 12 nt, Haemophilus influenzae Rd
ucauuucuuaau

SEQ ID NO: 694649 - RNA, 23 nt, Haemophilus influenzae Rd
ucauuucucgggcugaaauaccu

SEQ ID NO: 694650 - RNA, 13 nt, Haemophilus influenzae Rd
ucauuuaauaauu

SEQ ID NO: 694651 - RNA, 16 nt, Haemophilus influenzae Rd
ucauuuaauaauuuag

SEQ ID NO: 694652 - RNA, 16 nt, Haemophilus influenzae Rd
ucauugauggcucgaa

SEQ ID NO: 694653 - RNA, 13 nt, Haemophilus influenzae Rd
ucauugcauuuuu

SEQ ID NO: 694654 - RNA, 18 nt, Haemophilus influenzae Rd
ucauugauggaauaaauu

SEQ ID NO: 694655 - RNA, 20 nt, Haemophilus influenzae Rd
ucauugauggaauaaauuuu

SEQ ID NO: 694656 - RNA, 19 nt, Haemophilus influenzae Rd
ucauuguaguuuuucacgc

SEQ ID NO: 694657 - RNA, 17 nt, Haemophilus influenzae Rd
ucauuguuuccacacga

SEQ ID NO: 694658 - RNA, 20 nt, Haemophilus influenzae Rd
ucauuuaaccguaauuucaa

SEQ ID NO: 694659 - RNA, 23 nt, Haemophilus influenzae Rd
ucauugugacggugaauuuauca

SEQ ID NO: 694660 - RNA, 18 nt, Haemophilus influenzae Rd
ucauuguggaaacgugca

SEQ ID NO: 694661 - RNA, 14 nt, Haemophilus influenzae Rd
ucauuguuaaauaa

SEQ ID NO: 694662 - RNA, 20 nt, Haemophilus influenzae Rd
ucauuuugucagauuuauaa

SEQ ID NO: 694663 - RNA, 18 nt, Haemophilus influenzae Rd
uccaaacauuuuuauuuu

SEQ ID NO: 694664 - RNA, 20 nt, Haemophilus influenzae Rd
ucauuuucgacauucgcaua

SEQ ID NO: 694665 - RNA, 18 nt, Haemophilus influenzae Rd
ucauuuugcguuugagga

SEQ ID NO: 694666 - RNA, 21 nt, Haemophilus influenzae Rd
ucauuuugagauaaauuuuua

SEQ ID NO: 694667 - RNA, 17 nt, Haemophilus influenzae Rd
ucauuuugagccauuuc

SEQ ID NO: 694668 - RNA, 17 nt, Haemophilus influenzae Rd
uccaaacuggaauaaag

SEQ ID NO: 694669 - RNA, 13 nt, Haemophilus influenzae Rd
uccaaagaauaau

SEQ ID NO: 694670 - RNA, 15 nt, Haemophilus influenzae Rd
uccaaagaauaauaa

SEQ ID NO: 694671 - RNA, 18 nt, Haemophilus influenzae Rd
uccaaagaauaauaagug

SEQ ID NO: 694672 - RNA, 16 nt, Haemophilus influenzae Rd
uccaaagaaucaucuu

SEQ ID NO: 694673 - RNA, 18 nt, Haemophilus influenzae Rd
uccaaagaaucaucuuca

SEQ ID NO: 694674 - RNA, 19 nt, Haemophilus influenzae Rd
uccaaagacuaaaaccaca

SEQ ID NO: 694675 - RNA, 14 nt, Haemophilus influenzae Rd
uccaaagcaauuaa

SEQ ID NO: 694676 - RNA, 19 nt, Haemophilus influenzae Rd
uccaacaauuucacugaaa

SEQ ID NO: 694677 - RNA, 22 nt, Haemophilus influenzae Rd
uccaacaauuucacugaaagua

SEQ ID NO: 694678 - RNA, 21 nt, Haemophilus influenzae Rd
uccaaauuggguucgcaaaua

SEQ ID NO: 694679 - RNA, 17 nt, Haemophilus influenzae Rd
uccaaauucuuuaaauu

SEQ ID NO: 694680 - RNA, 22 nt, Haemophilus influenzae Rd
uccaaauucuuuaaauucaaua

SEQ ID NO: 694681 - RNA, 13 nt, Haemophilus influenzae Rd
uccaagaaguuuu

SEQ ID NO: 694682 - RNA, 17 nt, Haemophilus influenzae Rd
uccaagaauuuuaauaa

SEQ ID NO: 694683 - RNA, 13 nt, Haemophilus influenzae Rd
uccaaccaauucc

SEQ ID NO: 694684 - RNA, 14 nt, Haemophilus influenzae Rd
uccaacauuaauaa

SEQ ID NO: 694685 - RNA, 14 nt, Haemophilus influenzae Rd
uccaacccagaaua

SEQ ID NO: 694686 - RNA, 19 nt, Haemophilus influenzae Rd
uccaaccgauaaggaaaau

SEQ ID NO: 694687 - RNA, 14 nt, Haemophilus influenzae Rd
uccaaccuaauaac

SEQ ID NO: 694688 - RNA, 23 nt, Haemophilus influenzae Rd
uccaacucauuacacaaaauauu

SEQ ID NO: 694689 - RNA, 14 nt, Haemophilus influenzae Rd
uccaacuaugaaga

SEQ ID NO: 694690 - RNA, 17 nt, Haemophilus influenzae Rd
uccaacuaugaagacua

SEQ ID NO: 694691 - RNA, 14 nt, Haemophilus influenzae Rd
uccaacguuuuaau

SEQ ID NO: 694692 - RNA, 19 nt, Haemophilus influenzae Rd
uccaacguuuuaauccuuc

SEQ ID NO: 694693 - RNA, 15 nt, Haemophilus influenzae Rd
uccaacgauuuugca

SEQ ID NO: 694694 - RNA, 18 nt, Haemophilus influenzae Rd
uccaaucauauuucugca

SEQ ID NO: 694695 - RNA, 20 nt, Haemophilus influenzae Rd
uccaaucaucagaauaauua

SEQ ID NO: 694696 - RNA, 16 nt, Haemophilus influenzae Rd
uccaaucaucauccca

SEQ ID NO: 694697 - RNA, 18 nt, Haemophilus influenzae Rd
uccaaucaucaucccaau

SEQ ID NO: 694698 - RNA, 22 nt, Haemophilus influenzae Rd
uccaaucaucaucccaaucuuc

SEQ ID NO: 694699 - RNA, 20 nt, Haemophilus influenzae Rd
uccaaucagcaaaacuuuuu

SEQ ID NO: 694700 - RNA, 16 nt, Haemophilus influenzae Rd
uccaauccuaaaucug

SEQ ID NO: 694701 - RNA, 16 nt, Haemophilus influenzae Rd
uccaaugauccccauu

SEQ ID NO: 694702 - RNA, 14 nt, Haemophilus influenzae Rd
uccaaucuaauucu

SEQ ID NO: 694703 - RNA, 12 nt, Haemophilus influenzae Rd
uccaaggcaauu

SEQ ID NO: 694704 - RNA, 21 nt, Haemophilus influenzae Rd
uccaaguauuuuguggaauau

SEQ ID NO: 694705 - RNA, 15 nt, Haemophilus influenzae Rd
uccaagcaaagaaau

SEQ ID NO: 694706 - RNA, 20 nt, Haemophilus influenzae Rd
uccaagccauguugauguaa

SEQ ID NO: 694707 - RNA, 13 nt, Haemophilus influenzae Rd
uccaauaauuaaa

SEQ ID NO: 694708 - RNA, 17 nt, Haemophilus influenzae Rd
uccaauacuguuuggca

SEQ ID NO: 694709 - RNA, 17 nt, Haemophilus influenzae Rd
uccaauacaaucagcug

SEQ ID NO: 694710 - RNA, 19 nt, Haemophilus influenzae Rd
uccacgcuaaaaucuugca

SEQ ID NO: 694711 - RNA, 15 nt, Haemophilus influenzae Rd
uccacuaaaaacgca

SEQ ID NO: 694712 - RNA, 15 nt, Haemophilus influenzae Rd
uccacuaaaccauuu

SEQ ID NO: 694713 - RNA, 20 nt, Haemophilus influenzae Rd
uccacguuguaagcaaaauc

SEQ ID NO: 694714 - RNA, 14 nt, Haemophilus influenzae Rd
uccacuucauccau

SEQ ID NO: 694715 - RNA, 19 nt, Haemophilus influenzae Rd
uccacuacugcaucugcau

SEQ ID NO: 694716 - RNA, 15 nt, Haemophilus influenzae Rd
uccaccaugaauauu

SEQ ID NO: 694717 - RNA, 21 nt, Haemophilus influenzae Rd
uccacccacauacuuauucaa

SEQ ID NO: 694718 - RNA, 16 nt, Haemophilus influenzae Rd
uccacagcaaaagaaa

SEQ ID NO: 694719 - RNA, 18 nt, Haemophilus influenzae Rd
uccacacuuuaaaaguuu

SEQ ID NO: 694720 - RNA, 17 nt, Haemophilus influenzae Rd
uccacagaaacagaaau

SEQ ID NO: 694721 - RNA, 13 nt, Haemophilus influenzae Rd
uccaauuacuaau

SEQ ID NO: 694722 - RNA, 16 nt, Haemophilus influenzae Rd
uccaauuacuaaugcc

SEQ ID NO: 694723 - RNA, 17 nt, Haemophilus influenzae Rd
uccaaugccuugugcau

SEQ ID NO: 694724 - RNA, 13 nt, Haemophilus influenzae Rd
uccacaaucaauc

SEQ ID NO: 694725 - RNA, 17 nt, Haemophilus influenzae Rd
uccaaugugaccaaaua

SEQ ID NO: 694726 - RNA, 21 nt, Haemophilus influenzae Rd
uccagcaugagcuucaaaauc

SEQ ID NO: 694727 - RNA, 20 nt, Haemophilus influenzae Rd
uccagaaaauugcaccuucu

SEQ ID NO: 694728 - RNA, 21 nt, Haemophilus influenzae Rd
uccagaacgaacaauuucuaa

SEQ ID NO: 694729 - RNA, 22 nt, Haemophilus influenzae Rd
uccagaacgaacaauuucuaac

SEQ ID NO: 694730 - RNA, 19 nt, Haemophilus influenzae Rd
uccacuuuuucauguacaa

SEQ ID NO: 694731 - RNA, 18 nt, Haemophilus influenzae Rd
uccacuuuccguuuacua

SEQ ID NO: 694732 - RNA, 15 nt, Haemophilus influenzae Rd
uccacuucauaaauc

SEQ ID NO: 694733 - RNA, 21 nt, Haemophilus influenzae Rd
uccacuucgggcgaaaccuuu

SEQ ID NO: 694734 - RNA, 13 nt, Haemophilus influenzae Rd
uccacuucuuaug

SEQ ID NO: 694735 - RNA, 17 nt, Haemophilus influenzae Rd
uccagugguaaaccuaa

SEQ ID NO: 694736 - RNA, 13 nt, Haemophilus influenzae Rd
uccaguucuccuu

SEQ ID NO: 694737 - RNA, 12 nt, Haemophilus influenzae Rd
uccaucaaucau

SEQ ID NO: 694738 - RNA, 18 nt, Haemophilus influenzae Rd
uccauauuguuucaauuu

SEQ ID NO: 694739 - RNA, 15 nt, Haemophilus influenzae Rd
uccauaugaccauua

SEQ ID NO: 694740 - RNA, 19 nt, Haemophilus influenzae Rd
uccauaguucacuaaaaau

SEQ ID NO: 694741 - RNA, 23 nt, Haemophilus influenzae Rd
uccauaguuuggcugaaauucua

SEQ ID NO: 694742 - RNA, 13 nt, Haemophilus influenzae Rd
uccagguuguuuu

SEQ ID NO: 694743 - RNA, 17 nt, Haemophilus influenzae Rd
uccaugaugaaauaauu

SEQ ID NO: 694744 - RNA, 20 nt, Haemophilus influenzae Rd
uccaugaugaaauaauucau

SEQ ID NO: 694745 - RNA, 17 nt, Haemophilus influenzae Rd
uccaugaugaugggaug

SEQ ID NO: 694746 - RNA, 20 nt, Haemophilus influenzae Rd
uccauggacgguuacagcuu

SEQ ID NO: 694747 - RNA, 15 nt, Haemophilus influenzae Rd
uccauuaagcacagg

SEQ ID NO: 694748 - RNA, 13 nt, Haemophilus influenzae Rd
uccauuaauucau

SEQ ID NO: 694749 - RNA, 21 nt, Haemophilus influenzae Rd
uccauuacguucauauaaauu

SEQ ID NO: 694750 - RNA, 14 nt, Haemophilus influenzae Rd
uccaucuaaaaguu

SEQ ID NO: 694751 - RNA, 18 nt, Haemophilus influenzae Rd
uccaucgcacuguuauau

SEQ ID NO: 694752 - RNA, 23 nt, Haemophilus influenzae Rd
uccaucauugcucgacaaagauu

SEQ ID NO: 694753 - RNA, 21 nt, Haemophilus influenzae Rd
uccaucauuuuucgcaaaauc

SEQ ID NO: 694754 - RNA, 13 nt, Haemophilus influenzae Rd
uccaucaccuuca

SEQ ID NO: 694755 - RNA, 22 nt, Haemophilus influenzae Rd
ucccaaugcaccaaaaauccuc

SEQ ID NO: 694756 - RNA, 13 nt, Haemophilus influenzae Rd
ucccaauuauugg

SEQ ID NO: 694757 - RNA, 21 nt, Haemophilus influenzae Rd
ucccaaccgauauacucuccc

SEQ ID NO: 694758 - RNA, 19 nt, Haemophilus influenzae Rd
ucccaaucuuguuuuaauu

SEQ ID NO: 694759 - RNA, 18 nt, Haemophilus influenzae Rd
ucccaaagucuuaaugac

SEQ ID NO: 694760 - RNA, 21 nt, Haemophilus influenzae Rd
uccauugcauccacuucaucc

SEQ ID NO: 694761 - RNA, 17 nt, Haemophilus influenzae Rd
uccauugcaauuucagc

SEQ ID NO: 694762 - RNA, 16 nt, Haemophilus influenzae Rd
uccauucuaaaaaaau

SEQ ID NO: 694763 - RNA, 18 nt, Haemophilus influenzae Rd
uccauucuaguugcggug

SEQ ID NO: 694764 - RNA, 12 nt, Haemophilus influenzae Rd
uccauucucaaa

SEQ ID NO: 694765 - RNA, 17 nt, Haemophilus influenzae Rd
uccauuccugcaagaaa

SEQ ID NO: 694766 - RNA, 22 nt, Haemophilus influenzae Rd
uccauuccugcaagaaaaaugu

SEQ ID NO: 694767 - RNA, 22 nt, Haemophilus influenzae Rd
uccauuggugaaaucaacaauc

SEQ ID NO: 694768 - RNA, 21 nt, Haemophilus influenzae Rd
uccauuucgucgcuuuucccu

SEQ ID NO: 694769 - RNA, 20 nt, Haemophilus influenzae Rd
uccauuucaauaucuaagaa

SEQ ID NO: 694770 - RNA, 16 nt, Haemophilus influenzae Rd
uccauuucaaucacug

SEQ ID NO: 694771 - RNA, 19 nt, Haemophilus influenzae Rd
uccauuugaagaauuuguu

SEQ ID NO: 694772 - RNA, 18 nt, Haemophilus influenzae Rd
uccauuuuuaaauggucu

SEQ ID NO: 694773 - RNA, 15 nt, Haemophilus influenzae Rd
uccauuuuuaguaau

SEQ ID NO: 694774 - RNA, 13 nt, Haemophilus influenzae Rd
uccauuuuuuucu

SEQ ID NO: 694775 - RNA, 19 nt, Haemophilus influenzae Rd
uccauuuuuuuugcauuua

SEQ ID NO: 694776 - RNA, 16 nt, Haemophilus influenzae Rd
ucccaaaagcaaauga

SEQ ID NO: 694777 - RNA, 13 nt, Haemophilus influenzae Rd
ucccaaaaacuaa

SEQ ID NO: 694778 - RNA, 22 nt, Haemophilus influenzae Rd
ucccccaaucccucaaauacac

SEQ ID NO: 694779 - RNA, 14 nt, Haemophilus influenzae Rd
uccccauuuguaga

SEQ ID NO: 694780 - RNA, 22 nt, Haemophilus influenzae Rd
uccccauaaaccgccaaaaauu

SEQ ID NO: 694781 - RNA, 21 nt, Haemophilus influenzae Rd
uccccauacaaguauuuuccu

SEQ ID NO: 694782 - RNA, 22 nt, Haemophilus influenzae Rd
uccccauacaaguauuuuccuu

SEQ ID NO: 694783 - RNA, 19 nt, Haemophilus influenzae Rd
uccccauaucucugccauc

SEQ ID NO: 694784 - RNA, 13 nt, Haemophilus influenzae Rd
uccccaagguaua

SEQ ID NO: 694785 - RNA, 16 nt, Haemophilus influenzae Rd
uccccaaugaugacga

SEQ ID NO: 694786 - RNA, 18 nt, Haemophilus influenzae Rd
ucccauucuuaaaucaua

SEQ ID NO: 694787 - RNA, 21 nt, Haemophilus influenzae Rd
ucccauugcaaaauagaugua

SEQ ID NO: 694788 - RNA, 23 nt, Haemophilus influenzae Rd
ucccauuugaauuuuacuucuuc

SEQ ID NO: 694789 - RNA, 21 nt, Haemophilus influenzae Rd
ucccauuuagguuagaauaaa

SEQ ID NO: 694790 - RNA, 23 nt, Haemophilus influenzae Rd
ucccauuuagguuagaauaaacc

SEQ ID NO: 694791 - RNA, 15 nt, Haemophilus influenzae Rd
ucccauuucaucuuc

SEQ ID NO: 694792 - RNA, 17 nt, Haemophilus influenzae Rd
ucccauuucaucuucag

SEQ ID NO: 694793 - RNA, 23 nt, Haemophilus influenzae Rd
ucccauuucuaaugcaauuucaa

SEQ ID NO: 694794 - RNA, 16 nt, Haemophilus influenzae Rd
ucccagcguaaaaaug

SEQ ID NO: 694795 - RNA, 14 nt, Haemophilus influenzae Rd
ucccaguaaauauc

SEQ ID NO: 694796 - RNA, 14 nt, Haemophilus influenzae Rd
ucccauaauccagc

SEQ ID NO: 694797 - RNA, 15 nt, Haemophilus influenzae Rd
ucccauaauccagca

SEQ ID NO: 694798 - RNA, 19 nt, Haemophilus influenzae Rd
ucccagugcugaaauauag

SEQ ID NO: 694799 - RNA, 22 nt, Haemophilus influenzae Rd
ucccauaccguauuuuuuuaau

SEQ ID NO: 694800 - RNA, 14 nt, Haemophilus influenzae Rd
ucccauauuuaaaa

SEQ ID NO: 694801 - RNA, 19 nt, Haemophilus influenzae Rd
ucccauauuuaaaaccaaa

SEQ ID NO: 694802 - RNA, 20 nt, Haemophilus influenzae Rd
ucccagcauaaauaaauagc

SEQ ID NO: 694803 - RNA, 15 nt, Haemophilus influenzae Rd
ucccagauuuuacuu

SEQ ID NO: 694804 - RNA, 17 nt, Haemophilus influenzae Rd
ucccacuuguuuuuuca

SEQ ID NO: 694805 - RNA, 15 nt, Haemophilus influenzae Rd
uccccgaugauuuuu

SEQ ID NO: 694806 - RNA, 19 nt, Haemophilus influenzae Rd
uccccgaugauuuuuacaa

SEQ ID NO: 694807 - RNA, 21 nt, Haemophilus influenzae Rd
uccccgcuuucgcuucugcuu

SEQ ID NO: 694808 - RNA, 20 nt, Haemophilus influenzae Rd
ucccgcaacuuuugcaaaau

SEQ ID NO: 694809 - RNA, 20 nt, Haemophilus influenzae Rd
uccccuugauuauuuuuuaa

SEQ ID NO: 694810 - RNA, 14 nt, Haemophilus influenzae Rd
uccccuuguucuuc

SEQ ID NO: 694811 - RNA, 17 nt, Haemophilus influenzae Rd
uccccuuguucuucaua

SEQ ID NO: 694812 - RNA, 19 nt, Haemophilus influenzae Rd
uccccuuguucuucauaga

SEQ ID NO: 694813 - RNA, 15 nt, Haemophilus influenzae Rd
uccccuuccuugaca

SEQ ID NO: 694814 - RNA, 19 nt, Haemophilus influenzae Rd
uccccugucaauuuuucua

SEQ ID NO: 694815 - RNA, 21 nt, Haemophilus influenzae Rd
uccccugucaauuuuucuacu

SEQ ID NO: 694816 - RNA, 22 nt, Haemophilus influenzae Rd
ucccgucaauuccauaauaucu

SEQ ID NO: 694817 - RNA, 16 nt, Haemophilus influenzae Rd
ucccgcuuuugccaua

SEQ ID NO: 694818 - RNA, 19 nt, Haemophilus influenzae Rd
ucccgcuuuugccauauuu

SEQ ID NO: 694819 - RNA, 20 nt, Haemophilus influenzae Rd
ucccugauagguaauaauag

SEQ ID NO: 694820 - RNA, 16 nt, Haemophilus influenzae Rd
ucccucaaaauuauga

SEQ ID NO: 694821 - RNA, 20 nt, Haemophilus influenzae Rd
ucccuauaaugcaccgcaca

SEQ ID NO: 694822 - RNA, 20 nt, Haemophilus influenzae Rd
ucccuauacuccacuauaaa

SEQ ID NO: 694823 - RNA, 14 nt, Haemophilus influenzae Rd
ucccuaaaaucuuc

SEQ ID NO: 694824 - RNA, 17 nt, Haemophilus influenzae Rd
ucccuaaaaucuucgcu

SEQ ID NO: 694825 - RNA, 17 nt, Haemophilus influenzae Rd
aaaucuguugaaucuca

SEQ ID NO: 694826 - RNA, 22 nt, Haemophilus influenzae Rd
aaaucugugcaaaguuaccauu

SEQ ID NO: 694827 - RNA, 22 nt, Haemophilus influenzae Rd
uccgagcucuuucauuaaauua

SEQ ID NO: 694828 - RNA, 19 nt, Haemophilus influenzae Rd
uccgacuaaaaccaagaaa

SEQ ID NO: 694829 - RNA, 11 nt, Haemophilus influenzae Rd
aaaucucuugc

SEQ ID NO: 694830 - RNA, 15 nt, Haemophilus influenzae Rd
aaaucucuugcucac

SEQ ID NO: 694831 - RNA, 23 nt, Haemophilus influenzae Rd
aaaucugauucagaaaaagcuuc

SEQ ID NO: 694832 - RNA, 22 nt, Haemophilus influenzae Rd
aaaucugcacucuaauaaguga

SEQ ID NO: 694833 - RNA, 22 nt, Haemophilus influenzae Rd
aaaucugccaaugcuucuugcu

SEQ ID NO: 694834 - RNA, 16 nt, Haemophilus influenzae Rd
aaaucugccugauuuu

SEQ ID NO: 694835 - RNA, 19 nt, Haemophilus influenzae Rd
aaaucugguggagaaaugu

SEQ ID NO: 694836 - RNA, 21 nt, Haemophilus influenzae Rd
uccgcaacauaagcugcauca

SEQ ID NO: 694837 - RNA, 13 nt, Haemophilus influenzae Rd
uccgccacuuuga

SEQ ID NO: 694838 - RNA, 18 nt, Haemophilus influenzae Rd
uccgccaaugcuuuuaau

SEQ ID NO: 694839 - RNA, 16 nt, Haemophilus influenzae Rd
uccgcauaaauaauaa

SEQ ID NO: 694840 - RNA, 23 nt, Haemophilus influenzae Rd
uccgcauuaaucggcaauguuuu

SEQ ID NO: 694841 - RNA, 17 nt, Haemophilus influenzae Rd
uccgcauuuuuuuauuc

SEQ ID NO: 694842 - RNA, 17 nt, Haemophilus influenzae Rd
uccgccuacacgagaau

SEQ ID NO: 694843 - RNA, 14 nt, Haemophilus influenzae Rd
uccgcgacauuaag

SEQ ID NO: 694844 - RNA, 23 nt, Haemophilus influenzae Rd
uccgcguaaaguuuuaaaccaag

SEQ ID NO: 694845 - RNA, 21 nt, Haemophilus influenzae Rd
uccuuuaaucugucacgagcu

SEQ ID NO: 694846 - RNA, 16 nt, Haemophilus influenzae Rd
uccuuuacauuuaaac

SEQ ID NO: 694847 - RNA, 19 nt, Haemophilus influenzae Rd
uccuuuacugacuuucuaa

SEQ ID NO: 694848 - RNA, 15 nt, Haemophilus influenzae Rd
uccuuuauagcaauu

SEQ ID NO: 694849 - RNA, 14 nt, Haemophilus influenzae Rd
uccuuguuuuucaa

SEQ ID NO: 694850 - RNA, 24 nt, Haemophilus influenzae Rd
uccuuguagagcagggauuuucau

SEQ ID NO: 694851 - RNA, 16 nt, Haemophilus influenzae Rd
uccuugguuaauccua

SEQ ID NO: 694852 - RNA, 15 nt, Haemophilus influenzae Rd
uccuugauauucaag

SEQ ID NO: 694853 - RNA, 21 nt, Haemophilus influenzae Rd
ucgaacacuguaaauaaacgu

SEQ ID NO: 694854 - RNA, 14 nt, Haemophilus influenzae Rd
ucgaaauuaaaaua

SEQ ID NO: 694855 - RNA, 16 nt, Haemophilus influenzae Rd
ucgaaauuaaaauaau

SEQ ID NO: 694856 - RNA, 19 nt, Haemophilus influenzae Rd
ucgaaaucauaaucugaaa

SEQ ID NO: 694857 - RNA, 14 nt, Haemophilus influenzae Rd
ucgaacaugaaguu

SEQ ID NO: 694858 - RNA, 16 nt, Haemophilus influenzae Rd
ucgaaaauaacuucau

SEQ ID NO: 694859 - RNA, 21 nt, Haemophilus influenzae Rd
ucgaaaauaacuucauccauu

SEQ ID NO: 694860 - RNA, 23 nt, Haemophilus influenzae Rd
ucgaaaauaacuucauccauuuu

SEQ ID NO: 694861 - RNA, 20 nt, Haemophilus influenzae Rd
ucgaaaguggcuuuuuucau

SEQ ID NO: 694862 - RNA, 18 nt, Haemophilus influenzae Rd
ucgaaaguugguuuugca

SEQ ID NO: 694863 - RNA, 18 nt, Haemophilus influenzae Rd
uccuuuugccauuuugcu

SEQ ID NO: 694864 - RNA, 13 nt, Haemophilus influenzae Rd
uccuuuuucuaac

SEQ ID NO: 694865 - RNA, 16 nt, Haemophilus influenzae Rd
uccuuuuucuacuucu

SEQ ID NO: 694866 - RNA, 16 nt, Haemophilus influenzae Rd
uccuuuuuuauuuauu

SEQ ID NO: 694867 - RNA, 21 nt, Haemophilus influenzae Rd
uccuuuuuuauuuauuugcua

SEQ ID NO: 694868 - RNA, 19 nt, Haemophilus influenzae Rd
ucgaaaacauaauccgcau

SEQ ID NO: 694869 - RNA, 17 nt, Haemophilus influenzae Rd
uccuuuucauaaaaauu

SEQ ID NO: 694870 - RNA, 14 nt, Haemophilus influenzae Rd
ucgaaguaugaaaa

SEQ ID NO: 694871 - RNA, 17 nt, Haemophilus influenzae Rd
ucgaaggaaauccugcg

SEQ ID NO: 694872 - RNA, 21 nt, Haemophilus influenzae Rd
ucgaacuuagucucuuuauuu

SEQ ID NO: 694873 - RNA, 21 nt, Haemophilus influenzae Rd
ucgaacgaguaaucuaauucu

SEQ ID NO: 694874 - RNA, 14 nt, Haemophilus influenzae Rd
ucgacaaauuaaua

SEQ ID NO: 694875 - RNA, 16 nt, Haemophilus influenzae Rd
ucgaauaagguaacug

SEQ ID NO: 694876 - RNA, 19 nt, Haemophilus influenzae Rd
ucgaauaauccuucuucgg

SEQ ID NO: 694877 - RNA, 17 nt, Haemophilus influenzae Rd
ucgaauauugaucaucu

SEQ ID NO: 694878 - RNA, 16 nt, Haemophilus influenzae Rd
ucgaccguuuuuucuu

SEQ ID NO: 694879 - RNA, 16 nt, Haemophilus influenzae Rd
ucgacaggaacauuca

SEQ ID NO: 694880 - RNA, 13 nt, Haemophilus influenzae Rd
ucgacuuuuucac

SEQ ID NO: 694881 - RNA, 16 nt, Haemophilus influenzae Rd
ucgagcuaaauccaga

SEQ ID NO: 694882 - RNA, 15 nt, Haemophilus influenzae Rd
ucgaucauuuuuaac

SEQ ID NO: 694883 - RNA, 22 nt, Haemophilus influenzae Rd
ucgaucagcacgauaaccauca

SEQ ID NO: 694884 - RNA, 17 nt, Haemophilus influenzae Rd
ucgauacuuucuugcug

SEQ ID NO: 694885 - RNA, 18 nt, Haemophilus influenzae Rd
ucgauaauuuaacugaau

SEQ ID NO: 694886 - RNA, 16 nt, Haemophilus influenzae Rd
ucgagggucaaaagaa

SEQ ID NO: 694887 - RNA, 16 nt, Haemophilus influenzae Rd
ucgaggguucgaaucc

SEQ ID NO: 694888 - RNA, 14 nt, Haemophilus influenzae Rd
ucgagguuuuccac

SEQ ID NO: 694889 - RNA, 23 nt, Haemophilus influenzae Rd
ucgaguaaaaauaaaaugccguu

SEQ ID NO: 694890 - RNA, 15 nt, Haemophilus influenzae Rd
ucgaguaauuucaua

SEQ ID NO: 694891 - RNA, 23 nt, Haemophilus influenzae Rd
ucgauaagauugugcaauaacgu

SEQ ID NO: 694892 - RNA, 20 nt, Haemophilus influenzae Rd
ucgauaacaauuuuugcauu

SEQ ID NO: 694893 - RNA, 13 nt, Haemophilus influenzae Rd
ucgauaaagaauu

SEQ ID NO: 694894 - RNA, 14 nt, Haemophilus influenzae Rd
ucgaguuuuucaaa

SEQ ID NO: 694895 - RNA, 15 nt, Haemophilus influenzae Rd
ucgaugugcauuuuu

SEQ ID NO: 694896 - RNA, 18 nt, Haemophilus influenzae Rd
ucgaugugcauuuuucau

SEQ ID NO: 694897 - RNA, 13 nt, Haemophilus influenzae Rd
ucgauuacaaaaa

SEQ ID NO: 694898 - RNA, 12 nt, Haemophilus influenzae Rd
ucgauuacucug

SEQ ID NO: 694899 - RNA, 15 nt, Haemophilus influenzae Rd
ucgauucaaauaacg

SEQ ID NO: 694900 - RNA, 22 nt, Haemophilus influenzae Rd
ucgauugcaucuuggcauuuuu

SEQ ID NO: 694901 - RNA, 23 nt, Haemophilus influenzae Rd
ucgauugcauuuuuuauaaaugg

SEQ ID NO: 694902 - RNA, 16 nt, Haemophilus influenzae Rd
ucgaucuaaucuuaaa

SEQ ID NO: 694903 - RNA, 18 nt, Haemophilus influenzae Rd
ucgcaauuaauggcaauu

SEQ ID NO: 694904 - RNA, 23 nt, Haemophilus influenzae Rd
ucgcacccgcuuguuucaauaua

SEQ ID NO: 694905 - RNA, 16 nt, Haemophilus influenzae Rd
ucgcaaucagcauauu

SEQ ID NO: 694906 - RNA, 17 nt, Haemophilus influenzae Rd
ucgcaacaaacauuaau

SEQ ID NO: 694907 - RNA, 18 nt, Haemophilus influenzae Rd
ucgcaaaagaaugacgua

SEQ ID NO: 694908 - RNA, 15 nt, Haemophilus influenzae Rd
ucgcaaaaucuugcu

SEQ ID NO: 694909 - RNA, 16 nt, Haemophilus influenzae Rd
ucgcacuuaaaaagag

SEQ ID NO: 694910 - RNA, 16 nt, Haemophilus influenzae Rd
ucgcacuuaaaagauu

SEQ ID NO: 694911 - RNA, 19 nt, Haemophilus influenzae Rd
ucgcacuuaaaagauuaaa

SEQ ID NO: 694912 - RNA, 13 nt, Haemophilus influenzae Rd
ucgcaggcuuuca

SEQ ID NO: 694913 - RNA, 15 nt, Haemophilus influenzae Rd
ucgcaggcuuucacu

SEQ ID NO: 694914 - RNA, 15 nt, Haemophilus influenzae Rd
ucgcauaauauaaau

SEQ ID NO: 694915 - RNA, 18 nt, Haemophilus influenzae Rd
ucgcaggugucacagcaa

SEQ ID NO: 694916 - RNA, 21 nt, Haemophilus influenzae Rd
uccucuaaauaaaaacgcccu

SEQ ID NO: 694917 - RNA, 11 nt, Haemophilus influenzae Rd
uccucccauuc

SEQ ID NO: 694918 - RNA, 14 nt, Haemophilus influenzae Rd
uccucagcaaaaga

SEQ ID NO: 694919 - RNA, 18 nt, Haemophilus influenzae Rd
uccucagcaauuucuuca

SEQ ID NO: 694920 - RNA, 19 nt, Haemophilus influenzae Rd
uccucagcaauuucuucag

SEQ ID NO: 694921 - RNA, 19 nt, Haemophilus influenzae Rd
uccugcaagaaaaauguuu

SEQ ID NO: 694922 - RNA, 22 nt, Haemophilus influenzae Rd
uccugaugaauuuaguacuucc

SEQ ID NO: 694923 - RNA, 13 nt, Haemophilus influenzae Rd
uccucuuuaaaau

SEQ ID NO: 694924 - RNA, 13 nt, Haemophilus influenzae Rd
uccucuccaucau

SEQ ID NO: 694925 - RNA, 15 nt, Haemophilus influenzae Rd
uccucucgccaaauc

SEQ ID NO: 694926 - RNA, 13 nt, Haemophilus influenzae Rd
uccugcaucagug

SEQ ID NO: 694927 - RNA, 15 nt, Haemophilus influenzae Rd
uccugcaucagugau

SEQ ID NO: 694928 - RNA, 15 nt, Haemophilus influenzae Rd
uccugcuuuuuucaa

SEQ ID NO: 694929 - RNA, 14 nt, Haemophilus influenzae Rd
uccuuaauuucauu

SEQ ID NO: 694930 - RNA, 15 nt, Haemophilus influenzae Rd
uccuuaauuucauua

SEQ ID NO: 694931 - RNA, 16 nt, Haemophilus influenzae Rd
uccuuaccuuccacuu

SEQ ID NO: 694932 - RNA, 14 nt, Haemophilus influenzae Rd
uccuuauaauauga

SEQ ID NO: 694933 - RNA, 14 nt, Haemophilus influenzae Rd
uccuuccaaaucca

SEQ ID NO: 694934 - RNA, 13 nt, Haemophilus influenzae Rd
uccuuauucaaau

SEQ ID NO: 694935 - RNA, 18 nt, Haemophilus influenzae Rd
uccuguauaauuuuucac

SEQ ID NO: 694936 - RNA, 23 nt, Haemophilus influenzae Rd
uccuauuuacguaaaaaaguuug

SEQ ID NO: 694937 - RNA, 14 nt, Haemophilus influenzae Rd
uccuauuuuuaaug

SEQ ID NO: 694938 - RNA, 19 nt, Haemophilus influenzae Rd
uccucacucgcauaggugu

SEQ ID NO: 694939 - RNA, 12 nt, Haemophilus influenzae Rd
uccuauucuaaa

SEQ ID NO: 694940 - RNA, 13 nt, Haemophilus influenzae Rd
uccuauucuaaau

SEQ ID NO: 694941 - RNA, 15 nt, Haemophilus influenzae Rd
uccuauuaauuuaau

SEQ ID NO: 694942 - RNA, 20 nt, Haemophilus influenzae Rd
uccuauuaauuuaauucuaa

SEQ ID NO: 694943 - RNA, 16 nt, Haemophilus influenzae Rd
uccuaguuuuuucccu

SEQ ID NO: 694944 - RNA, 22 nt, Haemophilus influenzae Rd
uccuauaaaacaaauaagccca

SEQ ID NO: 694945 - RNA, 12 nt, Haemophilus influenzae Rd
uccuauacuaau

SEQ ID NO: 694946 - RNA, 14 nt, Haemophilus influenzae Rd
uccuaacuuuucuu

SEQ ID NO: 694947 - RNA, 18 nt, Haemophilus influenzae Rd
uccuaacuuuucuucaau

SEQ ID NO: 694948 - RNA, 14 nt, Haemophilus influenzae Rd
uccuaaacuacaac

SEQ ID NO: 694949 - RNA, 23 nt, Haemophilus influenzae Rd
uccuaaugcagcagcuucuucuu

SEQ ID NO: 694950 - RNA, 18 nt, Haemophilus influenzae Rd
uccuaaugugcaaucagc

SEQ ID NO: 694951 - RNA, 16 nt, Haemophilus influenzae Rd
uccuaaaauacaaaua

SEQ ID NO: 694952 - RNA, 20 nt, Haemophilus influenzae Rd
uccuaauagacaggcauauu

SEQ ID NO: 694953 - RNA, 23 nt, Haemophilus influenzae Rd
uccuacguauuaucguagguuuu

SEQ ID NO: 694954 - RNA, 20 nt, Haemophilus influenzae Rd
uccgugaacugaguuuucac

SEQ ID NO: 694955 - RNA, 19 nt, Haemophilus influenzae Rd
uccguuuuuaaucucccaa

SEQ ID NO: 694956 - RNA, 14 nt, Haemophilus influenzae Rd
uccguuuuuuucac

SEQ ID NO: 694957 - RNA, 12 nt, Haemophilus influenzae Rd
uccguaaaauac

SEQ ID NO: 694958 - RNA, 22 nt, Haemophilus influenzae Rd
uccguaaucgugccugccacca

SEQ ID NO: 694959 - RNA, 21 nt, Haemophilus influenzae Rd
uccguauaagcuaaagcaauu

SEQ ID NO: 694960 - RNA, 17 nt, Haemophilus influenzae Rd
uccguaucauuuaauaa

SEQ ID NO: 694961 - RNA, 14 nt, Haemophilus influenzae Rd
uccgcuuuuuucgc

SEQ ID NO: 694962 - RNA, 20 nt, Haemophilus influenzae Rd
uccgcuuuuuucgcaccaau

SEQ ID NO: 694963 - RNA, 21 nt, Haemophilus influenzae Rd
uccgcuuuuuucgcaccaaug

SEQ ID NO: 694964 - RNA, 16 nt, Haemophilus influenzae Rd
uaguccuuaauuuuau

SEQ ID NO: 694965 - RNA, 20 nt, Haemophilus influenzae Rd
uagucgcuggaacuucuaaa

SEQ ID NO: 694966 - RNA, 16 nt, Haemophilus influenzae Rd
uagucgucuauuuauu

SEQ ID NO: 694967 - RNA, 14 nt, Haemophilus influenzae Rd
uagucgucaucauu

SEQ ID NO: 694968 - RNA, 19 nt, Haemophilus influenzae Rd
uagucucuuuugaggcuaa

SEQ ID NO: 694969 - RNA, 22 nt, Haemophilus influenzae Rd
uagucuacaagaaaccaaaaua

SEQ ID NO: 694970 - RNA, 14 nt, Haemophilus influenzae Rd
uagucguuuaacca

SEQ ID NO: 694971 - RNA, 14 nt, Haemophilus influenzae Rd
uagugaaauauuua

SEQ ID NO: 694972 - RNA, 13 nt, Haemophilus influenzae Rd
uagucuuuuuaau

SEQ ID NO: 694973 - RNA, 18 nt, Haemophilus influenzae Rd
uaguuagaagugaaauau

SEQ ID NO: 694974 - RNA, 16 nt, Haemophilus influenzae Rd
uaguuagcuaaaaaaa

SEQ ID NO: 694975 - RNA, 21 nt, Haemophilus influenzae Rd
uaguuauaagcguucuacaau

SEQ ID NO: 694976 - RNA, 23 nt, Haemophilus influenzae Rd
uaguuacaaacaaucuuaacugc

SEQ ID NO: 694977 - RNA, 17 nt, Haemophilus influenzae Rd
uaguucguuuuuuagcu

SEQ ID NO: 694978 - RNA, 14 nt, Haemophilus influenzae Rd
uaguuauaugccua

SEQ ID NO: 694979 - RNA, 12 nt, Haemophilus influenzae Rd
uagugauaaaug

SEQ ID NO: 694980 - RNA, 17 nt, Haemophilus influenzae Rd
uaguggugccuucuuca

SEQ ID NO: 694981 - RNA, 20 nt, Haemophilus influenzae Rd
uaguggcaauccaacagcuu

SEQ ID NO: 694982 - RNA, 13 nt, Haemophilus influenzae Rd
uaguaauuuuaau

SEQ ID NO: 694983 - RNA, 13 nt, Haemophilus influenzae Rd
uaguaaugaaucu

SEQ ID NO: 694984 - RNA, 14 nt, Haemophilus influenzae Rd
uagucaauuuaccc

SEQ ID NO: 694985 - RNA, 22 nt, Haemophilus influenzae Rd
uagucacuugugguuauuugau

SEQ ID NO: 694986 - RNA, 15 nt, Haemophilus influenzae Rd
uagucagauaauaca

SEQ ID NO: 694987 - RNA, 20 nt, Haemophilus influenzae Rd
uagucauacagaaaccagaa

SEQ ID NO: 694988 - RNA, 22 nt, Haemophilus influenzae Rd
uaguccuuuacugacuuucuaa

SEQ ID NO: 694989 - RNA, 15 nt, Haemophilus influenzae Rd
uaguccuuuagaaaa

SEQ ID NO: 694990 - RNA, 23 nt, Haemophilus influenzae Rd
uacuuucaggauuuguuucuguc

SEQ ID NO: 694991 - RNA, 13 nt, Haemophilus influenzae Rd
uacuuuauuuuua

SEQ ID NO: 694992 - RNA, 22 nt, Haemophilus influenzae Rd
uaguaagcugauucuucauaaa

SEQ ID NO: 694993 - RNA, 15 nt, Haemophilus influenzae Rd
uaguaagauuuugac

SEQ ID NO: 694994 - RNA, 21 nt, Haemophilus influenzae Rd
uaguaagcaccaaaauuuguu

SEQ ID NO: 694995 - RNA, 14 nt, Haemophilus influenzae Rd
uaguaaauuuucca

SEQ ID NO: 694996 - RNA, 15 nt, Haemophilus influenzae Rd
uaguaaauuuuccaa

SEQ ID NO: 694997 - RNA, 20 nt, Haemophilus influenzae Rd
uauaauacguaaauucaaua

SEQ ID NO: 694998 - RNA, 13 nt, Haemophilus influenzae Rd
uauaauaaauaug

SEQ ID NO: 694999 - RNA, 17 nt, Haemophilus influenzae Rd
uauaagugccaacaaua

SEQ ID NO: 695000 - RNA, 13 nt, Haemophilus influenzae Rd
uauaagugauuaa

SEQ ID NO: 695001 - RNA, 15 nt, Haemophilus influenzae Rd
uauaagugauuaaag

SEQ ID NO: 695002 - RNA, 18 nt, Haemophilus influenzae Rd
uauaagugauuaaaguga

SEQ ID NO: 695003 - RNA, 20 nt, Haemophilus influenzae Rd
uauaagggacgagaacugaa

SEQ ID NO: 695004 - RNA, 19 nt, Haemophilus influenzae Rd
uauaagggcgaaauaucgc

SEQ ID NO: 695005 - RNA, 18 nt, Haemophilus influenzae Rd
uauaagguaguuuuccuu

SEQ ID NO: 695006 - RNA, 20 nt, Haemophilus influenzae Rd
uauaaguaacuuuagaacau

SEQ ID NO: 695007 - RNA, 15 nt, Haemophilus influenzae Rd
uauaaggauguuugg

SEQ ID NO: 695008 - RNA, 17 nt, Haemophilus influenzae Rd
uauaagcuaaagcaauu

SEQ ID NO: 695009 - RNA, 19 nt, Haemophilus influenzae Rd
uauaagcuguauuacuuau

SEQ ID NO: 695010 - RNA, 20 nt, Haemophilus influenzae Rd
uauaagcugugguaaaaaua

SEQ ID NO: 695011 - RNA, 17 nt, Haemophilus influenzae Rd
uauaauuuaacauaacu

SEQ ID NO: 695012 - RNA, 18 nt, Haemophilus influenzae Rd
uauaauuaaaguuacuuu

SEQ ID NO: 695013 - RNA, 17 nt, Haemophilus influenzae Rd
uauaauuaaauucauuu

SEQ ID NO: 695014 - RNA, 21 nt, Haemophilus influenzae Rd
uauaauuaauaaaaaaucugu

SEQ ID NO: 695015 - RNA, 19 nt, Haemophilus influenzae Rd
uauaauuaaucugcaccuu

SEQ ID NO: 695016 - RNA, 20 nt, Haemophilus influenzae Rd
uauaauuagaucauaaaaaa

SEQ ID NO: 695017 - RNA, 12 nt, Haemophilus influenzae Rd
uauaauucagca

SEQ ID NO: 695018 - RNA, 20 nt, Haemophilus influenzae Rd
uauaaucuccauaauauugu

SEQ ID NO: 695019 - RNA, 15 nt, Haemophilus influenzae Rd
uauaauccguuaauc

SEQ ID NO: 695020 - RNA, 13 nt, Haemophilus influenzae Rd
uauaaucauugcu

SEQ ID NO: 695021 - RNA, 16 nt, Haemophilus influenzae Rd
uauaauccauucagcc

SEQ ID NO: 695022 - RNA, 15 nt, Haemophilus influenzae Rd
uauaauauuuaaauu

SEQ ID NO: 695023 - RNA, 15 nt, Haemophilus influenzae Rd
uauaauauuuucuuu

SEQ ID NO: 695024 - RNA, 15 nt, Haemophilus influenzae Rd
uauaaucaauuucua

SEQ ID NO: 695025 - RNA, 16 nt, Haemophilus influenzae Rd
uauaaucaauuucuaa

SEQ ID NO: 695026 - RNA, 15 nt, Haemophilus influenzae Rd
uauaaugaauuaugc

SEQ ID NO: 695027 - RNA, 13 nt, Haemophilus influenzae Rd
uauaaucuuuaaa

SEQ ID NO: 695028 - RNA, 13 nt, Haemophilus influenzae Rd
uauaauuaaacau

SEQ ID NO: 695029 - RNA, 21 nt, Haemophilus influenzae Rd
uauaaccagauucaucaaagu

SEQ ID NO: 695030 - RNA, 12 nt, Haemophilus influenzae Rd
uauaagcaaauu

SEQ ID NO: 695031 - RNA, 16 nt, Haemophilus influenzae Rd
uauaagccccuuguuu

SEQ ID NO: 695032 - RNA, 12 nt, Haemophilus influenzae Rd
uauaagcgaauu

SEQ ID NO: 695033 - RNA, 19 nt, Haemophilus influenzae Rd
uauaagcgaauuacaucau

SEQ ID NO: 695034 - RNA, 20 nt, Haemophilus influenzae Rd
uauaaauggaaaccauugau

SEQ ID NO: 695035 - RNA, 20 nt, Haemophilus influenzae Rd
uauaaauggguuuuaucuuu

SEQ ID NO: 695036 - RNA, 15 nt, Haemophilus influenzae Rd
uauaaaucuauuccu

SEQ ID NO: 695037 - RNA, 14 nt, Haemophilus influenzae Rd
uauaaauaauuuuc

SEQ ID NO: 695038 - RNA, 15 nt, Haemophilus influenzae Rd
uauaaauaauuuucu

SEQ ID NO: 695039 - RNA, 22 nt, Haemophilus influenzae Rd
uauaaauaacaugguuaaaaua

SEQ ID NO: 695040 - RNA, 21 nt, Haemophilus influenzae Rd
uauaaauauuuaggcuauuuu

SEQ ID NO: 695041 - RNA, 15 nt, Haemophilus influenzae Rd
uauaaauauuuccaa

SEQ ID NO: 695042 - RNA, 18 nt, Haemophilus influenzae Rd
uauaaagaguaccacuuu

SEQ ID NO: 695043 - RNA, 21 nt, Haemophilus influenzae Rd
uauaaagcucuaauugaaaua

SEQ ID NO: 695044 - RNA, 13 nt, Haemophilus influenzae Rd
uauaaauaaaaaa

SEQ ID NO: 695045 - RNA, 19 nt, Haemophilus influenzae Rd
uauaaagucgguuuuuuca

SEQ ID NO: 695046 - RNA, 22 nt, Haemophilus influenzae Rd
uauaaaggauuuuaucauugcu

SEQ ID NO: 695047 - RNA, 19 nt, Haemophilus influenzae Rd
uaguuggguauucacuuaa

SEQ ID NO: 695048 - RNA, 14 nt, Haemophilus influenzae Rd
uaguucuuccccuc

SEQ ID NO: 695049 - RNA, 20 nt, Haemophilus influenzae Rd
uaguuggaucauuauccaaa

SEQ ID NO: 695050 - RNA, 21 nt, Haemophilus influenzae Rd
uauaaaagugcgguaaaaauu

SEQ ID NO: 695051 - RNA, 21 nt, Haemophilus influenzae Rd
uauaaaaguggaagucauuca

SEQ ID NO: 695052 - RNA, 15 nt, Haemophilus influenzae Rd
uauaaaauaaagaaa

SEQ ID NO: 695053 - RNA, 16 nt, Haemophilus influenzae Rd
uauaaaauaaagaaac

SEQ ID NO: 695054 - RNA, 15 nt, Haemophilus influenzae Rd
uauaaaauauauaau

SEQ ID NO: 695055 - RNA, 24 nt, Haemophilus influenzae Rd
uauaaaauauauaaucuucucuag

SEQ ID NO: 695056 - RNA, 19 nt, Haemophilus influenzae Rd
uauaucuuuauuauuucug

SEQ ID NO: 695057 - RNA, 15 nt, Haemophilus influenzae Rd
uauaucuuauauuuu

SEQ ID NO: 695058 - RNA, 22 nt, Haemophilus influenzae Rd
uauaucugaacuuuguucauuu

SEQ ID NO: 695059 - RNA, 13 nt, Haemophilus influenzae Rd
uauaucuaaauaa

SEQ ID NO: 695060 - RNA, 15 nt, Haemophilus influenzae Rd
uauauccugcacauc

SEQ ID NO: 695061 - RNA, 21 nt, Haemophilus influenzae Rd
uauauaaauccguaaaauacg

SEQ ID NO: 695062 - RNA, 11 nt, Haemophilus influenzae Rd
uauauaaaaua

SEQ ID NO: 695063 - RNA, 21 nt, Haemophilus influenzae Rd
uauauaaagcucuaauugaaa

SEQ ID NO: 695064 - RNA, 15 nt, Haemophilus influenzae Rd
uauauauaaaauaua

SEQ ID NO: 695065 - RNA, 22 nt, Haemophilus influenzae Rd
uauauaucacagauuuuuaaau

SEQ ID NO: 695066 - RNA, 17 nt, Haemophilus influenzae Rd
uauauauccaaaugccu

SEQ ID NO: 695067 - RNA, 16 nt, Haemophilus influenzae Rd
uauauaugauaaaaau

SEQ ID NO: 695068 - RNA, 18 nt, Haemophilus influenzae Rd
uauauaugauaaaaauaa

SEQ ID NO: 695069 - RNA, 23 nt, Haemophilus influenzae Rd
uauacaaaaaagccacuuucaau

SEQ ID NO: 695070 - RNA, 16 nt, Haemophilus influenzae Rd
uauacaaaacuaaaaa

SEQ ID NO: 695071 - RNA, 22 nt, Haemophilus influenzae Rd
uauacaaaacuaaaaaaauuca

SEQ ID NO: 695072 - RNA, 18 nt, Haemophilus influenzae Rd
uauaauuuccuauacuaa

SEQ ID NO: 695073 - RNA, 23 nt, Haemophilus influenzae Rd
uauaauuucgccauuuuuuccua

SEQ ID NO: 695074 - RNA, 13 nt, Haemophilus influenzae Rd
uauaauuuuagaa

SEQ ID NO: 695075 - RNA, 21 nt, Haemophilus influenzae Rd
uauaauuuuagaacuuagccu

SEQ ID NO: 695076 - RNA, 14 nt, Haemophilus influenzae Rd
uauacaaaauugug

SEQ ID NO: 695077 - RNA, 15 nt, Haemophilus influenzae Rd
uauacaaaauuuugu

SEQ ID NO: 695078 - RNA, 13 nt, Haemophilus influenzae Rd
uauacaauucuug

SEQ ID NO: 695079 - RNA, 17 nt, Haemophilus influenzae Rd
uauagggaauaaaaaag

SEQ ID NO: 695080 - RNA, 20 nt, Haemophilus influenzae Rd
uauagggcaugcacaacaug

SEQ ID NO: 695081 - RNA, 18 nt, Haemophilus influenzae Rd
uauaggcuauauuuucca

SEQ ID NO: 695082 - RNA, 16 nt, Haemophilus influenzae Rd
uauaggguaaauaaaa

SEQ ID NO: 695083 - RNA, 13 nt, Haemophilus influenzae Rd
uauaguuuaaacu

SEQ ID NO: 695084 - RNA, 14 nt, Haemophilus influenzae Rd
uauaguuuaaacuc

SEQ ID NO: 695085 - RNA, 22 nt, Haemophilus influenzae Rd
uaucacagauuuuuaaaucaau

SEQ ID NO: 695086 - RNA, 21 nt, Haemophilus influenzae Rd
uaucaauuuuauugaauacua

SEQ ID NO: 695087 - RNA, 23 nt, Haemophilus influenzae Rd
uaucacauuuuauugaagaguaa

SEQ ID NO: 695088 - RNA, 20 nt, Haemophilus influenzae Rd
uaucaccugggcggaagcua

SEQ ID NO: 695089 - RNA, 15 nt, Haemophilus influenzae Rd
uaucaauuucauuug

SEQ ID NO: 695090 - RNA, 19 nt, Haemophilus influenzae Rd
uaucaacaguaaauuuuuc

SEQ ID NO: 695091 - RNA, 18 nt, Haemophilus influenzae Rd
uauaugauuauaaauuag

SEQ ID NO: 695092 - RNA, 15 nt, Haemophilus influenzae Rd
uauaugccaagauuu

SEQ ID NO: 695093 - RNA, 15 nt, Haemophilus influenzae Rd
uauauuaauuuugau

SEQ ID NO: 695094 - RNA, 14 nt, Haemophilus influenzae Rd
uauauuaacuugcu

SEQ ID NO: 695095 - RNA, 16 nt, Haemophilus influenzae Rd
uauaugguucauuauu

SEQ ID NO: 695096 - RNA, 14 nt, Haemophilus influenzae Rd
uauauuauugugau

SEQ ID NO: 695097 - RNA, 15 nt, Haemophilus influenzae Rd
uauauucaaauuuca

SEQ ID NO: 695098 - RNA, 22 nt, Haemophilus influenzae Rd
uauauucaacuaaaggcacaaa

SEQ ID NO: 695099 - RNA, 16 nt, Haemophilus influenzae Rd
uauauuguugcacauu

SEQ ID NO: 695100 - RNA, 22 nt, Haemophilus influenzae Rd
uauauuucacuggcucauuauu

SEQ ID NO: 695101 - RNA, 11 nt, Haemophilus influenzae Rd
uauauuucuaa

SEQ ID NO: 695102 - RNA, 15 nt, Haemophilus influenzae Rd
uauauuucuuuucaa

SEQ ID NO: 695103 - RNA, 16 nt, Haemophilus influenzae Rd
uauauuuacaacugca

SEQ ID NO: 695104 - RNA, 21 nt, Haemophilus influenzae Rd
uaucauaacgggcauuuuucu

SEQ ID NO: 695105 - RNA, 16 nt, Haemophilus influenzae Rd
uaucauaacuauaauu

SEQ ID NO: 695106 - RNA, 23 nt, Haemophilus influenzae Rd
uaucauaucgagcagacaaaauu

SEQ ID NO: 695107 - RNA, 15 nt, Haemophilus influenzae Rd
uaucauacuaaaaaa

SEQ ID NO: 695108 - RNA, 16 nt, Haemophilus influenzae Rd
uaucauacuaaaaaau

SEQ ID NO: 695109 - RNA, 14 nt, Haemophilus influenzae Rd
uaucccaacuuuau

SEQ ID NO: 695110 - RNA, 14 nt, Haemophilus influenzae Rd
uauccagugccauu

SEQ ID NO: 695111 - RNA, 14 nt, Haemophilus influenzae Rd
uaucgcccgcuuua

SEQ ID NO: 695112 - RNA, 12 nt, Haemophilus influenzae Rd
uaucgccaauaa

SEQ ID NO: 695113 - RNA, 15 nt, Haemophilus influenzae Rd
uaucgucaaauuuaa

SEQ ID NO: 695114 - RNA, 14 nt, Haemophilus influenzae Rd
uaucguaaaaaauu

SEQ ID NO: 695115 - RNA, 17 nt, Haemophilus influenzae Rd
uaucgguuggauuuuaa

SEQ ID NO: 695116 - RNA, 15 nt, Haemophilus influenzae Rd
uaucgggaauaauau

SEQ ID NO: 695117 - RNA, 21 nt, Haemophilus influenzae Rd
uaucggagggggauuuucucg

SEQ ID NO: 695118 - RNA, 14 nt, Haemophilus influenzae Rd
uaucgcacuuuuuu

SEQ ID NO: 695119 - RNA, 14 nt, Haemophilus influenzae Rd
uaucgaggacaauc

SEQ ID NO: 695120 - RNA, 20 nt, Haemophilus influenzae Rd
uaugaagaacaaggggaaaa

SEQ ID NO: 695121 - RNA, 15 nt, Haemophilus influenzae Rd
uaugaagacuaaaca

SEQ ID NO: 695122 - RNA, 18 nt, Haemophilus influenzae Rd
uaugaagacuaaacagaa

SEQ ID NO: 695123 - RNA, 18 nt, Haemophilus influenzae Rd
uaugaauaacuuuaauuu

SEQ ID NO: 695124 - RNA, 23 nt, Haemophilus influenzae Rd
uaugaauaacuuuaauuuuccaa

SEQ ID NO: 695125 - RNA, 15 nt, Haemophilus influenzae Rd
uaugaaacagcuaaa

SEQ ID NO: 695126 - RNA, 22 nt, Haemophilus influenzae Rd
uaugaaacagcuaaaaaugaau

SEQ ID NO: 695127 - RNA, 23 nt, Haemophilus influenzae Rd
uaugaaacgcgaguaaaauaaaa

SEQ ID NO: 695128 - RNA, 21 nt, Haemophilus influenzae Rd
uaugaaauuuguugauagaaa

SEQ ID NO: 695129 - RNA, 14 nt, Haemophilus influenzae Rd
uaugaaauugcugu

SEQ ID NO: 695130 - RNA, 18 nt, Haemophilus influenzae Rd
uaugaaauugcuguaaug

SEQ ID NO: 695131 - RNA, 21 nt, Haemophilus influenzae Rd
uaucuuuuucgauaagauugu

SEQ ID NO: 695132 - RNA, 22 nt, Haemophilus influenzae Rd
uaugaaaaaaccgacuuuauau

SEQ ID NO: 695133 - RNA, 15 nt, Haemophilus influenzae Rd
uaucuuuuuguaauu

SEQ ID NO: 695134 - RNA, 15 nt, Haemophilus influenzae Rd
uaugaaaaaggcggc

SEQ ID NO: 695135 - RNA, 13 nt, Haemophilus influenzae Rd
uaugaaaaauaau

SEQ ID NO: 695136 - RNA, 19 nt, Haemophilus influenzae Rd
uaugaaaaauaaucaucua

SEQ ID NO: 695137 - RNA, 15 nt, Haemophilus influenzae Rd
uaucuucauaucuuu

SEQ ID NO: 695138 - RNA, 13 nt, Haemophilus influenzae Rd
uaucuuuagcuug

SEQ ID NO: 695139 - RNA, 17 nt, Haemophilus influenzae Rd
uaucuugcuuuuuuaau

SEQ ID NO: 695140 - RNA, 22 nt, Haemophilus influenzae Rd
uaucuucaaaauaguaaaaauu

SEQ ID NO: 695141 - RNA, 18 nt, Haemophilus influenzae Rd
uaucugucauauaaccac

SEQ ID NO: 695142 - RNA, 17 nt, Haemophilus influenzae Rd
uaucugucauuguaauu

SEQ ID NO: 695143 - RNA, 16 nt, Haemophilus influenzae Rd
uaucuaucuuguaauu

SEQ ID NO: 695144 - RNA, 19 nt, Haemophilus influenzae Rd
uaucuacuagccaaucaua

SEQ ID NO: 695145 - RNA, 22 nt, Haemophilus influenzae Rd
uaucuacaaucaaaaaaucuac

SEQ ID NO: 695146 - RNA, 19 nt, Haemophilus influenzae Rd
uaucuacugcuucauaaaa

SEQ ID NO: 695147 - RNA, 14 nt, Haemophilus influenzae Rd
uaucuacuuucagg

SEQ ID NO: 695148 - RNA, 14 nt, Haemophilus influenzae Rd
uaucuagaaaacuc

SEQ ID NO: 695149 - RNA, 14 nt, Haemophilus influenzae Rd
uaucuagcacaaag

SEQ ID NO: 695150 - RNA, 16 nt, Haemophilus influenzae Rd
uaucuagcacaaagac

SEQ ID NO: 695151 - RNA, 15 nt, Haemophilus influenzae Rd
uaucuagacuuucuu

SEQ ID NO: 695152 - RNA, 16 nt, Haemophilus influenzae Rd
uaucuaagauaaauuu

SEQ ID NO: 695153 - RNA, 19 nt, Haemophilus influenzae Rd
uaucuaagauaaauuuaaa

SEQ ID NO: 695154 - RNA, 13 nt, Haemophilus influenzae Rd
uaucuaaacuuca

SEQ ID NO: 695155 - RNA, 16 nt, Haemophilus influenzae Rd
uaucuaaacuucaauu

SEQ ID NO: 695156 - RNA, 12 nt, Haemophilus influenzae Rd
uaucuaaaagua

SEQ ID NO: 695157 - RNA, 13 nt, Haemophilus influenzae Rd
uaucuaaaauaua

SEQ ID NO: 695158 - RNA, 14 nt, Haemophilus influenzae Rd
uaucuaaaaagauu

SEQ ID NO: 695159 - RNA, 12 nt, Haemophilus influenzae Rd
uaucugcuuuuu

SEQ ID NO: 695160 - RNA, 21 nt, Haemophilus influenzae Rd
uaucuggauguuguaaaauau

SEQ ID NO: 695161 - RNA, 14 nt, Haemophilus influenzae Rd
uaucugcucucauu

SEQ ID NO: 695162 - RNA, 14 nt, Haemophilus influenzae Rd
uaucucugccaucc

SEQ ID NO: 695163 - RNA, 21 nt, Haemophilus influenzae Rd
uaucugauguagcuugaauau

SEQ ID NO: 695164 - RNA, 23 nt, Haemophilus influenzae Rd
uaucugauccacgguauuuucuu

SEQ ID NO: 695165 - RNA, 21 nt, Haemophilus influenzae Rd
uaucucuuacaguaccuauau

SEQ ID NO: 695166 - RNA, 18 nt, Haemophilus influenzae Rd
uaucucggcuaaaaucug

SEQ ID NO: 695167 - RNA, 20 nt, Haemophilus influenzae Rd
uaucucuaaaaaauaaccgc

SEQ ID NO: 695168 - RNA, 12 nt, Haemophilus influenzae Rd
uaugauuuuaaa

SEQ ID NO: 695169 - RNA, 22 nt, Haemophilus influenzae Rd
uaugauuuuuaaccgcccuuua

SEQ ID NO: 695170 - RNA, 13 nt, Haemophilus influenzae Rd
uaugcaaauacau

SEQ ID NO: 695171 - RNA, 18 nt, Haemophilus influenzae Rd
uaugcaucacuugugcua

SEQ ID NO: 695172 - RNA, 20 nt, Haemophilus influenzae Rd
uaugcaucagauuuuucgca

SEQ ID NO: 695173 - RNA, 16 nt, Haemophilus influenzae Rd
uaugccaaauaaaauu

SEQ ID NO: 695174 - RNA, 15 nt, Haemophilus influenzae Rd
uaugccaaggcuccc

SEQ ID NO: 695175 - RNA, 18 nt, Haemophilus influenzae Rd
uaugccaaucacaaugag

SEQ ID NO: 695176 - RNA, 20 nt, Haemophilus influenzae Rd
uaugccaaugcuauuaucau

SEQ ID NO: 695177 - RNA, 14 nt, Haemophilus influenzae Rd
uaugaucuucaauc

SEQ ID NO: 695178 - RNA, 15 nt, Haemophilus influenzae Rd
uaugauauauaaaac

SEQ ID NO: 695179 - RNA, 12 nt, Haemophilus influenzae Rd
uaugaucuacac

SEQ ID NO: 695180 - RNA, 13 nt, Haemophilus influenzae Rd
uaugauuauaaau

SEQ ID NO: 695181 - RNA, 22 nt, Haemophilus influenzae Rd
uaugauuaaaaugguuuaaaua

SEQ ID NO: 695182 - RNA, 16 nt, Haemophilus influenzae Rd
uaugaugugcuugaug

SEQ ID NO: 695183 - RNA, 14 nt, Haemophilus influenzae Rd
uaugauguggcuuu

SEQ ID NO: 695184 - RNA, 13 nt, Haemophilus influenzae Rd
uaugauuauagau

SEQ ID NO: 695185 - RNA, 16 nt, Haemophilus influenzae Rd
uaugauuuagaacaau

SEQ ID NO: 695186 - RNA, 19 nt, Haemophilus influenzae Rd
uaugagaauuaauuuauaa

SEQ ID NO: 695187 - RNA, 18 nt, Haemophilus influenzae Rd
uaugauaaaaauaaaaaa

SEQ ID NO: 695188 - RNA, 16 nt, Haemophilus influenzae Rd
uaugauaaaugcaaua

SEQ ID NO: 695189 - RNA, 20 nt, Haemophilus influenzae Rd
uaugauaaccaucuauauuu

SEQ ID NO: 695190 - RNA, 23 nt, Haemophilus influenzae Rd
uaugacgaacgugggaauuuucc

SEQ ID NO: 695191 - RNA, 20 nt, Haemophilus influenzae Rd
uaugacuaauuaauuaccug

SEQ ID NO: 695192 - RNA, 21 nt, Haemophilus influenzae Rd
uaugaauggcgucugcaauua

SEQ ID NO: 695193 - RNA, 14 nt, Haemophilus influenzae Rd
uaugaauguuucaa

SEQ ID NO: 695194 - RNA, 18 nt, Haemophilus influenzae Rd
uaugaauuaccaauucca

SEQ ID NO: 695195 - RNA, 23 nt, Haemophilus influenzae Rd
uauggcuugugcuauacaaaauu

SEQ ID NO: 695196 - RNA, 21 nt, Haemophilus influenzae Rd
uauggguguuuaaauuuuuaa

SEQ ID NO: 695197 - RNA, 17 nt, Haemophilus influenzae Rd
uauggucgguauucaua

SEQ ID NO: 695198 - RNA, 13 nt, Haemophilus influenzae Rd
uauggaaauaaau

SEQ ID NO: 695199 - RNA, 19 nt, Haemophilus influenzae Rd
uauggcauacuuaacaaau

SEQ ID NO: 695200 - RNA, 17 nt, Haemophilus influenzae Rd
uauggauauuguaggaa

SEQ ID NO: 695201 - RNA, 18 nt, Haemophilus influenzae Rd
uaugccuuauauuucacu

SEQ ID NO: 695202 - RNA, 21 nt, Haemophilus influenzae Rd
uaugcuccauugcaauuucag

SEQ ID NO: 695203 - RNA, 14 nt, Haemophilus influenzae Rd
uaugcgcuucauca

SEQ ID NO: 695204 - RNA, 16 nt, Haemophilus influenzae Rd
uaugcgcuucaucaaa

SEQ ID NO: 695205 - RNA, 16 nt, Haemophilus influenzae Rd
uaugcgggcaaaaacu

SEQ ID NO: 695206 - RNA, 20 nt, Haemophilus influenzae Rd
uauucuuuccucuccaucau

SEQ ID NO: 695207 - RNA, 17 nt, Haemophilus influenzae Rd
uauucuuuaaagagcaa

SEQ ID NO: 695208 - RNA, 17 nt, Haemophilus influenzae Rd
uauucuuuaaauauuca

SEQ ID NO: 695209 - RNA, 17 nt, Haemophilus influenzae Rd
uauucuucgcuuaaugg

SEQ ID NO: 695210 - RNA, 22 nt, Haemophilus influenzae Rd
uauucuucagaacugcuuucuu

SEQ ID NO: 695211 - RNA, 17 nt, Haemophilus influenzae Rd
uauucuucuaaaagauc

SEQ ID NO: 695212 - RNA, 21 nt, Haemophilus influenzae Rd
uauucuguaucaauuccuuca

SEQ ID NO: 695213 - RNA, 14 nt, Haemophilus influenzae Rd
uauucuguugaaug

SEQ ID NO: 695214 - RNA, 21 nt, Haemophilus influenzae Rd
uauucuaccgcauuuuuaaug

SEQ ID NO: 695215 - RNA, 22 nt, Haemophilus influenzae Rd
uauucuaaccgcacuuuuuaau

SEQ ID NO: 695216 - RNA, 17 nt, Haemophilus influenzae Rd
uauucccaaauuuuuug

SEQ ID NO: 695217 - RNA, 19 nt, Haemophilus influenzae Rd
uauucccaaauuuuuuguu

SEQ ID NO: 695218 - RNA, 13 nt, Haemophilus influenzae Rd
uauucccaaggcu

SEQ ID NO: 695219 - RNA, 16 nt, Haemophilus influenzae Rd
uauucccaaggcucca

SEQ ID NO: 695220 - RNA, 14 nt, Haemophilus influenzae Rd
uauucaaaauaaaa

SEQ ID NO: 695221 - RNA, 19 nt, Haemophilus influenzae Rd
uauucaaaauaaaaccauc

SEQ ID NO: 695222 - RNA, 14 nt, Haemophilus influenzae Rd
uauucaaauuucau

SEQ ID NO: 695223 - RNA, 22 nt, Haemophilus influenzae Rd
uauucccuauacuccacuauaa

SEQ ID NO: 695224 - RNA, 13 nt, Haemophilus influenzae Rd
uauucaaaacauu

SEQ ID NO: 695225 - RNA, 19 nt, Haemophilus influenzae Rd
uauucaaaacauuaauuga

SEQ ID NO: 695226 - RNA, 23 nt, Haemophilus influenzae Rd
uauucaaacgcccuucaccuucg

SEQ ID NO: 695227 - RNA, 19 nt, Haemophilus influenzae Rd
uauucaaacucuaauucca

SEQ ID NO: 695228 - RNA, 14 nt, Haemophilus influenzae Rd
uauuauuuccucuu

SEQ ID NO: 695229 - RNA, 22 nt, Haemophilus influenzae Rd
uauuaugugcuugggcaauuaa

SEQ ID NO: 695230 - RNA, 16 nt, Haemophilus influenzae Rd
uauuauguuuuguaga

SEQ ID NO: 695231 - RNA, 12 nt, Haemophilus influenzae Rd
uauuauuaagua

SEQ ID NO: 695232 - RNA, 16 nt, Haemophilus influenzae Rd
aaauccuaaauaaaga

SEQ ID NO: 695233 - RNA, 16 nt, Haemophilus influenzae Rd
aaauccguaaaauacg

SEQ ID NO: 695234 - RNA, 16 nt, Haemophilus influenzae Rd
aaauccugaagauuuu

SEQ ID NO: 695235 - RNA, 19 nt, Haemophilus influenzae Rd
aaauccugaagauuuuggu

SEQ ID NO: 695236 - RNA, 12 nt, Haemophilus influenzae Rd
uauugaagaaag

SEQ ID NO: 695237 - RNA, 14 nt, Haemophilus influenzae Rd
uauugaaauaagau

SEQ ID NO: 695238 - RNA, 15 nt, Haemophilus influenzae Rd
uauugaaauuuuaau

SEQ ID NO: 695239 - RNA, 14 nt, Haemophilus influenzae Rd
uauugauuucucug

SEQ ID NO: 695240 - RNA, 14 nt, Haemophilus influenzae Rd
uauugauucaauuc

SEQ ID NO: 695241 - RNA, 21 nt, Haemophilus influenzae Rd
aaauccuguucagcuuuacuc

SEQ ID NO: 695242 - RNA, 17 nt, Haemophilus influenzae Rd
uauugccaacuuagauu

SEQ ID NO: 695243 - RNA, 20 nt, Haemophilus influenzae Rd
uauugcauaaucauaucuaa

SEQ ID NO: 695244 - RNA, 18 nt, Haemophilus influenzae Rd
uauugcacaauagcuucc

SEQ ID NO: 695245 - RNA, 22 nt, Haemophilus influenzae Rd
uauuguuggcccaacagaaauc

SEQ ID NO: 695246 - RNA, 15 nt, Haemophilus influenzae Rd
uauuguuugcuuugg

SEQ ID NO: 695247 - RNA, 18 nt, Haemophilus influenzae Rd
uauuuaaguaaugcuaaa

SEQ ID NO: 695248 - RNA, 15 nt, Haemophilus influenzae Rd
uauuuaagcuuuccu

SEQ ID NO: 695249 - RNA, 22 nt, Haemophilus influenzae Rd
uauuuaagcuuuccuauucuaa

SEQ ID NO: 695250 - RNA, 19 nt, Haemophilus influenzae Rd
uauuuaagcugaaauuuag

SEQ ID NO: 695251 - RNA, 14 nt, Haemophilus influenzae Rd
uauuuaauaaaaug

SEQ ID NO: 695252 - RNA, 15 nt, Haemophilus influenzae Rd
uauuuaauaaaaugu

SEQ ID NO: 695253 - RNA, 13 nt, Haemophilus influenzae Rd
uauuuaauaauau

SEQ ID NO: 695254 - RNA, 16 nt, Haemophilus influenzae Rd
uauuuaauaauaucaa

SEQ ID NO: 695255 - RNA, 13 nt, Haemophilus influenzae Rd
uauuuaauaauuu

SEQ ID NO: 695256 - RNA, 17 nt, Haemophilus influenzae Rd
uauuuaauaauuuaaau

SEQ ID NO: 695257 - RNA, 14 nt, Haemophilus influenzae Rd
uauuggcaauuucc

SEQ ID NO: 695258 - RNA, 13 nt, Haemophilus influenzae Rd
uauuggaauggca

SEQ ID NO: 695259 - RNA, 19 nt, Haemophilus influenzae Rd
uauugcuugcauucacaaa

SEQ ID NO: 695260 - RNA, 15 nt, Haemophilus influenzae Rd
uauuggaaaauucaa

SEQ ID NO: 695261 - RNA, 16 nt, Haemophilus influenzae Rd
uauuguuauagaaaau

SEQ ID NO: 695262 - RNA, 17 nt, Haemophilus influenzae Rd
uauuaccgcguaaaaau

SEQ ID NO: 695263 - RNA, 18 nt, Haemophilus influenzae Rd
uauuaccgcguaaaaauu

SEQ ID NO: 695264 - RNA, 11 nt, Haemophilus influenzae Rd
uauuacaaaau

SEQ ID NO: 695265 - RNA, 15 nt, Haemophilus influenzae Rd
uauuacaaacaaaaa

SEQ ID NO: 695266 - RNA, 20 nt, Haemophilus influenzae Rd
uauuaauguuauuaaauaua

SEQ ID NO: 695267 - RNA, 17 nt, Haemophilus influenzae Rd
uauuaauuuaauucuaa

SEQ ID NO: 695268 - RNA, 20 nt, Haemophilus influenzae Rd
uauuaguuagcuaaaaaaac

SEQ ID NO: 695269 - RNA, 21 nt, Haemophilus influenzae Rd
uauuaguuaguuuuuuaccuu

SEQ ID NO: 695270 - RNA, 17 nt, Haemophilus influenzae Rd
uauuaguaaaauaauaa

SEQ ID NO: 695271 - RNA, 12 nt, Haemophilus influenzae Rd
uauuauaaaaau

SEQ ID NO: 695272 - RNA, 16 nt, Haemophilus influenzae Rd
uauuauaaaaauauuu

SEQ ID NO: 695273 - RNA, 19 nt, Haemophilus influenzae Rd
uauuauaaaaauauuuuaa

SEQ ID NO: 695274 - RNA, 20 nt, Haemophilus influenzae Rd
uauuauaaaaauauuuuaau

SEQ ID NO: 695275 - RNA, 19 nt, Haemophilus influenzae Rd
uauuaguauuuaagcugaa

SEQ ID NO: 695276 - RNA, 21 nt, Haemophilus influenzae Rd
uauuaucuacuagccaaucau

SEQ ID NO: 695277 - RNA, 18 nt, Haemophilus influenzae Rd
uauuaucuucaugauuuu

SEQ ID NO: 695278 - RNA, 21 nt, Haemophilus influenzae Rd
uauuaacuugcuauuuucuaa

SEQ ID NO: 695279 - RNA, 16 nt, Haemophilus influenzae Rd
uauuaaauuagacuaa

SEQ ID NO: 695280 - RNA, 17 nt, Haemophilus influenzae Rd
uauuaaagaguuauaaa

SEQ ID NO: 695281 - RNA, 11 nt, Haemophilus influenzae Rd
uauuaaauacc

SEQ ID NO: 695282 - RNA, 21 nt, Haemophilus influenzae Rd
uauuaaauagcgaucugcacu

SEQ ID NO: 695283 - RNA, 22 nt, Haemophilus influenzae Rd
uauuaaauauaggguaaauaaa

SEQ ID NO: 695284 - RNA, 16 nt, Haemophilus influenzae Rd
uauuaaugacaccuuu

SEQ ID NO: 695285 - RNA, 23 nt, Haemophilus influenzae Rd
uauuaaugcggugcuuuaaguaa

SEQ ID NO: 695286 - RNA, 20 nt, Haemophilus influenzae Rd
uauuaaugcuguuuaaaucu

SEQ ID NO: 695287 - RNA, 17 nt, Haemophilus influenzae Rd
uauuaagccauuggaaa

SEQ ID NO: 695288 - RNA, 13 nt, Haemophilus influenzae Rd
uauuaaguaaaua

SEQ ID NO: 695289 - RNA, 21 nt, Haemophilus influenzae Rd
uauguucaacaaguaaaucaa

SEQ ID NO: 695290 - RNA, 21 nt, Haemophilus influenzae Rd
uauguucuaagguauaaauaa

SEQ ID NO: 695291 - RNA, 19 nt, Haemophilus influenzae Rd
uauguucucucacgugaau

SEQ ID NO: 695292 - RNA, 22 nt, Haemophilus influenzae Rd
uauguucucucacgugaaucac

SEQ ID NO: 695293 - RNA, 17 nt, Haemophilus influenzae Rd
uauguugcuuuuaucaa

SEQ ID NO: 695294 - RNA, 13 nt, Haemophilus influenzae Rd
uauguuauuaaaa

SEQ ID NO: 695295 - RNA, 15 nt, Haemophilus influenzae Rd
uauguuauuaaaauu

SEQ ID NO: 695296 - RNA, 13 nt, Haemophilus influenzae Rd
uauguuuugccaa

SEQ ID NO: 695297 - RNA, 20 nt, Haemophilus influenzae Rd
uauguuucucucuauucauc

SEQ ID NO: 695298 - RNA, 13 nt, Haemophilus influenzae Rd
uauuaaaauauuu

SEQ ID NO: 695299 - RNA, 12 nt, Haemophilus influenzae Rd
uauuaaacaaaa

SEQ ID NO: 695300 - RNA, 17 nt, Haemophilus influenzae Rd
uauuaaacaaaaaccau

SEQ ID NO: 695301 - RNA, 19 nt, Haemophilus influenzae Rd
uaugguucauuauuaauug

SEQ ID NO: 695302 - RNA, 20 nt, Haemophilus influenzae Rd
uauguaguugugauuuucag

SEQ ID NO: 695303 - RNA, 16 nt, Haemophilus influenzae Rd
uauguauaauuccuaa

SEQ ID NO: 695304 - RNA, 15 nt, Haemophilus influenzae Rd
uaugugaauaaaauc

SEQ ID NO: 695305 - RNA, 23 nt, Haemophilus influenzae Rd
uaugugaauaaaaucaauaauau

SEQ ID NO: 695306 - RNA, 17 nt, Haemophilus influenzae Rd
uaugugauguaauauua

SEQ ID NO: 695307 - RNA, 20 nt, Haemophilus influenzae Rd
uaugucaauuacuguuugaa

SEQ ID NO: 695308 - RNA, 22 nt, Haemophilus influenzae Rd
ucagcggcuuucuucagccauu

SEQ ID NO: 695309 - RNA, 20 nt, Haemophilus influenzae Rd
ucagcuccuacauuaaaaga

SEQ ID NO: 695310 - RNA, 14 nt, Haemophilus influenzae Rd
ucagcgauuuuaac

SEQ ID NO: 695311 - RNA, 22 nt, Haemophilus influenzae Rd
ucagcccuuuuaguuuccccug

SEQ ID NO: 695312 - RNA, 22 nt, Haemophilus influenzae Rd
ucagcgcagcaauuaauaauaa

SEQ ID NO: 695313 - RNA, 15 nt, Haemophilus influenzae Rd
ucagcgcauuuuuua

SEQ ID NO: 695314 - RNA, 19 nt, Haemophilus influenzae Rd
ucagccaauuuuucaaaac

SEQ ID NO: 695315 - RNA, 13 nt, Haemophilus influenzae Rd
ucagcaauuaauu

SEQ ID NO: 695316 - RNA, 18 nt, Haemophilus influenzae Rd
ucagcacuugcaucuaaa

SEQ ID NO: 695317 - RNA, 20 nt, Haemophilus influenzae Rd
ucagcacuaauuuguggaaa

SEQ ID NO: 695318 - RNA, 21 nt, Haemophilus influenzae Rd
ucagcacgauaaccaucagcu

SEQ ID NO: 695319 - RNA, 16 nt, Haemophilus influenzae Rd
ucagcauaaacaaaau

SEQ ID NO: 695320 - RNA, 16 nt, Haemophilus influenzae Rd
ucagcauaaagagaau

SEQ ID NO: 695321 - RNA, 23 nt, Haemophilus influenzae Rd
ucagcagauacaucuucuggguu

SEQ ID NO: 695322 - RNA, 12 nt, Haemophilus influenzae Rd
ucagcauaccua

SEQ ID NO: 695323 - RNA, 17 nt, Haemophilus influenzae Rd
aaaucuauagauaacac

SEQ ID NO: 695324 - RNA, 23 nt, Haemophilus influenzae Rd
aaaucuagagauuguaugaaaaa

SEQ ID NO: 695325 - RNA, 15 nt, Haemophilus influenzae Rd
aaaucuacuaaaaua

SEQ ID NO: 695326 - RNA, 16 nt, Haemophilus influenzae Rd
aaaucuacuaaaauaa

SEQ ID NO: 695327 - RNA, 17 nt, Haemophilus influenzae Rd
aaaucuacuaaaauaag

SEQ ID NO: 695328 - RNA, 18 nt, Haemophilus influenzae Rd
aaaucuacuaaaauaagg

SEQ ID NO: 695329 - RNA, 18 nt, Haemophilus influenzae Rd
aaaucucucaaaaaucaa

SEQ ID NO: 695330 - RNA, 19 nt, Haemophilus influenzae Rd
aaaucucucaaaaaucaac

SEQ ID NO: 695331 - RNA, 21 nt, Haemophilus influenzae Rd
ucaggcaguagccuauaacga

SEQ ID NO: 695332 - RNA, 14 nt, Haemophilus influenzae Rd
ucaggauaaaacaa

SEQ ID NO: 695333 - RNA, 18 nt, Haemophilus influenzae Rd
ucaggaggaauaaugaau

SEQ ID NO: 695334 - RNA, 14 nt, Haemophilus influenzae Rd
ucaggcuuaacuuu

SEQ ID NO: 695335 - RNA, 18 nt, Haemophilus influenzae Rd
ucaggcuuaacuuucucu

SEQ ID NO: 695336 - RNA, 19 nt, Haemophilus influenzae Rd
ucagguauuucuucaauau

SEQ ID NO: 695337 - RNA, 16 nt, Haemophilus influenzae Rd
ucaguacgcaccacuu

SEQ ID NO: 695338 - RNA, 15 nt, Haemophilus influenzae Rd
ucagugcuuuuucaa

SEQ ID NO: 695339 - RNA, 19 nt, Haemophilus influenzae Rd
ucaguguaguuuucuguau

SEQ ID NO: 695340 - RNA, 22 nt, Haemophilus influenzae Rd
ucagacugaauuugacauuccu

SEQ ID NO: 695341 - RNA, 13 nt, Haemophilus influenzae Rd
ucagaauauaagu

SEQ ID NO: 695342 - RNA, 17 nt, Haemophilus influenzae Rd
ucagaauauaaguucuu

SEQ ID NO: 695343 - RNA, 19 nt, Haemophilus influenzae Rd
ucagaauaauuaacaaaua

SEQ ID NO: 695344 - RNA, 20 nt, Haemophilus influenzae Rd
ucagaauaauuaacaaauaa

SEQ ID NO: 695345 - RNA, 21 nt, Haemophilus influenzae Rd
ucagacauauccucaacauca

SEQ ID NO: 695346 - RNA, 17 nt, Haemophilus influenzae Rd
ucagaauuucaucuguu

SEQ ID NO: 695347 - RNA, 23 nt, Haemophilus influenzae Rd
ucagauaacguaaguaaugaaaa

SEQ ID NO: 695348 - RNA, 19 nt, Haemophilus influenzae Rd
ucagauaaucuacaaaaca

SEQ ID NO: 695349 - RNA, 12 nt, Haemophilus influenzae Rd
ucagauaaugau

SEQ ID NO: 695350 - RNA, 14 nt, Haemophilus influenzae Rd
ucagauacuuucua

SEQ ID NO: 695351 - RNA, 21 nt, Haemophilus influenzae Rd
ucagauacuuucuaauuauuu

SEQ ID NO: 695352 - RNA, 14 nt, Haemophilus influenzae Rd
ucagauucaauaau

SEQ ID NO: 695353 - RNA, 23 nt, Haemophilus influenzae Rd
ucagcaacauuauugccaauuau

SEQ ID NO: 695354 - RNA, 21 nt, Haemophilus influenzae Rd
ucagcaacgguguggaaagau

SEQ ID NO: 695355 - RNA, 15 nt, Haemophilus influenzae Rd
ucagauuuuuuucag

SEQ ID NO: 695356 - RNA, 14 nt, Haemophilus influenzae Rd
ucagauuuuucgca

SEQ ID NO: 695357 - RNA, 21 nt, Haemophilus influenzae Rd
ucagauuuuucgcauuuuaac

SEQ ID NO: 695358 - RNA, 17 nt, Haemophilus influenzae Rd
aaaucuaauuuugccau

SEQ ID NO: 695359 - RNA, 17 nt, Haemophilus influenzae Rd
ucagauuuauaaauagg

SEQ ID NO: 695360 - RNA, 14 nt, Haemophilus influenzae Rd
aaaucuaacauuuc

SEQ ID NO: 695361 - RNA, 15 nt, Haemophilus influenzae Rd
aaaucuaagccuugu

SEQ ID NO: 695362 - RNA, 13 nt, Haemophilus influenzae Rd
aaaucuaaaaaua

SEQ ID NO: 695363 - RNA, 13 nt, Haemophilus influenzae Rd
aaaucuaaugccu

SEQ ID NO: 695364 - RNA, 16 nt, Haemophilus influenzae Rd
aaaucguaauuaaaau

SEQ ID NO: 695365 - RNA, 16 nt, Haemophilus influenzae Rd
aaaucguaauuuuaaa

SEQ ID NO: 695366 - RNA, 21 nt, Haemophilus influenzae Rd
aaaucguaauuuuaaaaccac

SEQ ID NO: 695367 - RNA, 16 nt, Haemophilus influenzae Rd
ucacuguaaauaauag

SEQ ID NO: 695368 - RNA, 16 nt, Haemophilus influenzae Rd
ucacuguauuggaaaa

SEQ ID NO: 695369 - RNA, 11 nt, Haemophilus influenzae Rd
ucacugcaucu

SEQ ID NO: 695370 - RNA, 21 nt, Haemophilus influenzae Rd
ucacugcaucuguugugaaug

SEQ ID NO: 695371 - RNA, 21 nt, Haemophilus influenzae Rd
ucacuucaggguuuucaucau

SEQ ID NO: 695372 - RNA, 17 nt, Haemophilus influenzae Rd
ucacuuucacauaaauu

SEQ ID NO: 695373 - RNA, 17 nt, Haemophilus influenzae Rd
ucacuugauaaaaauga

SEQ ID NO: 695374 - RNA, 21 nt, Haemophilus influenzae Rd
ucacuugauaaaaaugagauu

SEQ ID NO: 695375 - RNA, 23 nt, Haemophilus influenzae Rd
ucacuuggcgaaaaucaucauau

SEQ ID NO: 695376 - RNA, 21 nt, Haemophilus influenzae Rd
ucacuuggcguaaauccugcu

SEQ ID NO: 695377 - RNA, 17 nt, Haemophilus influenzae Rd
ucagaacaagcauuuuu

SEQ ID NO: 695378 - RNA, 18 nt, Haemophilus influenzae Rd
ucagaaagacuaauagcc

SEQ ID NO: 695379 - RNA, 18 nt, Haemophilus influenzae Rd
ucagaaauaucuucaauu

SEQ ID NO: 695380 - RNA, 11 nt, Haemophilus influenzae Rd
ucagaaaauaa

SEQ ID NO: 695381 - RNA, 14 nt, Haemophilus influenzae Rd
ucagaaaauaaaua

SEQ ID NO: 695382 - RNA, 17 nt, Haemophilus influenzae Rd
ucagaaaauaaauaagg

SEQ ID NO: 695383 - RNA, 20 nt, Haemophilus influenzae Rd
ucacuuuguacaccaaaaua

SEQ ID NO: 695384 - RNA, 17 nt, Haemophilus influenzae Rd
ucacuuucauccucucg

SEQ ID NO: 695385 - RNA, 18 nt, Haemophilus influenzae Rd
ucacguaguuaaaccaaa

SEQ ID NO: 695386 - RNA, 15 nt, Haemophilus influenzae Rd
ucacuagauuuucuu

SEQ ID NO: 695387 - RNA, 23 nt, Haemophilus influenzae Rd
ucacuagccauaaauaaaucaau

SEQ ID NO: 695388 - RNA, 15 nt, Haemophilus influenzae Rd
ucacguuuauccugu

SEQ ID NO: 695389 - RNA, 15 nt, Haemophilus influenzae Rd
ucacuauaacuuuuc

SEQ ID NO: 695390 - RNA, 17 nt, Haemophilus influenzae Rd
ucacuauaacuuuucaa

SEQ ID NO: 695391 - RNA, 14 nt, Haemophilus influenzae Rd
ucacgugaaucaca

SEQ ID NO: 695392 - RNA, 17 nt, Haemophilus influenzae Rd
ucacgggcaauucaguu

SEQ ID NO: 695393 - RNA, 20 nt, Haemophilus influenzae Rd
ucacgcccaaauacuucacu

SEQ ID NO: 695394 - RNA, 16 nt, Haemophilus influenzae Rd
ucaaaucaaauuuucc

SEQ ID NO: 695395 - RNA, 16 nt, Haemophilus influenzae Rd
ucaaagcguuuuaaaa

SEQ ID NO: 695396 - RNA, 18 nt, Haemophilus influenzae Rd
ucaaagauuauuuaaucu

SEQ ID NO: 695397 - RNA, 21 nt, Haemophilus influenzae Rd
ucaaagauguuccuacagaac

SEQ ID NO: 695398 - RNA, 15 nt, Haemophilus influenzae Rd
ucaaacugugcuucu

SEQ ID NO: 695399 - RNA, 14 nt, Haemophilus influenzae Rd
ucaaacugaucaua

SEQ ID NO: 695400 - RNA, 15 nt, Haemophilus influenzae Rd
ucaaacugaucauaa

SEQ ID NO: 695401 - RNA, 14 nt, Haemophilus influenzae Rd
ucaaauuucuucac

SEQ ID NO: 695402 - RNA, 16 nt, Haemophilus influenzae Rd
ucaaauuucauccuaa

SEQ ID NO: 695403 - RNA, 17 nt, Haemophilus influenzae Rd
ucaaauuugaucuuaga

SEQ ID NO: 695404 - RNA, 14 nt, Haemophilus influenzae Rd
ucaaauuuuucaca

SEQ ID NO: 695405 - RNA, 23 nt, Haemophilus influenzae Rd
ucaaauuuuuguugauaaacaua

SEQ ID NO: 695406 - RNA, 13 nt, Haemophilus influenzae Rd
ucaacaaaaauac

SEQ ID NO: 695407 - RNA, 15 nt, Haemophilus influenzae Rd
ucaacaaaaauacgu

SEQ ID NO: 695408 - RNA, 23 nt, Haemophilus influenzae Rd
ucaacaaaaauacguuguuuuuc

SEQ ID NO: 695409 - RNA, 17 nt, Haemophilus influenzae Rd
ucaaauucucuguuucu

SEQ ID NO: 695410 - RNA, 21 nt, Haemophilus influenzae Rd
ucaaauucucuguuucuuuaa

SEQ ID NO: 695411 - RNA, 13 nt, Haemophilus influenzae Rd
ucaaauugaucaa

SEQ ID NO: 695412 - RNA, 17 nt, Haemophilus influenzae Rd
ucaaauugaugcucugc

SEQ ID NO: 695413 - RNA, 13 nt, Haemophilus influenzae Rd
ucaaauugauuaa

SEQ ID NO: 695414 - RNA, 14 nt, Haemophilus influenzae Rd
ucaaauugcaaaaa

SEQ ID NO: 695415 - RNA, 11 nt, Haemophilus influenzae Rd
ucaaauuucaa

SEQ ID NO: 695416 - RNA, 15 nt, Haemophilus influenzae Rd
ucaaaugcuuugacu

SEQ ID NO: 695417 - RNA, 18 nt, Haemophilus influenzae Rd
ucaaaugccgcuaauggu

SEQ ID NO: 695418 - RNA, 22 nt, Haemophilus influenzae Rd
ucaaaugugaccgcuuguuuau

SEQ ID NO: 695419 - RNA, 22 nt, Haemophilus influenzae Rd
ucaaauuaaccgcacuuucauu

SEQ ID NO: 695420 - RNA, 23 nt, Haemophilus influenzae Rd
ucaaauuaaccgcacuuucauuc

SEQ ID NO: 695421 - RNA, 13 nt, Haemophilus influenzae Rd
ucaaauuaauuua

SEQ ID NO: 695422 - RNA, 14 nt, Haemophilus influenzae Rd
ucaaauuaauuuaa

SEQ ID NO: 695423 - RNA, 21 nt, Haemophilus influenzae Rd
ucaaauucacgucgaaucuga

SEQ ID NO: 695424 - RNA, 17 nt, Haemophilus influenzae Rd
ucaaauucagucuuaau

SEQ ID NO: 695425 - RNA, 19 nt, Haemophilus influenzae Rd
ucaaauucagucuuaauuu

SEQ ID NO: 695426 - RNA, 13 nt, Haemophilus influenzae Rd
ucaaauucuacau

SEQ ID NO: 695427 - RNA, 14 nt, Haemophilus influenzae Rd
ucaaauucuaaaac

SEQ ID NO: 695428 - RNA, 16 nt, Haemophilus influenzae Rd
ucaaauucuaaaacaa

SEQ ID NO: 695429 - RNA, 23 nt, Haemophilus influenzae Rd
ucaaacguuaaaucacuuucauu

SEQ ID NO: 695430 - RNA, 21 nt, Haemophilus influenzae Rd
ucaaacaggcuuauuaaaaac

SEQ ID NO: 695431 - RNA, 23 nt, Haemophilus influenzae Rd
ucaaacaggcuuauuaaaaacua

SEQ ID NO: 695432 - RNA, 13 nt, Haemophilus influenzae Rd
ucaaacacaacau

SEQ ID NO: 695433 - RNA, 11 nt, Haemophilus influenzae Rd
ucaaacaacaa

SEQ ID NO: 695434 - RNA, 19 nt, Haemophilus influenzae Rd
ucaaaauugaucgaaaaau

SEQ ID NO: 695435 - RNA, 16 nt, Haemophilus influenzae Rd
ucaaaauugaugaaaa

SEQ ID NO: 695436 - RNA, 17 nt, Haemophilus influenzae Rd
ucaaaauugaugaaaau

SEQ ID NO: 695437 - RNA, 22 nt, Haemophilus influenzae Rd
ucaaaauugaugaaaauucucu

SEQ ID NO: 695438 - RNA, 23 nt, Haemophilus influenzae Rd
ucaaaaugaaaacuaugcucuac

SEQ ID NO: 695439 - RNA, 15 nt, Haemophilus influenzae Rd
ucaaaauccauaauu

SEQ ID NO: 695440 - RNA, 22 nt, Haemophilus influenzae Rd
ucaaaagaaaagaugaaugaac

SEQ ID NO: 695441 - RNA, 15 nt, Haemophilus influenzae Rd
ucaaaacuugcuaca

SEQ ID NO: 695442 - RNA, 20 nt, Haemophilus influenzae Rd
ucaaaacuuggcaauucaaa

SEQ ID NO: 695443 - RNA, 16 nt, Haemophilus influenzae Rd
ucaaaagaauuaaaaa

SEQ ID NO: 695444 - RNA, 22 nt, Haemophilus influenzae Rd
uauuuaauguguagauaaaaua

SEQ ID NO: 695445 - RNA, 13 nt, Haemophilus influenzae Rd
uauuuaauacgaa

SEQ ID NO: 695446 - RNA, 22 nt, Haemophilus influenzae Rd
uauuuaauacgaacuaaaagga

SEQ ID NO: 695447 - RNA, 19 nt, Haemophilus influenzae Rd
uauuuaauuucaaaaucac

SEQ ID NO: 695448 - RNA, 13 nt, Haemophilus influenzae Rd
uauuuaauuucgc

SEQ ID NO: 695449 - RNA, 19 nt, Haemophilus influenzae Rd
ucaaaacuaucaaaaucaa

SEQ ID NO: 695450 - RNA, 15 nt, Haemophilus influenzae Rd
ucaaccauaacaaga

SEQ ID NO: 695451 - RNA, 18 nt, Haemophilus influenzae Rd
ucaaccauuaaauaggca

SEQ ID NO: 695452 - RNA, 18 nt, Haemophilus influenzae Rd
ucaaccacuucagcagau

SEQ ID NO: 695453 - RNA, 20 nt, Haemophilus influenzae Rd
ucaacauucacuaacaaaua

SEQ ID NO: 695454 - RNA, 19 nt, Haemophilus influenzae Rd
ucaacaguaaauuuuucca

SEQ ID NO: 695455 - RNA, 18 nt, Haemophilus influenzae Rd
ucaacaauucauaaauaa

SEQ ID NO: 695456 - RNA, 18 nt, Haemophilus influenzae Rd
ucaacaauuucugcauaa

SEQ ID NO: 695457 - RNA, 14 nt, Haemophilus influenzae Rd
ucaacaagacucuc

SEQ ID NO: 695458 - RNA, 14 nt, Haemophilus influenzae Rd
ucaacaaucacuuc

SEQ ID NO: 695459 - RNA, 18 nt, Haemophilus influenzae Rd
ucaacaauaauuuuuaau

SEQ ID NO: 695460 - RNA, 20 nt, Haemophilus influenzae Rd
ucaacaauaauuuuuaauuc

SEQ ID NO: 695461 - RNA, 16 nt, Haemophilus influenzae Rd
ucaacaaaugucauug

SEQ ID NO: 695462 - RNA, 23 nt, Haemophilus influenzae Rd
ucaacaaaugucauugauggcuc

SEQ ID NO: 695463 - RNA, 21 nt, Haemophilus influenzae Rd
ucaacacaccuauuuuuuccu

SEQ ID NO: 695464 - RNA, 22 nt, Haemophilus influenzae Rd
ucaacacaccuauuuuuuccug

SEQ ID NO: 695465 - RNA, 16 nt, Haemophilus influenzae Rd
ucaacaccgcaaaaau

SEQ ID NO: 695466 - RNA, 21 nt, Haemophilus influenzae Rd
ucaacaccgcaaaaauacuaa

SEQ ID NO: 695467 - RNA, 12 nt, Haemophilus influenzae Rd
ucaacaccuaau

SEQ ID NO: 695468 - RNA, 20 nt, Haemophilus influenzae Rd
ucaacuaaaggcacaaaaaa

SEQ ID NO: 695469 - RNA, 22 nt, Haemophilus influenzae Rd
ucaacuaaaggcacaaaaaauu

SEQ ID NO: 695470 - RNA, 13 nt, Haemophilus influenzae Rd
ucaacuaaaaaau

SEQ ID NO: 695471 - RNA, 14 nt, Haemophilus influenzae Rd
ucaacuaaaaaaua

SEQ ID NO: 695472 - RNA, 22 nt, Haemophilus influenzae Rd
ucaacuaaaaaauaguuaauaa

SEQ ID NO: 695473 - RNA, 22 nt, Haemophilus influenzae Rd
ucaacgcgccacgguaaaucug

SEQ ID NO: 695474 - RNA, 14 nt, Haemophilus influenzae Rd
ucaacgcuuuucgu

SEQ ID NO: 695475 - RNA, 15 nt, Haemophilus influenzae Rd
ucaacgcuuuucguu

SEQ ID NO: 695476 - RNA, 18 nt, Haemophilus influenzae Rd
ucaacuugauugauaaau

SEQ ID NO: 695477 - RNA, 15 nt, Haemophilus influenzae Rd
ucaacuugccacagu

SEQ ID NO: 695478 - RNA, 17 nt, Haemophilus influenzae Rd
ucaacuugccagcagaa

SEQ ID NO: 695479 - RNA, 17 nt, Haemophilus influenzae Rd
ucaacuuggaaaggcac

SEQ ID NO: 695480 - RNA, 19 nt, Haemophilus influenzae Rd
ucaacuaauuuauuaaaaa

SEQ ID NO: 695481 - RNA, 14 nt, Haemophilus influenzae Rd
ucaaccauuuguug

SEQ ID NO: 695482 - RNA, 20 nt, Haemophilus influenzae Rd
ucaaccauuuucucugcgau

SEQ ID NO: 695483 - RNA, 17 nt, Haemophilus influenzae Rd
ucaaccguacacgcgca

SEQ ID NO: 695484 - RNA, 13 nt, Haemophilus influenzae Rd
ucaacgccacuca

SEQ ID NO: 695485 - RNA, 15 nt, Haemophilus influenzae Rd
ucaacgacuaaaauu

SEQ ID NO: 695486 - RNA, 19 nt, Haemophilus influenzae Rd
ucaacgacaauuaaaguaa

SEQ ID NO: 695487 - RNA, 14 nt, Haemophilus influenzae Rd
ucaauugcaaaauc

SEQ ID NO: 695488 - RNA, 17 nt, Haemophilus influenzae Rd
ucaauucuuuuuguaau

SEQ ID NO: 695489 - RNA, 19 nt, Haemophilus influenzae Rd
ucaauuccuucaaauucua

SEQ ID NO: 695490 - RNA, 21 nt, Haemophilus influenzae Rd
ucaauuuacccacuucauaua

SEQ ID NO: 695491 - RNA, 10 nt, Haemophilus influenzae Rd
ucaauuucaa

SEQ ID NO: 695492 - RNA, 20 nt, Haemophilus influenzae Rd
ucaauugggguaucgacagu

SEQ ID NO: 695493 - RNA, 14 nt, Haemophilus influenzae Rd
ucaauuuaauaauc

SEQ ID NO: 695494 - RNA, 21 nt, Haemophilus influenzae Rd
ucaauuuaauaaucuuaaaua

SEQ ID NO: 695495 - RNA, 16 nt, Haemophilus influenzae Rd
ucaauguuaagugaau

SEQ ID NO: 695496 - RNA, 22 nt, Haemophilus influenzae Rd
ucaaugguuuauaacaaguuag

SEQ ID NO: 695497 - RNA, 16 nt, Haemophilus influenzae Rd
ucaaucauaucaucaa

SEQ ID NO: 695498 - RNA, 17 nt, Haemophilus influenzae Rd
ucaaucauaucaucaac

SEQ ID NO: 695499 - RNA, 14 nt, Haemophilus influenzae Rd
ucaaucauuucuaa

SEQ ID NO: 695500 - RNA, 18 nt, Haemophilus influenzae Rd
ucaaucaggcuuucauuu

SEQ ID NO: 695501 - RNA, 20 nt, Haemophilus influenzae Rd
ucaaucaggcuuucauuuuc

SEQ ID NO: 695502 - RNA, 22 nt, Haemophilus influenzae Rd
ucaaugaguggucguuuugauu

SEQ ID NO: 695503 - RNA, 14 nt, Haemophilus influenzae Rd
ucaaugcaaauuaa

SEQ ID NO: 695504 - RNA, 20 nt, Haemophilus influenzae Rd
ucaauaacucuauaaaauga

SEQ ID NO: 695505 - RNA, 18 nt, Haemophilus influenzae Rd
ucaauaacugaucgccau

SEQ ID NO: 695506 - RNA, 19 nt, Haemophilus influenzae Rd
ucaauaauagccauauuau

SEQ ID NO: 695507 - RNA, 20 nt, Haemophilus influenzae Rd
ucaauaaggcuuuuuuaauu

SEQ ID NO: 695508 - RNA, 22 nt, Haemophilus influenzae Rd
ucaauaauguuaccgacaacca

SEQ ID NO: 695509 - RNA, 20 nt, Haemophilus influenzae Rd
ucaauaauucauuagaaagu

SEQ ID NO: 695510 - RNA, 11 nt, Haemophilus influenzae Rd
ucaauaaaaau

SEQ ID NO: 695511 - RNA, 13 nt, Haemophilus influenzae Rd
ucaauaaaaauaa

SEQ ID NO: 695512 - RNA, 16 nt, Haemophilus influenzae Rd
ucaaguuuguggagua

SEQ ID NO: 695513 - RNA, 19 nt, Haemophilus influenzae Rd
ucaaguuuguggaguaauu

SEQ ID NO: 695514 - RNA, 13 nt, Haemophilus influenzae Rd
ucaauaaaaauau

SEQ ID NO: 695515 - RNA, 20 nt, Haemophilus influenzae Rd
ucaaguuuaucguauuccca

SEQ ID NO: 695516 - RNA, 15 nt, Haemophilus influenzae Rd
ucaauaaauaucuaa

SEQ ID NO: 695517 - RNA, 14 nt, Haemophilus influenzae Rd
ucaauacgccuaaa

SEQ ID NO: 695518 - RNA, 16 nt, Haemophilus influenzae Rd
ucaauacguuuaauau

SEQ ID NO: 695519 - RNA, 16 nt, Haemophilus influenzae Rd
ucaauacuuauauuau

SEQ ID NO: 695520 - RNA, 13 nt, Haemophilus influenzae Rd
ucaauaauuuuca

SEQ ID NO: 695521 - RNA, 14 nt, Haemophilus influenzae Rd
ucaauaauuuucac

SEQ ID NO: 695522 - RNA, 18 nt, Haemophilus influenzae Rd
ucaauacaacaagaaauu

SEQ ID NO: 695523 - RNA, 16 nt, Haemophilus influenzae Rd
ucaauagccaauaaua

SEQ ID NO: 695524 - RNA, 19 nt, Haemophilus influenzae Rd
ucaauagccuguaaauuua

SEQ ID NO: 695525 - RNA, 21 nt, Haemophilus influenzae Rd
ucaauauaaguuguaggaugu

SEQ ID NO: 695526 - RNA, 23 nt, Haemophilus influenzae Rd
ucaauaucccaacuuuaugucca

SEQ ID NO: 695527 - RNA, 19 nt, Haemophilus influenzae Rd
ucaauaucaaagaaaaauu

SEQ ID NO: 695528 - RNA, 15 nt, Haemophilus influenzae Rd
ucaauauaaucaauu

SEQ ID NO: 695529 - RNA, 17 nt, Haemophilus influenzae Rd
ucacagccgcauuuuua

SEQ ID NO: 695530 - RNA, 18 nt, Haemophilus influenzae Rd
ucacagcaagaacagcca

SEQ ID NO: 695531 - RNA, 20 nt, Haemophilus influenzae Rd
ucacaaaauggcaaacaaaa

SEQ ID NO: 695532 - RNA, 23 nt, Haemophilus influenzae Rd
ucacaaaauggcaaacaaaauaa

SEQ ID NO: 695533 - RNA, 20 nt, Haemophilus influenzae Rd
ucacaaaacaacgaauaucc

SEQ ID NO: 695534 - RNA, 20 nt, Haemophilus influenzae Rd
ucaauuuuuuaucaaauaac

SEQ ID NO: 695535 - RNA, 17 nt, Haemophilus influenzae Rd
ucaauuuuuucaaauaa

SEQ ID NO: 695536 - RNA, 20 nt, Haemophilus influenzae Rd
ucaauuuuuucuccacaaac

SEQ ID NO: 695537 - RNA, 20 nt, Haemophilus influenzae Rd
aaaucgcacucacaauacca

SEQ ID NO: 695538 - RNA, 21 nt, Haemophilus influenzae Rd
aaaucgcacucacaauaccaa

SEQ ID NO: 695539 - RNA, 15 nt, Haemophilus influenzae Rd
aaaucgcaauauuaa

SEQ ID NO: 695540 - RNA, 16 nt, Haemophilus influenzae Rd
aaaucgcaauauuaaa

SEQ ID NO: 695541 - RNA, 18 nt, Haemophilus influenzae Rd
aaaucgcaauauuaaaca

SEQ ID NO: 695542 - RNA, 16 nt, Haemophilus influenzae Rd
aaaucgauuacucugc

SEQ ID NO: 695543 - RNA, 13 nt, Haemophilus influenzae Rd
ucacauaauaaac

SEQ ID NO: 695544 - RNA, 15 nt, Haemophilus influenzae Rd
aaaucgaucacuuaa

SEQ ID NO: 695545 - RNA, 19 nt, Haemophilus influenzae Rd
ucacaguuuuauuuuccau

SEQ ID NO: 695546 - RNA, 15 nt, Haemophilus influenzae Rd
ucacauaaaaaauga

SEQ ID NO: 695547 - RNA, 21 nt, Haemophilus influenzae Rd
ucacauaauaaacauacaucu

SEQ ID NO: 695548 - RNA, 22 nt, Haemophilus influenzae Rd
ucacauaauaaacauacaucua

SEQ ID NO: 695549 - RNA, 17 nt, Haemophilus influenzae Rd
aaaucggcguauuuuac

SEQ ID NO: 695550 - RNA, 18 nt, Haemophilus influenzae Rd
aaaucggcguauuuuaca

SEQ ID NO: 695551 - RNA, 18 nt, Haemophilus influenzae Rd
aaaucgcugggauuuugu

SEQ ID NO: 695552 - RNA, 17 nt, Haemophilus influenzae Rd
aaaucgccugacauuuu

SEQ ID NO: 695553 - RNA, 13 nt, Haemophilus influenzae Rd
ucaccaucacaag

SEQ ID NO: 695554 - RNA, 15 nt, Haemophilus influenzae Rd
ucaccauaaucaaaa

SEQ ID NO: 695555 - RNA, 18 nt, Haemophilus influenzae Rd
ucacaucagcaaucauuu

SEQ ID NO: 695556 - RNA, 15 nt, Haemophilus influenzae Rd
ucaccaccagauaag

SEQ ID NO: 695557 - RNA, 22 nt, Haemophilus influenzae Rd
uaaagccacauaauaagaaagu

SEQ ID NO: 695558 - RNA, 17 nt, Haemophilus influenzae Rd
uaaagcuauaaguaacu

SEQ ID NO: 695559 - RNA, 13 nt, Haemophilus influenzae Rd
uaaagcucagcca

SEQ ID NO: 695560 - RNA, 17 nt, Haemophilus influenzae Rd
uaaagcuacuaaaaauu

SEQ ID NO: 695561 - RNA, 15 nt, Haemophilus influenzae Rd
uaaagcucuaauuga

SEQ ID NO: 695562 - RNA, 20 nt, Haemophilus influenzae Rd
uaaagcugaauaaauaaacc

SEQ ID NO: 695563 - RNA, 19 nt, Haemophilus influenzae Rd
uaaagcugaccgcacuuuu

SEQ ID NO: 695564 - RNA, 21 nt, Haemophilus influenzae Rd
uaaagcuucauuugcuuuaac

SEQ ID NO: 695565 - RNA, 20 nt, Haemophilus influenzae Rd
uaaagauggacguguugugg

SEQ ID NO: 695566 - RNA, 15 nt, Haemophilus influenzae Rd
uaaagauuauuuaua

SEQ ID NO: 695567 - RNA, 21 nt, Haemophilus influenzae Rd
uaaagcaucgcuagacggucg

SEQ ID NO: 695568 - RNA, 18 nt, Haemophilus influenzae Rd
uaaagucgguuuuuucau

SEQ ID NO: 695569 - RNA, 18 nt, Haemophilus influenzae Rd
uaaaguauucauauaauu

SEQ ID NO: 695570 - RNA, 22 nt, Haemophilus influenzae Rd
uaaaguauucauauaauucauu

SEQ ID NO: 695571 - RNA, 18 nt, Haemophilus influenzae Rd
uaaaguaaauuuuaaaau

SEQ ID NO: 695572 - RNA, 15 nt, Haemophilus influenzae Rd
uaaaguaagaauuag

SEQ ID NO: 695573 - RNA, 19 nt, Haemophilus influenzae Rd
uaaaguaaacccuuuagca

SEQ ID NO: 695574 - RNA, 21 nt, Haemophilus influenzae Rd
uaaagugcggucaauuuucaa

SEQ ID NO: 695575 - RNA, 20 nt, Haemophilus influenzae Rd
uaaagugcgguuauuuuauu

SEQ ID NO: 695576 - RNA, 17 nt, Haemophilus influenzae Rd
uaaagugaccgccuuua

SEQ ID NO: 695577 - RNA, 23 nt, Haemophilus influenzae Rd
uaaagugcagauuuuuuuauaaa

SEQ ID NO: 695578 - RNA, 13 nt, Haemophilus influenzae Rd
uaaaguuacacaa

SEQ ID NO: 695579 - RNA, 18 nt, Haemophilus influenzae Rd
uaaaguguggauuuugua

SEQ ID NO: 695580 - RNA, 21 nt, Haemophilus influenzae Rd
uaaaguguggauuuuguaaua

SEQ ID NO: 695581 - RNA, 23 nt, Haemophilus influenzae Rd
uaaaguuucuuuuacauuuggau

SEQ ID NO: 695582 - RNA, 22 nt, Haemophilus influenzae Rd
uaaaguuauuuggaauguugug

SEQ ID NO: 695583 - RNA, 13 nt, Haemophilus influenzae Rd
uaaaguucucaaa

SEQ ID NO: 695584 - RNA, 16 nt, Haemophilus influenzae Rd
uaaaucacuuucauua

SEQ ID NO: 695585 - RNA, 22 nt, Haemophilus influenzae Rd
uaaaucagaacuggcuuccaac

SEQ ID NO: 695586 - RNA, 13 nt, Haemophilus influenzae Rd
uaaauauuacuua

SEQ ID NO: 695587 - RNA, 18 nt, Haemophilus influenzae Rd
uaaauaugauaaaugcaa

SEQ ID NO: 695588 - RNA, 18 nt, Haemophilus influenzae Rd
uaaauaugccuuauauuu

SEQ ID NO: 695589 - RNA, 23 nt, Haemophilus influenzae Rd
uaaauauguugaauaguaaagaa

SEQ ID NO: 695590 - RNA, 13 nt, Haemophilus influenzae Rd
uaaauaucagccc

SEQ ID NO: 695591 - RNA, 23 nt, Haemophilus influenzae Rd
uaaauaucagcccuuuguuuuaa

SEQ ID NO: 695592 - RNA, 19 nt, Haemophilus influenzae Rd
uaaauauauuuuuauugaa

SEQ ID NO: 695593 - RNA, 22 nt, Haemophilus influenzae Rd
uaaauauccccauugaauuaaa

SEQ ID NO: 695594 - RNA, 15 nt, Haemophilus influenzae Rd
uaaauaucuaaacuu

SEQ ID NO: 695595 - RNA, 21 nt, Haemophilus influenzae Rd
uaaauaucuaaacuucaauuu

SEQ ID NO: 695596 - RNA, 20 nt, Haemophilus influenzae Rd
uaaaucauaagcaauaauuu

SEQ ID NO: 695597 - RNA, 17 nt, Haemophilus influenzae Rd
uaaaucagcgaauuaaa

SEQ ID NO: 695598 - RNA, 17 nt, Haemophilus influenzae Rd
uaaaucaugaauaauuu

SEQ ID NO: 695599 - RNA, 21 nt, Haemophilus influenzae Rd
uaaaucaucggguaaauuuag

SEQ ID NO: 695600 - RNA, 23 nt, Haemophilus influenzae Rd
uaaaucaucuaccacgauaaauc

SEQ ID NO: 695601 - RNA, 16 nt, Haemophilus influenzae Rd
uaaauaauaaauccaa

SEQ ID NO: 695602 - RNA, 22 nt, Haemophilus influenzae Rd
uaaauaauccagauaacaaacc

SEQ ID NO: 695603 - RNA, 16 nt, Haemophilus influenzae Rd
uaaauauaauuuccua

SEQ ID NO: 695604 - RNA, 17 nt, Haemophilus influenzae Rd
uaaauauaauuuccuau

SEQ ID NO: 695605 - RNA, 15 nt, Haemophilus influenzae Rd
uaaauauaaugaaaa

SEQ ID NO: 695606 - RNA, 16 nt, Haemophilus influenzae Rd
uaaauauaauuuagca

SEQ ID NO: 695607 - RNA, 14 nt, Haemophilus influenzae Rd
uaaaguuuuuucaa

SEQ ID NO: 695608 - RNA, 16 nt, Haemophilus influenzae Rd
uaaaguuuuuucaaua

SEQ ID NO: 695609 - RNA, 13 nt, Haemophilus influenzae Rd
uaaauaaaaaaua

SEQ ID NO: 695610 - RNA, 21 nt, Haemophilus influenzae Rd
uaaauaaaaaugaauaaaauu

SEQ ID NO: 695611 - RNA, 15 nt, Haemophilus influenzae Rd
uaaauaaaacaagga

SEQ ID NO: 695612 - RNA, 16 nt, Haemophilus influenzae Rd
uaaauaaaacaaggaa

SEQ ID NO: 695613 - RNA, 19 nt, Haemophilus influenzae Rd
uaaauaaaacacaguuauu

SEQ ID NO: 695614 - RNA, 23 nt, Haemophilus influenzae Rd
uaaauaaggaucuuguaaagauu

SEQ ID NO: 695615 - RNA, 20 nt, Haemophilus influenzae Rd
uaaauaaggcguaaaacuau

SEQ ID NO: 695616 - RNA, 14 nt, Haemophilus influenzae Rd
uaaauaacaucgcu

SEQ ID NO: 695617 - RNA, 20 nt, Haemophilus influenzae Rd
uaaauaaccauaucugaaaa

SEQ ID NO: 695618 - RNA, 18 nt, Haemophilus influenzae Rd
uaaacgcucaaauaaauu

SEQ ID NO: 695619 - RNA, 23 nt, Haemophilus influenzae Rd
uaaacgcucuuuaauacgagcug

SEQ ID NO: 695620 - RNA, 22 nt, Haemophilus influenzae Rd
uaaacgcugacguacaauuuca

SEQ ID NO: 695621 - RNA, 23 nt, Haemophilus influenzae Rd
uaaaccuacacccacugauuuuu

SEQ ID NO: 695622 - RNA, 19 nt, Haemophilus influenzae Rd
uaaaccgucauuuauaaaa

SEQ ID NO: 695623 - RNA, 20 nt, Haemophilus influenzae Rd
uaaaccguacaaacccacaa

SEQ ID NO: 695624 - RNA, 15 nt, Haemophilus influenzae Rd
uaaaccuaaagccaa

SEQ ID NO: 695625 - RNA, 23 nt, Haemophilus influenzae Rd
uaaacucaaugaauuaaaaguuu

SEQ ID NO: 695626 - RNA, 16 nt, Haemophilus influenzae Rd
uaaacucgaaggaaau

SEQ ID NO: 695627 - RNA, 16 nt, Haemophilus influenzae Rd
uaaacucuaagcuuaa

SEQ ID NO: 695628 - RNA, 22 nt, Haemophilus influenzae Rd
uaaacggcguaucauacuaaaa

SEQ ID NO: 695629 - RNA, 14 nt, Haemophilus influenzae Rd
uaaacggcgugcca

SEQ ID NO: 695630 - RNA, 23 nt, Haemophilus influenzae Rd
uaaacgcuguuuugcuuccuuau

SEQ ID NO: 695631 - RNA, 21 nt, Haemophilus influenzae Rd
uaaacggagcgauguuuuccc

SEQ ID NO: 695632 - RNA, 18 nt, Haemophilus influenzae Rd
uaaacggaacucuugaua

SEQ ID NO: 695633 - RNA, 14 nt, Haemophilus influenzae Rd
uaaagauaaauuau

SEQ ID NO: 695634 - RNA, 15 nt, Haemophilus influenzae Rd
uaaagauaaauuaua

SEQ ID NO: 695635 - RNA, 19 nt, Haemophilus influenzae Rd
uaaagauaaggacgaagga

SEQ ID NO: 695636 - RNA, 18 nt, Haemophilus influenzae Rd
uaaagagugaccagucau

SEQ ID NO: 695637 - RNA, 17 nt, Haemophilus influenzae Rd
uaaagaguguuauaaag

SEQ ID NO: 695638 - RNA, 21 nt, Haemophilus influenzae Rd
uaaagaguguuauaaagcucu

SEQ ID NO: 695639 - RNA, 23 nt, Haemophilus influenzae Rd
uaaagaguucguccaaaaucucu

SEQ ID NO: 695640 - RNA, 18 nt, Haemophilus influenzae Rd
uaaagaauuucuuucgcu

SEQ ID NO: 695641 - RNA, 17 nt, Haemophilus influenzae Rd
uaaagaauaauuuucaa

SEQ ID NO: 695642 - RNA, 16 nt, Haemophilus influenzae Rd
uaaagaauacuuaaua

SEQ ID NO: 695643 - RNA, 16 nt, Haemophilus influenzae Rd
uaaagaauauuuuaau

SEQ ID NO: 695644 - RNA, 18 nt, Haemophilus influenzae Rd
uaaagaaucaaauucacg

SEQ ID NO: 695645 - RNA, 14 nt, Haemophilus influenzae Rd
uaaacuuaccuaaa

SEQ ID NO: 695646 - RNA, 14 nt, Haemophilus influenzae Rd
uaaacugauuuuga

SEQ ID NO: 695647 - RNA, 15 nt, Haemophilus influenzae Rd
uaaacugauuuugau

SEQ ID NO: 695648 - RNA, 16 nt, Haemophilus influenzae Rd
uaaacugauuuugauu

SEQ ID NO: 695649 - RNA, 16 nt, Haemophilus influenzae Rd
uaaacugacagaagac

SEQ ID NO: 695650 - RNA, 19 nt, Haemophilus influenzae Rd
uaaacuggguuuuauuuua

SEQ ID NO: 695651 - RNA, 18 nt, Haemophilus influenzae Rd
uaaacuggaugaaaucau

SEQ ID NO: 695652 - RNA, 19 nt, Haemophilus influenzae Rd
uaaacuggaugaaaucauu

SEQ ID NO: 695653 - RNA, 23 nt, Haemophilus influenzae Rd
guuuuucacccaucuaaacuuau

SEQ ID NO: 695654 - RNA, 12 nt, Haemophilus influenzae Rd
guuuuucaaaaa

SEQ ID NO: 695655 - RNA, 16 nt, Haemophilus influenzae Rd
guuuuucaaaaauuuu

SEQ ID NO: 695656 - RNA, 20 nt, Haemophilus influenzae Rd
guuuuucaaaaauuuuugca

SEQ ID NO: 695657 - RNA, 14 nt, Haemophilus influenzae Rd
guuuugcuguaaau

SEQ ID NO: 695658 - RNA, 18 nt, Haemophilus influenzae Rd
guuuuggcauuuucaauc

SEQ ID NO: 695659 - RNA, 21 nt, Haemophilus influenzae Rd
guuuuggcauuuucaaucccu

SEQ ID NO: 695660 - RNA, 18 nt, Haemophilus influenzae Rd
guuuuggagguaguuuag

SEQ ID NO: 695661 - RNA, 12 nt, Haemophilus influenzae Rd
guuuuuccauuc

SEQ ID NO: 695662 - RNA, 14 nt, Haemophilus influenzae Rd
guuuuuccauucac

SEQ ID NO: 695663 - RNA, 15 nt, Haemophilus influenzae Rd
uaaacaaacuuucau

SEQ ID NO: 695664 - RNA, 17 nt, Haemophilus influenzae Rd
uaaacaaacuuucauuc

SEQ ID NO: 695665 - RNA, 12 nt, Haemophilus influenzae Rd
uaaacaaagaau

SEQ ID NO: 695666 - RNA, 17 nt, Haemophilus influenzae Rd
uaaacaagauucugaaa

SEQ ID NO: 695667 - RNA, 22 nt, Haemophilus influenzae Rd
uaaacagccauggcuuuuuccu

SEQ ID NO: 695668 - RNA, 15 nt, Haemophilus influenzae Rd
uaaacagccaaacaa

SEQ ID NO: 695669 - RNA, 13 nt, Haemophilus influenzae Rd
uaaacauuucuau

SEQ ID NO: 695670 - RNA, 20 nt, Haemophilus influenzae Rd
uaaacagaaauauugucuau

SEQ ID NO: 695671 - RNA, 17 nt, Haemophilus influenzae Rd
uaaacaagcucuagaaa

SEQ ID NO: 695672 - RNA, 15 nt, Haemophilus influenzae Rd
uaaaccaacaacugc

SEQ ID NO: 695673 - RNA, 22 nt, Haemophilus influenzae Rd
uaaaccaacaacugcacagccc

SEQ ID NO: 695674 - RNA, 12 nt, Haemophilus influenzae Rd
uaaacauuuuuu

SEQ ID NO: 695675 - RNA, 14 nt, Haemophilus influenzae Rd
uaaacauuuuuuca

SEQ ID NO: 695676 - RNA, 18 nt, Haemophilus influenzae Rd
uaaaccaaacgagaaaau

SEQ ID NO: 695677 - RNA, 13 nt, Haemophilus influenzae Rd
uaaacauuuuuca

SEQ ID NO: 695678 - RNA, 16 nt, Haemophilus influenzae Rd
uaaacauuuuucauuu

SEQ ID NO: 695679 - RNA, 16 nt, Haemophilus influenzae Rd
uaaaccgccaaaaauu

SEQ ID NO: 695680 - RNA, 19 nt, Haemophilus influenzae Rd
uaaaccgccaaaaauuaau

SEQ ID NO: 695681 - RNA, 15 nt, Haemophilus influenzae Rd
uaaaugcucgaauau

SEQ ID NO: 695682 - RNA, 15 nt, Haemophilus influenzae Rd
uaaaugcuguagaaa

SEQ ID NO: 695683 - RNA, 17 nt, Haemophilus influenzae Rd
uaaaugcuguagaaauu

SEQ ID NO: 695684 - RNA, 20 nt, Haemophilus influenzae Rd
uaaaugcuguagaaauuaau

SEQ ID NO: 695685 - RNA, 18 nt, Haemophilus influenzae Rd
uaaaugcgcuuuuaauuu

SEQ ID NO: 695686 - RNA, 19 nt, Haemophilus influenzae Rd
uaaaugcgggaauagcuca

SEQ ID NO: 695687 - RNA, 21 nt, Haemophilus influenzae Rd
uaaaugcgggaauagcucagu

SEQ ID NO: 695688 - RNA, 17 nt, Haemophilus influenzae Rd
uaaaucggcuuuaucau

SEQ ID NO: 695689 - RNA, 15 nt, Haemophilus influenzae Rd
uaaauggcaucugga

SEQ ID NO: 695690 - RNA, 14 nt, Haemophilus influenzae Rd
uaaaugcuaaaauu

SEQ ID NO: 695691 - RNA, 15 nt, Haemophilus influenzae Rd
uaaauggcucaagua

SEQ ID NO: 695692 - RNA, 17 nt, Haemophilus influenzae Rd
uaaauggcucaaguauu

SEQ ID NO: 695693 - RNA, 18 nt, Haemophilus influenzae Rd
uaaauccaucaauucuuc

SEQ ID NO: 695694 - RNA, 19 nt, Haemophilus influenzae Rd
uaaaucccccaaucccuca

SEQ ID NO: 695695 - RNA, 17 nt, Haemophilus influenzae Rd
uaaaucgccuucacaua

SEQ ID NO: 695696 - RNA, 22 nt, Haemophilus influenzae Rd
uaaauccucagcaauuucuuca

SEQ ID NO: 695697 - RNA, 21 nt, Haemophilus influenzae Rd
uaaauccuucaggauaaaaca

SEQ ID NO: 695698 - RNA, 22 nt, Haemophilus influenzae Rd
uaaauccuucaggauaaaacaa

SEQ ID NO: 695699 - RNA, 14 nt, Haemophilus influenzae Rd
uaaauccuucgccg

SEQ ID NO: 695700 - RNA, 13 nt, Haemophilus influenzae Rd
uaaauucauuuaa

SEQ ID NO: 695701 - RNA, 22 nt, Haemophilus influenzae Rd
uaaauucauuuaaaauauauau

SEQ ID NO: 695702 - RNA, 21 nt, Haemophilus influenzae Rd
uaaauucacugacaucaagca

SEQ ID NO: 695703 - RNA, 13 nt, Haemophilus influenzae Rd
uaaauucacugug

SEQ ID NO: 695704 - RNA, 15 nt, Haemophilus influenzae Rd
uaaauucaaucgcuu

SEQ ID NO: 695705 - RNA, 17 nt, Haemophilus influenzae Rd
uaaauucaguuaagaaa

SEQ ID NO: 695706 - RNA, 16 nt, Haemophilus influenzae Rd
uaaauucuguuuaguc

SEQ ID NO: 695707 - RNA, 18 nt, Haemophilus influenzae Rd
uaaauucggaauauucaa

SEQ ID NO: 695708 - RNA, 20 nt, Haemophilus influenzae Rd
uaaauucucaagaauauauu

SEQ ID NO: 695709 - RNA, 21 nt, Haemophilus influenzae Rd
uaaauucucaagaauauauuu

SEQ ID NO: 695710 - RNA, 14 nt, Haemophilus influenzae Rd
uaaauuauuuuaau

SEQ ID NO: 695711 - RNA, 16 nt, Haemophilus influenzae Rd
uaaauuauuaaauagc

SEQ ID NO: 695712 - RNA, 15 nt, Haemophilus influenzae Rd
uaaauuauucugcaa

SEQ ID NO: 695713 - RNA, 16 nt, Haemophilus influenzae Rd
uaaauuaauuacuguc

SEQ ID NO: 695714 - RNA, 20 nt, Haemophilus influenzae Rd
uaaauuauguuuacggaugc

SEQ ID NO: 695715 - RNA, 11 nt, Haemophilus influenzae Rd
uaaauuaaauu

SEQ ID NO: 695716 - RNA, 15 nt, Haemophilus influenzae Rd
uaaauuaauaagcca

SEQ ID NO: 695717 - RNA, 15 nt, Haemophilus influenzae Rd
uaaauuaaaaagacu

SEQ ID NO: 695718 - RNA, 13 nt, Haemophilus influenzae Rd
uaaauuaaaaaga

SEQ ID NO: 695719 - RNA, 17 nt, Haemophilus influenzae Rd
uaacaacucacaauaau

SEQ ID NO: 695720 - RNA, 15 nt, Haemophilus influenzae Rd
uaacaaaauggcuuu

SEQ ID NO: 695721 - RNA, 15 nt, Haemophilus influenzae Rd
uaacaacuaaaaauc

SEQ ID NO: 695722 - RNA, 14 nt, Haemophilus influenzae Rd
uaaauuuuuuugau

SEQ ID NO: 695723 - RNA, 17 nt, Haemophilus influenzae Rd
uaaauuuuuuugcauuu

SEQ ID NO: 695724 - RNA, 17 nt, Haemophilus influenzae Rd
uaacaaaaacaaucacu

SEQ ID NO: 695725 - RNA, 20 nt, Haemophilus influenzae Rd
uaacaaaaacaaucacugaa

SEQ ID NO: 695726 - RNA, 20 nt, Haemophilus influenzae Rd
uaacaaaagugcgguaaaaa

SEQ ID NO: 695727 - RNA, 23 nt, Haemophilus influenzae Rd
uaacaaaagugcgguaaaaauua

SEQ ID NO: 695728 - RNA, 13 nt, Haemophilus influenzae Rd
uaacaaaaucaau

SEQ ID NO: 695729 - RNA, 20 nt, Haemophilus influenzae Rd
uaaauuuucggcaagaaauu

SEQ ID NO: 695730 - RNA, 12 nt, Haemophilus influenzae Rd
uaaauugaaaaa

SEQ ID NO: 695731 - RNA, 14 nt, Haemophilus influenzae Rd
uaaauugaaaaaau

SEQ ID NO: 695732 - RNA, 16 nt, Haemophilus influenzae Rd
uaaauugaaaaaaucu

SEQ ID NO: 695733 - RNA, 18 nt, Haemophilus influenzae Rd
uaaauugaaaaaaucuuc

SEQ ID NO: 695734 - RNA, 19 nt, Haemophilus influenzae Rd
uaaauugaacugaauuaaa

SEQ ID NO: 695735 - RNA, 21 nt, Haemophilus influenzae Rd
uaaauugaccgcacuuguaau

SEQ ID NO: 695736 - RNA, 15 nt, Haemophilus influenzae Rd
uaaauugagauaacg

SEQ ID NO: 695737 - RNA, 19 nt, Haemophilus influenzae Rd
uaaauugagaucaaaaauc

SEQ ID NO: 695738 - RNA, 22 nt, Haemophilus influenzae Rd
uaaauuuuauuccaccacagcc

SEQ ID NO: 695739 - RNA, 17 nt, Haemophilus influenzae Rd
uaaauuuuuaauuuucu

SEQ ID NO: 695740 - RNA, 12 nt, Haemophilus influenzae Rd
uaaauuuuucca

SEQ ID NO: 695741 - RNA, 13 nt, Haemophilus influenzae Rd
uaaauuuuuccac

SEQ ID NO: 695742 - RNA, 22 nt, Haemophilus influenzae Rd
uaaauuuuuccacauuaaacug

SEQ ID NO: 695743 - RNA, 17 nt, Haemophilus influenzae Rd
uaaauuuuuuaauucag

SEQ ID NO: 695744 - RNA, 14 nt, Haemophilus influenzae Rd
uaacacgaaaccaa

SEQ ID NO: 695745 - RNA, 19 nt, Haemophilus influenzae Rd
uaacacccucaaccacuuc

SEQ ID NO: 695746 - RNA, 18 nt, Haemophilus influenzae Rd
uaacacaccgucuugcca

SEQ ID NO: 695747 - RNA, 16 nt, Haemophilus influenzae Rd
uaacacagaaaccaau

SEQ ID NO: 695748 - RNA, 12 nt, Haemophilus influenzae Rd
uaacacagaaag

SEQ ID NO: 695749 - RNA, 15 nt, Haemophilus influenzae Rd
uaacacagaugaaaa

SEQ ID NO: 695750 - RNA, 14 nt, Haemophilus influenzae Rd
uaacacaaaaucuu

SEQ ID NO: 695751 - RNA, 13 nt, Haemophilus influenzae Rd
uaacacaaccauc

SEQ ID NO: 695752 - RNA, 19 nt, Haemophilus influenzae Rd
uaacacaaccaucuucaac

SEQ ID NO: 695753 - RNA, 20 nt, Haemophilus influenzae Rd
uaacacauccguuaagaaac

SEQ ID NO: 695754 - RNA, 12 nt, Haemophilus influenzae Rd
uaacacaugcaa

SEQ ID NO: 695755 - RNA, 21 nt, Haemophilus influenzae Rd
uaacaagcucagguucaaaac

SEQ ID NO: 695756 - RNA, 16 nt, Haemophilus influenzae Rd
uaacaauaauuugcca

SEQ ID NO: 695757 - RNA, 21 nt, Haemophilus influenzae Rd
uaaccacuugucauuaaaaaa

SEQ ID NO: 695758 - RNA, 22 nt, Haemophilus influenzae Rd
uaaccacuugucauuaaaaaau

SEQ ID NO: 695759 - RNA, 18 nt, Haemophilus influenzae Rd
uaaccacuagccauugca

SEQ ID NO: 695760 - RNA, 16 nt, Haemophilus influenzae Rd
uaaccauaaaaaaugg

SEQ ID NO: 695761 - RNA, 17 nt, Haemophilus influenzae Rd
uaaccaguuauucuuca

SEQ ID NO: 695762 - RNA, 23 nt, Haemophilus influenzae Rd
uaaccaucuauauuugaguuauu

SEQ ID NO: 695763 - RNA, 14 nt, Haemophilus influenzae Rd
uaacccuaaaguga

SEQ ID NO: 695764 - RNA, 20 nt, Haemophilus influenzae Rd
uaacaucuuaguauuuuauu

SEQ ID NO: 695765 - RNA, 17 nt, Haemophilus influenzae Rd
uaacaucucuugaauac

SEQ ID NO: 695766 - RNA, 18 nt, Haemophilus influenzae Rd
uaacaugguuaaaauauu

SEQ ID NO: 695767 - RNA, 21 nt, Haemophilus influenzae Rd
uaacaugcaaaauauucuauu

SEQ ID NO: 695768 - RNA, 23 nt, Haemophilus influenzae Rd
uaaccacauauagugaaaaaaua

SEQ ID NO: 695769 - RNA, 14 nt, Haemophilus influenzae Rd
uaacacuuuuucua

SEQ ID NO: 695770 - RNA, 18 nt, Haemophilus influenzae Rd
uaacacugccaaugcagc

SEQ ID NO: 695771 - RNA, 17 nt, Haemophilus influenzae Rd
uaacgcucauaagcauu

SEQ ID NO: 695772 - RNA, 21 nt, Haemophilus influenzae Rd
uaacgcuccccuugauuauuu

SEQ ID NO: 695773 - RNA, 17 nt, Haemophilus influenzae Rd
uaacgcguacuucccgc

SEQ ID NO: 695774 - RNA, 20 nt, Haemophilus influenzae Rd
uaacgcguacuucccgcaca

SEQ ID NO: 695775 - RNA, 22 nt, Haemophilus influenzae Rd
uaacgcugcuuaaagcaaucaa

SEQ ID NO: 695776 - RNA, 13 nt, Haemophilus influenzae Rd
uaacgcuuuuaaa

SEQ ID NO: 695777 - RNA, 14 nt, Haemophilus influenzae Rd
uaacgcuuuuaaac

SEQ ID NO: 695778 - RNA, 19 nt, Haemophilus influenzae Rd
uaacggcaaaaucauuaaa

SEQ ID NO: 695779 - RNA, 17 nt, Haemophilus influenzae Rd
uaacgggcauuuuucuu

SEQ ID NO: 695780 - RNA, 21 nt, Haemophilus influenzae Rd
uaaccguucuaguuuuuccuu

SEQ ID NO: 695781 - RNA, 20 nt, Haemophilus influenzae Rd
uaaccuaauuucauaaaaau

SEQ ID NO: 695782 - RNA, 19 nt, Haemophilus influenzae Rd
uaaccuaccggaaaccagc

SEQ ID NO: 695783 - RNA, 21 nt, Haemophilus influenzae Rd
uaaccuagaacaaaaggcuuu

SEQ ID NO: 695784 - RNA, 14 nt, Haemophilus influenzae Rd
uaaccuaucaucug

SEQ ID NO: 695785 - RNA, 22 nt, Haemophilus influenzae Rd
uaacgcauuguuacaaauuccu

SEQ ID NO: 695786 - RNA, 20 nt, Haemophilus influenzae Rd
uaacgcaucaccacaaaaua

SEQ ID NO: 695787 - RNA, 23 nt, Haemophilus influenzae Rd
uaacgcaucaccacaaaauaaau

SEQ ID NO: 695788 - RNA, 19 nt, Haemophilus influenzae Rd
uaacgcccaaacggcacaa

SEQ ID NO: 695789 - RNA, 22 nt, Haemophilus influenzae Rd
uaacgcccccgccauuuugaau

SEQ ID NO: 695790 - RNA, 14 nt, Haemophilus influenzae Rd
uaacgcaaacuaca

SEQ ID NO: 695791 - RNA, 13 nt, Haemophilus influenzae Rd
uaagcaaguaauu

SEQ ID NO: 695792 - RNA, 16 nt, Haemophilus influenzae Rd
uaagcaauaauuucau

SEQ ID NO: 695793 - RNA, 17 nt, Haemophilus influenzae Rd
uaagcaauccuaagaau

SEQ ID NO: 695794 - RNA, 13 nt, Haemophilus influenzae Rd
uaagcaauuucac

SEQ ID NO: 695795 - RNA, 14 nt, Haemophilus influenzae Rd
uaagcaauuucacg

SEQ ID NO: 695796 - RNA, 17 nt, Haemophilus influenzae Rd
uaagcaauuucacgauu

SEQ ID NO: 695797 - RNA, 18 nt, Haemophilus influenzae Rd
uaagcaauuuucugcaga

SEQ ID NO: 695798 - RNA, 19 nt, Haemophilus influenzae Rd
uaagcaauuuucugcagaa

SEQ ID NO: 695799 - RNA, 19 nt, Haemophilus influenzae Rd
uaagcaaaaucauauugau

SEQ ID NO: 695800 - RNA, 17 nt, Haemophilus influenzae Rd
uaagcaaagaaauuuaa

SEQ ID NO: 695801 - RNA, 19 nt, Haemophilus influenzae Rd
uaagauuuuugauaaaaaa

SEQ ID NO: 695802 - RNA, 16 nt, Haemophilus influenzae Rd
uaagauuuuaucuaac

SEQ ID NO: 695803 - RNA, 19 nt, Haemophilus influenzae Rd
uaagauuuuaugaaaucuu

SEQ ID NO: 695804 - RNA, 15 nt, Haemophilus influenzae Rd
uaagauuuacagaac

SEQ ID NO: 695805 - RNA, 16 nt, Haemophilus influenzae Rd
uaagcacuuguacauc

SEQ ID NO: 695806 - RNA, 15 nt, Haemophilus influenzae Rd
uaagcagcuaacaaa

SEQ ID NO: 695807 - RNA, 13 nt, Haemophilus influenzae Rd
uaagccaauaauu

SEQ ID NO: 695808 - RNA, 13 nt, Haemophilus influenzae Rd
uaagccacugugc

SEQ ID NO: 695809 - RNA, 19 nt, Haemophilus influenzae Rd
uaagccacugugcauuaaa

SEQ ID NO: 695810 - RNA, 13 nt, Haemophilus influenzae Rd
uaagcauuuugau

SEQ ID NO: 695811 - RNA, 19 nt, Haemophilus influenzae Rd
uaagccaaaaccuagaaau

SEQ ID NO: 695812 - RNA, 12 nt, Haemophilus influenzae Rd
uaagccaaaucc

SEQ ID NO: 695813 - RNA, 17 nt, Haemophilus influenzae Rd
uaagcauuuuaucacaa

SEQ ID NO: 695814 - RNA, 18 nt, Haemophilus influenzae Rd
uaagcauuuuaucacaag

SEQ ID NO: 695815 - RNA, 23 nt, Haemophilus influenzae Rd
uaagccuugacgaauaccccaag

SEQ ID NO: 695816 - RNA, 16 nt, Haemophilus influenzae Rd
uaagccuacgcuaccu

SEQ ID NO: 695817 - RNA, 14 nt, Haemophilus influenzae Rd
uaagccuaaaccaa

SEQ ID NO: 695818 - RNA, 18 nt, Haemophilus influenzae Rd
uaagccuaaaccaaauau

SEQ ID NO: 695819 - RNA, 19 nt, Haemophilus influenzae Rd
uaagccgcaccaauaacag

SEQ ID NO: 695820 - RNA, 15 nt, Haemophilus influenzae Rd
uaagcugauucuuca

SEQ ID NO: 695821 - RNA, 23 nt, Haemophilus influenzae Rd
uaagcugaaccauuccaaaucau

SEQ ID NO: 695822 - RNA, 22 nt, Haemophilus influenzae Rd
uaagcucacuugcauauccgcu

SEQ ID NO: 695823 - RNA, 17 nt, Haemophilus influenzae Rd
uaagcucgcuauuuuga

SEQ ID NO: 695824 - RNA, 15 nt, Haemophilus influenzae Rd
uaagcuguauuacuu

SEQ ID NO: 695825 - RNA, 16 nt, Haemophilus influenzae Rd
uaagcuguauuacuua

SEQ ID NO: 695826 - RNA, 21 nt, Haemophilus influenzae Rd
uaagcugugguaaaaauaauc

SEQ ID NO: 695827 - RNA, 19 nt, Haemophilus influenzae Rd
uaagcgguaacgacaaaac

SEQ ID NO: 695828 - RNA, 19 nt, Haemophilus influenzae Rd
uaagcguaaugcacuuuca

SEQ ID NO: 695829 - RNA, 13 nt, Haemophilus influenzae Rd
uaagcguaccauu

SEQ ID NO: 695830 - RNA, 16 nt, Haemophilus influenzae Rd
uaagcuaaguacaaaa

SEQ ID NO: 695831 - RNA, 22 nt, Haemophilus influenzae Rd
uaagcuagaggcugaagccauu

SEQ ID NO: 695832 - RNA, 16 nt, Haemophilus influenzae Rd
uaagcuaauuuuucag

SEQ ID NO: 695833 - RNA, 16 nt, Haemophilus influenzae Rd
uaagcuaucgucaaau

SEQ ID NO: 695834 - RNA, 19 nt, Haemophilus influenzae Rd
uaagcuaucgucaaauuua

SEQ ID NO: 695835 - RNA, 18 nt, Haemophilus influenzae Rd
uaagcuuuuuuuaaucac

SEQ ID NO: 695836 - RNA, 16 nt, Haemophilus influenzae Rd
uaaggaccaagcaaug

SEQ ID NO: 695837 - RNA, 17 nt, Haemophilus influenzae Rd
uaaggacuaaacuuuua

SEQ ID NO: 695838 - RNA, 15 nt, Haemophilus influenzae Rd
uaaggauugaccgcc

SEQ ID NO: 695839 - RNA, 21 nt, Haemophilus influenzae Rd
uaaggaucuuguaaagauugu

SEQ ID NO: 695840 - RNA, 19 nt, Haemophilus influenzae Rd
uaaggauuucuuaugaaaa

SEQ ID NO: 695841 - RNA, 14 nt, Haemophilus influenzae Rd
uaaggcaagauaca

SEQ ID NO: 695842 - RNA, 21 nt, Haemophilus influenzae Rd
uaaggcaccuuuuugcucugg

SEQ ID NO: 695843 - RNA, 19 nt, Haemophilus influenzae Rd
uaauaaaccaacauacauu

SEQ ID NO: 695844 - RNA, 13 nt, Haemophilus influenzae Rd
uaauaaaauauac

SEQ ID NO: 695845 - RNA, 15 nt, Haemophilus influenzae Rd
uaauaaaaaauaaag

SEQ ID NO: 695846 - RNA, 13 nt, Haemophilus influenzae Rd
uaauaaaaaaacc

SEQ ID NO: 695847 - RNA, 13 nt, Haemophilus influenzae Rd
uaauaaaaauccu

SEQ ID NO: 695848 - RNA, 18 nt, Haemophilus influenzae Rd
uaaguuuucaccaacaaa

SEQ ID NO: 695849 - RNA, 15 nt, Haemophilus influenzae Rd
uaaguuugagcaaau

SEQ ID NO: 695850 - RNA, 21 nt, Haemophilus influenzae Rd
uaaguuugcuaauuuauccaa

SEQ ID NO: 695851 - RNA, 19 nt, Haemophilus influenzae Rd
uaauaaagcuacuaaaaau

SEQ ID NO: 695852 - RNA, 15 nt, Haemophilus influenzae Rd
uaauaaauauugauu

SEQ ID NO: 695853 - RNA, 16 nt, Haemophilus influenzae Rd
uaauaaaucaaaagaa

SEQ ID NO: 695854 - RNA, 16 nt, Haemophilus influenzae Rd
uaauaaaucaagcaau

SEQ ID NO: 695855 - RNA, 14 nt, Haemophilus influenzae Rd
uaauaaauagaaau

SEQ ID NO: 695856 - RNA, 18 nt, Haemophilus influenzae Rd
uaauaacauagaaaucac

SEQ ID NO: 695857 - RNA, 14 nt, Haemophilus influenzae Rd
uaauaaauuuuauu

SEQ ID NO: 695858 - RNA, 16 nt, Haemophilus influenzae Rd
uaaguuauuuauauaa

SEQ ID NO: 695859 - RNA, 23 nt, Haemophilus influenzae Rd
uaaguuauuuauauaauuuaaca

SEQ ID NO: 695860 - RNA, 16 nt, Haemophilus influenzae Rd
uaaguucagaaagaga

SEQ ID NO: 695861 - RNA, 17 nt, Haemophilus influenzae Rd
uaaguucauaaaagggg

SEQ ID NO: 695862 - RNA, 21 nt, Haemophilus influenzae Rd
uaaguucauaaaaggggcaaa

SEQ ID NO: 695863 - RNA, 14 nt, Haemophilus influenzae Rd
uaaguucaucaacu

SEQ ID NO: 695864 - RNA, 14 nt, Haemophilus influenzae Rd
uaaguucuaaaauu

SEQ ID NO: 695865 - RNA, 15 nt, Haemophilus influenzae Rd
uaaguucuaaauaaa

SEQ ID NO: 695866 - RNA, 20 nt, Haemophilus influenzae Rd
uaaguucuacccauucaaau

SEQ ID NO: 695867 - RNA, 22 nt, Haemophilus influenzae Rd
uaaguugggcuuauuuguuuua

SEQ ID NO: 695868 - RNA, 15 nt, Haemophilus influenzae Rd
uaaguuggauucauu

SEQ ID NO: 695869 - RNA, 15 nt, Haemophilus influenzae Rd
uaaguggcauaaaga

SEQ ID NO: 695870 - RNA, 19 nt, Haemophilus influenzae Rd
uaagugcgguauuuuuauu

SEQ ID NO: 695871 - RNA, 23 nt, Haemophilus influenzae Rd
uaagugcgguauuuuuauuuaua

SEQ ID NO: 695872 - RNA, 20 nt, Haemophilus influenzae Rd
uaagugcgguccguuuucaa

SEQ ID NO: 695873 - RNA, 20 nt, Haemophilus influenzae Rd
uaagugcgguugaaaauucu

SEQ ID NO: 695874 - RNA, 19 nt, Haemophilus influenzae Rd
uaagugcguguauauauuu

SEQ ID NO: 695875 - RNA, 14 nt, Haemophilus influenzae Rd
uaagugagaaaaua

SEQ ID NO: 695876 - RNA, 20 nt, Haemophilus influenzae Rd
uaaguguagcaauaaacaga

SEQ ID NO: 695877 - RNA, 21 nt, Haemophilus influenzae Rd
uaaguuaaaccaacaacugca

SEQ ID NO: 695878 - RNA, 14 nt, Haemophilus influenzae Rd
uaagggcaaaaaau

SEQ ID NO: 695879 - RNA, 13 nt, Haemophilus influenzae Rd
uaaggcuuuucuu

SEQ ID NO: 695880 - RNA, 15 nt, Haemophilus influenzae Rd
uaaggcuagauaaca

SEQ ID NO: 695881 - RNA, 16 nt, Haemophilus influenzae Rd
uaagguuuccauaaug

SEQ ID NO: 695882 - RNA, 16 nt, Haemophilus influenzae Rd
uaaguaaaauagucac

SEQ ID NO: 695883 - RNA, 20 nt, Haemophilus influenzae Rd
uaagguucgauaguauuuua

SEQ ID NO: 695884 - RNA, 15 nt, Haemophilus influenzae Rd
uaagguuaaauucac

SEQ ID NO: 695885 - RNA, 22 nt, Haemophilus influenzae Rd
uaaggugcagauuaauuauauu

SEQ ID NO: 695886 - RNA, 22 nt, Haemophilus influenzae Rd
uaagucagcauaaacaaaauaa

SEQ ID NO: 695887 - RNA, 16 nt, Haemophilus influenzae Rd
uaagucaggaauaaaa

SEQ ID NO: 695888 - RNA, 17 nt, Haemophilus influenzae Rd
uaagucaagcuaaucuc

SEQ ID NO: 695889 - RNA, 12 nt, Haemophilus influenzae Rd
uaaguauuuugc

SEQ ID NO: 695890 - RNA, 22 nt, Haemophilus influenzae Rd
uaaguccaaguuuucacuucgu

SEQ ID NO: 695891 - RNA, 16 nt, Haemophilus influenzae Rd
uaagucauauagggcu

SEQ ID NO: 695892 - RNA, 17 nt, Haemophilus influenzae Rd
uaagucuaguaacuguu

SEQ ID NO: 695893 - RNA, 23 nt, Haemophilus influenzae Rd
uaagucgcuaauuuuuuuucuaa

SEQ ID NO: 695894 - RNA, 13 nt, Haemophilus influenzae Rd
uaaguaaauauuu

SEQ ID NO: 695895 - RNA, 15 nt, Haemophilus influenzae Rd
uaaguacaaaagagc

SEQ ID NO: 695896 - RNA, 14 nt, Haemophilus influenzae Rd
uaaguagaaaaauu

SEQ ID NO: 695897 - RNA, 21 nt, Haemophilus influenzae Rd
uaaguacgacaucuuaaauua

SEQ ID NO: 695898 - RNA, 22 nt, Haemophilus influenzae Rd
uaaguauucaugauguaauucu

SEQ ID NO: 695899 - RNA, 14 nt, Haemophilus influenzae Rd
uaaguauaaaucua

SEQ ID NO: 695900 - RNA, 19 nt, Haemophilus influenzae Rd
uaaguauaacuaauuaaga

SEQ ID NO: 695901 - RNA, 20 nt, Haemophilus influenzae Rd
uaaguaguauuuuauuuaua

SEQ ID NO: 695902 - RNA, 14 nt, Haemophilus influenzae Rd
uaaguaguguuuua

SEQ ID NO: 695903 - RNA, 20 nt, Haemophilus influenzae Rd
uaaguaguguuuuauuuaua

SEQ ID NO: 695904 - RNA, 21 nt, Haemophilus influenzae Rd
uaagaggcauaacccaccaaa

SEQ ID NO: 695905 - RNA, 16 nt, Haemophilus influenzae Rd
uaagaguaaauuuaac

SEQ ID NO: 695906 - RNA, 18 nt, Haemophilus influenzae Rd
uaagagaggagaaauaau

SEQ ID NO: 695907 - RNA, 20 nt, Haemophilus influenzae Rd
uaagauggcuauuuaagccu

SEQ ID NO: 695908 - RNA, 15 nt, Haemophilus influenzae Rd
uaagaugacuuguuu

SEQ ID NO: 695909 - RNA, 16 nt, Haemophilus influenzae Rd
uaagauguuucacuaa

SEQ ID NO: 695910 - RNA, 20 nt, Haemophilus influenzae Rd
uaagaucuucuacuguuaau

SEQ ID NO: 695911 - RNA, 16 nt, Haemophilus influenzae Rd
uaagauccaaaccguc

SEQ ID NO: 695912 - RNA, 22 nt, Haemophilus influenzae Rd
uaagauaguagagucauuuaca

SEQ ID NO: 695913 - RNA, 15 nt, Haemophilus influenzae Rd
uaagauaaauuuaaa

SEQ ID NO: 695914 - RNA, 16 nt, Haemophilus influenzae Rd
uaagauaaauuuaaag

SEQ ID NO: 695915 - RNA, 12 nt, Haemophilus influenzae Rd
uaacuuuaauua

SEQ ID NO: 695916 - RNA, 12 nt, Haemophilus influenzae Rd
uaacuugcuauu

SEQ ID NO: 695917 - RNA, 18 nt, Haemophilus influenzae Rd
uaacuuuccauauaacaa

SEQ ID NO: 695918 - RNA, 11 nt, Haemophilus influenzae Rd
uaacuucuaaa

SEQ ID NO: 695919 - RNA, 14 nt, Haemophilus influenzae Rd
uaagaaaagugcau

SEQ ID NO: 695920 - RNA, 12 nt, Haemophilus influenzae Rd
uaagaaaauaau

SEQ ID NO: 695921 - RNA, 19 nt, Haemophilus influenzae Rd
uaagaaaauaauauaagug

SEQ ID NO: 695922 - RNA, 17 nt, Haemophilus influenzae Rd
uaagaaaauagaaagaa

SEQ ID NO: 695923 - RNA, 20 nt, Haemophilus influenzae Rd
uaagaaaauagaagccaaau

SEQ ID NO: 695924 - RNA, 13 nt, Haemophilus influenzae Rd
uaagaaaaucaaa

SEQ ID NO: 695925 - RNA, 17 nt, Haemophilus influenzae Rd
uaagaaaaaauauaaaa

SEQ ID NO: 695926 - RNA, 14 nt, Haemophilus influenzae Rd
uaagaaaaacauua

SEQ ID NO: 695927 - RNA, 21 nt, Haemophilus influenzae Rd
uaacuuuuuuauuuguuaaua

SEQ ID NO: 695928 - RNA, 19 nt, Haemophilus influenzae Rd
uaacuuuucuucaauuacc

SEQ ID NO: 695929 - RNA, 21 nt, Haemophilus influenzae Rd
uaagaauaacccuuguaacgu

SEQ ID NO: 695930 - RNA, 14 nt, Haemophilus influenzae Rd
uaagaauguuuauc

SEQ ID NO: 695931 - RNA, 23 nt, Haemophilus influenzae Rd
uaagaauuaccgcacuuuaaacu

SEQ ID NO: 695932 - RNA, 13 nt, Haemophilus influenzae Rd
uaagaauuuuaau

SEQ ID NO: 695933 - RNA, 23 nt, Haemophilus influenzae Rd
uaagaauuuuaaucgcacuuaaa

SEQ ID NO: 695934 - RNA, 19 nt, Haemophilus influenzae Rd
uaagaaugaaguagaaauu

SEQ ID NO: 695935 - RNA, 19 nt, Haemophilus influenzae Rd
uaagaaagcgacauuuugu

SEQ ID NO: 695936 - RNA, 16 nt, Haemophilus influenzae Rd
uaagaaagcuaauggu

SEQ ID NO: 695937 - RNA, 13 nt, Haemophilus influenzae Rd
uaagaaagaaacu

SEQ ID NO: 695938 - RNA, 16 nt, Haemophilus influenzae Rd
uaagaaaauccaagag

SEQ ID NO: 695939 - RNA, 17 nt, Haemophilus influenzae Rd
uaagaaaaucccuugcu

SEQ ID NO: 695940 - RNA, 23 nt, Haemophilus influenzae Rd
uaagaaaucucuuucaauuucaa

SEQ ID NO: 695941 - RNA, 15 nt, Haemophilus influenzae Rd
uaagaaauuuucuuu

SEQ ID NO: 695942 - RNA, 15 nt, Haemophilus influenzae Rd
uaacuagcaaucuuu

SEQ ID NO: 695943 - RNA, 15 nt, Haemophilus influenzae Rd
uaacuagcuggcuua

SEQ ID NO: 695944 - RNA, 23 nt, Haemophilus influenzae Rd
uaacuaggcaucaaaauucaaaa

SEQ ID NO: 695945 - RNA, 19 nt, Haemophilus influenzae Rd
uaacuacaacuucaucaau

SEQ ID NO: 695946 - RNA, 17 nt, Haemophilus influenzae Rd
uaacuaaggugcagauu

SEQ ID NO: 695947 - RNA, 14 nt, Haemophilus influenzae Rd
uaacuaaaccauuu

SEQ ID NO: 695948 - RNA, 15 nt, Haemophilus influenzae Rd
uaacuaccuaauaaa

SEQ ID NO: 695949 - RNA, 18 nt, Haemophilus influenzae Rd
uaacguuuaaaaauuaau

SEQ ID NO: 695950 - RNA, 14 nt, Haemophilus influenzae Rd
uaacuaaaaauacc

SEQ ID NO: 695951 - RNA, 15 nt, Haemophilus influenzae Rd
uaacuaaaaauaccg

SEQ ID NO: 695952 - RNA, 14 nt, Haemophilus influenzae Rd
uaacgucauuaauu

SEQ ID NO: 695953 - RNA, 12 nt, Haemophilus influenzae Rd
uaacguuauaaa

SEQ ID NO: 695954 - RNA, 19 nt, Haemophilus influenzae Rd
uaacguuaucaucuguaaa

SEQ ID NO: 695955 - RNA, 22 nt, Haemophilus influenzae Rd
uaacuguaucuacuuuauucaa

SEQ ID NO: 695956 - RNA, 16 nt, Haemophilus influenzae Rd
uaacuggcaauacuac

SEQ ID NO: 695957 - RNA, 16 nt, Haemophilus influenzae Rd
uaacugcuuuaauaaa

SEQ ID NO: 695958 - RNA, 17 nt, Haemophilus influenzae Rd
uaacuuaucuaaaaaga

SEQ ID NO: 695959 - RNA, 22 nt, Haemophilus influenzae Rd
uaacuuaaucauuuuuuaacuu

SEQ ID NO: 695960 - RNA, 19 nt, Haemophilus influenzae Rd
uaacuuaugaauaauaaug

SEQ ID NO: 695961 - RNA, 18 nt, Haemophilus influenzae Rd
uaacugauuguccaaaga

SEQ ID NO: 695962 - RNA, 22 nt, Haemophilus influenzae Rd
uaacugaucggauuucuuuauu

SEQ ID NO: 695963 - RNA, 14 nt, Haemophilus influenzae Rd
aaaucccuugacca

SEQ ID NO: 695964 - RNA, 22 nt, Haemophilus influenzae Rd
aaauccgccaaucauacuaaau

SEQ ID NO: 695965 - RNA, 14 nt, Haemophilus influenzae Rd
uaacugaauuaaau

SEQ ID NO: 695966 - RNA, 19 nt, Haemophilus influenzae Rd
aaauccaucaauucuuccc

SEQ ID NO: 695967 - RNA, 20 nt, Haemophilus influenzae Rd
aaauccaucaauucuuccca

SEQ ID NO: 695968 - RNA, 21 nt, Haemophilus influenzae Rd
aaauccaucaauucuucccaa

SEQ ID NO: 695969 - RNA, 12 nt, Haemophilus influenzae Rd
aaaucccaaucu

SEQ ID NO: 695970 - RNA, 17 nt, Haemophilus influenzae Rd
aaauccccccauuacaa

SEQ ID NO: 695971 - RNA, 20 nt, Haemophilus influenzae Rd
uaauuaccugccaaaccauc

SEQ ID NO: 695972 - RNA, 15 nt, Haemophilus influenzae Rd
uaauuacgcaacgcu

SEQ ID NO: 695973 - RNA, 18 nt, Haemophilus influenzae Rd
uaauuacgccuaaccaag

SEQ ID NO: 695974 - RNA, 20 nt, Haemophilus influenzae Rd
uaauuacgccugcccaaguu

SEQ ID NO: 695975 - RNA, 22 nt, Haemophilus influenzae Rd
uaauuacgccugcccaaguugu

SEQ ID NO: 695976 - RNA, 16 nt, Haemophilus influenzae Rd
uaauuaauuuagauaa

SEQ ID NO: 695977 - RNA, 13 nt, Haemophilus influenzae Rd
uaauuaaacauuu

SEQ ID NO: 695978 - RNA, 22 nt, Haemophilus influenzae Rd
uaauuaaacuuucaauuuuucc

SEQ ID NO: 695979 - RNA, 23 nt, Haemophilus influenzae Rd
uaauuaaagauaguaauguucua

SEQ ID NO: 695980 - RNA, 14 nt, Haemophilus influenzae Rd
uaauuaaagucaga

SEQ ID NO: 695981 - RNA, 13 nt, Haemophilus influenzae Rd
uaauuaaaaauaa

SEQ ID NO: 695982 - RNA, 15 nt, Haemophilus influenzae Rd
uaauuaaaaauaaau

SEQ ID NO: 695983 - RNA, 14 nt, Haemophilus influenzae Rd
uaauuaaaaauaac

SEQ ID NO: 695984 - RNA, 15 nt, Haemophilus influenzae Rd
uaauuaaaaauaacc

SEQ ID NO: 695985 - RNA, 18 nt, Haemophilus influenzae Rd
uaauuaaaaauaaccgcc

SEQ ID NO: 695986 - RNA, 13 nt, Haemophilus influenzae Rd
uaauuaaaaggac

SEQ ID NO: 695987 - RNA, 21 nt, Haemophilus influenzae Rd
uaauguucccacaaagacuaa

SEQ ID NO: 695988 - RNA, 14 nt, Haemophilus influenzae Rd
uaauguuuaaagua

SEQ ID NO: 695989 - RNA, 19 nt, Haemophilus influenzae Rd
uaauguuuaaaguaagaau

SEQ ID NO: 695990 - RNA, 14 nt, Haemophilus influenzae Rd
uaauguuuaagcca

SEQ ID NO: 695991 - RNA, 12 nt, Haemophilus influenzae Rd
uaauguuuucuu

SEQ ID NO: 695992 - RNA, 21 nt, Haemophilus influenzae Rd
uaauguuuucuugaccuucaa

SEQ ID NO: 695993 - RNA, 15 nt, Haemophilus influenzae Rd
uaauguuauuaaaua

SEQ ID NO: 695994 - RNA, 17 nt, Haemophilus influenzae Rd
uaauguuaaaucuaagc

SEQ ID NO: 695995 - RNA, 15 nt, Haemophilus influenzae Rd
uaauuagauaauaca

SEQ ID NO: 695996 - RNA, 19 nt, Haemophilus influenzae Rd
uaauuagauaauacagaaa

SEQ ID NO: 695997 - RNA, 21 nt, Haemophilus influenzae Rd
uaauuacugucgaaccaaguu

SEQ ID NO: 695998 - RNA, 18 nt, Haemophilus influenzae Rd
uaauuacuuuuauaucua

SEQ ID NO: 695999 - RNA, 20 nt, Haemophilus influenzae Rd
uaauuagaauaacaacaaaa

SEQ ID NO: 696000 - RNA, 12 nt, Haemophilus influenzae Rd
uaauuaugguga

SEQ ID NO: 696001 - RNA, 15 nt, Haemophilus influenzae Rd
uaauucgcaaauccu

SEQ ID NO: 696002 - RNA, 18 nt, Haemophilus influenzae Rd
uaauuccuuuuucuacuu

SEQ ID NO: 696003 - RNA, 14 nt, Haemophilus influenzae Rd
uaauuccaccgcac

SEQ ID NO: 696004 - RNA, 15 nt, Haemophilus influenzae Rd
uaauuauuuuaaaua

SEQ ID NO: 696005 - RNA, 15 nt, Haemophilus influenzae Rd
uaauuauuuuuagcu

SEQ ID NO: 696006 - RNA, 14 nt, Haemophilus influenzae Rd
uaauuccccuucaa

SEQ ID NO: 696007 - RNA, 18 nt, Haemophilus influenzae Rd
uaauuccccuucaaauau

SEQ ID NO: 696008 - RNA, 18 nt, Haemophilus influenzae Rd
uaaugauguaccaaaaug

SEQ ID NO: 696009 - RNA, 19 nt, Haemophilus influenzae Rd
uaaugaugaaugcuuuuau

SEQ ID NO: 696010 - RNA, 12 nt, Haemophilus influenzae Rd
uaaugauaaucu

SEQ ID NO: 696011 - RNA, 17 nt, Haemophilus influenzae Rd
uaaugauaaauuuuauu

SEQ ID NO: 696012 - RNA, 23 nt, Haemophilus influenzae Rd
uaaucgcaaugccagcgcuugca

SEQ ID NO: 696013 - RNA, 19 nt, Haemophilus influenzae Rd
uaaucgaucuauauucguu

SEQ ID NO: 696014 - RNA, 17 nt, Haemophilus influenzae Rd
uaaucgccaaucuaagc

SEQ ID NO: 696015 - RNA, 19 nt, Haemophilus influenzae Rd
uaaucgccaaaaucaucac

SEQ ID NO: 696016 - RNA, 14 nt, Haemophilus influenzae Rd
uaaucgcacuuaaa

SEQ ID NO: 696017 - RNA, 22 nt, Haemophilus influenzae Rd
uaaugagcacgccuaauaccaa

SEQ ID NO: 696018 - RNA, 22 nt, Haemophilus influenzae Rd
uaauguccacuuuuggaaacua

SEQ ID NO: 696019 - RNA, 16 nt, Haemophilus influenzae Rd
uaaugucaucuaguac

SEQ ID NO: 696020 - RNA, 18 nt, Haemophilus influenzae Rd
uaaugugagaauaaccac

SEQ ID NO: 696021 - RNA, 16 nt, Haemophilus influenzae Rd
uaaugugcaaucagca

SEQ ID NO: 696022 - RNA, 17 nt, Haemophilus influenzae Rd
uaaugugcaaucagcaa

SEQ ID NO: 696023 - RNA, 14 nt, Haemophilus influenzae Rd
uaauguaaacaaaa

SEQ ID NO: 696024 - RNA, 16 nt, Haemophilus influenzae Rd
uaauguaaacaaaaau

SEQ ID NO: 696025 - RNA, 15 nt, Haemophilus influenzae Rd
uaauguaauaaaaaa

SEQ ID NO: 696026 - RNA, 17 nt, Haemophilus influenzae Rd
uaauguaauaaaaaaua

SEQ ID NO: 696027 - RNA, 23 nt, Haemophilus influenzae Rd
uaaugccucgauauuuauaagua

SEQ ID NO: 696028 - RNA, 16 nt, Haemophilus influenzae Rd
uaaugcaaccaaacaa

SEQ ID NO: 696029 - RNA, 14 nt, Haemophilus influenzae Rd
uaaugcaaaaucuu

SEQ ID NO: 696030 - RNA, 13 nt, Haemophilus influenzae Rd
uaaugcaauuuca

SEQ ID NO: 696031 - RNA, 14 nt, Haemophilus influenzae Rd
uaaugcuaaaccaa

SEQ ID NO: 696032 - RNA, 15 nt, Haemophilus influenzae Rd
uaaugcuaaaccaau

SEQ ID NO: 696033 - RNA, 18 nt, Haemophilus influenzae Rd
uaaugcuaaaccaauuuc

SEQ ID NO: 696034 - RNA, 14 nt, Haemophilus influenzae Rd
uaaugcuaauuuca

SEQ ID NO: 696035 - RNA, 23 nt, Haemophilus influenzae Rd
uaaugcggugcuuuaaguaaaag

SEQ ID NO: 696036 - RNA, 13 nt, Haemophilus influenzae Rd
uacaaacccacaa

SEQ ID NO: 696037 - RNA, 21 nt, Haemophilus influenzae Rd
uacaaacgguuucaauaugac

SEQ ID NO: 696038 - RNA, 20 nt, Haemophilus influenzae Rd
uacaaauaacacagaaacca

SEQ ID NO: 696039 - RNA, 20 nt, Haemophilus influenzae Rd
uacaaauaaccuaucccaaa

SEQ ID NO: 696040 - RNA, 23 nt, Haemophilus influenzae Rd
uacaaauaaccuaucccaaaaug

SEQ ID NO: 696041 - RNA, 14 nt, Haemophilus influenzae Rd
uacaacuucaucaa

SEQ ID NO: 696042 - RNA, 14 nt, Haemophilus influenzae Rd
uacaagaaagaaau

SEQ ID NO: 696043 - RNA, 18 nt, Haemophilus influenzae Rd
uacaagaaagaaauauaa

SEQ ID NO: 696044 - RNA, 19 nt, Haemophilus influenzae Rd
uacaagaaagaaauauaau

SEQ ID NO: 696045 - RNA, 20 nt, Haemophilus influenzae Rd
uacaagaaagaaauauaaua

SEQ ID NO: 696046 - RNA, 23 nt, Haemophilus influenzae Rd
uacaagaaagaaauauaauaaau

SEQ ID NO: 696047 - RNA, 15 nt, Haemophilus influenzae Rd
uacaacuuuuuauuu

SEQ ID NO: 696048 - RNA, 11 nt, Haemophilus influenzae Rd
uacaagcggcu

SEQ ID NO: 696049 - RNA, 20 nt, Haemophilus influenzae Rd
uacaagauaaucagugauua

SEQ ID NO: 696050 - RNA, 22 nt, Haemophilus influenzae Rd
uacaagauaaucagugauuaua

SEQ ID NO: 696051 - RNA, 13 nt, Haemophilus influenzae Rd
uacaacuaauccc

SEQ ID NO: 696052 - RNA, 20 nt, Haemophilus influenzae Rd
uacaacagacgaaguguuaa

SEQ ID NO: 696053 - RNA, 14 nt, Haemophilus influenzae Rd
uacaaauuuagaua

SEQ ID NO: 696054 - RNA, 19 nt, Haemophilus influenzae Rd
uacaaauuuagauaacaau

SEQ ID NO: 696055 - RNA, 18 nt, Haemophilus influenzae Rd
uacaaaucguaauuaaaa

SEQ ID NO: 696056 - RNA, 17 nt, Haemophilus influenzae Rd
uacaaauuccucugaac

SEQ ID NO: 696057 - RNA, 22 nt, Haemophilus influenzae Rd
uacaaaaagugcgguuaaaaau

SEQ ID NO: 696058 - RNA, 12 nt, Haemophilus influenzae Rd
uacaaaaccaau

SEQ ID NO: 696059 - RNA, 14 nt, Haemophilus influenzae Rd
uacaaaacauaaua

SEQ ID NO: 696060 - RNA, 23 nt, Haemophilus influenzae Rd
uacaaaacauaauaaaauuuauu

SEQ ID NO: 696061 - RNA, 17 nt, Haemophilus influenzae Rd
uaauuuuuucuaaauuu

SEQ ID NO: 696062 - RNA, 14 nt, Haemophilus influenzae Rd
uaauuuuuucuguu

SEQ ID NO: 696063 - RNA, 15 nt, Haemophilus influenzae Rd
uaauuuuuugaauau

SEQ ID NO: 696064 - RNA, 19 nt, Haemophilus influenzae Rd
uaauuuuuuuucuaauaau

SEQ ID NO: 696065 - RNA, 12 nt, Haemophilus influenzae Rd
uaauuuuuagaa

SEQ ID NO: 696066 - RNA, 13 nt, Haemophilus influenzae Rd
uaauuuuuagauu

SEQ ID NO: 696067 - RNA, 12 nt, Haemophilus influenzae Rd
uaauuuuuaaaa

SEQ ID NO: 696068 - RNA, 14 nt, Haemophilus influenzae Rd
uaauuuuuaaaaua

SEQ ID NO: 696069 - RNA, 14 nt, Haemophilus influenzae Rd
uaauuuuuaaagaa

SEQ ID NO: 696070 - RNA, 18 nt, Haemophilus influenzae Rd
uaauuuugaagucuuaau

SEQ ID NO: 696071 - RNA, 23 nt, Haemophilus influenzae Rd
uaauucgcguuuauuuaacaaua

SEQ ID NO: 696072 - RNA, 14 nt, Haemophilus influenzae Rd
uaauugauuaaaaa

SEQ ID NO: 696073 - RNA, 20 nt, Haemophilus influenzae Rd
uaauugauucgauaaauuag

SEQ ID NO: 696074 - RNA, 17 nt, Haemophilus influenzae Rd
uaauugauuuaaaaauc

SEQ ID NO: 696075 - RNA, 18 nt, Haemophilus influenzae Rd
uaauugauuuaaaaaucu

SEQ ID NO: 696076 - RNA, 15 nt, Haemophilus influenzae Rd
uaauugauuuuaaag

SEQ ID NO: 696077 - RNA, 23 nt, Haemophilus influenzae Rd
uaauuuaucaucuaguuuuaaua

SEQ ID NO: 696078 - RNA, 17 nt, Haemophilus influenzae Rd
uaauuucaaaaucacau

SEQ ID NO: 696079 - RNA, 23 nt, Haemophilus influenzae Rd
uaauuucaaaaucacaucgccaa

SEQ ID NO: 696080 - RNA, 17 nt, Haemophilus influenzae Rd
uaauuucaauauaaguu

SEQ ID NO: 696081 - RNA, 20 nt, Haemophilus influenzae Rd
uaauuuaucgccauagaaaa

SEQ ID NO: 696082 - RNA, 12 nt, Haemophilus influenzae Rd
uaauuuauucaa

SEQ ID NO: 696083 - RNA, 20 nt, Haemophilus influenzae Rd
uaauuugaccuucauaaacu

SEQ ID NO: 696084 - RNA, 21 nt, Haemophilus influenzae Rd
uaauuugaccuucauaaacuu

SEQ ID NO: 696085 - RNA, 19 nt, Haemophilus influenzae Rd
uaauuugacgauaauauuu

SEQ ID NO: 696086 - RNA, 16 nt, Haemophilus influenzae Rd
uaauuugaugcucaga

SEQ ID NO: 696087 - RNA, 14 nt, Haemophilus influenzae Rd
uaauuugcacacuu

SEQ ID NO: 696088 - RNA, 19 nt, Haemophilus influenzae Rd
uaauuugcacacuuaaacu

SEQ ID NO: 696089 - RNA, 12 nt, Haemophilus influenzae Rd
uaauuugcccca

SEQ ID NO: 696090 - RNA, 16 nt, Haemophilus influenzae Rd
uaauuugcucaaaguu

SEQ ID NO: 696091 - RNA, 23 nt, Haemophilus influenzae Rd
uaauuugcuguggugaagugcgg

SEQ ID NO: 696092 - RNA, 22 nt, Haemophilus influenzae Rd
uaauuucacaccauuuuuaauu

SEQ ID NO: 696093 - RNA, 18 nt, Haemophilus influenzae Rd
uaauuucaucuuuuaaau

SEQ ID NO: 696094 - RNA, 21 nt, Haemophilus influenzae Rd
uaauuucauucaacaauucau

SEQ ID NO: 696095 - RNA, 21 nt, Haemophilus influenzae Rd
  misc_feature (9)..(9): n is a, c, g or u
uaauuucanagagguuuccuu

SEQ ID NO: 696096 - RNA, 22 nt, Haemophilus influenzae Rd
uaauuucaucccagauuuuacu

SEQ ID NO: 696097 - RNA, 15 nt, Haemophilus influenzae Rd
uaauuucaucgcguu

SEQ ID NO: 696098 - RNA, 22 nt, Haemophilus influenzae Rd
uaauuucaucgcguuuuuucuu

SEQ ID NO: 696099 - RNA, 16 nt, Haemophilus influenzae Rd
uaauauaugaaaaaua

SEQ ID NO: 696100 - RNA, 16 nt, Haemophilus influenzae Rd
uaauauagcaaacuag

SEQ ID NO: 696101 - RNA, 17 nt, Haemophilus influenzae Rd
uaauauaggauuuuaau

SEQ ID NO: 696102 - RNA, 19 nt, Haemophilus influenzae Rd
uaauauaggcgaacaaaag

SEQ ID NO: 696103 - RNA, 15 nt, Haemophilus influenzae Rd
uaauauauucaauuc

SEQ ID NO: 696104 - RNA, 15 nt, Haemophilus influenzae Rd
uaauaucagagaaaa

SEQ ID NO: 696105 - RNA, 23 nt, Haemophilus influenzae Rd
uaauaucauggcgaccauucucu

SEQ ID NO: 696106 - RNA, 23 nt, Haemophilus influenzae Rd
uaauaucgcccgcuuuaaguccu

SEQ ID NO: 696107 - RNA, 13 nt, Haemophilus influenzae Rd
uaauaucugcuuu

SEQ ID NO: 696108 - RNA, 21 nt, Haemophilus influenzae Rd
uaauaugcauucaaauuucaa

SEQ ID NO: 696109 - RNA, 14 nt, Haemophilus influenzae Rd
uaauauguaauauu

SEQ ID NO: 696110 - RNA, 15 nt, Haemophilus influenzae Rd
uaauauguucuuugu

SEQ ID NO: 696111 - RNA, 23 nt, Haemophilus influenzae Rd
uaauauguucuuuguugaugauu

SEQ ID NO: 696112 - RNA, 14 nt, Haemophilus influenzae Rd
uaauauguuuugcc

SEQ ID NO: 696113 - RNA, 13 nt, Haemophilus influenzae Rd
uaauauuuuugcc

SEQ ID NO: 696114 - RNA, 15 nt, Haemophilus influenzae Rd
uaauauuuuugccaa

SEQ ID NO: 696115 - RNA, 19 nt, Haemophilus influenzae Rd
uaauauuuuugccaauuuu

SEQ ID NO: 696116 - RNA, 17 nt, Haemophilus influenzae Rd
uaaucaaauaaaauauu

SEQ ID NO: 696117 - RNA, 21 nt, Haemophilus influenzae Rd
uaauauuucuucauuuuaaau

SEQ ID NO: 696118 - RNA, 13 nt, Haemophilus influenzae Rd
uaauauuucuugu

SEQ ID NO: 696119 - RNA, 12 nt, Haemophilus influenzae Rd
uaauauuuaaaa

SEQ ID NO: 696120 - RNA, 16 nt, Haemophilus influenzae Rd
uaauauugcaccauaa

SEQ ID NO: 696121 - RNA, 21 nt, Haemophilus influenzae Rd
uaauauugccauaauaaucac

SEQ ID NO: 696122 - RNA, 19 nt, Haemophilus influenzae Rd
uaauauucaaaacauuaau

SEQ ID NO: 696123 - RNA, 23 nt, Haemophilus influenzae Rd
uaaucaguugaucgcaauguuca

SEQ ID NO: 696124 - RNA, 24 nt, Haemophilus influenzae Rd
uaaucaguugaucgcaauguucac

SEQ ID NO: 696125 - RNA, 14 nt, Haemophilus influenzae Rd
uaaucaggcugugc

SEQ ID NO: 696126 - RNA, 16 nt, Haemophilus influenzae Rd
uaaucacuugauaaaa

SEQ ID NO: 696127 - RNA, 23 nt, Haemophilus influenzae Rd
uaaucagaacaagcauuuuucau

SEQ ID NO: 696128 - RNA, 14 nt, Haemophilus influenzae Rd
uaaucaauaagaaa

SEQ ID NO: 696129 - RNA, 15 nt, Haemophilus influenzae Rd
uaaucaauaagaaau

SEQ ID NO: 696130 - RNA, 16 nt, Haemophilus influenzae Rd
uaaucacaaagcuuag

SEQ ID NO: 696131 - RNA, 21 nt, Haemophilus influenzae Rd
uaaucacacuugcaccaccaa

SEQ ID NO: 696132 - RNA, 18 nt, Haemophilus influenzae Rd
uaauccaucgcaagauaa

SEQ ID NO: 696133 - RNA, 16 nt, Haemophilus influenzae Rd
uaauccccuaaacuaa

SEQ ID NO: 696134 - RNA, 13 nt, Haemophilus influenzae Rd
uaauccagucauu

SEQ ID NO: 696135 - RNA, 14 nt, Haemophilus influenzae Rd
uaauccagcuacau

SEQ ID NO: 696136 - RNA, 17 nt, Haemophilus influenzae Rd
uaauccagcuacauuca

SEQ ID NO: 696137 - RNA, 18 nt, Haemophilus influenzae Rd
uaauccagcuacauucau

SEQ ID NO: 696138 - RNA, 14 nt, Haemophilus influenzae Rd
uaauccaagugcau

SEQ ID NO: 696139 - RNA, 13 nt, Haemophilus influenzae Rd
uaauccaauccau

SEQ ID NO: 696140 - RNA, 18 nt, Haemophilus influenzae Rd
uaauccaauccauaacaa

SEQ ID NO: 696141 - RNA, 16 nt, Haemophilus influenzae Rd
uaauccacaauucuua

SEQ ID NO: 696142 - RNA, 13 nt, Haemophilus influenzae Rd
uaauccaaaucaa

SEQ ID NO: 696143 - RNA, 13 nt, Haemophilus influenzae Rd
uaaucauugaaau

SEQ ID NO: 696144 - RNA, 17 nt, Haemophilus influenzae Rd
uaaucauugcaagugca

SEQ ID NO: 696145 - RNA, 18 nt, Haemophilus influenzae Rd
uaaucauugcaagugcag

SEQ ID NO: 696146 - RNA, 16 nt, Haemophilus influenzae Rd
uaauagaguaccaaaa

SEQ ID NO: 696147 - RNA, 22 nt, Haemophilus influenzae Rd
uaauagauaagaaguuaucauu

SEQ ID NO: 696148 - RNA, 15 nt, Haemophilus influenzae Rd
uaauagacauagaaa

SEQ ID NO: 696149 - RNA, 20 nt, Haemophilus influenzae Rd
uaauagacuuaauaauauau

SEQ ID NO: 696150 - RNA, 12 nt, Haemophilus influenzae Rd
uaauacuuggug

SEQ ID NO: 696151 - RNA, 12 nt, Haemophilus influenzae Rd
uaauagaaaaau

SEQ ID NO: 696152 - RNA, 15 nt, Haemophilus influenzae Rd
uaauagaaaaaugcc

SEQ ID NO: 696153 - RNA, 15 nt, Haemophilus influenzae Rd
uaauacuuucuuuuc

SEQ ID NO: 696154 - RNA, 15 nt, Haemophilus influenzae Rd
uaauacuuuuguaug

SEQ ID NO: 696155 - RNA, 16 nt, Haemophilus influenzae Rd
uaauaccgcagcaggu

SEQ ID NO: 696156 - RNA, 15 nt, Haemophilus influenzae Rd
uaauaccuuuccauu

SEQ ID NO: 696157 - RNA, 21 nt, Haemophilus influenzae Rd
uaauacguuguuguucuuucc

SEQ ID NO: 696158 - RNA, 15 nt, Haemophilus influenzae Rd
uaauacguaaauuca

SEQ ID NO: 696159 - RNA, 16 nt, Haemophilus influenzae Rd
uaauacguaaauucaa

SEQ ID NO: 696160 - RNA, 12 nt, Haemophilus influenzae Rd
uaauacgucaau

SEQ ID NO: 696161 - RNA, 16 nt, Haemophilus influenzae Rd
uaauacgucaauugcu

SEQ ID NO: 696162 - RNA, 18 nt, Haemophilus influenzae Rd
uaauacugcugaauaaac

SEQ ID NO: 696163 - RNA, 18 nt, Haemophilus influenzae Rd
uaauaggcgaaucaaaau

SEQ ID NO: 696164 - RNA, 21 nt, Haemophilus influenzae Rd
uaauaggcgcguaauaaauaa

SEQ ID NO: 696165 - RNA, 23 nt, Haemophilus influenzae Rd
uaauaggcaauguuccaccacuc

SEQ ID NO: 696166 - RNA, 13 nt, Haemophilus influenzae Rd
uaauaguaaacuu

SEQ ID NO: 696167 - RNA, 18 nt, Haemophilus influenzae Rd
uaauaguaaacuuuuaaa

SEQ ID NO: 696168 - RNA, 20 nt, Haemophilus influenzae Rd
uaauaguaaacuuuuaaagu

SEQ ID NO: 696169 - RNA, 19 nt, Haemophilus influenzae Rd
uaauagcgugcauuccuaa

SEQ ID NO: 696170 - RNA, 15 nt, Haemophilus influenzae Rd
uaauaggaauaacac

SEQ ID NO: 696171 - RNA, 14 nt, Haemophilus influenzae Rd
uaauaggauaaaua

SEQ ID NO: 696172 - RNA, 15 nt, Haemophilus influenzae Rd
uaauauaaauuaugu

SEQ ID NO: 696173 - RNA, 21 nt, Haemophilus influenzae Rd
uaauauaaguuauuuauauaa

SEQ ID NO: 696174 - RNA, 15 nt, Haemophilus influenzae Rd
uaauauaauaaauuc

SEQ ID NO: 696175 - RNA, 15 nt, Haemophilus influenzae Rd
uaauauaauugugau

SEQ ID NO: 696176 - RNA, 13 nt, Haemophilus influenzae Rd
uaauaauuuuucc

SEQ ID NO: 696177 - RNA, 14 nt, Haemophilus influenzae Rd
uaauaauuuuuccg

SEQ ID NO: 696178 - RNA, 20 nt, Haemophilus influenzae Rd
uaauaauuagcuaaauacuu

SEQ ID NO: 696179 - RNA, 13 nt, Haemophilus influenzae Rd
uaauaauucauua

SEQ ID NO: 696180 - RNA, 23 nt, Haemophilus influenzae Rd
uaauacagaaauaugaaauuucu

SEQ ID NO: 696181 - RNA, 11 nt, Haemophilus influenzae Rd
uaauacaaaau

SEQ ID NO: 696182 - RNA, 15 nt, Haemophilus influenzae Rd
uaauacaaagcgauu

SEQ ID NO: 696183 - RNA, 16 nt, Haemophilus influenzae Rd
uaauacacaaaaucca

SEQ ID NO: 696184 - RNA, 9 nt, Haemophilus influenzae Rd
uaauacacc

SEQ ID NO: 696185 - RNA, 14 nt, Haemophilus influenzae Rd
uaauacauuuucau

SEQ ID NO: 696186 - RNA, 12 nt, Haemophilus influenzae Rd
uaauaccaauac

SEQ ID NO: 696187 - RNA, 16 nt, Haemophilus influenzae Rd
uaauaagugagaaagu

SEQ ID NO: 696188 - RNA, 22 nt, Haemophilus influenzae Rd
uaauaagugcgguuaauuuuca

SEQ ID NO: 696189 - RNA, 16 nt, Haemophilus influenzae Rd
uaauaaguuuucauca

SEQ ID NO: 696190 - RNA, 18 nt, Haemophilus influenzae Rd
uaauaaucacaacaaacc

SEQ ID NO: 696191 - RNA, 19 nt, Haemophilus influenzae Rd
uaauaaucacaauuuuuaa

SEQ ID NO: 696192 - RNA, 19 nt, Haemophilus influenzae Rd
uaauaauccucuuuaaaau

SEQ ID NO: 696193 - RNA, 23 nt, Haemophilus influenzae Rd
uaauaaucgaaaaaguucuuucu

SEQ ID NO: 696194 - RNA, 15 nt, Haemophilus influenzae Rd
uaauaaucuuaaaua

SEQ ID NO: 696195 - RNA, 14 nt, Haemophilus influenzae Rd
uaauaaucuucuuc

SEQ ID NO: 696196 - RNA, 17 nt, Haemophilus influenzae Rd
uaauaaucuucuuccca

SEQ ID NO: 696197 - RNA, 19 nt, Haemophilus influenzae Rd
uaauaaucuucuugaagau

SEQ ID NO: 696198 - RNA, 16 nt, Haemophilus influenzae Rd
uaauaagauuuuuaac

SEQ ID NO: 696199 - RNA, 19 nt, Haemophilus influenzae Rd
uaauaagcuaaguacaaaa

SEQ ID NO: 696200 - RNA, 15 nt, Haemophilus influenzae Rd
uaauaacgcaagcac

SEQ ID NO: 696201 - RNA, 19 nt, Haemophilus influenzae Rd
uaauaacguguaaauugcu

SEQ ID NO: 696202 - RNA, 14 nt, Haemophilus influenzae Rd
uaauaaccaagaaa

SEQ ID NO: 696203 - RNA, 14 nt, Haemophilus influenzae Rd
uaauaaccauacaa

SEQ ID NO: 696204 - RNA, 16 nt, Haemophilus influenzae Rd
uaauaagaauacaaau

SEQ ID NO: 696205 - RNA, 17 nt, Haemophilus influenzae Rd
uaauaagaauacaaauu

SEQ ID NO: 696206 - RNA, 15 nt, Haemophilus influenzae Rd
uaauaagaaaaucaa

SEQ ID NO: 696207 - RNA, 23 nt, Haemophilus influenzae Rd
uaauaagaaaaucaaagauauuu

SEQ ID NO: 696208 - RNA, 20 nt, Haemophilus influenzae Rd
uaauaagaaaguaauugcau

SEQ ID NO: 696209 - RNA, 15 nt, Haemophilus influenzae Rd
uacaauuuuuuucaa

SEQ ID NO: 696210 - RNA, 14 nt, Haemophilus influenzae Rd
uacacaaaauauuc

SEQ ID NO: 696211 - RNA, 14 nt, Haemophilus influenzae Rd
uacagguucuacgu

SEQ ID NO: 696212 - RNA, 18 nt, Haemophilus influenzae Rd
uacaguacaauuaauuaa

SEQ ID NO: 696213 - RNA, 16 nt, Haemophilus influenzae Rd
uacaguaccuauauac

SEQ ID NO: 696214 - RNA, 18 nt, Haemophilus influenzae Rd
uacaaguggcgguaaaaa

SEQ ID NO: 696215 - RNA, 19 nt, Haemophilus influenzae Rd
uacaagguacuugaacuug

SEQ ID NO: 696216 - RNA, 18 nt, Haemophilus influenzae Rd
uacaagucucuaugauuu

SEQ ID NO: 696217 - RNA, 22 nt, Haemophilus influenzae Rd
uacaauuugaccgcggaaaaua

SEQ ID NO: 696218 - RNA, 14 nt, Haemophilus influenzae Rd
uacaauuucauuaa

SEQ ID NO: 696219 - RNA, 21 nt, Haemophilus influenzae Rd
uacaauuucauuaauuuuauu

SEQ ID NO: 696220 - RNA, 20 nt, Haemophilus influenzae Rd
uacaauucuuguuuaauauu

SEQ ID NO: 696221 - RNA, 12 nt, Haemophilus influenzae Rd
uacauaaucuug

SEQ ID NO: 696222 - RNA, 12 nt, Haemophilus influenzae Rd
uacauaauuaaa

SEQ ID NO: 696223 - RNA, 16 nt, Haemophilus influenzae Rd
uacauaauauugaaaa

SEQ ID NO: 696224 - RNA, 21 nt, Haemophilus influenzae Rd
uacauagauugaaaaguaaau

SEQ ID NO: 696225 - RNA, 21 nt, Haemophilus influenzae Rd
uacauagaacguuuuuuacuu

SEQ ID NO: 696226 - RNA, 15 nt, Haemophilus influenzae Rd
uacaucaacaaaugu

SEQ ID NO: 696227 - RNA, 19 nt, Haemophilus influenzae Rd
uacauccacuuuuucugcc

SEQ ID NO: 696228 - RNA, 17 nt, Haemophilus influenzae Rd
uacaucauuugcaauau

SEQ ID NO: 696229 - RNA, 15 nt, Haemophilus influenzae Rd
uacaucgaaaacaua

SEQ ID NO: 696230 - RNA, 16 nt, Haemophilus influenzae Rd
uacaucgaaaacauaa

SEQ ID NO: 696231 - RNA, 17 nt, Haemophilus influenzae Rd
uaccaaaugaccaaggc

SEQ ID NO: 696232 - RNA, 18 nt, Haemophilus influenzae Rd
uaccaaauuccauucacu

SEQ ID NO: 696233 - RNA, 22 nt, Haemophilus influenzae Rd
uacauugcuauggcaaugaaua

SEQ ID NO: 696234 - RNA, 17 nt, Haemophilus influenzae Rd
uaccaauugauuuuuca

SEQ ID NO: 696235 - RNA, 16 nt, Haemophilus influenzae Rd
uaccaauugcaacuuc

SEQ ID NO: 696236 - RNA, 14 nt, Haemophilus influenzae Rd
uaccaacugagcua

SEQ ID NO: 696237 - RNA, 21 nt, Haemophilus influenzae Rd
uaccaaccgguaaaauuaaug

SEQ ID NO: 696238 - RNA, 14 nt, Haemophilus influenzae Rd
uacauucccaaaua

SEQ ID NO: 696239 - RNA, 12 nt, Haemophilus influenzae Rd
uacauuauuaaa

SEQ ID NO: 696240 - RNA, 16 nt, Haemophilus influenzae Rd
uacauuauuaaaagca

SEQ ID NO: 696241 - RNA, 23 nt, Haemophilus influenzae Rd
uacauucuccagacugcauugca

SEQ ID NO: 696242 - RNA, 23 nt, Haemophilus influenzae Rd
uacauugaagcgggcgaugaaag

SEQ ID NO: 696243 - RNA, 13 nt, Haemophilus influenzae Rd
uacaucuaauuuu

SEQ ID NO: 696244 - RNA, 16 nt, Haemophilus influenzae Rd
uacaucuucaaaaaca

SEQ ID NO: 696245 - RNA, 17 nt, Haemophilus influenzae Rd
uacaucuucaaaaacau

SEQ ID NO: 696246 - RNA, 13 nt, Haemophilus influenzae Rd
uacaucuucacaa

SEQ ID NO: 696247 - RNA, 14 nt, Haemophilus influenzae Rd
uacauuaaucacca

SEQ ID NO: 696248 - RNA, 22 nt, Haemophilus influenzae Rd
uaccaccagucggcauuaucug

SEQ ID NO: 696249 - RNA, 23 nt, Haemophilus influenzae Rd
uaccaccagucggcauuaucugu

SEQ ID NO: 696250 - RNA, 18 nt, Haemophilus influenzae Rd
uaccacccaaaauuucag

SEQ ID NO: 696251 - RNA, 19 nt, Haemophilus influenzae Rd
uaccacccaaaauuucagc

SEQ ID NO: 696252 - RNA, 11 nt, Haemophilus influenzae Rd
uaccacagcau

SEQ ID NO: 696253 - RNA, 21 nt, Haemophilus influenzae Rd
uaccacaucauuauugccuuu

SEQ ID NO: 696254 - RNA, 21 nt, Haemophilus influenzae Rd
uaccacaugcauuuuucuuau

SEQ ID NO: 696255 - RNA, 17 nt, Haemophilus influenzae Rd
uaccacuugccaaacau

SEQ ID NO: 696256 - RNA, 23 nt, Haemophilus influenzae Rd
uaccacuuucaacuguucuucug

SEQ ID NO: 696257 - RNA, 21 nt, Haemophilus influenzae Rd
uaccauugugccaaauucagu

SEQ ID NO: 696258 - RNA, 18 nt, Haemophilus influenzae Rd
uaccaugccauuuccuac

SEQ ID NO: 696259 - RNA, 16 nt, Haemophilus influenzae Rd
uaccauauccauugca

SEQ ID NO: 696260 - RNA, 21 nt, Haemophilus influenzae Rd
uaccauacagccugcgauugc

SEQ ID NO: 696261 - RNA, 13 nt, Haemophilus influenzae Rd
uaccauacuugcc

SEQ ID NO: 696262 - RNA, 12 nt, Haemophilus influenzae Rd
uacccacuucau

SEQ ID NO: 696263 - RNA, 17 nt, Haemophilus influenzae Rd
uacccacacaaacuaau

SEQ ID NO: 696264 - RNA, 13 nt, Haemophilus influenzae Rd
uacccaacaaauu

SEQ ID NO: 696265 - RNA, 23 nt, Haemophilus influenzae Rd
uacccaaaugaugaaacaagcug

SEQ ID NO: 696266 - RNA, 21 nt, Haemophilus influenzae Rd
uaccauucuuucaauaauuuu

SEQ ID NO: 696267 - RNA, 18 nt, Haemophilus influenzae Rd
uaccauuuaaaaguaaaa

SEQ ID NO: 696268 - RNA, 15 nt, Haemophilus influenzae Rd
uaccauuugauucac

SEQ ID NO: 696269 - RNA, 18 nt, Haemophilus influenzae Rd
uacccauuucgaucauau

SEQ ID NO: 696270 - RNA, 14 nt, Haemophilus influenzae Rd
uaccgaaguaagau

SEQ ID NO: 696271 - RNA, 22 nt, Haemophilus influenzae Rd
uaccgaaguaagauguuguaaa

SEQ ID NO: 696272 - RNA, 14 nt, Haemophilus influenzae Rd
uaccgcuucuuccu

SEQ ID NO: 696273 - RNA, 20 nt, Haemophilus influenzae Rd
uaccgcucgccaauaaaaug

SEQ ID NO: 696274 - RNA, 19 nt, Haemophilus influenzae Rd
uaccgcacuuuugagugcu

SEQ ID NO: 696275 - RNA, 20 nt, Haemophilus influenzae Rd
uaccgcacuuuuuauuuuuc

SEQ ID NO: 696276 - RNA, 14 nt, Haemophilus influenzae Rd
uaccgcacuuuuuu

SEQ ID NO: 696277 - RNA, 22 nt, Haemophilus influenzae Rd
uaccgcacuuuuuuucuuauuu

SEQ ID NO: 696278 - RNA, 19 nt, Haemophilus influenzae Rd
uacccgugccuaauucacu

SEQ ID NO: 696279 - RNA, 16 nt, Haemophilus influenzae Rd
uacccguauuaaauac

SEQ ID NO: 696280 - RNA, 18 nt, Haemophilus influenzae Rd
uaccccucguucucccac

SEQ ID NO: 696281 - RNA, 18 nt, Haemophilus influenzae Rd
uaccccucuuuucucaaa

SEQ ID NO: 696282 - RNA, 18 nt, Haemophilus influenzae Rd
uacuugaacuaauaucac

SEQ ID NO: 696283 - RNA, 22 nt, Haemophilus influenzae Rd
uacuugaccagagccaaauaca

SEQ ID NO: 696284 - RNA, 21 nt, Haemophilus influenzae Rd
uacuuuauaaaugauuggauu

SEQ ID NO: 696285 - RNA, 19 nt, Haemophilus influenzae Rd
uacuuuauacuaaaaguac

SEQ ID NO: 696286 - RNA, 23 nt, Haemophilus influenzae Rd
uacuuuagaaauucgauugcauu

SEQ ID NO: 696287 - RNA, 14 nt, Haemophilus influenzae Rd
uacuugcagugaug

SEQ ID NO: 696288 - RNA, 21 nt, Haemophilus influenzae Rd
uacuugaucggcuacuauaca

SEQ ID NO: 696289 - RNA, 13 nt, Haemophilus influenzae Rd
uacuuaaaauuca

SEQ ID NO: 696290 - RNA, 20 nt, Haemophilus influenzae Rd
uacuucaccgugaaguugga

SEQ ID NO: 696291 - RNA, 21 nt, Haemophilus influenzae Rd
uacuucacaguaaagauuaga

SEQ ID NO: 696292 - RNA, 17 nt, Haemophilus influenzae Rd
uacugcuuuauuuucuu

SEQ ID NO: 696293 - RNA, 19 nt, Haemophilus influenzae Rd
uacuggaaauucuucaaua

SEQ ID NO: 696294 - RNA, 17 nt, Haemophilus influenzae Rd
uacugugccgauuacuu

SEQ ID NO: 696295 - RNA, 17 nt, Haemophilus influenzae Rd
uacuguggauaauucau

SEQ ID NO: 696296 - RNA, 15 nt, Haemophilus influenzae Rd
uacuguuaauuugcc

SEQ ID NO: 696297 - RNA, 21 nt, Haemophilus influenzae Rd
uacuguuaccaauaacuaaaa

SEQ ID NO: 696298 - RNA, 18 nt, Haemophilus influenzae Rd
uacuagcaaaacaagaca

SEQ ID NO: 696299 - RNA, 20 nt, Haemophilus influenzae Rd
uacuagcucguaaagaucau

SEQ ID NO: 696300 - RNA, 18 nt, Haemophilus influenzae Rd
uacucuugucaauaaauc

SEQ ID NO: 696301 - RNA, 19 nt, Haemophilus influenzae Rd
uacucucccgaaaauuguu

SEQ ID NO: 696302 - RNA, 20 nt, Haemophilus influenzae Rd
uacugauaccguuaaggcau

SEQ ID NO: 696303 - RNA, 15 nt, Haemophilus influenzae Rd
uacugagaucucuau

SEQ ID NO: 696304 - RNA, 11 nt, Haemophilus influenzae Rd
uacugauuuua

SEQ ID NO: 696305 - RNA, 17 nt, Haemophilus influenzae Rd
uacugcagcauuuaaag

SEQ ID NO: 696306 - RNA, 12 nt, Haemophilus influenzae Rd
uacugaauaaaa

SEQ ID NO: 696307 - RNA, 14 nt, Haemophilus influenzae Rd
uacugaauaaaaaa

SEQ ID NO: 696308 - RNA, 18 nt, Haemophilus influenzae Rd
uacucuuuuuuagauaaa

SEQ ID NO: 696309 - RNA, 13 nt, Haemophilus influenzae Rd
uacguaauuuaau

SEQ ID NO: 696310 - RNA, 17 nt, Haemophilus influenzae Rd
uacguagaaaacaauaa

SEQ ID NO: 696311 - RNA, 19 nt, Haemophilus influenzae Rd
uacgucaauugcuaaaccu

SEQ ID NO: 696312 - RNA, 22 nt, Haemophilus influenzae Rd
uacguaauaaguuuucaucaau

SEQ ID NO: 696313 - RNA, 22 nt, Haemophilus influenzae Rd
uacguaaucccauuucaucuuc

SEQ ID NO: 696314 - RNA, 14 nt, Haemophilus influenzae Rd
uacguaaugcuuuu

SEQ ID NO: 696315 - RNA, 15 nt, Haemophilus influenzae Rd
uacuaauucauuaca

SEQ ID NO: 696316 - RNA, 15 nt, Haemophilus influenzae Rd
uacuaauuguuguaa

SEQ ID NO: 696317 - RNA, 15 nt, Haemophilus influenzae Rd
uacuaacucaaaaua

SEQ ID NO: 696318 - RNA, 21 nt, Haemophilus influenzae Rd
uacuaaaugugacauuguaaa

SEQ ID NO: 696319 - RNA, 15 nt, Haemophilus influenzae Rd
uacgccauucuuuau

SEQ ID NO: 696320 - RNA, 13 nt, Haemophilus influenzae Rd
uacgcccauugaa

SEQ ID NO: 696321 - RNA, 12 nt, Haemophilus influenzae Rd
uacgccuaacca

SEQ ID NO: 696322 - RNA, 14 nt, Haemophilus influenzae Rd
uacgcaauuuagau

SEQ ID NO: 696323 - RNA, 18 nt, Haemophilus influenzae Rd
uacgaguaaaaaaucuau

SEQ ID NO: 696324 - RNA, 17 nt, Haemophilus influenzae Rd
uacgauuguauuuuaaa

SEQ ID NO: 696325 - RNA, 22 nt, Haemophilus influenzae Rd
uacgagaaacgauaauguucac

SEQ ID NO: 696326 - RNA, 22 nt, Haemophilus influenzae Rd
uacgagaaagguguaauuccau

SEQ ID NO: 696327 - RNA, 19 nt, Haemophilus influenzae Rd
uacgacaucuuaaauuaua

SEQ ID NO: 696328 - RNA, 17 nt, Haemophilus influenzae Rd
uacgacauucuuuagaa

SEQ ID NO: 696329 - RNA, 17 nt, Haemophilus influenzae Rd
uacgacauuuuuaacua

SEQ ID NO: 696330 - RNA, 19 nt, Haemophilus influenzae Rd
uaccgguuacuuggaugaa

SEQ ID NO: 696331 - RNA, 20 nt, Haemophilus influenzae Rd
uaccguauuuuuuuaauuuu

SEQ ID NO: 696332 - RNA, 23 nt, Haemophilus influenzae Rd
uaccgucagccaaauuuuucuuu

SEQ ID NO: 696333 - RNA, 20 nt, Haemophilus influenzae Rd
uaccgucaugggauaaacau

SEQ ID NO: 696334 - RNA, 22 nt, Haemophilus influenzae Rd
gucaucacucguugguauuuac

SEQ ID NO: 696335 - RNA, 19 nt, Haemophilus influenzae Rd
gucaucagaaauaucuuca

SEQ ID NO: 696336 - RNA, 17 nt, Haemophilus influenzae Rd
gucaucgaguuuuauaa

SEQ ID NO: 696337 - RNA, 19 nt, Haemophilus influenzae Rd
gucaugugauuaaacggac

SEQ ID NO: 696338 - RNA, 17 nt, Haemophilus influenzae Rd
gucauuaauuuuuucac

SEQ ID NO: 696339 - RNA, 16 nt, Haemophilus influenzae Rd
guccaaagaaguuuuc

SEQ ID NO: 696340 - RNA, 16 nt, Haemophilus influenzae Rd
gucaugggauaaacau

SEQ ID NO: 696341 - RNA, 20 nt, Haemophilus influenzae Rd
gucaugggauaaacauuucu

SEQ ID NO: 696342 - RNA, 19 nt, Haemophilus influenzae Rd
guccacaagccauauuuua

SEQ ID NO: 696343 - RNA, 12 nt, Haemophilus influenzae Rd
guccaccacugg

SEQ ID NO: 696344 - RNA, 17 nt, Haemophilus influenzae Rd
guccaugcguuuuauuu

SEQ ID NO: 696345 - RNA, 18 nt, Haemophilus influenzae Rd
gucacgcuguaaacaaga

SEQ ID NO: 696346 - RNA, 19 nt, Haemophilus influenzae Rd
ggugaaaggaaacgcccau

SEQ ID NO: 696347 - RNA, 23 nt, Haemophilus influenzae Rd
ggugaaauuucaccgcauucuuc

SEQ ID NO: 696348 - RNA, 22 nt, Haemophilus influenzae Rd
gucacugcaguaaaaucuucac

SEQ ID NO: 696349 - RNA, 14 nt, Haemophilus influenzae Rd
gucagcauaaacaa

SEQ ID NO: 696350 - RNA, 14 nt, Haemophilus influenzae Rd
gucgaguuuuucaa

SEQ ID NO: 696351 - RNA, 21 nt, Haemophilus influenzae Rd
gucccgcuuuugccauauuua

SEQ ID NO: 696352 - RNA, 18 nt, Haemophilus influenzae Rd
gucccgcauauaaaauaa

SEQ ID NO: 696353 - RNA, 22 nt, Haemophilus influenzae Rd
gucgcuuuuuccucagcaaaag

SEQ ID NO: 696354 - RNA, 19 nt, Haemophilus influenzae Rd
gucgcuuucuuauauucaa

SEQ ID NO: 696355 - RNA, 19 nt, Haemophilus influenzae Rd
gucgcagccuuguucugca

SEQ ID NO: 696356 - RNA, 14 nt, Haemophilus influenzae Rd
gucucgcccagagc

SEQ ID NO: 696357 - RNA, 15 nt, Haemophilus influenzae Rd
gucucgguuugcuuu

SEQ ID NO: 696358 - RNA, 22 nt, Haemophilus influenzae Rd
gucucucaccgugccacgccca

SEQ ID NO: 696359 - RNA, 15 nt, Haemophilus influenzae Rd
gucgugaucugcauc

SEQ ID NO: 696360 - RNA, 13 nt, Haemophilus influenzae Rd
gucguuauucauc

SEQ ID NO: 696361 - RNA, 13 nt, Haemophilus influenzae Rd
gucguuauuuuuu

SEQ ID NO: 696362 - RNA, 17 nt, Haemophilus influenzae Rd
gucugcuaaugcccaag

SEQ ID NO: 696363 - RNA, 18 nt, Haemophilus influenzae Rd
gucugcuccaaauaaucc

SEQ ID NO: 696364 - RNA, 18 nt, Haemophilus influenzae Rd
gucugcgccuaaaauauu

SEQ ID NO: 696365 - RNA, 14 nt, Haemophilus influenzae Rd
gucugaaauuuuua

SEQ ID NO: 696366 - RNA, 14 nt, Haemophilus influenzae Rd
gucuugcuuuuuaa

SEQ ID NO: 696367 - RNA, 20 nt, Haemophilus influenzae Rd
gucuuacuuuuuguuuguaa

SEQ ID NO: 696368 - RNA, 19 nt, Haemophilus influenzae Rd
gucuuaaucuuaucaaaca

SEQ ID NO: 696369 - RNA, 13 nt, Haemophilus influenzae Rd
gucuuaauuuuuu

SEQ ID NO: 696370 - RNA, 21 nt, Haemophilus influenzae Rd
gucuuccacaacggaagauuu

SEQ ID NO: 696371 - RNA, 19 nt, Haemophilus influenzae Rd
gucuguugcaaauuuuuca

SEQ ID NO: 696372 - RNA, 21 nt, Haemophilus influenzae Rd
gucuguugcaaauuuuucauu

SEQ ID NO: 696373 - RNA, 12 nt, Haemophilus influenzae Rd
gucuguuuaaaa

SEQ ID NO: 696374 - RNA, 23 nt, Haemophilus influenzae Rd
gugaaagaagauuuauauaccuu

SEQ ID NO: 696375 - RNA, 13 nt, Haemophilus influenzae Rd
gugaaauaaaaua

SEQ ID NO: 696376 - RNA, 23 nt, Haemophilus influenzae Rd
gugaaaaucuguugaaucucagc

SEQ ID NO: 696377 - RNA, 18 nt, Haemophilus influenzae Rd
gucuuguuuucaauaguu

SEQ ID NO: 696378 - RNA, 22 nt, Haemophilus influenzae Rd
gucuuuaggauuguugauuuug

SEQ ID NO: 696379 - RNA, 19 nt, Haemophilus influenzae Rd
gucuuuuuaauuuaaauaa

SEQ ID NO: 696380 - RNA, 13 nt, Haemophilus influenzae Rd
gucuuuguuaucg

SEQ ID NO: 696381 - RNA, 20 nt, Haemophilus influenzae Rd
gucuuuuaacacauaagcac

SEQ ID NO: 696382 - RNA, 14 nt, Haemophilus influenzae Rd
gucuuuuuuuguug

SEQ ID NO: 696383 - RNA, 12 nt, Haemophilus influenzae Rd
gugaaaaaauaa

SEQ ID NO: 696384 - RNA, 19 nt, Haemophilus influenzae Rd
gugaaaaaauaaccacuag

SEQ ID NO: 696385 - RNA, 17 nt, Haemophilus influenzae Rd
aaauaggcugaaaaaau

SEQ ID NO: 696386 - RNA, 13 nt, Haemophilus influenzae Rd
aaauaggcacaua

SEQ ID NO: 696387 - RNA, 16 nt, Haemophilus influenzae Rd
aaauagucauaaaggc

SEQ ID NO: 696388 - RNA, 23 nt, Haemophilus influenzae Rd
gugaccacggauaaaugcgugaa

SEQ ID NO: 696389 - RNA, 13 nt, Haemophilus influenzae Rd
gugaccagucauu

SEQ ID NO: 696390 - RNA, 17 nt, Haemophilus influenzae Rd
aaauaguugaugccccu

SEQ ID NO: 696391 - RNA, 13 nt, Haemophilus influenzae Rd
aaauaguuuaaua

SEQ ID NO: 696392 - RNA, 17 nt, Haemophilus influenzae Rd
gugacagcuugcauauu

SEQ ID NO: 696393 - RNA, 17 nt, Haemophilus influenzae Rd
aaauaguuaaagaaaau

SEQ ID NO: 696394 - RNA, 14 nt, Haemophilus influenzae Rd
aaauaguuaauaau

SEQ ID NO: 696395 - RNA, 16 nt, Haemophilus influenzae Rd
gugaaugacuuucacu

SEQ ID NO: 696396 - RNA, 17 nt, Haemophilus influenzae Rd
gugaaugaugccauuuu

SEQ ID NO: 696397 - RNA, 19 nt, Haemophilus influenzae Rd
gugaaucacaacauauaaa

SEQ ID NO: 696398 - RNA, 20 nt, Haemophilus influenzae Rd
gugaaucacaacauauaaau

SEQ ID NO: 696399 - RNA, 12 nt, Haemophilus influenzae Rd
gugaauuuauca

SEQ ID NO: 696400 - RNA, 14 nt, Haemophilus influenzae Rd
gugaauuuaucauc

SEQ ID NO: 696401 - RNA, 19 nt, Haemophilus influenzae Rd
gugaaguuauaguauauuu

SEQ ID NO: 696402 - RNA, 18 nt, Haemophilus influenzae Rd
gugaaguuuaugaucuac

SEQ ID NO: 696403 - RNA, 23 nt, Haemophilus influenzae Rd
gugaaguuuuuuaaguuuccaag

SEQ ID NO: 696404 - RNA, 15 nt, Haemophilus influenzae Rd
gugaauauaagaaau

SEQ ID NO: 696405 - RNA, 18 nt, Haemophilus influenzae Rd
aaauagccuaaauauuua

SEQ ID NO: 696406 - RNA, 22 nt, Haemophilus influenzae Rd
aaauagccuucaucacaaaucu

SEQ ID NO: 696407 - RNA, 22 nt, Haemophilus influenzae Rd
aaauagcuaacaaauuuaauau

SEQ ID NO: 696408 - RNA, 16 nt, Haemophilus influenzae Rd
aaauagcuaacaauau

SEQ ID NO: 696409 - RNA, 19 nt, Haemophilus influenzae Rd
gugaucccagcauaaauaa

SEQ ID NO: 696410 - RNA, 13 nt, Haemophilus influenzae Rd
gugaugaaacaau

SEQ ID NO: 696411 - RNA, 18 nt, Haemophilus influenzae Rd
gugcagaauuuggaucuu

SEQ ID NO: 696412 - RNA, 15 nt, Haemophilus influenzae Rd
gugcaauuugaucuu

SEQ ID NO: 696413 - RNA, 16 nt, Haemophilus influenzae Rd
gugcaauuugaucuuc

SEQ ID NO: 696414 - RNA, 19 nt, Haemophilus influenzae Rd
gugagcuaagcauuucagu

SEQ ID NO: 696415 - RNA, 22 nt, Haemophilus influenzae Rd
gugagcuuguuggaaaaaugcu

SEQ ID NO: 696416 - RNA, 17 nt, Haemophilus influenzae Rd
gugagugagcauuucgu

SEQ ID NO: 696417 - RNA, 13 nt, Haemophilus influenzae Rd
gugagauccuuua

SEQ ID NO: 696418 - RNA, 22 nt, Haemophilus influenzae Rd
gugacuuuaguuggaucuaaga

SEQ ID NO: 696419 - RNA, 14 nt, Haemophilus influenzae Rd
aaauauaaaauaaa

SEQ ID NO: 696420 - RNA, 18 nt, Haemophilus influenzae Rd
aaauauaaaacuuuucuu

SEQ ID NO: 696421 - RNA, 13 nt, Haemophilus influenzae Rd
aaauauaaaauaa

SEQ ID NO: 696422 - RNA, 21 nt, Haemophilus influenzae Rd
aaauauaauaaauauguugaa

SEQ ID NO: 696423 - RNA, 17 nt, Haemophilus influenzae Rd
aaauauaagaaaaacau

SEQ ID NO: 696424 - RNA, 14 nt, Haemophilus influenzae Rd
aaauauaaauaguu

SEQ ID NO: 696425 - RNA, 15 nt, Haemophilus influenzae Rd
aaauauaaauggaaa

SEQ ID NO: 696426 - RNA, 14 nt, Haemophilus influenzae Rd
aaauauaaugaaaa

SEQ ID NO: 696427 - RNA, 16 nt, Haemophilus influenzae Rd
aaauauaaugaauuau

SEQ ID NO: 696428 - RNA, 22 nt, Haemophilus influenzae Rd
aaauauacaauucuuguuuaau

SEQ ID NO: 696429 - RNA, 14 nt, Haemophilus influenzae Rd
aaauauaauuaauc

SEQ ID NO: 696430 - RNA, 18 nt, Haemophilus influenzae Rd
guggaaauugccaaaaaa

SEQ ID NO: 696431 - RNA, 19 nt, Haemophilus influenzae Rd
guggaaacuaauuuuguug

SEQ ID NO: 696432 - RNA, 16 nt, Haemophilus influenzae Rd
guggaaagguugcuau

SEQ ID NO: 696433 - RNA, 19 nt, Haemophilus influenzae Rd
guggauaauucaucaaaau

SEQ ID NO: 696434 - RNA, 20 nt, Haemophilus influenzae Rd
guggaucaugguaauuuaau

SEQ ID NO: 696435 - RNA, 20 nt, Haemophilus influenzae Rd
guggaucguaaauuaauaag

SEQ ID NO: 696436 - RNA, 17 nt, Haemophilus influenzae Rd
guggauugguuggaaac

SEQ ID NO: 696437 - RNA, 13 nt, Haemophilus influenzae Rd
guggaauaaaaua

SEQ ID NO: 696438 - RNA, 14 nt, Haemophilus influenzae Rd
guggaacucuuuca

SEQ ID NO: 696439 - RNA, 15 nt, Haemophilus influenzae Rd
guggaguuauuucuu

SEQ ID NO: 696440 - RNA, 14 nt, Haemophilus influenzae Rd
gugggaauuuuccc

SEQ ID NO: 696441 - RNA, 17 nt, Haemophilus influenzae Rd
guggcauaaagaaacag

SEQ ID NO: 696442 - RNA, 22 nt, Haemophilus influenzae Rd
guggcgaaauuuccgcagguga

SEQ ID NO: 696443 - RNA, 17 nt, Haemophilus influenzae Rd
guguagcaauaaacaga

SEQ ID NO: 696444 - RNA, 20 nt, Haemophilus influenzae Rd
guguagauaaaauauucaaa

SEQ ID NO: 696445 - RNA, 23 nt, Haemophilus influenzae Rd
gugucacagcaagaacagccagu

SEQ ID NO: 696446 - RNA, 13 nt, Haemophilus influenzae Rd
gugugaaauuccu

SEQ ID NO: 696447 - RNA, 17 nt, Haemophilus influenzae Rd
gugucucugcccauaag

SEQ ID NO: 696448 - RNA, 14 nt, Haemophilus influenzae Rd
gugggugcugcaac

SEQ ID NO: 696449 - RNA, 19 nt, Haemophilus influenzae Rd
gugguuauuugauuaucua

SEQ ID NO: 696450 - RNA, 16 nt, Haemophilus influenzae Rd
gugguuucagaauaaa

SEQ ID NO: 696451 - RNA, 14 nt, Haemophilus influenzae Rd
guguuaucacaauu

SEQ ID NO: 696452 - RNA, 16 nt, Haemophilus influenzae Rd
guguucgcuuccuuuc

SEQ ID NO: 696453 - RNA, 14 nt, Haemophilus influenzae Rd
guguuaagcaccau

SEQ ID NO: 696454 - RNA, 14 nt, Haemophilus influenzae Rd
guguggugauuuua

SEQ ID NO: 696455 - RNA, 22 nt, Haemophilus influenzae Rd
gugugcuugcauuuacauaaac

SEQ ID NO: 696456 - RNA, 13 nt, Haemophilus influenzae Rd
guguggaaaaaug

SEQ ID NO: 696457 - RNA, 17 nt, Haemophilus influenzae Rd
gugugauuuuagaaaaa

SEQ ID NO: 696458 - RNA, 20 nt, Haemophilus influenzae Rd
aaauaucaacagcuucuccu

SEQ ID NO: 696459 - RNA, 19 nt, Haemophilus influenzae Rd
aaauauauuuagauacaaa

SEQ ID NO: 696460 - RNA, 14 nt, Haemophilus influenzae Rd
aaauauaucaagca

SEQ ID NO: 696461 - RNA, 18 nt, Haemophilus influenzae Rd
aaauauaugggaaacaau

SEQ ID NO: 696462 - RNA, 19 nt, Haemophilus influenzae Rd
aaauauaugggaaacaaua

SEQ ID NO: 696463 - RNA, 23 nt, Haemophilus influenzae Rd
aaauaucagcccuuuguuuuaau

SEQ ID NO: 696464 - RNA, 13 nt, Haemophilus influenzae Rd
aaauaucacuuuu

SEQ ID NO: 696465 - RNA, 23 nt, Haemophilus influenzae Rd
aaauauccccauugaauuaaaaa

SEQ ID NO: 696466 - RNA, 17 nt, Haemophilus influenzae Rd
guuaaaccaacaacugc

SEQ ID NO: 696467 - RNA, 11 nt, Haemophilus influenzae Rd
guuaaaaauag

SEQ ID NO: 696468 - RNA, 15 nt, Haemophilus influenzae Rd
guuaaaaguaagcaa

SEQ ID NO: 696469 - RNA, 21 nt, Haemophilus influenzae Rd
guuaaaaguaagcaauuuucu

SEQ ID NO: 696470 - RNA, 15 nt, Haemophilus influenzae Rd
guuaaaaguuuuuua

SEQ ID NO: 696471 - RNA, 10 nt, Haemophilus influenzae Rd
guuaaaauau

SEQ ID NO: 696472 - RNA, 22 nt, Haemophilus influenzae Rd
guuaaaauugccccuucaccuu

SEQ ID NO: 696473 - RNA, 18 nt, Haemophilus influenzae Rd
guuaagcaaauuucuguu

SEQ ID NO: 696474 - RNA, 18 nt, Haemophilus influenzae Rd
guuaagccgauauuaucu

SEQ ID NO: 696475 - RNA, 16 nt, Haemophilus influenzae Rd
guuaaugaaacuucac

SEQ ID NO: 696476 - RNA, 17 nt, Haemophilus influenzae Rd
guuaauggaugaauaca

SEQ ID NO: 696477 - RNA, 23 nt, Haemophilus influenzae Rd
guuaauucacuacgauuuaaugu

SEQ ID NO: 696478 - RNA, 14 nt, Haemophilus influenzae Rd
guuaauuaagcagc

SEQ ID NO: 696479 - RNA, 15 nt, Haemophilus influenzae Rd
guuaauuagaauaac

SEQ ID NO: 696480 - RNA, 20 nt, Haemophilus influenzae Rd
guuaauuaucaaaaagaaau

SEQ ID NO: 696481 - RNA, 18 nt, Haemophilus influenzae Rd
guuaauuuuaaauuuucu

SEQ ID NO: 696482 - RNA, 12 nt, Haemophilus influenzae Rd
guuaauuuucac

SEQ ID NO: 696483 - RNA, 21 nt, Haemophilus influenzae Rd
guuagaaauacauuauuaaaa

SEQ ID NO: 696484 - RNA, 15 nt, Haemophilus influenzae Rd
guuagaauaaaccaa

SEQ ID NO: 696485 - RNA, 15 nt, Haemophilus influenzae Rd
guuaccuuuuccaau

SEQ ID NO: 696486 - RNA, 13 nt, Haemophilus influenzae Rd
guuacucauucua

SEQ ID NO: 696487 - RNA, 19 nt, Haemophilus influenzae Rd
guuaccgacaaccauauua

SEQ ID NO: 696488 - RNA, 13 nt, Haemophilus influenzae Rd
guuaccgcugcag

SEQ ID NO: 696489 - RNA, 19 nt, Haemophilus influenzae Rd
guuauauucagcaaaauca

SEQ ID NO: 696490 - RNA, 14 nt, Haemophilus influenzae Rd
guuaucaaagaaac

SEQ ID NO: 696491 - RNA, 22 nt, Haemophilus influenzae Rd
guuauacgccccuugauaauuc

SEQ ID NO: 696492 - RNA, 14 nt, Haemophilus influenzae Rd
guuauacugaauua

SEQ ID NO: 696493 - RNA, 19 nt, Haemophilus influenzae Rd
guuauaccacauaaaugug

SEQ ID NO: 696494 - RNA, 14 nt, Haemophilus influenzae Rd
guuaugaaauugcu

SEQ ID NO: 696495 - RNA, 23 nt, Haemophilus influenzae Rd
guuaugaagcccuauaccaccag

SEQ ID NO: 696496 - RNA, 17 nt, Haemophilus influenzae Rd
guuaugagccaagaaug

SEQ ID NO: 696497 - RNA, 22 nt, Haemophilus influenzae Rd
guuaugcaaauacauauuuuua

SEQ ID NO: 696498 - RNA, 12 nt, Haemophilus influenzae Rd
guuauugccuaa

SEQ ID NO: 696499 - RNA, 15 nt, Haemophilus influenzae Rd
guuaugcuuuauucu

SEQ ID NO: 696500 - RNA, 12 nt, Haemophilus influenzae Rd
guucuaaaaugg

SEQ ID NO: 696501 - RNA, 15 nt, Haemophilus influenzae Rd
guucacguaaguagu

SEQ ID NO: 696502 - RNA, 21 nt, Haemophilus influenzae Rd
guucagccaauuuuucaaaac

SEQ ID NO: 696503 - RNA, 21 nt, Haemophilus influenzae Rd
guucagcccuuuuaguuuccc

SEQ ID NO: 696504 - RNA, 16 nt, Haemophilus influenzae Rd
guuauuuugauaacgc

SEQ ID NO: 696505 - RNA, 16 nt, Haemophilus influenzae Rd
guuauuggaaaauuca

SEQ ID NO: 696506 - RNA, 12 nt, Haemophilus influenzae Rd
guuauuuaaccu

SEQ ID NO: 696507 - RNA, 23 nt, Haemophilus influenzae Rd
guuauugucugcuccaaauaauc

SEQ ID NO: 696508 - RNA, 14 nt, Haemophilus influenzae Rd
guuauuucuugcca

SEQ ID NO: 696509 - RNA, 22 nt, Haemophilus influenzae Rd
guuauuugagcaagaugaauua

SEQ ID NO: 696510 - RNA, 14 nt, Haemophilus influenzae Rd
guuccaauuuugga

SEQ ID NO: 696511 - RNA, 21 nt, Haemophilus influenzae Rd
guuccacuucauaaauccaau

SEQ ID NO: 696512 - RNA, 17 nt, Haemophilus influenzae Rd
guuccaccuugaauaau

SEQ ID NO: 696513 - RNA, 16 nt, Haemophilus influenzae Rd
guuccaccacccuucu

SEQ ID NO: 696514 - RNA, 23 nt, Haemophilus influenzae Rd
guucaucaucaucgauaaauuca

SEQ ID NO: 696515 - RNA, 16 nt, Haemophilus influenzae Rd
guucaucauuugcucu

SEQ ID NO: 696516 - RNA, 18 nt, Haemophilus influenzae Rd
guugccgcugaaaugaag

SEQ ID NO: 696517 - RNA, 21 nt, Haemophilus influenzae Rd
guugcacuuggguaaauauaa

SEQ ID NO: 696518 - RNA, 18 nt, Haemophilus influenzae Rd
guugcacauuaauuugug

SEQ ID NO: 696519 - RNA, 20 nt, Haemophilus influenzae Rd
guugcacauuaauuugugag

SEQ ID NO: 696520 - RNA, 21 nt, Haemophilus influenzae Rd
guugaguauagucauucaaug

SEQ ID NO: 696521 - RNA, 13 nt, Haemophilus influenzae Rd
guugauaaucauc

SEQ ID NO: 696522 - RNA, 15 nt, Haemophilus influenzae Rd
guugcaccuuuaaau

SEQ ID NO: 696523 - RNA, 16 nt, Haemophilus influenzae Rd
guugcaccuuuauuug

SEQ ID NO: 696524 - RNA, 20 nt, Haemophilus influenzae Rd
guugagcgagguaagcugaa

SEQ ID NO: 696525 - RNA, 21 nt, Haemophilus influenzae Rd
guugagcgagguaagcugaag

SEQ ID NO: 696526 - RNA, 19 nt, Haemophilus influenzae Rd
guucucguugcaucuucua

SEQ ID NO: 696527 - RNA, 19 nt, Haemophilus influenzae Rd
guugagcauaacguauuuu

SEQ ID NO: 696528 - RNA, 19 nt, Haemophilus influenzae Rd
guucuauauuuugaauaau

SEQ ID NO: 696529 - RNA, 16 nt, Haemophilus influenzae Rd
guucuaagguauaaau

SEQ ID NO: 696530 - RNA, 18 nt, Haemophilus influenzae Rd
guucuaagguauaaauaa

SEQ ID NO: 696531 - RNA, 17 nt, Haemophilus influenzae Rd
guucuaaaauuauagaa

SEQ ID NO: 696532 - RNA, 20 nt, Haemophilus influenzae Rd
guucuaaagcacguuucauc

SEQ ID NO: 696533 - RNA, 23 nt, Haemophilus influenzae Rd
guucuaaaggcugagguucaaaa

SEQ ID NO: 696534 - RNA, 18 nt, Haemophilus influenzae Rd
guucuaaauauuuuucaa

SEQ ID NO: 696535 - RNA, 20 nt, Haemophilus influenzae Rd
guugcgugaugaccugcaga

SEQ ID NO: 696536 - RNA, 13 nt, Haemophilus influenzae Rd
guugcucuuucaa

SEQ ID NO: 696537 - RNA, 19 nt, Haemophilus influenzae Rd
guugguauuuacuaaauuc

SEQ ID NO: 696538 - RNA, 14 nt, Haemophilus influenzae Rd
guuggcucaagccu

SEQ ID NO: 696539 - RNA, 12 nt, Haemophilus influenzae Rd
guuguaaaagug

SEQ ID NO: 696540 - RNA, 20 nt, Haemophilus influenzae Rd
guugguucgauaucuaaaau

SEQ ID NO: 696541 - RNA, 21 nt, Haemophilus influenzae Rd
guugguucgauaucuaaaauu

SEQ ID NO: 696542 - RNA, 23 nt, Haemophilus influenzae Rd
guugguucgauaucuaaaauucg

SEQ ID NO: 696543 - RNA, 19 nt, Haemophilus influenzae Rd
guuggaaauuuaagugagu

SEQ ID NO: 696544 - RNA, 19 nt, Haemophilus influenzae Rd
aaauaugauuuagaacaau

SEQ ID NO: 696545 - RNA, 13 nt, Haemophilus influenzae Rd
aaauaugaaauuu

SEQ ID NO: 696546 - RNA, 17 nt, Haemophilus influenzae Rd
aaauaugacuuauuauc

SEQ ID NO: 696547 - RNA, 15 nt, Haemophilus influenzae Rd
aaauaucuuguuuua

SEQ ID NO: 696548 - RNA, 22 nt, Haemophilus influenzae Rd
aaauaucuuugauuuucuuauu

SEQ ID NO: 696549 - RNA, 17 nt, Haemophilus influenzae Rd
aaauaucuucaauuucu

SEQ ID NO: 696550 - RNA, 21 nt, Haemophilus influenzae Rd
aaauaucuucaauuucuaccg

SEQ ID NO: 696551 - RNA, 21 nt, Haemophilus influenzae Rd
aaauaucuucauaucuuugaa

SEQ ID NO: 696552 - RNA, 23 nt, Haemophilus influenzae Rd
aaauaucuucauaucuuugaauu

SEQ ID NO: 696553 - RNA, 16 nt, Haemophilus influenzae Rd
aaauaucuacuuucag

SEQ ID NO: 696554 - RNA, 22 nt, Haemophilus influenzae Rd
aaauaucuaggcuaauuauuua

SEQ ID NO: 696555 - RNA, 20 nt, Haemophilus influenzae Rd
guuucacgaucauaaauuuu

SEQ ID NO: 696556 - RNA, 15 nt, Haemophilus influenzae Rd
guuucagaauaaaga

SEQ ID NO: 696557 - RNA, 20 nt, Haemophilus influenzae Rd
guuucauacaacgcucugca

SEQ ID NO: 696558 - RNA, 18 nt, Haemophilus influenzae Rd
guuuccaaguauuuucug

SEQ ID NO: 696559 - RNA, 17 nt, Haemophilus influenzae Rd
guuucauuuuugcacca

SEQ ID NO: 696560 - RNA, 15 nt, Haemophilus influenzae Rd
aaauauucuauuuau

SEQ ID NO: 696561 - RNA, 21 nt, Haemophilus influenzae Rd
aaauauucucucgcugaauua

SEQ ID NO: 696562 - RNA, 22 nt, Haemophilus influenzae Rd
aaauauucucucgcugaauuau

SEQ ID NO: 696563 - RNA, 15 nt, Haemophilus influenzae Rd
aaauauucuucauaa

SEQ ID NO: 696564 - RNA, 18 nt, Haemophilus influenzae Rd
aaauauucuucauaaaaa

SEQ ID NO: 696565 - RNA, 23 nt, Haemophilus influenzae Rd
aaauauucuucauaaaaaaagac

SEQ ID NO: 696566 - RNA, 15 nt, Haemophilus influenzae Rd
aaauauucuucuaaa

SEQ ID NO: 696567 - RNA, 15 nt, Haemophilus influenzae Rd
aaauauuauuaaaaa

SEQ ID NO: 696568 - RNA, 15 nt, Haemophilus influenzae Rd
aaauauuaucuucau

SEQ ID NO: 696569 - RNA, 22 nt, Haemophilus influenzae Rd
aaauauuaucuucaugauuuuc

SEQ ID NO: 696570 - RNA, 15 nt, Haemophilus influenzae Rd
aaauauucaauuaca

SEQ ID NO: 696571 - RNA, 21 nt, Haemophilus influenzae Rd
aaauauuccaacgauuuugca

SEQ ID NO: 696572 - RNA, 23 nt, Haemophilus influenzae Rd
aaauauuaguuagcuaaaaaaac

SEQ ID NO: 696573 - RNA, 23 nt, Haemophilus influenzae Rd
guugucacaacagauugagcggu

SEQ ID NO: 696574 - RNA, 23 nt, Haemophilus influenzae Rd
guuuaacuucaaccacuucaaau

SEQ ID NO: 696575 - RNA, 21 nt, Haemophilus influenzae Rd
guugucguuauuaugaaauuu

SEQ ID NO: 696576 - RNA, 18 nt, Haemophilus influenzae Rd
guuuaauauuuuuuucaa

SEQ ID NO: 696577 - RNA, 15 nt, Haemophilus influenzae Rd
guuuacugaauaaaa

SEQ ID NO: 696578 - RNA, 14 nt, Haemophilus influenzae Rd
guuuacuauuaaag

SEQ ID NO: 696579 - RNA, 23 nt, Haemophilus influenzae Rd
guuuacgcuaauuuaagaaaaac

SEQ ID NO: 696580 - RNA, 16 nt, Haemophilus influenzae Rd
guuuaucgucugcacg

SEQ ID NO: 696581 - RNA, 16 nt, Haemophilus influenzae Rd
guuuaucucuuucuua

SEQ ID NO: 696582 - RNA, 21 nt, Haemophilus influenzae Rd
guuuaucucuuucuuaaaaua

SEQ ID NO: 696583 - RNA, 22 nt, Haemophilus influenzae Rd
guuuauauaccauuugauucac

SEQ ID NO: 696584 - RNA, 23 nt, Haemophilus influenzae Rd
guuuauauucuggcaauauuuca

SEQ ID NO: 696585 - RNA, 21 nt, Haemophilus influenzae Rd
guuuagaaagcacuucaucac

SEQ ID NO: 696586 - RNA, 17 nt, Haemophilus influenzae Rd
guuuacuuuugauuuua

SEQ ID NO: 696587 - RNA, 22 nt, Haemophilus influenzae Rd
guuuacuuuuuccauaauaacg

SEQ ID NO: 696588 - RNA, 23 nt, Haemophilus influenzae Rd
guuuacuuuuuccauaauaacga

SEQ ID NO: 696589 - RNA, 15 nt, Haemophilus influenzae Rd
guuucaaaucguuug

SEQ ID NO: 696590 - RNA, 14 nt, Haemophilus influenzae Rd
guuucaacauaucg

SEQ ID NO: 696591 - RNA, 16 nt, Haemophilus influenzae Rd
guuucaacaaaaauac

SEQ ID NO: 696592 - RNA, 21 nt, Haemophilus influenzae Rd
guuucaacaaaaauacguugu

SEQ ID NO: 696593 - RNA, 19 nt, Haemophilus influenzae Rd
guuuaugccauagcuccaa

SEQ ID NO: 696594 - RNA, 16 nt, Haemophilus influenzae Rd
guuucaauuuacccac

SEQ ID NO: 696595 - RNA, 16 nt, Haemophilus influenzae Rd
guuucaacuuggaaag

SEQ ID NO: 696596 - RNA, 19 nt, Haemophilus influenzae Rd
guuucaaugucuuuuucuu

SEQ ID NO: 696597 - RNA, 11 nt, Haemophilus influenzae Rd
aaauauuuaaa

SEQ ID NO: 696598 - RNA, 12 nt, Haemophilus influenzae Rd
aaauauuuaaaa

SEQ ID NO: 696599 - RNA, 17 nt, Haemophilus influenzae Rd
aaauauuuaaaaagaau

SEQ ID NO: 696600 - RNA, 23 nt, Haemophilus influenzae Rd
aaauauugguuauuuaaaccauu

SEQ ID NO: 696601 - RNA, 15 nt, Haemophilus influenzae Rd
aaauauuguccuaau

SEQ ID NO: 696602 - RNA, 22 nt, Haemophilus influenzae Rd
aaauauuguccuaauuaauuua

SEQ ID NO: 696603 - RNA, 20 nt, Haemophilus influenzae Rd
aaauauugucuauuugcuuu

SEQ ID NO: 696604 - RNA, 16 nt, Haemophilus influenzae Rd
aaauauugcucucccu

SEQ ID NO: 696605 - RNA, 21 nt, Haemophilus influenzae Rd
aaauauuggaguuagaauaau

SEQ ID NO: 696606 - RNA, 17 nt, Haemophilus influenzae Rd
aaauauugauuacccau

SEQ ID NO: 696607 - RNA, 21 nt, Haemophilus influenzae Rd
aaauauuuacgacuaaaauua

SEQ ID NO: 696608 - RNA, 18 nt, Haemophilus influenzae Rd
aaauauugccugaguuau

SEQ ID NO: 696609 - RNA, 22 nt, Haemophilus influenzae Rd
aaauauuuaggcuauuuuauaa

SEQ ID NO: 696610 - RNA, 12 nt, Haemophilus influenzae Rd
aaauauuucacu

SEQ ID NO: 696611 - RNA, 17 nt, Haemophilus influenzae Rd
aaauauuucacuagucu

SEQ ID NO: 696612 - RNA, 14 nt, Haemophilus influenzae Rd
aaauauuucauuug

SEQ ID NO: 696613 - RNA, 12 nt, Haemophilus influenzae Rd
aaauauuuuaau

SEQ ID NO: 696614 - RNA, 14 nt, Haemophilus influenzae Rd
aaauauuuuaauaa

SEQ ID NO: 696615 - RNA, 22 nt, Haemophilus influenzae Rd
aaauauuuuaauaaagauaaau

SEQ ID NO: 696616 - RNA, 12 nt, Haemophilus influenzae Rd
aaauauuuuuac

SEQ ID NO: 696617 - RNA, 12 nt, Haemophilus influenzae Rd
aaauauuuuuau

SEQ ID NO: 696618 - RNA, 19 nt, Haemophilus influenzae Rd
aaauauuuuuuaguuuguu

SEQ ID NO: 696619 - RNA, 15 nt, Haemophilus influenzae Rd
aaaucaaauuuagga

SEQ ID NO: 696620 - RNA, 13 nt, Haemophilus influenzae Rd
aaaucaaauuuuc

SEQ ID NO: 696621 - RNA, 15 nt, Haemophilus influenzae Rd
aaaucaaauuuuccu

SEQ ID NO: 696622 - RNA, 22 nt, Haemophilus influenzae Rd
aaaucaaagugcgguaaauuuu

SEQ ID NO: 696623 - RNA, 13 nt, Haemophilus influenzae Rd
aaaucaaauaauu

SEQ ID NO: 696624 - RNA, 19 nt, Haemophilus influenzae Rd
aaaucaaauaauucaagau

SEQ ID NO: 696625 - RNA, 17 nt, Haemophilus influenzae Rd
aaaucaacacaccauuu

SEQ ID NO: 696626 - RNA, 17 nt, Haemophilus influenzae Rd
aaaucaaacaaaauuuu

SEQ ID NO: 696627 - RNA, 13 nt, Haemophilus influenzae Rd
aaaucaaacaacg

SEQ ID NO: 696628 - RNA, 15 nt, Haemophilus influenzae Rd
aaaucaaaagaaauu

SEQ ID NO: 696629 - RNA, 17 nt, Haemophilus influenzae Rd
aaaucaaaagaaauuaa

SEQ ID NO: 696630 - RNA, 14 nt, Haemophilus influenzae Rd
aaaucaaaaaugcu

SEQ ID NO: 696631 - RNA, 14 nt, Haemophilus influenzae Rd
aaaucaaagauauu

SEQ ID NO: 696632 - RNA, 18 nt, Haemophilus influenzae Rd
aaaucaaagauauuuuua

SEQ ID NO: 696633 - RNA, 20 nt, Haemophilus influenzae Rd
aaaucacgccagauaaaauu

SEQ ID NO: 696634 - RNA, 15 nt, Haemophilus influenzae Rd
aaaucacauaaaaaa

SEQ ID NO: 696635 - RNA, 13 nt, Haemophilus influenzae Rd
aaaucacaccuuu

SEQ ID NO: 696636 - RNA, 16 nt, Haemophilus influenzae Rd
aaaucacacguucauu

SEQ ID NO: 696637 - RNA, 21 nt, Haemophilus influenzae Rd
aaaucacaauaaaagcaauaa

SEQ ID NO: 696638 - RNA, 13 nt, Haemophilus influenzae Rd
aaaucacaauaag

SEQ ID NO: 696639 - RNA, 16 nt, Haemophilus influenzae Rd
aaaucacaauaagcaa

SEQ ID NO: 696640 - RNA, 15 nt, Haemophilus influenzae Rd
guuucuaaaauaaac

SEQ ID NO: 696641 - RNA, 19 nt, Haemophilus influenzae Rd
guuucuaaacguuuuugaa

SEQ ID NO: 696642 - RNA, 17 nt, Haemophilus influenzae Rd
guuucuaaaugaauaaa

SEQ ID NO: 696643 - RNA, 15 nt, Haemophilus influenzae Rd
guuucuaauucuucc

SEQ ID NO: 696644 - RNA, 16 nt, Haemophilus influenzae Rd
guuucuaauucuucca

SEQ ID NO: 696645 - RNA, 13 nt, Haemophilus influenzae Rd
guuucuaauuuuu

SEQ ID NO: 696646 - RNA, 14 nt, Haemophilus influenzae Rd
aaaucaaguuaaaa

SEQ ID NO: 696647 - RNA, 17 nt, Haemophilus influenzae Rd
aaaucaaguuaaaaaau

SEQ ID NO: 696648 - RNA, 22 nt, Haemophilus influenzae Rd
aaaucaagaugacgaaaugaaa

SEQ ID NO: 696649 - RNA, 20 nt, Haemophilus influenzae Rd
aaaucaagcccucgaauauu

SEQ ID NO: 696650 - RNA, 13 nt, Haemophilus influenzae Rd
aaaucaagcuaag

SEQ ID NO: 696651 - RNA, 21 nt, Haemophilus influenzae Rd
aaaucaagcuaagauugacaa

SEQ ID NO: 696652 - RNA, 17 nt, Haemophilus influenzae Rd
aaaucaaggacuaggcu

SEQ ID NO: 696653 - RNA, 22 nt, Haemophilus influenzae Rd
aaaucaaucaggcuuucauuuu

SEQ ID NO: 696654 - RNA, 23 nt, Haemophilus influenzae Rd
aaaucaauguuuucagcuucaau

SEQ ID NO: 696655 - RNA, 13 nt, Haemophilus influenzae Rd
aaaucaauuaacu

SEQ ID NO: 696656 - RNA, 19 nt, Haemophilus influenzae Rd
guuucgagcgugaagauau

SEQ ID NO: 696657 - RNA, 15 nt, Haemophilus influenzae Rd
guuucgauauuaaua

SEQ ID NO: 696658 - RNA, 16 nt, Haemophilus influenzae Rd
guuucugguuccauua

SEQ ID NO: 696659 - RNA, 13 nt, Haemophilus influenzae Rd
guuugacauucag

SEQ ID NO: 696660 - RNA, 15 nt, Haemophilus influenzae Rd
guuugauccacacuu

SEQ ID NO: 696661 - RNA, 17 nt, Haemophilus influenzae Rd
guuugauaacuuuaagu

SEQ ID NO: 696662 - RNA, 17 nt, Haemophilus influenzae Rd
guuuguuaaaugaaaag

SEQ ID NO: 696663 - RNA, 16 nt, Haemophilus influenzae Rd
guuugugcuaaauuaa

SEQ ID NO: 696664 - RNA, 16 nt, Haemophilus influenzae Rd
guuuguggaauaccau

SEQ ID NO: 696665 - RNA, 15 nt, Haemophilus influenzae Rd
guuuguuaugaaauu

SEQ ID NO: 696666 - RNA, 19 nt, Haemophilus influenzae Rd
guuuguuaugaaauugcug

SEQ ID NO: 696667 - RNA, 21 nt, Haemophilus influenzae Rd
guuugucguaauaacauucag

SEQ ID NO: 696668 - RNA, 15 nt, Haemophilus influenzae Rd
guuuguuugcugcac

SEQ ID NO: 696669 - RNA, 22 nt, Haemophilus influenzae Rd
guuuuacgccauucuuuauucg

SEQ ID NO: 696670 - RNA, 15 nt, Haemophilus influenzae Rd
guuuuacuucauccc

SEQ ID NO: 696671 - RNA, 21 nt, Haemophilus influenzae Rd
guuugcuaauguaguuggaac

SEQ ID NO: 696672 - RNA, 19 nt, Haemophilus influenzae Rd
guuugcuaccuucaaccac

SEQ ID NO: 696673 - RNA, 21 nt, Haemophilus influenzae Rd
guuugcuaccuucaaccaccc

SEQ ID NO: 696674 - RNA, 21 nt, Haemophilus influenzae Rd
guuugccguaauaacauuccg

SEQ ID NO: 696675 - RNA, 15 nt, Haemophilus influenzae Rd
guuuggagauaaaua

SEQ ID NO: 696676 - RNA, 14 nt, Haemophilus influenzae Rd
guuuucuuuugccc

SEQ ID NO: 696677 - RNA, 17 nt, Haemophilus influenzae Rd
guuuucuuuugcccuua

SEQ ID NO: 696678 - RNA, 12 nt, Haemophilus influenzae Rd
guuuucacaauc

SEQ ID NO: 696679 - RNA, 19 nt, Haemophilus influenzae Rd
guuuucaauaucaaagaaa

SEQ ID NO: 696680 - RNA, 22 nt, Haemophilus influenzae Rd
guuuuauuugagaaaaauguua

SEQ ID NO: 696681 - RNA, 18 nt, Haemophilus influenzae Rd
guuuuauuuucaaauuca

SEQ ID NO: 696682 - RNA, 19 nt, Haemophilus influenzae Rd
guuuuauuuuccaucaucu

SEQ ID NO: 696683 - RNA, 13 nt, Haemophilus influenzae Rd
guuuuauuuauca

SEQ ID NO: 696684 - RNA, 14 nt, Haemophilus influenzae Rd
guuuuauuuauucu

SEQ ID NO: 696685 - RNA, 17 nt, Haemophilus influenzae Rd
aaauccacacuuuaaua

SEQ ID NO: 696686 - RNA, 23 nt, Haemophilus influenzae Rd
guuuugccgcaaacaucaucacc

SEQ ID NO: 696687 - RNA, 14 nt, Haemophilus influenzae Rd
guuuugcguugcgg

SEQ ID NO: 696688 - RNA, 17 nt, Haemophilus influenzae Rd
guuuugccacaaagcaa

SEQ ID NO: 696689 - RNA, 16 nt, Haemophilus influenzae Rd
guuuucuuuuuuucau

SEQ ID NO: 696690 - RNA, 21 nt, Haemophilus influenzae Rd
guuuugauaaccuaucaucug

SEQ ID NO: 696691 - RNA, 22 nt, Haemophilus influenzae Rd
guuuugauucgccuuauauccc

SEQ ID NO: 696692 - RNA, 18 nt, Haemophilus influenzae Rd
guuuugagugagauaaau

SEQ ID NO: 696693 - RNA, 13 nt, Haemophilus influenzae Rd
aaaucaucauauu

SEQ ID NO: 696694 - RNA, 11 nt, Haemophilus influenzae Rd
aaauccaaaac

SEQ ID NO: 696695 - RNA, 20 nt, Haemophilus influenzae Rd
aaaucauuuauauaaaagaa

SEQ ID NO: 696696 - RNA, 17 nt, Haemophilus influenzae Rd
aaauccacaaaaucuga

SEQ ID NO: 696697 - RNA, 22 nt, Haemophilus influenzae Rd
aaauccaaccccauuugccaaa

SEQ ID NO: 696698 - RNA, 20 nt, Haemophilus influenzae Rd
aaauccacaaucaaucuuua

SEQ ID NO: 696699 - RNA, 20 nt, Haemophilus influenzae Rd
aaaucauauuucuucgauuu

SEQ ID NO: 696700 - RNA, 16 nt, Haemophilus influenzae Rd
aaaucaucaaagcuca

SEQ ID NO: 696701 - RNA, 19 nt, Haemophilus influenzae Rd
aaaucauaggcuucuuguu

SEQ ID NO: 696702 - RNA, 23 nt, Haemophilus influenzae Rd
aaaucauaagcaauaauuucauu

SEQ ID NO: 696703 - RNA, 15 nt, Haemophilus influenzae Rd
aaaucauaaucugaa

SEQ ID NO: 696704 - RNA, 18 nt, Haemophilus influenzae Rd
aaaucauaaucugaaagu

SEQ ID NO: 696705 - RNA, 18 nt, Haemophilus influenzae Rd
aaaucacuuaauuucuua

SEQ ID NO: 696706 - RNA, 13 nt, Haemophilus influenzae Rd
gcgguaucaaugc

SEQ ID NO: 696707 - RNA, 14 nt, Haemophilus influenzae Rd
gcuccaaucaucau

SEQ ID NO: 696708 - RNA, 16 nt, Haemophilus influenzae Rd
gcuccaaucaucaucc

SEQ ID NO: 696709 - RNA, 23 nt, Haemophilus influenzae Rd
gcucauuuuaaagaguucgucca

SEQ ID NO: 696710 - RNA, 19 nt, Haemophilus influenzae Rd
gcuccauuaccguaugcaa

SEQ ID NO: 696711 - RNA, 18 nt, Haemophilus influenzae Rd
gcuccgccaccuacgccu

SEQ ID NO: 696712 - RNA, 16 nt, Haemophilus influenzae Rd
gcuccuacuuuuacaa

SEQ ID NO: 696713 - RNA, 20 nt, Haemophilus influenzae Rd
gcucgaaaucacaggcuuca

SEQ ID NO: 696714 - RNA, 16 nt, Haemophilus influenzae Rd
gcucgauagcccaagg

SEQ ID NO: 696715 - RNA, 19 nt, Haemophilus influenzae Rd
gcucgccaauaaaauguua

SEQ ID NO: 696716 - RNA, 15 nt, Haemophilus influenzae Rd
gcucgauuuuuaaaa

SEQ ID NO: 696717 - RNA, 19 nt, Haemophilus influenzae Rd
gcucgugauuaucuaaauu

SEQ ID NO: 696718 - RNA, 17 nt, Haemophilus influenzae Rd
gcucggucgauggcugg

SEQ ID NO: 696719 - RNA, 22 nt, Haemophilus influenzae Rd
gcucuaccuaaaauaaauuuug

SEQ ID NO: 696720 - RNA, 17 nt, Haemophilus influenzae Rd
gcucuaccaacugagcu

SEQ ID NO: 696721 - RNA, 19 nt, Haemophilus influenzae Rd
gcucuaguuuuaagguugu

SEQ ID NO: 696722 - RNA, 22 nt, Haemophilus influenzae Rd
gcucuagcucucguuguucuuu

SEQ ID NO: 696723 - RNA, 13 nt, Haemophilus influenzae Rd
gcucgcucuucag

SEQ ID NO: 696724 - RNA, 17 nt, Haemophilus influenzae Rd
gcucucgaguaucaaaa

SEQ ID NO: 696725 - RNA, 20 nt, Haemophilus influenzae Rd
gcugaaauuuagugauuucu

SEQ ID NO: 696726 - RNA, 23 nt, Haemophilus influenzae Rd
gcugaaauuuagugauuucuaug

SEQ ID NO: 696727 - RNA, 16 nt, Haemophilus influenzae Rd
gcugaagucguuucau

SEQ ID NO: 696728 - RNA, 17 nt, Haemophilus influenzae Rd
gcugaagucguuucauc

SEQ ID NO: 696729 - RNA, 20 nt, Haemophilus influenzae Rd
gcugacacgguaguaaauaa

SEQ ID NO: 696730 - RNA, 15 nt, Haemophilus influenzae Rd
gcugaauagcaaaua

SEQ ID NO: 696731 - RNA, 13 nt, Haemophilus influenzae Rd
gcugacaaauuug

SEQ ID NO: 696732 - RNA, 12 nt, Haemophilus influenzae Rd
gcugauauaaaa

SEQ ID NO: 696733 - RNA, 14 nt, Haemophilus influenzae Rd
gcugauauuuaaaa

SEQ ID NO: 696734 - RNA, 14 nt, Haemophilus influenzae Rd
gcugauucuaaugc

SEQ ID NO: 696735 - RNA, 13 nt, Haemophilus influenzae Rd
gcugauucacgau

SEQ ID NO: 696736 - RNA, 15 nt, Haemophilus influenzae Rd
gcugcaacaaauaaa

SEQ ID NO: 696737 - RNA, 16 nt, Haemophilus influenzae Rd
gcugauuuuaaauauc

SEQ ID NO: 696738 - RNA, 12 nt, Haemophilus influenzae Rd
gcugauuuaccu

SEQ ID NO: 696739 - RNA, 21 nt, Haemophilus influenzae Rd
gcugccuucaaugggcaucca

SEQ ID NO: 696740 - RNA, 14 nt, Haemophilus influenzae Rd
gcugcgaauugcaa

SEQ ID NO: 696741 - RNA, 13 nt, Haemophilus influenzae Rd
gcugcgaugcaua

SEQ ID NO: 696742 - RNA, 16 nt, Haemophilus influenzae Rd
gcugcuacaauuucau

SEQ ID NO: 696743 - RNA, 14 nt, Haemophilus influenzae Rd
gcuguauauuuuua

SEQ ID NO: 696744 - RNA, 15 nt, Haemophilus influenzae Rd
aaaggauuaaauaac

SEQ ID NO: 696745 - RNA, 17 nt, Haemophilus influenzae Rd
aaaggaauggcaaagaa

SEQ ID NO: 696746 - RNA, 20 nt, Haemophilus influenzae Rd
aaaggacuaagcccuguaga

SEQ ID NO: 696747 - RNA, 22 nt, Haemophilus influenzae Rd
gcuggauucauuugcaaaucaa

SEQ ID NO: 696748 - RNA, 11 nt, Haemophilus influenzae Rd
gcuggucacuu

SEQ ID NO: 696749 - RNA, 13 nt, Haemophilus influenzae Rd
gcuguguaaaaca

SEQ ID NO: 696750 - RNA, 20 nt, Haemophilus influenzae Rd
gcuguguugauauucaauuu

SEQ ID NO: 696751 - RNA, 15 nt, Haemophilus influenzae Rd
gcuguccaauauaaa

SEQ ID NO: 696752 - RNA, 16 nt, Haemophilus influenzae Rd
gcuguucuucuaaugu

SEQ ID NO: 696753 - RNA, 14 nt, Haemophilus influenzae Rd
gcuguuuaaaucua

SEQ ID NO: 696754 - RNA, 20 nt, Haemophilus influenzae Rd
gcuguuucgcaucaaagaau

SEQ ID NO: 696755 - RNA, 14 nt, Haemophilus influenzae Rd
gcuguuuucaauuu

SEQ ID NO: 696756 - RNA, 23 nt, Haemophilus influenzae Rd
gcuguuuuuccgcuaaugcccac

SEQ ID NO: 696757 - RNA, 13 nt, Haemophilus influenzae Rd
gcuuaagucagca

SEQ ID NO: 696758 - RNA, 21 nt, Haemophilus influenzae Rd
gcuuaagucagcauaaacaaa

SEQ ID NO: 696759 - RNA, 21 nt, Haemophilus influenzae Rd
gcuuaaagcaaucaaaaauga

SEQ ID NO: 696760 - RNA, 20 nt, Haemophilus influenzae Rd
gcuuaaccaucacaaaggaa

SEQ ID NO: 696761 - RNA, 19 nt, Haemophilus influenzae Rd
gcuuaauugcuguuagcaa

SEQ ID NO: 696762 - RNA, 14 nt, Haemophilus influenzae Rd
gcuuaagccuuuau

SEQ ID NO: 696763 - RNA, 15 nt, Haemophilus influenzae Rd
gcuuacaaaauauac

SEQ ID NO: 696764 - RNA, 18 nt, Haemophilus influenzae Rd
gcuucauaaaaaccuguu

SEQ ID NO: 696765 - RNA, 21 nt, Haemophilus influenzae Rd
gcuucauuuugagauaaauuu

SEQ ID NO: 696766 - RNA, 19 nt, Haemophilus influenzae Rd
gcuuccauuuggaauacuc

SEQ ID NO: 696767 - RNA, 15 nt, Haemophilus influenzae Rd
gcuuagauaauaaaa

SEQ ID NO: 696768 - RNA, 19 nt, Haemophilus influenzae Rd
gcuuagggucgcaacuaaa

SEQ ID NO: 696769 - RNA, 12 nt, Haemophilus influenzae Rd
gcuuagugaaaa

SEQ ID NO: 696770 - RNA, 18 nt, Haemophilus influenzae Rd
gcuuagugaaaagaaaac

SEQ ID NO: 696771 - RNA, 15 nt, Haemophilus influenzae Rd
gcuuauccuauaaaa

SEQ ID NO: 696772 - RNA, 18 nt, Haemophilus influenzae Rd
gcuuaucuaacuaaaaua

SEQ ID NO: 696773 - RNA, 21 nt, Haemophilus influenzae Rd
gcuuaucuacugcuucauaaa

SEQ ID NO: 696774 - RNA, 18 nt, Haemophilus influenzae Rd
gcuuauacgaguaaaaaa

SEQ ID NO: 696775 - RNA, 22 nt, Haemophilus influenzae Rd
gcuuauacgaguaaaaaaucua

SEQ ID NO: 696776 - RNA, 22 nt, Haemophilus influenzae Rd
gcuuaccuuaauuaaucuuuuu

SEQ ID NO: 696777 - RNA, 18 nt, Haemophilus influenzae Rd
gcuuauguaaauuuaucu

SEQ ID NO: 696778 - RNA, 10 nt, Haemophilus influenzae Rd
gcuucugccg

SEQ ID NO: 696779 - RNA, 14 nt, Haemophilus influenzae Rd
gcuucuaauuuuug

SEQ ID NO: 696780 - RNA, 17 nt, Haemophilus influenzae Rd
gcuucuaauuuuugcaa

SEQ ID NO: 696781 - RNA, 22 nt, Haemophilus influenzae Rd
gcuucuaauuuuugcaauggcu

SEQ ID NO: 696782 - RNA, 13 nt, Haemophilus influenzae Rd
gcuucuaauuuuu

SEQ ID NO: 696783 - RNA, 18 nt, Haemophilus influenzae Rd
gcuucgccagcagugcca

SEQ ID NO: 696784 - RNA, 18 nt, Haemophilus influenzae Rd
gcuucgccuucagcaauu

SEQ ID NO: 696785 - RNA, 18 nt, Haemophilus influenzae Rd
gcuugccagucauuuuuu

SEQ ID NO: 696786 - RNA, 17 nt, Haemophilus influenzae Rd
gcuugaugucagugaau

SEQ ID NO: 696787 - RNA, 15 nt, Haemophilus influenzae Rd
gcuugauuuuaaguu

SEQ ID NO: 696788 - RNA, 22 nt, Haemophilus influenzae Rd
gcuugauuuucagcacugguua

SEQ ID NO: 696789 - RNA, 21 nt, Haemophilus influenzae Rd
gcuugcauucacaaaaguuug

SEQ ID NO: 696790 - RNA, 15 nt, Haemophilus influenzae Rd
gcuugcauuucuuca

SEQ ID NO: 696791 - RNA, 21 nt, Haemophilus influenzae Rd
gcuugauauaauauuuuggca

SEQ ID NO: 696792 - RNA, 17 nt, Haemophilus influenzae Rd
gcuugaauauuugggaa

SEQ ID NO: 696793 - RNA, 22 nt, Haemophilus influenzae Rd
gcuugauacauuucuaaaauaa

SEQ ID NO: 696794 - RNA, 19 nt, Haemophilus influenzae Rd
gcuugaauugcuccuccua

SEQ ID NO: 696795 - RNA, 14 nt, Haemophilus influenzae Rd
gcuuggaaauguuu

SEQ ID NO: 696796 - RNA, 15 nt, Haemophilus influenzae Rd
gcuuggaaauguuua

SEQ ID NO: 696797 - RNA, 17 nt, Haemophilus influenzae Rd
gcuuggauauucugcau

SEQ ID NO: 696798 - RNA, 19 nt, Haemophilus influenzae Rd
gcuugcuuacauuuuggca

SEQ ID NO: 696799 - RNA, 22 nt, Haemophilus influenzae Rd
aaaggauuaucuggauguaaca

SEQ ID NO: 696800 - RNA, 21 nt, Haemophilus influenzae Rd
gcuugggcgauggcucgcucc

SEQ ID NO: 696801 - RNA, 15 nt, Haemophilus influenzae Rd
aaaggcacugcgggu

SEQ ID NO: 696802 - RNA, 23 nt, Haemophilus influenzae Rd
gcuugugcuauacaaaauuuugu

SEQ ID NO: 696803 - RNA, 19 nt, Haemophilus influenzae Rd
gcuuguuaauacacuuuua

SEQ ID NO: 696804 - RNA, 19 nt, Haemophilus influenzae Rd
aaaggcggauuuauuauuu

SEQ ID NO: 696805 - RNA, 21 nt, Haemophilus influenzae Rd
aaaggcgagggauuuuaaauc

SEQ ID NO: 696806 - RNA, 16 nt, Haemophilus influenzae Rd
gcuugguaauaaucaa

SEQ ID NO: 696807 - RNA, 20 nt, Haemophilus influenzae Rd
gcuugguaguuuuucaccca

SEQ ID NO: 696808 - RNA, 17 nt, Haemophilus influenzae Rd
gcuuucauaaauucauc

SEQ ID NO: 696809 - RNA, 18 nt, Haemophilus influenzae Rd
gcuuucauaaauucaucu

SEQ ID NO: 696810 - RNA, 23 nt, Haemophilus influenzae Rd
gcuuucauacgcgcccauucauu

SEQ ID NO: 696811 - RNA, 15 nt, Haemophilus influenzae Rd
gcuuucauuuuccaa

SEQ ID NO: 696812 - RNA, 16 nt, Haemophilus influenzae Rd
gcuuuaucaucuuuug

SEQ ID NO: 696813 - RNA, 14 nt, Haemophilus influenzae Rd
gcuuuauuuagaau

SEQ ID NO: 696814 - RNA, 18 nt, Haemophilus influenzae Rd
gcuuuauuuagaauuuuu

SEQ ID NO: 696815 - RNA, 18 nt, Haemophilus influenzae Rd
gcuuucaauuaaugaacg

SEQ ID NO: 696816 - RNA, 21 nt, Haemophilus influenzae Rd
gcuuucaacacaacaucagcu

SEQ ID NO: 696817 - RNA, 15 nt, Haemophilus influenzae Rd
gcuuucaauuucacg

SEQ ID NO: 696818 - RNA, 15 nt, Haemophilus influenzae Rd
gcuuucaauuuucug

SEQ ID NO: 696819 - RNA, 16 nt, Haemophilus influenzae Rd
gcuuuaaaucaaauaa

SEQ ID NO: 696820 - RNA, 18 nt, Haemophilus influenzae Rd
gcuuguuucaucauucug

SEQ ID NO: 696821 - RNA, 19 nt, Haemophilus influenzae Rd
gcuuguuucaucauucugg

SEQ ID NO: 696822 - RNA, 22 nt, Haemophilus influenzae Rd
gcuuuaauucgugcaaauuuuu

SEQ ID NO: 696823 - RNA, 15 nt, Haemophilus influenzae Rd
gcuuuaagcuuuucu

SEQ ID NO: 696824 - RNA, 17 nt, Haemophilus influenzae Rd
gcuuuaagcuuuucuac

SEQ ID NO: 696825 - RNA, 22 nt, Haemophilus influenzae Rd
gcuuuaacccauuuauuuaaau

SEQ ID NO: 696826 - RNA, 22 nt, Haemophilus influenzae Rd
gcuuuaacgagaauauuccauu

SEQ ID NO: 696827 - RNA, 13 nt, Haemophilus influenzae Rd
gcuuuagcuugau

SEQ ID NO: 696828 - RNA, 13 nt, Haemophilus influenzae Rd
gcuuuaccuuuua

SEQ ID NO: 696829 - RNA, 21 nt, Haemophilus influenzae Rd
gcuuuacccgggccaaauaau

SEQ ID NO: 696830 - RNA, 13 nt, Haemophilus influenzae Rd
gcuuuacaaugag

SEQ ID NO: 696831 - RNA, 13 nt, Haemophilus influenzae Rd
gcuuuaaauuguu

SEQ ID NO: 696832 - RNA, 14 nt, Haemophilus influenzae Rd
ggaacaguugaaaa

SEQ ID NO: 696833 - RNA, 12 nt, Haemophilus influenzae Rd
ggaaguaauauu

SEQ ID NO: 696834 - RNA, 16 nt, Haemophilus influenzae Rd
ggaaguaauauuucuu

SEQ ID NO: 696835 - RNA, 22 nt, Haemophilus influenzae Rd
ggaacguuuuuuacuuggaaua

SEQ ID NO: 696836 - RNA, 17 nt, Haemophilus influenzae Rd
ggaacucuuucaccauu

SEQ ID NO: 696837 - RNA, 18 nt, Haemophilus influenzae Rd
ggaauuugcucaauaauu

SEQ ID NO: 696838 - RNA, 23 nt, Haemophilus influenzae Rd
ggaauuugguuccccuuucugaa

SEQ ID NO: 696839 - RNA, 16 nt, Haemophilus influenzae Rd
ggaauugcauuaagaa

SEQ ID NO: 696840 - RNA, 16 nt, Haemophilus influenzae Rd
ggaauucgaagguaua

SEQ ID NO: 696841 - RNA, 12 nt, Haemophilus influenzae Rd
ggacaauguucg

SEQ ID NO: 696842 - RNA, 23 nt, Haemophilus influenzae Rd
ggaauaccacaguccccauaucu

SEQ ID NO: 696843 - RNA, 14 nt, Haemophilus influenzae Rd
ggaauaauuuuccu

SEQ ID NO: 696844 - RNA, 13 nt, Haemophilus influenzae Rd
ggaauaaagcaac

SEQ ID NO: 696845 - RNA, 19 nt, Haemophilus influenzae Rd
ggaaguuaauggguuaaaa

SEQ ID NO: 696846 - RNA, 15 nt, Haemophilus influenzae Rd
ggaaugaucugcacc

SEQ ID NO: 696847 - RNA, 16 nt, Haemophilus influenzae Rd
ggaauggauguaauga

SEQ ID NO: 696848 - RNA, 16 nt, Haemophilus influenzae Rd
ggaaugcccagcaauu

SEQ ID NO: 696849 - RNA, 14 nt, Haemophilus influenzae Rd
aaagggaaauaaca

SEQ ID NO: 696850 - RNA, 22 nt, Haemophilus influenzae Rd
aaaggcucuaccuaaaauaaau

SEQ ID NO: 696851 - RNA, 19 nt, Haemophilus influenzae Rd
aaaggcuucauuugcuucu

SEQ ID NO: 696852 - RNA, 23 nt, Haemophilus influenzae Rd
aaaggcugagguucaaaacuauc

SEQ ID NO: 696853 - RNA, 23 nt, Haemophilus influenzae Rd
ggagauuuccaucuaaaaguugg

SEQ ID NO: 696854 - RNA, 14 nt, Haemophilus influenzae Rd
ggagaaaagcaugg

SEQ ID NO: 696855 - RNA, 13 nt, Haemophilus influenzae Rd
aaaguaagaaacu

SEQ ID NO: 696856 - RNA, 23 nt, Haemophilus influenzae Rd
ggagaaagcuugcuuucuugcug

SEQ ID NO: 696857 - RNA, 15 nt, Haemophilus influenzae Rd
aaaguaaauuuuaaa

SEQ ID NO: 696858 - RNA, 14 nt, Haemophilus influenzae Rd
aaaguaacaaugua

SEQ ID NO: 696859 - RNA, 13 nt, Haemophilus influenzae Rd
aaaguaagaauua

SEQ ID NO: 696860 - RNA, 14 nt, Haemophilus influenzae Rd
aaaguaagaauuag

SEQ ID NO: 696861 - RNA, 17 nt, Haemophilus influenzae Rd
aaaguaacguugcucuu

SEQ ID NO: 696862 - RNA, 16 nt, Haemophilus influenzae Rd
ggacuggacuccaagg

SEQ ID NO: 696863 - RNA, 21 nt, Haemophilus influenzae Rd
ggacuggacuccaaggcaauu

SEQ ID NO: 696864 - RNA, 16 nt, Haemophilus influenzae Rd
aaagguaauugccaau

SEQ ID NO: 696865 - RNA, 14 nt, Haemophilus influenzae Rd
aaagguaaaacuuu

SEQ ID NO: 696866 - RNA, 23 nt, Haemophilus influenzae Rd
aaaggguuuguuggcaacaacag

SEQ ID NO: 696867 - RNA, 18 nt, Haemophilus influenzae Rd
ggauaaauuauucugcaa

SEQ ID NO: 696868 - RNA, 16 nt, Haemophilus influenzae Rd
ggaguuguuuaaaauu

SEQ ID NO: 696869 - RNA, 11 nt, Haemophilus influenzae Rd
ggagcauuuug

SEQ ID NO: 696870 - RNA, 23 nt, Haemophilus influenzae Rd
ggauaauguucuuuuaaaagacc

SEQ ID NO: 696871 - RNA, 19 nt, Haemophilus influenzae Rd
ggauaaggcagaaaugaau

SEQ ID NO: 696872 - RNA, 13 nt, Haemophilus influenzae Rd
ggauaaccaaaau

SEQ ID NO: 696873 - RNA, 13 nt, Haemophilus influenzae Rd
ggauauuuuauug

SEQ ID NO: 696874 - RNA, 15 nt, Haemophilus influenzae Rd
ggauauuuuuuauua

SEQ ID NO: 696875 - RNA, 11 nt, Haemophilus influenzae Rd
ggaucuuccaa

SEQ ID NO: 696876 - RNA, 22 nt, Haemophilus influenzae Rd
ggaucuuccaauaauucuuuaa

SEQ ID NO: 696877 - RNA, 19 nt, Haemophilus influenzae Rd
ggaucuuguggaucuaaau

SEQ ID NO: 696878 - RNA, 17 nt, Haemophilus influenzae Rd
ggauggcuaaauacaac

SEQ ID NO: 696879 - RNA, 23 nt, Haemophilus influenzae Rd
aaaguaauagcgacuugccgcuu

SEQ ID NO: 696880 - RNA, 19 nt, Haemophilus influenzae Rd
aaaguaaucuaaauauucu

SEQ ID NO: 696881 - RNA, 20 nt, Haemophilus influenzae Rd
aaaguacugcagcauuuaaa

SEQ ID NO: 696882 - RNA, 15 nt, Haemophilus influenzae Rd
ggauuaauuucucgc

SEQ ID NO: 696883 - RNA, 13 nt, Haemophilus influenzae Rd
ggauuaagaaaau

SEQ ID NO: 696884 - RNA, 16 nt, Haemophilus influenzae Rd
ggauuaagaaaauugu

SEQ ID NO: 696885 - RNA, 22 nt, Haemophilus influenzae Rd
ggauuaccacuugccaaacauu

SEQ ID NO: 696886 - RNA, 13 nt, Haemophilus influenzae Rd
ggauuaaucaauu

SEQ ID NO: 696887 - RNA, 18 nt, Haemophilus influenzae Rd
ggauuagcauaaaauuaa

SEQ ID NO: 696888 - RNA, 16 nt, Haemophilus influenzae Rd
ggauuaucuauaucuu

SEQ ID NO: 696889 - RNA, 19 nt, Haemophilus influenzae Rd
ggauuaucuauaucuuuaa

SEQ ID NO: 696890 - RNA, 19 nt, Haemophilus influenzae Rd
ggauucauuugcaaaucaa

SEQ ID NO: 696891 - RNA, 11 nt, Haemophilus influenzae Rd
ggauuuuaaau

SEQ ID NO: 696892 - RNA, 19 nt, Haemophilus influenzae Rd
ggcaacccacuucugcacc

SEQ ID NO: 696893 - RNA, 12 nt, Haemophilus influenzae Rd
ggcaaaaaauac

SEQ ID NO: 696894 - RNA, 17 nt, Haemophilus influenzae Rd
ggauuuuguaaccuuag

SEQ ID NO: 696895 - RNA, 19 nt, Haemophilus influenzae Rd
ggauuuuuucuaauccaga

SEQ ID NO: 696896 - RNA, 22 nt, Haemophilus influenzae Rd
ggauuuuucgcaggaucacaau

SEQ ID NO: 696897 - RNA, 23 nt, Haemophilus influenzae Rd
ggauuuuugccguuuucuacuuc

SEQ ID NO: 696898 - RNA, 18 nt, Haemophilus influenzae Rd
ggcagagcaagauuuaaa

SEQ ID NO: 696899 - RNA, 21 nt, Haemophilus influenzae Rd
ggcagaauuucgucaaaaaug

SEQ ID NO: 696900 - RNA, 20 nt, Haemophilus influenzae Rd
ggcaagucccuguucaaauu

SEQ ID NO: 696901 - RNA, 13 nt, Haemophilus influenzae Rd
aaaguauacuuuu

SEQ ID NO: 696902 - RNA, 17 nt, Haemophilus influenzae Rd
ggcauaucugcugcugg

SEQ ID NO: 696903 - RNA, 19 nt, Haemophilus influenzae Rd
aaagucaguaaaccaagug

SEQ ID NO: 696904 - RNA, 13 nt, Haemophilus influenzae Rd
aaagucccaaaag

SEQ ID NO: 696905 - RNA, 16 nt, Haemophilus influenzae Rd
ggccacgagcgugaag

SEQ ID NO: 696906 - RNA, 20 nt, Haemophilus influenzae Rd
ggcauggacguagucggcga

SEQ ID NO: 696907 - RNA, 21 nt, Haemophilus influenzae Rd
ggccauacgcuugauugcacu

SEQ ID NO: 696908 - RNA, 23 nt, Haemophilus influenzae Rd
aaagucuaauuuuguaagcauua

SEQ ID NO: 696909 - RNA, 23 nt, Haemophilus influenzae Rd
aaagucgguuuuuaauucaguuc

SEQ ID NO: 696910 - RNA, 20 nt, Haemophilus influenzae Rd
aaagucgguuuuuucauaga

SEQ ID NO: 696911 - RNA, 24 nt, Haemophilus influenzae Rd
aaagucgguuuuuucauagauaaa

SEQ ID NO: 696912 - RNA, 19 nt, Haemophilus influenzae Rd
aaauacuugcuuaugcaaa

SEQ ID NO: 696913 - RNA, 14 nt, Haemophilus influenzae Rd
aaauacgaugauaa

SEQ ID NO: 696914 - RNA, 15 nt, Haemophilus influenzae Rd
aaauacauuauuaaa

SEQ ID NO: 696915 - RNA, 18 nt, Haemophilus influenzae Rd
aaauacauuauuaaaagc

SEQ ID NO: 696916 - RNA, 14 nt, Haemophilus influenzae Rd
aaauacauuuuuau

SEQ ID NO: 696917 - RNA, 16 nt, Haemophilus influenzae Rd
aaauacauuuuuauag

SEQ ID NO: 696918 - RNA, 14 nt, Haemophilus influenzae Rd
aaauacauuuuuga

SEQ ID NO: 696919 - RNA, 16 nt, Haemophilus influenzae Rd
aaauaccccaauuaag

SEQ ID NO: 696920 - RNA, 22 nt, Haemophilus influenzae Rd
aaauacagugacaaauuuugca

SEQ ID NO: 696921 - RNA, 13 nt, Haemophilus influenzae Rd
ggcgauauaaguu

SEQ ID NO: 696922 - RNA, 13 nt, Haemophilus influenzae Rd
aaauaauuuucuu

SEQ ID NO: 696923 - RNA, 19 nt, Haemophilus influenzae Rd
aaauaauuuucauugaaaa

SEQ ID NO: 696924 - RNA, 14 nt, Haemophilus influenzae Rd
aaauaauuuccuuu

SEQ ID NO: 696925 - RNA, 22 nt, Haemophilus influenzae Rd
aaauaauuuccuuuuuuauuua

SEQ ID NO: 696926 - RNA, 15 nt, Haemophilus influenzae Rd
aaauaauuuuacuug

SEQ ID NO: 696927 - RNA, 20 nt, Haemophilus influenzae Rd
aaauaauuuuacuugugcau

SEQ ID NO: 696928 - RNA, 17 nt, Haemophilus influenzae Rd
aaauaauucaagaugau

SEQ ID NO: 696929 - RNA, 21 nt, Haemophilus influenzae Rd
aaauaauuaaggauuucuuau

SEQ ID NO: 696930 - RNA, 17 nt, Haemophilus influenzae Rd
aaauaagggcugauuuu

SEQ ID NO: 696931 - RNA, 16 nt, Haemophilus influenzae Rd
aaauaaguucaucaac

SEQ ID NO: 696932 - RNA, 17 nt, Haemophilus influenzae Rd
aaauaaguucaucaacu

SEQ ID NO: 696933 - RNA, 15 nt, Haemophilus influenzae Rd
aaauaauaaaauagc

SEQ ID NO: 696934 - RNA, 17 nt, Haemophilus influenzae Rd
aaauaauaaauccaaau

SEQ ID NO: 696935 - RNA, 14 nt, Haemophilus influenzae Rd
aaauaagcauaaaa

SEQ ID NO: 696936 - RNA, 19 nt, Haemophilus influenzae Rd
aaauaaggcguaaaacuau

SEQ ID NO: 696937 - RNA, 17 nt, Haemophilus influenzae Rd
aaauaaggcucaacacc

SEQ ID NO: 696938 - RNA, 17 nt, Haemophilus influenzae Rd
aaauaagcuaauuuuuc

SEQ ID NO: 696939 - RNA, 19 nt, Haemophilus influenzae Rd
aaauaaggaucuuguaaag

SEQ ID NO: 696940 - RNA, 12 nt, Haemophilus influenzae Rd
aaauaaugcaaa

SEQ ID NO: 696941 - RNA, 20 nt, Haemophilus influenzae Rd
aaauaaugagguauaaaaug

SEQ ID NO: 696942 - RNA, 15 nt, Haemophilus influenzae Rd
aaauaauguguugau

SEQ ID NO: 696943 - RNA, 17 nt, Haemophilus influenzae Rd
aaauaauguuaaaucua

SEQ ID NO: 696944 - RNA, 12 nt, Haemophilus influenzae Rd
aaauaauguuuu

SEQ ID NO: 696945 - RNA, 12 nt, Haemophilus influenzae Rd
aaauaauuaaaa

SEQ ID NO: 696946 - RNA, 22 nt, Haemophilus influenzae Rd
aaauaaugcccgcacuuuuaac

SEQ ID NO: 696947 - RNA, 16 nt, Haemophilus influenzae Rd
aaauaaugccucaucu

SEQ ID NO: 696948 - RNA, 20 nt, Haemophilus influenzae Rd
aaauaaugccucaucuuuug

SEQ ID NO: 696949 - RNA, 14 nt, Haemophilus influenzae Rd
aaauaaucacuuga

SEQ ID NO: 696950 - RNA, 17 nt, Haemophilus influenzae Rd
aaauaaucacuugauaa

SEQ ID NO: 696951 - RNA, 20 nt, Haemophilus influenzae Rd
ggcgaccauuacagcaagca

SEQ ID NO: 696952 - RNA, 17 nt, Haemophilus influenzae Rd
ggcgaaauaucgcccuu

SEQ ID NO: 696953 - RNA, 14 nt, Haemophilus influenzae Rd
ggccuuuacuaaag

SEQ ID NO: 696954 - RNA, 20 nt, Haemophilus influenzae Rd
aaauaaauuuauuuaauaau

SEQ ID NO: 696955 - RNA, 17 nt, Haemophilus influenzae Rd
aaauaaauuuucaaauu

SEQ ID NO: 696956 - RNA, 21 nt, Haemophilus influenzae Rd
aaauaaauuuucaaauugaaa

SEQ ID NO: 696957 - RNA, 18 nt, Haemophilus influenzae Rd
aaauaacauaacuaucac

SEQ ID NO: 696958 - RNA, 16 nt, Haemophilus influenzae Rd
aaauaaccaauauaau

SEQ ID NO: 696959 - RNA, 12 nt, Haemophilus influenzae Rd
aaauaaccacua

SEQ ID NO: 696960 - RNA, 21 nt, Haemophilus influenzae Rd
aaauaaccacuccaaauaaua

SEQ ID NO: 696961 - RNA, 24 nt, Haemophilus influenzae Rd
aaauaacaaaaaagcuaagacauu

SEQ ID NO: 696962 - RNA, 16 nt, Haemophilus influenzae Rd
aaauaacacagaaacc

SEQ ID NO: 696963 - RNA, 20 nt, Haemophilus influenzae Rd
aaauaacacagaaaccaaua

SEQ ID NO: 696964 - RNA, 14 nt, Haemophilus influenzae Rd
aaauaaccuagaac

SEQ ID NO: 696965 - RNA, 18 nt, Haemophilus influenzae Rd
aaauaaccuagaacaaaa

SEQ ID NO: 696966 - RNA, 16 nt, Haemophilus influenzae Rd
aaauaaccuauaauag

SEQ ID NO: 696967 - RNA, 16 nt, Haemophilus influenzae Rd
aaauaacaucgcuaaa

SEQ ID NO: 696968 - RNA, 19 nt, Haemophilus influenzae Rd
aaauaacaucgcuaaaucu

SEQ ID NO: 696969 - RNA, 19 nt, Haemophilus influenzae Rd
aaauaacgcaucaccacaa

SEQ ID NO: 696970 - RNA, 21 nt, Haemophilus influenzae Rd
aaauaacguuuuaaguuuuca

SEQ ID NO: 696971 - RNA, 16 nt, Haemophilus influenzae Rd
aaauaacgucauuaau

SEQ ID NO: 696972 - RNA, 11 nt, Haemophilus influenzae Rd
ggcugauaguc

SEQ ID NO: 696973 - RNA, 13 nt, Haemophilus influenzae Rd
ggcugauauauua

SEQ ID NO: 696974 - RNA, 17 nt, Haemophilus influenzae Rd
ggcugauuuuaaauauc

SEQ ID NO: 696975 - RNA, 14 nt, Haemophilus influenzae Rd
ggcugaaaaaauau

SEQ ID NO: 696976 - RNA, 15 nt, Haemophilus influenzae Rd
ggcugccuucaaugg

SEQ ID NO: 696977 - RNA, 21 nt, Haemophilus influenzae Rd
ggcucaucauuaugaaaaaaa

SEQ ID NO: 696978 - RNA, 17 nt, Haemophilus influenzae Rd
ggcguaucauacuaaaa

SEQ ID NO: 696979 - RNA, 20 nt, Haemophilus influenzae Rd
ggcucuaacauaccgcucau

SEQ ID NO: 696980 - RNA, 12 nt, Haemophilus influenzae Rd
ggcucuacuuug

SEQ ID NO: 696981 - RNA, 11 nt, Haemophilus influenzae Rd
ggcuucuuuuc

SEQ ID NO: 696982 - RNA, 19 nt, Haemophilus influenzae Rd
ggcuugugggauaaauuca

SEQ ID NO: 696983 - RNA, 22 nt, Haemophilus influenzae Rd
ggcuucaguccgccuuuuugcu

SEQ ID NO: 696984 - RNA, 23 nt, Haemophilus influenzae Rd
ggcuucaucuaacaauagaauug

SEQ ID NO: 696985 - RNA, 15 nt, Haemophilus influenzae Rd
ggcuucagaaaauaa

SEQ ID NO: 696986 - RNA, 16 nt, Haemophilus influenzae Rd
ggcuuaacacaugcaa

SEQ ID NO: 696987 - RNA, 17 nt, Haemophilus influenzae Rd
ggcuuacagcaaaagca

SEQ ID NO: 696988 - RNA, 17 nt, Haemophilus influenzae Rd
ggcuuaguuaaauauaa

SEQ ID NO: 696989 - RNA, 17 nt, Haemophilus influenzae Rd
ggcuuauuaaaaacuaa

SEQ ID NO: 696990 - RNA, 17 nt, Haemophilus influenzae Rd
ggcuuauuuuuaaacaa

SEQ ID NO: 696991 - RNA, 22 nt, Haemophilus influenzae Rd
ggcuuuuuuauuuuauauauua

SEQ ID NO: 696992 - RNA, 12 nt, Haemophilus influenzae Rd
ggcuuuuuugcc

SEQ ID NO: 696993 - RNA, 21 nt, Haemophilus influenzae Rd
gggaaaacauaauauuuuccc

SEQ ID NO: 696994 - RNA, 17 nt, Haemophilus influenzae Rd
ggcuuuaaagguuuaaa

SEQ ID NO: 696995 - RNA, 21 nt, Haemophilus influenzae Rd
ggcuuuaaagguuuaaaccuu

SEQ ID NO: 696996 - RNA, 15 nt, Haemophilus influenzae Rd
ggcuuucuuuuucaa

SEQ ID NO: 696997 - RNA, 15 nt, Haemophilus influenzae Rd
gggaaggcuuuuccc

SEQ ID NO: 696998 - RNA, 19 nt, Haemophilus influenzae Rd
gggaaacaauaucuaagau

SEQ ID NO: 696999 - RNA, 21 nt, Haemophilus influenzae Rd
gggaaaauauuauguuuuccc

SEQ ID NO: 697000 - RNA, 14 nt, Haemophilus influenzae Rd
gggaauagcucagu

SEQ ID NO: 697001 - RNA, 20 nt, Haemophilus influenzae Rd
gggacugccacggcuugcca

SEQ ID NO: 697002 - RNA, 18 nt, Haemophilus influenzae Rd
gggacuuuaucgaggaca

SEQ ID NO: 697003 - RNA, 19 nt, Haemophilus influenzae Rd
gggcaccauuuaaacacca

SEQ ID NO: 697004 - RNA, 23 nt, Haemophilus influenzae Rd
gggcagaauuaaaucugcccuuu

SEQ ID NO: 697005 - RNA, 18 nt, Haemophilus influenzae Rd
gggcacuacucggaaagc

SEQ ID NO: 697006 - RNA, 23 nt, Haemophilus influenzae Rd
gggcagauuuaauucugcccuuu

SEQ ID NO: 697007 - RNA, 16 nt, Haemophilus influenzae Rd
gggaucauuucaucug

SEQ ID NO: 697008 - RNA, 14 nt, Haemophilus influenzae Rd
gggauaauuucuuu

SEQ ID NO: 697009 - RNA, 16 nt, Haemophilus influenzae Rd
gggauaagcuuuugag

SEQ ID NO: 697010 - RNA, 19 nt, Haemophilus influenzae Rd
gggaucuauuugauuuaac

SEQ ID NO: 697011 - RNA, 14 nt, Haemophilus influenzae Rd
gggauuaagaaaau

SEQ ID NO: 697012 - RNA, 16 nt, Haemophilus influenzae Rd
gggaugguuaauuuuu

SEQ ID NO: 697013 - RNA, 20 nt, Haemophilus influenzae Rd
gggauuuuuuauuuugugau

SEQ ID NO: 697014 - RNA, 17 nt, Haemophilus influenzae Rd
gggauuuugucaccaaa

SEQ ID NO: 697015 - RNA, 14 nt, Haemophilus influenzae Rd
gggcaaaagguaaa

SEQ ID NO: 697016 - RNA, 15 nt, Haemophilus influenzae Rd
gggcagugauguaaa

SEQ ID NO: 697017 - RNA, 21 nt, Haemophilus influenzae Rd
gggcauccaaaguacacaaga

SEQ ID NO: 697018 - RNA, 22 nt, Haemophilus influenzae Rd
gggcgauaaaaauuaaggaaag

SEQ ID NO: 697019 - RNA, 15 nt, Haemophilus influenzae Rd
gggcugaagcccacc

SEQ ID NO: 697020 - RNA, 19 nt, Haemophilus influenzae Rd
gggcugaauggauuauaaa

SEQ ID NO: 697021 - RNA, 21 nt, Haemophilus influenzae Rd
ggggacgcaccuuuugaaaaa

SEQ ID NO: 697022 - RNA, 18 nt, Haemophilus influenzae Rd
gggcuucucaaaugaaau

SEQ ID NO: 697023 - RNA, 16 nt, Haemophilus influenzae Rd
gggcuuuguauuuugu

SEQ ID NO: 697024 - RNA, 22 nt, Haemophilus influenzae Rd
gggcuuuaucauaacuauaauu

SEQ ID NO: 697025 - RNA, 23 nt, Haemophilus influenzae Rd
ggguauucacuuaauugugugcg

SEQ ID NO: 697026 - RNA, 20 nt, Haemophilus influenzae Rd
gggguaucgacaguugccau

SEQ ID NO: 697027 - RNA, 16 nt, Haemophilus influenzae Rd
ggguaaucaaauucaa

SEQ ID NO: 697028 - RNA, 17 nt, Haemophilus influenzae Rd
ggguaaaccaaacgaga

SEQ ID NO: 697029 - RNA, 22 nt, Haemophilus influenzae Rd
ggguaaaccaaacgagaaaauu

SEQ ID NO: 697030 - RNA, 22 nt, Haemophilus influenzae Rd
gguaaaagugcgguaaaaauua

SEQ ID NO: 697031 - RNA, 16 nt, Haemophilus influenzae Rd
gguaaaauaaugcaaa

SEQ ID NO: 697032 - RNA, 12 nt, Haemophilus influenzae Rd
gguaaaaaucau

SEQ ID NO: 697033 - RNA, 21 nt, Haemophilus influenzae Rd
gguaaaaaucguacaucgaaa

SEQ ID NO: 697034 - RNA, 20 nt, Haemophilus influenzae Rd
ggguuguggugucugaacuc

SEQ ID NO: 697035 - RNA, 23 nt, Haemophilus influenzae Rd
gguaaaugucuucuguuuggaua

SEQ ID NO: 697036 - RNA, 12 nt, Haemophilus influenzae Rd
gguaacaacugc

SEQ ID NO: 697037 - RNA, 20 nt, Haemophilus influenzae Rd
gguaaagccaacuuuuucua

SEQ ID NO: 697038 - RNA, 17 nt, Haemophilus influenzae Rd
gguaaacgaacuucacu

SEQ ID NO: 697039 - RNA, 18 nt, Haemophilus influenzae Rd
gguaagauuuuaugaaau

SEQ ID NO: 697040 - RNA, 17 nt, Haemophilus influenzae Rd
gguaagaagugaaauua

SEQ ID NO: 697041 - RNA, 19 nt, Haemophilus influenzae Rd
gguaagaagugaaauuacu

SEQ ID NO: 697042 - RNA, 19 nt, Haemophilus influenzae Rd
gguaaguugugaguaaacc

SEQ ID NO: 697043 - RNA, 19 nt, Haemophilus influenzae Rd
gguaauaaaucaaaagaau

SEQ ID NO: 697044 - RNA, 22 nt, Haemophilus influenzae Rd
gguaaucuuucacugcauuuuc

SEQ ID NO: 697045 - RNA, 23 nt, Haemophilus influenzae Rd
ggguuauauucagcaaaaucacu

SEQ ID NO: 697046 - RNA, 18 nt, Haemophilus influenzae Rd
ggguuggaagaauguuuu

SEQ ID NO: 697047 - RNA, 12 nt, Haemophilus influenzae Rd
gggugguaaaaa

SEQ ID NO: 697048 - RNA, 15 nt, Haemophilus influenzae Rd
gguaucagaaauuac

SEQ ID NO: 697049 - RNA, 16 nt, Haemophilus influenzae Rd
gguauaaaaaaucggu

SEQ ID NO: 697050 - RNA, 18 nt, Haemophilus influenzae Rd
gguaguuuauaaaaaaau

SEQ ID NO: 697051 - RNA, 22 nt, Haemophilus influenzae Rd
ggucaacauaaagauuaaaauc

SEQ ID NO: 697052 - RNA, 12 nt, Haemophilus influenzae Rd
gguauuuauuau

SEQ ID NO: 697053 - RNA, 20 nt, Haemophilus influenzae Rd
gguauuucaauuugaacaaa

SEQ ID NO: 697054 - RNA, 23 nt, Haemophilus influenzae Rd
gguauuucuauuguuuuuuucua

SEQ ID NO: 697055 - RNA, 22 nt, Haemophilus influenzae Rd
gguauuuucuuauugaagaaag

SEQ ID NO: 697056 - RNA, 23 nt, Haemophilus influenzae Rd
gguaugguuuuccaaaaaccaac

SEQ ID NO: 697057 - RNA, 23 nt, Haemophilus influenzae Rd
gguagagcagcggacuuuuaauc

SEQ ID NO: 697058 - RNA, 15 nt, Haemophilus influenzae Rd
gguagauugauacag

SEQ ID NO: 697059 - RNA, 14 nt, Haemophilus influenzae Rd
gguacaucuggaua

SEQ ID NO: 697060 - RNA, 13 nt, Haemophilus influenzae Rd
ggucgcaccaccu

SEQ ID NO: 697061 - RNA, 14 nt, Haemophilus influenzae Rd
ggucuguugcaaau

SEQ ID NO: 697062 - RNA, 17 nt, Haemophilus influenzae Rd
ggucugacgugaacuuu

SEQ ID NO: 697063 - RNA, 20 nt, Haemophilus influenzae Rd
ggucugaaaaucaaaagaaa

SEQ ID NO: 697064 - RNA, 18 nt, Haemophilus influenzae Rd
ggucugcaauaauaucug

SEQ ID NO: 697065 - RNA, 16 nt, Haemophilus influenzae Rd
ggucaauuuuuucaca

SEQ ID NO: 697066 - RNA, 19 nt, Haemophilus influenzae Rd
ggucaauaaaaauaauguu

SEQ ID NO: 697067 - RNA, 21 nt, Haemophilus influenzae Rd
ggucaagaucggaauauuuuu

SEQ ID NO: 697068 - RNA, 20 nt, Haemophilus influenzae Rd
ggucacgauuuuuuuauaaa

SEQ ID NO: 697069 - RNA, 18 nt, Haemophilus influenzae Rd
ggucagaaauauguuuua

SEQ ID NO: 697070 - RNA, 20 nt, Haemophilus influenzae Rd
ggucagucuaccauuuggga

SEQ ID NO: 697071 - RNA, 18 nt, Haemophilus influenzae Rd
gccucagguauuucuuca

SEQ ID NO: 697072 - RNA, 22 nt, Haemophilus influenzae Rd
gccucagguauuucuucaauau

SEQ ID NO: 697073 - RNA, 17 nt, Haemophilus influenzae Rd
gccuagugcuaaaauaa

SEQ ID NO: 697074 - RNA, 13 nt, Haemophilus influenzae Rd
gccucagcaauuu

SEQ ID NO: 697075 - RNA, 17 nt, Haemophilus influenzae Rd
gccuagauauuguucua

SEQ ID NO: 697076 - RNA, 14 nt, Haemophilus influenzae Rd
gccuacacgagaau

SEQ ID NO: 697077 - RNA, 15 nt, Haemophilus influenzae Rd
gccguuuaguuucaa

SEQ ID NO: 697078 - RNA, 19 nt, Haemophilus influenzae Rd
gccuaaugccuugaugcca

SEQ ID NO: 697079 - RNA, 20 nt, Haemophilus influenzae Rd
gccuaaugccuugaugccau

SEQ ID NO: 697080 - RNA, 16 nt, Haemophilus influenzae Rd
gccuaauaaaaaauaa

SEQ ID NO: 697081 - RNA, 17 nt, Haemophilus influenzae Rd
gccuaauaaaaaauaaa

SEQ ID NO: 697082 - RNA, 16 nt, Haemophilus influenzae Rd
gccuaauagaaaaaug

SEQ ID NO: 697083 - RNA, 15 nt, Haemophilus influenzae Rd
gccguguucuagugc

SEQ ID NO: 697084 - RNA, 16 nt, Haemophilus influenzae Rd
gccgcuuuuugaucuc

SEQ ID NO: 697085 - RNA, 14 nt, Haemophilus influenzae Rd
gccugucauauaaa

SEQ ID NO: 697086 - RNA, 15 nt, Haemophilus influenzae Rd
gccuguuucacaagu

SEQ ID NO: 697087 - RNA, 14 nt, Haemophilus influenzae Rd
gccucuguauuuuu

SEQ ID NO: 697088 - RNA, 16 nt, Haemophilus influenzae Rd
gccucuguauuuuuca

SEQ ID NO: 697089 - RNA, 21 nt, Haemophilus influenzae Rd
gccucuguauuuuucauaucu

SEQ ID NO: 697090 - RNA, 14 nt, Haemophilus influenzae Rd
gccuuuuauuucuu

SEQ ID NO: 697091 - RNA, 14 nt, Haemophilus influenzae Rd
gccuuuuaaaauga

SEQ ID NO: 697092 - RNA, 19 nt, Haemophilus influenzae Rd
gccuuuuaaaaugaacaaa

SEQ ID NO: 697093 - RNA, 22 nt, Haemophilus influenzae Rd
gccuuugguuggggucagauca

SEQ ID NO: 697094 - RNA, 17 nt, Haemophilus influenzae Rd
gccuuugucuuauucaa

SEQ ID NO: 697095 - RNA, 14 nt, Haemophilus influenzae Rd
gccuuuguuuuaua

SEQ ID NO: 697096 - RNA, 17 nt, Haemophilus influenzae Rd
gccuuucaucauugcuu

SEQ ID NO: 697097 - RNA, 15 nt, Haemophilus influenzae Rd
gccuuuccugcauca

SEQ ID NO: 697098 - RNA, 13 nt, Haemophilus influenzae Rd
gccuugcaaaaac

SEQ ID NO: 697099 - RNA, 15 nt, Haemophilus influenzae Rd
gccuucagccugcuc

SEQ ID NO: 697100 - RNA, 16 nt, Haemophilus influenzae Rd
gccuucaccuaauccu

SEQ ID NO: 697101 - RNA, 18 nt, Haemophilus influenzae Rd
gccuugaugcucugcaua

SEQ ID NO: 697102 - RNA, 19 nt, Haemophilus influenzae Rd
gcgaaccugauaaguagaa

SEQ ID NO: 697103 - RNA, 16 nt, Haemophilus influenzae Rd
gcgaaaccuuuuucuu

SEQ ID NO: 697104 - RNA, 15 nt, Haemophilus influenzae Rd
gccuuuuucuaaugg

SEQ ID NO: 697105 - RNA, 15 nt, Haemophilus influenzae Rd
gcgcauuuaauacug

SEQ ID NO: 697106 - RNA, 13 nt, Haemophilus influenzae Rd
gcgcauuaaacug

SEQ ID NO: 697107 - RNA, 19 nt, Haemophilus influenzae Rd
gcgcacuuuuggauaaagu

SEQ ID NO: 697108 - RNA, 19 nt, Haemophilus influenzae Rd
gcgcaacuucacgauuucu

SEQ ID NO: 697109 - RNA, 21 nt, Haemophilus influenzae Rd
gcgaugagucgcuuuaucuuc

SEQ ID NO: 697110 - RNA, 20 nt, Haemophilus influenzae Rd
gcgauuuuuauauaaauaac

SEQ ID NO: 697111 - RNA, 12 nt, Haemophilus influenzae Rd
gcgauuaugagu

SEQ ID NO: 697112 - RNA, 17 nt, Haemophilus influenzae Rd
gcgaaguuuaauucuuc

SEQ ID NO: 697113 - RNA, 22 nt, Haemophilus influenzae Rd
gcgacggcaucaaaccaaccac

SEQ ID NO: 697114 - RNA, 21 nt, Haemophilus influenzae Rd
gcgaucuaaaucauuuauaua

SEQ ID NO: 697115 - RNA, 12 nt, Haemophilus influenzae Rd
gcgaugaaauua

SEQ ID NO: 697116 - RNA, 14 nt, Haemophilus influenzae Rd
gcgauauucuuuug

SEQ ID NO: 697117 - RNA, 19 nt, Haemophilus influenzae Rd
gcgauauugaccauuucau

SEQ ID NO: 697118 - RNA, 21 nt, Haemophilus influenzae Rd
gcgaucgcuccaccaugaaua

SEQ ID NO: 697119 - RNA, 15 nt, Haemophilus influenzae Rd
gcgaucacugcaccg

SEQ ID NO: 697120 - RNA, 17 nt, Haemophilus influenzae Rd
gcgcuuagcaauguuuu

SEQ ID NO: 697121 - RNA, 13 nt, Haemophilus influenzae Rd
gcgguaaauuuuu

SEQ ID NO: 697122 - RNA, 20 nt, Haemophilus influenzae Rd
gcgguaaaauuuuuagugau

SEQ ID NO: 697123 - RNA, 14 nt, Haemophilus influenzae Rd
gcgguaaaaauuua

SEQ ID NO: 697124 - RNA, 20 nt, Haemophilus influenzae Rd
gcgccgauaacaccgcuaau

SEQ ID NO: 697125 - RNA, 15 nt, Haemophilus influenzae Rd
gcccgauauuuuggc

SEQ ID NO: 697126 - RNA, 21 nt, Haemophilus influenzae Rd
gcccgaacagaaagccccagu

SEQ ID NO: 697127 - RNA, 16 nt, Haemophilus influenzae Rd
gcccauuccacaagcc

SEQ ID NO: 697128 - RNA, 15 nt, Haemophilus influenzae Rd
gcccauuagauguga

SEQ ID NO: 697129 - RNA, 17 nt, Haemophilus influenzae Rd
gcccacuaacucacauu

SEQ ID NO: 697130 - RNA, 22 nt, Haemophilus influenzae Rd
gcccacauagcuugaauugcuc

SEQ ID NO: 697131 - RNA, 23 nt, Haemophilus influenzae Rd
gcccacccuacgauacuuuuaau

SEQ ID NO: 697132 - RNA, 19 nt, Haemophilus influenzae Rd
gcccauaagugagaaaaua

SEQ ID NO: 697133 - RNA, 19 nt, Haemophilus influenzae Rd
gccauauuuucccaguaaa

SEQ ID NO: 697134 - RNA, 17 nt, Haemophilus influenzae Rd
gccauauccguaucauu

SEQ ID NO: 697135 - RNA, 13 nt, Haemophilus influenzae Rd
gccaucaguaaag

SEQ ID NO: 697136 - RNA, 20 nt, Haemophilus influenzae Rd
gccaucauagauaaauauau

SEQ ID NO: 697137 - RNA, 15 nt, Haemophilus influenzae Rd
gcccaaaugcaacaa

SEQ ID NO: 697138 - RNA, 22 nt, Haemophilus influenzae Rd
gcccaacauuucacuaaauaaa

SEQ ID NO: 697139 - RNA, 21 nt, Haemophilus influenzae Rd
gcccaaccaaaccugcccuug

SEQ ID NO: 697140 - RNA, 14 nt, Haemophilus influenzae Rd
gccauuaccacugc

SEQ ID NO: 697141 - RNA, 14 nt, Haemophilus influenzae Rd
gccgcuaaugguug

SEQ ID NO: 697142 - RNA, 17 nt, Haemophilus influenzae Rd
gccgcugcaacaaauaa

SEQ ID NO: 697143 - RNA, 16 nt, Haemophilus influenzae Rd
gccgcugcagcaggaa

SEQ ID NO: 697144 - RNA, 20 nt, Haemophilus influenzae Rd
aaagcugaccgcacuuuuug

SEQ ID NO: 697145 - RNA, 22 nt, Haemophilus influenzae Rd
aaagcugcacuauauacauuaa

SEQ ID NO: 697146 - RNA, 14 nt, Haemophilus influenzae Rd
aaagcugaauaaau

SEQ ID NO: 697147 - RNA, 21 nt, Haemophilus influenzae Rd
gccgcgaugauagaaccaaua

SEQ ID NO: 697148 - RNA, 14 nt, Haemophilus influenzae Rd
gccgccuucuucca

SEQ ID NO: 697149 - RNA, 15 nt, Haemophilus influenzae Rd
gccagcuacaucuaa

SEQ ID NO: 697150 - RNA, 15 nt, Haemophilus influenzae Rd
gccagcuuaagcugg

SEQ ID NO: 697151 - RNA, 18 nt, Haemophilus influenzae Rd
gccagcuuaagcuggcgu

SEQ ID NO: 697152 - RNA, 15 nt, Haemophilus influenzae Rd
gccagccuggauaag

SEQ ID NO: 697153 - RNA, 19 nt, Haemophilus influenzae Rd
gccagcagugccaaccacc

SEQ ID NO: 697154 - RNA, 20 nt, Haemophilus influenzae Rd
gccagaaagcagguuuuucu

SEQ ID NO: 697155 - RNA, 20 nt, Haemophilus influenzae Rd
gccagaccuaagguuaauuu

SEQ ID NO: 697156 - RNA, 21 nt, Haemophilus influenzae Rd
gccagauacaaauaacacaga

SEQ ID NO: 697157 - RNA, 13 nt, Haemophilus influenzae Rd
gccagcaccacgu

SEQ ID NO: 697158 - RNA, 14 nt, Haemophilus influenzae Rd
gccacauaauaaga

SEQ ID NO: 697159 - RNA, 21 nt, Haemophilus influenzae Rd
gccacaucaucguuuuuucug

SEQ ID NO: 697160 - RNA, 12 nt, Haemophilus influenzae Rd
gccaccaaaaug

SEQ ID NO: 697161 - RNA, 17 nt, Haemophilus influenzae Rd
gccaaaucaucuagcau

SEQ ID NO: 697162 - RNA, 23 nt, Haemophilus influenzae Rd
gccaaagcauuuagagcaagcaa

SEQ ID NO: 697163 - RNA, 20 nt, Haemophilus influenzae Rd
gccaaauucaguaucaaaua

SEQ ID NO: 697164 - RNA, 13 nt, Haemophilus influenzae Rd
gccaaauuuaaaa

SEQ ID NO: 697165 - RNA, 18 nt, Haemophilus influenzae Rd
gccaaauuuaaaaaagcc

SEQ ID NO: 697166 - RNA, 22 nt, Haemophilus influenzae Rd
gcauaaaagugcgguaaaaaaa

SEQ ID NO: 697167 - RNA, 23 nt, Haemophilus influenzae Rd
gcauaaaaauaaccgcacuuugg

SEQ ID NO: 697168 - RNA, 13 nt, Haemophilus influenzae Rd
gcauaaaagcacg

SEQ ID NO: 697169 - RNA, 12 nt, Haemophilus influenzae Rd
gcauaaaagccu

SEQ ID NO: 697170 - RNA, 17 nt, Haemophilus influenzae Rd
gcauaaacaucuugcau

SEQ ID NO: 697171 - RNA, 15 nt, Haemophilus influenzae Rd
gcauaaacuaaaaua

SEQ ID NO: 697172 - RNA, 23 nt, Haemophilus influenzae Rd
gcauaaaaauuccaguucuccuu

SEQ ID NO: 697173 - RNA, 15 nt, Haemophilus influenzae Rd
gcaguugcuaaauca

SEQ ID NO: 697174 - RNA, 17 nt, Haemophilus influenzae Rd
gcaguuucugguuccau

SEQ ID NO: 697175 - RNA, 23 nt, Haemophilus influenzae Rd
gcaguuucuuuguucacaucaaa

SEQ ID NO: 697176 - RNA, 15 nt, Haemophilus influenzae Rd
gcaguguugcaggga

SEQ ID NO: 697177 - RNA, 18 nt, Haemophilus influenzae Rd
gcaguguugcagggaaag

SEQ ID NO: 697178 - RNA, 23 nt, Haemophilus influenzae Rd
gcaguguugcagggaaagucgca

SEQ ID NO: 697179 - RNA, 15 nt, Haemophilus influenzae Rd
gcaggggauugaaaa

SEQ ID NO: 697180 - RNA, 13 nt, Haemophilus influenzae Rd
gcagguuuugcaa

SEQ ID NO: 697181 - RNA, 19 nt, Haemophilus influenzae Rd
gcagguuuuuuauuucuca

SEQ ID NO: 697182 - RNA, 14 nt, Haemophilus influenzae Rd
gcaguaaaggcacu

SEQ ID NO: 697183 - RNA, 15 nt, Haemophilus influenzae Rd
gcaggaauauuagga

SEQ ID NO: 697184 - RNA, 13 nt, Haemophilus influenzae Rd
gcaggaaugaaag

SEQ ID NO: 697185 - RNA, 16 nt, Haemophilus influenzae Rd
gcaggagaaagcuugc

SEQ ID NO: 697186 - RNA, 23 nt, Haemophilus influenzae Rd
gcagcuucagcaaguucugcacg

SEQ ID NO: 697187 - RNA, 15 nt, Haemophilus influenzae Rd
gcaggaaaggcauua

SEQ ID NO: 697188 - RNA, 18 nt, Haemophilus influenzae Rd
gcagcguuugcugccucu

SEQ ID NO: 697189 - RNA, 21 nt, Haemophilus influenzae Rd
gcagcuaaaagugcggcuuca

SEQ ID NO: 697190 - RNA, 15 nt, Haemophilus influenzae Rd
gcagcuaauaggcuu

SEQ ID NO: 697191 - RNA, 15 nt, Haemophilus influenzae Rd
gcaucuuuauaacau

SEQ ID NO: 697192 - RNA, 15 nt, Haemophilus influenzae Rd
gcaucuguaucuuua

SEQ ID NO: 697193 - RNA, 19 nt, Haemophilus influenzae Rd
gcaucuguugugaaugcaa

SEQ ID NO: 697194 - RNA, 12 nt, Haemophilus influenzae Rd
gcauuaagaagu

SEQ ID NO: 697195 - RNA, 13 nt, Haemophilus influenzae Rd
gcauuaaguuuuu

SEQ ID NO: 697196 - RNA, 19 nt, Haemophilus influenzae Rd
gcauuaaugccucagaugc

SEQ ID NO: 697197 - RNA, 21 nt, Haemophilus influenzae Rd
gcauugcgccuuuuuggaaac

SEQ ID NO: 697198 - RNA, 18 nt, Haemophilus influenzae Rd
gcauuggaaugguauaaa

SEQ ID NO: 697199 - RNA, 19 nt, Haemophilus influenzae Rd
gcauugcccgcuucuucga

SEQ ID NO: 697200 - RNA, 12 nt, Haemophilus influenzae Rd
gcauugccuaaa

SEQ ID NO: 697201 - RNA, 16 nt, Haemophilus influenzae Rd
gcauugaguuuuucug

SEQ ID NO: 697202 - RNA, 18 nt, Haemophilus influenzae Rd
gcauugauugcuaaauaa

SEQ ID NO: 697203 - RNA, 10 nt, Haemophilus influenzae Rd
gcauuaauag

SEQ ID NO: 697204 - RNA, 21 nt, Haemophilus influenzae Rd
gcauuaccgccagugauuuuu

SEQ ID NO: 697205 - RNA, 15 nt, Haemophilus influenzae Rd
gcauuugcuaagauu

SEQ ID NO: 697206 - RNA, 18 nt, Haemophilus influenzae Rd
gcauuugcucaauaccua

SEQ ID NO: 697207 - RNA, 22 nt, Haemophilus influenzae Rd
gcauuuucucguccaccacugg

SEQ ID NO: 697208 - RNA, 13 nt, Haemophilus influenzae Rd
gcauuuucuuuuu

SEQ ID NO: 697209 - RNA, 15 nt, Haemophilus influenzae Rd
gcauuucuaaauaaa

SEQ ID NO: 697210 - RNA, 15 nt, Haemophilus influenzae Rd
gcauagccguucuua

SEQ ID NO: 697211 - RNA, 18 nt, Haemophilus influenzae Rd
gcauaauggcuuaauaau

SEQ ID NO: 697212 - RNA, 22 nt, Haemophilus influenzae Rd
gcauaucgauaauuuaacugaa

SEQ ID NO: 697213 - RNA, 19 nt, Haemophilus influenzae Rd
gcauagaaugcaacaagua

SEQ ID NO: 697214 - RNA, 17 nt, Haemophilus influenzae Rd
gcauaauuccuuuuucu

SEQ ID NO: 697215 - RNA, 12 nt, Haemophilus influenzae Rd
gcauaaccugcg

SEQ ID NO: 697216 - RNA, 18 nt, Haemophilus influenzae Rd
gcaucaaccgauaaaucu

SEQ ID NO: 697217 - RNA, 15 nt, Haemophilus influenzae Rd
gcaucauagccuuuu

SEQ ID NO: 697218 - RNA, 18 nt, Haemophilus influenzae Rd
gcaucauagccuuuucua

SEQ ID NO: 697219 - RNA, 16 nt, Haemophilus influenzae Rd
gcaucaaaauuauaaa

SEQ ID NO: 697220 - RNA, 15 nt, Haemophilus influenzae Rd
gcauauuuuguucua

SEQ ID NO: 697221 - RNA, 17 nt, Haemophilus influenzae Rd
gcauauuuuguucuaca

SEQ ID NO: 697222 - RNA, 17 nt, Haemophilus influenzae Rd
gcauauuuuugcaagau

SEQ ID NO: 697223 - RNA, 22 nt, Haemophilus influenzae Rd
gcauauguugguaauucagcgc

SEQ ID NO: 697224 - RNA, 19 nt, Haemophilus influenzae Rd
gcaucuaaaaauaauuuua

SEQ ID NO: 697225 - RNA, 13 nt, Haemophilus influenzae Rd
gcauccacuucau

SEQ ID NO: 697226 - RNA, 16 nt, Haemophilus influenzae Rd
gcauccacuucaucca

SEQ ID NO: 697227 - RNA, 15 nt, Haemophilus influenzae Rd
gcaucauucaaugca

SEQ ID NO: 697228 - RNA, 17 nt, Haemophilus influenzae Rd
gcauccaaacgccacgc

SEQ ID NO: 697229 - RNA, 13 nt, Haemophilus influenzae Rd
gcaaaaucaaagu

SEQ ID NO: 697230 - RNA, 16 nt, Haemophilus influenzae Rd
gcaaaagccaauaaga

SEQ ID NO: 697231 - RNA, 12 nt, Haemophilus influenzae Rd
gcaaaagugcuu

SEQ ID NO: 697232 - RNA, 17 nt, Haemophilus influenzae Rd
gcaaaaucgcaauauua

SEQ ID NO: 697233 - RNA, 18 nt, Haemophilus influenzae Rd
gcaaaaugggccucuuua

SEQ ID NO: 697234 - RNA, 16 nt, Haemophilus influenzae Rd
gcaaaaucucuggaga

SEQ ID NO: 697235 - RNA, 17 nt, Haemophilus influenzae Rd
gcaaacaaaauaaauga

SEQ ID NO: 697236 - RNA, 19 nt, Haemophilus influenzae Rd
gcaaaaccgcuauuacuua

SEQ ID NO: 697237 - RNA, 15 nt, Haemophilus influenzae Rd
gcaaaaccuaacaua

SEQ ID NO: 697238 - RNA, 18 nt, Haemophilus influenzae Rd
gcaaaagacgaagaaaca

SEQ ID NO: 697239 - RNA, 11 nt, Haemophilus influenzae Rd
gcaaaagaaau

SEQ ID NO: 697240 - RNA, 13 nt, Haemophilus influenzae Rd
gcaaaacugaaag

SEQ ID NO: 697241 - RNA, 23 nt, Haemophilus influenzae Rd
gcaaaaaacuuugguuuguuaaa

SEQ ID NO: 697242 - RNA, 19 nt, Haemophilus influenzae Rd
gcaaaaaaucuuuuauucu

SEQ ID NO: 697243 - RNA, 20 nt, Haemophilus influenzae Rd
gcaaaaacccucaagaaacu

SEQ ID NO: 697244 - RNA, 13 nt, Haemophilus influenzae Rd
gcaaaaauacuaa

SEQ ID NO: 697245 - RNA, 18 nt, Haemophilus influenzae Rd
gauuuuuucuaauccaga

SEQ ID NO: 697246 - RNA, 23 nt, Haemophilus influenzae Rd
gauuuuuuaugaccaaauaccac

SEQ ID NO: 697247 - RNA, 17 nt, Haemophilus influenzae Rd
gauuuuuuauuaauuau

SEQ ID NO: 697248 - RNA, 24 nt, Haemophilus influenzae Rd
gauuuuuuuuauaucuucucuugg

SEQ ID NO: 697249 - RNA, 18 nt, Haemophilus influenzae Rd
gauuuugucuaagguuuc

SEQ ID NO: 697250 - RNA, 22 nt, Haemophilus influenzae Rd
gauuuuguuuucuuuuuuucuu

SEQ ID NO: 697251 - RNA, 20 nt, Haemophilus influenzae Rd
gauuuugccgagaauaaagg

SEQ ID NO: 697252 - RNA, 17 nt, Haemophilus influenzae Rd
gauuuugccagauuuuu

SEQ ID NO: 697253 - RNA, 20 nt, Haemophilus influenzae Rd
gauuuuucuuuuucaguuuu

SEQ ID NO: 697254 - RNA, 20 nt, Haemophilus influenzae Rd
gauuuuugaggggaauuuuu

SEQ ID NO: 697255 - RNA, 16 nt, Haemophilus influenzae Rd
gauuuuugauaaaaaa

SEQ ID NO: 697256 - RNA, 17 nt, Haemophilus influenzae Rd
gcaaacuacaacuuuuu

SEQ ID NO: 697257 - RNA, 13 nt, Haemophilus influenzae Rd
gcaaacaucauca

SEQ ID NO: 697258 - RNA, 18 nt, Haemophilus influenzae Rd
gcaaacaaguuucuaaaa

SEQ ID NO: 697259 - RNA, 17 nt, Haemophilus influenzae Rd
gcaaagaaauuuuaauc

SEQ ID NO: 697260 - RNA, 16 nt, Haemophilus influenzae Rd
gcaaccagcagaaaau

SEQ ID NO: 697261 - RNA, 23 nt, Haemophilus influenzae Rd
gcaaccacacaagcaccagucaa

SEQ ID NO: 697262 - RNA, 18 nt, Haemophilus influenzae Rd
gcaacccacuucugcacc

SEQ ID NO: 697263 - RNA, 22 nt, Haemophilus influenzae Rd
gcaacaucaauaacaagcucag

SEQ ID NO: 697264 - RNA, 12 nt, Haemophilus influenzae Rd
gcaacauauuuu

SEQ ID NO: 697265 - RNA, 14 nt, Haemophilus influenzae Rd
gcaacaauaacugc

SEQ ID NO: 697266 - RNA, 19 nt, Haemophilus influenzae Rd
gcaacaauaucauugacuu

SEQ ID NO: 697267 - RNA, 13 nt, Haemophilus influenzae Rd
gcaacaaauauug

SEQ ID NO: 697268 - RNA, 22 nt, Haemophilus influenzae Rd
gcaaauugcccuguugaaacag

SEQ ID NO: 697269 - RNA, 22 nt, Haemophilus influenzae Rd
gcaaauuuucguuuacccacuu

SEQ ID NO: 697270 - RNA, 20 nt, Haemophilus influenzae Rd
gcaaauuuuucauucugucg

SEQ ID NO: 697271 - RNA, 12 nt, Haemophilus influenzae Rd
gcaaauuuuuuc

SEQ ID NO: 697272 - RNA, 13 nt, Haemophilus influenzae Rd
gcaaauuuaaaua

SEQ ID NO: 697273 - RNA, 16 nt, Haemophilus influenzae Rd
gcaaaugaggaaaaua

SEQ ID NO: 697274 - RNA, 23 nt, Haemophilus influenzae Rd
gcaaagguuuuauuuugaacaau

SEQ ID NO: 697275 - RNA, 20 nt, Haemophilus influenzae Rd
gcaaauacguauaauugacc

SEQ ID NO: 697276 - RNA, 14 nt, Haemophilus influenzae Rd
gcaaauacuucacc

SEQ ID NO: 697277 - RNA, 16 nt, Haemophilus influenzae Rd
gcaaauacuucaccgu

SEQ ID NO: 697278 - RNA, 19 nt, Haemophilus influenzae Rd
gauugaccucguggcaaaa

SEQ ID NO: 697279 - RNA, 18 nt, Haemophilus influenzae Rd
gauugacuuguuuuaaaa

SEQ ID NO: 697280 - RNA, 22 nt, Haemophilus influenzae Rd
gauugacuuguuuuaaaacuau

SEQ ID NO: 697281 - RNA, 22 nt, Haemophilus influenzae Rd
gauugacauuuuacuuuagcaa

SEQ ID NO: 697282 - RNA, 10 nt, Haemophilus influenzae Rd
gauucuucca

SEQ ID NO: 697283 - RNA, 15 nt, Haemophilus influenzae Rd
gauugaacuugaauu

SEQ ID NO: 697284 - RNA, 22 nt, Haemophilus influenzae Rd
gauucuguuguccagucaucau

SEQ ID NO: 697285 - RNA, 13 nt, Haemophilus influenzae Rd
gauugcaugaaau

SEQ ID NO: 697286 - RNA, 15 nt, Haemophilus influenzae Rd
gauugcaugaaaugu

SEQ ID NO: 697287 - RNA, 16 nt, Haemophilus influenzae Rd
gauugauuuaguucaa

SEQ ID NO: 697288 - RNA, 16 nt, Haemophilus influenzae Rd
gauugauuuucuuucu

SEQ ID NO: 697289 - RNA, 15 nt, Haemophilus influenzae Rd
gauugauauuuggau

SEQ ID NO: 697290 - RNA, 20 nt, Haemophilus influenzae Rd
gauugaucagaaguuaaaac

SEQ ID NO: 697291 - RNA, 18 nt, Haemophilus influenzae Rd
gauugcgagucaaauuuu

SEQ ID NO: 697292 - RNA, 15 nt, Haemophilus influenzae Rd
gauugcuaaauaaau

SEQ ID NO: 697293 - RNA, 20 nt, Haemophilus influenzae Rd
gauugcuacagcaaauccuu

SEQ ID NO: 697294 - RNA, 18 nt, Haemophilus influenzae Rd
gauugcugacaaauuugu

SEQ ID NO: 697295 - RNA, 13 nt, Haemophilus influenzae Rd
gauugcuuuaacu

SEQ ID NO: 697296 - RNA, 20 nt, Haemophilus influenzae Rd
gauucacgaucacuuguuuu

SEQ ID NO: 697297 - RNA, 17 nt, Haemophilus influenzae Rd
gauucagaaaaagcuuc

SEQ ID NO: 697298 - RNA, 23 nt, Haemophilus influenzae Rd
gauucaaaucuaaugccuuuccu

SEQ ID NO: 697299 - RNA, 18 nt, Haemophilus influenzae Rd
gauucaacaauaauuuuu

SEQ ID NO: 697300 - RNA, 24 nt, Haemophilus influenzae Rd
gauucaauaauagccauauuaucu

SEQ ID NO: 697301 - RNA, 17 nt, Haemophilus influenzae Rd
gauucaauucuucuaau

SEQ ID NO: 697302 - RNA, 19 nt, Haemophilus influenzae Rd
gauucaguguaguuuucug

SEQ ID NO: 697303 - RNA, 19 nt, Haemophilus influenzae Rd
gauucauuugcaaaucaag

SEQ ID NO: 697304 - RNA, 14 nt, Haemophilus influenzae Rd
gauucgcacguuuu

SEQ ID NO: 697305 - RNA, 15 nt, Haemophilus influenzae Rd
gauucgcacguuuuu

SEQ ID NO: 697306 - RNA, 14 nt, Haemophilus influenzae Rd
gauuccuaaucuua

SEQ ID NO: 697307 - RNA, 15 nt, Haemophilus influenzae Rd
gauucgccuugcuuu

SEQ ID NO: 697308 - RNA, 21 nt, Haemophilus influenzae Rd
gauucgccuugcuuuuaauaa

SEQ ID NO: 697309 - RNA, 21 nt, Haemophilus influenzae Rd
gauucuaauuccccuucaaau

SEQ ID NO: 697310 - RNA, 14 nt, Haemophilus influenzae Rd
gauucuaaaaacuc

SEQ ID NO: 697311 - RNA, 20 nt, Haemophilus influenzae Rd
gauuuaaaaaaacguuaaau

SEQ ID NO: 697312 - RNA, 15 nt, Haemophilus influenzae Rd
gauuuaaaaucccuc

SEQ ID NO: 697313 - RNA, 22 nt, Haemophilus influenzae Rd
gauuuacgcaaccaucuuuaau

SEQ ID NO: 697314 - RNA, 12 nt, Haemophilus influenzae Rd
gauuuaauacca

SEQ ID NO: 697315 - RNA, 17 nt, Haemophilus influenzae Rd
gauuuaauagcacagaa

SEQ ID NO: 697316 - RNA, 18 nt, Haemophilus influenzae Rd
gauuuaauagcacagaaa

SEQ ID NO: 697317 - RNA, 19 nt, Haemophilus influenzae Rd
gauuguccaaagaauaaua

SEQ ID NO: 697318 - RNA, 17 nt, Haemophilus influenzae Rd
gauuguuguaauccauu

SEQ ID NO: 697319 - RNA, 14 nt, Haemophilus influenzae Rd
gauuuagccaguaa

SEQ ID NO: 697320 - RNA, 17 nt, Haemophilus influenzae Rd
gauuuaggcauugcugu

SEQ ID NO: 697321 - RNA, 20 nt, Haemophilus influenzae Rd
gauuuaguuggguauucacu

SEQ ID NO: 697322 - RNA, 20 nt, Haemophilus influenzae Rd
gauuuaguucaaggacugag

SEQ ID NO: 697323 - RNA, 20 nt, Haemophilus influenzae Rd
gauuuagauaauaaaaaaac

SEQ ID NO: 697324 - RNA, 23 nt, Haemophilus influenzae Rd
gauuuauauuccauuauuuauca

SEQ ID NO: 697325 - RNA, 13 nt, Haemophilus influenzae Rd
gauuucaacgaau

SEQ ID NO: 697326 - RNA, 16 nt, Haemophilus influenzae Rd
gauuuauuucugaagg

SEQ ID NO: 697327 - RNA, 18 nt, Haemophilus influenzae Rd
gauuuccaucuaaaaguu

SEQ ID NO: 697328 - RNA, 23 nt, Haemophilus influenzae Rd
gauuucauuggcgguuuugccaa

SEQ ID NO: 697329 - RNA, 14 nt, Haemophilus influenzae Rd
gauuucaucuucau

SEQ ID NO: 697330 - RNA, 20 nt, Haemophilus influenzae Rd
gauuucaguaucaauaccaa

SEQ ID NO: 697331 - RNA, 12 nt, Haemophilus influenzae Rd
gauuugccaaaa

SEQ ID NO: 697332 - RNA, 22 nt, Haemophilus influenzae Rd
gauuugagcccuaagucauaua

SEQ ID NO: 697333 - RNA, 19 nt, Haemophilus influenzae Rd
gauuugcaaagcuaccuac

SEQ ID NO: 697334 - RNA, 16 nt, Haemophilus influenzae Rd
gauuucuuuugguuua

SEQ ID NO: 697335 - RNA, 13 nt, Haemophilus influenzae Rd
gauuugaaccuuc

SEQ ID NO: 697336 - RNA, 18 nt, Haemophilus influenzae Rd
gauuucgugcaauaacaa

SEQ ID NO: 697337 - RNA, 15 nt, Haemophilus influenzae Rd
gauuucuuaugaaaa

SEQ ID NO: 697338 - RNA, 16 nt, Haemophilus influenzae Rd
gauuucuuaugaaaaa

SEQ ID NO: 697339 - RNA, 16 nt, Haemophilus influenzae Rd
gauuucuguuaaaucu

SEQ ID NO: 697340 - RNA, 20 nt, Haemophilus influenzae Rd
gauuuucucgugugaaauua

SEQ ID NO: 697341 - RNA, 16 nt, Haemophilus influenzae Rd
gauuuucuuagcuuca

SEQ ID NO: 697342 - RNA, 12 nt, Haemophilus influenzae Rd
gauuuucuuauc

SEQ ID NO: 697343 - RNA, 12 nt, Haemophilus influenzae Rd
gauuuucuuauu

SEQ ID NO: 697344 - RNA, 23 nt, Haemophilus influenzae Rd
gauuuuauuucgcuauuguuaaa

SEQ ID NO: 697345 - RNA, 16 nt, Haemophilus influenzae Rd
gauuuuauuuaauaua

SEQ ID NO: 697346 - RNA, 22 nt, Haemophilus influenzae Rd
gauuuuaguuucuaauucuucc

SEQ ID NO: 697347 - RNA, 22 nt, Haemophilus influenzae Rd
gauuuuaaaacacgaaaaaaac

SEQ ID NO: 697348 - RNA, 15 nt, Haemophilus influenzae Rd
gauuuuaaaauaaau

SEQ ID NO: 697349 - RNA, 16 nt, Haemophilus influenzae Rd
gauuuuacuuguuuau

SEQ ID NO: 697350 - RNA, 15 nt, Haemophilus influenzae Rd
gauuuuagaaaaauc

SEQ ID NO: 697351 - RNA, 19 nt, Haemophilus influenzae Rd
gauuuuacgauuucugccu

SEQ ID NO: 697352 - RNA, 15 nt, Haemophilus influenzae Rd
gauuuuaauguaaua

SEQ ID NO: 697353 - RNA, 22 nt, Haemophilus influenzae Rd
gauuuuaccgcacuuuuuuucu

SEQ ID NO: 697354 - RNA, 10 nt, Haemophilus influenzae Rd
gauuuuaaau

SEQ ID NO: 697355 - RNA, 15 nt, Haemophilus influenzae Rd
gauggcgugaaauau

SEQ ID NO: 697356 - RNA, 16 nt, Haemophilus influenzae Rd
gaugguaaaaacuuug

SEQ ID NO: 697357 - RNA, 15 nt, Haemophilus influenzae Rd
gaugguaauagagua

SEQ ID NO: 697358 - RNA, 20 nt, Haemophilus influenzae Rd
gauggcuauuuaagccuuga

SEQ ID NO: 697359 - RNA, 19 nt, Haemophilus influenzae Rd
gauggcugggauuucaaac

SEQ ID NO: 697360 - RNA, 16 nt, Haemophilus influenzae Rd
gauguaauugagcguc

SEQ ID NO: 697361 - RNA, 23 nt, Haemophilus influenzae Rd
gauguaaugagcacgccuaauac

SEQ ID NO: 697362 - RNA, 18 nt, Haemophilus influenzae Rd
gauguaaaagauaaaaca

SEQ ID NO: 697363 - RNA, 20 nt, Haemophilus influenzae Rd
gauguaaaagauaaaacaga

SEQ ID NO: 697364 - RNA, 13 nt, Haemophilus influenzae Rd
gauguaaauuuuc

SEQ ID NO: 697365 - RNA, 14 nt, Haemophilus influenzae Rd
gauguaggcaaaaa

SEQ ID NO: 697366 - RNA, 15 nt, Haemophilus influenzae Rd
gauguaccaaaaugu

SEQ ID NO: 697367 - RNA, 23 nt, Haemophilus influenzae Rd
gaugucaggaucgguaaguugug

SEQ ID NO: 697368 - RNA, 20 nt, Haemophilus influenzae Rd
gauuacccacuaaguauuaa

SEQ ID NO: 697369 - RNA, 21 nt, Haemophilus influenzae Rd
gauuaauuuuuuauaaaauuu

SEQ ID NO: 697370 - RNA, 16 nt, Haemophilus influenzae Rd
gauuaauaccaauaau

SEQ ID NO: 697371 - RNA, 18 nt, Haemophilus influenzae Rd
gauuaauccgcucaucgc

SEQ ID NO: 697372 - RNA, 13 nt, Haemophilus influenzae Rd
gauuaaucuuuuu

SEQ ID NO: 697373 - RNA, 14 nt, Haemophilus influenzae Rd
gauuaauuaaauua

SEQ ID NO: 697374 - RNA, 22 nt, Haemophilus influenzae Rd
gauuaauuacgccugcccaagu

SEQ ID NO: 697375 - RNA, 17 nt, Haemophilus influenzae Rd
gauuaauuauauuuucu

SEQ ID NO: 697376 - RNA, 22 nt, Haemophilus influenzae Rd
gauuaauugcuaccauuuaucu

SEQ ID NO: 697377 - RNA, 23 nt, Haemophilus influenzae Rd
gauuacgcguacgcaauuuagau

SEQ ID NO: 697378 - RNA, 22 nt, Haemophilus influenzae Rd
gauuacguagaaaacaauaaaa

SEQ ID NO: 697379 - RNA, 16 nt, Haemophilus influenzae Rd
gauuacugucaaucca

SEQ ID NO: 697380 - RNA, 15 nt, Haemophilus influenzae Rd
gauuagaaaugauca

SEQ ID NO: 697381 - RNA, 14 nt, Haemophilus influenzae Rd
gauuagcuaauaua

SEQ ID NO: 697382 - RNA, 15 nt, Haemophilus influenzae Rd
gauuauugcacuaau

SEQ ID NO: 697383 - RNA, 20 nt, Haemophilus influenzae Rd
gauuauuuggcaaaugauaa

SEQ ID NO: 697384 - RNA, 22 nt, Haemophilus influenzae Rd
gauuauuaccuaguuugcuaua

SEQ ID NO: 697385 - RNA, 19 nt, Haemophilus influenzae Rd
gauuauauuguugcacauu

SEQ ID NO: 697386 - RNA, 18 nt, Haemophilus influenzae Rd
gauuaucgccuaaaauug

SEQ ID NO: 697387 - RNA, 13 nt, Haemophilus influenzae Rd
gauuaucuagaaa

SEQ ID NO: 697388 - RNA, 17 nt, Haemophilus influenzae Rd
gauuaucuagaaaacuc

SEQ ID NO: 697389 - RNA, 20 nt, Haemophilus influenzae Rd
gauuaucuagcacaaagaca

SEQ ID NO: 697390 - RNA, 23 nt, Haemophilus influenzae Rd
gauuauacgaucacgauuuuucu

SEQ ID NO: 697391 - RNA, 14 nt, Haemophilus influenzae Rd
gauuauaaauuagc

SEQ ID NO: 697392 - RNA, 14 nt, Haemophilus influenzae Rd
gaugugaauaucca

SEQ ID NO: 697393 - RNA, 15 nt, Haemophilus influenzae Rd
gaugucuggcugagu

SEQ ID NO: 697394 - RNA, 20 nt, Haemophilus influenzae Rd
gaugugcuugaugucaguga

SEQ ID NO: 697395 - RNA, 21 nt, Haemophilus influenzae Rd
gaugucuaaaugugcccagcg

SEQ ID NO: 697396 - RNA, 13 nt, Haemophilus influenzae Rd
gauuaacaauaau

SEQ ID NO: 697397 - RNA, 19 nt, Haemophilus influenzae Rd
gauuaacuuucucacuuau

SEQ ID NO: 697398 - RNA, 16 nt, Haemophilus influenzae Rd
gauuaagaaaauuguc

SEQ ID NO: 697399 - RNA, 23 nt, Haemophilus influenzae Rd
gauuaaagcguuguucaucugcc

SEQ ID NO: 697400 - RNA, 21 nt, Haemophilus influenzae Rd
gauuaaagggcugcuacaauu

SEQ ID NO: 697401 - RNA, 11 nt, Haemophilus influenzae Rd
gauuaaaaguc

SEQ ID NO: 697402 - RNA, 22 nt, Haemophilus influenzae Rd
gauuaaauauuuucauuuaugu

SEQ ID NO: 697403 - RNA, 17 nt, Haemophilus influenzae Rd
gauguucaaguaaaugc

SEQ ID NO: 697404 - RNA, 22 nt, Haemophilus influenzae Rd
gauguuuuugaaguaaaaaaau

SEQ ID NO: 697405 - RNA, 19 nt, Haemophilus influenzae Rd
gauguuguaaaaucucuau

SEQ ID NO: 697406 - RNA, 13 nt, Haemophilus influenzae Rd
gauguuuuaacaa

SEQ ID NO: 697407 - RNA, 11 nt, Haemophilus influenzae Rd
gaugaagauga

SEQ ID NO: 697408 - RNA, 19 nt, Haemophilus influenzae Rd
gaugaaugccacaaauaaa

SEQ ID NO: 697409 - RNA, 23 nt, Haemophilus influenzae Rd
gaugaauggguuaguaaguggua

SEQ ID NO: 697410 - RNA, 15 nt, Haemophilus influenzae Rd
gaugaagaaaauuuc

SEQ ID NO: 697411 - RNA, 19 nt, Haemophilus influenzae Rd
gaugaagaaaauuucugcu

SEQ ID NO: 697412 - RNA, 15 nt, Haemophilus influenzae Rd
gaugaaauuaucauc

SEQ ID NO: 697413 - RNA, 14 nt, Haemophilus influenzae Rd
gaugaaaucaaaau

SEQ ID NO: 697414 - RNA, 23 nt, Haemophilus influenzae Rd
gaugaaaaaagugcggaaaauuu

SEQ ID NO: 697415 - RNA, 12 nt, Haemophilus influenzae Rd
gaucuuuugcca

SEQ ID NO: 697416 - RNA, 22 nt, Haemophilus influenzae Rd
gaucuuuuguuacuuuccauuc

SEQ ID NO: 697417 - RNA, 16 nt, Haemophilus influenzae Rd
gaucuucaaucaucau

SEQ ID NO: 697418 - RNA, 18 nt, Haemophilus influenzae Rd
gaucuucagcauuuacca

SEQ ID NO: 697419 - RNA, 13 nt, Haemophilus influenzae Rd
gaucuguuuuaag

SEQ ID NO: 697420 - RNA, 13 nt, Haemophilus influenzae Rd
gaugacugcaauu

SEQ ID NO: 697421 - RNA, 16 nt, Haemophilus influenzae Rd
gaugacuggcaaaaau

SEQ ID NO: 697422 - RNA, 15 nt, Haemophilus influenzae Rd
gaugaccuguacuug

SEQ ID NO: 697423 - RNA, 18 nt, Haemophilus influenzae Rd
gaugacgaaaugaaauua

SEQ ID NO: 697424 - RNA, 15 nt, Haemophilus influenzae Rd
gaugacuaaacaaau

SEQ ID NO: 697425 - RNA, 14 nt, Haemophilus influenzae Rd
gaugauaauuucau

SEQ ID NO: 697426 - RNA, 15 nt, Haemophilus influenzae Rd
gaugauaauuucauc

SEQ ID NO: 697427 - RNA, 17 nt, Haemophilus influenzae Rd
gaugauaauuucaucgc

SEQ ID NO: 697428 - RNA, 20 nt, Haemophilus influenzae Rd
gaugaugggaugaaaucaaa

SEQ ID NO: 697429 - RNA, 18 nt, Haemophilus influenzae Rd
gaugcggucggcgaguug

SEQ ID NO: 697430 - RNA, 14 nt, Haemophilus influenzae Rd
gaugccauuaaaac

SEQ ID NO: 697431 - RNA, 16 nt, Haemophilus influenzae Rd
gaugccagcaaguuca

SEQ ID NO: 697432 - RNA, 20 nt, Haemophilus influenzae Rd
gaugcauacuuguaguggau

SEQ ID NO: 697433 - RNA, 21 nt, Haemophilus influenzae Rd
gaugcauacuuguaguggauu

SEQ ID NO: 697434 - RNA, 21 nt, Haemophilus influenzae Rd
gaugcaacgcauuagcaucca

SEQ ID NO: 697435 - RNA, 13 nt, Haemophilus influenzae Rd
gaugauuuuaaag

SEQ ID NO: 697436 - RNA, 20 nt, Haemophilus influenzae Rd
aaagcgaaaucgcacucaca

SEQ ID NO: 697437 - RNA, 19 nt, Haemophilus influenzae Rd
aaagccuuauuguacucaa

SEQ ID NO: 697438 - RNA, 15 nt, Haemophilus influenzae Rd
aaagcgacauuuugu

SEQ ID NO: 697439 - RNA, 15 nt, Haemophilus influenzae Rd
gauaagagcuuacuu

SEQ ID NO: 697440 - RNA, 18 nt, Haemophilus influenzae Rd
gauaagaucguauuuuug

SEQ ID NO: 697441 - RNA, 17 nt, Haemophilus influenzae Rd
gauaacuuagaaaauau

SEQ ID NO: 697442 - RNA, 11 nt, Haemophilus influenzae Rd
gauaacuucuu

SEQ ID NO: 697443 - RNA, 23 nt, Haemophilus influenzae Rd
gauaacuuucaguuaaauuuuca

SEQ ID NO: 697444 - RNA, 18 nt, Haemophilus influenzae Rd
gauaagaugauaaauucu

SEQ ID NO: 697445 - RNA, 22 nt, Haemophilus influenzae Rd
gauaagcauuuuaucacaaguu

SEQ ID NO: 697446 - RNA, 14 nt, Haemophilus influenzae Rd
gauacgaauguuug

SEQ ID NO: 697447 - RNA, 18 nt, Haemophilus influenzae Rd
gauacuuuuaauuaaaua

SEQ ID NO: 697448 - RNA, 18 nt, Haemophilus influenzae Rd
gauacuuuuacgcuugga

SEQ ID NO: 697449 - RNA, 20 nt, Haemophilus influenzae Rd
gauacuuggcguucauaucu

SEQ ID NO: 697450 - RNA, 15 nt, Haemophilus influenzae Rd
gauacggcaaauuaa

SEQ ID NO: 697451 - RNA, 12 nt, Haemophilus influenzae Rd
gauacuuucuug

SEQ ID NO: 697452 - RNA, 18 nt, Haemophilus influenzae Rd
gauagcugccgaauagau

SEQ ID NO: 697453 - RNA, 20 nt, Haemophilus influenzae Rd
gauagcaaugccaaucuaaa

SEQ ID NO: 697454 - RNA, 23 nt, Haemophilus influenzae Rd
gauaggcguuagccgauuuaccu

SEQ ID NO: 697455 - RNA, 22 nt, Haemophilus influenzae Rd
gauagugcccgcuacaaauaag

SEQ ID NO: 697456 - RNA, 20 nt, Haemophilus influenzae Rd
gauaguggaauaaugaaaua

SEQ ID NO: 697457 - RNA, 16 nt, Haemophilus influenzae Rd
gauaguaaaaaaucaa

SEQ ID NO: 697458 - RNA, 17 nt, Haemophilus influenzae Rd
gauauaccauucuuuca

SEQ ID NO: 697459 - RNA, 18 nt, Haemophilus influenzae Rd
gauauaccauucuuucaa

SEQ ID NO: 697460 - RNA, 16 nt, Haemophilus influenzae Rd
gauauaugauuauaaa

SEQ ID NO: 697461 - RNA, 15 nt, Haemophilus influenzae Rd
gauauagaaaucaua

SEQ ID NO: 697462 - RNA, 21 nt, Haemophilus influenzae Rd
gauauaguggcuuuaaagguu

SEQ ID NO: 697463 - RNA, 17 nt, Haemophilus influenzae Rd
gauauggauauuccagc

SEQ ID NO: 697464 - RNA, 23 nt, Haemophilus influenzae Rd
gaucauaaaaaaauguagagaua

SEQ ID NO: 697465 - RNA, 12 nt, Haemophilus influenzae Rd
gaucauaaauuu

SEQ ID NO: 697466 - RNA, 21 nt, Haemophilus influenzae Rd
gaucauagaaccgucuuuaaa

SEQ ID NO: 697467 - RNA, 21 nt, Haemophilus influenzae Rd
gaucacgcaaaggaacaauuu

SEQ ID NO: 697468 - RNA, 19 nt, Haemophilus influenzae Rd
gaucagcacgauaaccauc

SEQ ID NO: 697469 - RNA, 15 nt, Haemophilus influenzae Rd
gaucacuucugcaua

SEQ ID NO: 697470 - RNA, 15 nt, Haemophilus influenzae Rd
gauauuacuuauaag

SEQ ID NO: 697471 - RNA, 22 nt, Haemophilus influenzae Rd
gauauguuaauaagcccaacuu

SEQ ID NO: 697472 - RNA, 13 nt, Haemophilus influenzae Rd
gaucaccauaauc

SEQ ID NO: 697473 - RNA, 21 nt, Haemophilus influenzae Rd
gaucaccauaaucaaaauuac

SEQ ID NO: 697474 - RNA, 18 nt, Haemophilus influenzae Rd
gaucaagcacuuuuccuu

SEQ ID NO: 697475 - RNA, 20 nt, Haemophilus influenzae Rd
gauccaaagacuaaaaccac

SEQ ID NO: 697476 - RNA, 21 nt, Haemophilus influenzae Rd
gaucauuuggaucuaaaaaau

SEQ ID NO: 697477 - RNA, 23 nt, Haemophilus influenzae Rd
gaucauuuuuuuaaauauuuuua

SEQ ID NO: 697478 - RNA, 17 nt, Haemophilus influenzae Rd
gaucauuuuuaaccgca

SEQ ID NO: 697479 - RNA, 23 nt, Haemophilus influenzae Rd
gauccgcaauauagucaaauaac

SEQ ID NO: 697480 - RNA, 13 nt, Haemophilus influenzae Rd
gaucgcaauguuc

SEQ ID NO: 697481 - RNA, 13 nt, Haemophilus influenzae Rd
gaucgaguaaaaa

SEQ ID NO: 697482 - RNA, 13 nt, Haemophilus influenzae Rd
gaucgaaauuagg

SEQ ID NO: 697483 - RNA, 16 nt, Haemophilus influenzae Rd
aaagccccauuucuuu

SEQ ID NO: 697484 - RNA, 17 nt, Haemophilus influenzae Rd
gauccgugaacugaguu

SEQ ID NO: 697485 - RNA, 17 nt, Haemophilus influenzae Rd
gaucguauuuuuguccc

SEQ ID NO: 697486 - RNA, 21 nt, Haemophilus influenzae Rd
gaucggacuuuuuucuuaaau

SEQ ID NO: 697487 - RNA, 15 nt, Haemophilus influenzae Rd
gaucggcaaugguuc

SEQ ID NO: 697488 - RNA, 14 nt, Haemophilus influenzae Rd
gaucuauuccuaau

SEQ ID NO: 697489 - RNA, 18 nt, Haemophilus influenzae Rd
gaucuauauucguuaaau

SEQ ID NO: 697490 - RNA, 16 nt, Haemophilus influenzae Rd
gaucuaauuugccaag

SEQ ID NO: 697491 - RNA, 16 nt, Haemophilus influenzae Rd
gaucuaaaucauuuau

SEQ ID NO: 697492 - RNA, 23 nt, Haemophilus influenzae Rd
gaucugcacgauagcaaugccaa

SEQ ID NO: 697493 - RNA, 18 nt, Haemophilus influenzae Rd
gaucugaccccaaaaagu

SEQ ID NO: 697494 - RNA, 13 nt, Haemophilus influenzae Rd
gaucucuuucuau

SEQ ID NO: 697495 - RNA, 14 nt, Haemophilus influenzae Rd
gagcucuuucauua

SEQ ID NO: 697496 - RNA, 21 nt, Haemophilus influenzae Rd
gagcucuuucauuaaauuagu

SEQ ID NO: 697497 - RNA, 18 nt, Haemophilus influenzae Rd
gagcucgcacuuccucaa

SEQ ID NO: 697498 - RNA, 21 nt, Haemophilus influenzae Rd
gaggccucuacggcaauugga

SEQ ID NO: 697499 - RNA, 16 nt, Haemophilus influenzae Rd
gaggggauaaaauaaa

SEQ ID NO: 697500 - RNA, 16 nt, Haemophilus influenzae Rd
gaguaaucuaauucuu

SEQ ID NO: 697501 - RNA, 16 nt, Haemophilus influenzae Rd
gaguaccaaaauuuaa

SEQ ID NO: 697502 - RNA, 12 nt, Haemophilus influenzae Rd
gaguauguugcu

SEQ ID NO: 697503 - RNA, 14 nt, Haemophilus influenzae Rd
gagucaauuugacc

SEQ ID NO: 697504 - RNA, 21 nt, Haemophilus influenzae Rd
gagucgcacccgccuuaauca

SEQ ID NO: 697505 - RNA, 13 nt, Haemophilus influenzae Rd
gagugcaagccac

SEQ ID NO: 697506 - RNA, 13 nt, Haemophilus influenzae Rd
gagugagcauuuc

SEQ ID NO: 697507 - RNA, 14 nt, Haemophilus influenzae Rd
gagugagauaaaua

SEQ ID NO: 697508 - RNA, 17 nt, Haemophilus influenzae Rd
gagugguggaaucggua

SEQ ID NO: 697509 - RNA, 13 nt, Haemophilus influenzae Rd
gauaaccuucaau

SEQ ID NO: 697510 - RNA, 22 nt, Haemophilus influenzae Rd
gauaaccuaucaucugauacug

SEQ ID NO: 697511 - RNA, 19 nt, Haemophilus influenzae Rd
gauaacuaugccuucuuca

SEQ ID NO: 697512 - RNA, 14 nt, Haemophilus influenzae Rd
gauaacguaaguaa

SEQ ID NO: 697513 - RNA, 15 nt, Haemophilus influenzae Rd
gauaacguaaguaau

SEQ ID NO: 697514 - RNA, 18 nt, Haemophilus influenzae Rd
gauaaagauaacuaagau

SEQ ID NO: 697515 - RNA, 22 nt, Haemophilus influenzae Rd
gaguugucccgcauauaaaaua

SEQ ID NO: 697516 - RNA, 12 nt, Haemophilus influenzae Rd
gaguuuagucuu

SEQ ID NO: 697517 - RNA, 15 nt, Haemophilus influenzae Rd
gaguuggcucauugu

SEQ ID NO: 697518 - RNA, 18 nt, Haemophilus influenzae Rd
gaguuggcucauugugau

SEQ ID NO: 697519 - RNA, 13 nt, Haemophilus influenzae Rd
gauaaaagugcgg

SEQ ID NO: 697520 - RNA, 16 nt, Haemophilus influenzae Rd
gagcgauagaaauaaa

SEQ ID NO: 697521 - RNA, 13 nt, Haemophilus influenzae Rd
gagcgauguuuuc

SEQ ID NO: 697522 - RNA, 14 nt, Haemophilus influenzae Rd
gagcuaaaaaaucu

SEQ ID NO: 697523 - RNA, 22 nt, Haemophilus influenzae Rd
gagcgggaaacgaggcucgaac

SEQ ID NO: 697524 - RNA, 21 nt, Haemophilus influenzae Rd
gagcgguuaaaacaaaagaaa

SEQ ID NO: 697525 - RNA, 18 nt, Haemophilus influenzae Rd
gagaucgaaauuagguac

SEQ ID NO: 697526 - RNA, 15 nt, Haemophilus influenzae Rd
gagauuguaugaaaa

SEQ ID NO: 697527 - RNA, 16 nt, Haemophilus influenzae Rd
gagauuguaugaaaaa

SEQ ID NO: 697528 - RNA, 18 nt, Haemophilus influenzae Rd
gagauuguaugaaaaaug

SEQ ID NO: 697529 - RNA, 20 nt, Haemophilus influenzae Rd
gagauuuagcggcuuuuugc

SEQ ID NO: 697530 - RNA, 21 nt, Haemophilus influenzae Rd
gagauuuauuuugguauuuuu

SEQ ID NO: 697531 - RNA, 14 nt, Haemophilus influenzae Rd
gagauuuuuugacc

SEQ ID NO: 697532 - RNA, 13 nt, Haemophilus influenzae Rd
gagauuauuucua

SEQ ID NO: 697533 - RNA, 14 nt, Haemophilus influenzae Rd
gagauuauuucuac

SEQ ID NO: 697534 - RNA, 17 nt, Haemophilus influenzae Rd
gacuauuuuuuucucug

SEQ ID NO: 697535 - RNA, 15 nt, Haemophilus influenzae Rd
gacucaacgccacuc

SEQ ID NO: 697536 - RNA, 22 nt, Haemophilus influenzae Rd
gacucagguguuacuuccacua

SEQ ID NO: 697537 - RNA, 22 nt, Haemophilus influenzae Rd
gagcaggcacaacgguugaaau

SEQ ID NO: 697538 - RNA, 18 nt, Haemophilus influenzae Rd
aaagcacugaaauucauu

SEQ ID NO: 697539 - RNA, 14 nt, Haemophilus influenzae Rd
aaagcaccauaaug

SEQ ID NO: 697540 - RNA, 17 nt, Haemophilus influenzae Rd
gagccaaauuuaaaaaa

SEQ ID NO: 697541 - RNA, 20 nt, Haemophilus influenzae Rd
gagcauuuuuuauuaaaaaa

SEQ ID NO: 697542 - RNA, 11 nt, Haemophilus influenzae Rd
gagcaaaucaa

SEQ ID NO: 697543 - RNA, 13 nt, Haemophilus influenzae Rd
gagcaauauaauc

SEQ ID NO: 697544 - RNA, 17 nt, Haemophilus influenzae Rd
cuuucuacgacauuuuu

SEQ ID NO: 697545 - RNA, 19 nt, Haemophilus influenzae Rd
cuuucccgcaacuuuugca

SEQ ID NO: 697546 - RNA, 14 nt, Haemophilus influenzae Rd
cuuucauuucuucu

SEQ ID NO: 697547 - RNA, 21 nt, Haemophilus influenzae Rd
cuuucauucguauaaauauuu

SEQ ID NO: 697548 - RNA, 22 nt, Haemophilus influenzae Rd
cuuucauuccauucuaaaaaaa

SEQ ID NO: 697549 - RNA, 23 nt, Haemophilus influenzae Rd
cuuucaucguuugaacaaauuca

SEQ ID NO: 697550 - RNA, 16 nt, Haemophilus influenzae Rd
cuuuccauuugaaucu

SEQ ID NO: 697551 - RNA, 21 nt, Haemophilus influenzae Rd
cuuuccauuuuuuucuauuua

SEQ ID NO: 697552 - RNA, 23 nt, Haemophilus influenzae Rd
cuuuccauaccauuuaaaaguaa

SEQ ID NO: 697553 - RNA, 23 nt, Haemophilus influenzae Rd
cuuucuucgaugggccuucaacu

SEQ ID NO: 697554 - RNA, 15 nt, Haemophilus influenzae Rd
cuuucucaaauauuu

SEQ ID NO: 697555 - RNA, 20 nt, Haemophilus influenzae Rd
cuuucuauuugaauuaaaac

SEQ ID NO: 697556 - RNA, 14 nt, Haemophilus influenzae Rd
cuuucuauuaaaaa

SEQ ID NO: 697557 - RNA, 15 nt, Haemophilus influenzae Rd
cuuucuauuaaaaaa

SEQ ID NO: 697558 - RNA, 24 nt, Haemophilus influenzae Rd
cuuucuauuaaaaaaucaucaauu

SEQ ID NO: 697559 - RNA, 20 nt, Haemophilus influenzae Rd
cuuugaugauuccaaaguuu

SEQ ID NO: 697560 - RNA, 14 nt, Haemophilus influenzae Rd
cuuuguauuuugug

SEQ ID NO: 697561 - RNA, 23 nt, Haemophilus influenzae Rd
cuuuguauagaacgguuaugaaa

SEQ ID NO: 697562 - RNA, 17 nt, Haemophilus influenzae Rd
cuuuguaaguuggauuc

SEQ ID NO: 697563 - RNA, 22 nt, Haemophilus influenzae Rd
cuuuguaaguuggauucauuaa

SEQ ID NO: 697564 - RNA, 18 nt, Haemophilus influenzae Rd
cuuugugccauuucuaaa

SEQ ID NO: 697565 - RNA, 13 nt, Haemophilus influenzae Rd
cuuuguucauuuu

SEQ ID NO: 697566 - RNA, 21 nt, Haemophilus influenzae Rd
cuuuguugauuaucuaauuca

SEQ ID NO: 697567 - RNA, 18 nt, Haemophilus influenzae Rd
cuuuguuuuaaugauaaa

SEQ ID NO: 697568 - RNA, 14 nt, Haemophilus influenzae Rd
cuuuguuuuauagc

SEQ ID NO: 697569 - RNA, 21 nt, Haemophilus influenzae Rd
cuuuagcaucguagucuuuca

SEQ ID NO: 697570 - RNA, 17 nt, Haemophilus influenzae Rd
cuuuagcccaccaauua

SEQ ID NO: 697571 - RNA, 13 nt, Haemophilus influenzae Rd
cuuuagcaaucaa

SEQ ID NO: 697572 - RNA, 18 nt, Haemophilus influenzae Rd
cuuuagaaaguuuugcaa

SEQ ID NO: 697573 - RNA, 18 nt, Haemophilus influenzae Rd
cuuuagacaacaacuuuu

SEQ ID NO: 697574 - RNA, 20 nt, Haemophilus influenzae Rd
cuuuagacaacaacuuuucu

SEQ ID NO: 697575 - RNA, 21 nt, Haemophilus influenzae Rd
cuuuaggauuguugauuuugg

SEQ ID NO: 697576 - RNA, 14 nt, Haemophilus influenzae Rd
cuuuaucaagcaca

SEQ ID NO: 697577 - RNA, 13 nt, Haemophilus influenzae Rd
cuuuaucaaagaa

SEQ ID NO: 697578 - RNA, 15 nt, Haemophilus influenzae Rd
cuuuaucaucuuuug

SEQ ID NO: 697579 - RNA, 17 nt, Haemophilus influenzae Rd
cuuuauuaaacaaaaac

SEQ ID NO: 697580 - RNA, 18 nt, Haemophilus influenzae Rd
cuuuauuaaacaaaaacc

SEQ ID NO: 697581 - RNA, 19 nt, Haemophilus influenzae Rd
cuuuauuuaaauuaaaaag

SEQ ID NO: 697582 - RNA, 15 nt, Haemophilus influenzae Rd
cuuuauucuuuagug

SEQ ID NO: 697583 - RNA, 22 nt, Haemophilus influenzae Rd
cuuuauuuacccaagccaauua

SEQ ID NO: 697584 - RNA, 18 nt, Haemophilus influenzae Rd
cuuucaacuguucuucug

SEQ ID NO: 697585 - RNA, 10 nt, Haemophilus influenzae Rd
cuuucaauuu

SEQ ID NO: 697586 - RNA, 19 nt, Haemophilus influenzae Rd
cuuucacaacuggacgcuc

SEQ ID NO: 697587 - RNA, 12 nt, Haemophilus influenzae Rd
cuuucaccauua

SEQ ID NO: 697588 - RNA, 15 nt, Haemophilus influenzae Rd
cuuucauaaagauaa

SEQ ID NO: 697589 - RNA, 17 nt, Haemophilus influenzae Rd
cuuucauaaauucaucu

SEQ ID NO: 697590 - RNA, 14 nt, Haemophilus influenzae Rd
cuuucauauaaaua

SEQ ID NO: 697591 - RNA, 22 nt, Haemophilus influenzae Rd
aaagacccaccgcaaaagccaa

SEQ ID NO: 697592 - RNA, 20 nt, Haemophilus influenzae Rd
aaagaccaugccuguucuaa

SEQ ID NO: 697593 - RNA, 15 nt, Haemophilus influenzae Rd
cuucggauuuuucaa

SEQ ID NO: 697594 - RNA, 16 nt, Haemophilus influenzae Rd
cuucgcuaauuuuuuu

SEQ ID NO: 697595 - RNA, 20 nt, Haemophilus influenzae Rd
cuucgcuaauuuuuuuccaa

SEQ ID NO: 697596 - RNA, 19 nt, Haemophilus influenzae Rd
cuucgcuccaaucaucauc

SEQ ID NO: 697597 - RNA, 22 nt, Haemophilus influenzae Rd
cuucgcuccaaucaucauccca

SEQ ID NO: 697598 - RNA, 14 nt, Haemophilus influenzae Rd
cuuuaacaggaauu

SEQ ID NO: 697599 - RNA, 20 nt, Haemophilus influenzae Rd
cuuuaaauuguuuaaugaaa

SEQ ID NO: 697600 - RNA, 16 nt, Haemophilus influenzae Rd
cuuuaaauucaauaaa

SEQ ID NO: 697601 - RNA, 12 nt, Haemophilus influenzae Rd
cuuuaaauuuuc

SEQ ID NO: 697602 - RNA, 17 nt, Haemophilus influenzae Rd
cuuuaaauuuuccuguu

SEQ ID NO: 697603 - RNA, 19 nt, Haemophilus influenzae Rd
cuuuaacaauuacugcaaa

SEQ ID NO: 697604 - RNA, 14 nt, Haemophilus influenzae Rd
cuuuaaucugucac

SEQ ID NO: 697605 - RNA, 18 nt, Haemophilus influenzae Rd
cuuuaauacguuguuguu

SEQ ID NO: 697606 - RNA, 17 nt, Haemophilus influenzae Rd
cuuuaauaguaaacuuu

SEQ ID NO: 697607 - RNA, 21 nt, Haemophilus influenzae Rd
cuuuaauaguaaacuuuuaaa

SEQ ID NO: 697608 - RNA, 20 nt, Haemophilus influenzae Rd
cuuuaccauugcguucacuc

SEQ ID NO: 697609 - RNA, 19 nt, Haemophilus influenzae Rd
cuuuacccacacaaacuaa

SEQ ID NO: 697610 - RNA, 19 nt, Haemophilus influenzae Rd
cuuuaccgcaaucuucaca

SEQ ID NO: 697611 - RNA, 22 nt, Haemophilus influenzae Rd
cuuuaccgaucgcuuucauuuc

SEQ ID NO: 697612 - RNA, 21 nt, Haemophilus influenzae Rd
cuuuaccgucagccaaauuuu

SEQ ID NO: 697613 - RNA, 20 nt, Haemophilus influenzae Rd
aaagacguuugauuguaaaa

SEQ ID NO: 697614 - RNA, 19 nt, Haemophilus influenzae Rd
aaagacuaaaaccacauca

SEQ ID NO: 697615 - RNA, 16 nt, Haemophilus influenzae Rd
aaagacugcuacuuuu

SEQ ID NO: 697616 - RNA, 15 nt, Haemophilus influenzae Rd
cuuuucuucuaauuc

SEQ ID NO: 697617 - RNA, 19 nt, Haemophilus influenzae Rd
cuuuucuuguaaugcugua

SEQ ID NO: 697618 - RNA, 13 nt, Haemophilus influenzae Rd
cuuuugcuucaau

SEQ ID NO: 697619 - RNA, 15 nt, Haemophilus influenzae Rd
cuuuugcuucaauuu

SEQ ID NO: 697620 - RNA, 17 nt, Haemophilus influenzae Rd
cuuuugccuaaaaccug

SEQ ID NO: 697621 - RNA, 17 nt, Haemophilus influenzae Rd
cuuuugccauauuuaau

SEQ ID NO: 697622 - RNA, 22 nt, Haemophilus influenzae Rd
cuuuugcccacgcacuuuucca

SEQ ID NO: 697623 - RNA, 23 nt, Haemophilus influenzae Rd
cuuuugcccacgcacuuuuccaa

SEQ ID NO: 697624 - RNA, 22 nt, Haemophilus influenzae Rd
cuuuugaaagauuuucuacaac

SEQ ID NO: 697625 - RNA, 16 nt, Haemophilus influenzae Rd
cuuuugcacugcaaug

SEQ ID NO: 697626 - RNA, 20 nt, Haemophilus influenzae Rd
cuuuucgcaauucuuuuucu

SEQ ID NO: 697627 - RNA, 17 nt, Haemophilus influenzae Rd
cuuuucucaaaacaucu

SEQ ID NO: 697628 - RNA, 21 nt, Haemophilus influenzae Rd
cuuuucuauaauuaaacauuu

SEQ ID NO: 697629 - RNA, 14 nt, Haemophilus influenzae Rd
cuuuucugauaauu

SEQ ID NO: 697630 - RNA, 20 nt, Haemophilus influenzae Rd
cuuuucuuaugaaccuaaac

SEQ ID NO: 697631 - RNA, 15 nt, Haemophilus influenzae Rd
cuuuucuuagauaaa

SEQ ID NO: 697632 - RNA, 20 nt, Haemophilus influenzae Rd
aaagaccgcacuuuaaaagu

SEQ ID NO: 697633 - RNA, 14 nt, Haemophilus influenzae Rd
aaagacgaagaaac

SEQ ID NO: 697634 - RNA, 20 nt, Haemophilus influenzae Rd
aaagacggcgcguucuucug

SEQ ID NO: 697635 - RNA, 15 nt, Haemophilus influenzae Rd
cuuuuaucuauaaaa

SEQ ID NO: 697636 - RNA, 16 nt, Haemophilus influenzae Rd
cuuuuaucuauaaaaa

SEQ ID NO: 697637 - RNA, 21 nt, Haemophilus influenzae Rd
cuuuuaucucggcuaaaaucu

SEQ ID NO: 697638 - RNA, 20 nt, Haemophilus influenzae Rd
cuuuuagaauaaauuaaaaa

SEQ ID NO: 697639 - RNA, 13 nt, Haemophilus influenzae Rd
cuuuuauuauuua

SEQ ID NO: 697640 - RNA, 12 nt, Haemophilus influenzae Rd
cuuuuauuguuc

SEQ ID NO: 697641 - RNA, 15 nt, Haemophilus influenzae Rd
cuuuuaccaauugau

SEQ ID NO: 697642 - RNA, 19 nt, Haemophilus influenzae Rd
cuuuuacgcguuuuucugg

SEQ ID NO: 697643 - RNA, 18 nt, Haemophilus influenzae Rd
cuuuuaacacuuuuucac

SEQ ID NO: 697644 - RNA, 14 nt, Haemophilus influenzae Rd
cuuuuaacauuaca

SEQ ID NO: 697645 - RNA, 13 nt, Haemophilus influenzae Rd
cuuuuacaucaau

SEQ ID NO: 697646 - RNA, 20 nt, Haemophilus influenzae Rd
cuuuuaaaagaccacauucu

SEQ ID NO: 697647 - RNA, 17 nt, Haemophilus influenzae Rd
cuuuuaacaaauacauc

SEQ ID NO: 697648 - RNA, 18 nt, Haemophilus influenzae Rd
cuuuuaaacguuuauuua

SEQ ID NO: 697649 - RNA, 13 nt, Haemophilus influenzae Rd
cuuuucaacaaaa

SEQ ID NO: 697650 - RNA, 15 nt, Haemophilus influenzae Rd
cuuuucaacaaaaaa

SEQ ID NO: 697651 - RNA, 19 nt, Haemophilus influenzae Rd
cuuuucaacacuuuauuac

SEQ ID NO: 697652 - RNA, 14 nt, Haemophilus influenzae Rd
cuuuucaaacaaca

SEQ ID NO: 697653 - RNA, 16 nt, Haemophilus influenzae Rd
cuuuucaaacaacaag

SEQ ID NO: 697654 - RNA, 12 nt, Haemophilus influenzae Rd
cuuuucaucuuc

SEQ ID NO: 697655 - RNA, 19 nt, Haemophilus influenzae Rd
cuuuucaucuuccgugaca

SEQ ID NO: 697656 - RNA, 17 nt, Haemophilus influenzae Rd
cuuuucccucuuuuuca

SEQ ID NO: 697657 - RNA, 14 nt, Haemophilus influenzae Rd
cuuuucgaauuaaa

SEQ ID NO: 697658 - RNA, 22 nt, Haemophilus influenzae Rd
cuuuucgaauuaaacgugauuu

SEQ ID NO: 697659 - RNA, 16 nt, Haemophilus influenzae Rd
cuuuuccuaaaguuuu

SEQ ID NO: 697660 - RNA, 18 nt, Haemophilus influenzae Rd
cuuuuccuaaaguuuuug

SEQ ID NO: 697661 - RNA, 20 nt, Haemophilus influenzae Rd
cuuuuucuuacggauuuuug

SEQ ID NO: 697662 - RNA, 20 nt, Haemophilus influenzae Rd
cuuuuucugcgcgcaaucca

SEQ ID NO: 697663 - RNA, 11 nt, Haemophilus influenzae Rd
cuuuuuccuuu

SEQ ID NO: 697664 - RNA, 12 nt, Haemophilus influenzae Rd
cuuuuguuuuaa

SEQ ID NO: 697665 - RNA, 21 nt, Haemophilus influenzae Rd
cuuuuguugcacccauuuuga

SEQ ID NO: 697666 - RNA, 22 nt, Haemophilus influenzae Rd
cuuuuguugcacccauuuugau

SEQ ID NO: 697667 - RNA, 12 nt, Haemophilus influenzae Rd
cuuuuuuaagua

SEQ ID NO: 697668 - RNA, 18 nt, Haemophilus influenzae Rd
cuuuuuuaaguaguguuu

SEQ ID NO: 697669 - RNA, 19 nt, Haemophilus influenzae Rd
cuuuuucuucuuucauuug

SEQ ID NO: 697670 - RNA, 20 nt, Haemophilus influenzae Rd
cuuuuucuuggaacaucauu

SEQ ID NO: 697671 - RNA, 18 nt, Haemophilus influenzae Rd
cuuuuuguuacaucuuca

SEQ ID NO: 697672 - RNA, 14 nt, Haemophilus influenzae Rd
gaaaaauaaaaaau

SEQ ID NO: 697673 - RNA, 19 nt, Haemophilus influenzae Rd
gaaaaaguuagacuaugaa

SEQ ID NO: 697674 - RNA, 12 nt, Haemophilus influenzae Rd
gaaaaaacaaga

SEQ ID NO: 697675 - RNA, 21 nt, Haemophilus influenzae Rd
gaaaaaaagugcgguugaaau

SEQ ID NO: 697676 - RNA, 18 nt, Haemophilus influenzae Rd
cuuuuuuaaugggauuuu

SEQ ID NO: 697677 - RNA, 23 nt, Haemophilus influenzae Rd
cuuuuuuuuuugcucaaaaucaa

SEQ ID NO: 697678 - RNA, 11 nt, Haemophilus influenzae Rd
gaaaagaaaac

SEQ ID NO: 697679 - RNA, 13 nt, Haemophilus influenzae Rd
gaaaagaaaacuu

SEQ ID NO: 697680 - RNA, 14 nt, Haemophilus influenzae Rd
gaaaagaaaacuua

SEQ ID NO: 697681 - RNA, 19 nt, Haemophilus influenzae Rd
gaaaagaaaguauuaaaua

SEQ ID NO: 697682 - RNA, 14 nt, Haemophilus influenzae Rd
gaaaacuuggaauu

SEQ ID NO: 697683 - RNA, 10 nt, Haemophilus influenzae Rd
gaaaauaaua

SEQ ID NO: 697684 - RNA, 19 nt, Haemophilus influenzae Rd
gaaaauagaagccaaauca

SEQ ID NO: 697685 - RNA, 22 nt, Haemophilus influenzae Rd
gaaaaucaccgcacuuuuauug

SEQ ID NO: 697686 - RNA, 17 nt, Haemophilus influenzae Rd
gaaaauacguacauugu

SEQ ID NO: 697687 - RNA, 19 nt, Haemophilus influenzae Rd
gaaaacagcggucaaaaua

SEQ ID NO: 697688 - RNA, 15 nt, Haemophilus influenzae Rd
gaaaaccaaaacaua

SEQ ID NO: 697689 - RNA, 17 nt, Haemophilus influenzae Rd
gaaaacguagguaguuu

SEQ ID NO: 697690 - RNA, 21 nt, Haemophilus influenzae Rd
gaaaacguagguaguuuucaa

SEQ ID NO: 697691 - RNA, 20 nt, Haemophilus influenzae Rd
gaaaacgaugaaguuuucau

SEQ ID NO: 697692 - RNA, 16 nt, Haemophilus influenzae Rd
gaaaaccgcagcuaau

SEQ ID NO: 697693 - RNA, 22 nt, Haemophilus influenzae Rd
gaaaacauaauccgcaucuaaa

SEQ ID NO: 697694 - RNA, 17 nt, Haemophilus influenzae Rd
gaaaucacaauaaaagc

SEQ ID NO: 697695 - RNA, 18 nt, Haemophilus influenzae Rd
gaaauauuuuaauagaau

SEQ ID NO: 697696 - RNA, 12 nt, Haemophilus influenzae Rd
gaaauauuucac

SEQ ID NO: 697697 - RNA, 14 nt, Haemophilus influenzae Rd
gaaauauucuugga

SEQ ID NO: 697698 - RNA, 13 nt, Haemophilus influenzae Rd
gaaaucaaacaac

SEQ ID NO: 697699 - RNA, 15 nt, Haemophilus influenzae Rd
gaaaucaaaaaugcu

SEQ ID NO: 697700 - RNA, 20 nt, Haemophilus influenzae Rd
gaaaucaaaaaugcuuuugc

SEQ ID NO: 697701 - RNA, 22 nt, Haemophilus influenzae Rd
gaaauagacuacuuaaaauuca

SEQ ID NO: 697702 - RNA, 18 nt, Haemophilus influenzae Rd
gaaauacgagaaagcuca

SEQ ID NO: 697703 - RNA, 16 nt, Haemophilus influenzae Rd
gaaauaccuucuugau

SEQ ID NO: 697704 - RNA, 22 nt, Haemophilus influenzae Rd
gaaaguauuaaauauaaugaaa

SEQ ID NO: 697705 - RNA, 19 nt, Haemophilus influenzae Rd
gaaaguauuuucuuuccaa

SEQ ID NO: 697706 - RNA, 21 nt, Haemophilus influenzae Rd
gaaauaagauuuuugauaaaa

SEQ ID NO: 697707 - RNA, 12 nt, Haemophilus influenzae Rd
gaaauaaaucua

SEQ ID NO: 697708 - RNA, 18 nt, Haemophilus influenzae Rd
gaaaguaacaauguagaa

SEQ ID NO: 697709 - RNA, 22 nt, Haemophilus influenzae Rd
gaaagcuauuucggcaguacuc

SEQ ID NO: 697710 - RNA, 17 nt, Haemophilus influenzae Rd
gaaagcaugaauaaaaa

SEQ ID NO: 697711 - RNA, 18 nt, Haemophilus influenzae Rd
gaaagcaugaauaaaaau

SEQ ID NO: 697712 - RNA, 19 nt, Haemophilus influenzae Rd
gaaagcaugaauaaaaaug

SEQ ID NO: 697713 - RNA, 20 nt, Haemophilus influenzae Rd
gaaagcaugaauaaaaaugg

SEQ ID NO: 697714 - RNA, 15 nt, Haemophilus influenzae Rd
gaaagauuacauucu

SEQ ID NO: 697715 - RNA, 15 nt, Haemophilus influenzae Rd
gaaacugaaccagcc

SEQ ID NO: 697716 - RNA, 22 nt, Haemophilus influenzae Rd
gaaacugguuuaucacuaauau

SEQ ID NO: 697717 - RNA, 14 nt, Haemophilus influenzae Rd
gaaacuguuuuggc

SEQ ID NO: 697718 - RNA, 21 nt, Haemophilus influenzae Rd
gaaaaucguauucucauuuua

SEQ ID NO: 697719 - RNA, 18 nt, Haemophilus influenzae Rd
gaaaaucgaucuaaucuu

SEQ ID NO: 697720 - RNA, 15 nt, Haemophilus influenzae Rd
gaaaaucaucauauu

SEQ ID NO: 697721 - RNA, 17 nt, Haemophilus influenzae Rd
gaaaaucaucauauuca

SEQ ID NO: 697722 - RNA, 19 nt, Haemophilus influenzae Rd
gaaaaugguuacguuuuuc

SEQ ID NO: 697723 - RNA, 16 nt, Haemophilus influenzae Rd
gaaacuacuuucuauu

SEQ ID NO: 697724 - RNA, 13 nt, Haemophilus influenzae Rd
gaaacucaccauu

SEQ ID NO: 697725 - RNA, 17 nt, Haemophilus influenzae Rd
gaaauuaauaagaaaga

SEQ ID NO: 697726 - RNA, 19 nt, Haemophilus influenzae Rd
gaaauuaauaagaaagaau

SEQ ID NO: 697727 - RNA, 12 nt, Haemophilus influenzae Rd
gaaauuaauaau

SEQ ID NO: 697728 - RNA, 23 nt, Haemophilus influenzae Rd
gaaaugaucaaaucaaauuuucc

SEQ ID NO: 697729 - RNA, 13 nt, Haemophilus influenzae Rd
aaagagacucugu

SEQ ID NO: 697730 - RNA, 14 nt, Haemophilus influenzae Rd
aaagagaaacauug

SEQ ID NO: 697731 - RNA, 19 nt, Haemophilus influenzae Rd
gaaaucuuggcucauuuua

SEQ ID NO: 697732 - RNA, 17 nt, Haemophilus influenzae Rd
gaaauuauugcuuauga

SEQ ID NO: 697733 - RNA, 14 nt, Haemophilus influenzae Rd
aaagagauuauuuc

SEQ ID NO: 697734 - RNA, 16 nt, Haemophilus influenzae Rd
gaaauuccuugccaaa

SEQ ID NO: 697735 - RNA, 16 nt, Haemophilus influenzae Rd
gaaauucuaaaaaaau

SEQ ID NO: 697736 - RNA, 18 nt, Haemophilus influenzae Rd
gaaauucuucaauaacaa

SEQ ID NO: 697737 - RNA, 21 nt, Haemophilus influenzae Rd
gaaauuuuuaucuaaauuaau

SEQ ID NO: 697738 - RNA, 15 nt, Haemophilus influenzae Rd
gaaauugauauaaau

SEQ ID NO: 697739 - RNA, 22 nt, Haemophilus influenzae Rd
gaaauucuaccugcuguaacgu

SEQ ID NO: 697740 - RNA, 20 nt, Haemophilus influenzae Rd
gaacacucuaucuaaaauau

SEQ ID NO: 697741 - RNA, 14 nt, Haemophilus influenzae Rd
gaacauaacuuuuu

SEQ ID NO: 697742 - RNA, 19 nt, Haemophilus influenzae Rd
gaacaaugucagaaaagau

SEQ ID NO: 697743 - RNA, 19 nt, Haemophilus influenzae Rd
gaacaauuaauacgucaau

SEQ ID NO: 697744 - RNA, 23 nt, Haemophilus influenzae Rd
gaaauuuuuuugcuggaaaaaug

SEQ ID NO: 697745 - RNA, 19 nt, Haemophilus influenzae Rd
gaaauuuuuccguuuucua

SEQ ID NO: 697746 - RNA, 17 nt, Haemophilus influenzae Rd
gaacaaggggaaaauau

SEQ ID NO: 697747 - RNA, 13 nt, Haemophilus influenzae Rd
gaacaaacgccau

SEQ ID NO: 697748 - RNA, 21 nt, Haemophilus influenzae Rd
gaacaaaauaauuauggugaa

SEQ ID NO: 697749 - RNA, 16 nt, Haemophilus influenzae Rd
gaacgcuggcggcagg

SEQ ID NO: 697750 - RNA, 18 nt, Haemophilus influenzae Rd
gaacgccuaaacacauaa

SEQ ID NO: 697751 - RNA, 16 nt, Haemophilus influenzae Rd
gaacgaguaaucuaau

SEQ ID NO: 697752 - RNA, 16 nt, Haemophilus influenzae Rd
gaacggucaaaaugca

SEQ ID NO: 697753 - RNA, 21 nt, Haemophilus influenzae Rd
gaacggucaaaaugcaguagg

SEQ ID NO: 697754 - RNA, 19 nt, Haemophilus influenzae Rd
gaacugauucaguguaguu

SEQ ID NO: 697755 - RNA, 15 nt, Haemophilus influenzae Rd
gaacugcuugcgcuu

SEQ ID NO: 697756 - RNA, 15 nt, Haemophilus influenzae Rd
gaacugcuuucuucc

SEQ ID NO: 697757 - RNA, 19 nt, Haemophilus influenzae Rd
gaacuggaccuaaucccau

SEQ ID NO: 697758 - RNA, 20 nt, Haemophilus influenzae Rd
gaacuggcugagagaagaaa

SEQ ID NO: 697759 - RNA, 22 nt, Haemophilus influenzae Rd
gaacuaauaagcuuggcuuauu

SEQ ID NO: 697760 - RNA, 19 nt, Haemophilus influenzae Rd
gaacuauauccaaaucaaa

SEQ ID NO: 697761 - RNA, 21 nt, Haemophilus influenzae Rd
gaacucaauuccuucaucguc

SEQ ID NO: 697762 - RNA, 19 nt, Haemophilus influenzae Rd
gaaccuaucucauccacua

SEQ ID NO: 697763 - RNA, 22 nt, Haemophilus influenzae Rd
gaaccgccacccgcuuuugcau

SEQ ID NO: 697764 - RNA, 13 nt, Haemophilus influenzae Rd
gaaccgauuuuaa

SEQ ID NO: 697765 - RNA, 23 nt, Haemophilus influenzae Rd
gaacaucaccuguaaacaaauau

SEQ ID NO: 697766 - RNA, 17 nt, Haemophilus influenzae Rd
gaacaucauuuucaagu

SEQ ID NO: 697767 - RNA, 18 nt, Haemophilus influenzae Rd
gaacaucauuuucaagua

SEQ ID NO: 697768 - RNA, 21 nt, Haemophilus influenzae Rd
gaacauuaugugcaauuugac

SEQ ID NO: 697769 - RNA, 22 nt, Haemophilus influenzae Rd
gaacauugugacauuggauuaa

SEQ ID NO: 697770 - RNA, 18 nt, Haemophilus influenzae Rd
gaaccaaaucuaacauuu

SEQ ID NO: 697771 - RNA, 23 nt, Haemophilus influenzae Rd
gaaccaaaucuaacauuuccugu

SEQ ID NO: 697772 - RNA, 20 nt, Haemophilus influenzae Rd
gaacauuuucugcucuucau

SEQ ID NO: 697773 - RNA, 21 nt, Haemophilus influenzae Rd
gaccaucgggcuguaaaaaau

SEQ ID NO: 697774 - RNA, 17 nt, Haemophilus influenzae Rd
gaccauuggugaaagga

SEQ ID NO: 697775 - RNA, 17 nt, Haemophilus influenzae Rd
gaccauuacagcaagca

SEQ ID NO: 697776 - RNA, 16 nt, Haemophilus influenzae Rd
gaccaucuaaaccugu

SEQ ID NO: 697777 - RNA, 21 nt, Haemophilus influenzae Rd
gaccgcccucuugcacaauuu

SEQ ID NO: 697778 - RNA, 19 nt, Haemophilus influenzae Rd
gacauuuuacuacguaaag

SEQ ID NO: 697779 - RNA, 20 nt, Haemophilus influenzae Rd
gaccacaugaauuucuaauu

SEQ ID NO: 697780 - RNA, 16 nt, Haemophilus influenzae Rd
gaccaccagaaaguuu

SEQ ID NO: 697781 - RNA, 18 nt, Haemophilus influenzae Rd
gaccaauugguaaaauuu

SEQ ID NO: 697782 - RNA, 18 nt, Haemophilus influenzae Rd
gaccaauauugaaaagua

SEQ ID NO: 697783 - RNA, 12 nt, Haemophilus influenzae Rd
gaccaaugaaua

SEQ ID NO: 697784 - RNA, 23 nt, Haemophilus influenzae Rd
gacaguauuuagcggaauuuuug

SEQ ID NO: 697785 - RNA, 21 nt, Haemophilus influenzae Rd
gacagacgcugcccaaauaac

SEQ ID NO: 697786 - RNA, 12 nt, Haemophilus influenzae Rd
gacaggcauauu

SEQ ID NO: 697787 - RNA, 20 nt, Haemophilus influenzae Rd
gacgauagcggcgaaugugg

SEQ ID NO: 697788 - RNA, 20 nt, Haemophilus influenzae Rd
gacgccaaauaugaacuugu

SEQ ID NO: 697789 - RNA, 21 nt, Haemophilus influenzae Rd
gaccugcagccauaauauuua

SEQ ID NO: 697790 - RNA, 14 nt, Haemophilus influenzae Rd
gaccuugcaaauuu

SEQ ID NO: 697791 - RNA, 13 nt, Haemophilus influenzae Rd
gaccuugaaguuu

SEQ ID NO: 697792 - RNA, 23 nt, Haemophilus influenzae Rd
gacguguaaaucuaaaauaaucg

SEQ ID NO: 697793 - RNA, 14 nt, Haemophilus influenzae Rd
gacuaaauuagaau

SEQ ID NO: 697794 - RNA, 12 nt, Haemophilus influenzae Rd
gacuaaauaaau

SEQ ID NO: 697795 - RNA, 11 nt, Haemophilus influenzae Rd
gacuaaaacca

SEQ ID NO: 697796 - RNA, 13 nt, Haemophilus influenzae Rd
gacuaaaaccaca

SEQ ID NO: 697797 - RNA, 14 nt, Haemophilus influenzae Rd
gacuaaacaaauaa

SEQ ID NO: 697798 - RNA, 15 nt, Haemophilus influenzae Rd
gacuaaacaaauaaa

SEQ ID NO: 697799 - RNA, 17 nt, Haemophilus influenzae Rd
gacuauuacaagauaau

SEQ ID NO: 697800 - RNA, 18 nt, Haemophilus influenzae Rd
gacuauuucuguauuuuu

SEQ ID NO: 697801 - RNA, 19 nt, Haemophilus influenzae Rd
gacuauuaaguucaaauuu

SEQ ID NO: 697802 - RNA, 16 nt, Haemophilus influenzae Rd
gacuagauauaaaaac

SEQ ID NO: 697803 - RNA, 18 nt, Haemophilus influenzae Rd
gacuagcaucaaaauaaa

SEQ ID NO: 697804 - RNA, 14 nt, Haemophilus influenzae Rd
gacuacaaacaaau

SEQ ID NO: 697805 - RNA, 18 nt, Haemophilus influenzae Rd
gacuacaaacaaauuuuu

SEQ ID NO: 697806 - RNA, 15 nt, Haemophilus influenzae Rd
gacuaauucguuucu

SEQ ID NO: 697807 - RNA, 19 nt, Haemophilus influenzae Rd
gaagaaaaagacgaaaaug

SEQ ID NO: 697808 - RNA, 18 nt, Haemophilus influenzae Rd
gaagaaaauauccaagaa

SEQ ID NO: 697809 - RNA, 19 nt, Haemophilus influenzae Rd
gaagaaacaaccagcgcac

SEQ ID NO: 697810 - RNA, 19 nt, Haemophilus influenzae Rd
gaacuugcgcgcugguuuc

SEQ ID NO: 697811 - RNA, 18 nt, Haemophilus influenzae Rd
gaacuuuuaaaacacgcc

SEQ ID NO: 697812 - RNA, 22 nt, Haemophilus influenzae Rd
gaacuuagucucuuuauuuuuu

SEQ ID NO: 697813 - RNA, 14 nt, Haemophilus influenzae Rd
gaagaaauuaagaa

SEQ ID NO: 697814 - RNA, 15 nt, Haemophilus influenzae Rd
gaacuuuuuuauaau

SEQ ID NO: 697815 - RNA, 15 nt, Haemophilus influenzae Rd
gaagaacaaggggaa

SEQ ID NO: 697816 - RNA, 13 nt, Haemophilus influenzae Rd
gaagaacguaaau

SEQ ID NO: 697817 - RNA, 23 nt, Haemophilus influenzae Rd
aaagauaaaacagagaaaaaaau

SEQ ID NO: 697818 - RNA, 21 nt, Haemophilus influenzae Rd
aaagaguaccacuuucaacug

SEQ ID NO: 697819 - RNA, 16 nt, Haemophilus influenzae Rd
aaagaguaagcaagua

SEQ ID NO: 697820 - RNA, 14 nt, Haemophilus influenzae Rd
gaagcguaaaagua

SEQ ID NO: 697821 - RNA, 18 nt, Haemophilus influenzae Rd
gaagcaacaaucacugua

SEQ ID NO: 697822 - RNA, 12 nt, Haemophilus influenzae Rd
gaagcagcuggc

SEQ ID NO: 697823 - RNA, 20 nt, Haemophilus influenzae Rd
gaagccaucuguaaaccuuu

SEQ ID NO: 697824 - RNA, 14 nt, Haemophilus influenzae Rd
gaagccauuuuaug

SEQ ID NO: 697825 - RNA, 13 nt, Haemophilus influenzae Rd
gaagcacugaaau

SEQ ID NO: 697826 - RNA, 21 nt, Haemophilus influenzae Rd
gaagcacuggugugacuaauc

SEQ ID NO: 697827 - RNA, 21 nt, Haemophilus influenzae Rd
gaaggaacaagaccugcuucu

SEQ ID NO: 697828 - RNA, 14 nt, Haemophilus influenzae Rd
gaagcguucaaaaa

SEQ ID NO: 697829 - RNA, 18 nt, Haemophilus influenzae Rd
gaaguagcaacaccacca

SEQ ID NO: 697830 - RNA, 17 nt, Haemophilus influenzae Rd
gaaguaauaaucuucuu

SEQ ID NO: 697831 - RNA, 13 nt, Haemophilus influenzae Rd
gaaguaaaaaaau

SEQ ID NO: 697832 - RNA, 19 nt, Haemophilus influenzae Rd
gaaguaaaaagaaaagugc

SEQ ID NO: 697833 - RNA, 12 nt, Haemophilus influenzae Rd
gaauaaaaaaaa

SEQ ID NO: 697834 - RNA, 16 nt, Haemophilus influenzae Rd
gaauaaaaaaaagccc

SEQ ID NO: 697835 - RNA, 12 nt, Haemophilus influenzae Rd
gaaguuuugcua

SEQ ID NO: 697836 - RNA, 12 nt, Haemophilus influenzae Rd
gaaguuuuccau

SEQ ID NO: 697837 - RNA, 21 nt, Haemophilus influenzae Rd
aaagaucaggaucaaaaauau

SEQ ID NO: 697838 - RNA, 14 nt, Haemophilus influenzae Rd
aaagaucauucaca

SEQ ID NO: 697839 - RNA, 13 nt, Haemophilus influenzae Rd
aaagauccaaaga

SEQ ID NO: 697840 - RNA, 23 nt, Haemophilus influenzae Rd
aaagaucaauggguuuaaaaagu

SEQ ID NO: 697841 - RNA, 18 nt, Haemophilus influenzae Rd
gaauaauauuaaagaaaa

SEQ ID NO: 697842 - RNA, 21 nt, Haemophilus influenzae Rd
gaauacauccauaacuaaaag

SEQ ID NO: 697843 - RNA, 23 nt, Haemophilus influenzae Rd
gaauacauccauaacuaaaagga

SEQ ID NO: 697844 - RNA, 17 nt, Haemophilus influenzae Rd
gaauaagcgaaaaacau

SEQ ID NO: 697845 - RNA, 14 nt, Haemophilus influenzae Rd
gaauaaaauaagag

SEQ ID NO: 697846 - RNA, 21 nt, Haemophilus influenzae Rd
gaauaaaagauuuugcagaua

SEQ ID NO: 697847 - RNA, 21 nt, Haemophilus influenzae Rd
gaauaaaacggcucaaaucuu

SEQ ID NO: 697848 - RNA, 17 nt, Haemophilus influenzae Rd
gaauaaaccaaugagaa

SEQ ID NO: 697849 - RNA, 23 nt, Haemophilus influenzae Rd
gaauaaaccaaugagaaaaaguc

SEQ ID NO: 697850 - RNA, 21 nt, Haemophilus influenzae Rd
gaauaaacgccacucuuugaa

SEQ ID NO: 697851 - RNA, 17 nt, Haemophilus influenzae Rd
gaauagcucaguuggua

SEQ ID NO: 697852 - RNA, 12 nt, Haemophilus influenzae Rd
aaagauuaaaau

SEQ ID NO: 697853 - RNA, 22 nt, Haemophilus influenzae Rd
gaauaccugauuucgcagcugg

SEQ ID NO: 697854 - RNA, 14 nt, Haemophilus influenzae Rd
gaauauuuugcaug

SEQ ID NO: 697855 - RNA, 14 nt, Haemophilus influenzae Rd
gaauauuuccacug

SEQ ID NO: 697856 - RNA, 16 nt, Haemophilus influenzae Rd
aaagauuuauguugaa

SEQ ID NO: 697857 - RNA, 22 nt, Haemophilus influenzae Rd
aaagauucgcuuuuuuuuuugc

SEQ ID NO: 697858 - RNA, 19 nt, Haemophilus influenzae Rd
gaaucaauuuuuucuccac

SEQ ID NO: 697859 - RNA, 18 nt, Haemophilus influenzae Rd
gaaucacaacuugaccau

SEQ ID NO: 697860 - RNA, 16 nt, Haemophilus influenzae Rd
gaaucaaggcuggaau

SEQ ID NO: 697861 - RNA, 13 nt, Haemophilus influenzae Rd
gaaucauuuucac

SEQ ID NO: 697862 - RNA, 19 nt, Haemophilus influenzae Rd
gaaugaaguuagaaacaga

SEQ ID NO: 697863 - RNA, 22 nt, Haemophilus influenzae Rd
gaaucgcccacgaaaagcacuu

SEQ ID NO: 697864 - RNA, 21 nt, Haemophilus influenzae Rd
gaaugcccacuaacucacauu

SEQ ID NO: 697865 - RNA, 14 nt, Haemophilus influenzae Rd
gaauguaaaaaaua

SEQ ID NO: 697866 - RNA, 22 nt, Haemophilus influenzae Rd
gaauguaaaaaauaauuuucau

SEQ ID NO: 697867 - RNA, 15 nt, Haemophilus influenzae Rd
gaaugucuuaaagau

SEQ ID NO: 697868 - RNA, 15 nt, Haemophilus influenzae Rd
gacaaccguugcauu

SEQ ID NO: 697869 - RNA, 19 nt, Haemophilus influenzae Rd
gacaacggggcguauuuua

SEQ ID NO: 697870 - RNA, 13 nt, Haemophilus influenzae Rd
gacacccaaauua

SEQ ID NO: 697871 - RNA, 17 nt, Haemophilus influenzae Rd
gacaauggcuuugccac

SEQ ID NO: 697872 - RNA, 18 nt, Haemophilus influenzae Rd
gacaaugcguaauucucc

SEQ ID NO: 697873 - RNA, 17 nt, Haemophilus influenzae Rd
gacaauaauaagcacaa

SEQ ID NO: 697874 - RNA, 19 nt, Haemophilus influenzae Rd
gaauuuagggaaaauuuua

SEQ ID NO: 697875 - RNA, 13 nt, Haemophilus influenzae Rd
gaauuucacuggc

SEQ ID NO: 697876 - RNA, 18 nt, Haemophilus influenzae Rd
gaauuuuugugauuucaa

SEQ ID NO: 697877 - RNA, 19 nt, Haemophilus influenzae Rd
gaauuuuugugauuucaau

SEQ ID NO: 697878 - RNA, 13 nt, Haemophilus influenzae Rd
gaauuuuuuucaa

SEQ ID NO: 697879 - RNA, 17 nt, Haemophilus influenzae Rd
gaauuguguaagacuuu

SEQ ID NO: 697880 - RNA, 21 nt, Haemophilus influenzae Rd
gaauugcaucguuuacaucac

SEQ ID NO: 697881 - RNA, 15 nt, Haemophilus influenzae Rd
gaauuggauuugaac

SEQ ID NO: 697882 - RNA, 21 nt, Haemophilus influenzae Rd
gaauuggcgcaggcaaaccaa

SEQ ID NO: 697883 - RNA, 20 nt, Haemophilus influenzae Rd
gaauuggacggcaaaaauau

SEQ ID NO: 697884 - RNA, 14 nt, Haemophilus influenzae Rd
gaauugguucuaaa

SEQ ID NO: 697885 - RNA, 18 nt, Haemophilus influenzae Rd
gaauugguucuaaauauu

SEQ ID NO: 697886 - RNA, 15 nt, Haemophilus influenzae Rd
gaauuguaccuucug

SEQ ID NO: 697887 - RNA, 15 nt, Haemophilus influenzae Rd
gaauuauguauuuua

SEQ ID NO: 697888 - RNA, 15 nt, Haemophilus influenzae Rd
gaauuaucugaugua

SEQ ID NO: 697889 - RNA, 20 nt, Haemophilus influenzae Rd
gaauuaguuuuuuauuucua

SEQ ID NO: 697890 - RNA, 15 nt, Haemophilus influenzae Rd
gaauugcaaugcaga

SEQ ID NO: 697891 - RNA, 15 nt, Haemophilus influenzae Rd
gaauuauuuaaacuu

SEQ ID NO: 697892 - RNA, 19 nt, Haemophilus influenzae Rd
gaauuagauucggcuaaaa

SEQ ID NO: 697893 - RNA, 19 nt, Haemophilus influenzae Rd
gaauguugcguaccauauu

SEQ ID NO: 697894 - RNA, 14 nt, Haemophilus influenzae Rd
gaauuaaagugcag

SEQ ID NO: 697895 - RNA, 13 nt, Haemophilus influenzae Rd
gaauuaaacggcu

SEQ ID NO: 697896 - RNA, 14 nt, Haemophilus influenzae Rd
gaauuaaaaaccga

SEQ ID NO: 697897 - RNA, 12 nt, Haemophilus influenzae Rd
gaauuaaaacuu

SEQ ID NO: 697898 - RNA, 13 nt, Haemophilus influenzae Rd
gaauuaaaacuug

SEQ ID NO: 697899 - RNA, 16 nt, Haemophilus influenzae Rd
gaauuaaaaguagaag

SEQ ID NO: 697900 - RNA, 13 nt, Haemophilus influenzae Rd
gaauuaaaaaugg

SEQ ID NO: 697901 - RNA, 22 nt, Haemophilus influenzae Rd
gaauguuuucgaucauuugacg

SEQ ID NO: 697902 - RNA, 13 nt, Haemophilus influenzae Rd
gaauguuuugauu

SEQ ID NO: 697903 - RNA, 17 nt, Haemophilus influenzae Rd
gaauguuuugauugaga

SEQ ID NO: 697904 - RNA, 13 nt, Haemophilus influenzae Rd
gaauguuuuucau

SEQ ID NO: 697905 - RNA, 14 nt, Haemophilus influenzae Rd
cugagcuaacgacc

SEQ ID NO: 697906 - RNA, 16 nt, Haemophilus influenzae Rd
cugagcuaagggggga

SEQ ID NO: 697907 - RNA, 22 nt, Haemophilus influenzae Rd
cugaggauuaaagggcugcuac

SEQ ID NO: 697908 - RNA, 17 nt, Haemophilus influenzae Rd
cugaggcuaauaauaaa

SEQ ID NO: 697909 - RNA, 23 nt, Haemophilus influenzae Rd
cugaggcuaauaauaaaaagugc

SEQ ID NO: 697910 - RNA, 14 nt, Haemophilus influenzae Rd
cugagcguuaaauc

SEQ ID NO: 697911 - RNA, 12 nt, Haemophilus influenzae Rd
cugaguaaugua

SEQ ID NO: 697912 - RNA, 13 nt, Haemophilus influenzae Rd
cugaguaaauaaa

SEQ ID NO: 697913 - RNA, 19 nt, Haemophilus influenzae Rd
cugaguaaauaaacggaac

SEQ ID NO: 697914 - RNA, 20 nt, Haemophilus influenzae Rd
cugauaaacgccuuuuaaac

SEQ ID NO: 697915 - RNA, 21 nt, Haemophilus influenzae Rd
cugauaaacgccuuuuaaacu

SEQ ID NO: 697916 - RNA, 21 nt, Haemophilus influenzae Rd
cugauaaagauaacuaagaug

SEQ ID NO: 697917 - RNA, 18 nt, Haemophilus influenzae Rd
cugauauagcuagaaagc

SEQ ID NO: 697918 - RNA, 23 nt, Haemophilus influenzae Rd
cugauauagcuagaaagcaaugu

SEQ ID NO: 697919 - RNA, 16 nt, Haemophilus influenzae Rd
cugauauaguggcuuu

SEQ ID NO: 697920 - RNA, 14 nt, Haemophilus influenzae Rd
cugaugaaaucauu

SEQ ID NO: 697921 - RNA, 14 nt, Haemophilus influenzae Rd
cugaugcuuuaaca

SEQ ID NO: 697922 - RNA, 18 nt, Haemophilus influenzae Rd
cugauuauauuguugcac

SEQ ID NO: 697923 - RNA, 17 nt, Haemophilus influenzae Rd
cugauuacuuaaaguua

SEQ ID NO: 697924 - RNA, 16 nt, Haemophilus influenzae Rd
cugauuaaucaaaaau

SEQ ID NO: 697925 - RNA, 16 nt, Haemophilus influenzae Rd
cugauguuugaggauc

SEQ ID NO: 697926 - RNA, 20 nt, Haemophilus influenzae Rd
cugauuagcagguuuuuuau

SEQ ID NO: 697927 - RNA, 22 nt, Haemophilus influenzae Rd
cugauucauugcauuuuuauaa

SEQ ID NO: 697928 - RNA, 13 nt, Haemophilus influenzae Rd
cugauuugacaga

SEQ ID NO: 697929 - RNA, 13 nt, Haemophilus influenzae Rd
cugauucgccaaa

SEQ ID NO: 697930 - RNA, 13 nt, Haemophilus influenzae Rd
cugacgcauugca

SEQ ID NO: 697931 - RNA, 19 nt, Haemophilus influenzae Rd
cugacguaauuguuccaau

SEQ ID NO: 697932 - RNA, 23 nt, Haemophilus influenzae Rd
cugacguguaaaucuaaaauaau

SEQ ID NO: 697933 - RNA, 17 nt, Haemophilus influenzae Rd
cugaccgcacuuuuuga

SEQ ID NO: 697934 - RNA, 12 nt, Haemophilus influenzae Rd
cugaauuuugua

SEQ ID NO: 697935 - RNA, 13 nt, Haemophilus influenzae Rd
cugaauuuaaacu

SEQ ID NO: 697936 - RNA, 13 nt, Haemophilus influenzae Rd
cugaauuuaauuc

SEQ ID NO: 697937 - RNA, 13 nt, Haemophilus influenzae Rd
cucuaccaacuga

SEQ ID NO: 697938 - RNA, 17 nt, Haemophilus influenzae Rd
cucuacauuuacaucua

SEQ ID NO: 697939 - RNA, 16 nt, Haemophilus influenzae Rd
cucuaccaacugagcu

SEQ ID NO: 697940 - RNA, 13 nt, Haemophilus influenzae Rd
cucuaccgacuga

SEQ ID NO: 697941 - RNA, 16 nt, Haemophilus influenzae Rd
cucuaccgacugagcu

SEQ ID NO: 697942 - RNA, 20 nt, Haemophilus influenzae Rd
cugaauacacuuuaaauuuu

SEQ ID NO: 697943 - RNA, 23 nt, Haemophilus influenzae Rd
cugaauacacuuuaaauuuuccu

SEQ ID NO: 697944 - RNA, 14 nt, Haemophilus influenzae Rd
cugaauaaugugca

SEQ ID NO: 697945 - RNA, 16 nt, Haemophilus influenzae Rd
cugaauaaauuuuuua

SEQ ID NO: 697946 - RNA, 13 nt, Haemophilus influenzae Rd
cugaauaaauaaa

SEQ ID NO: 697947 - RNA, 21 nt, Haemophilus influenzae Rd
cugaaguuguaauaaagcuga

SEQ ID NO: 697948 - RNA, 13 nt, Haemophilus influenzae Rd
cugaauaaaaaaa

SEQ ID NO: 697949 - RNA, 14 nt, Haemophilus influenzae Rd
cugaauaaaaaaaa

SEQ ID NO: 697950 - RNA, 20 nt, Haemophilus influenzae Rd
cugaauauccagugccauuu

SEQ ID NO: 697951 - RNA, 14 nt, Haemophilus influenzae Rd
cugaauaucagaag

SEQ ID NO: 697952 - RNA, 21 nt, Haemophilus influenzae Rd
cugaaugcuugcgccgaauaa

SEQ ID NO: 697953 - RNA, 19 nt, Haemophilus influenzae Rd
cugaaugaucgaguaaaaa

SEQ ID NO: 697954 - RNA, 14 nt, Haemophilus influenzae Rd
cugaauuaaaaacc

SEQ ID NO: 697955 - RNA, 15 nt, Haemophilus influenzae Rd
cugaauuaaaaaccg

SEQ ID NO: 697956 - RNA, 16 nt, Haemophilus influenzae Rd
cugcagccauaauauu

SEQ ID NO: 697957 - RNA, 21 nt, Haemophilus influenzae Rd
cugcagccauaauauuuaaaa

SEQ ID NO: 697958 - RNA, 23 nt, Haemophilus influenzae Rd
cugcagcaagaucaauauaaccu

SEQ ID NO: 697959 - RNA, 15 nt, Haemophilus influenzae Rd
cugcagcauuuaaag

SEQ ID NO: 697960 - RNA, 13 nt, Haemophilus influenzae Rd
cugcacuuuaaca

SEQ ID NO: 697961 - RNA, 15 nt, Haemophilus influenzae Rd
cugcacuuuaacagu

SEQ ID NO: 697962 - RNA, 18 nt, Haemophilus influenzae Rd
cugcaggcauuuucaacu

SEQ ID NO: 697963 - RNA, 23 nt, Haemophilus influenzae Rd
cugcagcugcugcuuuaacaauu

SEQ ID NO: 697964 - RNA, 15 nt, Haemophilus influenzae Rd
cugcauauucauaaa

SEQ ID NO: 697965 - RNA, 14 nt, Haemophilus influenzae Rd
cugcaacaaauaaa

SEQ ID NO: 697966 - RNA, 19 nt, Haemophilus influenzae Rd
cugcaacaaauaaaucaua

SEQ ID NO: 697967 - RNA, 12 nt, Haemophilus influenzae Rd
cugauuuugugg

SEQ ID NO: 697968 - RNA, 18 nt, Haemophilus influenzae Rd
cugauuuuucuuuuucag

SEQ ID NO: 697969 - RNA, 16 nt, Haemophilus influenzae Rd
cugauuuuuuaaagua

SEQ ID NO: 697970 - RNA, 16 nt, Haemophilus influenzae Rd
cugcacgggaaaucca

SEQ ID NO: 697971 - RNA, 16 nt, Haemophilus influenzae Rd
cugcacgaauaauuaa

SEQ ID NO: 697972 - RNA, 19 nt, Haemophilus influenzae Rd
cugcaccuuaaaggcugaa

SEQ ID NO: 697973 - RNA, 17 nt, Haemophilus influenzae Rd
cugcaccguugaaugcu

SEQ ID NO: 697974 - RNA, 15 nt, Haemophilus influenzae Rd
cugccgucccccagu

SEQ ID NO: 697975 - RNA, 13 nt, Haemophilus influenzae Rd
cugccuuuuucuu

SEQ ID NO: 697976 - RNA, 17 nt, Haemophilus influenzae Rd
cugcccaaguugugcca

SEQ ID NO: 697977 - RNA, 18 nt, Haemophilus influenzae Rd
cugccaguagaaaaucag

SEQ ID NO: 697978 - RNA, 20 nt, Haemophilus influenzae Rd
cugccacuucagcuaauaaa

SEQ ID NO: 697979 - RNA, 15 nt, Haemophilus influenzae Rd
cugccacuaauaagc

SEQ ID NO: 697980 - RNA, 20 nt, Haemophilus influenzae Rd
cugcucuucaucaaaaugaa

SEQ ID NO: 697981 - RNA, 20 nt, Haemophilus influenzae Rd
cugcugacgguucaguuuca

SEQ ID NO: 697982 - RNA, 23 nt, Haemophilus influenzae Rd
aaacuauauagccuguuguucuc

SEQ ID NO: 697983 - RNA, 17 nt, Haemophilus influenzae Rd
aaacuauugaaaauuaa

SEQ ID NO: 697984 - RNA, 17 nt, Haemophilus influenzae Rd
aaacuauuaccuaacca

SEQ ID NO: 697985 - RNA, 22 nt, Haemophilus influenzae Rd
cugcuaggacauagccuuuuuc

SEQ ID NO: 697986 - RNA, 17 nt, Haemophilus influenzae Rd
cugcuaauuccacuuca

SEQ ID NO: 697987 - RNA, 13 nt, Haemophilus influenzae Rd
cugcuacuuuuga

SEQ ID NO: 697988 - RNA, 16 nt, Haemophilus influenzae Rd
cugcuacuuuugacgc

SEQ ID NO: 697989 - RNA, 14 nt, Haemophilus influenzae Rd
cugcuacaauuuca

SEQ ID NO: 697990 - RNA, 18 nt, Haemophilus influenzae Rd
cugcuacaauuucauuaa

SEQ ID NO: 697991 - RNA, 17 nt, Haemophilus influenzae Rd
cugcuacauuugcccca

SEQ ID NO: 697992 - RNA, 16 nt, Haemophilus influenzae Rd
cugcuugauacauuuc

SEQ ID NO: 697993 - RNA, 16 nt, Haemophilus influenzae Rd
cugcuucguuuucugc

SEQ ID NO: 697994 - RNA, 17 nt, Haemophilus influenzae Rd
cugcuucguuuucugcu

SEQ ID NO: 697995 - RNA, 22 nt, Haemophilus influenzae Rd
cugcuuguucacguguuuuuuc

SEQ ID NO: 697996 - RNA, 19 nt, Haemophilus influenzae Rd
cugcuuuaacaauuacugc

SEQ ID NO: 697997 - RNA, 22 nt, Haemophilus influenzae Rd
cugcuuuaauaaacggauugca

SEQ ID NO: 697998 - RNA, 13 nt, Haemophilus influenzae Rd
cugcuuguaacca

SEQ ID NO: 697999 - RNA, 21 nt, Haemophilus influenzae Rd
cugcuuguaaccaauaaaggg

SEQ ID NO: 698000 - RNA, 22 nt, Haemophilus influenzae Rd
cugcuuguaaccaauaaaggga

SEQ ID NO: 698001 - RNA, 21 nt, Haemophilus influenzae Rd
cugcuugcacugcuaauucca

SEQ ID NO: 698002 - RNA, 23 nt, Haemophilus influenzae Rd
cugcuggguuugcacuuuaaaaa

SEQ ID NO: 698003 - RNA, 23 nt, Haemophilus influenzae Rd
cugcuggcucuacgcaagcgguu

SEQ ID NO: 698004 - RNA, 23 nt, Haemophilus influenzae Rd
cugcugcaagauuugcugcugcu

SEQ ID NO: 698005 - RNA, 20 nt, Haemophilus influenzae Rd
cugcuguaacguuaaaugaa

SEQ ID NO: 698006 - RNA, 22 nt, Haemophilus influenzae Rd
cuggagagugaguuuggaauac

SEQ ID NO: 698007 - RNA, 20 nt, Haemophilus influenzae Rd
cuggaagcgaauuuaagaaa

SEQ ID NO: 698008 - RNA, 19 nt, Haemophilus influenzae Rd
cuggauauugcucaauuaa

SEQ ID NO: 698009 - RNA, 16 nt, Haemophilus influenzae Rd
cuggauaaaugccgcc

SEQ ID NO: 698010 - RNA, 17 nt, Haemophilus influenzae Rd
cuggauucguuguacca

SEQ ID NO: 698011 - RNA, 13 nt, Haemophilus influenzae Rd
cuggauuaucuau

SEQ ID NO: 698012 - RNA, 16 nt, Haemophilus influenzae Rd
cuggauuaucuguaac

SEQ ID NO: 698013 - RNA, 20 nt, Haemophilus influenzae Rd
cuggcaauauuucaauaagc

SEQ ID NO: 698014 - RNA, 20 nt, Haemophilus influenzae Rd
aaacucgggcguaaaccuuu

SEQ ID NO: 698015 - RNA, 17 nt, Haemophilus influenzae Rd
aaacucgguuuauuuuc

SEQ ID NO: 698016 - RNA, 23 nt, Haemophilus influenzae Rd
cuggcucuucuuucgguggugcg

SEQ ID NO: 698017 - RNA, 14 nt, Haemophilus influenzae Rd
cuggcucugcugau

SEQ ID NO: 698018 - RNA, 12 nt, Haemophilus influenzae Rd
cuggcucuucuu

SEQ ID NO: 698019 - RNA, 16 nt, Haemophilus influenzae Rd
cuggcuuaaaugaucu

SEQ ID NO: 698020 - RNA, 16 nt, Haemophilus influenzae Rd
cuggcuugugaaauaa

SEQ ID NO: 698021 - RNA, 18 nt, Haemophilus influenzae Rd
cuggcuugugaaauaaaa

SEQ ID NO: 698022 - RNA, 23 nt, Haemophilus influenzae Rd
cugggcaaaaucaucaaacaccc

SEQ ID NO: 698023 - RNA, 24 nt, Haemophilus influenzae Rd
cugggaauucgaagguauauaagc

SEQ ID NO: 698024 - RNA, 12 nt, Haemophilus influenzae Rd
aaacucacuaaa

SEQ ID NO: 698025 - RNA, 19 nt, Haemophilus influenzae Rd
aaacucacuaaauuaggaa

SEQ ID NO: 698026 - RNA, 17 nt, Haemophilus influenzae Rd
cuggcauaucugcugcu

SEQ ID NO: 698027 - RNA, 13 nt, Haemophilus influenzae Rd
cugguaauuugcu

SEQ ID NO: 698028 - RNA, 15 nt, Haemophilus influenzae Rd
cugguacaaauuuag

SEQ ID NO: 698029 - RNA, 18 nt, Haemophilus influenzae Rd
cugguagcaauaaccaau

SEQ ID NO: 698030 - RNA, 15 nt, Haemophilus influenzae Rd
cugguagcauaaagg

SEQ ID NO: 698031 - RNA, 18 nt, Haemophilus influenzae Rd
cugguauuuacaagucuc

SEQ ID NO: 698032 - RNA, 19 nt, Haemophilus influenzae Rd
cuggguauugauucaauuc

SEQ ID NO: 698033 - RNA, 22 nt, Haemophilus influenzae Rd
cuggguauugauucaauucuuc

SEQ ID NO: 698034 - RNA, 13 nt, Haemophilus influenzae Rd
cugggucuuuuug

SEQ ID NO: 698035 - RNA, 20 nt, Haemophilus influenzae Rd
cugggucuuuuuguggagca

SEQ ID NO: 698036 - RNA, 21 nt, Haemophilus influenzae Rd
cuggguuugcacuuuaaaaau

SEQ ID NO: 698037 - RNA, 19 nt, Haemophilus influenzae Rd
cuggggacgcaccuuuuga

SEQ ID NO: 698038 - RNA, 22 nt, Haemophilus influenzae Rd
cuggggacgcaccuuuugaaaa

SEQ ID NO: 698039 - RNA, 18 nt, Haemophilus influenzae Rd
cugguucguuugguucga

SEQ ID NO: 698040 - RNA, 14 nt, Haemophilus influenzae Rd
cugguucaaaaugg

SEQ ID NO: 698041 - RNA, 21 nt, Haemophilus influenzae Rd
cugguguuauuggaaaauuca

SEQ ID NO: 698042 - RNA, 15 nt, Haemophilus influenzae Rd
cugguuuauuuauuc

SEQ ID NO: 698043 - RNA, 15 nt, Haemophilus influenzae Rd
cuggugggaauaauu

SEQ ID NO: 698044 - RNA, 18 nt, Haemophilus influenzae Rd
cugguguggagaaagaaa

SEQ ID NO: 698045 - RNA, 20 nt, Haemophilus influenzae Rd
cuguaauauaugaaaaauaa

SEQ ID NO: 698046 - RNA, 23 nt, Haemophilus influenzae Rd
cuguaauauaugaaaaauaauca

SEQ ID NO: 698047 - RNA, 15 nt, Haemophilus influenzae Rd
cuguaacguuaaaug

SEQ ID NO: 698048 - RNA, 13 nt, Haemophilus influenzae Rd
cuguaaaaaaccu

SEQ ID NO: 698049 - RNA, 15 nt, Haemophilus influenzae Rd
cuguaaaccuucaaa

SEQ ID NO: 698050 - RNA, 21 nt, Haemophilus influenzae Rd
cuguaaauaugccuuauauuu

SEQ ID NO: 698051 - RNA, 22 nt, Haemophilus influenzae Rd
cuguaaauggcguuuugcguga

SEQ ID NO: 698052 - RNA, 16 nt, Haemophilus influenzae Rd
cuguaauuucacuucc

SEQ ID NO: 698053 - RNA, 17 nt, Haemophilus influenzae Rd
cuguaaugacagaaucu

SEQ ID NO: 698054 - RNA, 22 nt, Haemophilus influenzae Rd
cuguccaauaauuaaacuuuca

SEQ ID NO: 698055 - RNA, 14 nt, Haemophilus influenzae Rd
cugucacaauauuu

SEQ ID NO: 698056 - RNA, 18 nt, Haemophilus influenzae Rd
cugucaucgguucuuuua

SEQ ID NO: 698057 - RNA, 22 nt, Haemophilus influenzae Rd
cugucaucgguucuuuuaauuc

SEQ ID NO: 698058 - RNA, 17 nt, Haemophilus influenzae Rd
cugucauauucauuuuc

SEQ ID NO: 698059 - RNA, 16 nt, Haemophilus influenzae Rd
cugucauauaaagugg

SEQ ID NO: 698060 - RNA, 18 nt, Haemophilus influenzae Rd
cuguacguucaaaaagcu

SEQ ID NO: 698061 - RNA, 22 nt, Haemophilus influenzae Rd
cugucaaacgaaaaaaauaaaa

SEQ ID NO: 698062 - RNA, 16 nt, Haemophilus influenzae Rd
cuguaucaauuccuuc

SEQ ID NO: 698063 - RNA, 13 nt, Haemophilus influenzae Rd
cuguauuaucuaa

SEQ ID NO: 698064 - RNA, 19 nt, Haemophilus influenzae Rd
aaacucuucguugguuuuc

SEQ ID NO: 698065 - RNA, 23 nt, Haemophilus influenzae Rd
aaacucuugugccaaauucauuc

SEQ ID NO: 698066 - RNA, 13 nt, Haemophilus influenzae Rd
cuguaucuuuuug

SEQ ID NO: 698067 - RNA, 13 nt, Haemophilus influenzae Rd
cuguaucuacuuu

SEQ ID NO: 698068 - RNA, 18 nt, Haemophilus influenzae Rd
cuguaucuacuuuauuca

SEQ ID NO: 698069 - RNA, 13 nt, Haemophilus influenzae Rd
cuguauaccaacc

SEQ ID NO: 698070 - RNA, 16 nt, Haemophilus influenzae Rd
cuguauaccaaccauu

SEQ ID NO: 698071 - RNA, 16 nt, Haemophilus influenzae Rd
cugucgcuuuuuccuc

SEQ ID NO: 698072 - RNA, 20 nt, Haemophilus influenzae Rd
cugucuggcaaguagaacca

SEQ ID NO: 698073 - RNA, 15 nt, Haemophilus influenzae Rd
cugucuaauuuuuua

SEQ ID NO: 698074 - RNA, 19 nt, Haemophilus influenzae Rd
cugugauauauaucacaga

SEQ ID NO: 698075 - RNA, 18 nt, Haemophilus influenzae Rd
cugugauaacuaugccuu

SEQ ID NO: 698076 - RNA, 17 nt, Haemophilus influenzae Rd
cugugauaccgauaaaa

SEQ ID NO: 698077 - RNA, 19 nt, Haemophilus influenzae Rd
cugugcaaaacuagucaua

SEQ ID NO: 698078 - RNA, 19 nt, Haemophilus influenzae Rd
cugugcaaaguuaccauuu

SEQ ID NO: 698079 - RNA, 19 nt, Haemophilus influenzae Rd
cuguggcaaguugaagaga

SEQ ID NO: 698080 - RNA, 16 nt, Haemophilus influenzae Rd
cugugcgaccugaaga

SEQ ID NO: 698081 - RNA, 21 nt, Haemophilus influenzae Rd
cuguuccacccgguacgcaac

SEQ ID NO: 698082 - RNA, 23 nt, Haemophilus influenzae Rd
cuguuacaucauccuuaccuucc

SEQ ID NO: 698083 - RNA, 16 nt, Haemophilus influenzae Rd
cuguucaaauucugcu

SEQ ID NO: 698084 - RNA, 22 nt, Haemophilus influenzae Rd
cuguuaauugaguguggugaac

SEQ ID NO: 698085 - RNA, 13 nt, Haemophilus influenzae Rd
cuguuaccaauaa

SEQ ID NO: 698086 - RNA, 19 nt, Haemophilus influenzae Rd
cuguugaggccgaucauag

SEQ ID NO: 698087 - RNA, 16 nt, Haemophilus influenzae Rd
cuguugaaugcuauuc

SEQ ID NO: 698088 - RNA, 16 nt, Haemophilus influenzae Rd
cuguucuucugggauu

SEQ ID NO: 698089 - RNA, 13 nt, Haemophilus influenzae Rd
cugugguaaaaau

SEQ ID NO: 698090 - RNA, 17 nt, Haemophilus influenzae Rd
cugugguaaauaauuuu

SEQ ID NO: 698091 - RNA, 15 nt, Haemophilus influenzae Rd
cuguggugaagugcg

SEQ ID NO: 698092 - RNA, 20 nt, Haemophilus influenzae Rd
cugugguuuugugaguucaa

SEQ ID NO: 698093 - RNA, 20 nt, Haemophilus influenzae Rd
cuguuaaacgcauauuuugu

SEQ ID NO: 698094 - RNA, 20 nt, Haemophilus influenzae Rd
aaacugugcccgcagcaauu

SEQ ID NO: 698095 - RNA, 17 nt, Haemophilus influenzae Rd
cuuaacaacaaagucaa

SEQ ID NO: 698096 - RNA, 14 nt, Haemophilus influenzae Rd
aaacuuaaauacau

SEQ ID NO: 698097 - RNA, 16 nt, Haemophilus influenzae Rd
cuuaaaagauuaaaac

SEQ ID NO: 698098 - RNA, 22 nt, Haemophilus influenzae Rd
cuuaaaccaaauugauucauuu

SEQ ID NO: 698099 - RNA, 23 nt, Haemophilus influenzae Rd
cuuaaaccaaauugauucauuug

SEQ ID NO: 698100 - RNA, 14 nt, Haemophilus influenzae Rd
cuuaaacaagcucu

SEQ ID NO: 698101 - RNA, 16 nt, Haemophilus influenzae Rd
cuguugcaccaagcaa

SEQ ID NO: 698102 - RNA, 23 nt, Haemophilus influenzae Rd
cuguugcgauuuccacuuuuuca

SEQ ID NO: 698103 - RNA, 21 nt, Haemophilus influenzae Rd
cuguugcauuagaaaucaaca

SEQ ID NO: 698104 - RNA, 17 nt, Haemophilus influenzae Rd
cuguugauguuuuaaca

SEQ ID NO: 698105 - RNA, 20 nt, Haemophilus influenzae Rd
cuguugggauagauuuuuua

SEQ ID NO: 698106 - RNA, 23 nt, Haemophilus influenzae Rd
cuguugggguugcgccuaaacca

SEQ ID NO: 698107 - RNA, 15 nt, Haemophilus influenzae Rd
cuguugggaauaauu

SEQ ID NO: 698108 - RNA, 16 nt, Haemophilus influenzae Rd
cuguuugugcacagau

SEQ ID NO: 698109 - RNA, 16 nt, Haemophilus influenzae Rd
cuuaucuaacuaaaau

SEQ ID NO: 698110 - RNA, 15 nt, Haemophilus influenzae Rd
cuuaucuaaaaagau

SEQ ID NO: 698111 - RNA, 16 nt, Haemophilus influenzae Rd
cuuaucuaaacuuuca

SEQ ID NO: 698112 - RNA, 18 nt, Haemophilus influenzae Rd
cuuaucuacaaucaaaaa

SEQ ID NO: 698113 - RNA, 21 nt, Haemophilus influenzae Rd
cuuaugaacuuuuuuauaauc

SEQ ID NO: 698114 - RNA, 18 nt, Haemophilus influenzae Rd
cuuaugaaaaaaaauuua

SEQ ID NO: 698115 - RNA, 21 nt, Haemophilus influenzae Rd
cuuauaagcuguauuacuuau

SEQ ID NO: 698116 - RNA, 12 nt, Haemophilus influenzae Rd
cuuauaaauuua

SEQ ID NO: 698117 - RNA, 17 nt, Haemophilus influenzae Rd
cuuauacgaguaaaaaa

SEQ ID NO: 698118 - RNA, 18 nt, Haemophilus influenzae Rd
cuuauacgaguaaaaaau

SEQ ID NO: 698119 - RNA, 19 nt, Haemophilus influenzae Rd
cuuauacgaguaaaaaauc

SEQ ID NO: 698120 - RNA, 21 nt, Haemophilus influenzae Rd
cuuauacgaguaaaaaaucua

SEQ ID NO: 698121 - RNA, 23 nt, Haemophilus influenzae Rd
cuuauaauaugaaucguugauca

SEQ ID NO: 698122 - RNA, 13 nt, Haemophilus influenzae Rd
cuuauacaaaacu

SEQ ID NO: 698123 - RNA, 14 nt, Haemophilus influenzae Rd
cuuauacaaaacua

SEQ ID NO: 698124 - RNA, 15 nt, Haemophilus influenzae Rd
cuuauacaaaacuaa

SEQ ID NO: 698125 - RNA, 20 nt, Haemophilus influenzae Rd
cuuaguauuuuauuuaagcu

SEQ ID NO: 698126 - RNA, 14 nt, Haemophilus influenzae Rd
cuuagugaaaagaa

SEQ ID NO: 698127 - RNA, 18 nt, Haemophilus influenzae Rd
cuuagacaaauuaaauua

SEQ ID NO: 698128 - RNA, 15 nt, Haemophilus influenzae Rd
cuuacuuuuuguuug

SEQ ID NO: 698129 - RNA, 21 nt, Haemophilus influenzae Rd
cuuacuuuauacuaaaaguac

SEQ ID NO: 698130 - RNA, 16 nt, Haemophilus influenzae Rd
cuuacuuuauuuuuaa

SEQ ID NO: 698131 - RNA, 19 nt, Haemophilus influenzae Rd
cuuacuuuauuuuuaagug

SEQ ID NO: 698132 - RNA, 19 nt, Haemophilus influenzae Rd
cuuacuucuacuucuugug

SEQ ID NO: 698133 - RNA, 21 nt, Haemophilus influenzae Rd
cuuacgcugaauagcaaauac

SEQ ID NO: 698134 - RNA, 23 nt, Haemophilus influenzae Rd
cuuacagauucauuguuucucaa

SEQ ID NO: 698135 - RNA, 13 nt, Haemophilus influenzae Rd
cuuacaggaaagu

SEQ ID NO: 698136 - RNA, 22 nt, Haemophilus influenzae Rd
cuuacgccagcuaaagaaagca

SEQ ID NO: 698137 - RNA, 13 nt, Haemophilus influenzae Rd
cuuaauuuuuuaa

SEQ ID NO: 698138 - RNA, 16 nt, Haemophilus influenzae Rd
cuuaauuuuuuaaccg

SEQ ID NO: 698139 - RNA, 14 nt, Haemophilus influenzae Rd
cuuaauuuuauuaa

SEQ ID NO: 698140 - RNA, 17 nt, Haemophilus influenzae Rd
cuuaagguuuauagaug

SEQ ID NO: 698141 - RNA, 18 nt, Haemophilus influenzae Rd
cuuaagucagcauaaaca

SEQ ID NO: 698142 - RNA, 14 nt, Haemophilus influenzae Rd
cuuaauaaauauug

SEQ ID NO: 698143 - RNA, 16 nt, Haemophilus influenzae Rd
cuuaacugaaaauuca

SEQ ID NO: 698144 - RNA, 16 nt, Haemophilus influenzae Rd
cuuaauucuugccaua

SEQ ID NO: 698145 - RNA, 19 nt, Haemophilus influenzae Rd
cuuaauuucauuaauaacc

SEQ ID NO: 698146 - RNA, 20 nt, Haemophilus influenzae Rd
cuucagaacugcuuucuucc

SEQ ID NO: 698147 - RNA, 13 nt, Haemophilus influenzae Rd
cuucagaaaauaa

SEQ ID NO: 698148 - RNA, 20 nt, Haemophilus influenzae Rd
cuucagaaagauuacauucu

SEQ ID NO: 698149 - RNA, 16 nt, Haemophilus influenzae Rd
cuucacuuuucgcaau

SEQ ID NO: 698150 - RNA, 14 nt, Haemophilus influenzae Rd
cuucacugugccaa

SEQ ID NO: 698151 - RNA, 19 nt, Haemophilus influenzae Rd
cuucagccacuaauuucac

SEQ ID NO: 698152 - RNA, 14 nt, Haemophilus influenzae Rd
cuucagcguuguca

SEQ ID NO: 698153 - RNA, 23 nt, Haemophilus influenzae Rd
cuucauauaaauuagccaucgca

SEQ ID NO: 698154 - RNA, 17 nt, Haemophilus influenzae Rd
cuucauuaaaaccaauu

SEQ ID NO: 698155 - RNA, 23 nt, Haemophilus influenzae Rd
cuucauuaaacugaaucgcuugu

SEQ ID NO: 698156 - RNA, 16 nt, Haemophilus influenzae Rd
cuucaugauuuuccaa

SEQ ID NO: 698157 - RNA, 21 nt, Haemophilus influenzae Rd
cuucaugauuuuccaaaauuu

SEQ ID NO: 698158 - RNA, 14 nt, Haemophilus influenzae Rd
cuucaucuucuuuu

SEQ ID NO: 698159 - RNA, 15 nt, Haemophilus influenzae Rd
cuucaucuuuaaaca

SEQ ID NO: 698160 - RNA, 12 nt, Haemophilus influenzae Rd
cuucaucaaaac

SEQ ID NO: 698161 - RNA, 16 nt, Haemophilus influenzae Rd
cuucaucgaaaauuaa

SEQ ID NO: 698162 - RNA, 22 nt, Haemophilus influenzae Rd
cuucauaucuuugaauugaagc

SEQ ID NO: 698163 - RNA, 15 nt, Haemophilus influenzae Rd
cuucaucgucuucuu

SEQ ID NO: 698164 - RNA, 16 nt, Haemophilus influenzae Rd
cuucaucgucuucuuc

SEQ ID NO: 698165 - RNA, 17 nt, Haemophilus influenzae Rd
cuucaucgucuucuucg

SEQ ID NO: 698166 - RNA, 23 nt, Haemophilus influenzae Rd
cuucaucgucuucuucgcuccaa

SEQ ID NO: 698167 - RNA, 16 nt, Haemophilus influenzae Rd
cuucaucugcaucaca

SEQ ID NO: 698168 - RNA, 14 nt, Haemophilus influenzae Rd
cuucaagucuuuuu

SEQ ID NO: 698169 - RNA, 15 nt, Haemophilus influenzae Rd
cuucaagucuuuuuu

SEQ ID NO: 698170 - RNA, 20 nt, Haemophilus influenzae Rd
cuucaauagaacguaauaau

SEQ ID NO: 698171 - RNA, 18 nt, Haemophilus influenzae Rd
cuucaauagauaaaucaa

SEQ ID NO: 698172 - RNA, 16 nt, Haemophilus influenzae Rd
cuucaaauucuacaug

SEQ ID NO: 698173 - RNA, 20 nt, Haemophilus influenzae Rd
cuucaaauugcaaaaaacuu

SEQ ID NO: 698174 - RNA, 14 nt, Haemophilus influenzae Rd
cuucaacauuuuuu

SEQ ID NO: 698175 - RNA, 21 nt, Haemophilus influenzae Rd
cuucaaccacccauacuuuaa

SEQ ID NO: 698176 - RNA, 14 nt, Haemophilus influenzae Rd
cuuauugaagaaag

SEQ ID NO: 698177 - RNA, 22 nt, Haemophilus influenzae Rd
cuuauuccagucuacacuugua

SEQ ID NO: 698178 - RNA, 14 nt, Haemophilus influenzae Rd
cuucacagauuuca

SEQ ID NO: 698179 - RNA, 18 nt, Haemophilus influenzae Rd
cuucacagauuucaauua

SEQ ID NO: 698180 - RNA, 13 nt, Haemophilus influenzae Rd
cuucacaaaccca

SEQ ID NO: 698181 - RNA, 14 nt, Haemophilus influenzae Rd
cuucaaguuuaucg

SEQ ID NO: 698182 - RNA, 14 nt, Haemophilus influenzae Rd
cuucaauuucuacc

SEQ ID NO: 698183 - RNA, 17 nt, Haemophilus influenzae Rd
cuucaauuuuuuaucaa

SEQ ID NO: 698184 - RNA, 17 nt, Haemophilus influenzae Rd
cuucacgacccaccacu

SEQ ID NO: 698185 - RNA, 15 nt, Haemophilus influenzae Rd
cuuccauaauacuca

SEQ ID NO: 698186 - RNA, 23 nt, Haemophilus influenzae Rd
cuuccauuucaauaucuaagaaa

SEQ ID NO: 698187 - RNA, 18 nt, Haemophilus influenzae Rd
cuuccauuuuuauuccuu

SEQ ID NO: 698188 - RNA, 14 nt, Haemophilus influenzae Rd
cuucccaaucuugu

SEQ ID NO: 698189 - RNA, 20 nt, Haemophilus influenzae Rd
cuucccaaucuuguuuuaau

SEQ ID NO: 698190 - RNA, 22 nt, Haemophilus influenzae Rd
cuuccaaugugaccaaauaauc

SEQ ID NO: 698191 - RNA, 17 nt, Haemophilus influenzae Rd
aaacuuacccaguaaaa

SEQ ID NO: 698192 - RNA, 22 nt, Haemophilus influenzae Rd
aaacuuacccaguaaaacuugc

SEQ ID NO: 698193 - RNA, 18 nt, Haemophilus influenzae Rd
aaacuuaccuaaaaauuu

SEQ ID NO: 698194 - RNA, 23 nt, Haemophilus influenzae Rd
aaacuuaccuaaaaauuuaaaua

SEQ ID NO: 698195 - RNA, 18 nt, Haemophilus influenzae Rd
aaacuuaguuuuaauucu

SEQ ID NO: 698196 - RNA, 14 nt, Haemophilus influenzae Rd
cuucgauauuuucc

SEQ ID NO: 698197 - RNA, 19 nt, Haemophilus influenzae Rd
cuucgaaaauaacuucauc

SEQ ID NO: 698198 - RNA, 20 nt, Haemophilus influenzae Rd
cuucgaaaauaacuucaucc

SEQ ID NO: 698199 - RNA, 23 nt, Haemophilus influenzae Rd
cuucgaaaauaacuucauccauu

SEQ ID NO: 698200 - RNA, 19 nt, Haemophilus influenzae Rd
cuucgauuaguuuaucaga

SEQ ID NO: 698201 - RNA, 14 nt, Haemophilus influenzae Rd
cuucgccauuuuua

SEQ ID NO: 698202 - RNA, 15 nt, Haemophilus influenzae Rd
cuuccgcgucauuua

SEQ ID NO: 698203 - RNA, 17 nt, Haemophilus influenzae Rd
cuuccgcaucggcuaac

SEQ ID NO: 698204 - RNA, 22 nt, Haemophilus influenzae Rd
cuuccugcaaacauaccacuuc

SEQ ID NO: 698205 - RNA, 13 nt, Haemophilus influenzae Rd
cguacauuauuaa

SEQ ID NO: 698206 - RNA, 18 nt, Haemophilus influenzae Rd
cguacaucgaaaacauaa

SEQ ID NO: 698207 - RNA, 15 nt, Haemophilus influenzae Rd
cguacagaccauuga

SEQ ID NO: 698208 - RNA, 19 nt, Haemophilus influenzae Rd
cguacaauuucaaauaaac

SEQ ID NO: 698209 - RNA, 15 nt, Haemophilus influenzae Rd
cguaaugcuuuugcu

SEQ ID NO: 698210 - RNA, 16 nt, Haemophilus influenzae Rd
cguaaugcuuuugcuu

SEQ ID NO: 698211 - RNA, 15 nt, Haemophilus influenzae Rd
cguaauuaaaaauaa

SEQ ID NO: 698212 - RNA, 16 nt, Haemophilus influenzae Rd
cguaauuaaaaauaac

SEQ ID NO: 698213 - RNA, 15 nt, Haemophilus influenzae Rd
cguaguaaauuuucc

SEQ ID NO: 698214 - RNA, 16 nt, Haemophilus influenzae Rd
cguagaaaucaaaaau

SEQ ID NO: 698215 - RNA, 14 nt, Haemophilus influenzae Rd
cguccacuucaucg

SEQ ID NO: 698216 - RNA, 19 nt, Haemophilus influenzae Rd
cguccaaagaaguuuucca

SEQ ID NO: 698217 - RNA, 20 nt, Haemophilus influenzae Rd
cguccaagguuuuaauuuug

SEQ ID NO: 698218 - RNA, 22 nt, Haemophilus influenzae Rd
cguauuuucucaucauuauuuu

SEQ ID NO: 698219 - RNA, 15 nt, Haemophilus influenzae Rd
cguauuuuuuacagu

SEQ ID NO: 698220 - RNA, 13 nt, Haemophilus influenzae Rd
cguauucuuuaca

SEQ ID NO: 698221 - RNA, 16 nt, Haemophilus influenzae Rd
cguauucuuuacaaau

SEQ ID NO: 698222 - RNA, 21 nt, Haemophilus influenzae Rd
cgucaccuacugguguagaug

SEQ ID NO: 698223 - RNA, 21 nt, Haemophilus influenzae Rd
cgucuaaugccgccuuaucua

SEQ ID NO: 698224 - RNA, 17 nt, Haemophilus influenzae Rd
cgugaaucguuuguaaa

SEQ ID NO: 698225 - RNA, 20 nt, Haemophilus influenzae Rd
cgugaauauauuauuaaguc

SEQ ID NO: 698226 - RNA, 10 nt, Haemophilus influenzae Rd
cgucuugcca

SEQ ID NO: 698227 - RNA, 17 nt, Haemophilus influenzae Rd
cgugaugaccugcagag

SEQ ID NO: 698228 - RNA, 13 nt, Haemophilus influenzae Rd
cgugauuuaccaa

SEQ ID NO: 698229 - RNA, 18 nt, Haemophilus influenzae Rd
cgugauuccaaaaauucc

SEQ ID NO: 698230 - RNA, 12 nt, Haemophilus influenzae Rd
cgugauuuuuuu

SEQ ID NO: 698231 - RNA, 22 nt, Haemophilus influenzae Rd
cgucgcuaccgccaauauguuu

SEQ ID NO: 698232 - RNA, 18 nt, Haemophilus influenzae Rd
cuacaaaacauaauaaaa

SEQ ID NO: 698233 - RNA, 14 nt, Haemophilus influenzae Rd
cuaauuuuuuucca

SEQ ID NO: 698234 - RNA, 22 nt, Haemophilus influenzae Rd
cuaauuuuuuuccaauuaauuc

SEQ ID NO: 698235 - RNA, 13 nt, Haemophilus influenzae Rd
cuacaaauaagcc

SEQ ID NO: 698236 - RNA, 16 nt, Haemophilus influenzae Rd
cuacaaggguaucuaa

SEQ ID NO: 698237 - RNA, 22 nt, Haemophilus influenzae Rd
cuacaaggguaucuaaauuugc

SEQ ID NO: 698238 - RNA, 18 nt, Haemophilus influenzae Rd
cuacaagugaaccaauau

SEQ ID NO: 698239 - RNA, 23 nt, Haemophilus influenzae Rd
cuacaacacagacuaaauucagu

SEQ ID NO: 698240 - RNA, 23 nt, Haemophilus influenzae Rd
cuacaacacuguuccgccacaag

SEQ ID NO: 698241 - RNA, 19 nt, Haemophilus influenzae Rd
cuaauuuucacauaauaaa

SEQ ID NO: 698242 - RNA, 15 nt, Haemophilus influenzae Rd
cuaauuuugccauca

SEQ ID NO: 698243 - RNA, 21 nt, Haemophilus influenzae Rd
cuaauuuugccaucaauaacu

SEQ ID NO: 698244 - RNA, 19 nt, Haemophilus influenzae Rd
cuaauuuuguaagcauuaa

SEQ ID NO: 698245 - RNA, 12 nt, Haemophilus influenzae Rd
cuaauuuuucag

SEQ ID NO: 698246 - RNA, 19 nt, Haemophilus influenzae Rd
cuaauuugccaaguacaau

SEQ ID NO: 698247 - RNA, 13 nt, Haemophilus influenzae Rd
cuaauuucauaaa

SEQ ID NO: 698248 - RNA, 17 nt, Haemophilus influenzae Rd
cuaauuucauaaaaauu

SEQ ID NO: 698249 - RNA, 22 nt, Haemophilus influenzae Rd
cuaauuucguccaguuauaaua

SEQ ID NO: 698250 - RNA, 22 nt, Haemophilus influenzae Rd
cuaauuaauuuagauaaaaauu

SEQ ID NO: 698251 - RNA, 16 nt, Haemophilus influenzae Rd
cuaauuccccuucaaa

SEQ ID NO: 698252 - RNA, 14 nt, Haemophilus influenzae Rd
cuaauucaauaucu

SEQ ID NO: 698253 - RNA, 15 nt, Haemophilus influenzae Rd
cuaauggggauuuac

SEQ ID NO: 698254 - RNA, 18 nt, Haemophilus influenzae Rd
cuaaugguugcauuugcu

SEQ ID NO: 698255 - RNA, 21 nt, Haemophilus influenzae Rd
cuaaugguugcauuugcucaa

SEQ ID NO: 698256 - RNA, 20 nt, Haemophilus influenzae Rd
cuaaugguuguaaauuuuca

SEQ ID NO: 698257 - RNA, 14 nt, Haemophilus influenzae Rd
cuaauuuaagaaaa

SEQ ID NO: 698258 - RNA, 16 nt, Haemophilus influenzae Rd
cuaauuuagucauaca

SEQ ID NO: 698259 - RNA, 16 nt, Haemophilus influenzae Rd
cuaauuggaaaaguaa

SEQ ID NO: 698260 - RNA, 22 nt, Haemophilus influenzae Rd
cuaauuggacaagaaauaauaa

SEQ ID NO: 698261 - RNA, 14 nt, Haemophilus influenzae Rd
cuaauugguaaaau

SEQ ID NO: 698262 - RNA, 17 nt, Haemophilus influenzae Rd
cuaauugcggaaaaauu

SEQ ID NO: 698263 - RNA, 18 nt, Haemophilus influenzae Rd
cuaauugugcuaaauaau

SEQ ID NO: 698264 - RNA, 18 nt, Haemophilus influenzae Rd
cuaauuguucagcaauuu

SEQ ID NO: 698265 - RNA, 20 nt, Haemophilus influenzae Rd
cuaauuguuguaaaauaguu

SEQ ID NO: 698266 - RNA, 15 nt, Haemophilus influenzae Rd
cuaauuguuuuaaaa

SEQ ID NO: 698267 - RNA, 14 nt, Haemophilus influenzae Rd
cuaauucuuucacg

SEQ ID NO: 698268 - RNA, 12 nt, Haemophilus influenzae Rd
cuaauucuucca

SEQ ID NO: 698269 - RNA, 21 nt, Haemophilus influenzae Rd
cuaauucuucccagcguaaaa

SEQ ID NO: 698270 - RNA, 18 nt, Haemophilus influenzae Rd
cuaauucuugccagauuu

SEQ ID NO: 698271 - RNA, 16 nt, Haemophilus influenzae Rd
cuaauucggaagaauu

SEQ ID NO: 698272 - RNA, 15 nt, Haemophilus influenzae Rd
cuaauucguuaauaa

SEQ ID NO: 698273 - RNA, 16 nt, Haemophilus influenzae Rd
cuaauucugcuuuucc

SEQ ID NO: 698274 - RNA, 19 nt, Haemophilus influenzae Rd
cuaauucugcuuuuccaua

SEQ ID NO: 698275 - RNA, 21 nt, Haemophilus influenzae Rd
cuaauauuucuugaguauauc

SEQ ID NO: 698276 - RNA, 19 nt, Haemophilus influenzae Rd
cuaauaggaguaaaaauau

SEQ ID NO: 698277 - RNA, 21 nt, Haemophilus influenzae Rd
cuaauaggaguaaaaauauua

SEQ ID NO: 698278 - RNA, 18 nt, Haemophilus influenzae Rd
cuaauaccgcguauuauc

SEQ ID NO: 698279 - RNA, 13 nt, Haemophilus influenzae Rd
cuaauacgucaau

SEQ ID NO: 698280 - RNA, 16 nt, Haemophilus influenzae Rd
cuaauagaaaaaugcc

SEQ ID NO: 698281 - RNA, 22 nt, Haemophilus influenzae Rd
cuaauaagaagcugcuuuuaau

SEQ ID NO: 698282 - RNA, 22 nt, Haemophilus influenzae Rd
cuaauaagccgccugauguuug

SEQ ID NO: 698283 - RNA, 17 nt, Haemophilus influenzae Rd
cuaauaauaagauuuuu

SEQ ID NO: 698284 - RNA, 21 nt, Haemophilus influenzae Rd
cuaauaauccucuuuaaaauu

SEQ ID NO: 698285 - RNA, 13 nt, Haemophilus influenzae Rd
cuaauaaucuauu

SEQ ID NO: 698286 - RNA, 15 nt, Haemophilus influenzae Rd
cuaauaaucuauuuc

SEQ ID NO: 698287 - RNA, 18 nt, Haemophilus influenzae Rd
cuaaugccauugcuagcc

SEQ ID NO: 698288 - RNA, 16 nt, Haemophilus influenzae Rd
cuaaugcccacgucca

SEQ ID NO: 698289 - RNA, 15 nt, Haemophilus influenzae Rd
cuaaugcaaaauuag

SEQ ID NO: 698290 - RNA, 22 nt, Haemophilus influenzae Rd
cuaauggcccguguuucaauuc

SEQ ID NO: 698291 - RNA, 22 nt, Haemophilus influenzae Rd
cuaaugcuuuaauuuguuuuuc

SEQ ID NO: 698292 - RNA, 20 nt, Haemophilus influenzae Rd
cuaaugauuaauuaaauuac

SEQ ID NO: 698293 - RNA, 22 nt, Haemophilus influenzae Rd
cuaaugagcguuuaacugcuuu

SEQ ID NO: 698294 - RNA, 17 nt, Haemophilus influenzae Rd
cuaaugaugcuucagcg

SEQ ID NO: 698295 - RNA, 14 nt, Haemophilus influenzae Rd
cuaaucuuaaaaaa

SEQ ID NO: 698296 - RNA, 16 nt, Haemophilus influenzae Rd
cuaaucuuaaaaaauc

SEQ ID NO: 698297 - RNA, 17 nt, Haemophilus influenzae Rd
cuaaucuuaaaaaauca

SEQ ID NO: 698298 - RNA, 15 nt, Haemophilus influenzae Rd
cuaaucgguacuuca

SEQ ID NO: 698299 - RNA, 19 nt, Haemophilus influenzae Rd
cuaaucgguacuucacagu

SEQ ID NO: 698300 - RNA, 17 nt, Haemophilus influenzae Rd
cuaaucguccaauuuca

SEQ ID NO: 698301 - RNA, 21 nt, Haemophilus influenzae Rd
cuaaucauuaacaaauucucg

SEQ ID NO: 698302 - RNA, 14 nt, Haemophilus influenzae Rd
cuaauccaaaucaa

SEQ ID NO: 698303 - RNA, 22 nt, Haemophilus influenzae Rd
cuaagguauaaauaauuuucuu

SEQ ID NO: 698304 - RNA, 19 nt, Haemophilus influenzae Rd
cuaagguuuccauaauguu

SEQ ID NO: 698305 - RNA, 14 nt, Haemophilus influenzae Rd
cuaaguacaaaaga

SEQ ID NO: 698306 - RNA, 15 nt, Haemophilus influenzae Rd
cuaaguacaaaagag

SEQ ID NO: 698307 - RNA, 12 nt, Haemophilus influenzae Rd
cuaauaaaccaa

SEQ ID NO: 698308 - RNA, 12 nt, Haemophilus influenzae Rd
cuaauaaaaauc

SEQ ID NO: 698309 - RNA, 15 nt, Haemophilus influenzae Rd
cuaaguucuauaauu

SEQ ID NO: 698310 - RNA, 21 nt, Haemophilus influenzae Rd
cuaaguuuaagugguuucaac

SEQ ID NO: 698311 - RNA, 15 nt, Haemophilus influenzae Rd
cuaagucaggaauaa

SEQ ID NO: 698312 - RNA, 22 nt, Haemophilus influenzae Rd
cuaaguguuuccgugauuucuu

SEQ ID NO: 698313 - RNA, 13 nt, Haemophilus influenzae Rd
cuaagaaaauaga

SEQ ID NO: 698314 - RNA, 17 nt, Haemophilus influenzae Rd
cuaagacaucacggguu

SEQ ID NO: 698315 - RNA, 13 nt, Haemophilus influenzae Rd
cuaacuuuuaauu

SEQ ID NO: 698316 - RNA, 15 nt, Haemophilus influenzae Rd
cuaagccgcuauugu

SEQ ID NO: 698317 - RNA, 16 nt, Haemophilus influenzae Rd
cuaagccuaagccaaa

SEQ ID NO: 698318 - RNA, 14 nt, Haemophilus influenzae Rd
cuaagauugacaac

SEQ ID NO: 698319 - RNA, 19 nt, Haemophilus influenzae Rd
cuaagauugcaagugagcu

SEQ ID NO: 698320 - RNA, 15 nt, Haemophilus influenzae Rd
cuaaccgcacuuugg

SEQ ID NO: 698321 - RNA, 24 nt, Haemophilus influenzae Rd
cuaacgacccaauuagaugauuuu

SEQ ID NO: 698322 - RNA, 15 nt, Haemophilus influenzae Rd
cuaacgcuuuuaaac

SEQ ID NO: 698323 - RNA, 16 nt, Haemophilus influenzae Rd
cuaacgcuuuuaaacg

SEQ ID NO: 698324 - RNA, 15 nt, Haemophilus influenzae Rd
cuaacggcaaauaac

SEQ ID NO: 698325 - RNA, 22 nt, Haemophilus influenzae Rd
cuaacucaaaauacucacaagu

SEQ ID NO: 698326 - RNA, 19 nt, Haemophilus influenzae Rd
cuaacuaaggugcagauuu

SEQ ID NO: 698327 - RNA, 15 nt, Haemophilus influenzae Rd
cuaaacgaucuaaua

SEQ ID NO: 698328 - RNA, 20 nt, Haemophilus influenzae Rd
cuaaacgaugugcauugaau

SEQ ID NO: 698329 - RNA, 18 nt, Haemophilus influenzae Rd
cuaacaaaugauuagaag

SEQ ID NO: 698330 - RNA, 13 nt, Haemophilus influenzae Rd
cuaaaccugcuuc

SEQ ID NO: 698331 - RNA, 23 nt, Haemophilus influenzae Rd
cuaaaccuuauuuuaaauaaaaa

SEQ ID NO: 698332 - RNA, 14 nt, Haemophilus influenzae Rd
cuaaacgaaugaag

SEQ ID NO: 698333 - RNA, 21 nt, Haemophilus influenzae Rd
cuaaacgaaugaaguuagaaa

SEQ ID NO: 698334 - RNA, 23 nt, Haemophilus influenzae Rd
cuaaaccagaaguagcaacacca

SEQ ID NO: 698335 - RNA, 13 nt, Haemophilus influenzae Rd
cuaaaccagcaag

SEQ ID NO: 698336 - RNA, 14 nt, Haemophilus influenzae Rd
cuaaaccauuuugg

SEQ ID NO: 698337 - RNA, 12 nt, Haemophilus influenzae Rd
cuaaacccauuu

SEQ ID NO: 698338 - RNA, 16 nt, Haemophilus influenzae Rd
cuaaacccgcaauuaa

SEQ ID NO: 698339 - RNA, 20 nt, Haemophilus influenzae Rd
cuaacaccauugagcauuuu

SEQ ID NO: 698340 - RNA, 22 nt, Haemophilus influenzae Rd
cuaacaccauugagcauuuuuu

SEQ ID NO: 698341 - RNA, 14 nt, Haemophilus influenzae Rd
cuaacacagucaua

SEQ ID NO: 698342 - RNA, 12 nt, Haemophilus influenzae Rd
cuaacaaucgac

SEQ ID NO: 698343 - RNA, 20 nt, Haemophilus influenzae Rd
cuaacaaucgacuuugucca

SEQ ID NO: 698344 - RNA, 18 nt, Haemophilus influenzae Rd
cuaacccccuuaauucua

SEQ ID NO: 698345 - RNA, 15 nt, Haemophilus influenzae Rd
cuaaccccuuuucug

SEQ ID NO: 698346 - RNA, 20 nt, Haemophilus influenzae Rd
cuaacccgauaacuaauuuc

SEQ ID NO: 698347 - RNA, 16 nt, Haemophilus influenzae Rd
cuaaccgacugagcua

SEQ ID NO: 698348 - RNA, 21 nt, Haemophilus influenzae Rd
cguucuaauguuaauuuuaaa

SEQ ID NO: 698349 - RNA, 18 nt, Haemophilus influenzae Rd
cguucuaaagauuuaugu

SEQ ID NO: 698350 - RNA, 22 nt, Haemophilus influenzae Rd
cguucuaaagcacguuucauca

SEQ ID NO: 698351 - RNA, 14 nt, Haemophilus influenzae Rd
cguucuaguuuuuc

SEQ ID NO: 698352 - RNA, 23 nt, Haemophilus influenzae Rd
cguucuauauuuugaauaauaaa

SEQ ID NO: 698353 - RNA, 15 nt, Haemophilus influenzae Rd
cguugagccaauuuu

SEQ ID NO: 698354 - RNA, 13 nt, Haemophilus influenzae Rd
cguugaguaaaua

SEQ ID NO: 698355 - RNA, 12 nt, Haemophilus influenzae Rd
cguucauauuug

SEQ ID NO: 698356 - RNA, 23 nt, Haemophilus influenzae Rd
cguucacguaaguaguaaaguuu

SEQ ID NO: 698357 - RNA, 12 nt, Haemophilus influenzae Rd
cguucaauauua

SEQ ID NO: 698358 - RNA, 19 nt, Haemophilus influenzae Rd
cguuagugcugcuguuuua

SEQ ID NO: 698359 - RNA, 18 nt, Haemophilus influenzae Rd
cguuauuaugaaauuugu

SEQ ID NO: 698360 - RNA, 20 nt, Haemophilus influenzae Rd
cguuaggcgugcguuuuuuu

SEQ ID NO: 698361 - RNA, 15 nt, Haemophilus influenzae Rd
cguuagccgauuuac

SEQ ID NO: 698362 - RNA, 15 nt, Haemophilus influenzae Rd
cguuagauacuuuac

SEQ ID NO: 698363 - RNA, 20 nt, Haemophilus influenzae Rd
cguuuucgaguaauuucaua

SEQ ID NO: 698364 - RNA, 15 nt, Haemophilus influenzae Rd
cguuuucugcuucag

SEQ ID NO: 698365 - RNA, 12 nt, Haemophilus influenzae Rd
cguuuuuuauaa

SEQ ID NO: 698366 - RNA, 20 nt, Haemophilus influenzae Rd
cguuuuuuauaaacuucugc

SEQ ID NO: 698367 - RNA, 16 nt, Haemophilus influenzae Rd
cguuuuuucuuuuucc

SEQ ID NO: 698368 - RNA, 19 nt, Haemophilus influenzae Rd
cguuuuuacgugcgaauuu

SEQ ID NO: 698369 - RNA, 13 nt, Haemophilus influenzae Rd
cguuuuucuuaaa

SEQ ID NO: 698370 - RNA, 12 nt, Haemophilus influenzae Rd
cguuuuuuacuu

SEQ ID NO: 698371 - RNA, 18 nt, Haemophilus influenzae Rd
cguuuuuuagaaagggcg

SEQ ID NO: 698372 - RNA, 13 nt, Haemophilus influenzae Rd
cuaaaacgaacaa

SEQ ID NO: 698373 - RNA, 18 nt, Haemophilus influenzae Rd
cuaaaaaaguuuaagccc

SEQ ID NO: 698374 - RNA, 12 nt, Haemophilus influenzae Rd
cuaaaaaauaac

SEQ ID NO: 698375 - RNA, 22 nt, Haemophilus influenzae Rd
cuaaaaaacccguaauuaaaaa

SEQ ID NO: 698376 - RNA, 18 nt, Haemophilus influenzae Rd
cuaaaaaauaguuaauaa

SEQ ID NO: 698377 - RNA, 15 nt, Haemophilus influenzae Rd
cuaaaagugcggcuu

SEQ ID NO: 698378 - RNA, 13 nt, Haemophilus influenzae Rd
cuaaaaggacuaa

SEQ ID NO: 698379 - RNA, 16 nt, Haemophilus influenzae Rd
cuaaaauugauuucau

SEQ ID NO: 698380 - RNA, 19 nt, Haemophilus influenzae Rd
cuaaacagaauuuacgaaa

SEQ ID NO: 698381 - RNA, 18 nt, Haemophilus influenzae Rd
cuaaacacauaauauuuu

SEQ ID NO: 698382 - RNA, 14 nt, Haemophilus influenzae Rd
cguuguaagcaaaa

SEQ ID NO: 698383 - RNA, 23 nt, Haemophilus influenzae Rd
cguuguaauugauucgauaaauu

SEQ ID NO: 698384 - RNA, 17 nt, Haemophilus influenzae Rd
cguuguuguucuuucca

SEQ ID NO: 698385 - RNA, 17 nt, Haemophilus influenzae Rd
cguuguucuucuguuaa

SEQ ID NO: 698386 - RNA, 20 nt, Haemophilus influenzae Rd
cguuugguaaacgaacuuca

SEQ ID NO: 698387 - RNA, 20 nt, Haemophilus influenzae Rd
cguuugguucgauaaacauu

SEQ ID NO: 698388 - RNA, 22 nt, Haemophilus influenzae Rd
cguuuuaaaaucucucaaaaau

SEQ ID NO: 698389 - RNA, 14 nt, Haemophilus influenzae Rd
cguuuuaauaaaaa

SEQ ID NO: 698390 - RNA, 13 nt, Haemophilus influenzae Rd
cguuuuaauaguu

SEQ ID NO: 698391 - RNA, 22 nt, Haemophilus influenzae Rd
cguuuuaauccuuccaaaucca

SEQ ID NO: 698392 - RNA, 23 nt, Haemophilus influenzae Rd
cucauucaucaaaucauuuuuug

SEQ ID NO: 698393 - RNA, 22 nt, Haemophilus influenzae Rd
cucauucgaauauugaucaucu

SEQ ID NO: 698394 - RNA, 15 nt, Haemophilus influenzae Rd
cucauuacacaaaau

SEQ ID NO: 698395 - RNA, 17 nt, Haemophilus influenzae Rd
cuccaagaauauuucac

SEQ ID NO: 698396 - RNA, 19 nt, Haemophilus influenzae Rd
cuccaaauauaaaauaaaa

SEQ ID NO: 698397 - RNA, 14 nt, Haemophilus influenzae Rd
cuccaaaaguugga

SEQ ID NO: 698398 - RNA, 12 nt, Haemophilus influenzae Rd
cucauuuugcuc

SEQ ID NO: 698399 - RNA, 17 nt, Haemophilus influenzae Rd
cucauugcugcuuuaau

SEQ ID NO: 698400 - RNA, 20 nt, Haemophilus influenzae Rd
cucauugcugcuuuaauuuc

SEQ ID NO: 698401 - RNA, 12 nt, Haemophilus influenzae Rd
cucauugugauc

SEQ ID NO: 698402 - RNA, 22 nt, Haemophilus influenzae Rd
cucauuuaaccguaauuucaaa

SEQ ID NO: 698403 - RNA, 20 nt, Haemophilus influenzae Rd
cuccaccuugaauugcauuu

SEQ ID NO: 698404 - RNA, 21 nt, Haemophilus influenzae Rd
cuccacgagacacacuaauca

SEQ ID NO: 698405 - RNA, 13 nt, Haemophilus influenzae Rd
cuccaaucaucau

SEQ ID NO: 698406 - RNA, 14 nt, Haemophilus influenzae Rd
cucccaaaaacuaa

SEQ ID NO: 698407 - RNA, 21 nt, Haemophilus influenzae Rd
cucccaaagaagcuuuccauc

SEQ ID NO: 698408 - RNA, 16 nt, Haemophilus influenzae Rd
cuccauugcaauuuca

SEQ ID NO: 698409 - RNA, 18 nt, Haemophilus influenzae Rd
cuccauugcaauuucagc

SEQ ID NO: 698410 - RNA, 18 nt, Haemophilus influenzae Rd
cucccauucuuaaaucau

SEQ ID NO: 698411 - RNA, 13 nt, Haemophilus influenzae Rd
cucccauggccaa

SEQ ID NO: 698412 - RNA, 17 nt, Haemophilus influenzae Rd
cucccccccaauaaaaa

SEQ ID NO: 698413 - RNA, 15 nt, Haemophilus influenzae Rd
cuccgauacauaaua

SEQ ID NO: 698414 - RNA, 14 nt, Haemophilus influenzae Rd
cuccuauuaguauu

SEQ ID NO: 698415 - RNA, 23 nt, Haemophilus influenzae Rd
cuccuacaucgccuugcauaauu

SEQ ID NO: 698416 - RNA, 14 nt, Haemophilus influenzae Rd
cuccuccuaaugca

SEQ ID NO: 698417 - RNA, 20 nt, Haemophilus influenzae Rd
cucgaacauucccuuuccaa

SEQ ID NO: 698418 - RNA, 17 nt, Haemophilus influenzae Rd
cucgcauugauucuuua

SEQ ID NO: 698419 - RNA, 14 nt, Haemophilus influenzae Rd
cucgccaaaucuca

SEQ ID NO: 698420 - RNA, 14 nt, Haemophilus influenzae Rd
cucgccuugcaaau

SEQ ID NO: 698421 - RNA, 16 nt, Haemophilus influenzae Rd
cucgccauaauaaaaa

SEQ ID NO: 698422 - RNA, 16 nt, Haemophilus influenzae Rd
cucgccauuuugagga

SEQ ID NO: 698423 - RNA, 13 nt, Haemophilus influenzae Rd
cucgccauuuuuc

SEQ ID NO: 698424 - RNA, 20 nt, Haemophilus influenzae Rd
cucuaaccuaaaauagagca

SEQ ID NO: 698425 - RNA, 15 nt, Haemophilus influenzae Rd
cucuaacgcauucaa

SEQ ID NO: 698426 - RNA, 20 nt, Haemophilus influenzae Rd
cucuaacgcauucaaaucua

SEQ ID NO: 698427 - RNA, 19 nt, Haemophilus influenzae Rd
cucuaaaugugauuuccau

SEQ ID NO: 698428 - RNA, 16 nt, Haemophilus influenzae Rd
cucuaacaauauuuca

SEQ ID NO: 698429 - RNA, 20 nt, Haemophilus influenzae Rd
cucguuguucuuuauaagaa

SEQ ID NO: 698430 - RNA, 17 nt, Haemophilus influenzae Rd
cucguugccauaaaaaa

SEQ ID NO: 698431 - RNA, 17 nt, Haemophilus influenzae Rd
cucguuauuauuaagug

SEQ ID NO: 698432 - RNA, 14 nt, Haemophilus influenzae Rd
cucgugauuaucua

SEQ ID NO: 698433 - RNA, 18 nt, Haemophilus influenzae Rd
cucgugauuaucuaaauu

SEQ ID NO: 698434 - RNA, 21 nt, Haemophilus influenzae Rd
cucgcugaauuauugucuuuu

SEQ ID NO: 698435 - RNA, 19 nt, Haemophilus influenzae Rd
cucgggcugaaauaccuuc

SEQ ID NO: 698436 - RNA, 14 nt, Haemophilus influenzae Rd
cuaugcugaaugug

SEQ ID NO: 698437 - RNA, 17 nt, Haemophilus influenzae Rd
cuauggcaaugaauaaa

SEQ ID NO: 698438 - RNA, 16 nt, Haemophilus influenzae Rd
cuauucaucuaaaaaa

SEQ ID NO: 698439 - RNA, 20 nt, Haemophilus influenzae Rd
cuauuauuccaaauaucuuc

SEQ ID NO: 698440 - RNA, 21 nt, Haemophilus influenzae Rd
cuauuaucauaaacaauuuca

SEQ ID NO: 698441 - RNA, 23 nt, Haemophilus influenzae Rd
cuauucaaugcaccuaagucagg

SEQ ID NO: 698442 - RNA, 18 nt, Haemophilus influenzae Rd
cuauagauuuauuuacug

SEQ ID NO: 698443 - RNA, 20 nt, Haemophilus influenzae Rd
cuaucuuguaauuuuuucuc

SEQ ID NO: 698444 - RNA, 13 nt, Haemophilus influenzae Rd
cuaucucauccac

SEQ ID NO: 698445 - RNA, 16 nt, Haemophilus influenzae Rd
cuaucugcuuuucuuc

SEQ ID NO: 698446 - RNA, 23 nt, Haemophilus influenzae Rd
cuauuuacguaaaaaaguuugau

SEQ ID NO: 698447 - RNA, 14 nt, Haemophilus influenzae Rd
cuauuuaagccuug

SEQ ID NO: 698448 - RNA, 17 nt, Haemophilus influenzae Rd
cuauuuacuguuuuuau

SEQ ID NO: 698449 - RNA, 18 nt, Haemophilus influenzae Rd
cuauuuauaauccauuca

SEQ ID NO: 698450 - RNA, 17 nt, Haemophilus influenzae Rd
cuauuucagcuugaagu

SEQ ID NO: 698451 - RNA, 17 nt, Haemophilus influenzae Rd
cuauuuauccccaauua

SEQ ID NO: 698452 - RNA, 16 nt, Haemophilus influenzae Rd
cuauuguuuuuuucua

SEQ ID NO: 698453 - RNA, 14 nt, Haemophilus influenzae Rd
cuauuggcaucaaa

SEQ ID NO: 698454 - RNA, 15 nt, Haemophilus influenzae Rd
cuauugaaaauuaaa

SEQ ID NO: 698455 - RNA, 22 nt, Haemophilus influenzae Rd
cuauucuaaccgcacuuuuuaa

SEQ ID NO: 698456 - RNA, 23 nt, Haemophilus influenzae Rd
cuauucuaaccgcacuuuuuaau

SEQ ID NO: 698457 - RNA, 15 nt, Haemophilus influenzae Rd
cuauucgcugauaaa

SEQ ID NO: 698458 - RNA, 14 nt, Haemophilus influenzae Rd
cuauuccuaaugcg

SEQ ID NO: 698459 - RNA, 14 nt, Haemophilus influenzae Rd
cuauuuuauuuaga

SEQ ID NO: 698460 - RNA, 11 nt, Haemophilus influenzae Rd
cuauuuuaaaa

SEQ ID NO: 698461 - RNA, 19 nt, Haemophilus influenzae Rd
cuauuuuauaauuaauaaa

SEQ ID NO: 698462 - RNA, 19 nt, Haemophilus influenzae Rd
cuauuuuuaauuuacugga

SEQ ID NO: 698463 - RNA, 17 nt, Haemophilus influenzae Rd
cuauuuuuaauuuugaa

SEQ ID NO: 698464 - RNA, 15 nt, Haemophilus influenzae Rd
cuauuuuuagaaaau

SEQ ID NO: 698465 - RNA, 19 nt, Haemophilus influenzae Rd
cucaaaaaguuaaauaagc

SEQ ID NO: 698466 - RNA, 15 nt, Haemophilus influenzae Rd
cucaccauuuugccc

SEQ ID NO: 698467 - RNA, 17 nt, Haemophilus influenzae Rd
cucaauuauuuauacua

SEQ ID NO: 698468 - RNA, 22 nt, Haemophilus influenzae Rd
cucacaauaauaggcgaaucaa

SEQ ID NO: 698469 - RNA, 18 nt, Haemophilus influenzae Rd
cucaaaaauuucagaauu

SEQ ID NO: 698470 - RNA, 21 nt, Haemophilus influenzae Rd
cucaaaauuaugacggauuac

SEQ ID NO: 698471 - RNA, 23 nt, Haemophilus influenzae Rd
cucaaucucuuuacuguucaaau

SEQ ID NO: 698472 - RNA, 14 nt, Haemophilus influenzae Rd
cucaaugaauuaaa

SEQ ID NO: 698473 - RNA, 13 nt, Haemophilus influenzae Rd
cucacuuuauaua

SEQ ID NO: 698474 - RNA, 14 nt, Haemophilus influenzae Rd
cucagccaaacugc

SEQ ID NO: 698475 - RNA, 19 nt, Haemophilus influenzae Rd
cucagcgugaauauaagaa

SEQ ID NO: 698476 - RNA, 13 nt, Haemophilus influenzae Rd
cuaguuuuccuuu

SEQ ID NO: 698477 - RNA, 13 nt, Haemophilus influenzae Rd
cuaguuuuuuccc

SEQ ID NO: 698478 - RNA, 15 nt, Haemophilus influenzae Rd
cuaguucuuccccuc

SEQ ID NO: 698479 - RNA, 16 nt, Haemophilus influenzae Rd
cuaguucuuccuuggu

SEQ ID NO: 698480 - RNA, 12 nt, Haemophilus influenzae Rd
cuauaaaagaag

SEQ ID NO: 698481 - RNA, 20 nt, Haemophilus influenzae Rd
cuagugaaauauuuacuuca

SEQ ID NO: 698482 - RNA, 14 nt, Haemophilus influenzae Rd
cuagucccgcuuuu

SEQ ID NO: 698483 - RNA, 19 nt, Haemophilus influenzae Rd
cuagucccgcuuuugccau

SEQ ID NO: 698484 - RNA, 23 nt, Haemophilus influenzae Rd
cuaguccugcagccgccauggaa

SEQ ID NO: 698485 - RNA, 13 nt, Haemophilus influenzae Rd
cuaguauuuuugu

SEQ ID NO: 698486 - RNA, 23 nt, Haemophilus influenzae Rd
cuagacuuucuuguauugccacu

SEQ ID NO: 698487 - RNA, 19 nt, Haemophilus influenzae Rd
cuagcaucaaaauaaauaa

SEQ ID NO: 698488 - RNA, 23 nt, Haemophilus influenzae Rd
cuagcaucaaaauaaauaaaaua

SEQ ID NO: 698489 - RNA, 22 nt, Haemophilus influenzae Rd
cuagagauauaagaaauaaucg

SEQ ID NO: 698490 - RNA, 19 nt, Haemophilus influenzae Rd
cuacggcguagaaugcaaa

SEQ ID NO: 698491 - RNA, 16 nt, Haemophilus influenzae Rd
cuacggucgcaccacc

SEQ ID NO: 698492 - RNA, 20 nt, Haemophilus influenzae Rd
cuacgccuaauucaucuucu

SEQ ID NO: 698493 - RNA, 15 nt, Haemophilus influenzae Rd
cuacguguagaagcg

SEQ ID NO: 698494 - RNA, 21 nt, Haemophilus influenzae Rd
cuacguaaggaucuuuuucuu

SEQ ID NO: 698495 - RNA, 14 nt, Haemophilus influenzae Rd
cuacuaaaaauugc

SEQ ID NO: 698496 - RNA, 13 nt, Haemophilus influenzae Rd
cuacuaaaauaag

SEQ ID NO: 698497 - RNA, 18 nt, Haemophilus influenzae Rd
cuacuaaacgcacuuuuu

SEQ ID NO: 698498 - RNA, 13 nt, Haemophilus influenzae Rd
cuagaaaacucau

SEQ ID NO: 698499 - RNA, 20 nt, Haemophilus influenzae Rd
cuacauuugccccaacaaca

SEQ ID NO: 698500 - RNA, 21 nt, Haemophilus influenzae Rd
cuacauuuaagcguuuaauau

SEQ ID NO: 698501 - RNA, 14 nt, Haemophilus influenzae Rd
cuaccaauauucuu

SEQ ID NO: 698502 - RNA, 23 nt, Haemophilus influenzae Rd
cuaccaauauucuuuaaaacauu

SEQ ID NO: 698503 - RNA, 18 nt, Haemophilus influenzae Rd
cuaccaauucaaaaacca

SEQ ID NO: 698504 - RNA, 18 nt, Haemophilus influenzae Rd
cuaccacgauacggcaaa

SEQ ID NO: 698505 - RNA, 13 nt, Haemophilus influenzae Rd
cuaccauuuaucu

SEQ ID NO: 698506 - RNA, 13 nt, Haemophilus influenzae Rd
cuacccacacacc

SEQ ID NO: 698507 - RNA, 14 nt, Haemophilus influenzae Rd
cuacccacacaccu

SEQ ID NO: 698508 - RNA, 22 nt, Haemophilus influenzae Rd
cuaccauggugccuucgccaac

SEQ ID NO: 698509 - RNA, 15 nt, Haemophilus influenzae Rd
cuaccgcauuuuuaa

SEQ ID NO: 698510 - RNA, 18 nt, Haemophilus influenzae Rd
cuaccugauaccaccaca

SEQ ID NO: 698511 - RNA, 18 nt, Haemophilus influenzae Rd
cuaccuaaaauaaauuuu

SEQ ID NO: 698512 - RNA, 14 nt, Haemophilus influenzae Rd
cuacagcaaauccu

SEQ ID NO: 698513 - RNA, 16 nt, Haemophilus influenzae Rd
cuacagugacuaaaac

SEQ ID NO: 698514 - RNA, 16 nt, Haemophilus influenzae Rd
cuacagauacagaagg

SEQ ID NO: 698515 - RNA, 14 nt, Haemophilus influenzae Rd
cuacaucaacaaau

SEQ ID NO: 698516 - RNA, 23 nt, Haemophilus influenzae Rd
cuacaucuaaaccgauagcuuuu

SEQ ID NO: 698517 - RNA, 14 nt, Haemophilus influenzae Rd
cuacauucaucaaa

SEQ ID NO: 698518 - RNA, 14 nt, Haemophilus influenzae Rd
cuacauuaaaagau

SEQ ID NO: 698519 - RNA, 15 nt, Haemophilus influenzae Rd
cuacauuaaucacca

SEQ ID NO: 698520 - RNA, 18 nt, Haemophilus influenzae Rd
cuacaauuucauuaauuu

SEQ ID NO: 698521 - RNA, 23 nt, Haemophilus influenzae Rd
cuacacccucaguuaccauacag

SEQ ID NO: 698522 - RNA, 17 nt, Haemophilus influenzae Rd
cuacaccgauuucuuua

SEQ ID NO: 698523 - RNA, 19 nt, Haemophilus influenzae Rd
cuacaccgauuucuuuaca

SEQ ID NO: 698524 - RNA, 15 nt, Haemophilus influenzae Rd
cuacaauauuuauuu

SEQ ID NO: 698525 - RNA, 18 nt, Haemophilus influenzae Rd
cuacaauauuuauuucua

SEQ ID NO: 698526 - RNA, 13 nt, Haemophilus influenzae Rd
cuacaaucaaaaa

SEQ ID NO: 698527 - RNA, 17 nt, Haemophilus influenzae Rd
cuacaaucaaaaaaucu

SEQ ID NO: 698528 - RNA, 16 nt, Haemophilus influenzae Rd
cuacaagaaaccaaaa

SEQ ID NO: 698529 - RNA, 15 nt, Haemophilus influenzae Rd
cuacaaugcucacuu

SEQ ID NO: 698530 - RNA, 15 nt, Haemophilus influenzae Rd
cuacaccaaaaccaa

SEQ ID NO: 698531 - RNA, 22 nt, Haemophilus influenzae Rd
aaaaaaagaccgcacuuuuaaa

SEQ ID NO: 698532 - RNA, 19 nt, Haemophilus influenzae Rd
aaaaaaacccaguuuuaaa

SEQ ID NO: 698533 - RNA, 12 nt, Haemophilus influenzae Rd
aaaaaaagaaaa

SEQ ID NO: 698534 - RNA, 14 nt, Haemophilus influenzae Rd
aaaaaaccgacuuu

SEQ ID NO: 698535 - RNA, 15 nt, Haemophilus influenzae Rd
aaaaaacauuaauuu

SEQ ID NO: 698536 - RNA, 13 nt, Haemophilus influenzae Rd
aaaaaaauaaaaa

SEQ ID NO: 698537 - RNA, 12 nt, Haemophilus influenzae Rd
aaaaaaagcaau

SEQ ID NO: 698538 - RNA, 13 nt, Haemophilus influenzae Rd
aaaaaaagcaaua

SEQ ID NO: 698539 - RNA, 22 nt, Haemophilus influenzae Rd
aaaaaagaccgcacuuuuaaag

SEQ ID NO: 698540 - RNA, 14 nt, Haemophilus influenzae Rd
aaaaaagcgaauuu

SEQ ID NO: 698541 - RNA, 20 nt, Haemophilus influenzae Rd
aaaaaagaccgcacuuuaaa

SEQ ID NO: 698542 - RNA, 22 nt, Haemophilus influenzae Rd
aaaaaagaccgcacuuuaaaag

SEQ ID NO: 698543 - RNA, 17 nt, Haemophilus influenzae Rd
aaaaaagaaaaccaaaa

SEQ ID NO: 698544 - RNA, 16 nt, Haemophilus influenzae Rd
aaaaaacguuaaauuu

SEQ ID NO: 698545 - RNA, 13 nt, Haemophilus influenzae Rd
aaaaacaagagga

SEQ ID NO: 698546 - RNA, 23 nt, Haemophilus influenzae Rd
aaaaaauuaaauuguaacuauau

SEQ ID NO: 698547 - RNA, 22 nt, Haemophilus influenzae Rd
aaaaaauuuauaggcuucguuu

SEQ ID NO: 698548 - RNA, 13 nt, Haemophilus influenzae Rd
aaaacaguaauga

SEQ ID NO: 698549 - RNA, 15 nt, Haemophilus influenzae Rd
aaaacaguauuuucc

SEQ ID NO: 698550 - RNA, 22 nt, Haemophilus influenzae Rd
aaaacaguuaucgccaauaaua

SEQ ID NO: 698551 - RNA, 18 nt, Haemophilus influenzae Rd
aaaacauaguaaauuuua

SEQ ID NO: 698552 - RNA, 21 nt, Haemophilus influenzae Rd
aaaacauaguaaauuuuaacc

SEQ ID NO: 698553 - RNA, 15 nt, Haemophilus influenzae Rd
aaaacauaauaaaau

SEQ ID NO: 698554 - RNA, 15 nt, Haemophilus influenzae Rd
aaaacauaauugagu

SEQ ID NO: 698555 - RNA, 14 nt, Haemophilus influenzae Rd
aaaaccacaagaug

SEQ ID NO: 698556 - RNA, 13 nt, Haemophilus influenzae Rd
aaaacaaaaaagu

SEQ ID NO: 698557 - RNA, 11 nt, Haemophilus influenzae Rd
aaaacaaaagg

SEQ ID NO: 698558 - RNA, 21 nt, Haemophilus influenzae Rd
aaaacaaaagaaauuuuaacc

SEQ ID NO: 698559 - RNA, 20 nt, Haemophilus influenzae Rd
aaaaccccguucaauuugaa

SEQ ID NO: 698560 - RNA, 17 nt, Haemophilus influenzae Rd
aaaacccguaauuaaaa

SEQ ID NO: 698561 - RNA, 18 nt, Haemophilus influenzae Rd
aaaacccguaauuaaaaa

SEQ ID NO: 698562 - RNA, 12 nt, Haemophilus influenzae Rd
aaaaccuaacau

SEQ ID NO: 698563 - RNA, 21 nt, Haemophilus influenzae Rd
aaaaauugaucuaaauuaucg

SEQ ID NO: 698564 - RNA, 14 nt, Haemophilus influenzae Rd
aaaaauucuuuuau

SEQ ID NO: 698565 - RNA, 20 nt, Haemophilus influenzae Rd
aaaaauucuuuuuucuuccu

SEQ ID NO: 698566 - RNA, 18 nt, Haemophilus influenzae Rd
aaaaauuggaaaauaaaa

SEQ ID NO: 698567 - RNA, 21 nt, Haemophilus influenzae Rd
aaaaauugguacgagaaaaau

SEQ ID NO: 698568 - RNA, 16 nt, Haemophilus influenzae Rd
aaaaauuuaaauauaa

SEQ ID NO: 698569 - RNA, 21 nt, Haemophilus influenzae Rd
aaaaauuuaauacuuucagcu

SEQ ID NO: 698570 - RNA, 21 nt, Haemophilus influenzae Rd
aaaaauuuaggguauuuauua

SEQ ID NO: 698571 - RNA, 15 nt, Haemophilus influenzae Rd
aaaaauguuaauaca

SEQ ID NO: 698572 - RNA, 20 nt, Haemophilus influenzae Rd
aaaaauguuauaaauaaaaa

SEQ ID NO: 698573 - RNA, 10 nt, Haemophilus influenzae Rd
aaaaauuccc

SEQ ID NO: 698574 - RNA, 15 nt, Haemophilus influenzae Rd
aaaaauggaauaaaa

SEQ ID NO: 698575 - RNA, 16 nt, Haemophilus influenzae Rd
aaaaauggaauaaaaa

SEQ ID NO: 698576 - RNA, 17 nt, Haemophilus influenzae Rd
aaaaauggacagaauaa

SEQ ID NO: 698577 - RNA, 22 nt, Haemophilus influenzae Rd
aaaaauggcaacgccaauaaaa

SEQ ID NO: 698578 - RNA, 23 nt, Haemophilus influenzae Rd
aaaaauggcaacgccaauaaaaa

SEQ ID NO: 698579 - RNA, 21 nt, Haemophilus influenzae Rd
aaaaaugcguucagaauuuga

SEQ ID NO: 698580 - RNA, 16 nt, Haemophilus influenzae Rd
aaaaaugccacuaagg

SEQ ID NO: 698581 - RNA, 17 nt, Haemophilus influenzae Rd
aaaaaucuuuaccaaaa

SEQ ID NO: 698582 - RNA, 12 nt, Haemophilus influenzae Rd
aaaaaucuuuau

SEQ ID NO: 698583 - RNA, 18 nt, Haemophilus influenzae Rd
aaaaaugagauuauuucu

SEQ ID NO: 698584 - RNA, 21 nt, Haemophilus influenzae Rd
aaaaaugagauuauuucuacu

SEQ ID NO: 698585 - RNA, 21 nt, Haemophilus influenzae Rd
aaaaaugauuaaguuaaaagu

SEQ ID NO: 698586 - RNA, 15 nt, Haemophilus influenzae Rd
aaaaaguucuuucug

SEQ ID NO: 698587 - RNA, 14 nt, Haemophilus influenzae Rd
aaaaaguugaauuu

SEQ ID NO: 698588 - RNA, 22 nt, Haemophilus influenzae Rd
aaaaagugcgguaaaauuucac

SEQ ID NO: 698589 - RNA, 21 nt, Haemophilus influenzae Rd
aaaaagugcgguaaauuuuua

SEQ ID NO: 698590 - RNA, 23 nt, Haemophilus influenzae Rd
aaaaagugcggucaauaaaaaua

SEQ ID NO: 698591 - RNA, 20 nt, Haemophilus influenzae Rd
aaaaagugcggucauaaaaa

SEQ ID NO: 698592 - RNA, 21 nt, Haemophilus influenzae Rd
aaaaagugcggucauaaaaaa

SEQ ID NO: 698593 - RNA, 22 nt, Haemophilus influenzae Rd
aaaaagugcgguuaaaauucac

SEQ ID NO: 698594 - RNA, 18 nt, Haemophilus influenzae Rd
aaaaagugcgguuaauuu

SEQ ID NO: 698595 - RNA, 18 nt, Haemophilus influenzae Rd
aaaaagugcgguugauuu

SEQ ID NO: 698596 - RNA, 14 nt, Haemophilus influenzae Rd
aaaaagucaaugaa

SEQ ID NO: 698597 - RNA, 13 nt, Haemophilus influenzae Rd
aaaaagugaaaga

SEQ ID NO: 698598 - RNA, 15 nt, Haemophilus influenzae Rd
aaaaaucuuccaaua

SEQ ID NO: 698599 - RNA, 19 nt, Haemophilus influenzae Rd
aaaaaucuuccaauacaau

SEQ ID NO: 698600 - RNA, 23 nt, Haemophilus influenzae Rd
aaaaaucuuccaauacaaucagc

SEQ ID NO: 698601 - RNA, 10 nt, Haemophilus influenzae Rd
aaaaaucucu

SEQ ID NO: 698602 - RNA, 12 nt, Haemophilus influenzae Rd
aaaaaucaauca

SEQ ID NO: 698603 - RNA, 12 nt, Haemophilus influenzae Rd
aaaaauauuaaa

SEQ ID NO: 698604 - RNA, 13 nt, Haemophilus influenzae Rd
aaaaauauuaaag

SEQ ID NO: 698605 - RNA, 14 nt, Haemophilus influenzae Rd
aaaaauauuaaaga

SEQ ID NO: 698606 - RNA, 20 nt, Haemophilus influenzae Rd
aaaaauauuuuaauaaagau

SEQ ID NO: 698607 - RNA, 19 nt, Haemophilus influenzae Rd
aaaaaucaaccgcacuuuu

SEQ ID NO: 698608 - RNA, 23 nt, Haemophilus influenzae Rd
aaaaaucaaccgcacuuuuauau

SEQ ID NO: 698609 - RNA, 14 nt, Haemophilus influenzae Rd
aaaaacuaaauauu

SEQ ID NO: 698610 - RNA, 17 nt, Haemophilus influenzae Rd
aaaaacuaaccgcacuu

SEQ ID NO: 698611 - RNA, 19 nt, Haemophilus influenzae Rd
aaaaacuaaccgcacuuuu

SEQ ID NO: 698612 - RNA, 14 nt, Haemophilus influenzae Rd
aaaaacuaacgugc

SEQ ID NO: 698613 - RNA, 23 nt, Haemophilus influenzae Rd
aaaaacuagagauauaagaaaua

SEQ ID NO: 698614 - RNA, 22 nt, Haemophilus influenzae Rd
aaaaacccucaagaaacugacc

SEQ ID NO: 698615 - RNA, 18 nt, Haemophilus influenzae Rd
aaaaacgcuggaauauuu

SEQ ID NO: 698616 - RNA, 19 nt, Haemophilus influenzae Rd
aaaaacgcuggaauauuuu

SEQ ID NO: 698617 - RNA, 13 nt, Haemophilus influenzae Rd
aaaaacaagugaa

SEQ ID NO: 698618 - RNA, 22 nt, Haemophilus influenzae Rd
aaaaacaagugguggaauaaaa

SEQ ID NO: 698619 - RNA, 13 nt, Haemophilus influenzae Rd
aaaaacaccuaaa

SEQ ID NO: 698620 - RNA, 22 nt, Haemophilus influenzae Rd
aaaaacgcaucguguccguaau

SEQ ID NO: 698621 - RNA, 21 nt, Haemophilus influenzae Rd
aaaaaccuuguggcaaccaac

SEQ ID NO: 698622 - RNA, 18 nt, Haemophilus influenzae Rd
aaaaacggauuaauuucu

SEQ ID NO: 698623 - RNA, 23 nt, Haemophilus influenzae Rd
aaaaacgccucaucuuuuuuaag

SEQ ID NO: 698624 - RNA, 17 nt, Haemophilus influenzae Rd
aaaaacccaguuuuaaa

SEQ ID NO: 698625 - RNA, 18 nt, Haemophilus influenzae Rd
aaaaacccguaauuaaaa

SEQ ID NO: 698626 - RNA, 19 nt, Haemophilus influenzae Rd
aaaaacccguaauuaaaaa

SEQ ID NO: 698627 - RNA, 21 nt, Haemophilus influenzae Rd
aaaaacccguaauuaaaaaua

SEQ ID NO: 698628 - RNA, 14 nt, Haemophilus influenzae Rd
aaaaacguuaaauu

SEQ ID NO: 698629 - RNA, 17 nt, Haemophilus influenzae Rd
aaaaacguuaaauuuag

SEQ ID NO: 698630 - RNA, 15 nt, Haemophilus influenzae Rd
aaaaacguucgugcu

SEQ ID NO: 698631 - RNA, 12 nt, Haemophilus influenzae Rd
aaaaagaaauuu

SEQ ID NO: 698632 - RNA, 12 nt, Haemophilus influenzae Rd
aaaaagaaauau

SEQ ID NO: 698633 - RNA, 14 nt, Haemophilus influenzae Rd
aaaaagaaauaaaa

SEQ ID NO: 698634 - RNA, 16 nt, Haemophilus influenzae Rd
aaaaagaaauaaaaga

SEQ ID NO: 698635 - RNA, 20 nt, Haemophilus influenzae Rd
aaaaacugugcggucuguug

SEQ ID NO: 698636 - RNA, 19 nt, Haemophilus influenzae Rd
aaaaagcaccuaaaaauuu

SEQ ID NO: 698637 - RNA, 14 nt, Haemophilus influenzae Rd
aaaaagacaaaacg

SEQ ID NO: 698638 - RNA, 14 nt, Haemophilus influenzae Rd
aaaaagacgaaaau

SEQ ID NO: 698639 - RNA, 18 nt, Haemophilus influenzae Rd
aaaaagcguugaaaauaa

SEQ ID NO: 698640 - RNA, 14 nt, Haemophilus influenzae Rd
aaaaagcuaaaaaa

SEQ ID NO: 698641 - RNA, 15 nt, Haemophilus influenzae Rd
aaaaagcuaaaaaaa

SEQ ID NO: 698642 - RNA, 16 nt, Haemophilus influenzae Rd
aaaaagcuaaaaaaac

SEQ ID NO: 698643 - RNA, 17 nt, Haemophilus influenzae Rd
aaaaagcuaaaaaaaca

SEQ ID NO: 698644 - RNA, 14 nt, Haemophilus influenzae Rd
aaaaaguacuugca

SEQ ID NO: 698645 - RNA, 21 nt, Haemophilus influenzae Rd
aaaaagggcagaauuaaaucu

SEQ ID NO: 698646 - RNA, 18 nt, Haemophilus influenzae Rd
aaaaaggcugcuugauau

SEQ ID NO: 698647 - RNA, 19 nt, Haemophilus influenzae Rd
aaaaagggaugguuaauuu

SEQ ID NO: 698648 - RNA, 21 nt, Haemophilus influenzae Rd
aaaaagggaugguuaauuuuu

SEQ ID NO: 698649 - RNA, 14 nt, Haemophilus influenzae Rd
aaaaugaauuaguu

SEQ ID NO: 698650 - RNA, 17 nt, Haemophilus influenzae Rd
aaaaugagauuauuucu

SEQ ID NO: 698651 - RNA, 14 nt, Haemophilus influenzae Rd
aaaaucuuugaauu

SEQ ID NO: 698652 - RNA, 16 nt, Haemophilus influenzae Rd
aaaaugaacaaaaaau

SEQ ID NO: 698653 - RNA, 15 nt, Haemophilus influenzae Rd
aaaaugaauaaaauu

SEQ ID NO: 698654 - RNA, 18 nt, Haemophilus influenzae Rd
aaaauggcuaaauucacu

SEQ ID NO: 698655 - RNA, 23 nt, Haemophilus influenzae Rd
aaaauggcaacgccaauaaaaag

SEQ ID NO: 698656 - RNA, 24 nt, Haemophilus influenzae Rd
aaaauggguucacagagaauaaau

SEQ ID NO: 698657 - RNA, 21 nt, Haemophilus influenzae Rd
aaaauggguaaggaaaguucu

SEQ ID NO: 698658 - RNA, 22 nt, Haemophilus influenzae Rd
aaaaugguuuaaauaaccaaua

SEQ ID NO: 698659 - RNA, 14 nt, Haemophilus influenzae Rd
aaaauguaaauugg

SEQ ID NO: 698660 - RNA, 23 nt, Haemophilus influenzae Rd
aaaauguaaauuggcauuuucaa

SEQ ID NO: 698661 - RNA, 21 nt, Haemophilus influenzae Rd
aaaauguaagagugaaguuau

SEQ ID NO: 698662 - RNA, 18 nt, Haemophilus influenzae Rd
aaaauggugcuuuuuaca

SEQ ID NO: 698663 - RNA, 23 nt, Haemophilus influenzae Rd
aaaauggugcuuuuuacaacauu

SEQ ID NO: 698664 - RNA, 19 nt, Haemophilus influenzae Rd
aaaauuaccgcucuuuucg

SEQ ID NO: 698665 - RNA, 15 nt, Haemophilus influenzae Rd
aaaauuaauacugaa

SEQ ID NO: 698666 - RNA, 20 nt, Haemophilus influenzae Rd
aaaauuaaucugcauucuaa

SEQ ID NO: 698667 - RNA, 14 nt, Haemophilus influenzae Rd
aaaauuaaugccaa

SEQ ID NO: 698668 - RNA, 14 nt, Haemophilus influenzae Rd
aaaauuaagcaaua

SEQ ID NO: 698669 - RNA, 15 nt, Haemophilus influenzae Rd
aaaauuaagcaauag

SEQ ID NO: 698670 - RNA, 21 nt, Haemophilus influenzae Rd
aaaauuaaccgcacuuuagaa

SEQ ID NO: 698671 - RNA, 18 nt, Haemophilus influenzae Rd
aaaauucuucuaacauuu

SEQ ID NO: 698672 - RNA, 16 nt, Haemophilus influenzae Rd
aaaauucuauuaaaau

SEQ ID NO: 698673 - RNA, 22 nt, Haemophilus influenzae Rd
aaaauucuauuaaaauauuucc

SEQ ID NO: 698674 - RNA, 10 nt, Haemophilus influenzae Rd
aaaauucucc

SEQ ID NO: 698675 - RNA, 20 nt, Haemophilus influenzae Rd
aaaauguuuaccucgccauu

SEQ ID NO: 698676 - RNA, 14 nt, Haemophilus influenzae Rd
aaaauguugaauau

SEQ ID NO: 698677 - RNA, 19 nt, Haemophilus influenzae Rd
aaaauuaaaaauuuaauac

SEQ ID NO: 698678 - RNA, 19 nt, Haemophilus influenzae Rd
aaaauuaaauugaaaaaau

SEQ ID NO: 698679 - RNA, 15 nt, Haemophilus influenzae Rd
aaaauguuauaaaua

SEQ ID NO: 698680 - RNA, 23 nt, Haemophilus influenzae Rd
aaaaugugguuagcgauccuaaa

SEQ ID NO: 698681 - RNA, 21 nt, Haemophilus influenzae Rd
aaaaugugguugcggcugaau

SEQ ID NO: 698682 - RNA, 20 nt, Haemophilus influenzae Rd
aaaaugucgcuuucuuauau

SEQ ID NO: 698683 - RNA, 13 nt, Haemophilus influenzae Rd
aaaaucaucacag

SEQ ID NO: 698684 - RNA, 20 nt, Haemophilus influenzae Rd
aaaaucaucauauucacuuu

SEQ ID NO: 698685 - RNA, 23 nt, Haemophilus influenzae Rd
aaaaucaucauauucacuuucau

SEQ ID NO: 698686 - RNA, 14 nt, Haemophilus influenzae Rd
aaaaucauagagac

SEQ ID NO: 698687 - RNA, 17 nt, Haemophilus influenzae Rd
aaaaucaucguauuaaa

SEQ ID NO: 698688 - RNA, 13 nt, Haemophilus influenzae Rd
aaaaucaucuaau

SEQ ID NO: 698689 - RNA, 23 nt, Haemophilus influenzae Rd
aaaaucaguuauugauaaaaaua

SEQ ID NO: 698690 - RNA, 13 nt, Haemophilus influenzae Rd
aaaaucagcuuuu

SEQ ID NO: 698691 - RNA, 12 nt, Haemophilus influenzae Rd
aaaaucacuuuu

SEQ ID NO: 698692 - RNA, 16 nt, Haemophilus influenzae Rd
aaaaucagauacauuu

SEQ ID NO: 698693 - RNA, 18 nt, Haemophilus influenzae Rd
aaaaucucuggagaaaau

SEQ ID NO: 698694 - RNA, 16 nt, Haemophilus influenzae Rd
aaaaucauuauccaac

SEQ ID NO: 698695 - RNA, 23 nt, Haemophilus influenzae Rd
aaaaucugcacucuaauaaguga

SEQ ID NO: 698696 - RNA, 11 nt, Haemophilus influenzae Rd
aaaaucucuau

SEQ ID NO: 698697 - RNA, 19 nt, Haemophilus influenzae Rd
aaaaucucucaaaaaucaa

SEQ ID NO: 698698 - RNA, 20 nt, Haemophilus influenzae Rd
aaaaucucucaaaaaucaac

SEQ ID NO: 698699 - RNA, 21 nt, Haemophilus influenzae Rd
aaaaucugcuccgcuacuuuu

SEQ ID NO: 698700 - RNA, 12 nt, Haemophilus influenzae Rd
aaaaucugcuag

SEQ ID NO: 698701 - RNA, 16 nt, Haemophilus influenzae Rd
aaaaucugugcaaagu

SEQ ID NO: 698702 - RNA, 13 nt, Haemophilus influenzae Rd
aaaaucuuauuuc

SEQ ID NO: 698703 - RNA, 23 nt, Haemophilus influenzae Rd
aaaaucuuccaauacaaucagcu

SEQ ID NO: 698704 - RNA, 23 nt, Haemophilus influenzae Rd
aaaaucuuuaccaaaaaauucgu

SEQ ID NO: 698705 - RNA, 12 nt, Haemophilus influenzae Rd
aaaaucuugcac

SEQ ID NO: 698706 - RNA, 16 nt, Haemophilus influenzae Rd
aaaaucuugguuuaaa

SEQ ID NO: 698707 - RNA, 19 nt, Haemophilus influenzae Rd
aaaauauccacauaaccaa

SEQ ID NO: 698708 - RNA, 22 nt, Haemophilus influenzae Rd
aaaauauccacauaaccaaagg

SEQ ID NO: 698709 - RNA, 14 nt, Haemophilus influenzae Rd
aaaauaucugcuaa

SEQ ID NO: 698710 - RNA, 18 nt, Haemophilus influenzae Rd
aaaauaucuuguuuuaau

SEQ ID NO: 698711 - RNA, 22 nt, Haemophilus influenzae Rd
aaaauaucuuguuuuaauauca

SEQ ID NO: 698712 - RNA, 21 nt, Haemophilus influenzae Rd
aaaauauucuucauaaaaaaa

SEQ ID NO: 698713 - RNA, 13 nt, Haemophilus influenzae Rd
aaaauauugccug

SEQ ID NO: 698714 - RNA, 22 nt, Haemophilus influenzae Rd
aaaauauuggaguuagaauaau

SEQ ID NO: 698715 - RNA, 14 nt, Haemophilus influenzae Rd
aaaauauuucauuu

SEQ ID NO: 698716 - RNA, 12 nt, Haemophilus influenzae Rd
aaaauacccaua

SEQ ID NO: 698717 - RNA, 16 nt, Haemophilus influenzae Rd
aaaauacaaauacauu

SEQ ID NO: 698718 - RNA, 17 nt, Haemophilus influenzae Rd
aaaaguuggauuaaaca

SEQ ID NO: 698719 - RNA, 18 nt, Haemophilus influenzae Rd
aaaagucuguuuaaaaac

SEQ ID NO: 698720 - RNA, 12 nt, Haemophilus influenzae Rd
aaaauaacauaa

SEQ ID NO: 698721 - RNA, 15 nt, Haemophilus influenzae Rd
aaaauaaauugauuu

SEQ ID NO: 698722 - RNA, 19 nt, Haemophilus influenzae Rd
aaaauaaauuuuaaaaucu

SEQ ID NO: 698723 - RNA, 20 nt, Haemophilus influenzae Rd
aaaauaauuuucauugaaaa

SEQ ID NO: 698724 - RNA, 20 nt, Haemophilus influenzae Rd
aaaauaacuuucuguguguu

SEQ ID NO: 698725 - RNA, 16 nt, Haemophilus influenzae Rd
aaaauaaaguaagcac

SEQ ID NO: 698726 - RNA, 22 nt, Haemophilus influenzae Rd
aaaauaaauuaacuuaucuaaa

SEQ ID NO: 698727 - RNA, 13 nt, Haemophilus influenzae Rd
aaaauaaagaaac

SEQ ID NO: 698728 - RNA, 15 nt, Haemophilus influenzae Rd
aaaauaaagaaacgu

SEQ ID NO: 698729 - RNA, 22 nt, Haemophilus influenzae Rd
aaaauaaagggcgguuaaaaau

SEQ ID NO: 698730 - RNA, 20 nt, Haemophilus influenzae Rd
aaaagucccugauucuuuga

SEQ ID NO: 698731 - RNA, 13 nt, Haemophilus influenzae Rd
aaaaguccgcauu

SEQ ID NO: 698732 - RNA, 15 nt, Haemophilus influenzae Rd
aaaagggcagaauua

SEQ ID NO: 698733 - RNA, 22 nt, Haemophilus influenzae Rd
aaaaggcugcuugauauaauau

SEQ ID NO: 698734 - RNA, 23 nt, Haemophilus influenzae Rd
aaaaggcuucgccauuuuuaaaa

SEQ ID NO: 698735 - RNA, 17 nt, Haemophilus influenzae Rd
aaaaggcaaagcaaaau

SEQ ID NO: 698736 - RNA, 23 nt, Haemophilus influenzae Rd
aaaaccuuucuguaaauaugccu

SEQ ID NO: 698737 - RNA, 19 nt, Haemophilus influenzae Rd
aaaacgcaaugcaaaagua

SEQ ID NO: 698738 - RNA, 15 nt, Haemophilus influenzae Rd
aaaagcuaaaaaaac

SEQ ID NO: 698739 - RNA, 23 nt, Haemophilus influenzae Rd
aaaagcgugauuuuuuucauuuu

SEQ ID NO: 698740 - RNA, 19 nt, Haemophilus influenzae Rd
aaaagcguugaaaauaaau

SEQ ID NO: 698741 - RNA, 21 nt, Haemophilus influenzae Rd
aaaagcguugaguaaauagcu

SEQ ID NO: 698742 - RNA, 17 nt, Haemophilus influenzae Rd
aaaagcggcgcaucaau

SEQ ID NO: 698743 - RNA, 21 nt, Haemophilus influenzae Rd
aaaaagaagcucacuuuauau

SEQ ID NO: 698744 - RNA, 13 nt, Haemophilus influenzae Rd
aaaaagacaaaac

SEQ ID NO: 698745 - RNA, 17 nt, Haemophilus influenzae Rd
aaaagcugauauaaaaa

SEQ ID NO: 698746 - RNA, 14 nt, Haemophilus influenzae Rd
aaaaagacuaaacu

SEQ ID NO: 698747 - RNA, 20 nt, Haemophilus influenzae Rd
aaaagcugcacuauauacau

SEQ ID NO: 698748 - RNA, 15 nt, Haemophilus influenzae Rd
aaaagcuguucugca

SEQ ID NO: 698749 - RNA, 13 nt, Haemophilus influenzae Rd
aaaagcuugagaa

SEQ ID NO: 698750 - RNA, 19 nt, Haemophilus influenzae Rd
aaaagcuugagaagugccu

SEQ ID NO: 698751 - RNA, 19 nt, Haemophilus influenzae Rd
aaaaacuuugggaaauugg

SEQ ID NO: 698752 - RNA, 13 nt, Haemophilus influenzae Rd
aaaaagaaaacca

SEQ ID NO: 698753 - RNA, 14 nt, Haemophilus influenzae Rd
aaacaccaaauauu

SEQ ID NO: 698754 - RNA, 18 nt, Haemophilus influenzae Rd
aaacacaguuauuuuuua

SEQ ID NO: 698755 - RNA, 18 nt, Haemophilus influenzae Rd
aaacacugcgcagauuaa

SEQ ID NO: 698756 - RNA, 13 nt, Haemophilus influenzae Rd
aaacaccuaaaau

SEQ ID NO: 698757 - RNA, 23 nt, Haemophilus influenzae Rd
aaacacgcaagcgcguuuaucau

SEQ ID NO: 698758 - RNA, 12 nt, Haemophilus influenzae Rd
aaaauugcaaag

SEQ ID NO: 698759 - RNA, 19 nt, Haemophilus influenzae Rd
aaaauugccccuucaccuu

SEQ ID NO: 698760 - RNA, 19 nt, Haemophilus influenzae Rd
aaaauugguacgagaaaaa

SEQ ID NO: 698761 - RNA, 22 nt, Haemophilus influenzae Rd
aaaauugaagccgaugaaagcu

SEQ ID NO: 698762 - RNA, 13 nt, Haemophilus influenzae Rd
aaaauugccacau

SEQ ID NO: 698763 - RNA, 17 nt, Haemophilus influenzae Rd
aaaauugaucgaaaaau

SEQ ID NO: 698764 - RNA, 20 nt, Haemophilus influenzae Rd
aaaauugaucgaaaaaucuu

SEQ ID NO: 698765 - RNA, 18 nt, Haemophilus influenzae Rd
aaaauugaucuaaauuau

SEQ ID NO: 698766 - RNA, 19 nt, Haemophilus influenzae Rd
aaaauugauaccaagauaa

SEQ ID NO: 698767 - RNA, 13 nt, Haemophilus influenzae Rd
aaacaaucuuaac

SEQ ID NO: 698768 - RNA, 15 nt, Haemophilus influenzae Rd
aaacaaucuuaacug

SEQ ID NO: 698769 - RNA, 22 nt, Haemophilus influenzae Rd
aaacaauucuauauuauuuaag

SEQ ID NO: 698770 - RNA, 17 nt, Haemophilus influenzae Rd
aaacaauauguauaauu

SEQ ID NO: 698771 - RNA, 14 nt, Haemophilus influenzae Rd
aaacaaucacugaa

SEQ ID NO: 698772 - RNA, 12 nt, Haemophilus influenzae Rd
aaacaauauauu

SEQ ID NO: 698773 - RNA, 12 nt, Haemophilus influenzae Rd
aaacaauaaaac

SEQ ID NO: 698774 - RNA, 12 nt, Haemophilus influenzae Rd
aaacaaggcuaa

SEQ ID NO: 698775 - RNA, 15 nt, Haemophilus influenzae Rd
aaacaaguauaaaaa

SEQ ID NO: 698776 - RNA, 16 nt, Haemophilus influenzae Rd
aaacaaguauaaaaaa

SEQ ID NO: 698777 - RNA, 17 nt, Haemophilus influenzae Rd
aaacaaguauaaaaaau

SEQ ID NO: 698778 - RNA, 21 nt, Haemophilus influenzae Rd
aaacaaguauaaaaaaucccu

SEQ ID NO: 698779 - RNA, 22 nt, Haemophilus influenzae Rd
aaacagccauggcuuuuuccug

SEQ ID NO: 698780 - RNA, 23 nt, Haemophilus influenzae Rd
aaacagaauuuacgaaaacuuuc

SEQ ID NO: 698781 - RNA, 19 nt, Haemophilus influenzae Rd
aaacagacugaaauucugu

SEQ ID NO: 698782 - RNA, 16 nt, Haemophilus influenzae Rd
aaacagagaaaaaaau

SEQ ID NO: 698783 - RNA, 15 nt, Haemophilus influenzae Rd
aaacagaaguugaaa

SEQ ID NO: 698784 - RNA, 20 nt, Haemophilus influenzae Rd
aaacagagcgucaaaauuau

SEQ ID NO: 698785 - RNA, 13 nt, Haemophilus influenzae Rd
aaacagcacacua

SEQ ID NO: 698786 - RNA, 16 nt, Haemophilus influenzae Rd
aaacauaguaaauuuu

SEQ ID NO: 698787 - RNA, 16 nt, Haemophilus influenzae Rd
aaacauaccuaaaaau

SEQ ID NO: 698788 - RNA, 13 nt, Haemophilus influenzae Rd
aaacauaagaaau

SEQ ID NO: 698789 - RNA, 15 nt, Haemophilus influenzae Rd
aaacaguucaauaaa

SEQ ID NO: 698790 - RNA, 17 nt, Haemophilus influenzae Rd
aaacaguucaauaaaaa

SEQ ID NO: 698791 - RNA, 18 nt, Haemophilus influenzae Rd
aaacaguucaauaaaaau

SEQ ID NO: 698792 - RNA, 20 nt, Haemophilus influenzae Rd
aaacaguucaauaaaaauau

SEQ ID NO: 698793 - RNA, 20 nt, Haemophilus influenzae Rd
aaacagguguguuuuucaaa

SEQ ID NO: 698794 - RNA, 13 nt, Haemophilus influenzae Rd
aaacaguauuuuc

SEQ ID NO: 698795 - RNA, 22 nt, Haemophilus influenzae Rd
aaacagucugcgccuaaaauau

SEQ ID NO: 698796 - RNA, 23 nt, Haemophilus influenzae Rd
aaacagucugcgccuaaaauauu

SEQ ID NO: 698797 - RNA, 18 nt, Haemophilus influenzae Rd
aaaccgcugucauauuca

SEQ ID NO: 698798 - RNA, 22 nt, Haemophilus influenzae Rd
aaaccgcagcuaauccaaauca

SEQ ID NO: 698799 - RNA, 20 nt, Haemophilus influenzae Rd
aaaccgcauccauucucaaa

SEQ ID NO: 698800 - RNA, 16 nt, Haemophilus influenzae Rd
aaacccguaauuaaaa

SEQ ID NO: 698801 - RNA, 18 nt, Haemophilus influenzae Rd
aaacccucccauuagcuu

SEQ ID NO: 698802 - RNA, 18 nt, Haemophilus influenzae Rd
aaaccgauagcuuuuguu

SEQ ID NO: 698803 - RNA, 19 nt, Haemophilus influenzae Rd
aaaccagaaauagaguuaa

SEQ ID NO: 698804 - RNA, 12 nt, Haemophilus influenzae Rd
aaaccagauaag

SEQ ID NO: 698805 - RNA, 17 nt, Haemophilus influenzae Rd
aaaccauccgaaauuaa

SEQ ID NO: 698806 - RNA, 21 nt, Haemophilus influenzae Rd
aaaccauccaagcaaagaaau

SEQ ID NO: 698807 - RNA, 18 nt, Haemophilus influenzae Rd
aaaccaguuaaauccuca

SEQ ID NO: 698808 - RNA, 16 nt, Haemophilus influenzae Rd
aaaccauuuuaaucau

SEQ ID NO: 698809 - RNA, 21 nt, Haemophilus influenzae Rd
aaacccacaacuuuuucaucu

SEQ ID NO: 698810 - RNA, 15 nt, Haemophilus influenzae Rd
aaacccgcuuuuaac

SEQ ID NO: 698811 - RNA, 20 nt, Haemophilus influenzae Rd
aaacccgaaccgauuuuaaa

SEQ ID NO: 698812 - RNA, 19 nt, Haemophilus influenzae Rd
aaaccaccgauuaauaaaa

SEQ ID NO: 698813 - RNA, 16 nt, Haemophilus influenzae Rd
aaaccaauuucguuuu

SEQ ID NO: 698814 - RNA, 13 nt, Haemophilus influenzae Rd
aaaccaauuuuac

SEQ ID NO: 698815 - RNA, 21 nt, Haemophilus influenzae Rd
aaaccaauuuuacaaaucgua

SEQ ID NO: 698816 - RNA, 15 nt, Haemophilus influenzae Rd
aaacauuuuuucaac

SEQ ID NO: 698817 - RNA, 14 nt, Haemophilus influenzae Rd
aaaccaaaagauuc

SEQ ID NO: 698818 - RNA, 17 nt, Haemophilus influenzae Rd
aaacauuuuuauuuuua

SEQ ID NO: 698819 - RNA, 16 nt, Haemophilus influenzae Rd
aaacauuuuucauuuu

SEQ ID NO: 698820 - RNA, 17 nt, Haemophilus influenzae Rd
aaacauuuuucauuuuc

SEQ ID NO: 698821 - RNA, 12 nt, Haemophilus influenzae Rd
aaacauuuuucc

SEQ ID NO: 698822 - RNA, 16 nt, Haemophilus influenzae Rd
aaacauuuuguaucua

SEQ ID NO: 698823 - RNA, 17 nt, Haemophilus influenzae Rd
aaacauuuuguaucuaa

SEQ ID NO: 698824 - RNA, 18 nt, Haemophilus influenzae Rd
aaacauuuuguaucuaaa

SEQ ID NO: 698825 - RNA, 14 nt, Haemophilus influenzae Rd
aaaccaacaacugc

SEQ ID NO: 698826 - RNA, 18 nt, Haemophilus influenzae Rd
aaaccaacacccacauca

SEQ ID NO: 698827 - RNA, 17 nt, Haemophilus influenzae Rd
aaaccaaacgagaaaau

SEQ ID NO: 698828 - RNA, 18 nt, Haemophilus influenzae Rd
aaaccaaacgagaaaauu

SEQ ID NO: 698829 - RNA, 14 nt, Haemophilus influenzae Rd
aaaccaaauaauga

SEQ ID NO: 698830 - RNA, 13 nt, Haemophilus influenzae Rd
aaaccaacauaca

SEQ ID NO: 698831 - RNA, 23 nt, Haemophilus influenzae Rd
aaaccaagagggcuuguuuuuuc

SEQ ID NO: 698832 - RNA, 12 nt, Haemophilus influenzae Rd
aaaccaauaaua

SEQ ID NO: 698833 - RNA, 17 nt, Haemophilus influenzae Rd
aaaccaauaauccuuuu

SEQ ID NO: 698834 - RNA, 11 nt, Haemophilus influenzae Rd
aaacaucauca

SEQ ID NO: 698835 - RNA, 23 nt, Haemophilus influenzae Rd
aaacaucaucacccccacggcaa

SEQ ID NO: 698836 - RNA, 18 nt, Haemophilus influenzae Rd
aaacauccgaauaaaugc

SEQ ID NO: 698837 - RNA, 17 nt, Haemophilus influenzae Rd
aaacaucgcuucaucau

SEQ ID NO: 698838 - RNA, 20 nt, Haemophilus influenzae Rd
aaacauugcucgugauuauc

SEQ ID NO: 698839 - RNA, 17 nt, Haemophilus influenzae Rd
aaacauuguuuuguuca

SEQ ID NO: 698840 - RNA, 16 nt, Haemophilus influenzae Rd
aaauauuaaagaguua

SEQ ID NO: 698841 - RNA, 15 nt, Haemophilus influenzae Rd
aaauauuacuuaaca

SEQ ID NO: 698842 - RNA, 21 nt, Haemophilus influenzae Rd
aaauauuacuuaacaucauca

SEQ ID NO: 698843 - RNA, 14 nt, Haemophilus influenzae Rd
aaaucauuuuuugc

SEQ ID NO: 698844 - RNA, 17 nt, Haemophilus influenzae Rd
aaaucauuuuuugcaaa

SEQ ID NO: 698845 - RNA, 22 nt, Haemophilus influenzae Rd
aaauccaaccgauaaggaaaau

SEQ ID NO: 698846 - RNA, 16 nt, Haemophilus influenzae Rd
aaauccccccauuaca

SEQ ID NO: 698847 - RNA, 17 nt, Haemophilus influenzae Rd
aaaucccgcagggaugc

SEQ ID NO: 698848 - RNA, 16 nt, Haemophilus influenzae Rd
aaaucccaccuuuuag

SEQ ID NO: 698849 - RNA, 13 nt, Haemophilus influenzae Rd
aaauccacacuuu

SEQ ID NO: 698850 - RNA, 20 nt, Haemophilus influenzae Rd
aaauccagacgcauucuuuc

SEQ ID NO: 698851 - RNA, 15 nt, Haemophilus influenzae Rd
aaaucccuuagaaaa

SEQ ID NO: 698852 - RNA, 21 nt, Haemophilus influenzae Rd
aaaucccuuucucaggaaagg

SEQ ID NO: 698853 - RNA, 11 nt, Haemophilus influenzae Rd
aaauccuaaau

SEQ ID NO: 698854 - RNA, 15 nt, Haemophilus influenzae Rd
aaauccucaucugaa

SEQ ID NO: 698855 - RNA, 15 nt, Haemophilus influenzae Rd
aaaucgaagaaauau

SEQ ID NO: 698856 - RNA, 16 nt, Haemophilus influenzae Rd
aaaucgacauaacauu

SEQ ID NO: 698857 - RNA, 20 nt, Haemophilus influenzae Rd
aaauccuguucagcuuuacu

SEQ ID NO: 698858 - RNA, 14 nt, Haemophilus influenzae Rd
aaauccuguuuauu

SEQ ID NO: 698859 - RNA, 13 nt, Haemophilus influenzae Rd
aaaucgaaauaug

SEQ ID NO: 698860 - RNA, 18 nt, Haemophilus influenzae Rd
aaauccuugaaucauuuc

SEQ ID NO: 698861 - RNA, 17 nt, Haemophilus influenzae Rd
aaauccuuuugcacauu

SEQ ID NO: 698862 - RNA, 14 nt, Haemophilus influenzae Rd
aaauccuacaacac

SEQ ID NO: 698863 - RNA, 22 nt, Haemophilus influenzae Rd
aaaucguacaucgaaaacauaa

SEQ ID NO: 698864 - RNA, 20 nt, Haemophilus influenzae Rd
aaaucggugcaacaauauca

SEQ ID NO: 698865 - RNA, 14 nt, Haemophilus influenzae Rd
aaaucucucaaaaa

SEQ ID NO: 698866 - RNA, 17 nt, Haemophilus influenzae Rd
aaaucucuggagaaaau

SEQ ID NO: 698867 - RNA, 18 nt, Haemophilus influenzae Rd
aaaucucuaccacaguca

SEQ ID NO: 698868 - RNA, 19 nt, Haemophilus influenzae Rd
aaaucuuuaccaaaaaauu

SEQ ID NO: 698869 - RNA, 12 nt, Haemophilus influenzae Rd
aaaucuuuaccu

SEQ ID NO: 698870 - RNA, 21 nt, Haemophilus influenzae Rd
aaaucuuuacgaauuguaccu

SEQ ID NO: 698871 - RNA, 16 nt, Haemophilus influenzae Rd
aaaucuugaacgcaaa

SEQ ID NO: 698872 - RNA, 16 nt, Haemophilus influenzae Rd
aaaucuugacauaauu

SEQ ID NO: 698873 - RNA, 24 nt, Haemophilus influenzae Rd
aaaucuuggcucauuuuaaagagu

SEQ ID NO: 698874 - RNA, 19 nt, Haemophilus influenzae Rd
aaaucuugguuuaaauuuu

SEQ ID NO: 698875 - RNA, 20 nt, Haemophilus influenzae Rd
aaaucuugguuuaaauuuua

SEQ ID NO: 698876 - RNA, 11 nt, Haemophilus influenzae Rd
aaaucugcacu

SEQ ID NO: 698877 - RNA, 17 nt, Haemophilus influenzae Rd
aaaucugauucagaaaa

SEQ ID NO: 698878 - RNA, 13 nt, Haemophilus influenzae Rd
aaaucuucuaucu

SEQ ID NO: 698879 - RNA, 15 nt, Haemophilus influenzae Rd
aaaugaggaaaauaa

SEQ ID NO: 698880 - RNA, 15 nt, Haemophilus influenzae Rd
aaaugaccuucacuu

SEQ ID NO: 698881 - RNA, 20 nt, Haemophilus influenzae Rd
aaaugacagucgauuacaaa

SEQ ID NO: 698882 - RNA, 23 nt, Haemophilus influenzae Rd
aaaucuuuggauugguguuuaaa

SEQ ID NO: 698883 - RNA, 20 nt, Haemophilus influenzae Rd
aaaugaaguaauaaucuucu

SEQ ID NO: 698884 - RNA, 22 nt, Haemophilus influenzae Rd
aaaugaaguaauaaucuucuuc

SEQ ID NO: 698885 - RNA, 22 nt, Haemophilus influenzae Rd
aaaugaagugcgguugaaauuu

SEQ ID NO: 698886 - RNA, 21 nt, Haemophilus influenzae Rd
aaaugaaguucacuucaucua

SEQ ID NO: 698887 - RNA, 22 nt, Haemophilus influenzae Rd
aaaugaaguucacuucaucuau

SEQ ID NO: 698888 - RNA, 17 nt, Haemophilus influenzae Rd
aaaugaauaaaacuucc

SEQ ID NO: 698889 - RNA, 18 nt, Haemophilus influenzae Rd
aaaugaauaaaacuuccu

SEQ ID NO: 698890 - RNA, 20 nt, Haemophilus influenzae Rd
aaaugaauaaaacuuccuaa

SEQ ID NO: 698891 - RNA, 16 nt, Haemophilus influenzae Rd
aaaaagcaccuaaaaa

SEQ ID NO: 698892 - RNA, 15 nt, Haemophilus influenzae Rd
aaaaagcaaaaccau

SEQ ID NO: 698893 - RNA, 18 nt, Haemophilus influenzae Rd
aaaaagauugaauguuuu

SEQ ID NO: 698894 - RNA, 20 nt, Haemophilus influenzae Rd
aaaaagauugcuccuacuuu

SEQ ID NO: 698895 - RNA, 21 nt, Haemophilus influenzae Rd
aaauuaaucugcauucuaaaa

SEQ ID NO: 698896 - RNA, 15 nt, Haemophilus influenzae Rd
aaauuaauaagaaaa

SEQ ID NO: 698897 - RNA, 16 nt, Haemophilus influenzae Rd
aaauuaauaagaaaau

SEQ ID NO: 698898 - RNA, 17 nt, Haemophilus influenzae Rd
aaauuaauaagaaagaa

SEQ ID NO: 698899 - RNA, 16 nt, Haemophilus influenzae Rd
aaauuaauaagcccuu

SEQ ID NO: 698900 - RNA, 17 nt, Haemophilus influenzae Rd
aaauuaagguuggaaua

SEQ ID NO: 698901 - RNA, 13 nt, Haemophilus influenzae Rd
aaauuaaaaauau

SEQ ID NO: 698902 - RNA, 13 nt, Haemophilus influenzae Rd
aaauuaaaaauuu

SEQ ID NO: 698903 - RNA, 17 nt, Haemophilus influenzae Rd
aaauuaaaaaagcaaaa

SEQ ID NO: 698904 - RNA, 18 nt, Haemophilus influenzae Rd
aaauuaaaaaaauaguua

SEQ ID NO: 698905 - RNA, 17 nt, Haemophilus influenzae Rd
aaaaagauaacuuagaa

SEQ ID NO: 698906 - RNA, 21 nt, Haemophilus influenzae Rd
aaaaagauaacuuagaaaaua

SEQ ID NO: 698907 - RNA, 21 nt, Haemophilus influenzae Rd
aaauuaguaguuagaauuuua

SEQ ID NO: 698908 - RNA, 23 nt, Haemophilus influenzae Rd
aaauuaguaguuagaauuuuaac

SEQ ID NO: 698909 - RNA, 19 nt, Haemophilus influenzae Rd
aaauuagccccaaauuacu

SEQ ID NO: 698910 - RNA, 18 nt, Haemophilus influenzae Rd
aaauuagcguaaacauuu

SEQ ID NO: 698911 - RNA, 12 nt, Haemophilus influenzae Rd
aaauuaaugcca

SEQ ID NO: 698912 - RNA, 22 nt, Haemophilus influenzae Rd
aaauuacucaucugaauuuaaa

SEQ ID NO: 698913 - RNA, 15 nt, Haemophilus influenzae Rd
aaauuagacaaaaau

SEQ ID NO: 698914 - RNA, 15 nt, Haemophilus influenzae Rd
aaauuagacuuucuu

SEQ ID NO: 698915 - RNA, 15 nt, Haemophilus influenzae Rd
aaauuacuugaaucu

SEQ ID NO: 698916 - RNA, 16 nt, Haemophilus influenzae Rd
aaauuauuuauuuaau

SEQ ID NO: 698917 - RNA, 13 nt, Haemophilus influenzae Rd
aaauuauaauauu

SEQ ID NO: 698918 - RNA, 18 nt, Haemophilus influenzae Rd
aaauuauagaacuuagcc

SEQ ID NO: 698919 - RNA, 17 nt, Haemophilus influenzae Rd
aaauuauagauaaauau

SEQ ID NO: 698920 - RNA, 22 nt, Haemophilus influenzae Rd
aaauuauugugagauaugaaau

SEQ ID NO: 698921 - RNA, 23 nt, Haemophilus influenzae Rd
aaauuaguuuuucgcugcagcug

SEQ ID NO: 698922 - RNA, 16 nt, Haemophilus influenzae Rd
aaaugguuuaaauaac

SEQ ID NO: 698923 - RNA, 18 nt, Haemophilus influenzae Rd
aaauguagaucgacucca

SEQ ID NO: 698924 - RNA, 19 nt, Haemophilus influenzae Rd
aaauguaaaaauuggaaaa

SEQ ID NO: 698925 - RNA, 13 nt, Haemophilus influenzae Rd
aaauguaaaacag

SEQ ID NO: 698926 - RNA, 20 nt, Haemophilus influenzae Rd
aaauguaagagugaaguuau

SEQ ID NO: 698927 - RNA, 22 nt, Haemophilus influenzae Rd
aaauguaagagugaaguuauag

SEQ ID NO: 698928 - RNA, 21 nt, Haemophilus influenzae Rd
aaauguaauagccauuuugga

SEQ ID NO: 698929 - RNA, 18 nt, Haemophilus influenzae Rd
aaauguaauucuggcugu

SEQ ID NO: 698930 - RNA, 14 nt, Haemophilus influenzae Rd
aaauguuugaaggc

SEQ ID NO: 698931 - RNA, 18 nt, Haemophilus influenzae Rd
aaauguuugaaggcaaaa

SEQ ID NO: 698932 - RNA, 16 nt, Haemophilus influenzae Rd
aaauguuuaauuauag

SEQ ID NO: 698933 - RNA, 20 nt, Haemophilus influenzae Rd
aaauguuuaauuauagaaaa

SEQ ID NO: 698934 - RNA, 19 nt, Haemophilus influenzae Rd
aaauguuuaccucgccauu

SEQ ID NO: 698935 - RNA, 23 nt, Haemophilus influenzae Rd
aaauguaucugauuuuuuaagau

SEQ ID NO: 698936 - RNA, 14 nt, Haemophilus influenzae Rd
aaauguauuuucca

SEQ ID NO: 698937 - RNA, 16 nt, Haemophilus influenzae Rd
aaaugugaaaacuacu

SEQ ID NO: 698938 - RNA, 22 nt, Haemophilus influenzae Rd
aaaugugaaaacuacuuuccaa

SEQ ID NO: 698939 - RNA, 21 nt, Haemophilus influenzae Rd
aaaugcaaaguaacuuuaauu

SEQ ID NO: 698940 - RNA, 23 nt, Haemophilus influenzae Rd
aaaugcaaaguaacuuuaauuau

SEQ ID NO: 698941 - RNA, 12 nt, Haemophilus influenzae Rd
aaaugaggaaua

SEQ ID NO: 698942 - RNA, 12 nt, Haemophilus influenzae Rd
aaaugauaaaaa

SEQ ID NO: 698943 - RNA, 13 nt, Haemophilus influenzae Rd
aaauggcaaacaa

SEQ ID NO: 698944 - RNA, 18 nt, Haemophilus influenzae Rd
aaauggcaucaauauuau

SEQ ID NO: 698945 - RNA, 20 nt, Haemophilus influenzae Rd
aaauggcaucaauauuaugu

SEQ ID NO: 698946 - RNA, 23 nt, Haemophilus influenzae Rd
aaauggcgguuuuuuaauuuuau

SEQ ID NO: 698947 - RNA, 20 nt, Haemophilus influenzae Rd
aaauggcuagggauuaagaa

SEQ ID NO: 698948 - RNA, 17 nt, Haemophilus influenzae Rd
aaauggcuuuuuugccu

SEQ ID NO: 698949 - RNA, 18 nt, Haemophilus influenzae Rd
aaaugggacaaagcagua

SEQ ID NO: 698950 - RNA, 12 nt, Haemophilus influenzae Rd
aacaaaaauacg

SEQ ID NO: 698951 - RNA, 19 nt, Haemophilus influenzae Rd
aacaaaaagauugaauguu

SEQ ID NO: 698952 - RNA, 19 nt, Haemophilus influenzae Rd
aaauuuuuccguuuucuac

SEQ ID NO: 698953 - RNA, 13 nt, Haemophilus influenzae Rd
aaauuuuuuugca

SEQ ID NO: 698954 - RNA, 22 nt, Haemophilus influenzae Rd
aaauuuuuuugcuggaaaaaug

SEQ ID NO: 698955 - RNA, 23 nt, Haemophilus influenzae Rd
aaauuuuucgcaagauagcaaaa

SEQ ID NO: 698956 - RNA, 16 nt, Haemophilus influenzae Rd
aaauuuuucuuuucuu

SEQ ID NO: 698957 - RNA, 21 nt, Haemophilus influenzae Rd
aaauuuuucaucuuuuuauaa

SEQ ID NO: 698958 - RNA, 17 nt, Haemophilus influenzae Rd
aaauuuuuccacauuaa

SEQ ID NO: 698959 - RNA, 18 nt, Haemophilus influenzae Rd
aaauuuucaauggcauca

SEQ ID NO: 698960 - RNA, 23 nt, Haemophilus influenzae Rd
aaauuuuccgcacuuuuuauuca

SEQ ID NO: 698961 - RNA, 19 nt, Haemophilus influenzae Rd
aaauuuuccgcauaaauaa

SEQ ID NO: 698962 - RNA, 17 nt, Haemophilus influenzae Rd
aaauuuucagcuugugc

SEQ ID NO: 698963 - RNA, 12 nt, Haemophilus influenzae Rd
aaauuuuccuuc

SEQ ID NO: 698964 - RNA, 12 nt, Haemophilus influenzae Rd
aaauuuugccaa

SEQ ID NO: 698965 - RNA, 20 nt, Haemophilus influenzae Rd
aaauuuuuagcgaguuuaag

SEQ ID NO: 698966 - RNA, 21 nt, Haemophilus influenzae Rd
aaauuuuuagcugauuuuuua

SEQ ID NO: 698967 - RNA, 23 nt, Haemophilus influenzae Rd
aaauuuuuaggugcuuuuugcua

SEQ ID NO: 698968 - RNA, 16 nt, Haemophilus influenzae Rd
aaauuuuucacagaaa

SEQ ID NO: 698969 - RNA, 21 nt, Haemophilus influenzae Rd
aacaaacgaugaagaaaauuu

SEQ ID NO: 698970 - RNA, 19 nt, Haemophilus influenzae Rd
aacaaaccagccugaaaaa

SEQ ID NO: 698971 - RNA, 11 nt, Haemophilus influenzae Rd
aacaaacauua

SEQ ID NO: 698972 - RNA, 22 nt, Haemophilus influenzae Rd
aacaaacauuaaucgaucaauu

SEQ ID NO: 698973 - RNA, 23 nt, Haemophilus influenzae Rd
aacaaagaaucuuaaauucauaa

SEQ ID NO: 698974 - RNA, 22 nt, Haemophilus influenzae Rd
aacaaagugcggcaaaaaaugg

SEQ ID NO: 698975 - RNA, 20 nt, Haemophilus influenzae Rd
aacaaagucaauacacauuu

SEQ ID NO: 698976 - RNA, 23 nt, Haemophilus influenzae Rd
aacaaagucaauacacauuucuu

SEQ ID NO: 698977 - RNA, 22 nt, Haemophilus influenzae Rd
aacaaaaggcuuuuuacguuca

SEQ ID NO: 698978 - RNA, 14 nt, Haemophilus influenzae Rd
aacaaaagaaauuu

SEQ ID NO: 698979 - RNA, 21 nt, Haemophilus influenzae Rd
aacaaaagugcgguaaaaauu

SEQ ID NO: 698980 - RNA, 14 nt, Haemophilus influenzae Rd
aacaaaaucuuacu

SEQ ID NO: 698981 - RNA, 17 nt, Haemophilus influenzae Rd
aacaaauuucacguagu

SEQ ID NO: 698982 - RNA, 17 nt, Haemophilus influenzae Rd
aacaaaugauuagaagu

SEQ ID NO: 698983 - RNA, 17 nt, Haemophilus influenzae Rd
aacaaaugucgaaauuu

SEQ ID NO: 698984 - RNA, 14 nt, Haemophilus influenzae Rd
aacaaauuacagaa

SEQ ID NO: 698985 - RNA, 20 nt, Haemophilus influenzae Rd
aacaaauuacagaacgauuu

SEQ ID NO: 698986 - RNA, 17 nt, Haemophilus influenzae Rd
aacaaauaaaucauagg

SEQ ID NO: 698987 - RNA, 14 nt, Haemophilus influenzae Rd
aacaaauaagccca

SEQ ID NO: 698988 - RNA, 16 nt, Haemophilus influenzae Rd
aacaaauaauuauuau

SEQ ID NO: 698989 - RNA, 21 nt, Haemophilus influenzae Rd
aacaaauauuccacaucacuu

SEQ ID NO: 698990 - RNA, 23 nt, Haemophilus influenzae Rd
aacaacaacgcaucuuuauaaca

SEQ ID NO: 698991 - RNA, 14 nt, Haemophilus influenzae Rd
aacaacagugaauu

SEQ ID NO: 698992 - RNA, 12 nt, Haemophilus influenzae Rd
aacaaccacauu

SEQ ID NO: 698993 - RNA, 14 nt, Haemophilus influenzae Rd
aacaaccacauuca

SEQ ID NO: 698994 - RNA, 19 nt, Haemophilus influenzae Rd
aacaacaucuuguuuuaau

SEQ ID NO: 698995 - RNA, 19 nt, Haemophilus influenzae Rd
aacaaccagcgcaccacac

SEQ ID NO: 698996 - RNA, 22 nt, Haemophilus influenzae Rd
aacaacgcaucuuuauaacaua

SEQ ID NO: 698997 - RNA, 13 nt, Haemophilus influenzae Rd
aacaacuuuucua

SEQ ID NO: 698998 - RNA, 23 nt, Haemophilus influenzae Rd
aacaacuaacuaaggugcagauu

SEQ ID NO: 698999 - RNA, 14 nt, Haemophilus influenzae Rd
aacaagauucugaa

SEQ ID NO: 699000 - RNA, 14 nt, Haemophilus influenzae Rd
aacaagaaccgccg

SEQ ID NO: 699001 - RNA, 15 nt, Haemophilus influenzae Rd
aacaagccccacagg

SEQ ID NO: 699002 - RNA, 16 nt, Haemophilus influenzae Rd
aacaagccccacaggu

SEQ ID NO: 699003 - RNA, 13 nt, Haemophilus influenzae Rd
aacaagcacaaga

SEQ ID NO: 699004 - RNA, 20 nt, Haemophilus influenzae Rd
aacaagcgcaaguucuucau

SEQ ID NO: 699005 - RNA, 21 nt, Haemophilus influenzae Rd
aacaagcgcaaguucuucauu

SEQ ID NO: 699006 - RNA, 19 nt, Haemophilus influenzae Rd
aacaagcgcgauaaagagu

SEQ ID NO: 699007 - RNA, 19 nt, Haemophilus influenzae Rd
aaauugaagagauugauuu

SEQ ID NO: 699008 - RNA, 17 nt, Haemophilus influenzae Rd
aaauugacaauguuuua

SEQ ID NO: 699009 - RNA, 11 nt, Haemophilus influenzae Rd
aaauucuuuuu

SEQ ID NO: 699010 - RNA, 18 nt, Haemophilus influenzae Rd
aaauugaaaaaaucuucc

SEQ ID NO: 699011 - RNA, 20 nt, Haemophilus influenzae Rd
aaauugaaaaaaucuuccaa

SEQ ID NO: 699012 - RNA, 20 nt, Haemophilus influenzae Rd
aaauugaacugaauuaaaaa

SEQ ID NO: 699013 - RNA, 20 nt, Haemophilus influenzae Rd
aaauugagaaugaaaauaac

SEQ ID NO: 699014 - RNA, 18 nt, Haemophilus influenzae Rd
aaauugaggauuugccuc

SEQ ID NO: 699015 - RNA, 16 nt, Haemophilus influenzae Rd
aaauugacggcuucag

SEQ ID NO: 699016 - RNA, 15 nt, Haemophilus influenzae Rd
aaauugaugaaaauu

SEQ ID NO: 699017 - RNA, 16 nt, Haemophilus influenzae Rd
aaauugagaucaaaaa

SEQ ID NO: 699018 - RNA, 17 nt, Haemophilus influenzae Rd
aaauugagaucaaaaau

SEQ ID NO: 699019 - RNA, 22 nt, Haemophilus influenzae Rd
aaauucaacacgccuaacauaa

SEQ ID NO: 699020 - RNA, 13 nt, Haemophilus influenzae Rd
aaauucaaauacu

SEQ ID NO: 699021 - RNA, 13 nt, Haemophilus influenzae Rd
aaauuauuuuaau

SEQ ID NO: 699022 - RNA, 12 nt, Haemophilus influenzae Rd
aaauucaaagau

SEQ ID NO: 699023 - RNA, 18 nt, Haemophilus influenzae Rd
aaauucaaagauuauuua

SEQ ID NO: 699024 - RNA, 18 nt, Haemophilus influenzae Rd
aaauucaaauacuuuacc

SEQ ID NO: 699025 - RNA, 18 nt, Haemophilus influenzae Rd
aaauucauccaaagaaau

SEQ ID NO: 699026 - RNA, 22 nt, Haemophilus influenzae Rd
aaauucaucguaauuaaacaaa

SEQ ID NO: 699027 - RNA, 14 nt, Haemophilus influenzae Rd
aaauucauuuuuua

SEQ ID NO: 699028 - RNA, 17 nt, Haemophilus influenzae Rd
aaauucauuuuuuauuu

SEQ ID NO: 699029 - RNA, 16 nt, Haemophilus influenzae Rd
aaauuccaguucuccu

SEQ ID NO: 699030 - RNA, 17 nt, Haemophilus influenzae Rd
aaauuccaguucuccuu

SEQ ID NO: 699031 - RNA, 13 nt, Haemophilus influenzae Rd
aaauucauuauua

SEQ ID NO: 699032 - RNA, 14 nt, Haemophilus influenzae Rd
aaauucauucuugc

SEQ ID NO: 699033 - RNA, 15 nt, Haemophilus influenzae Rd
aaauucauucuugcu

SEQ ID NO: 699034 - RNA, 15 nt, Haemophilus influenzae Rd
aaauucauugacuuc

SEQ ID NO: 699035 - RNA, 14 nt, Haemophilus influenzae Rd
aaauucauuuaaaa

SEQ ID NO: 699036 - RNA, 12 nt, Haemophilus influenzae Rd
aaauucauuuuu

SEQ ID NO: 699037 - RNA, 22 nt, Haemophilus influenzae Rd
aaauugcccuguugaaacaggu

SEQ ID NO: 699038 - RNA, 15 nt, Haemophilus influenzae Rd
aaauugcaaaaaacu

SEQ ID NO: 699039 - RNA, 20 nt, Haemophilus influenzae Rd
aaauugccccuucaccuuuu

SEQ ID NO: 699040 - RNA, 13 nt, Haemophilus influenzae Rd
aaauugccaaaaa

SEQ ID NO: 699041 - RNA, 17 nt, Haemophilus influenzae Rd
aaauugcaccuucuuuu

SEQ ID NO: 699042 - RNA, 22 nt, Haemophilus influenzae Rd
aaauugcaccuucuuuuggaua

SEQ ID NO: 699043 - RNA, 12 nt, Haemophilus influenzae Rd
aaauugauuaag

SEQ ID NO: 699044 - RNA, 15 nt, Haemophilus influenzae Rd
aaauugauucauuug

SEQ ID NO: 699045 - RNA, 20 nt, Haemophilus influenzae Rd
aaauugcuggcuugccaauu

SEQ ID NO: 699046 - RNA, 12 nt, Haemophilus influenzae Rd
aaauugcuuuca

SEQ ID NO: 699047 - RNA, 20 nt, Haemophilus influenzae Rd
aaauuggguucgcaaauaac

SEQ ID NO: 699048 - RNA, 19 nt, Haemophilus influenzae Rd
aaauuguaacuauaugaua

SEQ ID NO: 699049 - RNA, 17 nt, Haemophilus influenzae Rd
aaauugucguccuucaa

SEQ ID NO: 699050 - RNA, 22 nt, Haemophilus influenzae Rd
aaauugguuaauguaaacaaaa

SEQ ID NO: 699051 - RNA, 17 nt, Haemophilus influenzae Rd
aaauuguggcaauaguu

SEQ ID NO: 699052 - RNA, 14 nt, Haemophilus influenzae Rd
aaauugugucacau

SEQ ID NO: 699053 - RNA, 19 nt, Haemophilus influenzae Rd
aaauugugucacauaauca

SEQ ID NO: 699054 - RNA, 12 nt, Haemophilus influenzae Rd
aaauuguuuaau

SEQ ID NO: 699055 - RNA, 16 nt, Haemophilus influenzae Rd
aaauuguuugaaauca

SEQ ID NO: 699056 - RNA, 12 nt, Haemophilus influenzae Rd
aaauuuaaaaaa

SEQ ID NO: 699057 - RNA, 19 nt, Haemophilus influenzae Rd
aaauuuaaccacuaaaaaa

SEQ ID NO: 699058 - RNA, 13 nt, Haemophilus influenzae Rd
aaauuuaaauaua

SEQ ID NO: 699059 - RNA, 18 nt, Haemophilus influenzae Rd
aaauuuaaauauaauuua

SEQ ID NO: 699060 - RNA, 17 nt, Haemophilus influenzae Rd
aaauuuaaaaucgcaau

SEQ ID NO: 699061 - RNA, 21 nt, Haemophilus influenzae Rd
aaauuuagcguauuuuguucu

SEQ ID NO: 699062 - RNA, 14 nt, Haemophilus influenzae Rd
aaauuuacgauuaa

SEQ ID NO: 699063 - RNA, 18 nt, Haemophilus influenzae Rd
aaauuuacucacaacaaa

SEQ ID NO: 699064 - RNA, 17 nt, Haemophilus influenzae Rd
aaauuuaggguauuuau

SEQ ID NO: 699065 - RNA, 16 nt, Haemophilus influenzae Rd
aaauuuagugauuucu

SEQ ID NO: 699066 - RNA, 19 nt, Haemophilus influenzae Rd
aaauuuaguggcuaaauua

SEQ ID NO: 699067 - RNA, 20 nt, Haemophilus influenzae Rd
aaauuuaauaagaauuuuaa

SEQ ID NO: 699068 - RNA, 19 nt, Haemophilus influenzae Rd
aaauuuaagccuguuaugc

SEQ ID NO: 699069 - RNA, 17 nt, Haemophilus influenzae Rd
aaauuuaucuaaaagua

SEQ ID NO: 699070 - RNA, 19 nt, Haemophilus influenzae Rd
aaauuuaucuaaaaguaau

SEQ ID NO: 699071 - RNA, 18 nt, Haemophilus influenzae Rd
aaauuuaugcuguuuuau

SEQ ID NO: 699072 - RNA, 19 nt, Haemophilus influenzae Rd
aaauuuauaauagacugaa

SEQ ID NO: 699073 - RNA, 16 nt, Haemophilus influenzae Rd
aaauuuauuauaaaaa

SEQ ID NO: 699074 - RNA, 21 nt, Haemophilus influenzae Rd
aaauuuauuauaaaaauauuu

SEQ ID NO: 699075 - RNA, 23 nt, Haemophilus influenzae Rd
aaauuuauuauauaaaaaacccg

SEQ ID NO: 699076 - RNA, 13 nt, Haemophilus influenzae Rd
aaauuuauuuuaa

SEQ ID NO: 699077 - RNA, 22 nt, Haemophilus influenzae Rd
aaauuuguugcauuucuaaaua

SEQ ID NO: 699078 - RNA, 19 nt, Haemophilus influenzae Rd
aaauuuguuguucuccuug

SEQ ID NO: 699079 - RNA, 21 nt, Haemophilus influenzae Rd
aaauuuguuguucuccuugua

SEQ ID NO: 699080 - RNA, 16 nt, Haemophilus influenzae Rd
aaauuuuauccaucaa

SEQ ID NO: 699081 - RNA, 20 nt, Haemophilus influenzae Rd
aaauuuuauccgguuggaaa

SEQ ID NO: 699082 - RNA, 19 nt, Haemophilus influenzae Rd
aaauuuggcaauccugcuu

SEQ ID NO: 699083 - RNA, 18 nt, Haemophilus influenzae Rd
aaauuucuguugaaauca

SEQ ID NO: 699084 - RNA, 20 nt, Haemophilus influenzae Rd
aaauuugaauguaaaaauaa

SEQ ID NO: 699085 - RNA, 19 nt, Haemophilus influenzae Rd
aaauuucuuuuguuuuaac

SEQ ID NO: 699086 - RNA, 20 nt, Haemophilus influenzae Rd
aaauuucuuuuguuuuaacc

SEQ ID NO: 699087 - RNA, 14 nt, Haemophilus influenzae Rd
aaauuucuugcucu

SEQ ID NO: 699088 - RNA, 19 nt, Haemophilus influenzae Rd
aaauuucuuuaauugauua

SEQ ID NO: 699089 - RNA, 19 nt, Haemophilus influenzae Rd
aaauuucagcuuaaauacu

SEQ ID NO: 699090 - RNA, 17 nt, Haemophilus influenzae Rd
aaauuuauuuuuuaaaa

SEQ ID NO: 699091 - RNA, 21 nt, Haemophilus influenzae Rd
aaauuuauuuuuuaaaacuua

SEQ ID NO: 699092 - RNA, 13 nt, Haemophilus influenzae Rd
aaauuucaauuaa

SEQ ID NO: 699093 - RNA, 19 nt, Haemophilus influenzae Rd
aaauuucaauuaaaucaaa

SEQ ID NO: 699094 - RNA, 20 nt, Haemophilus influenzae Rd
aaauuucaccgcauucuucu

SEQ ID NO: 699095 - RNA, 20 nt, Haemophilus influenzae Rd
aaauuucaccguauuuuuua

SEQ ID NO: 699096 - RNA, 15 nt, Haemophilus influenzae Rd
aaauuuccgcaggug

SEQ ID NO: 699097 - RNA, 21 nt, Haemophilus influenzae Rd
aaauuuccauaugaccauuaa

SEQ ID NO: 699098 - RNA, 12 nt, Haemophilus influenzae Rd
aaauaccaugga

SEQ ID NO: 699099 - RNA, 19 nt, Haemophilus influenzae Rd
aaauaccccaauuaaguca

SEQ ID NO: 699100 - RNA, 19 nt, Haemophilus influenzae Rd
aaauaccgcaccuuuccag

SEQ ID NO: 699101 - RNA, 16 nt, Haemophilus influenzae Rd
aaauacauuauuaaaa

SEQ ID NO: 699102 - RNA, 12 nt, Haemophilus influenzae Rd
aaauacauuuuu

SEQ ID NO: 699103 - RNA, 13 nt, Haemophilus influenzae Rd
aaauacauuuuua

SEQ ID NO: 699104 - RNA, 19 nt, Haemophilus influenzae Rd
aaauacaucuucacaaaac

SEQ ID NO: 699105 - RNA, 17 nt, Haemophilus influenzae Rd
aaauagaauauuuugca

SEQ ID NO: 699106 - RNA, 14 nt, Haemophilus influenzae Rd
aaauagaaugaaaa

SEQ ID NO: 699107 - RNA, 18 nt, Haemophilus influenzae Rd
aaauagaaugaaaaacau

SEQ ID NO: 699108 - RNA, 14 nt, Haemophilus influenzae Rd
aaauagaaauuacu

SEQ ID NO: 699109 - RNA, 23 nt, Haemophilus influenzae Rd
aaauagaaaguggcuuaauuuau

SEQ ID NO: 699110 - RNA, 14 nt, Haemophilus influenzae Rd
aaauacgagaaagc

SEQ ID NO: 699111 - RNA, 19 nt, Haemophilus influenzae Rd
aaauacgauagguaaacuu

SEQ ID NO: 699112 - RNA, 13 nt, Haemophilus influenzae Rd
aaauaccuucuug

SEQ ID NO: 699113 - RNA, 23 nt, Haemophilus influenzae Rd
aaauaccuucuugauuauuuaau

SEQ ID NO: 699114 - RNA, 15 nt, Haemophilus influenzae Rd
aaauaccgcuugaau

SEQ ID NO: 699115 - RNA, 12 nt, Haemophilus influenzae Rd
aaauaauuuuuu

SEQ ID NO: 699116 - RNA, 18 nt, Haemophilus influenzae Rd
aaauaauuuuuugaauau

SEQ ID NO: 699117 - RNA, 17 nt, Haemophilus influenzae Rd
aaauacaccaagcauua

SEQ ID NO: 699118 - RNA, 13 nt, Haemophilus influenzae Rd
aaauacagcucaa

SEQ ID NO: 699119 - RNA, 15 nt, Haemophilus influenzae Rd
aaauacauauuuuua

SEQ ID NO: 699120 - RNA, 23 nt, Haemophilus influenzae Rd
aaauaauuauggugaauaaaacc

SEQ ID NO: 699121 - RNA, 22 nt, Haemophilus influenzae Rd
aaauaauucaagaugauauuua

SEQ ID NO: 699122 - RNA, 13 nt, Haemophilus influenzae Rd
aaauaauuuccuu

SEQ ID NO: 699123 - RNA, 21 nt, Haemophilus influenzae Rd
aaauaauuuccuuuuuuauuu

SEQ ID NO: 699124 - RNA, 15 nt, Haemophilus influenzae Rd
aaauaauuuucuuug

SEQ ID NO: 699125 - RNA, 16 nt, Haemophilus influenzae Rd
aaauaauuuucuuugc

SEQ ID NO: 699126 - RNA, 20 nt, Haemophilus influenzae Rd
aaauaauuuuaggacuugug

SEQ ID NO: 699127 - RNA, 13 nt, Haemophilus influenzae Rd
aaauaauuaaaaa

SEQ ID NO: 699128 - RNA, 16 nt, Haemophilus influenzae Rd
aaauaauuaaaaauaa

SEQ ID NO: 699129 - RNA, 19 nt, Haemophilus influenzae Rd
aaauaauuaaaaauaaaua

SEQ ID NO: 699130 - RNA, 21 nt, Haemophilus influenzae Rd
aaauaaugcccgcacuuuuaa

SEQ ID NO: 699131 - RNA, 18 nt, Haemophilus influenzae Rd
aaauaaugcccuaauucu

SEQ ID NO: 699132 - RNA, 14 nt, Haemophilus influenzae Rd
aaauaaagauuauu

SEQ ID NO: 699133 - RNA, 17 nt, Haemophilus influenzae Rd
aaauaaugcaaaaacaa

SEQ ID NO: 699134 - RNA, 20 nt, Haemophilus influenzae Rd
aaauaaugcaaaaacaagug

SEQ ID NO: 699135 - RNA, 15 nt, Haemophilus influenzae Rd
aaauaucgcaaucaa

SEQ ID NO: 699136 - RNA, 22 nt, Haemophilus influenzae Rd
aaauaucgcaaucaauucuuuc

SEQ ID NO: 699137 - RNA, 21 nt, Haemophilus influenzae Rd
aaauaucggcaucuacaccuu

SEQ ID NO: 699138 - RNA, 21 nt, Haemophilus influenzae Rd
aaauaucgcccuuauuuugug

SEQ ID NO: 699139 - RNA, 19 nt, Haemophilus influenzae Rd
aaauaucaacagcuucucc

SEQ ID NO: 699140 - RNA, 22 nt, Haemophilus influenzae Rd
aaauauccguuacauauuucac

SEQ ID NO: 699141 - RNA, 13 nt, Haemophilus influenzae Rd
aaauaucuucaau

SEQ ID NO: 699142 - RNA, 13 nt, Haemophilus influenzae Rd
aaauaucucuguu

SEQ ID NO: 699143 - RNA, 13 nt, Haemophilus influenzae Rd
aaauauauuuuua

SEQ ID NO: 699144 - RNA, 15 nt, Haemophilus influenzae Rd
aaauaucaaaaaaau

SEQ ID NO: 699145 - RNA, 14 nt, Haemophilus influenzae Rd
aaauaucaaaguuc

SEQ ID NO: 699146 - RNA, 13 nt, Haemophilus influenzae Rd
aaauauauccaua

SEQ ID NO: 699147 - RNA, 15 nt, Haemophilus influenzae Rd
aaauauauccauaaa

SEQ ID NO: 699148 - RNA, 23 nt, Haemophilus influenzae Rd
aaauauauuauugugauaauuaa

SEQ ID NO: 699149 - RNA, 12 nt, Haemophilus influenzae Rd
aaauauauauua

SEQ ID NO: 699150 - RNA, 20 nt, Haemophilus influenzae Rd
aaauauaaacugacagaaga

SEQ ID NO: 699151 - RNA, 16 nt, Haemophilus influenzae Rd
aaauauaagaaaaaca

SEQ ID NO: 699152 - RNA, 15 nt, Haemophilus influenzae Rd
aaauauaaaauaaaa

SEQ ID NO: 699153 - RNA, 16 nt, Haemophilus influenzae Rd
aaauauaaaauaaaau

SEQ ID NO: 699154 - RNA, 18 nt, Haemophilus influenzae Rd
aaauauaggguaaauaaa

SEQ ID NO: 699155 - RNA, 19 nt, Haemophilus influenzae Rd
aaauauaggguaaauaaaa

SEQ ID NO: 699156 - RNA, 21 nt, Haemophilus influenzae Rd
aaauauaggguaaauaaaaau

SEQ ID NO: 699157 - RNA, 18 nt, Haemophilus influenzae Rd
aaauauaaucaauuucua

SEQ ID NO: 699158 - RNA, 13 nt, Haemophilus influenzae Rd
aaauauaaugaaa

SEQ ID NO: 699159 - RNA, 18 nt, Haemophilus influenzae Rd
aaauauacaauucuuguu

SEQ ID NO: 699160 - RNA, 16 nt, Haemophilus influenzae Rd
aaauauacagcacuaa

SEQ ID NO: 699161 - RNA, 19 nt, Haemophilus influenzae Rd
aaauagaccgcuauuuuua

SEQ ID NO: 699162 - RNA, 23 nt, Haemophilus influenzae Rd
aaauagaccgcuauuuuuaauuu

SEQ ID NO: 699163 - RNA, 17 nt, Haemophilus influenzae Rd
aaauagacuacuuaaaa

SEQ ID NO: 699164 - RNA, 19 nt, Haemophilus influenzae Rd
aaauagauacaagaaagaa

SEQ ID NO: 699165 - RNA, 19 nt, Haemophilus influenzae Rd
aaauaguuaauugauuuaa

SEQ ID NO: 699166 - RNA, 18 nt, Haemophilus influenzae Rd
aaauaguuauuuauuccu

SEQ ID NO: 699167 - RNA, 16 nt, Haemophilus influenzae Rd
aaauagaugaaauuua

SEQ ID NO: 699168 - RNA, 19 nt, Haemophilus influenzae Rd
aaauagaugaaauuuauua

SEQ ID NO: 699169 - RNA, 13 nt, Haemophilus influenzae Rd
aaagucuuuaccu

SEQ ID NO: 699170 - RNA, 13 nt, Haemophilus influenzae Rd
aaagucuguuuaa

SEQ ID NO: 699171 - RNA, 15 nt, Haemophilus influenzae Rd
aaagucuguuuaaaa

SEQ ID NO: 699172 - RNA, 12 nt, Haemophilus influenzae Rd
aaagucuuaaug

SEQ ID NO: 699173 - RNA, 20 nt, Haemophilus influenzae Rd
aaagucuuaaugacauuaaa

SEQ ID NO: 699174 - RNA, 15 nt, Haemophilus influenzae Rd
aaaguaaucgcccca

SEQ ID NO: 699175 - RNA, 22 nt, Haemophilus influenzae Rd
aaaguaguuuuaguaauuuuaa

SEQ ID NO: 699176 - RNA, 23 nt, Haemophilus influenzae Rd
aaaguauaacguagcgauaaaau

SEQ ID NO: 699177 - RNA, 20 nt, Haemophilus influenzae Rd
aaaguauaauauagaugaag

SEQ ID NO: 699178 - RNA, 12 nt, Haemophilus influenzae Rd
aaaguagcacuu

SEQ ID NO: 699179 - RNA, 17 nt, Haemophilus influenzae Rd
aaaguggagaaacauuu

SEQ ID NO: 699180 - RNA, 18 nt, Haemophilus influenzae Rd
aaaguggagaaacauuuu

SEQ ID NO: 699181 - RNA, 15 nt, Haemophilus influenzae Rd
aaaguggaugaccaa

SEQ ID NO: 699182 - RNA, 21 nt, Haemophilus influenzae Rd
aaaguggguagcuuucgcuau

SEQ ID NO: 699183 - RNA, 17 nt, Haemophilus influenzae Rd
aaaguuaaacuaaauaa

SEQ ID NO: 699184 - RNA, 14 nt, Haemophilus influenzae Rd
aaaguguauaaaua

SEQ ID NO: 699185 - RNA, 23 nt, Haemophilus influenzae Rd
aaagugcagaucgcuauuuaaua

SEQ ID NO: 699186 - RNA, 19 nt, Haemophilus influenzae Rd
aaagugcagcccaaauaaa

SEQ ID NO: 699187 - RNA, 21 nt, Haemophilus influenzae Rd
aaagugcagcccaaauaaaga

SEQ ID NO: 699188 - RNA, 19 nt, Haemophilus influenzae Rd
aaagugcggaaauauuuua

SEQ ID NO: 699189 - RNA, 22 nt, Haemophilus influenzae Rd
aaagugcggaaauauuuuaaua

SEQ ID NO: 699190 - RNA, 18 nt, Haemophilus influenzae Rd
aaagugcggcuucauuuu

SEQ ID NO: 699191 - RNA, 17 nt, Haemophilus influenzae Rd
aaagugcgguaaaaauu

SEQ ID NO: 699192 - RNA, 22 nt, Haemophilus influenzae Rd
aaagugcgguaaaaauuucucu

SEQ ID NO: 699193 - RNA, 18 nt, Haemophilus influenzae Rd
aaagugcgguaaaaucac

SEQ ID NO: 699194 - RNA, 17 nt, Haemophilus influenzae Rd
aaagugcgguaaaauuu

SEQ ID NO: 699195 - RNA, 16 nt, Haemophilus influenzae Rd
aaagugcgguaaauuu

SEQ ID NO: 699196 - RNA, 18 nt, Haemophilus influenzae Rd
aaagugcgguaagaaaau

SEQ ID NO: 699197 - RNA, 17 nt, Haemophilus influenzae Rd
aaagugcgguauuuuuu

SEQ ID NO: 699198 - RNA, 17 nt, Haemophilus influenzae Rd
aaagugcggucaauuuc

SEQ ID NO: 699199 - RNA, 21 nt, Haemophilus influenzae Rd
aaagugcggugcaauuugaaa

SEQ ID NO: 699200 - RNA, 23 nt, Haemophilus influenzae Rd
aaagugcgguuaaaaaagaaaua

SEQ ID NO: 699201 - RNA, 18 nt, Haemophilus influenzae Rd
aaagugcgguuaaaauuu

SEQ ID NO: 699202 - RNA, 19 nt, Haemophilus influenzae Rd
aaagugcgguuaauuuuuu

SEQ ID NO: 699203 - RNA, 15 nt, Haemophilus influenzae Rd
aaagugcgauauuuu

SEQ ID NO: 699204 - RNA, 17 nt, Haemophilus influenzae Rd
aaagugcgauauuuuuu

SEQ ID NO: 699205 - RNA, 16 nt, Haemophilus influenzae Rd
aaagugcgaugacaaa

SEQ ID NO: 699206 - RNA, 18 nt, Haemophilus influenzae Rd
aaagugcgguuauuuuuu

SEQ ID NO: 699207 - RNA, 20 nt, Haemophilus influenzae Rd
aaagugcgguugaauuuuuu

SEQ ID NO: 699208 - RNA, 11 nt, Haemophilus influenzae Rd
aaauaaagaag

SEQ ID NO: 699209 - RNA, 12 nt, Haemophilus influenzae Rd
aaauaaagaaga

SEQ ID NO: 699210 - RNA, 13 nt, Haemophilus influenzae Rd
aaauaaagcauua

SEQ ID NO: 699211 - RNA, 14 nt, Haemophilus influenzae Rd
aaauaaagcccugu

SEQ ID NO: 699212 - RNA, 17 nt, Haemophilus influenzae Rd
aaauaaaggauuaaaua

SEQ ID NO: 699213 - RNA, 23 nt, Haemophilus influenzae Rd
aaauaaagugcggucaauuuuca

SEQ ID NO: 699214 - RNA, 12 nt, Haemophilus influenzae Rd
aaauaaaaccau

SEQ ID NO: 699215 - RNA, 19 nt, Haemophilus influenzae Rd
aaauaaaaaugaauaaaau

SEQ ID NO: 699216 - RNA, 15 nt, Haemophilus influenzae Rd
aaauaaaaaauaaau

SEQ ID NO: 699217 - RNA, 22 nt, Haemophilus influenzae Rd
aaauaaaaaauccacacuuuaa

SEQ ID NO: 699218 - RNA, 18 nt, Haemophilus influenzae Rd
aaaguuugacuauucuaa

SEQ ID NO: 699219 - RNA, 12 nt, Haemophilus influenzae Rd
aaaguuugauaa

SEQ ID NO: 699220 - RNA, 13 nt, Haemophilus influenzae Rd
aaaguuucuuuua

SEQ ID NO: 699221 - RNA, 10 nt, Haemophilus influenzae Rd
aaaguuuuuu

SEQ ID NO: 699222 - RNA, 12 nt, Haemophilus influenzae Rd
aaaguuaucaaa

SEQ ID NO: 699223 - RNA, 21 nt, Haemophilus influenzae Rd
aaaguuagauugauuuaguuc

SEQ ID NO: 699224 - RNA, 22 nt, Haemophilus influenzae Rd
aaaguuacgauuguauuuuaaa

SEQ ID NO: 699225 - RNA, 17 nt, Haemophilus influenzae Rd
aaaguuacuuugcauuu

SEQ ID NO: 699226 - RNA, 19 nt, Haemophilus influenzae Rd
aaaguuaccauuuauuccu

SEQ ID NO: 699227 - RNA, 17 nt, Haemophilus influenzae Rd
aaaguuaaucaaacuuu

SEQ ID NO: 699228 - RNA, 20 nt, Haemophilus influenzae Rd
aaaguucagauucaauaaua

SEQ ID NO: 699229 - RNA, 18 nt, Haemophilus influenzae Rd
aaaguucuuuuuuggcuu

SEQ ID NO: 699230 - RNA, 15 nt, Haemophilus influenzae Rd
aaaguugaauauuuu

SEQ ID NO: 699231 - RNA, 15 nt, Haemophilus influenzae Rd
aaaguugagaauuuu

SEQ ID NO: 699232 - RNA, 21 nt, Haemophilus influenzae Rd
aaaguuggacuaaacaacuaa

SEQ ID NO: 699233 - RNA, 22 nt, Haemophilus influenzae Rd
aaaguuggcaacauauuuucua

SEQ ID NO: 699234 - RNA, 20 nt, Haemophilus influenzae Rd
aaaguuggcacuucaauuuc

SEQ ID NO: 699235 - RNA, 18 nt, Haemophilus influenzae Rd
aaaguuggccaauuugca

SEQ ID NO: 699236 - RNA, 19 nt, Haemophilus influenzae Rd
aaaguuggcuuacagcaaa

SEQ ID NO: 699237 - RNA, 23 nt, Haemophilus influenzae Rd
aaaguuggcuuacagcaaaagca

SEQ ID NO: 699238 - RNA, 16 nt, Haemophilus influenzae Rd
aaaguuguacuauuuu

SEQ ID NO: 699239 - RNA, 16 nt, Haemophilus influenzae Rd
aaagcugagaaauuaa

SEQ ID NO: 699240 - RNA, 17 nt, Haemophilus influenzae Rd
aaagcugagaaauuaag

SEQ ID NO: 699241 - RNA, 18 nt, Haemophilus influenzae Rd
aaagcugauauaaaaaug

SEQ ID NO: 699242 - RNA, 21 nt, Haemophilus influenzae Rd
aaagcugccaucugauuuugu

SEQ ID NO: 699243 - RNA, 18 nt, Haemophilus influenzae Rd
aaaggcgaacauaacuuu

SEQ ID NO: 699244 - RNA, 19 nt, Haemophilus influenzae Rd
aaaggcgagggauuuuaaa

SEQ ID NO: 699245 - RNA, 20 nt, Haemophilus influenzae Rd
aaaggcgagggauuuuaaau

SEQ ID NO: 699246 - RNA, 21 nt, Haemophilus influenzae Rd
aaaggaaagugcggucaacau

SEQ ID NO: 699247 - RNA, 22 nt, Haemophilus influenzae Rd
aaaggacuaaaccuaugauuau

SEQ ID NO: 699248 - RNA, 16 nt, Haemophilus influenzae Rd
aaaggacuaagcccug

SEQ ID NO: 699249 - RNA, 13 nt, Haemophilus influenzae Rd
aaagguaaaaauu

SEQ ID NO: 699250 - RNA, 17 nt, Haemophilus influenzae Rd
aaaggcuuuuuacguuc

SEQ ID NO: 699251 - RNA, 16 nt, Haemophilus influenzae Rd
aaaggcuuucuguguu

SEQ ID NO: 699252 - RNA, 15 nt, Haemophilus influenzae Rd
aaaggcgcuuccaua

SEQ ID NO: 699253 - RNA, 23 nt, Haemophilus influenzae Rd
aaaggcggauuuauuauuuaaua

SEQ ID NO: 699254 - RNA, 17 nt, Haemophilus influenzae Rd
aaaggcuucauuugcuu

SEQ ID NO: 699255 - RNA, 14 nt, Haemophilus influenzae Rd
aaagguaauugcca

SEQ ID NO: 699256 - RNA, 17 nt, Haemophilus influenzae Rd
aaagguaauugccaaua

SEQ ID NO: 699257 - RNA, 13 nt, Haemophilus influenzae Rd
aaaguaaacaauu

SEQ ID NO: 699258 - RNA, 19 nt, Haemophilus influenzae Rd
aaaggugguuucaagagga

SEQ ID NO: 699259 - RNA, 22 nt, Haemophilus influenzae Rd
aaaggugguuuugcaaaccaaa

SEQ ID NO: 699260 - RNA, 23 nt, Haemophilus influenzae Rd
aaaggugguuuugcaaaccaaau

SEQ ID NO: 699261 - RNA, 16 nt, Haemophilus influenzae Rd
aaaguaaauuuuaaaa

SEQ ID NO: 699262 - RNA, 16 nt, Haemophilus influenzae Rd
aaaguaacaauguaga

SEQ ID NO: 699263 - RNA, 19 nt, Haemophilus influenzae Rd
aaaguaaggcgagauuaaa

SEQ ID NO: 699264 - RNA, 14 nt, Haemophilus influenzae Rd
aaagcauaauauuc

SEQ ID NO: 699265 - RNA, 16 nt, Haemophilus influenzae Rd
aaagccguagucugcu

SEQ ID NO: 699266 - RNA, 15 nt, Haemophilus influenzae Rd
aaagcgaauuucuuu

SEQ ID NO: 699267 - RNA, 17 nt, Haemophilus influenzae Rd
aaagcgaauuucuuuua

SEQ ID NO: 699268 - RNA, 15 nt, Haemophilus influenzae Rd
aaagccuuuuauuuc

SEQ ID NO: 699269 - RNA, 22 nt, Haemophilus influenzae Rd
aaagccuugauucuacugaaau

SEQ ID NO: 699270 - RNA, 17 nt, Haemophilus influenzae Rd
aaagccugcuacauuug

SEQ ID NO: 699271 - RNA, 21 nt, Haemophilus influenzae Rd
aaagccuguugauguuuuaac

SEQ ID NO: 699272 - RNA, 18 nt, Haemophilus influenzae Rd
aaagcugaauaaauaaac

SEQ ID NO: 699273 - RNA, 19 nt, Haemophilus influenzae Rd
aaagcucguauaauauuuu

SEQ ID NO: 699274 - RNA, 23 nt, Haemophilus influenzae Rd
aaagcucguauaauauuuucuuu

SEQ ID NO: 699275 - RNA, 22 nt, Haemophilus influenzae Rd
aaagcgaguaagggcaaaaaau

SEQ ID NO: 699276 - RNA, 18 nt, Haemophilus influenzae Rd
aaagaaugucaucuaauu

SEQ ID NO: 699277 - RNA, 13 nt, Haemophilus influenzae Rd
aaagaauuaaaau

SEQ ID NO: 699278 - RNA, 13 nt, Haemophilus influenzae Rd
aaagaauuucuuu

SEQ ID NO: 699279 - RNA, 12 nt, Haemophilus influenzae Rd
aaagaauuuuuu

SEQ ID NO: 699280 - RNA, 16 nt, Haemophilus influenzae Rd
aaagaauuuuuucaca

SEQ ID NO: 699281 - RNA, 14 nt, Haemophilus influenzae Rd
aaagaagaaaaucu

SEQ ID NO: 699282 - RNA, 23 nt, Haemophilus influenzae Rd
aaagaagcuauuacucuuaauuu

SEQ ID NO: 699283 - RNA, 19 nt, Haemophilus influenzae Rd
aaagaauauuuuaaugaaa

SEQ ID NO: 699284 - RNA, 23 nt, Haemophilus influenzae Rd
aaagaauauuuuaaugaaaguaa

SEQ ID NO: 699285 - RNA, 19 nt, Haemophilus influenzae Rd
aaagaaucaucuucaucug

SEQ ID NO: 699286 - RNA, 12 nt, Haemophilus influenzae Rd
aaagaaauuuaa

SEQ ID NO: 699287 - RNA, 14 nt, Haemophilus influenzae Rd
aaagaaauuuuaau

SEQ ID NO: 699288 - RNA, 15 nt, Haemophilus influenzae Rd
aaagaaauauuuuua

SEQ ID NO: 699289 - RNA, 13 nt, Haemophilus influenzae Rd
aaagaaauauaau

SEQ ID NO: 699290 - RNA, 18 nt, Haemophilus influenzae Rd
aaagaaauauauuauugu

SEQ ID NO: 699291 - RNA, 15 nt, Haemophilus influenzae Rd
aaagaaaguauuaaa

SEQ ID NO: 699292 - RNA, 20 nt, Haemophilus influenzae Rd
aaagaaaguauuaaauauaa

SEQ ID NO: 699293 - RNA, 22 nt, Haemophilus influenzae Rd
aaagaaaauauuuaacuaauuu

SEQ ID NO: 699294 - RNA, 13 nt, Haemophilus influenzae Rd
aaagaaaacuuau

SEQ ID NO: 699295 - RNA, 15 nt, Haemophilus influenzae Rd
aaagaaaacuuauaa

SEQ ID NO: 699296 - RNA, 16 nt, Haemophilus influenzae Rd
aaagaaaagcgaauuu

SEQ ID NO: 699297 - RNA, 20 nt, Haemophilus influenzae Rd
aaagaaaagcgaauuucuua

SEQ ID NO: 699298 - RNA, 13 nt, Haemophilus influenzae Rd
aaagaaagcaaug

SEQ ID NO: 699299 - RNA, 16 nt, Haemophilus influenzae Rd
aaagaaagcaauguag

SEQ ID NO: 699300 - RNA, 23 nt, Haemophilus influenzae Rd
aaagaaacgccuacaucuuaaug

SEQ ID NO: 699301 - RNA, 16 nt, Haemophilus influenzae Rd
aaagaaacugucuacu

SEQ ID NO: 699302 - RNA, 19 nt, Haemophilus influenzae Rd
aaaccucagaagaaauuaa

SEQ ID NO: 699303 - RNA, 20 nt, Haemophilus influenzae Rd
aaaccucagaagaaauuaag

SEQ ID NO: 699304 - RNA, 20 nt, Haemophilus influenzae Rd
aaaccuacacccacugauuu

SEQ ID NO: 699305 - RNA, 23 nt, Haemophilus influenzae Rd
aaaccuacacccacugauuuuuc

SEQ ID NO: 699306 - RNA, 14 nt, Haemophilus influenzae Rd
aaaccuaacauaau

SEQ ID NO: 699307 - RNA, 24 nt, Haemophilus influenzae Rd
aaaccguuagguuuaaaagauacu

SEQ ID NO: 699308 - RNA, 19 nt, Haemophilus influenzae Rd
aaagauguuccuacagaac

SEQ ID NO: 699309 - RNA, 23 nt, Haemophilus influenzae Rd
aaagaugguugucgaaaaaagag

SEQ ID NO: 699310 - RNA, 14 nt, Haemophilus influenzae Rd
aaagauuauuuaau

SEQ ID NO: 699311 - RNA, 15 nt, Haemophilus influenzae Rd
aaagauucaacaaua

SEQ ID NO: 699312 - RNA, 20 nt, Haemophilus influenzae Rd
aaagcacccaucacauuuuc

SEQ ID NO: 699313 - RNA, 21 nt, Haemophilus influenzae Rd
aaagcaauguugcaacuaaua

SEQ ID NO: 699314 - RNA, 13 nt, Haemophilus influenzae Rd
aaagcaauauuua

SEQ ID NO: 699315 - RNA, 16 nt, Haemophilus influenzae Rd
aaagcaaucaaaaaug

SEQ ID NO: 699316 - RNA, 15 nt, Haemophilus influenzae Rd
aaagcaagaucuaaa

SEQ ID NO: 699317 - RNA, 16 nt, Haemophilus influenzae Rd
aaagcaaccaaugcaa

SEQ ID NO: 699318 - RNA, 21 nt, Haemophilus influenzae Rd
aaagauuguccuuuugccauu

SEQ ID NO: 699319 - RNA, 15 nt, Haemophilus influenzae Rd
aaagagugaccaguc

SEQ ID NO: 699320 - RNA, 20 nt, Haemophilus influenzae Rd
aaagauccuuccaccacaac

SEQ ID NO: 699321 - RNA, 15 nt, Haemophilus influenzae Rd
aaagaguaagcaagu

SEQ ID NO: 699322 - RNA, 18 nt, Haemophilus influenzae Rd
aaagacagcuauuaaaaa

SEQ ID NO: 699323 - RNA, 20 nt, Haemophilus influenzae Rd
aaagaggagguagaaaaucg

SEQ ID NO: 699324 - RNA, 20 nt, Haemophilus influenzae Rd
aaagacccaccgcaaaagcc

SEQ ID NO: 699325 - RNA, 20 nt, Haemophilus influenzae Rd
caaacuauuaccuaaccaaa

SEQ ID NO: 699326 - RNA, 16 nt, Haemophilus influenzae Rd
caaacugccaaacaaa

SEQ ID NO: 699327 - RNA, 20 nt, Haemophilus influenzae Rd
caaacucgguuuauuuucag

SEQ ID NO: 699328 - RNA, 14 nt, Haemophilus influenzae Rd
caaacucuugugcc

SEQ ID NO: 699329 - RNA, 22 nt, Haemophilus influenzae Rd
caaacuggaauaaagcaaccaa

SEQ ID NO: 699330 - RNA, 15 nt, Haemophilus influenzae Rd
caaaggguaaauaac

SEQ ID NO: 699331 - RNA, 16 nt, Haemophilus influenzae Rd
caaagguaaaacuuuc

SEQ ID NO: 699332 - RNA, 22 nt, Haemophilus influenzae Rd
caaagcuggcucuucuuguuca

SEQ ID NO: 699333 - RNA, 17 nt, Haemophilus influenzae Rd
caaagcguucauuuuga

SEQ ID NO: 699334 - RNA, 17 nt, Haemophilus influenzae Rd
caaagcguuuuaaaauc

SEQ ID NO: 699335 - RNA, 18 nt, Haemophilus influenzae Rd
caaagcguuuuaaaaucu

SEQ ID NO: 699336 - RNA, 18 nt, Haemophilus influenzae Rd
caaagcguccaagcaagc

SEQ ID NO: 699337 - RNA, 20 nt, Haemophilus influenzae Rd
caaagcucaccugcccugaa

SEQ ID NO: 699338 - RNA, 19 nt, Haemophilus influenzae Rd
caaagcauuaaguuuuuag

SEQ ID NO: 699339 - RNA, 21 nt, Haemophilus influenzae Rd
caaagcauuuagagcaagcaa

SEQ ID NO: 699340 - RNA, 13 nt, Haemophilus influenzae Rd
caaagcacuaauc

SEQ ID NO: 699341 - RNA, 22 nt, Haemophilus influenzae Rd
caaagcacuaugguguuacuua

SEQ ID NO: 699342 - RNA, 16 nt, Haemophilus influenzae Rd
caaauacagugacaaa

SEQ ID NO: 699343 - RNA, 17 nt, Haemophilus influenzae Rd
caaauacauauuuuuag

SEQ ID NO: 699344 - RNA, 18 nt, Haemophilus influenzae Rd
caaauacauauuuuuaga

SEQ ID NO: 699345 - RNA, 18 nt, Haemophilus influenzae Rd
caaauacaucuucacaaa

SEQ ID NO: 699346 - RNA, 21 nt, Haemophilus influenzae Rd
caaauacauuuuguuucuaaa

SEQ ID NO: 699347 - RNA, 23 nt, Haemophilus influenzae Rd
caaauacaauuuucuuuucaaac

SEQ ID NO: 699348 - RNA, 15 nt, Haemophilus influenzae Rd
caaauacacaaauca

SEQ ID NO: 699349 - RNA, 21 nt, Haemophilus influenzae Rd
caaauacaccgucaucuugag

SEQ ID NO: 699350 - RNA, 20 nt, Haemophilus influenzae Rd
caaauaaauuugguacaugu

SEQ ID NO: 699351 - RNA, 19 nt, Haemophilus influenzae Rd
caaauaacuauuggcauca

SEQ ID NO: 699352 - RNA, 20 nt, Haemophilus influenzae Rd
caaauaacugauaugccaag

SEQ ID NO: 699353 - RNA, 23 nt, Haemophilus influenzae Rd
caaauaacugauaugccaaggcu

SEQ ID NO: 699354 - RNA, 19 nt, Haemophilus influenzae Rd
caaauaacacagaaaccaa

SEQ ID NO: 699355 - RNA, 14 nt, Haemophilus influenzae Rd
caaauaauacaucu

SEQ ID NO: 699356 - RNA, 20 nt, Haemophilus influenzae Rd
caaauaauacuugaccaaaa

SEQ ID NO: 699357 - RNA, 21 nt, Haemophilus influenzae Rd
caaagguuaaaccuaaauccc

SEQ ID NO: 699358 - RNA, 18 nt, Haemophilus influenzae Rd
caaagguuuuauuuugaa

SEQ ID NO: 699359 - RNA, 12 nt, Haemophilus influenzae Rd
caaaguaacuuu

SEQ ID NO: 699360 - RNA, 15 nt, Haemophilus influenzae Rd
caaaguaacuuuaau

SEQ ID NO: 699361 - RNA, 23 nt, Haemophilus influenzae Rd
caaagugcgguaagaaaaucaac

SEQ ID NO: 699362 - RNA, 18 nt, Haemophilus influenzae Rd
caaagugcgguaaucuuu

SEQ ID NO: 699363 - RNA, 19 nt, Haemophilus influenzae Rd
caaagugcgguuaaauauu

SEQ ID NO: 699364 - RNA, 22 nt, Haemophilus influenzae Rd
caaagugcgguuaguuuuuuau

SEQ ID NO: 699365 - RNA, 17 nt, Haemophilus influenzae Rd
caaaguuccuagaauua

SEQ ID NO: 699366 - RNA, 13 nt, Haemophilus influenzae Rd
caaaguuaccauu

SEQ ID NO: 699367 - RNA, 13 nt, Haemophilus influenzae Rd
caaauaaaauaga

SEQ ID NO: 699368 - RNA, 17 nt, Haemophilus influenzae Rd
caaauaaaauagacaau

SEQ ID NO: 699369 - RNA, 16 nt, Haemophilus influenzae Rd
caaauaaaaagugggu

SEQ ID NO: 699370 - RNA, 15 nt, Haemophilus influenzae Rd
caaauaaaauuacaa

SEQ ID NO: 699371 - RNA, 21 nt, Haemophilus influenzae Rd
caaauaaaauuacaaaaccaa

SEQ ID NO: 699372 - RNA, 23 nt, Haemophilus influenzae Rd
caaaauauuaguuagcuaaaaaa

SEQ ID NO: 699373 - RNA, 22 nt, Haemophilus influenzae Rd
caaaauaucacuuuuuuauucu

SEQ ID NO: 699374 - RNA, 20 nt, Haemophilus influenzae Rd
caaaauaugcaucagauuuu

SEQ ID NO: 699375 - RNA, 10 nt, Haemophilus influenzae Rd
caaaaucaau

SEQ ID NO: 699376 - RNA, 14 nt, Haemophilus influenzae Rd
caaaaucagcaaau

SEQ ID NO: 699377 - RNA, 17 nt, Haemophilus influenzae Rd
caaaaucagcaaauugu

SEQ ID NO: 699378 - RNA, 15 nt, Haemophilus influenzae Rd
caaaauaaacucauu

SEQ ID NO: 699379 - RNA, 17 nt, Haemophilus influenzae Rd
caaaauaaauaaaauau

SEQ ID NO: 699380 - RNA, 22 nt, Haemophilus influenzae Rd
caaaauaaauaaaauauuuggc

SEQ ID NO: 699381 - RNA, 14 nt, Haemophilus influenzae Rd
caaaauaaaugauu

SEQ ID NO: 699382 - RNA, 13 nt, Haemophilus influenzae Rd
caaaaguuggauu

SEQ ID NO: 699383 - RNA, 18 nt, Haemophilus influenzae Rd
caaaaccauucaguaaua

SEQ ID NO: 699384 - RNA, 21 nt, Haemophilus influenzae Rd
caaaaccauccaagcaaagaa

SEQ ID NO: 699385 - RNA, 22 nt, Haemophilus influenzae Rd
caaaaccauccaagcaaagaaa

SEQ ID NO: 699386 - RNA, 19 nt, Haemophilus influenzae Rd
caaaaccaaucauaaaauu

SEQ ID NO: 699387 - RNA, 14 nt, Haemophilus influenzae Rd
caaaaugagcuuuu

SEQ ID NO: 699388 - RNA, 21 nt, Haemophilus influenzae Rd
caaaaugcuugaauaaaugac

SEQ ID NO: 699389 - RNA, 19 nt, Haemophilus influenzae Rd
caaaauggcaaacaaaaua

SEQ ID NO: 699390 - RNA, 17 nt, Haemophilus influenzae Rd
caaaauugcuuaaugga

SEQ ID NO: 699391 - RNA, 15 nt, Haemophilus influenzae Rd
caaaauuguguguuu

SEQ ID NO: 699392 - RNA, 19 nt, Haemophilus influenzae Rd
caaaauugaucgaaaaauc

SEQ ID NO: 699393 - RNA, 16 nt, Haemophilus influenzae Rd
caaaauugaugaaaau

SEQ ID NO: 699394 - RNA, 18 nt, Haemophilus influenzae Rd
caaaauugaugaaaauuc

SEQ ID NO: 699395 - RNA, 12 nt, Haemophilus influenzae Rd
caaaauuuaaaa

SEQ ID NO: 699396 - RNA, 14 nt, Haemophilus influenzae Rd
caaaauuuaagccu

SEQ ID NO: 699397 - RNA, 17 nt, Haemophilus influenzae Rd
caaaauuucugaacaca

SEQ ID NO: 699398 - RNA, 20 nt, Haemophilus influenzae Rd
caaaauuuuaaauaaaauau

SEQ ID NO: 699399 - RNA, 16 nt, Haemophilus influenzae Rd
caaacauaccuaaaaa

SEQ ID NO: 699400 - RNA, 20 nt, Haemophilus influenzae Rd
caaacaucagcgcauaauua

SEQ ID NO: 699401 - RNA, 23 nt, Haemophilus influenzae Rd
caaacauuaaucgaucaauuugc

SEQ ID NO: 699402 - RNA, 21 nt, Haemophilus influenzae Rd
caaacaggcuuauuaaaaacu

SEQ ID NO: 699403 - RNA, 22 nt, Haemophilus influenzae Rd
caaacaggcuuauuaaaaacua

SEQ ID NO: 699404 - RNA, 20 nt, Haemophilus influenzae Rd
caaacaguucaauaaaaaua

SEQ ID NO: 699405 - RNA, 14 nt, Haemophilus influenzae Rd
caaacagcaauaaa

SEQ ID NO: 699406 - RNA, 14 nt, Haemophilus influenzae Rd
caaacaugcuccca

SEQ ID NO: 699407 - RNA, 17 nt, Haemophilus influenzae Rd
caaacgagaaaauuucu

SEQ ID NO: 699408 - RNA, 20 nt, Haemophilus influenzae Rd
caaacgacuuaauuuuauag

SEQ ID NO: 699409 - RNA, 18 nt, Haemophilus influenzae Rd
caaacgccguucaaaauc

SEQ ID NO: 699410 - RNA, 15 nt, Haemophilus influenzae Rd
caaacuaauuucauu

SEQ ID NO: 699411 - RNA, 15 nt, Haemophilus influenzae Rd
caaacgcguuaaauc

SEQ ID NO: 699412 - RNA, 14 nt, Haemophilus influenzae Rd
caaacuaaaugcuc

SEQ ID NO: 699413 - RNA, 14 nt, Haemophilus influenzae Rd
caaauagaugaaau

SEQ ID NO: 699414 - RNA, 16 nt, Haemophilus influenzae Rd
caaauagcaaaaccga

SEQ ID NO: 699415 - RNA, 17 nt, Haemophilus influenzae Rd
caaauuaucaaagaauu

SEQ ID NO: 699416 - RNA, 19 nt, Haemophilus influenzae Rd
caaauuaucaaagaauuuu

SEQ ID NO: 699417 - RNA, 16 nt, Haemophilus influenzae Rd
caaauuacccaaauga

SEQ ID NO: 699418 - RNA, 17 nt, Haemophilus influenzae Rd
caaauuacccaaaugau

SEQ ID NO: 699419 - RNA, 14 nt, Haemophilus influenzae Rd
caaaugcuaaauuc

SEQ ID NO: 699420 - RNA, 21 nt, Haemophilus influenzae Rd
caaauuaauuaaucaauaaga

SEQ ID NO: 699421 - RNA, 20 nt, Haemophilus influenzae Rd
caaauuuuauauauccaaau

SEQ ID NO: 699422 - RNA, 15 nt, Haemophilus influenzae Rd
caaauuuuuucaaaa

SEQ ID NO: 699423 - RNA, 16 nt, Haemophilus influenzae Rd
caaauuuuucuuuucu

SEQ ID NO: 699424 - RNA, 12 nt, Haemophilus influenzae Rd
caacaaaaaggc

SEQ ID NO: 699425 - RNA, 13 nt, Haemophilus influenzae Rd
caaauuuuccuuc

SEQ ID NO: 699426 - RNA, 14 nt, Haemophilus influenzae Rd
caaauuuucguuua

SEQ ID NO: 699427 - RNA, 21 nt, Haemophilus influenzae Rd
caaauuuuccgcauaaauaau

SEQ ID NO: 699428 - RNA, 20 nt, Haemophilus influenzae Rd
caaauuuguugcauuucuaa

SEQ ID NO: 699429 - RNA, 18 nt, Haemophilus influenzae Rd
caaauuugaucuuagaca

SEQ ID NO: 699430 - RNA, 14 nt, Haemophilus influenzae Rd
caaauucaacacgc

SEQ ID NO: 699431 - RNA, 23 nt, Haemophilus influenzae Rd
caaauucaacacgccuaacauaa

SEQ ID NO: 699432 - RNA, 15 nt, Haemophilus influenzae Rd
caaauuucuugcuau

SEQ ID NO: 699433 - RNA, 22 nt, Haemophilus influenzae Rd
caaauugcccuguugaaacagg

SEQ ID NO: 699434 - RNA, 16 nt, Haemophilus influenzae Rd
caaauugaugcucugc

SEQ ID NO: 699435 - RNA, 13 nt, Haemophilus influenzae Rd
caaauugauuaag

SEQ ID NO: 699436 - RNA, 14 nt, Haemophilus influenzae Rd
caaauugcaaaaaa

SEQ ID NO: 699437 - RNA, 15 nt, Haemophilus influenzae Rd
caaauugcaaaaaac

SEQ ID NO: 699438 - RNA, 16 nt, Haemophilus influenzae Rd
caaauugcaaaaaacu

SEQ ID NO: 699439 - RNA, 17 nt, Haemophilus influenzae Rd
caaauugcaaaaaacuu

SEQ ID NO: 699440 - RNA, 17 nt, Haemophilus influenzae Rd
caaauugauucauuuga

SEQ ID NO: 699441 - RNA, 18 nt, Haemophilus influenzae Rd
caacagauuuaauaccau

SEQ ID NO: 699442 - RNA, 16 nt, Haemophilus influenzae Rd
caacacuuuauuacuu

SEQ ID NO: 699443 - RNA, 20 nt, Haemophilus influenzae Rd
caacacuuuauuacuuuuau

SEQ ID NO: 699444 - RNA, 21 nt, Haemophilus influenzae Rd
caacacuugcuguuuuuccgc

SEQ ID NO: 699445 - RNA, 13 nt, Haemophilus influenzae Rd
caacaacuuuucu

SEQ ID NO: 699446 - RNA, 13 nt, Haemophilus influenzae Rd
caacaaucacugu

SEQ ID NO: 699447 - RNA, 15 nt, Haemophilus influenzae Rd
caacaaguucuucua

SEQ ID NO: 699448 - RNA, 22 nt, Haemophilus influenzae Rd
caacaaguaagucgugaucugc

SEQ ID NO: 699449 - RNA, 21 nt, Haemophilus influenzae Rd
caacaagucaucgaguuuuau

SEQ ID NO: 699450 - RNA, 14 nt, Haemophilus influenzae Rd
caacaauucauaaa

SEQ ID NO: 699451 - RNA, 19 nt, Haemophilus influenzae Rd
caacaauucauaaauaauu

SEQ ID NO: 699452 - RNA, 20 nt, Haemophilus influenzae Rd
caacaauucauaaauaauug

SEQ ID NO: 699453 - RNA, 20 nt, Haemophilus influenzae Rd
caaccacuucgccaagugca

SEQ ID NO: 699454 - RNA, 13 nt, Haemophilus influenzae Rd
caaccacuucaaa

SEQ ID NO: 699455 - RNA, 16 nt, Haemophilus influenzae Rd
caaccacuucaaauac

SEQ ID NO: 699456 - RNA, 13 nt, Haemophilus influenzae Rd
caaccacccaaau

SEQ ID NO: 699457 - RNA, 19 nt, Haemophilus influenzae Rd
caaccgauaaggaaaauac

SEQ ID NO: 699458 - RNA, 14 nt, Haemophilus influenzae Rd
caacauaagcugca

SEQ ID NO: 699459 - RNA, 16 nt, Haemophilus influenzae Rd
caacauauuuucuaag

SEQ ID NO: 699460 - RNA, 14 nt, Haemophilus influenzae Rd
caacauuuuuugcu

SEQ ID NO: 699461 - RNA, 23 nt, Haemophilus influenzae Rd
caacauagucgcuggaacuucua

SEQ ID NO: 699462 - RNA, 19 nt, Haemophilus influenzae Rd
caacauaguugaugaacca

SEQ ID NO: 699463 - RNA, 14 nt, Haemophilus influenzae Rd
caaccaaacaaaaa

SEQ ID NO: 699464 - RNA, 17 nt, Haemophilus influenzae Rd
caaccaaaauacaauca

SEQ ID NO: 699465 - RNA, 24 nt, Haemophilus influenzae Rd
caacgacuuuaccauugcguucac

SEQ ID NO: 699466 - RNA, 14 nt, Haemophilus influenzae Rd
caacgacuaaaauu

SEQ ID NO: 699467 - RNA, 18 nt, Haemophilus influenzae Rd
caaccuugagcaauauaa

SEQ ID NO: 699468 - RNA, 18 nt, Haemophilus influenzae Rd
caaccuuugguaaaagaa

SEQ ID NO: 699469 - RNA, 17 nt, Haemophilus influenzae Rd
caaccuuggucggaaug

SEQ ID NO: 699470 - RNA, 14 nt, Haemophilus influenzae Rd
caacuguuauauug

SEQ ID NO: 699471 - RNA, 21 nt, Haemophilus influenzae Rd
caacuuaaguugggcuuauuu

SEQ ID NO: 699472 - RNA, 17 nt, Haemophilus influenzae Rd
caacuucggaagaaaaa

SEQ ID NO: 699473 - RNA, 16 nt, Haemophilus influenzae Rd
caacugcaaaugaaac

SEQ ID NO: 699474 - RNA, 17 nt, Haemophilus influenzae Rd
caacuaaaaaauaguua

SEQ ID NO: 699475 - RNA, 14 nt, Haemophilus influenzae Rd
caacuaaaaauccc

SEQ ID NO: 699476 - RNA, 14 nt, Haemophilus influenzae Rd
caacuaaaucaucu

SEQ ID NO: 699477 - RNA, 15 nt, Haemophilus influenzae Rd
caacuaauaaaccaa

SEQ ID NO: 699478 - RNA, 16 nt, Haemophilus influenzae Rd
caacuaauaaaccaau

SEQ ID NO: 699479 - RNA, 13 nt, Haemophilus influenzae Rd
caacuugagcaaa

SEQ ID NO: 699480 - RNA, 21 nt, Haemophilus influenzae Rd
caacuucugcgccuaauccaa

SEQ ID NO: 699481 - RNA, 20 nt, Haemophilus influenzae Rd
caacuugccacaguagaugu

SEQ ID NO: 699482 - RNA, 14 nt, Haemophilus influenzae Rd
caacuuggaaugca

SEQ ID NO: 699483 - RNA, 23 nt, Haemophilus influenzae Rd
caacuuuauguccauaacuguca

SEQ ID NO: 699484 - RNA, 20 nt, Haemophilus influenzae Rd
caacuuuuuauuuucugcag

SEQ ID NO: 699485 - RNA, 17 nt, Haemophilus influenzae Rd
caacuuuuucaucuuua

SEQ ID NO: 699486 - RNA, 12 nt, Haemophilus influenzae Rd
caagaaacucaa

SEQ ID NO: 699487 - RNA, 15 nt, Haemophilus influenzae Rd
caagaaacucaaggu

SEQ ID NO: 699488 - RNA, 18 nt, Haemophilus influenzae Rd
caacuuuugagucaauuu

SEQ ID NO: 699489 - RNA, 20 nt, Haemophilus influenzae Rd
caagaaaguuuaugacgaac

SEQ ID NO: 699490 - RNA, 14 nt, Haemophilus influenzae Rd
caagaaagaaauau

SEQ ID NO: 699491 - RNA, 22 nt, Haemophilus influenzae Rd
caagaaagaaauauaauaaaua

SEQ ID NO: 699492 - RNA, 18 nt, Haemophilus influenzae Rd
caagaaauugauauaaau

SEQ ID NO: 699493 - RNA, 13 nt, Haemophilus influenzae Rd
caagaacagccag

SEQ ID NO: 699494 - RNA, 23 nt, Haemophilus influenzae Rd
caagagccaguuggguuaaauau

SEQ ID NO: 699495 - RNA, 17 nt, Haemophilus influenzae Rd
caagauucugaaagaua

SEQ ID NO: 699496 - RNA, 21 nt, Haemophilus influenzae Rd
caagcacaucauaacuacgaa

SEQ ID NO: 699497 - RNA, 15 nt, Haemophilus influenzae Rd
caagcacuuuuccuu

SEQ ID NO: 699498 - RNA, 16 nt, Haemophilus influenzae Rd
caagcacuuuuccuuu

SEQ ID NO: 699499 - RNA, 16 nt, Haemophilus influenzae Rd
caagcaaccuguggca

SEQ ID NO: 699500 - RNA, 16 nt, Haemophilus influenzae Rd
caagcaagcaaaauua

SEQ ID NO: 699501 - RNA, 14 nt, Haemophilus influenzae Rd
caagauuuuuugaa

SEQ ID NO: 699502 - RNA, 14 nt, Haemophilus influenzae Rd
caagcaacaaguca

SEQ ID NO: 699503 - RNA, 11 nt, Haemophilus influenzae Rd
caagcaaauau

SEQ ID NO: 699504 - RNA, 12 nt, Haemophilus influenzae Rd
caagauucuaaa

SEQ ID NO: 699505 - RNA, 18 nt, Haemophilus influenzae Rd
caagauuugccaaaauca

SEQ ID NO: 699506 - RNA, 17 nt, Haemophilus influenzae Rd
caagauuugcugcugcu

SEQ ID NO: 699507 - RNA, 20 nt, Haemophilus influenzae Rd
caagcgcgugugaaauuccu

SEQ ID NO: 699508 - RNA, 16 nt, Haemophilus influenzae Rd
caagcguuaauccaag

SEQ ID NO: 699509 - RNA, 22 nt, Haemophilus influenzae Rd
caagccacgguuacgaauugca

SEQ ID NO: 699510 - RNA, 14 nt, Haemophilus influenzae Rd
caaggacaauaaua

SEQ ID NO: 699511 - RNA, 18 nt, Haemophilus influenzae Rd
caaggacaauaauaagca

SEQ ID NO: 699512 - RNA, 18 nt, Haemophilus influenzae Rd
caaggaaucgaaauuaaa

SEQ ID NO: 699513 - RNA, 22 nt, Haemophilus influenzae Rd
caaggaaucgaaauuaaaauaa

SEQ ID NO: 699514 - RNA, 22 nt, Haemophilus influenzae Rd
caaggcucaucauuaugaaaaa

SEQ ID NO: 699515 - RNA, 19 nt, Haemophilus influenzae Rd
caagguugcaacaucaaua

SEQ ID NO: 699516 - RNA, 21 nt, Haemophilus influenzae Rd
caagguagauugauacaggaa

SEQ ID NO: 699517 - RNA, 15 nt, Haemophilus influenzae Rd
caagguacuugaacu

SEQ ID NO: 699518 - RNA, 19 nt, Haemophilus influenzae Rd
caaggguacaacaaauuuc

SEQ ID NO: 699519 - RNA, 20 nt, Haemophilus influenzae Rd
caaggguacaacaaauuuca

SEQ ID NO: 699520 - RNA, 15 nt, Haemophilus influenzae Rd
caaggguaucuaaau

SEQ ID NO: 699521 - RNA, 21 nt, Haemophilus influenzae Rd
caaucuccguugggauuuuuu

SEQ ID NO: 699522 - RNA, 12 nt, Haemophilus influenzae Rd
caaucucuuuac

SEQ ID NO: 699523 - RNA, 15 nt, Haemophilus influenzae Rd
caaucaucauuuauu

SEQ ID NO: 699524 - RNA, 19 nt, Haemophilus influenzae Rd
caaucaucccuucuuuuau

SEQ ID NO: 699525 - RNA, 16 nt, Haemophilus influenzae Rd
caauauugaccguuug

SEQ ID NO: 699526 - RNA, 15 nt, Haemophilus influenzae Rd
caauauucuuuaaaa

SEQ ID NO: 699527 - RNA, 17 nt, Haemophilus influenzae Rd
caauauucuuuaaaaca

SEQ ID NO: 699528 - RNA, 20 nt, Haemophilus influenzae Rd
caauauucuuuaaaacauuc

SEQ ID NO: 699529 - RNA, 11 nt, Haemophilus influenzae Rd
caauauuauuc

SEQ ID NO: 699530 - RNA, 15 nt, Haemophilus influenzae Rd
caauauuauucagca

SEQ ID NO: 699531 - RNA, 15 nt, Haemophilus influenzae Rd
caauauuuaaauaca

SEQ ID NO: 699532 - RNA, 18 nt, Haemophilus influenzae Rd
caauauuuaaauacacuu

SEQ ID NO: 699533 - RNA, 18 nt, Haemophilus influenzae Rd
caauauuuaauauauuuu

SEQ ID NO: 699534 - RNA, 12 nt, Haemophilus influenzae Rd
caauauuuaaau

SEQ ID NO: 699535 - RNA, 15 nt, Haemophilus influenzae Rd
caauauuuauuucua

SEQ ID NO: 699536 - RNA, 13 nt, Haemophilus influenzae Rd
caauauuucaaua

SEQ ID NO: 699537 - RNA, 14 nt, Haemophilus influenzae Rd
caauauuucaauaa

SEQ ID NO: 699538 - RNA, 12 nt, Haemophilus influenzae Rd
caaucauaucau

SEQ ID NO: 699539 - RNA, 16 nt, Haemophilus influenzae Rd
caaucaucagaauaau

SEQ ID NO: 699540 - RNA, 17 nt, Haemophilus influenzae Rd
caaucaucaucccaauc

SEQ ID NO: 699541 - RNA, 23 nt, Haemophilus influenzae Rd
caaugaguguuauugaugaagau

SEQ ID NO: 699542 - RNA, 22 nt, Haemophilus influenzae Rd
caaugauugagcgauagaaaua

SEQ ID NO: 699543 - RNA, 11 nt, Haemophilus influenzae Rd
caaugauuaau

SEQ ID NO: 699544 - RNA, 14 nt, Haemophilus influenzae Rd
caaugauccccauu

SEQ ID NO: 699545 - RNA, 17 nt, Haemophilus influenzae Rd
caaucuuuggcaaaaaa

SEQ ID NO: 699546 - RNA, 17 nt, Haemophilus influenzae Rd
caaugaagauuaacuca

SEQ ID NO: 699547 - RNA, 14 nt, Haemophilus influenzae Rd
caaugaaauauuac

SEQ ID NO: 699548 - RNA, 15 nt, Haemophilus influenzae Rd
caaugccucuuuuuu

SEQ ID NO: 699549 - RNA, 22 nt, Haemophilus influenzae Rd
caaugccucuuuuuucauugca

SEQ ID NO: 699550 - RNA, 15 nt, Haemophilus influenzae Rd
caaugccuuuuguau

SEQ ID NO: 699551 - RNA, 17 nt, Haemophilus influenzae Rd
caaugcggagaaaagca

SEQ ID NO: 699552 - RNA, 18 nt, Haemophilus influenzae Rd
caaugccagcgcuugcac

SEQ ID NO: 699553 - RNA, 15 nt, Haemophilus influenzae Rd
caaugcacuuguggc

SEQ ID NO: 699554 - RNA, 15 nt, Haemophilus influenzae Rd
caaugccaaaaccau

SEQ ID NO: 699555 - RNA, 14 nt, Haemophilus influenzae Rd
caaugccaaucuaa

SEQ ID NO: 699556 - RNA, 15 nt, Haemophilus influenzae Rd
caaugcaauuggcaa

SEQ ID NO: 699557 - RNA, 14 nt, Haemophilus influenzae Rd
caaugcaaauacaa

SEQ ID NO: 699558 - RNA, 14 nt, Haemophilus influenzae Rd
caaugcaacaauac

SEQ ID NO: 699559 - RNA, 14 nt, Haemophilus influenzae Rd
caauauaacucaac

SEQ ID NO: 699560 - RNA, 15 nt, Haemophilus influenzae Rd
caauauaacucaaca

SEQ ID NO: 699561 - RNA, 22 nt, Haemophilus influenzae Rd
caauauaaugguggcguuuuau

SEQ ID NO: 699562 - RNA, 19 nt, Haemophilus influenzae Rd
caauaugcgcuucaucaaa

SEQ ID NO: 699563 - RNA, 23 nt, Haemophilus influenzae Rd
caauauggguucaauauaacuca

SEQ ID NO: 699564 - RNA, 17 nt, Haemophilus influenzae Rd
caauauguauaauuccu

SEQ ID NO: 699565 - RNA, 20 nt, Haemophilus influenzae Rd
caauauguauaauuccuaaa

SEQ ID NO: 699566 - RNA, 13 nt, Haemophilus influenzae Rd
caauauaaaaaau

SEQ ID NO: 699567 - RNA, 19 nt, Haemophilus influenzae Rd
caauagcuuccgcuuuuuu

SEQ ID NO: 699568 - RNA, 19 nt, Haemophilus influenzae Rd
caauagcgaccaacaguua

SEQ ID NO: 699569 - RNA, 18 nt, Haemophilus influenzae Rd
caauagccaauaauaaag

SEQ ID NO: 699570 - RNA, 20 nt, Haemophilus influenzae Rd
caauagcauuaaagucuaau

SEQ ID NO: 699571 - RNA, 20 nt, Haemophilus influenzae Rd
caauagaacgcacacaacaa

SEQ ID NO: 699572 - RNA, 24 nt, Haemophilus influenzae Rd
caauagauucuaagguugcucgaa

SEQ ID NO: 699573 - RNA, 20 nt, Haemophilus influenzae Rd
caauagauugugaaauuuca

SEQ ID NO: 699574 - RNA, 21 nt, Haemophilus influenzae Rd
caauagauugugaaauuucau

SEQ ID NO: 699575 - RNA, 13 nt, Haemophilus influenzae Rd
caauagauuuaau

SEQ ID NO: 699576 - RNA, 18 nt, Haemophilus influenzae Rd
caauacccgcuucaaucg

SEQ ID NO: 699577 - RNA, 16 nt, Haemophilus influenzae Rd
caauacuggcugaaca

SEQ ID NO: 699578 - RNA, 14 nt, Haemophilus influenzae Rd
caaguuguuugaua

SEQ ID NO: 699579 - RNA, 14 nt, Haemophilus influenzae Rd
caauaaauaucuaa

SEQ ID NO: 699580 - RNA, 20 nt, Haemophilus influenzae Rd
caauaaauaucuaaacuuca

SEQ ID NO: 699581 - RNA, 22 nt, Haemophilus influenzae Rd
caauaaauucguacaaaugaaa

SEQ ID NO: 699582 - RNA, 19 nt, Haemophilus influenzae Rd
caaguugggauuuaucuuc

SEQ ID NO: 699583 - RNA, 23 nt, Haemophilus influenzae Rd
caaguugggauuuaucuuccccc

SEQ ID NO: 699584 - RNA, 12 nt, Haemophilus influenzae Rd
caaguuguaaaa

SEQ ID NO: 699585 - RNA, 12 nt, Haemophilus influenzae Rd
caaguuguaaau

SEQ ID NO: 699586 - RNA, 17 nt, Haemophilus influenzae Rd
caaguacucuugucaau

SEQ ID NO: 699587 - RNA, 16 nt, Haemophilus influenzae Rd
caaguugaagagaauu

SEQ ID NO: 699588 - RNA, 19 nt, Haemophilus influenzae Rd
caaguugaagagaauuuuc

SEQ ID NO: 699589 - RNA, 21 nt, Haemophilus influenzae Rd
caaguugaagagaauuuucau

SEQ ID NO: 699590 - RNA, 17 nt, Haemophilus influenzae Rd
caaguaaugcuuuaaau

SEQ ID NO: 699591 - RNA, 14 nt, Haemophilus influenzae Rd
caaguaauuuaaaa

SEQ ID NO: 699592 - RNA, 17 nt, Haemophilus influenzae Rd
caaguaauuuaaaaagu

SEQ ID NO: 699593 - RNA, 18 nt, Haemophilus influenzae Rd
caaguaauuuaaaaagua

SEQ ID NO: 699594 - RNA, 20 nt, Haemophilus influenzae Rd
caaguaagucgugaucugca

SEQ ID NO: 699595 - RNA, 12 nt, Haemophilus influenzae Rd
caaguaaaucaa

SEQ ID NO: 699596 - RNA, 23 nt, Haemophilus influenzae Rd
caagguuuuuugcuauguggauc

SEQ ID NO: 699597 - RNA, 22 nt, Haemophilus influenzae Rd
caauaacgagguuggcaauaaa

SEQ ID NO: 699598 - RNA, 18 nt, Haemophilus influenzae Rd
caauaacgauauucuugc

SEQ ID NO: 699599 - RNA, 15 nt, Haemophilus influenzae Rd
caauaaccacgccuu

SEQ ID NO: 699600 - RNA, 23 nt, Haemophilus influenzae Rd
caauaaccacgccuucgaaugcu

SEQ ID NO: 699601 - RNA, 18 nt, Haemophilus influenzae Rd
caauaacaagcucagguu

SEQ ID NO: 699602 - RNA, 22 nt, Haemophilus influenzae Rd
caauaauucauuagaaaguugu

SEQ ID NO: 699603 - RNA, 14 nt, Haemophilus influenzae Rd
caauaauugaugcu

SEQ ID NO: 699604 - RNA, 21 nt, Haemophilus influenzae Rd
caauaauugaagcaauugaaa

SEQ ID NO: 699605 - RNA, 23 nt, Haemophilus influenzae Rd
caauaaugugagaauaaccacau

SEQ ID NO: 699606 - RNA, 15 nt, Haemophilus influenzae Rd
caauaauguugcuga

SEQ ID NO: 699607 - RNA, 17 nt, Haemophilus influenzae Rd
caauaauuaaacagcca

SEQ ID NO: 699608 - RNA, 17 nt, Haemophilus influenzae Rd
caauaacucuauaaaau

SEQ ID NO: 699609 - RNA, 19 nt, Haemophilus influenzae Rd
caauaacguuacuaaaauc

SEQ ID NO: 699610 - RNA, 15 nt, Haemophilus influenzae Rd
caauaacuaaaaaua

SEQ ID NO: 699611 - RNA, 20 nt, Haemophilus influenzae Rd
caauaauauuugguguauuu

SEQ ID NO: 699612 - RNA, 15 nt, Haemophilus influenzae Rd
caauaaucacaguac

SEQ ID NO: 699613 - RNA, 17 nt, Haemophilus influenzae Rd
caauuuagauacaaaga

SEQ ID NO: 699614 - RNA, 12 nt, Haemophilus influenzae Rd
caauugauuuuu

SEQ ID NO: 699615 - RNA, 22 nt, Haemophilus influenzae Rd
caauugugccguauuuuuuaca

SEQ ID NO: 699616 - RNA, 23 nt, Haemophilus influenzae Rd
caauuuaaaucaacucacuaucc

SEQ ID NO: 699617 - RNA, 14 nt, Haemophilus influenzae Rd
caauuuaacauaau

SEQ ID NO: 699618 - RNA, 14 nt, Haemophilus influenzae Rd
caauuuaagcccug

SEQ ID NO: 699619 - RNA, 22 nt, Haemophilus influenzae Rd
caauuuucuuuucaaacaacaa

SEQ ID NO: 699620 - RNA, 15 nt, Haemophilus influenzae Rd
caauuuucugcagaa

SEQ ID NO: 699621 - RNA, 14 nt, Haemophilus influenzae Rd
caauuuucugugag

SEQ ID NO: 699622 - RNA, 22 nt, Haemophilus influenzae Rd
caauuuucugugagucuugcuu

SEQ ID NO: 699623 - RNA, 20 nt, Haemophilus influenzae Rd
caauuuuaacgccugcugca

SEQ ID NO: 699624 - RNA, 16 nt, Haemophilus influenzae Rd
caauuuuagcuaaugg

SEQ ID NO: 699625 - RNA, 20 nt, Haemophilus influenzae Rd
caauuuuacguuuuaaauua

SEQ ID NO: 699626 - RNA, 12 nt, Haemophilus influenzae Rd
cacaaacaauau

SEQ ID NO: 699627 - RNA, 17 nt, Haemophilus influenzae Rd
cacaaaauuccgcugcu

SEQ ID NO: 699628 - RNA, 22 nt, Haemophilus influenzae Rd
cacaaaauaagggcgauauuuc

SEQ ID NO: 699629 - RNA, 13 nt, Haemophilus influenzae Rd
cacaaaauccauu

SEQ ID NO: 699630 - RNA, 16 nt, Haemophilus influenzae Rd
cacaaaauggcaaaca

SEQ ID NO: 699631 - RNA, 17 nt, Haemophilus influenzae Rd
cacaaaauggcaaacaa

SEQ ID NO: 699632 - RNA, 20 nt, Haemophilus influenzae Rd
cacaaaauggcaaacaaaau

SEQ ID NO: 699633 - RNA, 16 nt, Haemophilus influenzae Rd
cacaaacuaauuucau

SEQ ID NO: 699634 - RNA, 19 nt, Haemophilus influenzae Rd
cacaaacugguuaaaaucc

SEQ ID NO: 699635 - RNA, 20 nt, Haemophilus influenzae Rd
cacaaacugguuaaaaucca

SEQ ID NO: 699636 - RNA, 21 nt, Haemophilus influenzae Rd
cacaaacugguuaaaauccaa

SEQ ID NO: 699637 - RNA, 16 nt, Haemophilus influenzae Rd
cacaaagaaaaacuaa

SEQ ID NO: 699638 - RNA, 20 nt, Haemophilus influenzae Rd
cacaaaggugguuucaagag

SEQ ID NO: 699639 - RNA, 22 nt, Haemophilus influenzae Rd
cacaaagacagcuauuaaaaaa

SEQ ID NO: 699640 - RNA, 13 nt, Haemophilus influenzae Rd
cacaaaacugaag

SEQ ID NO: 699641 - RNA, 19 nt, Haemophilus influenzae Rd
caauuuuucaguauuuuuu

SEQ ID NO: 699642 - RNA, 16 nt, Haemophilus influenzae Rd
caauuuuuugucugaa

SEQ ID NO: 699643 - RNA, 18 nt, Haemophilus influenzae Rd
caauuuuuuucaagcaac

SEQ ID NO: 699644 - RNA, 20 nt, Haemophilus influenzae Rd
caauuuuuuaucaaauaacg

SEQ ID NO: 699645 - RNA, 19 nt, Haemophilus influenzae Rd
caauuuuuucuccacaaac

SEQ ID NO: 699646 - RNA, 14 nt, Haemophilus influenzae Rd
caauuuuuucugaa

SEQ ID NO: 699647 - RNA, 20 nt, Haemophilus influenzae Rd
caauuuuuucugaauaaauu

SEQ ID NO: 699648 - RNA, 14 nt, Haemophilus influenzae Rd
caauuauuggauug

SEQ ID NO: 699649 - RNA, 23 nt, Haemophilus influenzae Rd
caauuauuggauugaaucaauuu

SEQ ID NO: 699650 - RNA, 12 nt, Haemophilus influenzae Rd
caauuauuuaua

SEQ ID NO: 699651 - RNA, 15 nt, Haemophilus influenzae Rd
caauucaaaaaccaa

SEQ ID NO: 699652 - RNA, 12 nt, Haemophilus influenzae Rd
caauucaaagaa

SEQ ID NO: 699653 - RNA, 18 nt, Haemophilus influenzae Rd
caauucaaagauuuuaaa

SEQ ID NO: 699654 - RNA, 20 nt, Haemophilus influenzae Rd
caauucaaagauuuuaaaau

SEQ ID NO: 699655 - RNA, 17 nt, Haemophilus influenzae Rd
caauuaggcgaauuugu

SEQ ID NO: 699656 - RNA, 18 nt, Haemophilus influenzae Rd
caauuagaugauuuuaaa

SEQ ID NO: 699657 - RNA, 19 nt, Haemophilus influenzae Rd
caauuagaugauuuuaaag

SEQ ID NO: 699658 - RNA, 20 nt, Haemophilus influenzae Rd
caauuacgacauucuuuaga

SEQ ID NO: 699659 - RNA, 15 nt, Haemophilus influenzae Rd
caauuacuguuugaa

SEQ ID NO: 699660 - RNA, 13 nt, Haemophilus influenzae Rd
caauugauguaaa

SEQ ID NO: 699661 - RNA, 17 nt, Haemophilus influenzae Rd
caauugauguaaaagau

SEQ ID NO: 699662 - RNA, 14 nt, Haemophilus influenzae Rd
caauucuuuuaaau

SEQ ID NO: 699663 - RNA, 24 nt, Haemophilus influenzae Rd
caauucagcuaacggcaaauaacu

SEQ ID NO: 699664 - RNA, 13 nt, Haemophilus influenzae Rd
caauguuccacca

SEQ ID NO: 699665 - RNA, 17 nt, Haemophilus influenzae Rd
caauguucgauuuuacu

SEQ ID NO: 699666 - RNA, 12 nt, Haemophilus influenzae Rd
caauguuuggau

SEQ ID NO: 699667 - RNA, 19 nt, Haemophilus influenzae Rd
caauguuugguauaaauaa

SEQ ID NO: 699668 - RNA, 22 nt, Haemophilus influenzae Rd
caauguuuucgccccauuauuu

SEQ ID NO: 699669 - RNA, 13 nt, Haemophilus influenzae Rd
caauuaaaucaaa

SEQ ID NO: 699670 - RNA, 18 nt, Haemophilus influenzae Rd
caauuaaaucaaaaauua

SEQ ID NO: 699671 - RNA, 13 nt, Haemophilus influenzae Rd
caauuaaagaaau

SEQ ID NO: 699672 - RNA, 16 nt, Haemophilus influenzae Rd
caauuaaagaaauuuc

SEQ ID NO: 699673 - RNA, 21 nt, Haemophilus influenzae Rd
caauuaauggcaauucgugaa

SEQ ID NO: 699674 - RNA, 20 nt, Haemophilus influenzae Rd
caauuaauacgucaauugcu

SEQ ID NO: 699675 - RNA, 23 nt, Haemophilus influenzae Rd
caauuaauacgucaauugcuaaa

SEQ ID NO: 699676 - RNA, 22 nt, Haemophilus influenzae Rd
caauuaauauaaaggauuuuau

SEQ ID NO: 699677 - RNA, 16 nt, Haemophilus influenzae Rd
caauuaaccauaaaaa

SEQ ID NO: 699678 - RNA, 21 nt, Haemophilus influenzae Rd
caauuaagccugcaaagccuu

SEQ ID NO: 699679 - RNA, 23 nt, Haemophilus influenzae Rd
caauuaaggauuuauuuaacaau

SEQ ID NO: 699680 - RNA, 18 nt, Haemophilus influenzae Rd
caauuaaggcauuuuccc

SEQ ID NO: 699681 - RNA, 17 nt, Haemophilus influenzae Rd
caauuacguaaucaucc

SEQ ID NO: 699682 - RNA, 20 nt, Haemophilus influenzae Rd
caauuacguaaucauccacu

SEQ ID NO: 699683 - RNA, 19 nt, Haemophilus influenzae Rd
caauuacuucuuacaacaa

SEQ ID NO: 699684 - RNA, 20 nt, Haemophilus influenzae Rd
caauuacuucuuacaacaaa

SEQ ID NO: 699685 - RNA, 15 nt, Haemophilus influenzae Rd
cacaggauaaaaacc

SEQ ID NO: 699686 - RNA, 18 nt, Haemophilus influenzae Rd
cacagagccuuuuucuaa

SEQ ID NO: 699687 - RNA, 22 nt, Haemophilus influenzae Rd
cacagccgcauuuuuaccuaau

SEQ ID NO: 699688 - RNA, 16 nt, Haemophilus influenzae Rd
cacagaccaaaauucu

SEQ ID NO: 699689 - RNA, 16 nt, Haemophilus influenzae Rd
cacagacuaaauucag

SEQ ID NO: 699690 - RNA, 13 nt, Haemophilus influenzae Rd
cacaguaaagauu

SEQ ID NO: 699691 - RNA, 13 nt, Haemophilus influenzae Rd
cacaguaccuaca

SEQ ID NO: 699692 - RNA, 17 nt, Haemophilus influenzae Rd
cacagucuuuuaacaca

SEQ ID NO: 699693 - RNA, 16 nt, Haemophilus influenzae Rd
cacaguccccauaucu

SEQ ID NO: 699694 - RNA, 19 nt, Haemophilus influenzae Rd
cacaggcccaucauuuguu

SEQ ID NO: 699695 - RNA, 17 nt, Haemophilus influenzae Rd
cacaggcuucaauuuga

SEQ ID NO: 699696 - RNA, 22 nt, Haemophilus influenzae Rd
cacagggcugauaaauuucuaa

SEQ ID NO: 699697 - RNA, 16 nt, Haemophilus influenzae Rd
cacaacaaccacauuc

SEQ ID NO: 699698 - RNA, 23 nt, Haemophilus influenzae Rd
cacaaaguguuuuauuuaucagc

SEQ ID NO: 699699 - RNA, 18 nt, Haemophilus influenzae Rd
cacaaaguugauaaucau

SEQ ID NO: 699700 - RNA, 20 nt, Haemophilus influenzae Rd
cacaaaguugauaaucaucc

SEQ ID NO: 699701 - RNA, 15 nt, Haemophilus influenzae Rd
cacaaauuuccauau

SEQ ID NO: 699702 - RNA, 15 nt, Haemophilus influenzae Rd
cacaauuuuuggauu

SEQ ID NO: 699703 - RNA, 21 nt, Haemophilus influenzae Rd
cacacuauuaauuacuuuuau

SEQ ID NO: 699704 - RNA, 17 nt, Haemophilus influenzae Rd
cacaccgucuaaaaauc

SEQ ID NO: 699705 - RNA, 16 nt, Haemophilus influenzae Rd
cacacugcccuucucu

SEQ ID NO: 699706 - RNA, 20 nt, Haemophilus influenzae Rd
cacacugcccuucucugccg

SEQ ID NO: 699707 - RNA, 17 nt, Haemophilus influenzae Rd
cacaccuauuuuuuccu

SEQ ID NO: 699708 - RNA, 18 nt, Haemophilus influenzae Rd
cacaccuauuuuuuccug

SEQ ID NO: 699709 - RNA, 21 nt, Haemophilus influenzae Rd
cacaccuauuuuuuccugccu

SEQ ID NO: 699710 - RNA, 20 nt, Haemophilus influenzae Rd
cacacccuuuucaaacaaca

SEQ ID NO: 699711 - RNA, 18 nt, Haemophilus influenzae Rd
caccacuuggugcaacca

SEQ ID NO: 699712 - RNA, 22 nt, Haemophilus influenzae Rd
caccacccgauaaaugcacauu

SEQ ID NO: 699713 - RNA, 17 nt, Haemophilus influenzae Rd
caccacccuucuuucaa

SEQ ID NO: 699714 - RNA, 15 nt, Haemophilus influenzae Rd
caccaaucaaauaaa

SEQ ID NO: 699715 - RNA, 12 nt, Haemophilus influenzae Rd
caccaauaccaa

SEQ ID NO: 699716 - RNA, 22 nt, Haemophilus influenzae Rd
caccaaucacagccgcauuuuu

SEQ ID NO: 699717 - RNA, 14 nt, Haemophilus influenzae Rd
caccaauuaauucu

SEQ ID NO: 699718 - RNA, 22 nt, Haemophilus influenzae Rd
caccaaugccaguuaaggauuu

SEQ ID NO: 699719 - RNA, 22 nt, Haemophilus influenzae Rd
cacaugggcaucauagccuuuu

SEQ ID NO: 699720 - RNA, 17 nt, Haemophilus influenzae Rd
cacauucuauagaauua

SEQ ID NO: 699721 - RNA, 12 nt, Haemophilus influenzae Rd
caccaauaauug

SEQ ID NO: 699722 - RNA, 14 nt, Haemophilus influenzae Rd
caccaauaagccuu

SEQ ID NO: 699723 - RNA, 21 nt, Haemophilus influenzae Rd
cacauuucuucuaguuuuccu

SEQ ID NO: 699724 - RNA, 21 nt, Haemophilus influenzae Rd
caccaagcaauuucaucacau

SEQ ID NO: 699725 - RNA, 21 nt, Haemophilus influenzae Rd
cacauuucccuuagauuuaag

SEQ ID NO: 699726 - RNA, 16 nt, Haemophilus influenzae Rd
cacaugaauuucuaau

SEQ ID NO: 699727 - RNA, 19 nt, Haemophilus influenzae Rd
cacauaaguuaccgcuucu

SEQ ID NO: 699728 - RNA, 14 nt, Haemophilus influenzae Rd
cacauaauaagaaa

SEQ ID NO: 699729 - RNA, 18 nt, Haemophilus influenzae Rd
cacauaacaaaauggcuu

SEQ ID NO: 699730 - RNA, 14 nt, Haemophilus influenzae Rd
cacauaaccaaagg

SEQ ID NO: 699731 - RNA, 15 nt, Haemophilus influenzae Rd
cacauaaaaaacuaa

SEQ ID NO: 699732 - RNA, 21 nt, Haemophilus influenzae Rd
cacaguuuuauuuuccaucau

SEQ ID NO: 699733 - RNA, 16 nt, Haemophilus influenzae Rd
cacaguuuccgcaaau

SEQ ID NO: 699734 - RNA, 21 nt, Haemophilus influenzae Rd
cacaguuuccgcaaaugcuaa

SEQ ID NO: 699735 - RNA, 13 nt, Haemophilus influenzae Rd
cacaguuauuuuu

SEQ ID NO: 699736 - RNA, 23 nt, Haemophilus influenzae Rd
aaaaguuugcaacauauggauag

SEQ ID NO: 699737 - RNA, 21 nt, Haemophilus influenzae Rd
aaaaguuuuccgacaacacuu

SEQ ID NO: 699738 - RNA, 22 nt, Haemophilus influenzae Rd
aaaaguuuuccgacaacacuug

SEQ ID NO: 699739 - RNA, 12 nt, Haemophilus influenzae Rd
aaaaguucuuuc

SEQ ID NO: 699740 - RNA, 23 nt, Haemophilus influenzae Rd
aaaaguucuuucugucaucacau

SEQ ID NO: 699741 - RNA, 20 nt, Haemophilus influenzae Rd
caccagccgcuuguaaugcu

SEQ ID NO: 699742 - RNA, 19 nt, Haemophilus influenzae Rd
aaaaguuggacuaaacaac

SEQ ID NO: 699743 - RNA, 13 nt, Haemophilus influenzae Rd
caccaucuacacg

SEQ ID NO: 699744 - RNA, 16 nt, Haemophilus influenzae Rd
caccauggcaccguuu

SEQ ID NO: 699745 - RNA, 21 nt, Haemophilus influenzae Rd
caccaucacguaauacaaaau

SEQ ID NO: 699746 - RNA, 13 nt, Haemophilus influenzae Rd
caccauaacuuau

SEQ ID NO: 699747 - RNA, 13 nt, Haemophilus influenzae Rd
caccgcaaaagcc

SEQ ID NO: 699748 - RNA, 14 nt, Haemophilus influenzae Rd
caccgauugccacg

SEQ ID NO: 699749 - RNA, 19 nt, Haemophilus influenzae Rd
caccgaaagguguuuuuuu

SEQ ID NO: 699750 - RNA, 18 nt, Haemophilus influenzae Rd
caccauuuguaauaguaa

SEQ ID NO: 699751 - RNA, 13 nt, Haemophilus influenzae Rd
caccauuuccuuu

SEQ ID NO: 699752 - RNA, 16 nt, Haemophilus influenzae Rd
cacccaaaauuucagc

SEQ ID NO: 699753 - RNA, 20 nt, Haemophilus influenzae Rd
cacccuacgauacuuuuaau

SEQ ID NO: 699754 - RNA, 17 nt, Haemophilus influenzae Rd
caccguuaagcaaauuu

SEQ ID NO: 699755 - RNA, 22 nt, Haemophilus influenzae Rd
caccugcagguuuugcaaauac

SEQ ID NO: 699756 - RNA, 16 nt, Haemophilus influenzae Rd
caccugaugcuuuaac

SEQ ID NO: 699757 - RNA, 21 nt, Haemophilus influenzae Rd
caccugaugcuuuaacaccaa

SEQ ID NO: 699758 - RNA, 17 nt, Haemophilus influenzae Rd
caccugaagaauacaag

SEQ ID NO: 699759 - RNA, 19 nt, Haemophilus influenzae Rd
caccgguacagaugccaau

SEQ ID NO: 699760 - RNA, 23 nt, Haemophilus influenzae Rd
aaaauaaccgcacuuuaaucucu

SEQ ID NO: 699761 - RNA, 20 nt, Haemophilus influenzae Rd
aaaauaaccgcacuuugggu

SEQ ID NO: 699762 - RNA, 17 nt, Haemophilus influenzae Rd
aaaauaaccuauaauag

SEQ ID NO: 699763 - RNA, 21 nt, Haemophilus influenzae Rd
aaaauaaccuuaaaucaaaca

SEQ ID NO: 699764 - RNA, 12 nt, Haemophilus influenzae Rd
aaaauaauauca

SEQ ID NO: 699765 - RNA, 19 nt, Haemophilus influenzae Rd
aaaauaaucacuugauaaa

SEQ ID NO: 699766 - RNA, 20 nt, Haemophilus influenzae Rd
aaaauaaucacuugauaaaa

SEQ ID NO: 699767 - RNA, 15 nt, Haemophilus influenzae Rd
caccuuuacguuuaa

SEQ ID NO: 699768 - RNA, 21 nt, Haemophilus influenzae Rd
caccuuuaggaugugaauaag

SEQ ID NO: 699769 - RNA, 14 nt, Haemophilus influenzae Rd
caccuugagaaaua

SEQ ID NO: 699770 - RNA, 16 nt, Haemophilus influenzae Rd
caccuucuuuuggaua

SEQ ID NO: 699771 - RNA, 20 nt, Haemophilus influenzae Rd
caccuugaauugcauuuucu

SEQ ID NO: 699772 - RNA, 22 nt, Haemophilus influenzae Rd
cacgacgagcuuuccaaacaag

SEQ ID NO: 699773 - RNA, 21 nt, Haemophilus influenzae Rd
cacgaccuuucggacuuugau

SEQ ID NO: 699774 - RNA, 23 nt, Haemophilus influenzae Rd
cacgauacggcaaauuaaaucac

SEQ ID NO: 699775 - RNA, 16 nt, Haemophilus influenzae Rd
cacgaagugaauuucc

SEQ ID NO: 699776 - RNA, 18 nt, Haemophilus influenzae Rd
cacgaauaauuaaaucuu

SEQ ID NO: 699777 - RNA, 15 nt, Haemophilus influenzae Rd
aaaauacugcacaau

SEQ ID NO: 699778 - RNA, 13 nt, Haemophilus influenzae Rd
caccuuuuuccuu

SEQ ID NO: 699779 - RNA, 15 nt, Haemophilus influenzae Rd
caccuuuuguagaaa

SEQ ID NO: 699780 - RNA, 17 nt, Haemophilus influenzae Rd
cacgcauuuaaauaaaa

SEQ ID NO: 699781 - RNA, 23 nt, Haemophilus influenzae Rd
cacgauagcaaugccaaucuaaa

SEQ ID NO: 699782 - RNA, 15 nt, Haemophilus influenzae Rd
cacgaucacuuguuu

SEQ ID NO: 699783 - RNA, 14 nt, Haemophilus influenzae Rd
cacgcccaaaggcu

SEQ ID NO: 699784 - RNA, 14 nt, Haemophilus influenzae Rd
cacgccagauaaaa

SEQ ID NO: 699785 - RNA, 16 nt, Haemophilus influenzae Rd
cacgcuguaaacaaga

SEQ ID NO: 699786 - RNA, 22 nt, Haemophilus influenzae Rd
cacgcuguaaacaagauucuga

SEQ ID NO: 699787 - RNA, 21 nt, Haemophilus influenzae Rd
aaaauauauuuagauacaaaa

SEQ ID NO: 699788 - RNA, 21 nt, Haemophilus influenzae Rd
aaaauauaugggaaacaauau

SEQ ID NO: 699789 - RNA, 16 nt, Haemophilus influenzae Rd
cacgguaguaaauaac

SEQ ID NO: 699790 - RNA, 22 nt, Haemophilus influenzae Rd
cacgguaguaaauaacacauca

SEQ ID NO: 699791 - RNA, 22 nt, Haemophilus influenzae Rd
cacguaaaguuggcaacauauu

SEQ ID NO: 699792 - RNA, 15 nt, Haemophilus influenzae Rd
cacguccgcaaccag

SEQ ID NO: 699793 - RNA, 22 nt, Haemophilus influenzae Rd
cacgucaagugguuuauuuuuu

SEQ ID NO: 699794 - RNA, 23 nt, Haemophilus influenzae Rd
cacgucaagugguuuauuuuuua

SEQ ID NO: 699795 - RNA, 19 nt, Haemophilus influenzae Rd
auuuccaagcguaaaagua

SEQ ID NO: 699796 - RNA, 13 nt, Haemophilus influenzae Rd
auuucauuguuaa

SEQ ID NO: 699797 - RNA, 12 nt, Haemophilus influenzae Rd
auuucauuuucu

SEQ ID NO: 699798 - RNA, 22 nt, Haemophilus influenzae Rd
auuucauuggcgguuuugccaa

SEQ ID NO: 699799 - RNA, 19 nt, Haemophilus influenzae Rd
auuucauuugcgccaauaa

SEQ ID NO: 699800 - RNA, 21 nt, Haemophilus influenzae Rd
auuucauuugcgccaauaaua

SEQ ID NO: 699801 - RNA, 13 nt, Haemophilus influenzae Rd
auuuccuauuuac

SEQ ID NO: 699802 - RNA, 16 nt, Haemophilus influenzae Rd
auuuccucuaaauaaa

SEQ ID NO: 699803 - RNA, 18 nt, Haemophilus influenzae Rd
auuucuaaugcaauuuca

SEQ ID NO: 699804 - RNA, 22 nt, Haemophilus influenzae Rd
auuucuaaccgcacucuuucaa

SEQ ID NO: 699805 - RNA, 17 nt, Haemophilus influenzae Rd
auuucgacauauucuac

SEQ ID NO: 699806 - RNA, 22 nt, Haemophilus influenzae Rd
auuucuacuaugaggauuuuca

SEQ ID NO: 699807 - RNA, 19 nt, Haemophilus influenzae Rd
auuucuacuugacgguuuu

SEQ ID NO: 699808 - RNA, 19 nt, Haemophilus influenzae Rd
auuucuaggcuauauuuuu

SEQ ID NO: 699809 - RNA, 20 nt, Haemophilus influenzae Rd
auuucuaggcuauauuuuua

SEQ ID NO: 699810 - RNA, 14 nt, Haemophilus influenzae Rd
auuucuauuguuuu

SEQ ID NO: 699811 - RNA, 15 nt, Haemophilus influenzae Rd
auuucuauuguuuuu

SEQ ID NO: 699812 - RNA, 18 nt, Haemophilus influenzae Rd
auuucuauguuauuaaaa

SEQ ID NO: 699813 - RNA, 22 nt, Haemophilus influenzae Rd
auuucuauguuauuaaaauuaa

SEQ ID NO: 699814 - RNA, 15 nt, Haemophilus influenzae Rd
auuucuaucgcauuu

SEQ ID NO: 699815 - RNA, 19 nt, Haemophilus influenzae Rd
auuucuaucgcauuuuaca

SEQ ID NO: 699816 - RNA, 14 nt, Haemophilus influenzae Rd
auuucaucacauca

SEQ ID NO: 699817 - RNA, 13 nt, Haemophilus influenzae Rd
auuucauaucuau

SEQ ID NO: 699818 - RNA, 22 nt, Haemophilus influenzae Rd
auuucauaucucacaauaauuu

SEQ ID NO: 699819 - RNA, 17 nt, Haemophilus influenzae Rd
auuucaucccaauuauu

SEQ ID NO: 699820 - RNA, 17 nt, Haemophilus influenzae Rd
auuucaucccagauuuu

SEQ ID NO: 699821 - RNA, 18 nt, Haemophilus influenzae Rd
auuucauccuaaaaaaau

SEQ ID NO: 699822 - RNA, 16 nt, Haemophilus influenzae Rd
auuucaucuacaccaa

SEQ ID NO: 699823 - RNA, 16 nt, Haemophilus influenzae Rd
auuucaucuucaguac

SEQ ID NO: 699824 - RNA, 17 nt, Haemophilus influenzae Rd
auuucaucuuuuaaaua

SEQ ID NO: 699825 - RNA, 19 nt, Haemophilus influenzae Rd
auuucaugguuucaaccau

SEQ ID NO: 699826 - RNA, 16 nt, Haemophilus influenzae Rd
auuucauucaaaaaua

SEQ ID NO: 699827 - RNA, 18 nt, Haemophilus influenzae Rd
auuucauucaaaaauaaa

SEQ ID NO: 699828 - RNA, 21 nt, Haemophilus influenzae Rd
  misc_feature (7)..(7): n is a, c, g or u
auuucanagagguuuccuuau

SEQ ID NO: 699829 - RNA, 16 nt, Haemophilus influenzae Rd
auuucauaaaaauuag

SEQ ID NO: 699830 - RNA, 13 nt, Haemophilus influenzae Rd
auuucaguuuaag

SEQ ID NO: 699831 - RNA, 21 nt, Haemophilus influenzae Rd
auuucacuucuaacuaaaaaa

SEQ ID NO: 699832 - RNA, 18 nt, Haemophilus influenzae Rd
auuucagacaaaacuuau

SEQ ID NO: 699833 - RNA, 20 nt, Haemophilus influenzae Rd
auuuaguugaagaaaucgcu

SEQ ID NO: 699834 - RNA, 17 nt, Haemophilus influenzae Rd
auuuaguuaauauauuc

SEQ ID NO: 699835 - RNA, 12 nt, Haemophilus influenzae Rd
auuuaguuuaac

SEQ ID NO: 699836 - RNA, 15 nt, Haemophilus influenzae Rd
auuuaguuuaacuuu

SEQ ID NO: 699837 - RNA, 14 nt, Haemophilus influenzae Rd
auuuaguccuaaaa

SEQ ID NO: 699838 - RNA, 16 nt, Haemophilus influenzae Rd
auuuaguccuaaaaaa

SEQ ID NO: 699839 - RNA, 18 nt, Haemophilus influenzae Rd
auuuaguccuaaaaaauc

SEQ ID NO: 699840 - RNA, 22 nt, Haemophilus influenzae Rd
auuuaguccuuaaacaaaugua

SEQ ID NO: 699841 - RNA, 14 nt, Haemophilus influenzae Rd
auuuaguccuuaau

SEQ ID NO: 699842 - RNA, 15 nt, Haemophilus influenzae Rd
auuuaguccuuaauu

SEQ ID NO: 699843 - RNA, 21 nt, Haemophilus influenzae Rd
auuuaguccuuaauuuuauag

SEQ ID NO: 699844 - RNA, 14 nt, Haemophilus influenzae Rd
auuuaguccuucug

SEQ ID NO: 699845 - RNA, 18 nt, Haemophilus influenzae Rd
auuuaguccuuuagaaaa

SEQ ID NO: 699846 - RNA, 16 nt, Haemophilus influenzae Rd
auuuagugaccacauu

SEQ ID NO: 699847 - RNA, 16 nt, Haemophilus influenzae Rd
auuuagugauuucuau

SEQ ID NO: 699848 - RNA, 17 nt, Haemophilus influenzae Rd
auuucaagcuuugcaac

SEQ ID NO: 699849 - RNA, 13 nt, Haemophilus influenzae Rd
auuucaauaaauu

SEQ ID NO: 699850 - RNA, 18 nt, Haemophilus influenzae Rd
auuucaauaaauucacca

SEQ ID NO: 699851 - RNA, 22 nt, Haemophilus influenzae Rd
auuucaaccgcacuuuuuuuca

SEQ ID NO: 699852 - RNA, 17 nt, Haemophilus influenzae Rd
auuuguguggaaaaaug

SEQ ID NO: 699853 - RNA, 14 nt, Haemophilus influenzae Rd
auuuguucuacuuu

SEQ ID NO: 699854 - RNA, 20 nt, Haemophilus influenzae Rd
auuuguuagaucaaauuuga

SEQ ID NO: 699855 - RNA, 18 nt, Haemophilus influenzae Rd
auuuguugccauuguuaa

SEQ ID NO: 699856 - RNA, 22 nt, Haemophilus influenzae Rd
auuuguugaauuggaaguuuuu

SEQ ID NO: 699857 - RNA, 23 nt, Haemophilus influenzae Rd
auuugucgauaaaagaagcuauu

SEQ ID NO: 699858 - RNA, 22 nt, Haemophilus influenzae Rd
auuuguccuuuaucaagcacaa

SEQ ID NO: 699859 - RNA, 18 nt, Haemophilus influenzae Rd
auuugggugcagauuuuu

SEQ ID NO: 699860 - RNA, 19 nt, Haemophilus influenzae Rd
auuuggcauuugaauuacc

SEQ ID NO: 699861 - RNA, 23 nt, Haemophilus influenzae Rd
auuuggucgccgacuuuuacauc

SEQ ID NO: 699862 - RNA, 16 nt, Haemophilus influenzae Rd
auuugguuagaucaga

SEQ ID NO: 699863 - RNA, 16 nt, Haemophilus influenzae Rd
auuuguaaguuguaaa

SEQ ID NO: 699864 - RNA, 22 nt, Haemophilus influenzae Rd
auuugguuuugcucuuuuucca

SEQ ID NO: 699865 - RNA, 17 nt, Haemophilus influenzae Rd
auuugcuaaaauuaccg

SEQ ID NO: 699866 - RNA, 13 nt, Haemophilus influenzae Rd
auuugcugaaaua

SEQ ID NO: 699867 - RNA, 16 nt, Haemophilus influenzae Rd
auuugcucaauaauuu

SEQ ID NO: 699868 - RNA, 18 nt, Haemophilus influenzae Rd
auuugcucaauaauuuca

SEQ ID NO: 699869 - RNA, 23 nt, Haemophilus influenzae Rd
auuugcucgcucacggguuggaa

SEQ ID NO: 699870 - RNA, 13 nt, Haemophilus influenzae Rd
auuugcucuaaau

SEQ ID NO: 699871 - RNA, 24 nt, Haemophilus influenzae Rd
auuugcuucgccuucagcaauuaa

SEQ ID NO: 699872 - RNA, 19 nt, Haemophilus influenzae Rd
auuugcuucuaauuuuaaa

SEQ ID NO: 699873 - RNA, 18 nt, Haemophilus influenzae Rd
auuugcuuggaauaaauu

SEQ ID NO: 699874 - RNA, 18 nt, Haemophilus influenzae Rd
auuugcuuuaacccauuu

SEQ ID NO: 699875 - RNA, 20 nt, Haemophilus influenzae Rd
auuugcuuuaacccauuuau

SEQ ID NO: 699876 - RNA, 16 nt, Haemophilus influenzae Rd
auuuggaucuaaaaaa

SEQ ID NO: 699877 - RNA, 15 nt, Haemophilus influenzae Rd
auuugaauguaaaaa

SEQ ID NO: 699878 - RNA, 17 nt, Haemophilus influenzae Rd
auuugaauguaaaaaua

SEQ ID NO: 699879 - RNA, 14 nt, Haemophilus influenzae Rd
auuucuuuugcaag

SEQ ID NO: 699880 - RNA, 16 nt, Haemophilus influenzae Rd
auuucuuuuguuuuaa

SEQ ID NO: 699881 - RNA, 15 nt, Haemophilus influenzae Rd
auuugacgaaauaaa

SEQ ID NO: 699882 - RNA, 20 nt, Haemophilus influenzae Rd
auuugacgauuaauaccaau

SEQ ID NO: 699883 - RNA, 22 nt, Haemophilus influenzae Rd
auuugacgcgcacauacuucuu

SEQ ID NO: 699884 - RNA, 15 nt, Haemophilus influenzae Rd
auuugacuuaaauga

SEQ ID NO: 699885 - RNA, 22 nt, Haemophilus influenzae Rd
auuucuuucguucaacccauuu

SEQ ID NO: 699886 - RNA, 16 nt, Haemophilus influenzae Rd
auuucuuguuuaaauu

SEQ ID NO: 699887 - RNA, 19 nt, Haemophilus influenzae Rd
auuucuugccgaaaauuua

SEQ ID NO: 699888 - RNA, 20 nt, Haemophilus influenzae Rd
auuucuugccgaaaauuuac

SEQ ID NO: 699889 - RNA, 16 nt, Haemophilus influenzae Rd
auuucuugcuaaaaua

SEQ ID NO: 699890 - RNA, 21 nt, Haemophilus influenzae Rd
auuucuugcuaaaauaucuug

SEQ ID NO: 699891 - RNA, 19 nt, Haemophilus influenzae Rd
auuucucauuuaaccguaa

SEQ ID NO: 699892 - RNA, 14 nt, Haemophilus influenzae Rd
auuugcaucauuuc

SEQ ID NO: 699893 - RNA, 19 nt, Haemophilus influenzae Rd
auuugcauaguuuuccauu

SEQ ID NO: 699894 - RNA, 15 nt, Haemophilus influenzae Rd
auuugcauauaaaaa

SEQ ID NO: 699895 - RNA, 22 nt, Haemophilus influenzae Rd
auuugcauauuuucgugggaaa

SEQ ID NO: 699896 - RNA, 23 nt, Haemophilus influenzae Rd
auuugcacccgcuuuaauagauu

SEQ ID NO: 699897 - RNA, 14 nt, Haemophilus influenzae Rd
auuugauuguugcu

SEQ ID NO: 699898 - RNA, 13 nt, Haemophilus influenzae Rd
auuugauuucaga

SEQ ID NO: 699899 - RNA, 21 nt, Haemophilus influenzae Rd
auuugauuucagaacaugacu

SEQ ID NO: 699900 - RNA, 14 nt, Haemophilus influenzae Rd
auuugccaucacuc

SEQ ID NO: 699901 - RNA, 15 nt, Haemophilus influenzae Rd
auuugccaucacuca

SEQ ID NO: 699902 - RNA, 16 nt, Haemophilus influenzae Rd
auuugccaucacucaa

SEQ ID NO: 699903 - RNA, 14 nt, Haemophilus influenzae Rd
auuugccaaguaca

SEQ ID NO: 699904 - RNA, 14 nt, Haemophilus influenzae Rd
auuugccagcuuga

SEQ ID NO: 699905 - RNA, 15 nt, Haemophilus influenzae Rd
auuugcgaugauaaa

SEQ ID NO: 699906 - RNA, 19 nt, Haemophilus influenzae Rd
auuugcgccaauaauaaau

SEQ ID NO: 699907 - RNA, 16 nt, Haemophilus influenzae Rd
auuugcggacaguaua

SEQ ID NO: 699908 - RNA, 15 nt, Haemophilus influenzae Rd
auuugcuauccaacc

SEQ ID NO: 699909 - RNA, 17 nt, Haemophilus influenzae Rd
auuugcuauccaaccua

SEQ ID NO: 699910 - RNA, 14 nt, Haemophilus influenzae Rd
caaaaaucaaccau

SEQ ID NO: 699911 - RNA, 19 nt, Haemophilus influenzae Rd
caaaaauccucaucugaac

SEQ ID NO: 699912 - RNA, 15 nt, Haemophilus influenzae Rd
caaaaaugaaaggga

SEQ ID NO: 699913 - RNA, 22 nt, Haemophilus influenzae Rd
caaaaaugaaagggaaauaaca

SEQ ID NO: 699914 - RNA, 17 nt, Haemophilus influenzae Rd
caaaaaugccuacuaaa

SEQ ID NO: 699915 - RNA, 18 nt, Haemophilus influenzae Rd
caaaaaugccuacuaaac

SEQ ID NO: 699916 - RNA, 12 nt, Haemophilus influenzae Rd
caaaaauugcau

SEQ ID NO: 699917 - RNA, 17 nt, Haemophilus influenzae Rd
caaaaauuuuugcaaaa

SEQ ID NO: 699918 - RNA, 14 nt, Haemophilus influenzae Rd
caaaacaauggcug

SEQ ID NO: 699919 - RNA, 22 nt, Haemophilus influenzae Rd
caaaaauuugaauguaaaaaua

SEQ ID NO: 699920 - RNA, 13 nt, Haemophilus influenzae Rd
caaaacaaccaag

SEQ ID NO: 699921 - RNA, 13 nt, Haemophilus influenzae Rd
caaaacauuaauu

SEQ ID NO: 699922 - RNA, 21 nt, Haemophilus influenzae Rd
caaaacaguuuucaaauuaac

SEQ ID NO: 699923 - RNA, 14 nt, Haemophilus influenzae Rd
caaaacauaagaaa

SEQ ID NO: 699924 - RNA, 13 nt, Haemophilus influenzae Rd
caaaacaguaaug

SEQ ID NO: 699925 - RNA, 22 nt, Haemophilus influenzae Rd
caaaacaguaaugaaagaaaca

SEQ ID NO: 699926 - RNA, 14 nt, Haemophilus influenzae Rd
caaaaauaaaaagu

SEQ ID NO: 699927 - RNA, 16 nt, Haemophilus influenzae Rd
caaaaauaaagcccug

SEQ ID NO: 699928 - RNA, 15 nt, Haemophilus influenzae Rd
caaaaagucaaaaua

SEQ ID NO: 699929 - RNA, 21 nt, Haemophilus influenzae Rd
caaaaagugcgguuaaaaauu

SEQ ID NO: 699930 - RNA, 22 nt, Haemophilus influenzae Rd
caaaaauagccuucaucacaaa

SEQ ID NO: 699931 - RNA, 22 nt, Haemophilus influenzae Rd
caaaaauacagccacuauuacu

SEQ ID NO: 699932 - RNA, 17 nt, Haemophilus influenzae Rd
caaaaauacuaacugga

SEQ ID NO: 699933 - RNA, 19 nt, Haemophilus influenzae Rd
caaaaaccaacgccauuuc

SEQ ID NO: 699934 - RNA, 24 nt, Haemophilus influenzae Rd
auuuuuucuguuuuuccauucacu

SEQ ID NO: 699935 - RNA, 11 nt, Haemophilus influenzae Rd
auuuuuucuuc

SEQ ID NO: 699936 - RNA, 18 nt, Haemophilus influenzae Rd
auuuuuugaauaaauauu

SEQ ID NO: 699937 - RNA, 18 nt, Haemophilus influenzae Rd
auuuuuuaauacgaaaaa

SEQ ID NO: 699938 - RNA, 13 nt, Haemophilus influenzae Rd
auuuuuugcuuca

SEQ ID NO: 699939 - RNA, 19 nt, Haemophilus influenzae Rd
auuuuugucccaaaauauu

SEQ ID NO: 699940 - RNA, 21 nt, Haemophilus influenzae Rd
auuuuugucccaaaauauuuu

SEQ ID NO: 699941 - RNA, 16 nt, Haemophilus influenzae Rd
auuuuugcgauuuuau

SEQ ID NO: 699942 - RNA, 19 nt, Haemophilus influenzae Rd
auuuuuguggaaugcccag

SEQ ID NO: 699943 - RNA, 15 nt, Haemophilus influenzae Rd
auuuuugguuucauu

SEQ ID NO: 699944 - RNA, 15 nt, Haemophilus influenzae Rd
auuuuuauuaguaaa

SEQ ID NO: 699945 - RNA, 21 nt, Haemophilus influenzae Rd
auuuuuauuaguaaaauaaua

SEQ ID NO: 699946 - RNA, 12 nt, Haemophilus influenzae Rd
auuuuuauuauc

SEQ ID NO: 699947 - RNA, 14 nt, Haemophilus influenzae Rd
auuuuuauuaucaa

SEQ ID NO: 699948 - RNA, 19 nt, Haemophilus influenzae Rd
auuuuuauuaucaaaaaac

SEQ ID NO: 699949 - RNA, 17 nt, Haemophilus influenzae Rd
auuuuuauuguguuuug

SEQ ID NO: 699950 - RNA, 20 nt, Haemophilus influenzae Rd
auuuuuauuccuuacaacaa

SEQ ID NO: 699951 - RNA, 15 nt, Haemophilus influenzae Rd
auuuuuauuuucuua

SEQ ID NO: 699952 - RNA, 15 nt, Haemophilus influenzae Rd
auuuuuauuuuuacu

SEQ ID NO: 699953 - RNA, 15 nt, Haemophilus influenzae Rd
auuuuugcauuuuca

SEQ ID NO: 699954 - RNA, 17 nt, Haemophilus influenzae Rd
auuuuugccaauuuuuu

SEQ ID NO: 699955 - RNA, 18 nt, Haemophilus influenzae Rd
auuuuuagugauuuuaaa

SEQ ID NO: 699956 - RNA, 18 nt, Haemophilus influenzae Rd
auuuuuaucauauauaaa

SEQ ID NO: 699957 - RNA, 14 nt, Haemophilus influenzae Rd
auuuuuauauguuc

SEQ ID NO: 699958 - RNA, 22 nt, Haemophilus influenzae Rd
auuuuuaugauuuugcauuaaa

SEQ ID NO: 699959 - RNA, 18 nt, Haemophilus influenzae Rd
caaaaaagcguugaaaau

SEQ ID NO: 699960 - RNA, 21 nt, Haemophilus influenzae Rd
caaaaaagcguugaaaauaaa

SEQ ID NO: 699961 - RNA, 18 nt, Haemophilus influenzae Rd
caaaaaagcuaagacauu

SEQ ID NO: 699962 - RNA, 19 nt, Haemophilus influenzae Rd
caaaaaacggacuaucaua

SEQ ID NO: 699963 - RNA, 15 nt, Haemophilus influenzae Rd
auuuuuuugcuggaa

SEQ ID NO: 699964 - RNA, 13 nt, Haemophilus influenzae Rd
auuuuuuucucug

SEQ ID NO: 699965 - RNA, 12 nt, Haemophilus influenzae Rd
auuuuuuuauga

SEQ ID NO: 699966 - RNA, 15 nt, Haemophilus influenzae Rd
auuuuuuuaugauua

SEQ ID NO: 699967 - RNA, 15 nt, Haemophilus influenzae Rd
auuuuuuucaaugaa

SEQ ID NO: 699968 - RNA, 17 nt, Haemophilus influenzae Rd
auuuuuuucaaugaaau

SEQ ID NO: 699969 - RNA, 19 nt, Haemophilus influenzae Rd
auuuuuuucaaugaaauau

SEQ ID NO: 699970 - RNA, 20 nt, Haemophilus influenzae Rd
auuuuuuucaaugaaauauu

SEQ ID NO: 699971 - RNA, 18 nt, Haemophilus influenzae Rd
auuuuuuggaauauuauc

SEQ ID NO: 699972 - RNA, 16 nt, Haemophilus influenzae Rd
auuuuuuguucauuuu

SEQ ID NO: 699973 - RNA, 14 nt, Haemophilus influenzae Rd
auuuuuuguuugag

SEQ ID NO: 699974 - RNA, 14 nt, Haemophilus influenzae Rd
auuuuuuuaggaug

SEQ ID NO: 699975 - RNA, 22 nt, Haemophilus influenzae Rd
auuuuuuuaggaugaaauuuga

SEQ ID NO: 699976 - RNA, 13 nt, Haemophilus influenzae Rd
auuuuuuuauaaa

SEQ ID NO: 699977 - RNA, 22 nt, Haemophilus influenzae Rd
auuuuauggcugcugcaauuca

SEQ ID NO: 699978 - RNA, 20 nt, Haemophilus influenzae Rd
auuuuaugccguauuuuuca

SEQ ID NO: 699979 - RNA, 13 nt, Haemophilus influenzae Rd
auuuuauuaucaa

SEQ ID NO: 699980 - RNA, 14 nt, Haemophilus influenzae Rd
auuuuauugccaau

SEQ ID NO: 699981 - RNA, 15 nt, Haemophilus influenzae Rd
auuuuauuccaccac

SEQ ID NO: 699982 - RNA, 16 nt, Haemophilus influenzae Rd
auuuuauugaagagua

SEQ ID NO: 699983 - RNA, 18 nt, Haemophilus influenzae Rd
auuuucaccguuuuuccu

SEQ ID NO: 699984 - RNA, 21 nt, Haemophilus influenzae Rd
auuuucaccguuuuuccuuug

SEQ ID NO: 699985 - RNA, 16 nt, Haemophilus influenzae Rd
auuuucaccugaagaa

SEQ ID NO: 699986 - RNA, 13 nt, Haemophilus influenzae Rd
auuuuaaaguaaa

SEQ ID NO: 699987 - RNA, 13 nt, Haemophilus influenzae Rd
auuuuaaagccau

SEQ ID NO: 699988 - RNA, 20 nt, Haemophilus influenzae Rd
auuuuaaagaauguuugaaa

SEQ ID NO: 699989 - RNA, 23 nt, Haemophilus influenzae Rd
auuuuaaaccgucauuuauaaaa

SEQ ID NO: 699990 - RNA, 15 nt, Haemophilus influenzae Rd
auuuuaaauaaaaaa

SEQ ID NO: 699991 - RNA, 20 nt, Haemophilus influenzae Rd
auuuuaaauaaaaaauaaau

SEQ ID NO: 699992 - RNA, 13 nt, Haemophilus influenzae Rd
auuuuaaauaaaa

SEQ ID NO: 699993 - RNA, 13 nt, Haemophilus influenzae Rd
auuuuaugaaauc

SEQ ID NO: 699994 - RNA, 19 nt, Haemophilus influenzae Rd
auuuucucaucauuauuuu

SEQ ID NO: 699995 - RNA, 12 nt, Haemophilus influenzae Rd
auuuuccuucua

SEQ ID NO: 699996 - RNA, 18 nt, Haemophilus influenzae Rd
auuuuccuucugccauaa

SEQ ID NO: 699997 - RNA, 21 nt, Haemophilus influenzae Rd
auuuuccgugccacgaauaag

SEQ ID NO: 699998 - RNA, 17 nt, Haemophilus influenzae Rd
auuuuccgaaaaaacaa

SEQ ID NO: 699999 - RNA, 18 nt, Haemophilus influenzae Rd
auuuuccgaaaaaacaag

SEQ ID NO: 700000 - RNA, 19 nt, Haemophilus influenzae Rd
auuuucugcucuucaucaa

SEQ ID NO: 700001 - RNA, 20 nt, Haemophilus influenzae Rd
auuuucugcucuucaucaaa

SEQ ID NO: 700002 - RNA, 19 nt, Haemophilus influenzae Rd
auuuucuuauuauacauuu

SEQ ID NO: 700003 - RNA, 11 nt, Haemophilus influenzae Rd
auuuucuuauc

SEQ ID NO: 700004 - RNA, 14 nt, Haemophilus influenzae Rd
auuuucuuaucuaa

SEQ ID NO: 700005 - RNA, 11 nt, Haemophilus influenzae Rd
auuuucuuauu

SEQ ID NO: 700006 - RNA, 16 nt, Haemophilus influenzae Rd
auuuucuuaauuuuau

SEQ ID NO: 700007 - RNA, 16 nt, Haemophilus influenzae Rd
auuuucagcaaaaugc

SEQ ID NO: 700008 - RNA, 19 nt, Haemophilus influenzae Rd
auuuucaggugcuauuuua

SEQ ID NO: 700009 - RNA, 12 nt, Haemophilus influenzae Rd
auuuucagcaaa

SEQ ID NO: 700010 - RNA, 19 nt, Haemophilus influenzae Rd
auuuuccccuuuccacgcc

SEQ ID NO: 700011 - RNA, 13 nt, Haemophilus influenzae Rd
auuuucccauuua

SEQ ID NO: 700012 - RNA, 10 nt, Haemophilus influenzae Rd
auuuucccau

SEQ ID NO: 700013 - RNA, 21 nt, Haemophilus influenzae Rd
auuuuccccgcucuuuccauu

SEQ ID NO: 700014 - RNA, 18 nt, Haemophilus influenzae Rd
auuuucccacaugucaaa

SEQ ID NO: 700015 - RNA, 13 nt, Haemophilus influenzae Rd
auuuuccaaaauu

SEQ ID NO: 700016 - RNA, 12 nt, Haemophilus influenzae Rd
auuuuccacauu

SEQ ID NO: 700017 - RNA, 11 nt, Haemophilus influenzae Rd
auuuuuagaaa

SEQ ID NO: 700018 - RNA, 14 nt, Haemophilus influenzae Rd
auuuuuagaaaauc

SEQ ID NO: 700019 - RNA, 22 nt, Haemophilus influenzae Rd
auuuuuagaagagauuauuugc

SEQ ID NO: 700020 - RNA, 21 nt, Haemophilus influenzae Rd
auuuuuagacggucaaauuca

SEQ ID NO: 700021 - RNA, 14 nt, Haemophilus influenzae Rd
auuuuuagauuauu

SEQ ID NO: 700022 - RNA, 19 nt, Haemophilus influenzae Rd
auuuuuaggugcuuuuugc

SEQ ID NO: 700023 - RNA, 14 nt, Haemophilus influenzae Rd
auuuuuaauuuacu

SEQ ID NO: 700024 - RNA, 13 nt, Haemophilus influenzae Rd
auuuuuacaaaua

SEQ ID NO: 700025 - RNA, 19 nt, Haemophilus influenzae Rd
auuuugucagauuuauaaa

SEQ ID NO: 700026 - RNA, 19 nt, Haemophilus influenzae Rd
auuuuuaauucuuuuucac

SEQ ID NO: 700027 - RNA, 20 nt, Haemophilus influenzae Rd
auuuuuaauucuuuuucacu

SEQ ID NO: 700028 - RNA, 13 nt, Haemophilus influenzae Rd
auuuugccaauua

SEQ ID NO: 700029 - RNA, 15 nt, Haemophilus influenzae Rd
auuuugccagauuuu

SEQ ID NO: 700030 - RNA, 16 nt, Haemophilus influenzae Rd
auuuugccagauuuuu

SEQ ID NO: 700031 - RNA, 17 nt, Haemophilus influenzae Rd
auuuugccagauuuuua

SEQ ID NO: 700032 - RNA, 18 nt, Haemophilus influenzae Rd
auuuugccagauuuuuag

SEQ ID NO: 700033 - RNA, 17 nt, Haemophilus influenzae Rd
auuuugccguucaaaac

SEQ ID NO: 700034 - RNA, 21 nt, Haemophilus influenzae Rd
auuuugcguguguuaucacaa

SEQ ID NO: 700035 - RNA, 13 nt, Haemophilus influenzae Rd
auuuugcucaaaa

SEQ ID NO: 700036 - RNA, 15 nt, Haemophilus influenzae Rd
auuuuguauauugug

SEQ ID NO: 700037 - RNA, 16 nt, Haemophilus influenzae Rd
auuuuguaagcauuaa

SEQ ID NO: 700038 - RNA, 15 nt, Haemophilus influenzae Rd
auuuugguuaaacuc

SEQ ID NO: 700039 - RNA, 16 nt, Haemophilus influenzae Rd
auuuugguuaaacucg

SEQ ID NO: 700040 - RNA, 16 nt, Haemophilus influenzae Rd
auuuugauauuugcuc

SEQ ID NO: 700041 - RNA, 12 nt, Haemophilus influenzae Rd
auuuugacuuuu

SEQ ID NO: 700042 - RNA, 15 nt, Haemophilus influenzae Rd
auuuugacuuuugcc

SEQ ID NO: 700043 - RNA, 18 nt, Haemophilus influenzae Rd
auuuugagcuuauuuuua

SEQ ID NO: 700044 - RNA, 19 nt, Haemophilus influenzae Rd
auuuugagauaaauuuuua

SEQ ID NO: 700045 - RNA, 20 nt, Haemophilus influenzae Rd
auuuugauugcuacagcaaa

SEQ ID NO: 700046 - RNA, 13 nt, Haemophilus influenzae Rd
auuuugcagaaua

SEQ ID NO: 700047 - RNA, 14 nt, Haemophilus influenzae Rd
auuuugaucuuccg

SEQ ID NO: 700048 - RNA, 12 nt, Haemophilus influenzae Rd
auuuugaacaag

SEQ ID NO: 700049 - RNA, 15 nt, Haemophilus influenzae Rd
auuuugaacaagguu

SEQ ID NO: 700050 - RNA, 14 nt, Haemophilus influenzae Rd
auuuugaacaaugu

SEQ ID NO: 700051 - RNA, 16 nt, Haemophilus influenzae Rd
auuuugaauaauaaau

SEQ ID NO: 700052 - RNA, 17 nt, Haemophilus influenzae Rd
auuuugaauaauaaauu

SEQ ID NO: 700053 - RNA, 15 nt, Haemophilus influenzae Rd
auuuugaccgcuguu

SEQ ID NO: 700054 - RNA, 22 nt, Haemophilus influenzae Rd
auuuucuuuuauccgaguuaaa

SEQ ID NO: 700055 - RNA, 19 nt, Haemophilus influenzae Rd
auuuagccccuuuugcugu

SEQ ID NO: 700056 - RNA, 18 nt, Haemophilus influenzae Rd
auuuagccgcaccuugag

SEQ ID NO: 700057 - RNA, 23 nt, Haemophilus influenzae Rd
auuuagccgcaccuugagaaaua

SEQ ID NO: 700058 - RNA, 20 nt, Haemophilus influenzae Rd
auuuagccaguaauuuuaca

SEQ ID NO: 700059 - RNA, 17 nt, Haemophilus influenzae Rd
auuuagcggaauuuuug

SEQ ID NO: 700060 - RNA, 18 nt, Haemophilus influenzae Rd
auuuagauacaaaauguu

SEQ ID NO: 700061 - RNA, 21 nt, Haemophilus influenzae Rd
auuuagauacaaagauuucau

SEQ ID NO: 700062 - RNA, 13 nt, Haemophilus influenzae Rd
auuuagauaaaaa

SEQ ID NO: 700063 - RNA, 15 nt, Haemophilus influenzae Rd
auuuagauauaaaaa

SEQ ID NO: 700064 - RNA, 15 nt, Haemophilus influenzae Rd
auuuagauuacuuuu

SEQ ID NO: 700065 - RNA, 14 nt, Haemophilus influenzae Rd
auuuagauaaaaau

SEQ ID NO: 700066 - RNA, 16 nt, Haemophilus influenzae Rd
auuuacuuuauaaaug

SEQ ID NO: 700067 - RNA, 17 nt, Haemophilus influenzae Rd
auuuacuuuauaaauga

SEQ ID NO: 700068 - RNA, 19 nt, Haemophilus influenzae Rd
auuuacuggaaauucuuca

SEQ ID NO: 700069 - RNA, 23 nt, Haemophilus influenzae Rd
auuuacuggaaauucuucaauaa

SEQ ID NO: 700070 - RNA, 20 nt, Haemophilus influenzae Rd
auuuacuguuuuuauauuua

SEQ ID NO: 700071 - RNA, 21 nt, Haemophilus influenzae Rd
auuuacuguuuuuauauuuag

SEQ ID NO: 700072 - RNA, 15 nt, Haemophilus influenzae Rd
auuuagaacaauauu

SEQ ID NO: 700073 - RNA, 16 nt, Haemophilus influenzae Rd
auuuagaacaauauuu

SEQ ID NO: 700074 - RNA, 18 nt, Haemophilus influenzae Rd
auuuagaacaauauuuau

SEQ ID NO: 700075 - RNA, 14 nt, Haemophilus influenzae Rd
auuuagaaaguaua

SEQ ID NO: 700076 - RNA, 11 nt, Haemophilus influenzae Rd
auuuagaauuu

SEQ ID NO: 700077 - RNA, 14 nt, Haemophilus influenzae Rd
auuuagaauuuuua

SEQ ID NO: 700078 - RNA, 18 nt, Haemophilus influenzae Rd
auuuagacggugaaaauu

SEQ ID NO: 700079 - RNA, 18 nt, Haemophilus influenzae Rd
auuuagagcaagcaauau

SEQ ID NO: 700080 - RNA, 18 nt, Haemophilus influenzae Rd
auuuagagggauaaaaau

SEQ ID NO: 700081 - RNA, 15 nt, Haemophilus influenzae Rd
auuuacacauugcca

SEQ ID NO: 700082 - RNA, 18 nt, Haemophilus influenzae Rd
auuuacaagucucuauga

SEQ ID NO: 700083 - RNA, 16 nt, Haemophilus influenzae Rd
auuuaauuuuuuauag

SEQ ID NO: 700084 - RNA, 24 nt, Haemophilus influenzae Rd
auuuaccaauaggaagcauuucua

SEQ ID NO: 700085 - RNA, 16 nt, Haemophilus influenzae Rd
auuuacccacaacuca

SEQ ID NO: 700086 - RNA, 17 nt, Haemophilus influenzae Rd
auuuaccgcacuuuaau

SEQ ID NO: 700087 - RNA, 16 nt, Haemophilus influenzae Rd
auuuaccgcuuucaau

SEQ ID NO: 700088 - RNA, 20 nt, Haemophilus influenzae Rd
auuuaccgcuuucaauuaau

SEQ ID NO: 700089 - RNA, 23 nt, Haemophilus influenzae Rd
auuuaccgcuuucaauuaaugaa

SEQ ID NO: 700090 - RNA, 16 nt, Haemophilus influenzae Rd
auuuacccacuucaua

SEQ ID NO: 700091 - RNA, 13 nt, Haemophilus influenzae Rd
auuuacagaacaa

SEQ ID NO: 700092 - RNA, 17 nt, Haemophilus influenzae Rd
auuuacagaacaaaaua

SEQ ID NO: 700093 - RNA, 20 nt, Haemophilus influenzae Rd
auuuacagaacaaaauaauu

SEQ ID NO: 700094 - RNA, 15 nt, Haemophilus influenzae Rd
auuuacguaaaaaag

SEQ ID NO: 700095 - RNA, 16 nt, Haemophilus influenzae Rd
auuuacucuuuuuuag

SEQ ID NO: 700096 - RNA, 14 nt, Haemophilus influenzae Rd
auuuacugauuuaa

SEQ ID NO: 700097 - RNA, 16 nt, Haemophilus influenzae Rd
auuuacugauuuaaaa

SEQ ID NO: 700098 - RNA, 17 nt, Haemophilus influenzae Rd
auuuacugauuuaaaaa

SEQ ID NO: 700099 - RNA, 19 nt, Haemophilus influenzae Rd
auuuacugauuuuaagaaa

SEQ ID NO: 700100 - RNA, 21 nt, Haemophilus influenzae Rd
auuuacucacaacaaagaugg

SEQ ID NO: 700101 - RNA, 23 nt, Haemophilus influenzae Rd
auuuacucacaacaaagauggau

SEQ ID NO: 700102 - RNA, 17 nt, Haemophilus influenzae Rd
auuuacggcuuagauaa

SEQ ID NO: 700103 - RNA, 19 nt, Haemophilus influenzae Rd
auuuacgaaaacuuucauu

SEQ ID NO: 700104 - RNA, 18 nt, Haemophilus influenzae Rd
auugugacauuggauuaa

SEQ ID NO: 700105 - RNA, 15 nt, Haemophilus influenzae Rd
auugucuuuuacguu

SEQ ID NO: 700106 - RNA, 21 nt, Haemophilus influenzae Rd
auugucuuuucuauaauuaaa

SEQ ID NO: 700107 - RNA, 19 nt, Haemophilus influenzae Rd
auugucugcuccaaauaau

SEQ ID NO: 700108 - RNA, 22 nt, Haemophilus influenzae Rd
auugucauaccccaaacuugga

SEQ ID NO: 700109 - RNA, 15 nt, Haemophilus influenzae Rd
auugugauguucuaa

SEQ ID NO: 700110 - RNA, 17 nt, Haemophilus influenzae Rd
auugugauguucuaaau

SEQ ID NO: 700111 - RNA, 16 nt, Haemophilus influenzae Rd
auugugcuaaauaauu

SEQ ID NO: 700112 - RNA, 17 nt, Haemophilus influenzae Rd
auuuaaaaaucugugau

SEQ ID NO: 700113 - RNA, 14 nt, Haemophilus influenzae Rd
auuuaaaacaaaag

SEQ ID NO: 700114 - RNA, 19 nt, Haemophilus influenzae Rd
auuuaaaaauauuaagcaa

SEQ ID NO: 700115 - RNA, 17 nt, Haemophilus influenzae Rd
auuuaaaaguaaaaaua

SEQ ID NO: 700116 - RNA, 12 nt, Haemophilus influenzae Rd
auuuaaaagcac

SEQ ID NO: 700117 - RNA, 13 nt, Haemophilus influenzae Rd
auuuaaaaaauca

SEQ ID NO: 700118 - RNA, 16 nt, Haemophilus influenzae Rd
auuuaaaaaaacguua

SEQ ID NO: 700119 - RNA, 23 nt, Haemophilus influenzae Rd
auuuaaaaaaacguuaaauuuag

SEQ ID NO: 700120 - RNA, 21 nt, Haemophilus influenzae Rd
auuguuuucugaacuaaaaua

SEQ ID NO: 700121 - RNA, 14 nt, Haemophilus influenzae Rd
auuguuuguuuuau

SEQ ID NO: 700122 - RNA, 21 nt, Haemophilus influenzae Rd
auuuaacucggcuuuuucaau

SEQ ID NO: 700123 - RNA, 15 nt, Haemophilus influenzae Rd
auuuaacuguaucua

SEQ ID NO: 700124 - RNA, 19 nt, Haemophilus influenzae Rd
auuuaacuguaucuacuuu

SEQ ID NO: 700125 - RNA, 22 nt, Haemophilus influenzae Rd
auuuaagccuguuaugcuuuau

SEQ ID NO: 700126 - RNA, 21 nt, Haemophilus influenzae Rd
auuuaagcuauuguuauagaa

SEQ ID NO: 700127 - RNA, 15 nt, Haemophilus influenzae Rd
auuuaagccagaaca

SEQ ID NO: 700128 - RNA, 23 nt, Haemophilus influenzae Rd
auuuaagccagaacauauaaccc

SEQ ID NO: 700129 - RNA, 22 nt, Haemophilus influenzae Rd
auuuaagauuuacagaacaaaa

SEQ ID NO: 700130 - RNA, 17 nt, Haemophilus influenzae Rd
auuuaagaaaaaauaua

SEQ ID NO: 700131 - RNA, 13 nt, Haemophilus influenzae Rd
auuuaauuucaaa

SEQ ID NO: 700132 - RNA, 19 nt, Haemophilus influenzae Rd
auuuaauuucaaaaucaca

SEQ ID NO: 700133 - RNA, 14 nt, Haemophilus influenzae Rd
auuuaauucuaaau

SEQ ID NO: 700134 - RNA, 17 nt, Haemophilus influenzae Rd
auuuaauuauguauuuu

SEQ ID NO: 700135 - RNA, 21 nt, Haemophilus influenzae Rd
auuuaauugaaauuuaucuaa

SEQ ID NO: 700136 - RNA, 21 nt, Haemophilus influenzae Rd
auuuaaugggugauccauaau

SEQ ID NO: 700137 - RNA, 21 nt, Haemophilus influenzae Rd
auuuaauguauaaaaguggaa

SEQ ID NO: 700138 - RNA, 22 nt, Haemophilus influenzae Rd
auuuaauccaauccauaacaac

SEQ ID NO: 700139 - RNA, 12 nt, Haemophilus influenzae Rd
auugguaacaac

SEQ ID NO: 700140 - RNA, 20 nt, Haemophilus influenzae Rd
auugguaacaacugcuagga

SEQ ID NO: 700141 - RNA, 23 nt, Haemophilus influenzae Rd
auugguaauugcccaauaaaagu

SEQ ID NO: 700142 - RNA, 20 nt, Haemophilus influenzae Rd
auuggguucgcaaauaacga

SEQ ID NO: 700143 - RNA, 17 nt, Haemophilus influenzae Rd
auugguacgagaaaaau

SEQ ID NO: 700144 - RNA, 18 nt, Haemophilus influenzae Rd
auuggucacgauaagauc

SEQ ID NO: 700145 - RNA, 13 nt, Haemophilus influenzae Rd
aaaaggucuuaau

SEQ ID NO: 700146 - RNA, 13 nt, Haemophilus influenzae Rd
aaaaguaaacaau

SEQ ID NO: 700147 - RNA, 13 nt, Haemophilus influenzae Rd
aaaaguaccaaaa

SEQ ID NO: 700148 - RNA, 17 nt, Haemophilus influenzae Rd
auuguaugaaaaaugcu

SEQ ID NO: 700149 - RNA, 22 nt, Haemophilus influenzae Rd
aaaaguacagcaaaccaaggaa

SEQ ID NO: 700150 - RNA, 19 nt, Haemophilus influenzae Rd
auuggggaaguaauauuuc

SEQ ID NO: 700151 - RNA, 21 nt, Haemophilus influenzae Rd
auuggggaaguaauauuucuu

SEQ ID NO: 700152 - RNA, 22 nt, Haemophilus influenzae Rd
auuggcgaaccuucacuuaaau

SEQ ID NO: 700153 - RNA, 14 nt, Haemophilus influenzae Rd
auuggaaaaugcuu

SEQ ID NO: 700154 - RNA, 12 nt, Haemophilus influenzae Rd
auuggaauggua

SEQ ID NO: 700155 - RNA, 16 nt, Haemophilus influenzae Rd
auuggaaguuuuuccg

SEQ ID NO: 700156 - RNA, 19 nt, Haemophilus influenzae Rd
auuggaaauaauauucaaa

SEQ ID NO: 700157 - RNA, 21 nt, Haemophilus influenzae Rd
auuggaaauaauauucaaaac

SEQ ID NO: 700158 - RNA, 22 nt, Haemophilus influenzae Rd
auuggauucacggauagggaua

SEQ ID NO: 700159 - RNA, 14 nt, Haemophilus influenzae Rd
auuggauuaaucaa

SEQ ID NO: 700160 - RNA, 15 nt, Haemophilus influenzae Rd
auuggauuaaucaau

SEQ ID NO: 700161 - RNA, 22 nt, Haemophilus influenzae Rd
auugcucgugauuaucuaaauu

SEQ ID NO: 700162 - RNA, 20 nt, Haemophilus influenzae Rd
auugcucgugcaggauaaag

SEQ ID NO: 700163 - RNA, 17 nt, Haemophilus influenzae Rd
auugcucgacaaagauu

SEQ ID NO: 700164 - RNA, 14 nt, Haemophilus influenzae Rd
auugcucugacacu

SEQ ID NO: 700165 - RNA, 14 nt, Haemophilus influenzae Rd
auugcuccacuucu

SEQ ID NO: 700166 - RNA, 15 nt, Haemophilus influenzae Rd
auugcuccacuucuu

SEQ ID NO: 700167 - RNA, 17 nt, Haemophilus influenzae Rd
auugcuauggcaaugaa

SEQ ID NO: 700168 - RNA, 21 nt, Haemophilus influenzae Rd
auuggaaaaguaagaaacuug

SEQ ID NO: 700169 - RNA, 14 nt, Haemophilus influenzae Rd
auuggaaaauaaaa

SEQ ID NO: 700170 - RNA, 18 nt, Haemophilus influenzae Rd
auuggaaaauaaaaugac

SEQ ID NO: 700171 - RNA, 15 nt, Haemophilus influenzae Rd
auugcuuuaacugaa

SEQ ID NO: 700172 - RNA, 13 nt, Haemophilus influenzae Rd
auugauauuugga

SEQ ID NO: 700173 - RNA, 16 nt, Haemophilus influenzae Rd
auugaguuuuucugau

SEQ ID NO: 700174 - RNA, 14 nt, Haemophilus influenzae Rd
auugauucauuuga

SEQ ID NO: 700175 - RNA, 17 nt, Haemophilus influenzae Rd
auugauucauuugaugg

SEQ ID NO: 700176 - RNA, 19 nt, Haemophilus influenzae Rd
auugauucgauaaauuagg

SEQ ID NO: 700177 - RNA, 13 nt, Haemophilus influenzae Rd
auugauuuuaaag

SEQ ID NO: 700178 - RNA, 16 nt, Haemophilus influenzae Rd
auugauuucauauauu

SEQ ID NO: 700179 - RNA, 14 nt, Haemophilus influenzae Rd
auugauuucucuga

SEQ ID NO: 700180 - RNA, 18 nt, Haemophilus influenzae Rd
auugauugcuaaauaaau

SEQ ID NO: 700181 - RNA, 13 nt, Haemophilus influenzae Rd
auugauuuucuuu

SEQ ID NO: 700182 - RNA, 19 nt, Haemophilus influenzae Rd
auugcgagucaaauuuuua

SEQ ID NO: 700183 - RNA, 14 nt, Haemophilus influenzae Rd
auuccucugaaccu

SEQ ID NO: 700184 - RNA, 17 nt, Haemophilus influenzae Rd
auuccgcaccugcaggu

SEQ ID NO: 700185 - RNA, 16 nt, Haemophilus influenzae Rd
auucauaauccguuaa

SEQ ID NO: 700186 - RNA, 14 nt, Haemophilus influenzae Rd
auucauaaaaggca

SEQ ID NO: 700187 - RNA, 23 nt, Haemophilus influenzae Rd
auucauaaaaggcaaagcaaaau

SEQ ID NO: 700188 - RNA, 21 nt, Haemophilus influenzae Rd
auucauaaauuccuuuuuaau

SEQ ID NO: 700189 - RNA, 19 nt, Haemophilus influenzae Rd
auuccagugguaaaccuaa

SEQ ID NO: 700190 - RNA, 22 nt, Haemophilus influenzae Rd
auuccaguaaugguuacuuuau

SEQ ID NO: 700191 - RNA, 20 nt, Haemophilus influenzae Rd
auucccccauuaaaagaagc

SEQ ID NO: 700192 - RNA, 15 nt, Haemophilus influenzae Rd
auucccauuccagua

SEQ ID NO: 700193 - RNA, 16 nt, Haemophilus influenzae Rd
auucccauuccaguaa

SEQ ID NO: 700194 - RNA, 16 nt, Haemophilus influenzae Rd
auucggaauauucaac

SEQ ID NO: 700195 - RNA, 15 nt, Haemophilus influenzae Rd
auucgccuaaugccu

SEQ ID NO: 700196 - RNA, 16 nt, Haemophilus influenzae Rd
auucuacugaaaucaa

SEQ ID NO: 700197 - RNA, 19 nt, Haemophilus influenzae Rd
auucuacuuggugauuaug

SEQ ID NO: 700198 - RNA, 18 nt, Haemophilus influenzae Rd
auucuacgaauugguucu

SEQ ID NO: 700199 - RNA, 16 nt, Haemophilus influenzae Rd
auucuacguauugaac

SEQ ID NO: 700200 - RNA, 20 nt, Haemophilus influenzae Rd
auucuacguauugaacuaaa

SEQ ID NO: 700201 - RNA, 12 nt, Haemophilus influenzae Rd
auucuaaauuua

SEQ ID NO: 700202 - RNA, 17 nt, Haemophilus influenzae Rd
auucuaccgcauuuuua

SEQ ID NO: 700203 - RNA, 12 nt, Haemophilus influenzae Rd
auucuaaaaaaa

SEQ ID NO: 700204 - RNA, 14 nt, Haemophilus influenzae Rd
auucuaaaaaaauc

SEQ ID NO: 700205 - RNA, 17 nt, Haemophilus influenzae Rd
auucuaaaaaaauccua

SEQ ID NO: 700206 - RNA, 20 nt, Haemophilus influenzae Rd
auucuaaacggcguaucaua

SEQ ID NO: 700207 - RNA, 22 nt, Haemophilus influenzae Rd
auucuaaacggcguaucauacu

SEQ ID NO: 700208 - RNA, 18 nt, Haemophilus influenzae Rd
auucgaucagcacgauaa

SEQ ID NO: 700209 - RNA, 18 nt, Haemophilus influenzae Rd
auucgauugcauuuuuua

SEQ ID NO: 700210 - RNA, 19 nt, Haemophilus influenzae Rd
auucgauugcauuuuuuau

SEQ ID NO: 700211 - RNA, 16 nt, Haemophilus influenzae Rd
auucgcaaauccuaca

SEQ ID NO: 700212 - RNA, 16 nt, Haemophilus influenzae Rd
auuccugcuuuuuuca

SEQ ID NO: 700213 - RNA, 20 nt, Haemophilus influenzae Rd
auugaguucucguugcaucu

SEQ ID NO: 700214 - RNA, 12 nt, Haemophilus influenzae Rd
auugacuugcac

SEQ ID NO: 700215 - RNA, 19 nt, Haemophilus influenzae Rd
auugacuugcacaauuacu

SEQ ID NO: 700216 - RNA, 20 nt, Haemophilus influenzae Rd
auugacuugcacaauuacuu

SEQ ID NO: 700217 - RNA, 15 nt, Haemophilus influenzae Rd
auugacuuguuuuaa

SEQ ID NO: 700218 - RNA, 18 nt, Haemophilus influenzae Rd
auugacuuguuuuaaaac

SEQ ID NO: 700219 - RNA, 17 nt, Haemophilus influenzae Rd
auugagcgauagaaaua

SEQ ID NO: 700220 - RNA, 12 nt, Haemophilus influenzae Rd
auugaacuguuu

SEQ ID NO: 700221 - RNA, 18 nt, Haemophilus influenzae Rd
auugaagagauugauuuu

SEQ ID NO: 700222 - RNA, 12 nt, Haemophilus influenzae Rd
auugaaggucau

SEQ ID NO: 700223 - RNA, 16 nt, Haemophilus influenzae Rd
auugaaggucauacga

SEQ ID NO: 700224 - RNA, 16 nt, Haemophilus influenzae Rd
auugaaucaauuuuuu

SEQ ID NO: 700225 - RNA, 19 nt, Haemophilus influenzae Rd
auugaauaauuacuugcuc

SEQ ID NO: 700226 - RNA, 15 nt, Haemophilus influenzae Rd
auugaauauuuaguu

SEQ ID NO: 700227 - RNA, 19 nt, Haemophilus influenzae Rd
auugaauuagauucggcua

SEQ ID NO: 700228 - RNA, 14 nt, Haemophilus influenzae Rd
auugaccaaugaau

SEQ ID NO: 700229 - RNA, 13 nt, Haemophilus influenzae Rd
auugacaauuaau

SEQ ID NO: 700230 - RNA, 15 nt, Haemophilus influenzae Rd
auugacaauuaauau

SEQ ID NO: 700231 - RNA, 20 nt, Haemophilus influenzae Rd
auugacaacgcgacuaaauc

SEQ ID NO: 700232 - RNA, 14 nt, Haemophilus influenzae Rd
auugacgaaaaauu

SEQ ID NO: 700233 - RNA, 19 nt, Haemophilus influenzae Rd
auugacgaaaaauuaacca

SEQ ID NO: 700234 - RNA, 19 nt, Haemophilus influenzae Rd
auugacguaaaaguuuucc

SEQ ID NO: 700235 - RNA, 18 nt, Haemophilus influenzae Rd
auugaccgcuucauuaaa

SEQ ID NO: 700236 - RNA, 14 nt, Haemophilus influenzae Rd
auucuuucucuuuu

SEQ ID NO: 700237 - RNA, 22 nt, Haemophilus influenzae Rd
auucuuugagucggggauuuuu

SEQ ID NO: 700238 - RNA, 12 nt, Haemophilus influenzae Rd
auucuuuuaaau

SEQ ID NO: 700239 - RNA, 13 nt, Haemophilus influenzae Rd
auucuuuucaaca

SEQ ID NO: 700240 - RNA, 14 nt, Haemophilus influenzae Rd
auucuuuucaacau

SEQ ID NO: 700241 - RNA, 13 nt, Haemophilus influenzae Rd
auucuuuuuaaau

SEQ ID NO: 700242 - RNA, 20 nt, Haemophilus influenzae Rd
auucuuuucuucuuugacua

SEQ ID NO: 700243 - RNA, 22 nt, Haemophilus influenzae Rd
auucuuuugcuaguaagauuuu

SEQ ID NO: 700244 - RNA, 23 nt, Haemophilus influenzae Rd
auugaacaauguuuaauccaaac

SEQ ID NO: 700245 - RNA, 18 nt, Haemophilus influenzae Rd
auugaaccauuuuacaau

SEQ ID NO: 700246 - RNA, 20 nt, Haemophilus influenzae Rd
auugaacgccuagauauugu

SEQ ID NO: 700247 - RNA, 21 nt, Haemophilus influenzae Rd
auugaacgccuagauauuguu

SEQ ID NO: 700248 - RNA, 19 nt, Haemophilus influenzae Rd
auugaaauagacuacuuaa

SEQ ID NO: 700249 - RNA, 13 nt, Haemophilus influenzae Rd
auucuucaauaac

SEQ ID NO: 700250 - RNA, 22 nt, Haemophilus influenzae Rd
auucuuagcuuuagcaaucaau

SEQ ID NO: 700251 - RNA, 16 nt, Haemophilus influenzae Rd
auucuuucaauaauuu

SEQ ID NO: 700252 - RNA, 19 nt, Haemophilus influenzae Rd
auucuuuaugaauuaccaa

SEQ ID NO: 700253 - RNA, 16 nt, Haemophilus influenzae Rd
auucuucagauuuuau

SEQ ID NO: 700254 - RNA, 17 nt, Haemophilus influenzae Rd
auucuucauaaaaaaag

SEQ ID NO: 700255 - RNA, 23 nt, Haemophilus influenzae Rd
auucuuaccaaaaggucuuaaua

SEQ ID NO: 700256 - RNA, 14 nt, Haemophilus influenzae Rd
auucuuaaaucaua

SEQ ID NO: 700257 - RNA, 19 nt, Haemophilus influenzae Rd
auucugugcaauauuuccu

SEQ ID NO: 700258 - RNA, 21 nt, Haemophilus influenzae Rd
auucuccgauacauaauacug

SEQ ID NO: 700259 - RNA, 15 nt, Haemophilus influenzae Rd
auucucaucagccuu

SEQ ID NO: 700260 - RNA, 23 nt, Haemophilus influenzae Rd
auucucccugaguauguuuugau

SEQ ID NO: 700261 - RNA, 14 nt, Haemophilus influenzae Rd
auucuccaaauaua

SEQ ID NO: 700262 - RNA, 16 nt, Haemophilus influenzae Rd
auucuccaaauauaaa

SEQ ID NO: 700263 - RNA, 17 nt, Haemophilus influenzae Rd
auucucaggaaauuuca

SEQ ID NO: 700264 - RNA, 18 nt, Haemophilus influenzae Rd
auucuaguucuuccccuc

SEQ ID NO: 700265 - RNA, 15 nt, Haemophilus influenzae Rd
auucucacaucauca

SEQ ID NO: 700266 - RNA, 12 nt, Haemophilus influenzae Rd
auucuaaauauu

SEQ ID NO: 700267 - RNA, 20 nt, Haemophilus influenzae Rd
augcaguaacuucugcugca

SEQ ID NO: 700268 - RNA, 14 nt, Haemophilus influenzae Rd
augcaguaauaaau

SEQ ID NO: 700269 - RNA, 14 nt, Haemophilus influenzae Rd
augcauugaugacu

SEQ ID NO: 700270 - RNA, 20 nt, Haemophilus influenzae Rd
augcauugaugacugcauca

SEQ ID NO: 700271 - RNA, 16 nt, Haemophilus influenzae Rd
augcauugauugcuuu

SEQ ID NO: 700272 - RNA, 21 nt, Haemophilus influenzae Rd
augcaccguaaccgcccagca

SEQ ID NO: 700273 - RNA, 13 nt, Haemophilus influenzae Rd
augaucuaauggg

SEQ ID NO: 700274 - RNA, 20 nt, Haemophilus influenzae Rd
augaucuaauggggauuuac

SEQ ID NO: 700275 - RNA, 22 nt, Haemophilus influenzae Rd
augaucuacaccgaauaauacu

SEQ ID NO: 700276 - RNA, 23 nt, Haemophilus influenzae Rd
augcaggggcuuuuaaugaugcg

SEQ ID NO: 700277 - RNA, 14 nt, Haemophilus influenzae Rd
augcaggaaaggca

SEQ ID NO: 700278 - RNA, 16 nt, Haemophilus influenzae Rd
augcacuuucaucuac

SEQ ID NO: 700279 - RNA, 19 nt, Haemophilus influenzae Rd
augccacuuggugaucacc

SEQ ID NO: 700280 - RNA, 16 nt, Haemophilus influenzae Rd
augccaaauuucuccg

SEQ ID NO: 700281 - RNA, 12 nt, Haemophilus influenzae Rd
augccaaauaaa

SEQ ID NO: 700282 - RNA, 17 nt, Haemophilus influenzae Rd
augcccacuuuuccuaa

SEQ ID NO: 700283 - RNA, 14 nt, Haemophilus influenzae Rd
augcccaauuaccu

SEQ ID NO: 700284 - RNA, 15 nt, Haemophilus influenzae Rd
augccaguggggaag

SEQ ID NO: 700285 - RNA, 14 nt, Haemophilus influenzae Rd
augccguauuuuuc

SEQ ID NO: 700286 - RNA, 17 nt, Haemophilus influenzae Rd
augccccuaauuauuua

SEQ ID NO: 700287 - RNA, 19 nt, Haemophilus influenzae Rd
augcgaucuaaaucauuua

SEQ ID NO: 700288 - RNA, 14 nt, Haemophilus influenzae Rd
augcgauuuccaag

SEQ ID NO: 700289 - RNA, 21 nt, Haemophilus influenzae Rd
augcggacuuuuucauuaucu

SEQ ID NO: 700290 - RNA, 22 nt, Haemophilus influenzae Rd
augcggcaaugguuaauacaaa

SEQ ID NO: 700291 - RNA, 16 nt, Haemophilus influenzae Rd
augcgcugauuuuuca

SEQ ID NO: 700292 - RNA, 15 nt, Haemophilus influenzae Rd
augcggugaaauuuc

SEQ ID NO: 700293 - RNA, 14 nt, Haemophilus influenzae Rd
augcguucagaauu

SEQ ID NO: 700294 - RNA, 13 nt, Haemophilus influenzae Rd
aaaagauaaaaca

SEQ ID NO: 700295 - RNA, 19 nt, Haemophilus influenzae Rd
aaaagagugcgguuaauuu

SEQ ID NO: 700296 - RNA, 22 nt, Haemophilus influenzae Rd
aaaagagugcgguuaauuuuga

SEQ ID NO: 700297 - RNA, 20 nt, Haemophilus influenzae Rd
augcuaauaaucuauuucuu

SEQ ID NO: 700298 - RNA, 12 nt, Haemophilus influenzae Rd
augcuaaauaua

SEQ ID NO: 700299 - RNA, 15 nt, Haemophilus influenzae Rd
augcuaaacguucuu

SEQ ID NO: 700300 - RNA, 18 nt, Haemophilus influenzae Rd
augcgugucaaauuaauu

SEQ ID NO: 700301 - RNA, 21 nt, Haemophilus influenzae Rd
aaaagagagauaacucucucu

SEQ ID NO: 700302 - RNA, 17 nt, Haemophilus influenzae Rd
aaaagagagcuaacucc

SEQ ID NO: 700303 - RNA, 20 nt, Haemophilus influenzae Rd
aaaagagcgguuaaaaauag

SEQ ID NO: 700304 - RNA, 20 nt, Haemophilus influenzae Rd
aaaagagcgguugaaaauuu

SEQ ID NO: 700305 - RNA, 19 nt, Haemophilus influenzae Rd
aaaagaccgcacuuuaaaa

SEQ ID NO: 700306 - RNA, 20 nt, Haemophilus influenzae Rd
aaaagaccgcacuuuaaaag

SEQ ID NO: 700307 - RNA, 21 nt, Haemophilus influenzae Rd
aaaagaccgcacuuuaaaagu

SEQ ID NO: 700308 - RNA, 20 nt, Haemophilus influenzae Rd
aaaagacgaagaaacaacca

SEQ ID NO: 700309 - RNA, 15 nt, Haemophilus influenzae Rd
aaaagacuaaacuca

SEQ ID NO: 700310 - RNA, 14 nt, Haemophilus influenzae Rd
augcugagauuuug

SEQ ID NO: 700311 - RNA, 18 nt, Haemophilus influenzae Rd
augcugagugcaagccac

SEQ ID NO: 700312 - RNA, 13 nt, Haemophilus influenzae Rd
auggcaaucacaa

SEQ ID NO: 700313 - RNA, 23 nt, Haemophilus influenzae Rd
auggcaagugcaagccccugaag

SEQ ID NO: 700314 - RNA, 22 nt, Haemophilus influenzae Rd
auggcaauucgugaagugauuc

SEQ ID NO: 700315 - RNA, 20 nt, Haemophilus influenzae Rd
auggcaacgccaauaaaaag

SEQ ID NO: 700316 - RNA, 19 nt, Haemophilus influenzae Rd
auggcaacaaauauugguu

SEQ ID NO: 700317 - RNA, 14 nt, Haemophilus influenzae Rd
auggcgaauuucac

SEQ ID NO: 700318 - RNA, 18 nt, Haemophilus influenzae Rd
auggcgacggcaucaaac

SEQ ID NO: 700319 - RNA, 18 nt, Haemophilus influenzae Rd
augggauuuuuaccccac

SEQ ID NO: 700320 - RNA, 15 nt, Haemophilus influenzae Rd
augggcaauggcaau

SEQ ID NO: 700321 - RNA, 19 nt, Haemophilus influenzae Rd
augggcaauggcaaucaca

SEQ ID NO: 700322 - RNA, 16 nt, Haemophilus influenzae Rd
augggauaaacauuuc

SEQ ID NO: 700323 - RNA, 22 nt, Haemophilus influenzae Rd
augggaucaagauaccaauaau

SEQ ID NO: 700324 - RNA, 18 nt, Haemophilus influenzae Rd
augggcauccaaaguaca

SEQ ID NO: 700325 - RNA, 18 nt, Haemophilus influenzae Rd
auggggcuuuuuuuuauu

SEQ ID NO: 700326 - RNA, 19 nt, Haemophilus influenzae Rd
augggggaauaaauucuga

SEQ ID NO: 700327 - RNA, 15 nt, Haemophilus influenzae Rd
auggcuuuuuccuga

SEQ ID NO: 700328 - RNA, 18 nt, Haemophilus influenzae Rd
auggcuuucaauuucacg

SEQ ID NO: 700329 - RNA, 18 nt, Haemophilus influenzae Rd
auggcgguauauucugua

SEQ ID NO: 700330 - RNA, 23 nt, Haemophilus influenzae Rd
auggcgguaaaaaaguaacaagu

SEQ ID NO: 700331 - RNA, 14 nt, Haemophilus influenzae Rd
auguaaaagauaaa

SEQ ID NO: 700332 - RNA, 12 nt, Haemophilus influenzae Rd
auguaaaaauaa

SEQ ID NO: 700333 - RNA, 21 nt, Haemophilus influenzae Rd
auguaaaaauaaccuauaaua

SEQ ID NO: 700334 - RNA, 17 nt, Haemophilus influenzae Rd
augguuuuccaaaaacc

SEQ ID NO: 700335 - RNA, 14 nt, Haemophilus influenzae Rd
augguuuguuccaa

SEQ ID NO: 700336 - RNA, 20 nt, Haemophilus influenzae Rd
augguuggaagaaaagcauu

SEQ ID NO: 700337 - RNA, 18 nt, Haemophilus influenzae Rd
auguaauucuggcuguuu

SEQ ID NO: 700338 - RNA, 20 nt, Haemophilus influenzae Rd
auguaauugagcguccacuu

SEQ ID NO: 700339 - RNA, 19 nt, Haemophilus influenzae Rd
auguaacuguuuguuuuuu

SEQ ID NO: 700340 - RNA, 24 nt, Haemophilus influenzae Rd
auguaagagugaaguuauaguaua

SEQ ID NO: 700341 - RNA, 23 nt, Haemophilus influenzae Rd
auguaauagccauuuuggaaugg

SEQ ID NO: 700342 - RNA, 17 nt, Haemophilus influenzae Rd
auguaggcaaaaacacu

SEQ ID NO: 700343 - RNA, 17 nt, Haemophilus influenzae Rd
auguagcugaaacuaaa

SEQ ID NO: 700344 - RNA, 13 nt, Haemophilus influenzae Rd
auguagagauaau

SEQ ID NO: 700345 - RNA, 18 nt, Haemophilus influenzae Rd
auguagagauaauaaaua

SEQ ID NO: 700346 - RNA, 20 nt, Haemophilus influenzae Rd
auguagagauaauaaauaua

SEQ ID NO: 700347 - RNA, 22 nt, Haemophilus influenzae Rd
auguauuuuacguauguauuuu

SEQ ID NO: 700348 - RNA, 22 nt, Haemophilus influenzae Rd
auguccacuuuuggaaacuaug

SEQ ID NO: 700349 - RNA, 12 nt, Haemophilus influenzae Rd
augucagguuua

SEQ ID NO: 700350 - RNA, 14 nt, Haemophilus influenzae Rd
aaaagcaaaaccau

SEQ ID NO: 700351 - RNA, 16 nt, Haemophilus influenzae Rd
aaaagcaaaacugaaa

SEQ ID NO: 700352 - RNA, 13 nt, Haemophilus influenzae Rd
aaaagcaaaugag

SEQ ID NO: 700353 - RNA, 19 nt, Haemophilus influenzae Rd
aaaagauucaacaauaauu

SEQ ID NO: 700354 - RNA, 18 nt, Haemophilus influenzae Rd
aaaagauuauacgaucac

SEQ ID NO: 700355 - RNA, 13 nt, Haemophilus influenzae Rd
auguauaaagcau

SEQ ID NO: 700356 - RNA, 17 nt, Haemophilus influenzae Rd
auguaguugugauuuuc

SEQ ID NO: 700357 - RNA, 20 nt, Haemophilus influenzae Rd
aaaagauaaacaaaccuaaa

SEQ ID NO: 700358 - RNA, 23 nt, Haemophilus influenzae Rd
aaaagaucaggaucaaaaauauc

SEQ ID NO: 700359 - RNA, 20 nt, Haemophilus influenzae Rd
aaaagaucauuuuuuuaaau

SEQ ID NO: 700360 - RNA, 14 nt, Haemophilus influenzae Rd
auuagcgauuaaag

SEQ ID NO: 700361 - RNA, 20 nt, Haemophilus influenzae Rd
auuagcuaauauaauaaauu

SEQ ID NO: 700362 - RNA, 15 nt, Haemophilus influenzae Rd
auuagcuaaauacuu

SEQ ID NO: 700363 - RNA, 16 nt, Haemophilus influenzae Rd
aaaagcccuucuaugc

SEQ ID NO: 700364 - RNA, 19 nt, Haemophilus influenzae Rd
aaaagcccuucuaugccaa

SEQ ID NO: 700365 - RNA, 12 nt, Haemophilus influenzae Rd
auuaggaauuug

SEQ ID NO: 700366 - RNA, 19 nt, Haemophilus influenzae Rd
auuaggacaauauuuacuc

SEQ ID NO: 700367 - RNA, 19 nt, Haemophilus influenzae Rd
auuaggaauagcaagauaa

SEQ ID NO: 700368 - RNA, 23 nt, Haemophilus influenzae Rd
auuacccguuugaaguacauuca

SEQ ID NO: 700369 - RNA, 18 nt, Haemophilus influenzae Rd
auuacgaccuuuacuuuu

SEQ ID NO: 700370 - RNA, 20 nt, Haemophilus influenzae Rd
auuacgacauucuuuagaau

SEQ ID NO: 700371 - RNA, 15 nt, Haemophilus influenzae Rd
auuacgccuaaccaa

SEQ ID NO: 700372 - RNA, 18 nt, Haemophilus influenzae Rd
auuacgccugcaaauaag

SEQ ID NO: 700373 - RNA, 17 nt, Haemophilus influenzae Rd
auuacgcguacgcaauu

SEQ ID NO: 700374 - RNA, 22 nt, Haemophilus influenzae Rd
auuacgcguacgcaauuuagau

SEQ ID NO: 700375 - RNA, 19 nt, Haemophilus influenzae Rd
auuacgcuguccaauaauu

SEQ ID NO: 700376 - RNA, 14 nt, Haemophilus influenzae Rd
auuauacauuuaac

SEQ ID NO: 700377 - RNA, 16 nt, Haemophilus influenzae Rd
auuauacauuuaacca

SEQ ID NO: 700378 - RNA, 15 nt, Haemophilus influenzae Rd
auuauaccgcucaca

SEQ ID NO: 700379 - RNA, 23 nt, Haemophilus influenzae Rd
auuauacgaucacgauuuuucuc

SEQ ID NO: 700380 - RNA, 11 nt, Haemophilus influenzae Rd
auuauaaacca

SEQ ID NO: 700381 - RNA, 18 nt, Haemophilus influenzae Rd
auuaguuuuuaauuugcc

SEQ ID NO: 700382 - RNA, 12 nt, Haemophilus influenzae Rd
auuauaaaaaua

SEQ ID NO: 700383 - RNA, 18 nt, Haemophilus influenzae Rd
auuaguuuuuuauuucua

SEQ ID NO: 700384 - RNA, 19 nt, Haemophilus influenzae Rd
auuaguuuuuuauuucuaa

SEQ ID NO: 700385 - RNA, 14 nt, Haemophilus influenzae Rd
auuaguaaaauaau

SEQ ID NO: 700386 - RNA, 17 nt, Haemophilus influenzae Rd
auuaggguacauuugac

SEQ ID NO: 700387 - RNA, 16 nt, Haemophilus influenzae Rd
aaaagcuggauuaaau

SEQ ID NO: 700388 - RNA, 13 nt, Haemophilus influenzae Rd
auuaugaaaaaaa

SEQ ID NO: 700389 - RNA, 15 nt, Haemophilus influenzae Rd
auuaugaaaaaaacu

SEQ ID NO: 700390 - RNA, 17 nt, Haemophilus influenzae Rd
auuauuacccguuugaa

SEQ ID NO: 700391 - RNA, 20 nt, Haemophilus influenzae Rd
auuauuagcauaauaaaaaa

SEQ ID NO: 700392 - RNA, 20 nt, Haemophilus influenzae Rd
auuauuacaauuuaagaucu

SEQ ID NO: 700393 - RNA, 14 nt, Haemophilus influenzae Rd
auuaucugauguag

SEQ ID NO: 700394 - RNA, 21 nt, Haemophilus influenzae Rd
auuauccaaaccaucauaggc

SEQ ID NO: 700395 - RNA, 14 nt, Haemophilus influenzae Rd
auuaucauuaaaua

SEQ ID NO: 700396 - RNA, 21 nt, Haemophilus influenzae Rd
auuaucauaaacaauuucauu

SEQ ID NO: 700397 - RNA, 15 nt, Haemophilus influenzae Rd
auuaucaaagaauuu

SEQ ID NO: 700398 - RNA, 14 nt, Haemophilus influenzae Rd
auuaucaaaugcca

SEQ ID NO: 700399 - RNA, 15 nt, Haemophilus influenzae Rd
auuaucaaaugccac

SEQ ID NO: 700400 - RNA, 15 nt, Haemophilus influenzae Rd
auuaucaaaaagaaa

SEQ ID NO: 700401 - RNA, 19 nt, Haemophilus influenzae Rd
auuaucaaaaagaaauauu

SEQ ID NO: 700402 - RNA, 14 nt, Haemophilus influenzae Rd
auuaucaacaucaa

SEQ ID NO: 700403 - RNA, 15 nt, Haemophilus influenzae Rd
auuauagagaaauaa

SEQ ID NO: 700404 - RNA, 20 nt, Haemophilus influenzae Rd
auuauagagaaauaaucacu

SEQ ID NO: 700405 - RNA, 14 nt, Haemophilus influenzae Rd
auuauauuuuuaau

SEQ ID NO: 700406 - RNA, 17 nt, Haemophilus influenzae Rd
auucacgagccaauaca

SEQ ID NO: 700407 - RNA, 17 nt, Haemophilus influenzae Rd
auucacgaauacaucca

SEQ ID NO: 700408 - RNA, 18 nt, Haemophilus influenzae Rd
auucaccccuucuguugc

SEQ ID NO: 700409 - RNA, 19 nt, Haemophilus influenzae Rd
auucacgcauuuaaauaaa

SEQ ID NO: 700410 - RNA, 23 nt, Haemophilus influenzae Rd
auucacgccuucgcgagauaaaa

SEQ ID NO: 700411 - RNA, 20 nt, Haemophilus influenzae Rd
auucacguucuuuaauauca

SEQ ID NO: 700412 - RNA, 13 nt, Haemophilus influenzae Rd
auucacuuucaca

SEQ ID NO: 700413 - RNA, 19 nt, Haemophilus influenzae Rd
auucagccccuuauggugg

SEQ ID NO: 700414 - RNA, 13 nt, Haemophilus influenzae Rd
auucagauauaac

SEQ ID NO: 700415 - RNA, 14 nt, Haemophilus influenzae Rd
auucagcaaaauca

SEQ ID NO: 700416 - RNA, 17 nt, Haemophilus influenzae Rd
auucagcgagagaauau

SEQ ID NO: 700417 - RNA, 15 nt, Haemophilus influenzae Rd
auucagcuaaacauu

SEQ ID NO: 700418 - RNA, 23 nt, Haemophilus influenzae Rd
auucagcuuuaaggcacagauua

SEQ ID NO: 700419 - RNA, 14 nt, Haemophilus influenzae Rd
auucaguccgcauu

SEQ ID NO: 700420 - RNA, 13 nt, Haemophilus influenzae Rd
auucagugccaua

SEQ ID NO: 700421 - RNA, 17 nt, Haemophilus influenzae Rd
auucagugccuaaauuu

SEQ ID NO: 700422 - RNA, 20 nt, Haemophilus influenzae Rd
auucaguccaugcguuuuau

SEQ ID NO: 700423 - RNA, 17 nt, Haemophilus influenzae Rd
auucaguaucaaauaca

SEQ ID NO: 700424 - RNA, 14 nt, Haemophilus influenzae Rd
auucauaaaaaugu

SEQ ID NO: 700425 - RNA, 19 nt, Haemophilus influenzae Rd
auucaguugauagacaaua

SEQ ID NO: 700426 - RNA, 20 nt, Haemophilus influenzae Rd
auucaguugauagacaauau

SEQ ID NO: 700427 - RNA, 23 nt, Haemophilus influenzae Rd
auucaguugauagacaauauaau

SEQ ID NO: 700428 - RNA, 17 nt, Haemophilus influenzae Rd
auucaguuaagaaaaua

SEQ ID NO: 700429 - RNA, 18 nt, Haemophilus influenzae Rd
auucaguuaagaaaauaa

SEQ ID NO: 700430 - RNA, 18 nt, Haemophilus influenzae Rd
auucaguguaguuuucug

SEQ ID NO: 700431 - RNA, 19 nt, Haemophilus influenzae Rd
auucaggugggaaauaauu

SEQ ID NO: 700432 - RNA, 16 nt, Haemophilus influenzae Rd
auucaguaagaaacca

SEQ ID NO: 700433 - RNA, 18 nt, Haemophilus influenzae Rd
auucagggauuaagaaaa

SEQ ID NO: 700434 - RNA, 16 nt, Haemophilus influenzae Rd
auucaaugcuuccuuc

SEQ ID NO: 700435 - RNA, 19 nt, Haemophilus influenzae Rd
auucaaugcuuccuucaaa

SEQ ID NO: 700436 - RNA, 20 nt, Haemophilus influenzae Rd
auucaaugcaacaauacguu

SEQ ID NO: 700437 - RNA, 18 nt, Haemophilus influenzae Rd
auucaaugcagaaauacu

SEQ ID NO: 700438 - RNA, 22 nt, Haemophilus influenzae Rd
aaaaggcuaaguucuaaaauua

SEQ ID NO: 700439 - RNA, 21 nt, Haemophilus influenzae Rd
aaaaggcggcuacuucuuuga

SEQ ID NO: 700440 - RNA, 19 nt, Haemophilus influenzae Rd
auucacauucuuuuaaaua

SEQ ID NO: 700441 - RNA, 21 nt, Haemophilus influenzae Rd
auucaauuuuccccucaauuu

SEQ ID NO: 700442 - RNA, 15 nt, Haemophilus influenzae Rd
auuauugcauuuuua

SEQ ID NO: 700443 - RNA, 15 nt, Haemophilus influenzae Rd
auucaaaucuugaca

SEQ ID NO: 700444 - RNA, 20 nt, Haemophilus influenzae Rd
auucaaaugaaauguuuuuu

SEQ ID NO: 700445 - RNA, 17 nt, Haemophilus influenzae Rd
auucaaaucgaucacuu

SEQ ID NO: 700446 - RNA, 23 nt, Haemophilus influenzae Rd
auuauucuuuucaacauucacua

SEQ ID NO: 700447 - RNA, 16 nt, Haemophilus influenzae Rd
auuauucuacauaaug

SEQ ID NO: 700448 - RNA, 15 nt, Haemophilus influenzae Rd
auucaaauuucaacu

SEQ ID NO: 700449 - RNA, 15 nt, Haemophilus influenzae Rd
auucaacaaaaaugc

SEQ ID NO: 700450 - RNA, 22 nt, Haemophilus influenzae Rd
auucaacaauucauaaauaauu

SEQ ID NO: 700451 - RNA, 17 nt, Haemophilus influenzae Rd
auucaauccuauuuuua

SEQ ID NO: 700452 - RNA, 20 nt, Haemophilus influenzae Rd
auucaauagguuauaaguuu

SEQ ID NO: 700453 - RNA, 15 nt, Haemophilus influenzae Rd
auucaacgguaacug

SEQ ID NO: 700454 - RNA, 14 nt, Haemophilus influenzae Rd
auuaaccaacauaa

SEQ ID NO: 700455 - RNA, 17 nt, Haemophilus influenzae Rd
auuaagguaauauguaa

SEQ ID NO: 700456 - RNA, 23 nt, Haemophilus influenzae Rd
auuaagggcgcagacugcauauc

SEQ ID NO: 700457 - RNA, 16 nt, Haemophilus influenzae Rd
auuaaggggauucgau

SEQ ID NO: 700458 - RNA, 19 nt, Haemophilus influenzae Rd
auuaagguuggaauagccg

SEQ ID NO: 700459 - RNA, 18 nt, Haemophilus influenzae Rd
auuaaguagauaacaaaa

SEQ ID NO: 700460 - RNA, 16 nt, Haemophilus influenzae Rd
auuaaguauaacuaau

SEQ ID NO: 700461 - RNA, 14 nt, Haemophilus influenzae Rd
auuaaguucaaauu

SEQ ID NO: 700462 - RNA, 17 nt, Haemophilus influenzae Rd
auuaaguucaaauuucu

SEQ ID NO: 700463 - RNA, 14 nt, Haemophilus influenzae Rd
auuaaguuaaaagu

SEQ ID NO: 700464 - RNA, 14 nt, Haemophilus influenzae Rd
auuaaguauauugc

SEQ ID NO: 700465 - RNA, 20 nt, Haemophilus influenzae Rd
auuaagucgauaaagaaugc

SEQ ID NO: 700466 - RNA, 21 nt, Haemophilus influenzae Rd
auuaagugcggugaaaaauca

SEQ ID NO: 700467 - RNA, 22 nt, Haemophilus influenzae Rd
auuaagugcguguauauauuuu

SEQ ID NO: 700468 - RNA, 16 nt, Haemophilus influenzae Rd
auuaauaucuuuaaca

SEQ ID NO: 700469 - RNA, 22 nt, Haemophilus influenzae Rd
aaaagccaccaaaugguggcuu

SEQ ID NO: 700470 - RNA, 14 nt, Haemophilus influenzae Rd
aaaagccacuuuca

SEQ ID NO: 700471 - RNA, 15 nt, Haemophilus influenzae Rd
auuaaucaaaaauug

SEQ ID NO: 700472 - RNA, 21 nt, Haemophilus influenzae Rd
auuaaucaauaagaaauccac

SEQ ID NO: 700473 - RNA, 14 nt, Haemophilus influenzae Rd
auuaaucaccauau

SEQ ID NO: 700474 - RNA, 21 nt, Haemophilus influenzae Rd
auuaaucaccauaucaauuuc

SEQ ID NO: 700475 - RNA, 22 nt, Haemophilus influenzae Rd
auuaaucaccauaucaauuuca

SEQ ID NO: 700476 - RNA, 15 nt, Haemophilus influenzae Rd
aaaagccaauaagag

SEQ ID NO: 700477 - RNA, 19 nt, Haemophilus influenzae Rd
auuaaugaacgaacuaaaa

SEQ ID NO: 700478 - RNA, 18 nt, Haemophilus influenzae Rd
auuaaucuuauacaacaa

SEQ ID NO: 700479 - RNA, 15 nt, Haemophilus influenzae Rd
auuaaucgaucaauu

SEQ ID NO: 700480 - RNA, 17 nt, Haemophilus influenzae Rd
auuaaucgaucaauuug

SEQ ID NO: 700481 - RNA, 22 nt, Haemophilus influenzae Rd
auuaaucugcaccuuaaaggcu

SEQ ID NO: 700482 - RNA, 13 nt, Haemophilus influenzae Rd
auuaaucugcauu

SEQ ID NO: 700483 - RNA, 19 nt, Haemophilus influenzae Rd
auuaaugacaccuuuaaaa

SEQ ID NO: 700484 - RNA, 21 nt, Haemophilus influenzae Rd
auuaaugcagccaucaauaaa

SEQ ID NO: 700485 - RNA, 22 nt, Haemophilus influenzae Rd
auuaaugcagccaucaauaaaa

SEQ ID NO: 700486 - RNA, 23 nt, Haemophilus influenzae Rd
auuaaugcagccaucaauaaaaa

SEQ ID NO: 700487 - RNA, 15 nt, Haemophilus influenzae Rd
auuaaucauaaaaau

SEQ ID NO: 700488 - RNA, 14 nt, Haemophilus influenzae Rd
auuaaucauuucaa

SEQ ID NO: 700489 - RNA, 15 nt, Haemophilus influenzae Rd
auuaauccaucauuu

SEQ ID NO: 700490 - RNA, 23 nt, Haemophilus influenzae Rd
auuaauccaucauuuuucgcaaa

SEQ ID NO: 700491 - RNA, 16 nt, Haemophilus influenzae Rd
auuaaucgcaauaaca

SEQ ID NO: 700492 - RNA, 23 nt, Haemophilus influenzae Rd
auuacaaaauccacacuuuaaaa

SEQ ID NO: 700493 - RNA, 13 nt, Haemophilus influenzae Rd
auuacaaacaaaa

SEQ ID NO: 700494 - RNA, 11 nt, Haemophilus influenzae Rd
auuaauuuuuu

SEQ ID NO: 700495 - RNA, 14 nt, Haemophilus influenzae Rd
auuacaagcauuaa

SEQ ID NO: 700496 - RNA, 19 nt, Haemophilus influenzae Rd
auuaccacccaaaauuuca

SEQ ID NO: 700497 - RNA, 23 nt, Haemophilus influenzae Rd
auuaccacccaaaauuucagcua

SEQ ID NO: 700498 - RNA, 17 nt, Haemophilus influenzae Rd
auuaccacguucauuuc

SEQ ID NO: 700499 - RNA, 20 nt, Haemophilus influenzae Rd
auuaccacugcauuuucucg

SEQ ID NO: 700500 - RNA, 18 nt, Haemophilus influenzae Rd
auuaccaauuccaaagcu

SEQ ID NO: 700501 - RNA, 20 nt, Haemophilus influenzae Rd
auuaccacaugcauuuuucu

SEQ ID NO: 700502 - RNA, 21 nt, Haemophilus influenzae Rd
auuaccacuugccaaacauua

SEQ ID NO: 700503 - RNA, 15 nt, Haemophilus influenzae Rd
auuacagaaucauuu

SEQ ID NO: 700504 - RNA, 12 nt, Haemophilus influenzae Rd
auuaauguaauc

SEQ ID NO: 700505 - RNA, 14 nt, Haemophilus influenzae Rd
auuaaugucgcauu

SEQ ID NO: 700506 - RNA, 19 nt, Haemophilus influenzae Rd
auuaaugggaucaagauac

SEQ ID NO: 700507 - RNA, 16 nt, Haemophilus influenzae Rd
auuaaugguauuguga

SEQ ID NO: 700508 - RNA, 23 nt, Haemophilus influenzae Rd
auuaaugguauugugauuacucu

SEQ ID NO: 700509 - RNA, 15 nt, Haemophilus influenzae Rd
auuaaugcuaaacca

SEQ ID NO: 700510 - RNA, 15 nt, Haemophilus influenzae Rd
auuaauuauaaaaua

SEQ ID NO: 700511 - RNA, 12 nt, Haemophilus influenzae Rd
auuaauuauuuu

SEQ ID NO: 700512 - RNA, 22 nt, Haemophilus influenzae Rd
auuaauuaaaagugcgguuaaa

SEQ ID NO: 700513 - RNA, 17 nt, Haemophilus influenzae Rd
auuaauuaccugccaaa

SEQ ID NO: 700514 - RNA, 13 nt, Haemophilus influenzae Rd
auuaauuacuuuu

SEQ ID NO: 700515 - RNA, 20 nt, Haemophilus influenzae Rd
auuaauuugggugguuuuug

SEQ ID NO: 700516 - RNA, 21 nt, Haemophilus influenzae Rd
auuaauuuuaaauugagauaa

SEQ ID NO: 700517 - RNA, 17 nt, Haemophilus influenzae Rd
auuaauuuaauucuaaa

SEQ ID NO: 700518 - RNA, 14 nt, Haemophilus influenzae Rd
auuaauuauauuuu

SEQ ID NO: 700519 - RNA, 16 nt, Haemophilus influenzae Rd
auuaauucucccucaa

SEQ ID NO: 700520 - RNA, 22 nt, Haemophilus influenzae Rd
auuaauucucccucaacccaua

SEQ ID NO: 700521 - RNA, 16 nt, Haemophilus influenzae Rd
auuaauucuuuugcua

SEQ ID NO: 700522 - RNA, 21 nt, Haemophilus influenzae Rd
auuaauugauggaauuuauac

SEQ ID NO: 700523 - RNA, 21 nt, Haemophilus influenzae Rd
auuaauugcuaccauuuaucu

SEQ ID NO: 700524 - RNA, 22 nt, Haemophilus influenzae Rd
auuaauugcucugacacuucuc

SEQ ID NO: 700525 - RNA, 18 nt, Haemophilus influenzae Rd
auuaauuggcgaaggcaa

SEQ ID NO: 700526 - RNA, 22 nt, Haemophilus influenzae Rd
auuaauuggcgcaacaucaaac

SEQ ID NO: 700527 - RNA, 23 nt, Haemophilus influenzae Rd
auguccauuuuuaguaauuggca

SEQ ID NO: 700528 - RNA, 22 nt, Haemophilus influenzae Rd
auguccauaacugucaaaauua

SEQ ID NO: 700529 - RNA, 13 nt, Haemophilus influenzae Rd
auguucagccacu

SEQ ID NO: 700530 - RNA, 16 nt, Haemophilus influenzae Rd
auguucacguguuaaa

SEQ ID NO: 700531 - RNA, 22 nt, Haemophilus influenzae Rd
auguucaacaaguaaaucaaca

SEQ ID NO: 700532 - RNA, 14 nt, Haemophilus influenzae Rd
auguuguaaaaucu

SEQ ID NO: 700533 - RNA, 16 nt, Haemophilus influenzae Rd
auguuguccaucaauc

SEQ ID NO: 700534 - RNA, 22 nt, Haemophilus influenzae Rd
auguuguccaucaaucauaaaa

SEQ ID NO: 700535 - RNA, 17 nt, Haemophilus influenzae Rd
auguuggaaauuuaagu

SEQ ID NO: 700536 - RNA, 19 nt, Haemophilus influenzae Rd
auguuuaaaguaagaauua

SEQ ID NO: 700537 - RNA, 20 nt, Haemophilus influenzae Rd
auguuuaaaguaagaauuag

SEQ ID NO: 700538 - RNA, 14 nt, Haemophilus influenzae Rd
auguuuaauccaaa

SEQ ID NO: 700539 - RNA, 15 nt, Haemophilus influenzae Rd
auguuuaauuauaga

SEQ ID NO: 700540 - RNA, 17 nt, Haemophilus influenzae Rd
auguuuaauuauagaaa

SEQ ID NO: 700541 - RNA, 23 nt, Haemophilus influenzae Rd
auguuuaauuauagaaaagacaa

SEQ ID NO: 700542 - RNA, 22 nt, Haemophilus influenzae Rd
auguuuaccaccgauaaacacu

SEQ ID NO: 700543 - RNA, 20 nt, Haemophilus influenzae Rd
auguuuaccgcaaaauuauu

SEQ ID NO: 700544 - RNA, 16 nt, Haemophilus influenzae Rd
auguuucacuuugccc

SEQ ID NO: 700545 - RNA, 13 nt, Haemophilus influenzae Rd
auuaaacagccaa

SEQ ID NO: 700546 - RNA, 14 nt, Haemophilus influenzae Rd
auuaaacagccaaa

SEQ ID NO: 700547 - RNA, 22 nt, Haemophilus influenzae Rd
auuaaacagccaaacaaauuag

SEQ ID NO: 700548 - RNA, 17 nt, Haemophilus influenzae Rd
auuaaacaaaaaccauc

SEQ ID NO: 700549 - RNA, 18 nt, Haemophilus influenzae Rd
auuaaaauuccuuauuuu

SEQ ID NO: 700550 - RNA, 22 nt, Haemophilus influenzae Rd
auuaaaaggacuaaguucggua

SEQ ID NO: 700551 - RNA, 22 nt, Haemophilus influenzae Rd
auuaaaaguccgcugcucuacc

SEQ ID NO: 700552 - RNA, 19 nt, Haemophilus influenzae Rd
auuaaaagucuguuuaaaa

SEQ ID NO: 700553 - RNA, 12 nt, Haemophilus influenzae Rd
auuaaaagugcg

SEQ ID NO: 700554 - RNA, 15 nt, Haemophilus influenzae Rd
auguuuugauaaccu

SEQ ID NO: 700555 - RNA, 19 nt, Haemophilus influenzae Rd
auguuuuugaaguaaaaaa

SEQ ID NO: 700556 - RNA, 20 nt, Haemophilus influenzae Rd
auguuugaaaauucuucuaa

SEQ ID NO: 700557 - RNA, 17 nt, Haemophilus influenzae Rd
auuaaaaaaagcaauau

SEQ ID NO: 700558 - RNA, 15 nt, Haemophilus influenzae Rd
auuaaaaaaauaguu

SEQ ID NO: 700559 - RNA, 17 nt, Haemophilus influenzae Rd
auuaaaaaaaucuuuau

SEQ ID NO: 700560 - RNA, 15 nt, Haemophilus influenzae Rd
auuaaaaaagcaaga

SEQ ID NO: 700561 - RNA, 16 nt, Haemophilus influenzae Rd
auuaaaaaagcaagau

SEQ ID NO: 700562 - RNA, 20 nt, Haemophilus influenzae Rd
auuaaaaaaucaucaauuug

SEQ ID NO: 700563 - RNA, 21 nt, Haemophilus influenzae Rd
auuaaagggcugcuacaauuu

SEQ ID NO: 700564 - RNA, 21 nt, Haemophilus influenzae Rd
auuaaacuggaugaaaucauu

SEQ ID NO: 700565 - RNA, 10 nt, Haemophilus influenzae Rd
auuaaacuga

SEQ ID NO: 700566 - RNA, 14 nt, Haemophilus influenzae Rd
auuaaagucccaaa

SEQ ID NO: 700567 - RNA, 18 nt, Haemophilus influenzae Rd
auuaaagucccaaaagca

SEQ ID NO: 700568 - RNA, 12 nt, Haemophilus influenzae Rd
auuaaagucaga

SEQ ID NO: 700569 - RNA, 19 nt, Haemophilus influenzae Rd
auuaaagugcgguaaauuu

SEQ ID NO: 700570 - RNA, 23 nt, Haemophilus influenzae Rd
auuaaagugcgguaaauuuuuuu

SEQ ID NO: 700571 - RNA, 19 nt, Haemophilus influenzae Rd
auuaaacgugauuuaccaa

SEQ ID NO: 700572 - RNA, 14 nt, Haemophilus influenzae Rd
auuaaaucacccgc

SEQ ID NO: 700573 - RNA, 12 nt, Haemophilus influenzae Rd
auuaaauaacuc

SEQ ID NO: 700574 - RNA, 21 nt, Haemophilus influenzae Rd
auuaaauauaggguaaauaaa

SEQ ID NO: 700575 - RNA, 22 nt, Haemophilus influenzae Rd
auuaaauauaggguaaauaaaa

SEQ ID NO: 700576 - RNA, 16 nt, Haemophilus influenzae Rd
auuaaauaaaaaugau

SEQ ID NO: 700577 - RNA, 14 nt, Haemophilus influenzae Rd
auuaaauugaaaaa

SEQ ID NO: 700578 - RNA, 16 nt, Haemophilus influenzae Rd
auuaaauaugauaaau

SEQ ID NO: 700579 - RNA, 20 nt, Haemophilus influenzae Rd
augaaaguaacaauguagaa

SEQ ID NO: 700580 - RNA, 15 nt, Haemophilus influenzae Rd
augaaaucauuacac

SEQ ID NO: 700581 - RNA, 17 nt, Haemophilus influenzae Rd
augaaauauuuuuauuu

SEQ ID NO: 700582 - RNA, 13 nt, Haemophilus influenzae Rd
augaaaucaaaau

SEQ ID NO: 700583 - RNA, 15 nt, Haemophilus influenzae Rd
augaaaucaaacaac

SEQ ID NO: 700584 - RNA, 19 nt, Haemophilus influenzae Rd
augaaaugcccguuacuuu

SEQ ID NO: 700585 - RNA, 14 nt, Haemophilus influenzae Rd
augaaauucaguga

SEQ ID NO: 700586 - RNA, 19 nt, Haemophilus influenzae Rd
augaaauucagugauuaag

SEQ ID NO: 700587 - RNA, 18 nt, Haemophilus influenzae Rd
aucuuuuaaauaaccaua

SEQ ID NO: 700588 - RNA, 13 nt, Haemophilus influenzae Rd
augaaaaauaauc

SEQ ID NO: 700589 - RNA, 24 nt, Haemophilus influenzae Rd
augaaaacagcggucaaaauagac

SEQ ID NO: 700590 - RNA, 16 nt, Haemophilus influenzae Rd
augaaaaauggguuaa

SEQ ID NO: 700591 - RNA, 14 nt, Haemophilus influenzae Rd
aucuucggauuuuu

SEQ ID NO: 700592 - RNA, 16 nt, Haemophilus influenzae Rd
aucuucggauuuuuca

SEQ ID NO: 700593 - RNA, 14 nt, Haemophilus influenzae Rd
aucuucuaaaagag

SEQ ID NO: 700594 - RNA, 15 nt, Haemophilus influenzae Rd
aucuucuaaaagagu

SEQ ID NO: 700595 - RNA, 15 nt, Haemophilus influenzae Rd
aucuucgucaucauc

SEQ ID NO: 700596 - RNA, 19 nt, Haemophilus influenzae Rd
aucuuuauuugucagauuu

SEQ ID NO: 700597 - RNA, 20 nt, Haemophilus influenzae Rd
aucuuuauuugucagauuua

SEQ ID NO: 700598 - RNA, 18 nt, Haemophilus influenzae Rd
augaacgaguaaauuaau

SEQ ID NO: 700599 - RNA, 21 nt, Haemophilus influenzae Rd
augaacgccgcaacuaauaaa

SEQ ID NO: 700600 - RNA, 14 nt, Haemophilus influenzae Rd
augaaccaaaucua

SEQ ID NO: 700601 - RNA, 17 nt, Haemophilus influenzae Rd
augaacaaaaaauuaac

SEQ ID NO: 700602 - RNA, 18 nt, Haemophilus influenzae Rd
augaaauugcuguaaugu

SEQ ID NO: 700603 - RNA, 22 nt, Haemophilus influenzae Rd
augaaauugcuguaaugugcua

SEQ ID NO: 700604 - RNA, 22 nt, Haemophilus influenzae Rd
augaaauuucuugcucuaauuu

SEQ ID NO: 700605 - RNA, 21 nt, Haemophilus influenzae Rd
augaaauuucuuuaauugauu

SEQ ID NO: 700606 - RNA, 22 nt, Haemophilus influenzae Rd
augacaaaagugcgguuaauuu

SEQ ID NO: 700607 - RNA, 20 nt, Haemophilus influenzae Rd
augaauuucuaauuuuuguu

SEQ ID NO: 700608 - RNA, 20 nt, Haemophilus influenzae Rd
augaaucguuuuuuccaguu

SEQ ID NO: 700609 - RNA, 22 nt, Haemophilus influenzae Rd
augaaucgaacacuguaaauaa

SEQ ID NO: 700610 - RNA, 17 nt, Haemophilus influenzae Rd
augacuaauuaauuacc

SEQ ID NO: 700611 - RNA, 22 nt, Haemophilus influenzae Rd
augacuggcuugugaaauaaaa

SEQ ID NO: 700612 - RNA, 19 nt, Haemophilus influenzae Rd
augacuggcaaaaauguca

SEQ ID NO: 700613 - RNA, 20 nt, Haemophilus influenzae Rd
augacuuagggcucaaaucu

SEQ ID NO: 700614 - RNA, 23 nt, Haemophilus influenzae Rd
augacuuagggcucaaaucuacu

SEQ ID NO: 700615 - RNA, 14 nt, Haemophilus influenzae Rd
augacauaucaauu

SEQ ID NO: 700616 - RNA, 22 nt, Haemophilus influenzae Rd
augacauaucaauuugccauuu

SEQ ID NO: 700617 - RNA, 20 nt, Haemophilus influenzae Rd
augacagucgauuacaaaaa

SEQ ID NO: 700618 - RNA, 19 nt, Haemophilus influenzae Rd
augacauuaaagcaauugc

SEQ ID NO: 700619 - RNA, 19 nt, Haemophilus influenzae Rd
augacgugcuaauucugcu

SEQ ID NO: 700620 - RNA, 16 nt, Haemophilus influenzae Rd
augacuaaacaaauaa

SEQ ID NO: 700621 - RNA, 21 nt, Haemophilus influenzae Rd
augaggcguuuuucuuaaauu

SEQ ID NO: 700622 - RNA, 15 nt, Haemophilus influenzae Rd
augagguauuucuau

SEQ ID NO: 700623 - RNA, 20 nt, Haemophilus influenzae Rd
augaguaaaccgauuaauuc

SEQ ID NO: 700624 - RNA, 14 nt, Haemophilus influenzae Rd
augagucgccugcu

SEQ ID NO: 700625 - RNA, 16 nt, Haemophilus influenzae Rd
augagucgccugcucu

SEQ ID NO: 700626 - RNA, 18 nt, Haemophilus influenzae Rd
augagcuucaaaaucacc

SEQ ID NO: 700627 - RNA, 13 nt, Haemophilus influenzae Rd
augacuuucacua

SEQ ID NO: 700628 - RNA, 18 nt, Haemophilus influenzae Rd
augaucaaaucaaauuuu

SEQ ID NO: 700629 - RNA, 21 nt, Haemophilus influenzae Rd
augaucaaggguacaacaaau

SEQ ID NO: 700630 - RNA, 15 nt, Haemophilus influenzae Rd
augaucgaccauugc

SEQ ID NO: 700631 - RNA, 16 nt, Haemophilus influenzae Rd
augaucgaguaaaaau

SEQ ID NO: 700632 - RNA, 15 nt, Haemophilus influenzae Rd
augauccaaaaauau

SEQ ID NO: 700633 - RNA, 16 nt, Haemophilus influenzae Rd
augaucauaagauaag

SEQ ID NO: 700634 - RNA, 14 nt, Haemophilus influenzae Rd
augauaaucuuccc

SEQ ID NO: 700635 - RNA, 22 nt, Haemophilus influenzae Rd
augauaaguuuugucugaaauu

SEQ ID NO: 700636 - RNA, 13 nt, Haemophilus influenzae Rd
augauaauuuuua

SEQ ID NO: 700637 - RNA, 15 nt, Haemophilus influenzae Rd
augaguucauuuuca

SEQ ID NO: 700638 - RNA, 14 nt, Haemophilus influenzae Rd
augauaaaaauaaa

SEQ ID NO: 700639 - RNA, 15 nt, Haemophilus influenzae Rd
augauaaaaauaaaa

SEQ ID NO: 700640 - RNA, 14 nt, Haemophilus influenzae Rd
augauaaaugcaau

SEQ ID NO: 700641 - RNA, 15 nt, Haemophilus influenzae Rd
augauaaaugcaaua

SEQ ID NO: 700642 - RNA, 21 nt, Haemophilus influenzae Rd
augauaaauuuuauuccacca

SEQ ID NO: 700643 - RNA, 21 nt, Haemophilus influenzae Rd
aucucauaaaguauacuuuuc

SEQ ID NO: 700644 - RNA, 16 nt, Haemophilus influenzae Rd
aucucacguacuuuua

SEQ ID NO: 700645 - RNA, 22 nt, Haemophilus influenzae Rd
aucucacguacuuuuaacacuu

SEQ ID NO: 700646 - RNA, 19 nt, Haemophilus influenzae Rd
aucuaucccaacagaaaau

SEQ ID NO: 700647 - RNA, 23 nt, Haemophilus influenzae Rd
aucuaucccaacagaaaauuuga

SEQ ID NO: 700648 - RNA, 15 nt, Haemophilus influenzae Rd
aucuauccaacucau

SEQ ID NO: 700649 - RNA, 20 nt, Haemophilus influenzae Rd
aucuauauuugaguuauuuu

SEQ ID NO: 700650 - RNA, 14 nt, Haemophilus influenzae Rd
aucuagcuuaacaa

SEQ ID NO: 700651 - RNA, 15 nt, Haemophilus influenzae Rd
aucuagcacaaagac

SEQ ID NO: 700652 - RNA, 17 nt, Haemophilus influenzae Rd
aucuauaaaaagaacua

SEQ ID NO: 700653 - RNA, 15 nt, Haemophilus influenzae Rd
aucgucaaaaucauu

SEQ ID NO: 700654 - RNA, 15 nt, Haemophilus influenzae Rd
aucgucaaauagcua

SEQ ID NO: 700655 - RNA, 15 nt, Haemophilus influenzae Rd
aucguaucaauuuua

SEQ ID NO: 700656 - RNA, 16 nt, Haemophilus influenzae Rd
aucguaucaauuuuau

SEQ ID NO: 700657 - RNA, 20 nt, Haemophilus influenzae Rd
aucguauucccaaauuuuuu

SEQ ID NO: 700658 - RNA, 22 nt, Haemophilus influenzae Rd
aucuacacggagauauuguaau

SEQ ID NO: 700659 - RNA, 20 nt, Haemophilus influenzae Rd
aucuaauuugccaaguacaa

SEQ ID NO: 700660 - RNA, 20 nt, Haemophilus influenzae Rd
aucuacaccgaauaauacug

SEQ ID NO: 700661 - RNA, 16 nt, Haemophilus influenzae Rd
aucuacaaucaaaaaa

SEQ ID NO: 700662 - RNA, 17 nt, Haemophilus influenzae Rd
aucucuuuacuguucaa

SEQ ID NO: 700663 - RNA, 20 nt, Haemophilus influenzae Rd
aucucuuuacuguucaaaua

SEQ ID NO: 700664 - RNA, 16 nt, Haemophilus influenzae Rd
aucucuuguuuuucca

SEQ ID NO: 700665 - RNA, 16 nt, Haemophilus influenzae Rd
aucucuuucuuaaaau

SEQ ID NO: 700666 - RNA, 19 nt, Haemophilus influenzae Rd
aucucuuucuuaaaauacc

SEQ ID NO: 700667 - RNA, 17 nt, Haemophilus influenzae Rd
aucuccaagaauauuuc

SEQ ID NO: 700668 - RNA, 21 nt, Haemophilus influenzae Rd
aucucauccacuaaaccauuu

SEQ ID NO: 700669 - RNA, 17 nt, Haemophilus influenzae Rd
aucugaacguaagauca

SEQ ID NO: 700670 - RNA, 18 nt, Haemophilus influenzae Rd
aucugaacguaagaucag

SEQ ID NO: 700671 - RNA, 15 nt, Haemophilus influenzae Rd
aucugccugauuuuu

SEQ ID NO: 700672 - RNA, 23 nt, Haemophilus influenzae Rd
aucuggcucaauguuaaguucau

SEQ ID NO: 700673 - RNA, 12 nt, Haemophilus influenzae Rd
aucuuaaaaaag

SEQ ID NO: 700674 - RNA, 14 nt, Haemophilus influenzae Rd
aucuuaaagaauuu

SEQ ID NO: 700675 - RNA, 17 nt, Haemophilus influenzae Rd
aucuuaaauuauagaua

SEQ ID NO: 700676 - RNA, 21 nt, Haemophilus influenzae Rd
aucugucacgagcuaaaaaau

SEQ ID NO: 700677 - RNA, 14 nt, Haemophilus influenzae Rd
aucugucauauaac

SEQ ID NO: 700678 - RNA, 21 nt, Haemophilus influenzae Rd
aucugucauauaaccacguaa

SEQ ID NO: 700679 - RNA, 18 nt, Haemophilus influenzae Rd
aucuuauacaacaaaaag

SEQ ID NO: 700680 - RNA, 15 nt, Haemophilus influenzae Rd
aucuuauauuuuuga

SEQ ID NO: 700681 - RNA, 16 nt, Haemophilus influenzae Rd
aucuuauauuuuugau

SEQ ID NO: 700682 - RNA, 16 nt, Haemophilus influenzae Rd
aucuuaucaaacacuu

SEQ ID NO: 700683 - RNA, 15 nt, Haemophilus influenzae Rd
aucuuauuucaauau

SEQ ID NO: 700684 - RNA, 15 nt, Haemophilus influenzae Rd
aucuucaaaaacaua

SEQ ID NO: 700685 - RNA, 14 nt, Haemophilus influenzae Rd
aucuuauuugauua

SEQ ID NO: 700686 - RNA, 21 nt, Haemophilus influenzae Rd
aucuucaaaauaguaaaaauu

SEQ ID NO: 700687 - RNA, 15 nt, Haemophilus influenzae Rd
aucuuaccuuuuucu

SEQ ID NO: 700688 - RNA, 23 nt, Haemophilus influenzae Rd
aucuuacgaagaauccacauuuu

SEQ ID NO: 700689 - RNA, 19 nt, Haemophilus influenzae Rd
aucuucaugauuuuccaaa

SEQ ID NO: 700690 - RNA, 19 nt, Haemophilus influenzae Rd
aucuucauuccauuuugca

SEQ ID NO: 700691 - RNA, 21 nt, Haemophilus influenzae Rd
aucuuccaauaauucuuuaau

SEQ ID NO: 700692 - RNA, 17 nt, Haemophilus influenzae Rd
aucuuccaauacaauca

SEQ ID NO: 700693 - RNA, 17 nt, Haemophilus influenzae Rd
aucuuccgcgucauuua

SEQ ID NO: 700694 - RNA, 22 nt, Haemophilus influenzae Rd
aucuucccagaaugguaaugca

SEQ ID NO: 700695 - RNA, 16 nt, Haemophilus influenzae Rd
aucuucacaaaacaac

SEQ ID NO: 700696 - RNA, 18 nt, Haemophilus influenzae Rd
aucuucaaucaucauuua

SEQ ID NO: 700697 - RNA, 17 nt, Haemophilus influenzae Rd
aucauuacgacgugcaa

SEQ ID NO: 700698 - RNA, 15 nt, Haemophilus influenzae Rd
aucauuaacuuacca

SEQ ID NO: 700699 - RNA, 15 nt, Haemophilus influenzae Rd
aucauuaauacacaa

SEQ ID NO: 700700 - RNA, 17 nt, Haemophilus influenzae Rd
aucauuaaucuuauaca

SEQ ID NO: 700701 - RNA, 12 nt, Haemophilus influenzae Rd
aaaacuacuugu

SEQ ID NO: 700702 - RNA, 20 nt, Haemophilus influenzae Rd
aucauuaaauaacucaagca

SEQ ID NO: 700703 - RNA, 19 nt, Haemophilus influenzae Rd
aucauuaaauauaaugaau

SEQ ID NO: 700704 - RNA, 21 nt, Haemophilus influenzae Rd
aucauuaaauauaaugaauua

SEQ ID NO: 700705 - RNA, 13 nt, Haemophilus influenzae Rd
aaaacuugcaaac

SEQ ID NO: 700706 - RNA, 16 nt, Haemophilus influenzae Rd
aaaacuugcaaaccaa

SEQ ID NO: 700707 - RNA, 22 nt, Haemophilus influenzae Rd
aucauuacuuagauauauuauu

SEQ ID NO: 700708 - RNA, 17 nt, Haemophilus influenzae Rd
aucauuacuuuuuuaag

SEQ ID NO: 700709 - RNA, 14 nt, Haemophilus influenzae Rd
aucauuagcaacuu

SEQ ID NO: 700710 - RNA, 23 nt, Haemophilus influenzae Rd
aaaacuuaucauuaaucuuauac

SEQ ID NO: 700711 - RNA, 18 nt, Haemophilus influenzae Rd
aaaacuugcuacacgaac

SEQ ID NO: 700712 - RNA, 19 nt, Haemophilus influenzae Rd
aaaacuuuuguucuugcuu

SEQ ID NO: 700713 - RNA, 13 nt, Haemophilus influenzae Rd
aaaagaaaacuua

SEQ ID NO: 700714 - RNA, 18 nt, Haemophilus influenzae Rd
aucauucaauauaaaaaa

SEQ ID NO: 700715 - RNA, 19 nt, Haemophilus influenzae Rd
aucauucaauauaaaaaau

SEQ ID NO: 700716 - RNA, 20 nt, Haemophilus influenzae Rd
aucauucaaugcaacaauac

SEQ ID NO: 700717 - RNA, 14 nt, Haemophilus influenzae Rd
aucauuaugaaaaa

SEQ ID NO: 700718 - RNA, 16 nt, Haemophilus influenzae Rd
aucauuaugaaaaaaa

SEQ ID NO: 700719 - RNA, 15 nt, Haemophilus influenzae Rd
aucauuauugccuuu

SEQ ID NO: 700720 - RNA, 14 nt, Haemophilus influenzae Rd
aaaagaaauaaaag

SEQ ID NO: 700721 - RNA, 23 nt, Haemophilus influenzae Rd
aaaagaaauaacgucauuaauuu

SEQ ID NO: 700722 - RNA, 11 nt, Haemophilus influenzae Rd
aaaagaaauau

SEQ ID NO: 700723 - RNA, 15 nt, Haemophilus influenzae Rd
aaaagaaaagaugaa

SEQ ID NO: 700724 - RNA, 14 nt, Haemophilus influenzae Rd
aucauuugaauuaa

SEQ ID NO: 700725 - RNA, 20 nt, Haemophilus influenzae Rd
aucauuuggaucuaaaaaau

SEQ ID NO: 700726 - RNA, 17 nt, Haemophilus influenzae Rd
aucauuuguaaguugua

SEQ ID NO: 700727 - RNA, 23 nt, Haemophilus influenzae Rd
aucauuuaacggggauuuuuuau

SEQ ID NO: 700728 - RNA, 18 nt, Haemophilus influenzae Rd
aucauuuauuaaaaguaa

SEQ ID NO: 700729 - RNA, 14 nt, Haemophilus influenzae Rd
auccaaaauuaaau

SEQ ID NO: 700730 - RNA, 15 nt, Haemophilus influenzae Rd
auccaaaauuaaauu

SEQ ID NO: 700731 - RNA, 22 nt, Haemophilus influenzae Rd
auccaaaauuaaauugaaaaaa

SEQ ID NO: 700732 - RNA, 14 nt, Haemophilus influenzae Rd
auccaaaauuacuu

SEQ ID NO: 700733 - RNA, 17 nt, Haemophilus influenzae Rd
auccaaaauuacuuuuc

SEQ ID NO: 700734 - RNA, 15 nt, Haemophilus influenzae Rd
auccaaaaauauaaa

SEQ ID NO: 700735 - RNA, 19 nt, Haemophilus influenzae Rd
aucauuuuuauuuaauggg

SEQ ID NO: 700736 - RNA, 13 nt, Haemophilus influenzae Rd
aucauuuuuugca

SEQ ID NO: 700737 - RNA, 15 nt, Haemophilus influenzae Rd
aucauuuuuugcaaa

SEQ ID NO: 700738 - RNA, 20 nt, Haemophilus influenzae Rd
aucauuuucaaguaacuuuc

SEQ ID NO: 700739 - RNA, 13 nt, Haemophilus influenzae Rd
aucauuuucacca

SEQ ID NO: 700740 - RNA, 13 nt, Haemophilus influenzae Rd
aucauuuuuuaac

SEQ ID NO: 700741 - RNA, 14 nt, Haemophilus influenzae Rd
auccaauguugcaa

SEQ ID NO: 700742 - RNA, 19 nt, Haemophilus influenzae Rd
auccaaugauccccauucu

SEQ ID NO: 700743 - RNA, 18 nt, Haemophilus influenzae Rd
auccaaguuuguuuuuua

SEQ ID NO: 700744 - RNA, 14 nt, Haemophilus influenzae Rd
auccaaguauaaaa

SEQ ID NO: 700745 - RNA, 13 nt, Haemophilus influenzae Rd
auccaaguauuuu

SEQ ID NO: 700746 - RNA, 22 nt, Haemophilus influenzae Rd
auccagcaugagcuucaaaauc

SEQ ID NO: 700747 - RNA, 18 nt, Haemophilus influenzae Rd
auccacuuuuucugccaa

SEQ ID NO: 700748 - RNA, 12 nt, Haemophilus influenzae Rd
auccacuuuuuu

SEQ ID NO: 700749 - RNA, 17 nt, Haemophilus influenzae Rd
auccacuuuuuucacga

SEQ ID NO: 700750 - RNA, 19 nt, Haemophilus influenzae Rd
auccagaaaauugcaccuu

SEQ ID NO: 700751 - RNA, 20 nt, Haemophilus influenzae Rd
auccagaaaauugcaccuuc

SEQ ID NO: 700752 - RNA, 16 nt, Haemophilus influenzae Rd
auccacuuacauuaug

SEQ ID NO: 700753 - RNA, 15 nt, Haemophilus influenzae Rd
auccacuuccguucc

SEQ ID NO: 700754 - RNA, 22 nt, Haemophilus influenzae Rd
auccacuucgggcgaaaccuuu

SEQ ID NO: 700755 - RNA, 15 nt, Haemophilus influenzae Rd
auccauuaauaacug

SEQ ID NO: 700756 - RNA, 17 nt, Haemophilus influenzae Rd
auccauuggauuaagaa

SEQ ID NO: 700757 - RNA, 17 nt, Haemophilus influenzae Rd
auccauuccugcaagaa

SEQ ID NO: 700758 - RNA, 14 nt, Haemophilus influenzae Rd
auccauuuuuaaau

SEQ ID NO: 700759 - RNA, 15 nt, Haemophilus influenzae Rd
aucccacuuguuuuu

SEQ ID NO: 700760 - RNA, 22 nt, Haemophilus influenzae Rd
auccauuucgucgcuuuucccu

SEQ ID NO: 700761 - RNA, 15 nt, Haemophilus influenzae Rd
aucccagucaaaaau

SEQ ID NO: 700762 - RNA, 16 nt, Haemophilus influenzae Rd
aucccauauacuugcc

SEQ ID NO: 700763 - RNA, 17 nt, Haemophilus influenzae Rd
auccccguuaaauuuau

SEQ ID NO: 700764 - RNA, 15 nt, Haemophilus influenzae Rd
auccgagagaaaguu

SEQ ID NO: 700765 - RNA, 21 nt, Haemophilus influenzae Rd
auccgcauugcccgcuucuuc

SEQ ID NO: 700766 - RNA, 15 nt, Haemophilus influenzae Rd
aucccucaaauacac

SEQ ID NO: 700767 - RNA, 14 nt, Haemophilus influenzae Rd
aucccuucuuuuau

SEQ ID NO: 700768 - RNA, 21 nt, Haemophilus influenzae Rd
aucccuucugcuccacaaaaa

SEQ ID NO: 700769 - RNA, 21 nt, Haemophilus influenzae Rd
aucccuuauguuaugaagccc

SEQ ID NO: 700770 - RNA, 17 nt, Haemophilus influenzae Rd
aucccugucuggcaagu

SEQ ID NO: 700771 - RNA, 20 nt, Haemophilus influenzae Rd
aucgcuuugagaaagaauau

SEQ ID NO: 700772 - RNA, 18 nt, Haemophilus influenzae Rd
aucgcuugcauuucuuca

SEQ ID NO: 700773 - RNA, 16 nt, Haemophilus influenzae Rd
aucgguaaguugugag

SEQ ID NO: 700774 - RNA, 20 nt, Haemophilus influenzae Rd
aucgguauaggggauuuuau

SEQ ID NO: 700775 - RNA, 12 nt, Haemophilus influenzae Rd
aucguaauuaaa

SEQ ID NO: 700776 - RNA, 14 nt, Haemophilus influenzae Rd
aucguaauuaaaau

SEQ ID NO: 700777 - RNA, 14 nt, Haemophilus influenzae Rd
aucguauaagcccc

SEQ ID NO: 700778 - RNA, 23 nt, Haemophilus influenzae Rd
aucguagguuuuuuuauaaacca

SEQ ID NO: 700779 - RNA, 16 nt, Haemophilus influenzae Rd
aucguagucuuucaau

SEQ ID NO: 700780 - RNA, 16 nt, Haemophilus influenzae Rd
aucgguuggauuuuaa

SEQ ID NO: 700781 - RNA, 17 nt, Haemophilus influenzae Rd
aucgguuguuuuuuaau

SEQ ID NO: 700782 - RNA, 19 nt, Haemophilus influenzae Rd
aucgguuaaaaguaagcaa

SEQ ID NO: 700783 - RNA, 20 nt, Haemophilus influenzae Rd
aucggcuuccauuaauacuu

SEQ ID NO: 700784 - RNA, 19 nt, Haemophilus influenzae Rd
aucgggauaacuuucaguu

SEQ ID NO: 700785 - RNA, 20 nt, Haemophilus influenzae Rd
aucggcgcaccaauuaucaa

SEQ ID NO: 700786 - RNA, 18 nt, Haemophilus influenzae Rd
auccugccuugcauucgg

SEQ ID NO: 700787 - RNA, 20 nt, Haemophilus influenzae Rd
auccugccaguagaaaauca

SEQ ID NO: 700788 - RNA, 20 nt, Haemophilus influenzae Rd
auccgcgagauacuauauuu

SEQ ID NO: 700789 - RNA, 16 nt, Haemophilus influenzae Rd
auccgcugcagcuuca

SEQ ID NO: 700790 - RNA, 19 nt, Haemophilus influenzae Rd
auccgcuuguuaauacacu

SEQ ID NO: 700791 - RNA, 19 nt, Haemophilus influenzae Rd
auccuucgccgccauuugg

SEQ ID NO: 700792 - RNA, 21 nt, Haemophilus influenzae Rd
auccuugaaucauuucaucua

SEQ ID NO: 700793 - RNA, 24 nt, Haemophilus influenzae Rd
auccugguauuuacaagucucuau

SEQ ID NO: 700794 - RNA, 14 nt, Haemophilus influenzae Rd
aucgaaauuaaaau

SEQ ID NO: 700795 - RNA, 23 nt, Haemophilus influenzae Rd
auccuugcucacgggcagaauga

SEQ ID NO: 700796 - RNA, 23 nt, Haemophilus influenzae Rd
auccuuuaccaaccgguaaaauu

SEQ ID NO: 700797 - RNA, 12 nt, Haemophilus influenzae Rd
aucgaagaaaua

SEQ ID NO: 700798 - RNA, 23 nt, Haemophilus influenzae Rd
aucgaacuuagucucuuuauuuu

SEQ ID NO: 700799 - RNA, 17 nt, Haemophilus influenzae Rd
aucgaauaauccuucuu

SEQ ID NO: 700800 - RNA, 18 nt, Haemophilus influenzae Rd
aucgaccauugcacgccu

SEQ ID NO: 700801 - RNA, 18 nt, Haemophilus influenzae Rd
aucgccacguagauacau

SEQ ID NO: 700802 - RNA, 15 nt, Haemophilus influenzae Rd
aucgccacucacgau

SEQ ID NO: 700803 - RNA, 12 nt, Haemophilus influenzae Rd
aucgccaauaau

SEQ ID NO: 700804 - RNA, 15 nt, Haemophilus influenzae Rd
aucgccaaaaucauc

SEQ ID NO: 700805 - RNA, 22 nt, Haemophilus influenzae Rd
aucgcauuguuuuaucggauau

SEQ ID NO: 700806 - RNA, 13 nt, Haemophilus influenzae Rd
aucgcauuaucaa

SEQ ID NO: 700807 - RNA, 19 nt, Haemophilus influenzae Rd
auacuugcgauauugacca

SEQ ID NO: 700808 - RNA, 14 nt, Haemophilus influenzae Rd
auacuugcuuaugc

SEQ ID NO: 700809 - RNA, 14 nt, Haemophilus influenzae Rd
auacuugccacagg

SEQ ID NO: 700810 - RNA, 22 nt, Haemophilus influenzae Rd
auacuuggugcaauaaaaucau

SEQ ID NO: 700811 - RNA, 17 nt, Haemophilus influenzae Rd
auacuuuauaacuugcu

SEQ ID NO: 700812 - RNA, 22 nt, Haemophilus influenzae Rd
auacuugacaacgcucacuuaa

SEQ ID NO: 700813 - RNA, 18 nt, Haemophilus influenzae Rd
auacuucggggaucauuu

SEQ ID NO: 700814 - RNA, 21 nt, Haemophilus influenzae Rd
auacuucggggaucauuucau

SEQ ID NO: 700815 - RNA, 12 nt, Haemophilus influenzae Rd
auacuuaauuuc

SEQ ID NO: 700816 - RNA, 12 nt, Haemophilus influenzae Rd
auacuuaaucaa

SEQ ID NO: 700817 - RNA, 19 nt, Haemophilus influenzae Rd
auacugcuuucuagaugau

SEQ ID NO: 700818 - RNA, 22 nt, Haemophilus influenzae Rd
auacugcuuucuagaugaugaa

SEQ ID NO: 700819 - RNA, 17 nt, Haemophilus influenzae Rd
auacugcgacuuucccu

SEQ ID NO: 700820 - RNA, 15 nt, Haemophilus influenzae Rd
auacugccuuuaaag

SEQ ID NO: 700821 - RNA, 19 nt, Haemophilus influenzae Rd
auacugccuuuaaagaagu

SEQ ID NO: 700822 - RNA, 11 nt, Haemophilus influenzae Rd
auacuauauuu

SEQ ID NO: 700823 - RNA, 15 nt, Haemophilus influenzae Rd
auacuauauuuucuu

SEQ ID NO: 700824 - RNA, 20 nt, Haemophilus influenzae Rd
auacuauuacccacuucaca

SEQ ID NO: 700825 - RNA, 15 nt, Haemophilus influenzae Rd
auacugcacaaucaa

SEQ ID NO: 700826 - RNA, 14 nt, Haemophilus influenzae Rd
auacucuccccuug

SEQ ID NO: 700827 - RNA, 21 nt, Haemophilus influenzae Rd
auacucguucguuauuuugau

SEQ ID NO: 700828 - RNA, 20 nt, Haemophilus influenzae Rd
auacucaccgcacuuugugg

SEQ ID NO: 700829 - RNA, 18 nt, Haemophilus influenzae Rd
auacuccaacccagaaua

SEQ ID NO: 700830 - RNA, 12 nt, Haemophilus influenzae Rd
auaccgcccauu

SEQ ID NO: 700831 - RNA, 14 nt, Haemophilus influenzae Rd
auacagcucaaaau

SEQ ID NO: 700832 - RNA, 15 nt, Haemophilus influenzae Rd
auacgaguaaaaaau

SEQ ID NO: 700833 - RNA, 15 nt, Haemophilus influenzae Rd
auacgaauguuugau

SEQ ID NO: 700834 - RNA, 19 nt, Haemophilus influenzae Rd
auacgaaauagcguuuuuc

SEQ ID NO: 700835 - RNA, 18 nt, Haemophilus influenzae Rd
auacgauucguuucagua

SEQ ID NO: 700836 - RNA, 14 nt, Haemophilus influenzae Rd
auacgaucugcauc

SEQ ID NO: 700837 - RNA, 14 nt, Haemophilus influenzae Rd
auacgauauuugug

SEQ ID NO: 700838 - RNA, 14 nt, Haemophilus influenzae Rd
auacgauagguaaa

SEQ ID NO: 700839 - RNA, 19 nt, Haemophilus influenzae Rd
auacgcgcccauucauuuu

SEQ ID NO: 700840 - RNA, 16 nt, Haemophilus influenzae Rd
auagagucaauccagu

SEQ ID NO: 700841 - RNA, 14 nt, Haemophilus influenzae Rd
auagacuucaagug

SEQ ID NO: 700842 - RNA, 22 nt, Haemophilus influenzae Rd
auagacuucaagugauuauuuc

SEQ ID NO: 700843 - RNA, 16 nt, Haemophilus influenzae Rd
auacuuucagcuucca

SEQ ID NO: 700844 - RNA, 23 nt, Haemophilus influenzae Rd
auacuuucagcuuccauccacca

SEQ ID NO: 700845 - RNA, 14 nt, Haemophilus influenzae Rd
auacuuuuguaugu

SEQ ID NO: 700846 - RNA, 23 nt, Haemophilus influenzae Rd
auacuuuuguauguuggcgaauu

SEQ ID NO: 700847 - RNA, 12 nt, Haemophilus influenzae Rd
auagauguuaau

SEQ ID NO: 700848 - RNA, 16 nt, Haemophilus influenzae Rd
auagauuacguagaaa

SEQ ID NO: 700849 - RNA, 18 nt, Haemophilus influenzae Rd
auagauuacguagaaaac

SEQ ID NO: 700850 - RNA, 22 nt, Haemophilus influenzae Rd
auagauuauuagcauaauaaaa

SEQ ID NO: 700851 - RNA, 19 nt, Haemophilus influenzae Rd
auagauuuaagcuuauuuc

SEQ ID NO: 700852 - RNA, 15 nt, Haemophilus influenzae Rd
auagauuuaauaucu

SEQ ID NO: 700853 - RNA, 15 nt, Haemophilus influenzae Rd
auagauaaaauaaaa

SEQ ID NO: 700854 - RNA, 18 nt, Haemophilus influenzae Rd
auagauaaauaucaaaau

SEQ ID NO: 700855 - RNA, 14 nt, Haemophilus influenzae Rd
auagauaaaucaaa

SEQ ID NO: 700856 - RNA, 16 nt, Haemophilus influenzae Rd
auagauaugugaauaa

SEQ ID NO: 700857 - RNA, 15 nt, Haemophilus influenzae Rd
auagaugaaauuuau

SEQ ID NO: 700858 - RNA, 16 nt, Haemophilus influenzae Rd
auagaugaauuagaaa

SEQ ID NO: 700859 - RNA, 18 nt, Haemophilus influenzae Rd
auagcauuaaagucuaau

SEQ ID NO: 700860 - RNA, 17 nt, Haemophilus influenzae Rd
auagcaagaacaauuaa

SEQ ID NO: 700861 - RNA, 20 nt, Haemophilus influenzae Rd
auagcaacgcccuucuuuga

SEQ ID NO: 700862 - RNA, 15 nt, Haemophilus influenzae Rd
auagcgaucugcacu

SEQ ID NO: 700863 - RNA, 14 nt, Haemophilus influenzae Rd
auagcggucaucua

SEQ ID NO: 700864 - RNA, 15 nt, Haemophilus influenzae Rd
auagccuauaauuaa

SEQ ID NO: 700865 - RNA, 20 nt, Haemophilus influenzae Rd
auagccuauaauuaaaguua

SEQ ID NO: 700866 - RNA, 15 nt, Haemophilus influenzae Rd
auagccguccauuuc

SEQ ID NO: 700867 - RNA, 16 nt, Haemophilus influenzae Rd
auagccguccauuuca

SEQ ID NO: 700868 - RNA, 18 nt, Haemophilus influenzae Rd
auagccuaaauauuuaua

SEQ ID NO: 700869 - RNA, 23 nt, Haemophilus influenzae Rd
auagccucagguauuucuucaau

SEQ ID NO: 700870 - RNA, 16 nt, Haemophilus influenzae Rd
auagccaagugcuuua

SEQ ID NO: 700871 - RNA, 20 nt, Haemophilus influenzae Rd
auagccaacgucuuacuuuu

SEQ ID NO: 700872 - RNA, 20 nt, Haemophilus influenzae Rd
auagcucaguugguagagca

SEQ ID NO: 700873 - RNA, 20 nt, Haemophilus influenzae Rd
auagcucagucgguagagca

SEQ ID NO: 700874 - RNA, 17 nt, Haemophilus influenzae Rd
auagcugaaaaauaaaa

SEQ ID NO: 700875 - RNA, 18 nt, Haemophilus influenzae Rd
auagcuaacaaauuuaau

SEQ ID NO: 700876 - RNA, 14 nt, Haemophilus influenzae Rd
auagcuagaaagca

SEQ ID NO: 700877 - RNA, 22 nt, Haemophilus influenzae Rd
auagcuagaaagcaauguugca

SEQ ID NO: 700878 - RNA, 20 nt, Haemophilus influenzae Rd
auagugcccgcuacaaauaa

SEQ ID NO: 700879 - RNA, 11 nt, Haemophilus influenzae Rd
auauaaaauau

SEQ ID NO: 700880 - RNA, 13 nt, Haemophilus influenzae Rd
auauaaaauaaaa

SEQ ID NO: 700881 - RNA, 22 nt, Haemophilus influenzae Rd
auauaaaaaagcguugaguaaa

SEQ ID NO: 700882 - RNA, 22 nt, Haemophilus influenzae Rd
auauaaaagugcgguaaaaauu

SEQ ID NO: 700883 - RNA, 14 nt, Haemophilus influenzae Rd
auaguucacuaaaa

SEQ ID NO: 700884 - RNA, 21 nt, Haemophilus influenzae Rd
auaguugaugaaccauaaaca

SEQ ID NO: 700885 - RNA, 21 nt, Haemophilus influenzae Rd
auaguuggguaaucaaauuca

SEQ ID NO: 700886 - RNA, 12 nt, Haemophilus influenzae Rd
auaguuuaaacu

SEQ ID NO: 700887 - RNA, 21 nt, Haemophilus influenzae Rd
auaguuuaaacucagaauaua

SEQ ID NO: 700888 - RNA, 16 nt, Haemophilus influenzae Rd
auaguuuuauuuuaau

SEQ ID NO: 700889 - RNA, 21 nt, Haemophilus influenzae Rd
auaguuuuauuuuaauuuuau

SEQ ID NO: 700890 - RNA, 14 nt, Haemophilus influenzae Rd
auaguuuucacaau

SEQ ID NO: 700891 - RNA, 16 nt, Haemophilus influenzae Rd
auaguuuggcucuucu

SEQ ID NO: 700892 - RNA, 13 nt, Haemophilus influenzae Rd
auaguuuucugau

SEQ ID NO: 700893 - RNA, 20 nt, Haemophilus influenzae Rd
auauacuuccacaucgcugc

SEQ ID NO: 700894 - RNA, 16 nt, Haemophilus influenzae Rd
auauacuuuuuugaua

SEQ ID NO: 700895 - RNA, 16 nt, Haemophilus influenzae Rd
auauauccaaaugccu

SEQ ID NO: 700896 - RNA, 22 nt, Haemophilus influenzae Rd
auauauccaaaugccuaacaca

SEQ ID NO: 700897 - RNA, 14 nt, Haemophilus influenzae Rd
auauaugaaaaaua

SEQ ID NO: 700898 - RNA, 13 nt, Haemophilus influenzae Rd
auauaucagugcu

SEQ ID NO: 700899 - RNA, 16 nt, Haemophilus influenzae Rd
auauaucacagauuuu

SEQ ID NO: 700900 - RNA, 19 nt, Haemophilus influenzae Rd
auauaucacagauuuuuaa

SEQ ID NO: 700901 - RNA, 20 nt, Haemophilus influenzae Rd
auauaagcguucguuaucau

SEQ ID NO: 700902 - RNA, 19 nt, Haemophilus influenzae Rd
auauaauaaauauguugaa

SEQ ID NO: 700903 - RNA, 16 nt, Haemophilus influenzae Rd
auauaauaaauucaau

SEQ ID NO: 700904 - RNA, 14 nt, Haemophilus influenzae Rd
auauaaguuuguuu

SEQ ID NO: 700905 - RNA, 16 nt, Haemophilus influenzae Rd
auauaccauuugauuc

SEQ ID NO: 700906 - RNA, 13 nt, Haemophilus influenzae Rd
auauaccaauaau

SEQ ID NO: 700907 - RNA, 13 nt, Haemophilus influenzae Rd
auauaauuaucaa

SEQ ID NO: 700908 - RNA, 19 nt, Haemophilus influenzae Rd
auauaaugguggcguuuua

SEQ ID NO: 700909 - RNA, 15 nt, Haemophilus influenzae Rd
auauaaugaaaacag

SEQ ID NO: 700910 - RNA, 15 nt, Haemophilus influenzae Rd
auauaauauuuuggc

SEQ ID NO: 700911 - RNA, 21 nt, Haemophilus influenzae Rd
auaucaucaaccaaaauacaa

SEQ ID NO: 700912 - RNA, 23 nt, Haemophilus influenzae Rd
auaucaucaaccaaaauacaauc

SEQ ID NO: 700913 - RNA, 15 nt, Haemophilus influenzae Rd
auaucaucaagauuu

SEQ ID NO: 700914 - RNA, 19 nt, Haemophilus influenzae Rd
auaucaucaucagacauau

SEQ ID NO: 700915 - RNA, 13 nt, Haemophilus influenzae Rd
auauccauaaaca

SEQ ID NO: 700916 - RNA, 15 nt, Haemophilus influenzae Rd
auauccauugcaaca

SEQ ID NO: 700917 - RNA, 18 nt, Haemophilus influenzae Rd
auaucaaaaaguugaauu

SEQ ID NO: 700918 - RNA, 12 nt, Haemophilus influenzae Rd
auauauugguuu

SEQ ID NO: 700919 - RNA, 16 nt, Haemophilus influenzae Rd
auauauugguuugcuu

SEQ ID NO: 700920 - RNA, 14 nt, Haemophilus influenzae Rd
auauauucuugguu

SEQ ID NO: 700921 - RNA, 15 nt, Haemophilus influenzae Rd
auaucgcccauucua

SEQ ID NO: 700922 - RNA, 18 nt, Haemophilus influenzae Rd
auaucgcccgauuuuaaa

SEQ ID NO: 700923 - RNA, 20 nt, Haemophilus influenzae Rd
auaucgcccgauuuuaaacc

SEQ ID NO: 700924 - RNA, 18 nt, Haemophilus influenzae Rd
auaucgcccuuauuuugu

SEQ ID NO: 700925 - RNA, 17 nt, Haemophilus influenzae Rd
auaucgcaaucaauucu

SEQ ID NO: 700926 - RNA, 21 nt, Haemophilus influenzae Rd
auaucgccuuaucccauaccg

SEQ ID NO: 700927 - RNA, 22 nt, Haemophilus influenzae Rd
auaugacagauagcauaaguua

SEQ ID NO: 700928 - RNA, 21 nt, Haemophilus influenzae Rd
auaugaccauuaaucacacuu

SEQ ID NO: 700929 - RNA, 15 nt, Haemophilus influenzae Rd
auaucuuccacaaca

SEQ ID NO: 700930 - RNA, 14 nt, Haemophilus influenzae Rd
auaucuucuucuug

SEQ ID NO: 700931 - RNA, 17 nt, Haemophilus influenzae Rd
auaucuucuucuugcag

SEQ ID NO: 700932 - RNA, 14 nt, Haemophilus influenzae Rd
auaucuuguugaua

SEQ ID NO: 700933 - RNA, 14 nt, Haemophilus influenzae Rd
auaucuuguuuuac

SEQ ID NO: 700934 - RNA, 13 nt, Haemophilus influenzae Rd
auaucuuuaaauu

SEQ ID NO: 700935 - RNA, 19 nt, Haemophilus influenzae Rd
auaucuuuaaauucuacgu

SEQ ID NO: 700936 - RNA, 21 nt, Haemophilus influenzae Rd
auaucuggauguuguaaaaua

SEQ ID NO: 700937 - RNA, 11 nt, Haemophilus influenzae Rd
auaucucugcc

SEQ ID NO: 700938 - RNA, 13 nt, Haemophilus influenzae Rd
auaucugaaaaua

SEQ ID NO: 700939 - RNA, 14 nt, Haemophilus influenzae Rd
auaucguauguuaa

SEQ ID NO: 700940 - RNA, 14 nt, Haemophilus influenzae Rd
auaucucacaauaa

SEQ ID NO: 700941 - RNA, 18 nt, Haemophilus influenzae Rd
auaucuauaccuaucuua

SEQ ID NO: 700942 - RNA, 18 nt, Haemophilus influenzae Rd
auaucuauccaacucauu

SEQ ID NO: 700943 - RNA, 20 nt, Haemophilus influenzae Rd
auaucuauuggaauggcaaa

SEQ ID NO: 700944 - RNA, 21 nt, Haemophilus influenzae Rd
auaucuauuggaauggcaaaa

SEQ ID NO: 700945 - RNA, 13 nt, Haemophilus influenzae Rd
auauuuaaaauca

SEQ ID NO: 700946 - RNA, 14 nt, Haemophilus influenzae Rd
auauuucaguauuu

SEQ ID NO: 700947 - RNA, 11 nt, Haemophilus influenzae Rd
auauuucacua

SEQ ID NO: 700948 - RNA, 22 nt, Haemophilus influenzae Rd
auauuucacuucuaacuaaaaa

SEQ ID NO: 700949 - RNA, 15 nt, Haemophilus influenzae Rd
auauuuaaaaccaaa

SEQ ID NO: 700950 - RNA, 22 nt, Haemophilus influenzae Rd
auauuggucacgcuguaaacaa

SEQ ID NO: 700951 - RNA, 15 nt, Haemophilus influenzae Rd
auauugguagcuaaa

SEQ ID NO: 700952 - RNA, 14 nt, Haemophilus influenzae Rd
auauuggaaaccug

SEQ ID NO: 700953 - RNA, 15 nt, Haemophilus influenzae Rd
auauuggauuuacuu

SEQ ID NO: 700954 - RNA, 17 nt, Haemophilus influenzae Rd
auauuggcggauaugcu

SEQ ID NO: 700955 - RNA, 16 nt, Haemophilus influenzae Rd
auauugucuauuuuau

SEQ ID NO: 700956 - RNA, 22 nt, Haemophilus influenzae Rd
auauuguaaugucgugaaagaa

SEQ ID NO: 700957 - RNA, 17 nt, Haemophilus influenzae Rd
auauugugucacuagau

SEQ ID NO: 700958 - RNA, 12 nt, Haemophilus influenzae Rd
auauugugcaua

SEQ ID NO: 700959 - RNA, 14 nt, Haemophilus influenzae Rd
auauuguugcacau

SEQ ID NO: 700960 - RNA, 15 nt, Haemophilus influenzae Rd
auauuguugcacauu

SEQ ID NO: 700961 - RNA, 17 nt, Haemophilus influenzae Rd
auauuguugcacauuaa

SEQ ID NO: 700962 - RNA, 14 nt, Haemophilus influenzae Rd
auauuguuucaaca

SEQ ID NO: 700963 - RNA, 13 nt, Haemophilus influenzae Rd
auauuguuuuaau

SEQ ID NO: 700964 - RNA, 15 nt, Haemophilus influenzae Rd
auauuuuagcaagug

SEQ ID NO: 700965 - RNA, 15 nt, Haemophilus influenzae Rd
auauuuuaaugaaag

SEQ ID NO: 700966 - RNA, 19 nt, Haemophilus influenzae Rd
auauuuuaucaacuaaaaa

SEQ ID NO: 700967 - RNA, 24 nt, Haemophilus influenzae Rd
auauuuggauaacaaauugcuucu

SEQ ID NO: 700968 - RNA, 21 nt, Haemophilus influenzae Rd
auauuucgcccuuauacaaaa

SEQ ID NO: 700969 - RNA, 13 nt, Haemophilus influenzae Rd
auauuuccuucua

SEQ ID NO: 700970 - RNA, 15 nt, Haemophilus influenzae Rd
auauuuucccaguaa

SEQ ID NO: 700971 - RNA, 20 nt, Haemophilus influenzae Rd
auauuuuccuagcgcacaau

SEQ ID NO: 700972 - RNA, 14 nt, Haemophilus influenzae Rd
auauuuuccuugug

SEQ ID NO: 700973 - RNA, 13 nt, Haemophilus influenzae Rd
auauuuugaauaa

SEQ ID NO: 700974 - RNA, 11 nt, Haemophilus influenzae Rd
aucaaaaccau

SEQ ID NO: 700975 - RNA, 14 nt, Haemophilus influenzae Rd
aucaaaacuugcua

SEQ ID NO: 700976 - RNA, 13 nt, Haemophilus influenzae Rd
aucaaaagaauua

SEQ ID NO: 700977 - RNA, 20 nt, Haemophilus influenzae Rd
auauucauaaaaggcaaagc

SEQ ID NO: 700978 - RNA, 20 nt, Haemophilus influenzae Rd
auauucaccccuucuguugc

SEQ ID NO: 700979 - RNA, 13 nt, Haemophilus influenzae Rd
auauucauuuaaa

SEQ ID NO: 700980 - RNA, 14 nt, Haemophilus influenzae Rd
auauucauuuaaaa

SEQ ID NO: 700981 - RNA, 17 nt, Haemophilus influenzae Rd
auauucauuuaaaacaa

SEQ ID NO: 700982 - RNA, 18 nt, Haemophilus influenzae Rd
auauucauuuaaaacaaa

SEQ ID NO: 700983 - RNA, 19 nt, Haemophilus influenzae Rd
auauucauuuaaaacaaaa

SEQ ID NO: 700984 - RNA, 23 nt, Haemophilus influenzae Rd
auauucaugaaucguuuuuucca

SEQ ID NO: 700985 - RNA, 14 nt, Haemophilus influenzae Rd
auauuccaaaaaau

SEQ ID NO: 700986 - RNA, 15 nt, Haemophilus influenzae Rd
auauuccacaucacu

SEQ ID NO: 700987 - RNA, 22 nt, Haemophilus influenzae Rd
auauuccagccccucagauaau

SEQ ID NO: 700988 - RNA, 22 nt, Haemophilus influenzae Rd
auauuccauaguucacuaaaaa

SEQ ID NO: 700989 - RNA, 16 nt, Haemophilus influenzae Rd
auauuccauuaacuaa

SEQ ID NO: 700990 - RNA, 22 nt, Haemophilus influenzae Rd
auauuccauuaacuaaaccauu

SEQ ID NO: 700991 - RNA, 19 nt, Haemophilus influenzae Rd
auaugauuucuucaaagcu

SEQ ID NO: 700992 - RNA, 23 nt, Haemophilus influenzae Rd
auaugauuuagaacaauauuuau

SEQ ID NO: 700993 - RNA, 19 nt, Haemophilus influenzae Rd
auauucaauccuauuuuua

SEQ ID NO: 700994 - RNA, 14 nt, Haemophilus influenzae Rd
auauucaauuacua

SEQ ID NO: 700995 - RNA, 21 nt, Haemophilus influenzae Rd
auauugccuaauagaaaaaug

SEQ ID NO: 700996 - RNA, 18 nt, Haemophilus influenzae Rd
auauugcucucccuugcc

SEQ ID NO: 700997 - RNA, 12 nt, Haemophilus influenzae Rd
auauugcucaau

SEQ ID NO: 700998 - RNA, 15 nt, Haemophilus influenzae Rd
auauugcucaauuaa

SEQ ID NO: 700999 - RNA, 16 nt, Haemophilus influenzae Rd
auauugauuauguaaa

SEQ ID NO: 701000 - RNA, 16 nt, Haemophilus influenzae Rd
auauugcacaauagcu

SEQ ID NO: 701001 - RNA, 23 nt, Haemophilus influenzae Rd
auauugccauaauaaucacaaca

SEQ ID NO: 701002 - RNA, 22 nt, Haemophilus influenzae Rd
auauugaacaauguuuaaucca

SEQ ID NO: 701003 - RNA, 19 nt, Haemophilus influenzae Rd
auauugaacuugagaaagu

SEQ ID NO: 701004 - RNA, 13 nt, Haemophilus influenzae Rd
auauugaccauuu

SEQ ID NO: 701005 - RNA, 16 nt, Haemophilus influenzae Rd
auauugaccauuucau

SEQ ID NO: 701006 - RNA, 23 nt, Haemophilus influenzae Rd
auauugaccguuugaccauucau

SEQ ID NO: 701007 - RNA, 19 nt, Haemophilus influenzae Rd
auauugagggcuuuuuuau

SEQ ID NO: 701008 - RNA, 14 nt, Haemophilus influenzae Rd
aucaagaauuccau

SEQ ID NO: 701009 - RNA, 18 nt, Haemophilus influenzae Rd
aucaagaauuccauugca

SEQ ID NO: 701010 - RNA, 22 nt, Haemophilus influenzae Rd
aucaagaauuccauugcaucca

SEQ ID NO: 701011 - RNA, 12 nt, Haemophilus influenzae Rd
aucaagaaaguu

SEQ ID NO: 701012 - RNA, 16 nt, Haemophilus influenzae Rd
aucaagauaacugauu

SEQ ID NO: 701013 - RNA, 17 nt, Haemophilus influenzae Rd
aucaagauaccaauaau

SEQ ID NO: 701014 - RNA, 15 nt, Haemophilus influenzae Rd
aucaagauuuauucc

SEQ ID NO: 701015 - RNA, 22 nt, Haemophilus influenzae Rd
aucaagauuuauuccugcuuuu

SEQ ID NO: 701016 - RNA, 23 nt, Haemophilus influenzae Rd
aucaagauuuauuccugcuuuuu

SEQ ID NO: 701017 - RNA, 17 nt, Haemophilus influenzae Rd
aucaagcaaacuuagau

SEQ ID NO: 701018 - RNA, 15 nt, Haemophilus influenzae Rd
aucaagcacaaucag

SEQ ID NO: 701019 - RNA, 23 nt, Haemophilus influenzae Rd
aucaacuuuagucgcuuucaaca

SEQ ID NO: 701020 - RNA, 23 nt, Haemophilus influenzae Rd
aucaaccgcacuuuuauauuuau

SEQ ID NO: 701021 - RNA, 22 nt, Haemophilus influenzae Rd
aucaaacaguucaauaaaaaua

SEQ ID NO: 701022 - RNA, 22 nt, Haemophilus influenzae Rd
aucaaaauuuaagccuguuaug

SEQ ID NO: 701023 - RNA, 22 nt, Haemophilus influenzae Rd
aucaaaauuauguuuuaucuuu

SEQ ID NO: 701024 - RNA, 16 nt, Haemophilus influenzae Rd
aucaaaaucugcuagu

SEQ ID NO: 701025 - RNA, 13 nt, Haemophilus influenzae Rd
aucaaaaugaaaa

SEQ ID NO: 701026 - RNA, 18 nt, Haemophilus influenzae Rd
aucaaaaugaaaacuaug

SEQ ID NO: 701027 - RNA, 12 nt, Haemophilus influenzae Rd
aucaaaauuuaa

SEQ ID NO: 701028 - RNA, 15 nt, Haemophilus influenzae Rd
aucaacaauccauuu

SEQ ID NO: 701029 - RNA, 20 nt, Haemophilus influenzae Rd
aucaaaccugcuucauccac

SEQ ID NO: 701030 - RNA, 19 nt, Haemophilus influenzae Rd
aucaacaaaugucauugau

SEQ ID NO: 701031 - RNA, 16 nt, Haemophilus influenzae Rd
aucaaugcucucuuuu

SEQ ID NO: 701032 - RNA, 16 nt, Haemophilus influenzae Rd
aucaaucuuuaaaacu

SEQ ID NO: 701033 - RNA, 13 nt, Haemophilus influenzae Rd
aucaauauuuauu

SEQ ID NO: 701034 - RNA, 19 nt, Haemophilus influenzae Rd
aucaauacgccuaaaacaa

SEQ ID NO: 701035 - RNA, 21 nt, Haemophilus influenzae Rd
aucaauccagaacgaacaauu

SEQ ID NO: 701036 - RNA, 21 nt, Haemophilus influenzae Rd
aucaaucaggcuuucauuuuc

SEQ ID NO: 701037 - RNA, 13 nt, Haemophilus influenzae Rd
aucaaucauaaaa

SEQ ID NO: 701038 - RNA, 18 nt, Haemophilus influenzae Rd
aucaaucauaucaucaac

SEQ ID NO: 701039 - RNA, 20 nt, Haemophilus influenzae Rd
aucaaucaagaauuccauug

SEQ ID NO: 701040 - RNA, 20 nt, Haemophilus influenzae Rd
aucaagcugugcaaaacuag

SEQ ID NO: 701041 - RNA, 18 nt, Haemophilus influenzae Rd
aucaaggguacaacaaau

SEQ ID NO: 701042 - RNA, 23 nt, Haemophilus influenzae Rd
aucaaggcuuuguaaugcuuuua

SEQ ID NO: 701043 - RNA, 12 nt, Haemophilus influenzae Rd
aucaauaaaaag

SEQ ID NO: 701044 - RNA, 14 nt, Haemophilus influenzae Rd
aucaauaccaauug

SEQ ID NO: 701045 - RNA, 13 nt, Haemophilus influenzae Rd
aucaaguuaaaaa

SEQ ID NO: 701046 - RNA, 14 nt, Haemophilus influenzae Rd
aucaaguuaaaaaa

SEQ ID NO: 701047 - RNA, 13 nt, Haemophilus influenzae Rd
aucauaaaaaugc

SEQ ID NO: 701048 - RNA, 17 nt, Haemophilus influenzae Rd
aucauaaaaacaauacu

SEQ ID NO: 701049 - RNA, 17 nt, Haemophilus influenzae Rd
aucauauauucaacuaa

SEQ ID NO: 701050 - RNA, 20 nt, Haemophilus influenzae Rd
aucauaacgggcauuuuucu

SEQ ID NO: 701051 - RNA, 13 nt, Haemophilus influenzae Rd
aucauaagguaca

SEQ ID NO: 701052 - RNA, 18 nt, Haemophilus influenzae Rd
aucauaagguacaacaga

SEQ ID NO: 701053 - RNA, 16 nt, Haemophilus influenzae Rd
aucauaaguaaaacca

SEQ ID NO: 701054 - RNA, 11 nt, Haemophilus influenzae Rd
aucauaaguau

SEQ ID NO: 701055 - RNA, 23 nt, Haemophilus influenzae Rd
aucauaacuauaauuagaucaua

SEQ ID NO: 701056 - RNA, 18 nt, Haemophilus influenzae Rd
aucaggcgauccaucgcu

SEQ ID NO: 701057 - RNA, 14 nt, Haemophilus influenzae Rd
aucagcuuuuguug

SEQ ID NO: 701058 - RNA, 20 nt, Haemophilus influenzae Rd
aaaacgcacuucaaaugaag

SEQ ID NO: 701059 - RNA, 21 nt, Haemophilus influenzae Rd
aaaacgcaaugcaaaaguaaa

SEQ ID NO: 701060 - RNA, 18 nt, Haemophilus influenzae Rd
aaaacgaugaaguuuuca

SEQ ID NO: 701061 - RNA, 20 nt, Haemophilus influenzae Rd
aaaacgcgaugaaauuauca

SEQ ID NO: 701062 - RNA, 13 nt, Haemophilus influenzae Rd
aaaacgccauuca

SEQ ID NO: 701063 - RNA, 23 nt, Haemophilus influenzae Rd
aucaucagcuuaucaaucaagaa

SEQ ID NO: 701064 - RNA, 24 nt, Haemophilus influenzae Rd
aucaucacucggagcauuuuggua

SEQ ID NO: 701065 - RNA, 16 nt, Haemophilus influenzae Rd
aucaucaaccaaaaua

SEQ ID NO: 701066 - RNA, 22 nt, Haemophilus influenzae Rd
aucaucaaccaaaauacaauca

SEQ ID NO: 701067 - RNA, 14 nt, Haemophilus influenzae Rd
aucaucaaauugau

SEQ ID NO: 701068 - RNA, 13 nt, Haemophilus influenzae Rd
aucauaucaucaa

SEQ ID NO: 701069 - RNA, 19 nt, Haemophilus influenzae Rd
aucauaucaucaaccaaaa

SEQ ID NO: 701070 - RNA, 14 nt, Haemophilus influenzae Rd
aucauauugauuua

SEQ ID NO: 701071 - RNA, 15 nt, Haemophilus influenzae Rd
aucauaucuaacaua

SEQ ID NO: 701072 - RNA, 22 nt, Haemophilus influenzae Rd
aucauauuucugcaaauaaaga

SEQ ID NO: 701073 - RNA, 19 nt, Haemophilus influenzae Rd
aucaucccuguauaaagau

SEQ ID NO: 701074 - RNA, 21 nt, Haemophilus influenzae Rd
aucaucccuguauaaagauaa

SEQ ID NO: 701075 - RNA, 22 nt, Haemophilus influenzae Rd
aucaucccaaucuucgucauca

SEQ ID NO: 701076 - RNA, 18 nt, Haemophilus influenzae Rd
aucaucauuuuuugcuuc

SEQ ID NO: 701077 - RNA, 19 nt, Haemophilus influenzae Rd
aucaucauuuauuaaaagu

SEQ ID NO: 701078 - RNA, 20 nt, Haemophilus influenzae Rd
aucaucauuuauuaaaagua

SEQ ID NO: 701079 - RNA, 16 nt, Haemophilus influenzae Rd
aucaucgauaaauuca

SEQ ID NO: 701080 - RNA, 15 nt, Haemophilus influenzae Rd
aucaucgaaaucuaa

SEQ ID NO: 701081 - RNA, 21 nt, Haemophilus influenzae Rd
aucagcuguuuaucaauagaa

SEQ ID NO: 701082 - RNA, 22 nt, Haemophilus influenzae Rd
aucagagccucuuggauuuucu

SEQ ID NO: 701083 - RNA, 21 nt, Haemophilus influenzae Rd
aucagauuuaggcaauaaaaa

SEQ ID NO: 701084 - RNA, 19 nt, Haemophilus influenzae Rd
aucagauuauguucauuuu

SEQ ID NO: 701085 - RNA, 13 nt, Haemophilus influenzae Rd
aucagauuuuucg

SEQ ID NO: 701086 - RNA, 19 nt, Haemophilus influenzae Rd
aucagauuuuucgcauuuu

SEQ ID NO: 701087 - RNA, 22 nt, Haemophilus influenzae Rd
aucagauuuuucgcauuuuaac

SEQ ID NO: 701088 - RNA, 21 nt, Haemophilus influenzae Rd
aucagauuuuuuucagaaaug

SEQ ID NO: 701089 - RNA, 21 nt, Haemophilus influenzae Rd
aucagacaaucugugugggca

SEQ ID NO: 701090 - RNA, 22 nt, Haemophilus influenzae Rd
aucacuugugcgauuaacaaua

SEQ ID NO: 701091 - RNA, 22 nt, Haemophilus influenzae Rd
aucacuugugcuacguuugcac

SEQ ID NO: 701092 - RNA, 19 nt, Haemophilus influenzae Rd
aucacuuuuucagauacuu

SEQ ID NO: 701093 - RNA, 14 nt, Haemophilus influenzae Rd
aucacuuuuuuauu

SEQ ID NO: 701094 - RNA, 22 nt, Haemophilus influenzae Rd
aucacuuuguacaccaaaauaa

SEQ ID NO: 701095 - RNA, 15 nt, Haemophilus influenzae Rd
aucacuugaagucua

SEQ ID NO: 701096 - RNA, 17 nt, Haemophilus influenzae Rd
aucacuucgucuggcac

SEQ ID NO: 701097 - RNA, 13 nt, Haemophilus influenzae Rd
aucacguaaguaa

SEQ ID NO: 701098 - RNA, 15 nt, Haemophilus influenzae Rd
aucacguaauacaaa

SEQ ID NO: 701099 - RNA, 18 nt, Haemophilus influenzae Rd
aucacguaauacaaaaua

SEQ ID NO: 701100 - RNA, 18 nt, Haemophilus influenzae Rd
aucacgcguuucuaaaau

SEQ ID NO: 701101 - RNA, 23 nt, Haemophilus influenzae Rd
aucacggguuugguaagcaauag

SEQ ID NO: 701102 - RNA, 14 nt, Haemophilus influenzae Rd
aucacgccagauaa

SEQ ID NO: 701103 - RNA, 13 nt, Haemophilus influenzae Rd
aucacgauuuuuc

SEQ ID NO: 701104 - RNA, 14 nt, Haemophilus influenzae Rd
aucacgauuuuucu

SEQ ID NO: 701105 - RNA, 15 nt, Haemophilus influenzae Rd
aucacgauuuuucuc

SEQ ID NO: 701106 - RNA, 20 nt, Haemophilus influenzae Rd
aucacgaucugcaacaucac

SEQ ID NO: 701107 - RNA, 19 nt, Haemophilus influenzae Rd
aucaauuagaugacuggca

SEQ ID NO: 701108 - RNA, 16 nt, Haemophilus influenzae Rd
aucaauuauuucagcu

SEQ ID NO: 701109 - RNA, 22 nt, Haemophilus influenzae Rd
aucaauguuugugcguuuuuua

SEQ ID NO: 701110 - RNA, 21 nt, Haemophilus influenzae Rd
aucaauguuuucagcuucaau

SEQ ID NO: 701111 - RNA, 18 nt, Haemophilus influenzae Rd
aucaaugucguuauucau

SEQ ID NO: 701112 - RNA, 14 nt, Haemophilus influenzae Rd
auaaaauauucaaa

SEQ ID NO: 701113 - RNA, 13 nt, Haemophilus influenzae Rd
auaaaauauuuaa

SEQ ID NO: 701114 - RNA, 19 nt, Haemophilus influenzae Rd
auaaaauauuuaauuucau

SEQ ID NO: 701115 - RNA, 17 nt, Haemophilus influenzae Rd
auaaaauauuuggcuga

SEQ ID NO: 701116 - RNA, 21 nt, Haemophilus influenzae Rd
auaaaauauauuaauuauuuu

SEQ ID NO: 701117 - RNA, 15 nt, Haemophilus influenzae Rd
auaaaaucaauaaua

SEQ ID NO: 701118 - RNA, 22 nt, Haemophilus influenzae Rd
auaaaauagccuaaauauuuau

SEQ ID NO: 701119 - RNA, 19 nt, Haemophilus influenzae Rd
aguuuucauuaaagaagaa

SEQ ID NO: 701120 - RNA, 16 nt, Haemophilus influenzae Rd
aguuuucaccaacaaa

SEQ ID NO: 701121 - RNA, 14 nt, Haemophilus influenzae Rd
auaaaauaaaauuc

SEQ ID NO: 701122 - RNA, 12 nt, Haemophilus influenzae Rd
aguuuucauuuu

SEQ ID NO: 701123 - RNA, 22 nt, Haemophilus influenzae Rd
aguuuucauuuuuuggugcaua

SEQ ID NO: 701124 - RNA, 14 nt, Haemophilus influenzae Rd
aguuuucaucaaug

SEQ ID NO: 701125 - RNA, 19 nt, Haemophilus influenzae Rd
auaaaauaaacauuuuuca

SEQ ID NO: 701126 - RNA, 20 nt, Haemophilus influenzae Rd
aguuuuauaagcaaauuauu

SEQ ID NO: 701127 - RNA, 18 nt, Haemophilus influenzae Rd
aguuuuacugauucuucg

SEQ ID NO: 701128 - RNA, 19 nt, Haemophilus influenzae Rd
aguuuuauuugagaaaaau

SEQ ID NO: 701129 - RNA, 21 nt, Haemophilus influenzae Rd
aguuuuauuugagaaaaaugu

SEQ ID NO: 701130 - RNA, 16 nt, Haemophilus influenzae Rd
aguuuuauaguuuuua

SEQ ID NO: 701131 - RNA, 17 nt, Haemophilus influenzae Rd
aguuuuaugcugcaaaa

SEQ ID NO: 701132 - RNA, 21 nt, Haemophilus influenzae Rd
auaaaauugcuuuguuaauuc

SEQ ID NO: 701133 - RNA, 19 nt, Haemophilus influenzae Rd
auaaaauuaaucauaaaaa

SEQ ID NO: 701134 - RNA, 16 nt, Haemophilus influenzae Rd
auaaaauggcuaucau

SEQ ID NO: 701135 - RNA, 21 nt, Haemophilus influenzae Rd
auaaaauguuuauauuuccau

SEQ ID NO: 701136 - RNA, 19 nt, Haemophilus influenzae Rd
auaaaccaaugagaaaaag

SEQ ID NO: 701137 - RNA, 18 nt, Haemophilus influenzae Rd
auaaaccaauuuuacaaa

SEQ ID NO: 701138 - RNA, 15 nt, Haemophilus influenzae Rd
auaaacaauuccccu

SEQ ID NO: 701139 - RNA, 16 nt, Haemophilus influenzae Rd
auaaacaauuccccuu

SEQ ID NO: 701140 - RNA, 20 nt, Haemophilus influenzae Rd
auaaacaauuccccuuccuu

SEQ ID NO: 701141 - RNA, 21 nt, Haemophilus influenzae Rd
auaaacaaagaaucuuaaauu

SEQ ID NO: 701142 - RNA, 15 nt, Haemophilus influenzae Rd
auaaaauuuuuaaag

SEQ ID NO: 701143 - RNA, 18 nt, Haemophilus influenzae Rd
auaaaauuuuuaaaguua

SEQ ID NO: 701144 - RNA, 14 nt, Haemophilus influenzae Rd
auaaacccaaaaaa

SEQ ID NO: 701145 - RNA, 18 nt, Haemophilus influenzae Rd
auaaaccuaaagccaagg

SEQ ID NO: 701146 - RNA, 14 nt, Haemophilus influenzae Rd
auaaacgcaccaca

SEQ ID NO: 701147 - RNA, 19 nt, Haemophilus influenzae Rd
auaaaccgccaaaaauuaa

SEQ ID NO: 701148 - RNA, 17 nt, Haemophilus influenzae Rd
auaaacgagaaccaaaa

SEQ ID NO: 701149 - RNA, 21 nt, Haemophilus influenzae Rd
auaaacgauaugguaagaacg

SEQ ID NO: 701150 - RNA, 15 nt, Haemophilus influenzae Rd
auaaagcauaauauu

SEQ ID NO: 701151 - RNA, 22 nt, Haemophilus influenzae Rd
auaaagccuauucucacaucau

SEQ ID NO: 701152 - RNA, 19 nt, Haemophilus influenzae Rd
auaaagcgugagccaaugc

SEQ ID NO: 701153 - RNA, 16 nt, Haemophilus influenzae Rd
auaaagguuacucauu

SEQ ID NO: 701154 - RNA, 18 nt, Haemophilus influenzae Rd
auaaaguaguuuuaguaa

SEQ ID NO: 701155 - RNA, 14 nt, Haemophilus influenzae Rd
auaaaguauacuuu

SEQ ID NO: 701156 - RNA, 14 nt, Haemophilus influenzae Rd
auaaauaauaaagu

SEQ ID NO: 701157 - RNA, 12 nt, Haemophilus influenzae Rd
auaaauacacca

SEQ ID NO: 701158 - RNA, 18 nt, Haemophilus influenzae Rd
auaaaguccauaauauca

SEQ ID NO: 701159 - RNA, 14 nt, Haemophilus influenzae Rd
auaaaguaaaauau

SEQ ID NO: 701160 - RNA, 22 nt, Haemophilus influenzae Rd
auaaaguauucauauaauucau

SEQ ID NO: 701161 - RNA, 21 nt, Haemophilus influenzae Rd
auaaagucgguucauuugggg

SEQ ID NO: 701162 - RNA, 14 nt, Haemophilus influenzae Rd
auaaauaaacuauu

SEQ ID NO: 701163 - RNA, 21 nt, Haemophilus influenzae Rd
auaaauaacaucgcuaaaucu

SEQ ID NO: 701164 - RNA, 16 nt, Haemophilus influenzae Rd
auaaauaccgcuugca

SEQ ID NO: 701165 - RNA, 21 nt, Haemophilus influenzae Rd
auaaauagauacaagaaagaa

SEQ ID NO: 701166 - RNA, 14 nt, Haemophilus influenzae Rd
auaaauauguugaa

SEQ ID NO: 701167 - RNA, 16 nt, Haemophilus influenzae Rd
auaacacagaaaccaa

SEQ ID NO: 701168 - RNA, 17 nt, Haemophilus influenzae Rd
auaacacagaugaaaau

SEQ ID NO: 701169 - RNA, 16 nt, Haemophilus influenzae Rd
auaacacccucaacca

SEQ ID NO: 701170 - RNA, 20 nt, Haemophilus influenzae Rd
auaacacccucaaccacuuc

SEQ ID NO: 701171 - RNA, 18 nt, Haemophilus influenzae Rd
auaacaccgcuaauaaaa

SEQ ID NO: 701172 - RNA, 23 nt, Haemophilus influenzae Rd
auaacaccgcuaauaaaaauccu

SEQ ID NO: 701173 - RNA, 19 nt, Haemophilus influenzae Rd
auaacacgaccauugaauc

SEQ ID NO: 701174 - RNA, 14 nt, Haemophilus influenzae Rd
auaacacucauugu

SEQ ID NO: 701175 - RNA, 21 nt, Haemophilus influenzae Rd
auaacauaccuagauugcuuu

SEQ ID NO: 701176 - RNA, 21 nt, Haemophilus influenzae Rd
auaacauuccguuuuuaaucu

SEQ ID NO: 701177 - RNA, 16 nt, Haemophilus influenzae Rd
auaacauuguuuuaau

SEQ ID NO: 701178 - RNA, 23 nt, Haemophilus influenzae Rd
auaaccaagaaagcaugaauaaa

SEQ ID NO: 701179 - RNA, 17 nt, Haemophilus influenzae Rd
auaacaugcaaaauauu

SEQ ID NO: 701180 - RNA, 14 nt, Haemophilus influenzae Rd
auaacaaaaacaau

SEQ ID NO: 701181 - RNA, 19 nt, Haemophilus influenzae Rd
auaaauuuuuuaauucagu

SEQ ID NO: 701182 - RNA, 19 nt, Haemophilus influenzae Rd
auaacaaaauggcuuuuuu

SEQ ID NO: 701183 - RNA, 11 nt, Haemophilus influenzae Rd
auaacaaauag

SEQ ID NO: 701184 - RNA, 14 nt, Haemophilus influenzae Rd
auaacaaauugcuu

SEQ ID NO: 701185 - RNA, 14 nt, Haemophilus influenzae Rd
auaacaacuaaaaa

SEQ ID NO: 701186 - RNA, 19 nt, Haemophilus influenzae Rd
auaacaacaacgcaucuuu

SEQ ID NO: 701187 - RNA, 16 nt, Haemophilus influenzae Rd
auaacaagcgaaaaac

SEQ ID NO: 701188 - RNA, 22 nt, Haemophilus influenzae Rd
auaacaagcucagguucaaaac

SEQ ID NO: 701189 - RNA, 18 nt, Haemophilus influenzae Rd
auaacaauuuuugcauuu

SEQ ID NO: 701190 - RNA, 19 nt, Haemophilus influenzae Rd
auaacacaaccaucuucaa

SEQ ID NO: 701191 - RNA, 14 nt, Haemophilus influenzae Rd
auaaauccuuaauu

SEQ ID NO: 701192 - RNA, 16 nt, Haemophilus influenzae Rd
auaaauccaaauaagu

SEQ ID NO: 701193 - RNA, 16 nt, Haemophilus influenzae Rd
auaaauccguaaaaua

SEQ ID NO: 701194 - RNA, 14 nt, Haemophilus influenzae Rd
auaaauuuuuagcu

SEQ ID NO: 701195 - RNA, 17 nt, Haemophilus influenzae Rd
auaaauuuugguugauu

SEQ ID NO: 701196 - RNA, 22 nt, Haemophilus influenzae Rd
auaaauuuugguugauugacca

SEQ ID NO: 701197 - RNA, 17 nt, Haemophilus influenzae Rd
auaaauuuuauuauguu

SEQ ID NO: 701198 - RNA, 20 nt, Haemophilus influenzae Rd
auaaauuuucaaauugaaaa

SEQ ID NO: 701199 - RNA, 16 nt, Haemophilus influenzae Rd
auaaccacguaauucu

SEQ ID NO: 701200 - RNA, 17 nt, Haemophilus influenzae Rd
auaaccacguaauucuu

SEQ ID NO: 701201 - RNA, 21 nt, Haemophilus influenzae Rd
auaacccacuguuaaagugca

SEQ ID NO: 701202 - RNA, 18 nt, Haemophilus influenzae Rd
auaacccgauuauucuua

SEQ ID NO: 701203 - RNA, 15 nt, Haemophilus influenzae Rd
auaacccuaaaguga

SEQ ID NO: 701204 - RNA, 16 nt, Haemophilus influenzae Rd
auaacccuaaagugac

SEQ ID NO: 701205 - RNA, 18 nt, Haemophilus influenzae Rd
auaaccgcacuucaaaaa

SEQ ID NO: 701206 - RNA, 20 nt, Haemophilus influenzae Rd
auaaccgcacuucaaaaagu

SEQ ID NO: 701207 - RNA, 16 nt, Haemophilus influenzae Rd
auaacccuuacuuuau

SEQ ID NO: 701208 - RNA, 17 nt, Haemophilus influenzae Rd
auaacccuuacuuuaua

SEQ ID NO: 701209 - RNA, 23 nt, Haemophilus influenzae Rd
auaacccuuguaacguauuuaaa

SEQ ID NO: 701210 - RNA, 17 nt, Haemophilus influenzae Rd
auaaccuaucccaaaau

SEQ ID NO: 701211 - RNA, 16 nt, Haemophilus influenzae Rd
auaacgcuaucuuuug

SEQ ID NO: 701212 - RNA, 21 nt, Haemophilus influenzae Rd
auaacgcuccccuugauuauu

SEQ ID NO: 701213 - RNA, 21 nt, Haemophilus influenzae Rd
auaacgcugcuuaaagcaauc

SEQ ID NO: 701214 - RNA, 20 nt, Haemophilus influenzae Rd
auaaccuuaaaucaaacaaa

SEQ ID NO: 701215 - RNA, 20 nt, Haemophilus influenzae Rd
auaacguagcgauaaaauau

SEQ ID NO: 701216 - RNA, 12 nt, Haemophilus influenzae Rd
auaacguauuuu

SEQ ID NO: 701217 - RNA, 16 nt, Haemophilus influenzae Rd
auaacgggcauuuuuc

SEQ ID NO: 701218 - RNA, 20 nt, Haemophilus influenzae Rd
auaacggcaaaaucauuaaa

SEQ ID NO: 701219 - RNA, 18 nt, Haemophilus influenzae Rd
auaacggcacaccuaacu

SEQ ID NO: 701220 - RNA, 14 nt, Haemophilus influenzae Rd
auaacugaauaauu

SEQ ID NO: 701221 - RNA, 19 nt, Haemophilus influenzae Rd
auaacugcgccaauauaag

SEQ ID NO: 701222 - RNA, 16 nt, Haemophilus influenzae Rd
auaacuuagaaaauau

SEQ ID NO: 701223 - RNA, 18 nt, Haemophilus influenzae Rd
auaacuuagaaaauaucu

SEQ ID NO: 701224 - RNA, 15 nt, Haemophilus influenzae Rd
auaacuuaugaauaa

SEQ ID NO: 701225 - RNA, 19 nt, Haemophilus influenzae Rd
auaauauaggcgaacaaaa

SEQ ID NO: 701226 - RNA, 14 nt, Haemophilus influenzae Rd
auaauauaaauuau

SEQ ID NO: 701227 - RNA, 18 nt, Haemophilus influenzae Rd
auaaucacaguaccuaca

SEQ ID NO: 701228 - RNA, 21 nt, Haemophilus influenzae Rd
auaaucacaguaccuacauuu

SEQ ID NO: 701229 - RNA, 23 nt, Haemophilus influenzae Rd
auaaucacaguaccuacauuuaa

SEQ ID NO: 701230 - RNA, 21 nt, Haemophilus influenzae Rd
auaauaggcgcguaauaaaua

SEQ ID NO: 701231 - RNA, 20 nt, Haemophilus influenzae Rd
auaaucaggauauuuuauug

SEQ ID NO: 701232 - RNA, 15 nt, Haemophilus influenzae Rd
auaauccguuaaauu

SEQ ID NO: 701233 - RNA, 15 nt, Haemophilus influenzae Rd
auaauccuuuuuuug

SEQ ID NO: 701234 - RNA, 14 nt, Haemophilus influenzae Rd
auaaucgaaaaagu

SEQ ID NO: 701235 - RNA, 12 nt, Haemophilus influenzae Rd
auaaugaaauau

SEQ ID NO: 701236 - RNA, 22 nt, Haemophilus influenzae Rd
auaaugaugaaugcuuuuauaa

SEQ ID NO: 701237 - RNA, 11 nt, Haemophilus influenzae Rd
auaaugaugag

SEQ ID NO: 701238 - RNA, 12 nt, Haemophilus influenzae Rd
auaaugauguac

SEQ ID NO: 701239 - RNA, 13 nt, Haemophilus influenzae Rd
auaaugauauuau

SEQ ID NO: 701240 - RNA, 16 nt, Haemophilus influenzae Rd
auaauggcaauuuuau

SEQ ID NO: 701241 - RNA, 22 nt, Haemophilus influenzae Rd
auaauggcaauuuuauauucau

SEQ ID NO: 701242 - RNA, 17 nt, Haemophilus influenzae Rd
auaaucuucuucccaac

SEQ ID NO: 701243 - RNA, 13 nt, Haemophilus influenzae Rd
auaaucuuuaaaa

SEQ ID NO: 701244 - RNA, 16 nt, Haemophilus influenzae Rd
auaaucuuuaaauuuu

SEQ ID NO: 701245 - RNA, 14 nt, Haemophilus influenzae Rd
auaaucugauuauu

SEQ ID NO: 701246 - RNA, 21 nt, Haemophilus influenzae Rd
auaaucugauugagaaaaugu

SEQ ID NO: 701247 - RNA, 16 nt, Haemophilus influenzae Rd
auaaucucuucuaaaa

SEQ ID NO: 701248 - RNA, 16 nt, Haemophilus influenzae Rd
auaaucgaucuuuuuu

SEQ ID NO: 701249 - RNA, 16 nt, Haemophilus influenzae Rd
auaauccucuuuaaaa

SEQ ID NO: 701250 - RNA, 14 nt, Haemophilus influenzae Rd
auaaucgccaaaau

SEQ ID NO: 701251 - RNA, 19 nt, Haemophilus influenzae Rd
auaaucgccaaaaucauca

SEQ ID NO: 701252 - RNA, 20 nt, Haemophilus influenzae Rd
auaaucgccaaaaucaucac

SEQ ID NO: 701253 - RNA, 18 nt, Haemophilus influenzae Rd
auaagaaauguuuggaua

SEQ ID NO: 701254 - RNA, 12 nt, Haemophilus influenzae Rd
auaagaaauaau

SEQ ID NO: 701255 - RNA, 18 nt, Haemophilus influenzae Rd
auaagaagcugcuuuuaa

SEQ ID NO: 701256 - RNA, 17 nt, Haemophilus influenzae Rd
auaagugagaaaauacg

SEQ ID NO: 701257 - RNA, 23 nt, Haemophilus influenzae Rd
auaagugagaaaguuaaucaaac

SEQ ID NO: 701258 - RNA, 20 nt, Haemophilus influenzae Rd
auaagugaaaugcucuaaau

SEQ ID NO: 701259 - RNA, 19 nt, Haemophilus influenzae Rd
auaaguggggaaaaauauu

SEQ ID NO: 701260 - RNA, 23 nt, Haemophilus influenzae Rd
auaagugugaguccgauccauac

SEQ ID NO: 701261 - RNA, 17 nt, Haemophilus influenzae Rd
auaaguucuaaauaaac

SEQ ID NO: 701262 - RNA, 19 nt, Haemophilus influenzae Rd
auaaguucuaaauaaacua

SEQ ID NO: 701263 - RNA, 21 nt, Haemophilus influenzae Rd
auaaguucauaaaaggggcaa

SEQ ID NO: 701264 - RNA, 15 nt, Haemophilus influenzae Rd
auaaguucaucaacu

SEQ ID NO: 701265 - RNA, 16 nt, Haemophilus influenzae Rd
auaaguuauuuauaua

SEQ ID NO: 701266 - RNA, 12 nt, Haemophilus influenzae Rd
auaauaaaaaaa

SEQ ID NO: 701267 - RNA, 15 nt, Haemophilus influenzae Rd
auaaguuuuuugcca

SEQ ID NO: 701268 - RNA, 22 nt, Haemophilus influenzae Rd
auaaguuaccgcuucuuccugu

SEQ ID NO: 701269 - RNA, 23 nt, Haemophilus influenzae Rd
auaaguuuugucugaaauuuuua

SEQ ID NO: 701270 - RNA, 14 nt, Haemophilus influenzae Rd
auaauaaaaaaacc

SEQ ID NO: 701271 - RNA, 12 nt, Haemophilus influenzae Rd
auaauaaaauag

SEQ ID NO: 701272 - RNA, 22 nt, Haemophilus influenzae Rd
auaauaaaauuuauuacaaaca

SEQ ID NO: 701273 - RNA, 21 nt, Haemophilus influenzae Rd
auaauaaagcuacuaaaaauu

SEQ ID NO: 701274 - RNA, 11 nt, Haemophilus influenzae Rd
auaauaaaaug

SEQ ID NO: 701275 - RNA, 16 nt, Haemophilus influenzae Rd
auaauaccuuuccauu

SEQ ID NO: 701276 - RNA, 23 nt, Haemophilus influenzae Rd
auaauaaucuucuugaagaucuu

SEQ ID NO: 701277 - RNA, 15 nt, Haemophilus influenzae Rd
auaauaauuuuuccg

SEQ ID NO: 701278 - RNA, 13 nt, Haemophilus influenzae Rd
auaauaacgccac

SEQ ID NO: 701279 - RNA, 19 nt, Haemophilus influenzae Rd
auaauaagccgaagaagau

SEQ ID NO: 701280 - RNA, 22 nt, Haemophilus influenzae Rd
auaauaagccgaagaagauaau

SEQ ID NO: 701281 - RNA, 22 nt, Haemophilus influenzae Rd
auaauaagcgauugcucguuau

SEQ ID NO: 701282 - RNA, 19 nt, Haemophilus influenzae Rd
auaauaagaaaguaauugc

SEQ ID NO: 701283 - RNA, 16 nt, Haemophilus influenzae Rd
auaauaagauuuuugg

SEQ ID NO: 701284 - RNA, 12 nt, Haemophilus influenzae Rd
auaauaagcaca

SEQ ID NO: 701285 - RNA, 14 nt, Haemophilus influenzae Rd
auaauaagcacaau

SEQ ID NO: 701286 - RNA, 12 nt, Haemophilus influenzae Rd
auaauuuucaaa

SEQ ID NO: 701287 - RNA, 17 nt, Haemophilus influenzae Rd
auaauuuucaaacacaa

SEQ ID NO: 701288 - RNA, 13 nt, Haemophilus influenzae Rd
auaauuuucaaua

SEQ ID NO: 701289 - RNA, 14 nt, Haemophilus influenzae Rd
auaauuuuggauca

SEQ ID NO: 701290 - RNA, 14 nt, Haemophilus influenzae Rd
auaauuuuuauaau

SEQ ID NO: 701291 - RNA, 16 nt, Haemophilus influenzae Rd
auaauuuuagaacuua

SEQ ID NO: 701292 - RNA, 21 nt, Haemophilus influenzae Rd
auaauuugaccuucauaaacu

SEQ ID NO: 701293 - RNA, 16 nt, Haemophilus influenzae Rd
auaauuugcaucauuu

SEQ ID NO: 701294 - RNA, 13 nt, Haemophilus influenzae Rd
auaauuucauugu

SEQ ID NO: 701295 - RNA, 21 nt, Haemophilus influenzae Rd
auaauuuccaacacauuauca

SEQ ID NO: 701296 - RNA, 18 nt, Haemophilus influenzae Rd
auaauuucccuaaaaucu

SEQ ID NO: 701297 - RNA, 17 nt, Haemophilus influenzae Rd
auaauuuccuauacuaa

SEQ ID NO: 701298 - RNA, 17 nt, Haemophilus influenzae Rd
auaauuuccuuuuuuau

SEQ ID NO: 701299 - RNA, 22 nt, Haemophilus influenzae Rd
auaauuucguagagagucuggu

SEQ ID NO: 701300 - RNA, 21 nt, Haemophilus influenzae Rd
auaauguagagcucaauuauu

SEQ ID NO: 701301 - RNA, 20 nt, Haemophilus influenzae Rd
auaaugguuacagaaauauu

SEQ ID NO: 701302 - RNA, 15 nt, Haemophilus influenzae Rd
auaauggcuuuucuc

SEQ ID NO: 701303 - RNA, 22 nt, Haemophilus influenzae Rd
auaauggcuuuucucaaaacau

SEQ ID NO: 701304 - RNA, 18 nt, Haemophilus influenzae Rd
auaauggcgauaauuauu

SEQ ID NO: 701305 - RNA, 22 nt, Haemophilus influenzae Rd
auaaugggcuuuccaauaacca

SEQ ID NO: 701306 - RNA, 18 nt, Haemophilus influenzae Rd
auaauugguaaucaaauu

SEQ ID NO: 701307 - RNA, 19 nt, Haemophilus influenzae Rd
auaauugaugcuaaauuau

SEQ ID NO: 701308 - RNA, 21 nt, Haemophilus influenzae Rd
auaauuuauuugcuaguuuag

SEQ ID NO: 701309 - RNA, 14 nt, Haemophilus influenzae Rd
auaauuuauauuau

SEQ ID NO: 701310 - RNA, 16 nt, Haemophilus influenzae Rd
auaauuuauauuaugc

SEQ ID NO: 701311 - RNA, 12 nt, Haemophilus influenzae Rd
auaauuuauuca

SEQ ID NO: 701312 - RNA, 16 nt, Haemophilus influenzae Rd
auaauuuauucaaaau

SEQ ID NO: 701313 - RNA, 23 nt, Haemophilus influenzae Rd
auaauuuauucaaaauaaaacca

SEQ ID NO: 701314 - RNA, 17 nt, Haemophilus influenzae Rd
auaauuggcaauaaugu

SEQ ID NO: 701315 - RNA, 14 nt, Haemophilus influenzae Rd
auaauuuaaauuua

SEQ ID NO: 701316 - RNA, 21 nt, Haemophilus influenzae Rd
auaauuuagcccgaaaauuaa

SEQ ID NO: 701317 - RNA, 13 nt, Haemophilus influenzae Rd
auacaccaauaau

SEQ ID NO: 701318 - RNA, 13 nt, Haemophilus influenzae Rd
auacacuucuaaa

SEQ ID NO: 701319 - RNA, 21 nt, Haemophilus influenzae Rd
auacacuuuaaauuuuccugu

SEQ ID NO: 701320 - RNA, 23 nt, Haemophilus influenzae Rd
auacacuuuaaauuuuccuguuu

SEQ ID NO: 701321 - RNA, 20 nt, Haemophilus influenzae Rd
auacaaucacgaucugcaac

SEQ ID NO: 701322 - RNA, 19 nt, Haemophilus influenzae Rd
auacaaucgguuaaaagua

SEQ ID NO: 701323 - RNA, 23 nt, Haemophilus influenzae Rd
auacaaucgguuaaaaguaagca

SEQ ID NO: 701324 - RNA, 21 nt, Haemophilus influenzae Rd
auacaaucucuagauuuuuua

SEQ ID NO: 701325 - RNA, 15 nt, Haemophilus influenzae Rd
auacaaguauuuucc

SEQ ID NO: 701326 - RNA, 20 nt, Haemophilus influenzae Rd
auacaaguggcgguaaaaau

SEQ ID NO: 701327 - RNA, 22 nt, Haemophilus influenzae Rd
auacaaguggcgguaaaaaugc

SEQ ID NO: 701328 - RNA, 23 nt, Haemophilus influenzae Rd
auacacaucagagcgaauacugu

SEQ ID NO: 701329 - RNA, 20 nt, Haemophilus influenzae Rd
auacacauggccaauuucau

SEQ ID NO: 701330 - RNA, 22 nt, Haemophilus influenzae Rd
auacaauuuuuuucaagcaaca

SEQ ID NO: 701331 - RNA, 18 nt, Haemophilus influenzae Rd
auacaauccaccaaaugc

SEQ ID NO: 701332 - RNA, 17 nt, Haemophilus influenzae Rd
auacaagaccaauauaa

SEQ ID NO: 701333 - RNA, 17 nt, Haemophilus influenzae Rd
auacaagaaagaaauau

SEQ ID NO: 701334 - RNA, 16 nt, Haemophilus influenzae Rd
auacaagguacuugaa

SEQ ID NO: 701335 - RNA, 16 nt, Haemophilus influenzae Rd
auacaagcggcugaca

SEQ ID NO: 701336 - RNA, 23 nt, Haemophilus influenzae Rd
auacaagcggcugacauuacaua

SEQ ID NO: 701337 - RNA, 21 nt, Haemophilus influenzae Rd
auacaacgcucugcaccuuca

SEQ ID NO: 701338 - RNA, 14 nt, Haemophilus influenzae Rd
auacaaaaaagcca

SEQ ID NO: 701339 - RNA, 12 nt, Haemophilus influenzae Rd
auacaaagauuu

SEQ ID NO: 701340 - RNA, 17 nt, Haemophilus influenzae Rd
auacaaauaacacagaa

SEQ ID NO: 701341 - RNA, 14 nt, Haemophilus influenzae Rd
aguuacguuuagua

SEQ ID NO: 701342 - RNA, 21 nt, Haemophilus influenzae Rd
aguuaccauacagccugcgau

SEQ ID NO: 701343 - RNA, 20 nt, Haemophilus influenzae Rd
aguuaccgcucgccaauaaa

SEQ ID NO: 701344 - RNA, 18 nt, Haemophilus influenzae Rd
aguuaccgcuucuuccug

SEQ ID NO: 701345 - RNA, 20 nt, Haemophilus influenzae Rd
aguuacgauuguauuuuaaa

SEQ ID NO: 701346 - RNA, 17 nt, Haemophilus influenzae Rd
aguuaauuagaauaaca

SEQ ID NO: 701347 - RNA, 15 nt, Haemophilus influenzae Rd
aguuaauggcaauuu

SEQ ID NO: 701348 - RNA, 13 nt, Haemophilus influenzae Rd
aguuaaucgaaaa

SEQ ID NO: 701349 - RNA, 13 nt, Haemophilus influenzae Rd
aguuaucaauaaa

SEQ ID NO: 701350 - RNA, 12 nt, Haemophilus influenzae Rd
aguuaucauuug

SEQ ID NO: 701351 - RNA, 15 nt, Haemophilus influenzae Rd
aguuaucgccaauaa

SEQ ID NO: 701352 - RNA, 16 nt, Haemophilus influenzae Rd
aguuaucuguauaaau

SEQ ID NO: 701353 - RNA, 19 nt, Haemophilus influenzae Rd
aguuaucaaacaguucaau

SEQ ID NO: 701354 - RNA, 22 nt, Haemophilus influenzae Rd
aguuagauugaacguuuaacuu

SEQ ID NO: 701355 - RNA, 16 nt, Haemophilus influenzae Rd
aguuagaaacagaagu

SEQ ID NO: 701356 - RNA, 14 nt, Haemophilus influenzae Rd
aguuacuuugcauu

SEQ ID NO: 701357 - RNA, 20 nt, Haemophilus influenzae Rd
aguuauucuucagaacugcu

SEQ ID NO: 701358 - RNA, 14 nt, Haemophilus influenzae Rd
aguucacuaaaaau

SEQ ID NO: 701359 - RNA, 15 nt, Haemophilus influenzae Rd
aguucagaaagagac

SEQ ID NO: 701360 - RNA, 21 nt, Haemophilus influenzae Rd
aguugauuuuaaaauaucaaa

SEQ ID NO: 701361 - RNA, 14 nt, Haemophilus influenzae Rd
aguucuguaauuca

SEQ ID NO: 701362 - RNA, 23 nt, Haemophilus influenzae Rd
aguuccaccacccuucuuucaaa

SEQ ID NO: 701363 - RNA, 15 nt, Haemophilus influenzae Rd
aguucgguuugcucg

SEQ ID NO: 701364 - RNA, 19 nt, Haemophilus influenzae Rd
aguucuaaaauuauagaac

SEQ ID NO: 701365 - RNA, 13 nt, Haemophilus influenzae Rd
aguucuaaauaaa

SEQ ID NO: 701366 - RNA, 19 nt, Haemophilus influenzae Rd
aguucucaaaaaguuaaau

SEQ ID NO: 701367 - RNA, 12 nt, Haemophilus influenzae Rd
aguuucaagcac

SEQ ID NO: 701368 - RNA, 15 nt, Haemophilus influenzae Rd
aguuuauuaauuugc

SEQ ID NO: 701369 - RNA, 15 nt, Haemophilus influenzae Rd
aguuuauucagugcu

SEQ ID NO: 701370 - RNA, 12 nt, Haemophilus influenzae Rd
aguuuacuuuug

SEQ ID NO: 701371 - RNA, 21 nt, Haemophilus influenzae Rd
aguuuaucucuuucuuaaaau

SEQ ID NO: 701372 - RNA, 21 nt, Haemophilus influenzae Rd
aguuuaguccuuaauuuaauu

SEQ ID NO: 701373 - RNA, 22 nt, Haemophilus influenzae Rd
aguuuagucuuuuuaauuuaaa

SEQ ID NO: 701374 - RNA, 13 nt, Haemophilus influenzae Rd
aguuuaguuuaau

SEQ ID NO: 701375 - RNA, 14 nt, Haemophilus influenzae Rd
aguuuauaaaaaaa

SEQ ID NO: 701376 - RNA, 20 nt, Haemophilus influenzae Rd
aguuuaccgccaagucccca

SEQ ID NO: 701377 - RNA, 16 nt, Haemophilus influenzae Rd
aguuuaacuuucaaca

SEQ ID NO: 701378 - RNA, 17 nt, Haemophilus influenzae Rd
aguuuaacuuucaacac

SEQ ID NO: 701379 - RNA, 14 nt, Haemophilus influenzae Rd
aguuuaauucuucg

SEQ ID NO: 701380 - RNA, 23 nt, Haemophilus influenzae Rd
aguuguuuuuucaguuguuugaa

SEQ ID NO: 701381 - RNA, 14 nt, Haemophilus influenzae Rd
aguuguuucaccau

SEQ ID NO: 701382 - RNA, 20 nt, Haemophilus influenzae Rd
aguuguuucaccauuuccuu

SEQ ID NO: 701383 - RNA, 12 nt, Haemophilus influenzae Rd
aguuguuuaaaa

SEQ ID NO: 701384 - RNA, 12 nt, Haemophilus influenzae Rd
aguugugccaau

SEQ ID NO: 701385 - RNA, 23 nt, Haemophilus influenzae Rd
aguugugaguaaaccacaauacu

SEQ ID NO: 701386 - RNA, 18 nt, Haemophilus influenzae Rd
aguuguggaaguugcucu

SEQ ID NO: 701387 - RNA, 18 nt, Haemophilus influenzae Rd
aguugucgcuacaucaac

SEQ ID NO: 701388 - RNA, 19 nt, Haemophilus influenzae Rd
aguugucccgcauauaaaa

SEQ ID NO: 701389 - RNA, 16 nt, Haemophilus influenzae Rd
aguugcauaagcaaaa

SEQ ID NO: 701390 - RNA, 14 nt, Haemophilus influenzae Rd
aguuucacucuacc

SEQ ID NO: 701391 - RNA, 21 nt, Haemophilus influenzae Rd
aguuucacucuaccaucuaaa

SEQ ID NO: 701392 - RNA, 23 nt, Haemophilus influenzae Rd
aguuucgccagcaccacguucau

SEQ ID NO: 701393 - RNA, 17 nt, Haemophilus influenzae Rd
aguuucuaauucuucca

SEQ ID NO: 701394 - RNA, 12 nt, Haemophilus influenzae Rd
aguuucugguuc

SEQ ID NO: 701395 - RNA, 16 nt, Haemophilus influenzae Rd
aguuucugguuccauu

SEQ ID NO: 701396 - RNA, 19 nt, Haemophilus influenzae Rd
aguuucugguuccauuacg

SEQ ID NO: 701397 - RNA, 14 nt, Haemophilus influenzae Rd
aguuucuuuuacau

SEQ ID NO: 701398 - RNA, 18 nt, Haemophilus influenzae Rd
aguuuggcucuucuuuaa

SEQ ID NO: 701399 - RNA, 17 nt, Haemophilus influenzae Rd
aguuuguuucucaaguu

SEQ ID NO: 701400 - RNA, 15 nt, Haemophilus influenzae Rd
aguuuuaagguuguu

SEQ ID NO: 701401 - RNA, 16 nt, Haemophilus influenzae Rd
aguuuuaauacuaaag

SEQ ID NO: 701402 - RNA, 19 nt, Haemophilus influenzae Rd
aguuucuucuuucaaugca

SEQ ID NO: 701403 - RNA, 13 nt, Haemophilus influenzae Rd
aguuugacuauuc

SEQ ID NO: 701404 - RNA, 15 nt, Haemophilus influenzae Rd
aguuugacuauucua

SEQ ID NO: 701405 - RNA, 16 nt, Haemophilus influenzae Rd
aguuugccgccaaucc

SEQ ID NO: 701406 - RNA, 21 nt, Haemophilus influenzae Rd
aguuugccgccaaucccgauu

SEQ ID NO: 701407 - RNA, 22 nt, Haemophilus influenzae Rd
aguuugcgugaauaucuaacau

SEQ ID NO: 701408 - RNA, 12 nt, Haemophilus influenzae Rd
aguuugcaacau

SEQ ID NO: 701409 - RNA, 14 nt, Haemophilus influenzae Rd
aguuugcaacauau

SEQ ID NO: 701410 - RNA, 22 nt, Haemophilus influenzae Rd
aguuugcaauaaagcuugaaaa

SEQ ID NO: 701411 - RNA, 17 nt, Haemophilus influenzae Rd
aguuugauuacaguaca

SEQ ID NO: 701412 - RNA, 20 nt, Haemophilus influenzae Rd
agugcgguaagaaaaucaac

SEQ ID NO: 701413 - RNA, 16 nt, Haemophilus influenzae Rd
agugcgguaauuuuua

SEQ ID NO: 701414 - RNA, 17 nt, Haemophilus influenzae Rd
agugcgguaaauuuuua

SEQ ID NO: 701415 - RNA, 14 nt, Haemophilus influenzae Rd
agugcgguaaaaau

SEQ ID NO: 701416 - RNA, 18 nt, Haemophilus influenzae Rd
agugcgguaaaaauuaac

SEQ ID NO: 701417 - RNA, 17 nt, Haemophilus influenzae Rd
agugcgguaaaauuuca

SEQ ID NO: 701418 - RNA, 18 nt, Haemophilus influenzae Rd
agugcgguaaaauuuuuc

SEQ ID NO: 701419 - RNA, 19 nt, Haemophilus influenzae Rd
agugcgguaaaauuuuucu

SEQ ID NO: 701420 - RNA, 15 nt, Haemophilus influenzae Rd
agugcggaaaauuuu

SEQ ID NO: 701421 - RNA, 14 nt, Haemophilus influenzae Rd
agugcggagaaaau

SEQ ID NO: 701422 - RNA, 14 nt, Haemophilus influenzae Rd
agugcggaugaaau

SEQ ID NO: 701423 - RNA, 15 nt, Haemophilus influenzae Rd
agugcggcaaaaaau

SEQ ID NO: 701424 - RNA, 17 nt, Haemophilus influenzae Rd
agugcggcaaagguuuu

SEQ ID NO: 701425 - RNA, 14 nt, Haemophilus influenzae Rd
agugguaucaaucg

SEQ ID NO: 701426 - RNA, 21 nt, Haemophilus influenzae Rd
aguggugguggaauaaauaac

SEQ ID NO: 701427 - RNA, 15 nt, Haemophilus influenzae Rd
agugguucagauuuc

SEQ ID NO: 701428 - RNA, 22 nt, Haemophilus influenzae Rd
agugguccugucaguuugcuuu

SEQ ID NO: 701429 - RNA, 17 nt, Haemophilus influenzae Rd
agugguggaauaaaagu

SEQ ID NO: 701430 - RNA, 20 nt, Haemophilus influenzae Rd
aguggugggucgugaaggau

SEQ ID NO: 701431 - RNA, 16 nt, Haemophilus influenzae Rd
agugcugguagcaaua

SEQ ID NO: 701432 - RNA, 15 nt, Haemophilus influenzae Rd
agugcuguacacaca

SEQ ID NO: 701433 - RNA, 16 nt, Haemophilus influenzae Rd
agugcuguacacacac

SEQ ID NO: 701434 - RNA, 21 nt, Haemophilus influenzae Rd
agugcuguacacacaccaucc

SEQ ID NO: 701435 - RNA, 15 nt, Haemophilus influenzae Rd
agugcuguauauuuu

SEQ ID NO: 701436 - RNA, 18 nt, Haemophilus influenzae Rd
aguggcaccgaauguggc

SEQ ID NO: 701437 - RNA, 23 nt, Haemophilus influenzae Rd
aguggcauaaagaaacaggacac

SEQ ID NO: 701438 - RNA, 20 nt, Haemophilus influenzae Rd
agugaaugaugccauuuuuu

SEQ ID NO: 701439 - RNA, 21 nt, Haemophilus influenzae Rd
agugaauaauguuuucauuaa

SEQ ID NO: 701440 - RNA, 21 nt, Haemophilus influenzae Rd
agugauagcugugguaaauaa

SEQ ID NO: 701441 - RNA, 22 nt, Haemophilus influenzae Rd
agugauauccgcuuuuaaaaua

SEQ ID NO: 701442 - RNA, 21 nt, Haemophilus influenzae Rd
agugaucuugauccccauaca

SEQ ID NO: 701443 - RNA, 20 nt, Haemophilus influenzae Rd
agugauugcgccgaauaaac

SEQ ID NO: 701444 - RNA, 23 nt, Haemophilus influenzae Rd
agugauuuuugcaacuucagcag

SEQ ID NO: 701445 - RNA, 19 nt, Haemophilus influenzae Rd
agugauuuuaaaucccaau

SEQ ID NO: 701446 - RNA, 21 nt, Haemophilus influenzae Rd
agugaugaugguguucugguu

SEQ ID NO: 701447 - RNA, 18 nt, Haemophilus influenzae Rd
agugauguaaauuuucag

SEQ ID NO: 701448 - RNA, 17 nt, Haemophilus influenzae Rd
agugauuaaagugacaa

SEQ ID NO: 701449 - RNA, 12 nt, Haemophilus influenzae Rd
agugauuauuua

SEQ ID NO: 701450 - RNA, 17 nt, Haemophilus influenzae Rd
agugcagcccaaauaaa

SEQ ID NO: 701451 - RNA, 19 nt, Haemophilus influenzae Rd
agugcagcccaaauaaaga

SEQ ID NO: 701452 - RNA, 15 nt, Haemophilus influenzae Rd
agugcagauuuuuau

SEQ ID NO: 701453 - RNA, 21 nt, Haemophilus influenzae Rd
agugcaugauguuuuucagca

SEQ ID NO: 701454 - RNA, 16 nt, Haemophilus influenzae Rd
agugaaaaaauaacca

SEQ ID NO: 701455 - RNA, 18 nt, Haemophilus influenzae Rd
agugaaaaaauaaccacu

SEQ ID NO: 701456 - RNA, 14 nt, Haemophilus influenzae Rd
agugaaaagaaaac

SEQ ID NO: 701457 - RNA, 21 nt, Haemophilus influenzae Rd
agugaaaagaaaacuuauaaa

SEQ ID NO: 701458 - RNA, 18 nt, Haemophilus influenzae Rd
agucuuguaacuauaacu

SEQ ID NO: 701459 - RNA, 22 nt, Haemophilus influenzae Rd
agucuuuuuaauuuaaauaaag

SEQ ID NO: 701460 - RNA, 22 nt, Haemophilus influenzae Rd
agucucuuuauuuuuucaucau

SEQ ID NO: 701461 - RNA, 22 nt, Haemophilus influenzae Rd
agucucuuuugaggcuaauaau

SEQ ID NO: 701462 - RNA, 16 nt, Haemophilus influenzae Rd
agucugcugaaauaca

SEQ ID NO: 701463 - RNA, 16 nt, Haemophilus influenzae Rd
agucugcuacaaguga

SEQ ID NO: 701464 - RNA, 22 nt, Haemophilus influenzae Rd
agucucuaugauuuuuuugccu

SEQ ID NO: 701465 - RNA, 19 nt, Haemophilus influenzae Rd
agucgcuuucaacacaaca

SEQ ID NO: 701466 - RNA, 18 nt, Haemophilus influenzae Rd
aguauuuuccuucugcca

SEQ ID NO: 701467 - RNA, 20 nt, Haemophilus influenzae Rd
aguauuuuauuuaagcuuuc

SEQ ID NO: 701468 - RNA, 23 nt, Haemophilus influenzae Rd
agucaaaaauugauaccaagaua

SEQ ID NO: 701469 - RNA, 18 nt, Haemophilus influenzae Rd
agucaaaaaugugguugc

SEQ ID NO: 701470 - RNA, 23 nt, Haemophilus influenzae Rd
agucaaaaaugugguugcggcug

SEQ ID NO: 701471 - RNA, 13 nt, Haemophilus influenzae Rd
agucaaauuuuua

SEQ ID NO: 701472 - RNA, 15 nt, Haemophilus influenzae Rd
agucgcuaauuuuuu

SEQ ID NO: 701473 - RNA, 18 nt, Haemophilus influenzae Rd
agucgcuacauuucgacu

SEQ ID NO: 701474 - RNA, 12 nt, Haemophilus influenzae Rd
agucgaugccaa

SEQ ID NO: 701475 - RNA, 18 nt, Haemophilus influenzae Rd
aguaacaauguagaaaug

SEQ ID NO: 701476 - RNA, 14 nt, Haemophilus influenzae Rd
aguaaauucaccaa

SEQ ID NO: 701477 - RNA, 22 nt, Haemophilus influenzae Rd
aguaaauucaguuaagaaaaua

SEQ ID NO: 701478 - RNA, 13 nt, Haemophilus influenzae Rd
aguaaauuuagag

SEQ ID NO: 701479 - RNA, 15 nt, Haemophilus influenzae Rd
aguaaauuuuaaaau

SEQ ID NO: 701480 - RNA, 15 nt, Haemophilus influenzae Rd
aguaaacuuuuaaag

SEQ ID NO: 701481 - RNA, 22 nt, Haemophilus influenzae Rd
aguaaacguucugauaaucugc

SEQ ID NO: 701482 - RNA, 21 nt, Haemophilus influenzae Rd
aguaauaaggcuugcacaaua

SEQ ID NO: 701483 - RNA, 14 nt, Haemophilus influenzae Rd
aguaauaaucuucu

SEQ ID NO: 701484 - RNA, 16 nt, Haemophilus influenzae Rd
aguaauaaaaagcacu

SEQ ID NO: 701485 - RNA, 17 nt, Haemophilus influenzae Rd
aguaaguuuuacaccaa

SEQ ID NO: 701486 - RNA, 20 nt, Haemophilus influenzae Rd
aguaauaaauucaaaaaaug

SEQ ID NO: 701487 - RNA, 21 nt, Haemophilus influenzae Rd
aguaagucgcaucaacaacua

SEQ ID NO: 701488 - RNA, 18 nt, Haemophilus influenzae Rd
aguaagucgugaucugca

SEQ ID NO: 701489 - RNA, 17 nt, Haemophilus influenzae Rd
aguaagggcaaaaaauc

SEQ ID NO: 701490 - RNA, 14 nt, Haemophilus influenzae Rd
aguaagguuauacu

SEQ ID NO: 701491 - RNA, 12 nt, Haemophilus influenzae Rd
aguaauuuaaaa

SEQ ID NO: 701492 - RNA, 13 nt, Haemophilus influenzae Rd
aguaauuuaaaaa

SEQ ID NO: 701493 - RNA, 17 nt, Haemophilus influenzae Rd
aguaauuucauaucuuc

SEQ ID NO: 701494 - RNA, 13 nt, Haemophilus influenzae Rd
aguaauuuucacg

SEQ ID NO: 701495 - RNA, 16 nt, Haemophilus influenzae Rd
aguaaucuaauucuug

SEQ ID NO: 701496 - RNA, 19 nt, Haemophilus influenzae Rd
aguaauucgggauaaggca

SEQ ID NO: 701497 - RNA, 22 nt, Haemophilus influenzae Rd
agguuuaucuaccacaucaaau

SEQ ID NO: 701498 - RNA, 18 nt, Haemophilus influenzae Rd
agguuuaauaaucgaaaa

SEQ ID NO: 701499 - RNA, 20 nt, Haemophilus influenzae Rd
agguuuaguggguaaaccaa

SEQ ID NO: 701500 - RNA, 17 nt, Haemophilus influenzae Rd
agguuucuaaaugaaua

SEQ ID NO: 701501 - RNA, 21 nt, Haemophilus influenzae Rd
agguuuggacaccuuuuuccu

SEQ ID NO: 701502 - RNA, 16 nt, Haemophilus influenzae Rd
aguaaaaauaaaaugc

SEQ ID NO: 701503 - RNA, 11 nt, Haemophilus influenzae Rd
agguuucucua

SEQ ID NO: 701504 - RNA, 15 nt, Haemophilus influenzae Rd
agguuucucuagccg

SEQ ID NO: 701505 - RNA, 13 nt, Haemophilus influenzae Rd
aguaaaaauuguu

SEQ ID NO: 701506 - RNA, 23 nt, Haemophilus influenzae Rd
aguaaaacuaauuugcacacuua

SEQ ID NO: 701507 - RNA, 17 nt, Haemophilus influenzae Rd
aguaaaauacgaauaaa

SEQ ID NO: 701508 - RNA, 15 nt, Haemophilus influenzae Rd
aguaaaauagucacu

SEQ ID NO: 701509 - RNA, 15 nt, Haemophilus influenzae Rd
aguaaaauaaaaaau

SEQ ID NO: 701510 - RNA, 14 nt, Haemophilus influenzae Rd
aguaaaauaaaaag

SEQ ID NO: 701511 - RNA, 17 nt, Haemophilus influenzae Rd
aguaaaccacaauacuu

SEQ ID NO: 701512 - RNA, 19 nt, Haemophilus influenzae Rd
aguaaacacuuaaauaguu

SEQ ID NO: 701513 - RNA, 18 nt, Haemophilus influenzae Rd
aguaaaccaagugaaauu

SEQ ID NO: 701514 - RNA, 11 nt, Haemophilus influenzae Rd
aguaaacaagu

SEQ ID NO: 701515 - RNA, 19 nt, Haemophilus influenzae Rd
aguaaacaaguauaaaaaa

SEQ ID NO: 701516 - RNA, 15 nt, Haemophilus influenzae Rd
aguaaacaauucuau

SEQ ID NO: 701517 - RNA, 16 nt, Haemophilus influenzae Rd
agguugcugauaaaga

SEQ ID NO: 701518 - RNA, 18 nt, Haemophilus influenzae Rd
agguugcugauaaagaua

SEQ ID NO: 701519 - RNA, 22 nt, Haemophilus influenzae Rd
agguugcgguaaaucuacuuua

SEQ ID NO: 701520 - RNA, 17 nt, Haemophilus influenzae Rd
agguugcuaugcccaag

SEQ ID NO: 701521 - RNA, 14 nt, Haemophilus influenzae Rd
agguuguaagccca

SEQ ID NO: 701522 - RNA, 22 nt, Haemophilus influenzae Rd
aguaguggugguggaauaaaua

SEQ ID NO: 701523 - RNA, 13 nt, Haemophilus influenzae Rd
aguaguguuuuau

SEQ ID NO: 701524 - RNA, 14 nt, Haemophilus influenzae Rd
aguagcaacaccac

SEQ ID NO: 701525 - RNA, 13 nt, Haemophilus influenzae Rd
aguagauuuuuau

SEQ ID NO: 701526 - RNA, 18 nt, Haemophilus influenzae Rd
aguagauuuuuauucaau

SEQ ID NO: 701527 - RNA, 20 nt, Haemophilus influenzae Rd
aguagauaacaacuaaaaau

SEQ ID NO: 701528 - RNA, 14 nt, Haemophilus influenzae Rd
aguagccuauaacg

SEQ ID NO: 701529 - RNA, 21 nt, Haemophilus influenzae Rd
aguaucuugcuuuuuuaauca

SEQ ID NO: 701530 - RNA, 15 nt, Haemophilus influenzae Rd
aguauauuuaucuaa

SEQ ID NO: 701531 - RNA, 23 nt, Haemophilus influenzae Rd
aguauaucgaauuaaagaaaaac

SEQ ID NO: 701532 - RNA, 22 nt, Haemophilus influenzae Rd
aguaucaaauacacaaaucaca

SEQ ID NO: 701533 - RNA, 16 nt, Haemophilus influenzae Rd
aguaucaaucauauca

SEQ ID NO: 701534 - RNA, 20 nt, Haemophilus influenzae Rd
aguauaacguagcgauaaaa

SEQ ID NO: 701535 - RNA, 17 nt, Haemophilus influenzae Rd
aguauaacuaauuaaga

SEQ ID NO: 701536 - RNA, 16 nt, Haemophilus influenzae Rd
aguauaagcaaugcaa

SEQ ID NO: 701537 - RNA, 19 nt, Haemophilus influenzae Rd
aguauucauauaauucauu

SEQ ID NO: 701538 - RNA, 20 nt, Haemophilus influenzae Rd
aguauuuacuaaauuauuug

SEQ ID NO: 701539 - RNA, 18 nt, Haemophilus influenzae Rd
aguauuuagcggaauuuu

SEQ ID NO: 701540 - RNA, 15 nt, Haemophilus influenzae Rd
aguaugccauaaaau

SEQ ID NO: 701541 - RNA, 22 nt, Haemophilus influenzae Rd
aguaugaugauuguuauuguga

SEQ ID NO: 701542 - RNA, 23 nt, Haemophilus influenzae Rd
aguaugaugauuguuauugugau

SEQ ID NO: 701543 - RNA, 17 nt, Haemophilus influenzae Rd
aguaugggguuaaaaag

SEQ ID NO: 701544 - RNA, 15 nt, Haemophilus influenzae Rd
aguauggcaagugca

SEQ ID NO: 701545 - RNA, 13 nt, Haemophilus influenzae Rd
aguauguugcuuu

SEQ ID NO: 701546 - RNA, 17 nt, Haemophilus influenzae Rd
aguauuaaauuuuuaau

SEQ ID NO: 701547 - RNA, 20 nt, Haemophilus influenzae Rd
aggcggauuuauuauuuaau

SEQ ID NO: 701548 - RNA, 19 nt, Haemophilus influenzae Rd
aggcuuguuguucaaaauu

SEQ ID NO: 701549 - RNA, 18 nt, Haemophilus influenzae Rd
aggcuuuaauuuuaucua

SEQ ID NO: 701550 - RNA, 16 nt, Haemophilus influenzae Rd
aggcuuucauuuucca

SEQ ID NO: 701551 - RNA, 18 nt, Haemophilus influenzae Rd
aggcuuucacuauuucau

SEQ ID NO: 701552 - RNA, 18 nt, Haemophilus influenzae Rd
agggaaaauuuuaaacag

SEQ ID NO: 701553 - RNA, 23 nt, Haemophilus influenzae Rd
agggaaauguacuggcucuucuu

SEQ ID NO: 701554 - RNA, 14 nt, Haemophilus influenzae Rd
agggaaauuuauua

SEQ ID NO: 701555 - RNA, 16 nt, Haemophilus influenzae Rd
agggauuugaaaaucu

SEQ ID NO: 701556 - RNA, 13 nt, Haemophilus influenzae Rd
agggauuuuaaau

SEQ ID NO: 701557 - RNA, 15 nt, Haemophilus influenzae Rd
agggauuuuaaguuu

SEQ ID NO: 701558 - RNA, 19 nt, Haemophilus influenzae Rd
agggauuuuaaguuucacu

SEQ ID NO: 701559 - RNA, 21 nt, Haemophilus influenzae Rd
agggauuuuaauuaucuaaau

SEQ ID NO: 701560 - RNA, 12 nt, Haemophilus influenzae Rd
agggauuuucau

SEQ ID NO: 701561 - RNA, 15 nt, Haemophilus influenzae Rd
agggauuuucaucca

SEQ ID NO: 701562 - RNA, 23 nt, Haemophilus influenzae Rd
agggaauaaaaaagccuugauuu

SEQ ID NO: 701563 - RNA, 16 nt, Haemophilus influenzae Rd
aggggcugaucuacac

SEQ ID NO: 701564 - RNA, 21 nt, Haemophilus influenzae Rd
agggcugcgcccauuggaaua

SEQ ID NO: 701565 - RNA, 17 nt, Haemophilus influenzae Rd
agggcugauuuuaaaua

SEQ ID NO: 701566 - RNA, 24 nt, Haemophilus influenzae Rd
agguacuaauuguuguaaaauagu

SEQ ID NO: 701567 - RNA, 21 nt, Haemophilus influenzae Rd
agguacuuggauugcaugaaa

SEQ ID NO: 701568 - RNA, 23 nt, Haemophilus influenzae Rd
agguacuuggauugcaugaaaug

SEQ ID NO: 701569 - RNA, 16 nt, Haemophilus influenzae Rd
agguacacggccguaa

SEQ ID NO: 701570 - RNA, 12 nt, Haemophilus influenzae Rd
agguaauugcca

SEQ ID NO: 701571 - RNA, 20 nt, Haemophilus influenzae Rd
agguaguuuagcuaauccuu

SEQ ID NO: 701572 - RNA, 14 nt, Haemophilus influenzae Rd
agguaguuuucaau

SEQ ID NO: 701573 - RNA, 17 nt, Haemophilus influenzae Rd
agguauaaauaauuuuc

SEQ ID NO: 701574 - RNA, 20 nt, Haemophilus influenzae Rd
agguacuuuuacgacuaauu

SEQ ID NO: 701575 - RNA, 13 nt, Haemophilus influenzae Rd
aggguaauuuuuu

SEQ ID NO: 701576 - RNA, 21 nt, Haemophilus influenzae Rd
agguaauaauagguuguccac

SEQ ID NO: 701577 - RNA, 20 nt, Haemophilus influenzae Rd
aggucauuagagccuacauu

SEQ ID NO: 701578 - RNA, 15 nt, Haemophilus influenzae Rd
aggugcagauuaaau

SEQ ID NO: 701579 - RNA, 18 nt, Haemophilus influenzae Rd
aggugcuuuuaaauuuuu

SEQ ID NO: 701580 - RNA, 12 nt, Haemophilus influenzae Rd
aggugcuuuuug

SEQ ID NO: 701581 - RNA, 15 nt, Haemophilus influenzae Rd
aggugcuuuuugcua

SEQ ID NO: 701582 - RNA, 13 nt, Haemophilus influenzae Rd
aggagcaaucuuu

SEQ ID NO: 701583 - RNA, 14 nt, Haemophilus influenzae Rd
aggagcaaucuuuu

SEQ ID NO: 701584 - RNA, 18 nt, Haemophilus influenzae Rd
aggagccaaauuuaaaaa

SEQ ID NO: 701585 - RNA, 23 nt, Haemophilus influenzae Rd
aggagccaaauuuaaaaaagccg

SEQ ID NO: 701586 - RNA, 17 nt, Haemophilus influenzae Rd
aggauuucuaaaguuuc

SEQ ID NO: 701587 - RNA, 13 nt, Haemophilus influenzae Rd
aggauugccuuca

SEQ ID NO: 701588 - RNA, 12 nt, Haemophilus influenzae Rd
aggauugcguuc

SEQ ID NO: 701589 - RNA, 15 nt, Haemophilus influenzae Rd
aggcaagcucuauuu

SEQ ID NO: 701590 - RNA, 16 nt, Haemophilus influenzae Rd
aggcacauaaguaaaa

SEQ ID NO: 701591 - RNA, 14 nt, Haemophilus influenzae Rd
aggcaaaaucgcaa

SEQ ID NO: 701592 - RNA, 17 nt, Haemophilus influenzae Rd
aggcaaaaucgcaauau

SEQ ID NO: 701593 - RNA, 19 nt, Haemophilus influenzae Rd
aggauuuuugaauuucacu

SEQ ID NO: 701594 - RNA, 13 nt, Haemophilus influenzae Rd
aggauuuuugccg

SEQ ID NO: 701595 - RNA, 17 nt, Haemophilus influenzae Rd
aggauuugccucuucuu

SEQ ID NO: 701596 - RNA, 18 nt, Haemophilus influenzae Rd
aggauuugccucuucuuu

SEQ ID NO: 701597 - RNA, 20 nt, Haemophilus influenzae Rd
aggauuuggcacuaaagcaa

SEQ ID NO: 701598 - RNA, 18 nt, Haemophilus influenzae Rd
aggcauuuuuucugcauu

SEQ ID NO: 701599 - RNA, 22 nt, Haemophilus influenzae Rd
aggcauugcgccuuuuuggaaa

SEQ ID NO: 701600 - RNA, 15 nt, Haemophilus influenzae Rd
aggcauugcugugcg

SEQ ID NO: 701601 - RNA, 22 nt, Haemophilus influenzae Rd
aggcauuaugccuacuuuuuau

SEQ ID NO: 701602 - RNA, 15 nt, Haemophilus influenzae Rd
aggcauuauguaaua

SEQ ID NO: 701603 - RNA, 21 nt, Haemophilus influenzae Rd
aggcacugauuuuuuuauaau

SEQ ID NO: 701604 - RNA, 19 nt, Haemophilus influenzae Rd
aggcaccgugcgugaaugu

SEQ ID NO: 701605 - RNA, 18 nt, Haemophilus influenzae Rd
aggcgagugcggcaaagg

SEQ ID NO: 701606 - RNA, 22 nt, Haemophilus influenzae Rd
aggcgaucugcuaauagaacug

SEQ ID NO: 701607 - RNA, 18 nt, Haemophilus influenzae Rd
aggccuccgccaagugcg

SEQ ID NO: 701608 - RNA, 17 nt, Haemophilus influenzae Rd
aggcgaacauaacuuuu

SEQ ID NO: 701609 - RNA, 14 nt, Haemophilus influenzae Rd
agcugugcaaaacu

SEQ ID NO: 701610 - RNA, 19 nt, Haemophilus influenzae Rd
agcugugcaaaacuaguca

SEQ ID NO: 701611 - RNA, 14 nt, Haemophilus influenzae Rd
agcugugguaaaua

SEQ ID NO: 701612 - RNA, 20 nt, Haemophilus influenzae Rd
agcugcauuucaauuucacu

SEQ ID NO: 701613 - RNA, 17 nt, Haemophilus influenzae Rd
agcugcauaaagcucag

SEQ ID NO: 701614 - RNA, 15 nt, Haemophilus influenzae Rd
agcugccgaauagau

SEQ ID NO: 701615 - RNA, 21 nt, Haemophilus influenzae Rd
agcugcucuuuaggaucacua

SEQ ID NO: 701616 - RNA, 22 nt, Haemophilus influenzae Rd
agcugcucuuuaggaucacuaa

SEQ ID NO: 701617 - RNA, 15 nt, Haemophilus influenzae Rd
agcugcugcuuuaac

SEQ ID NO: 701618 - RNA, 19 nt, Haemophilus influenzae Rd
agcugcugcuuuaacaauu

SEQ ID NO: 701619 - RNA, 17 nt, Haemophilus influenzae Rd
agcugcugcaagauuug

SEQ ID NO: 701620 - RNA, 22 nt, Haemophilus influenzae Rd
agcugcuuaauuaacgggcuua

SEQ ID NO: 701621 - RNA, 22 nt, Haemophilus influenzae Rd
agcuuccgcuuuuuucgcacca

SEQ ID NO: 701622 - RNA, 15 nt, Haemophilus influenzae Rd
agcuucuaauuuuug

SEQ ID NO: 701623 - RNA, 16 nt, Haemophilus influenzae Rd
agcuuagauacauaaa

SEQ ID NO: 701624 - RNA, 12 nt, Haemophilus influenzae Rd
agcuugauuuuc

SEQ ID NO: 701625 - RNA, 17 nt, Haemophilus influenzae Rd
agcuugcagauugcuga

SEQ ID NO: 701626 - RNA, 16 nt, Haemophilus influenzae Rd
agcuucugccagcaug

SEQ ID NO: 701627 - RNA, 21 nt, Haemophilus influenzae Rd
agcuugccgcugcagcaggaa

SEQ ID NO: 701628 - RNA, 19 nt, Haemophilus influenzae Rd
aggaagcucgguaaaaauc

SEQ ID NO: 701629 - RNA, 21 nt, Haemophilus influenzae Rd
aggaauuucgacauauucuac

SEQ ID NO: 701630 - RNA, 15 nt, Haemophilus influenzae Rd
aggagaaagcuugcu

SEQ ID NO: 701631 - RNA, 19 nt, Haemophilus influenzae Rd
aggagaaucagaguuaaaa

SEQ ID NO: 701632 - RNA, 16 nt, Haemophilus influenzae Rd
aggacuuaaauuuggc

SEQ ID NO: 701633 - RNA, 13 nt, Haemophilus influenzae Rd
aggagaaauaauc

SEQ ID NO: 701634 - RNA, 14 nt, Haemophilus influenzae Rd
aggaccaagcaaug

SEQ ID NO: 701635 - RNA, 17 nt, Haemophilus influenzae Rd
agcuuguuggaaaaaug

SEQ ID NO: 701636 - RNA, 18 nt, Haemophilus influenzae Rd
agcuuguuggaaaaaugc

SEQ ID NO: 701637 - RNA, 23 nt, Haemophilus influenzae Rd
aggaaagugcggucaacauaaag

SEQ ID NO: 701638 - RNA, 17 nt, Haemophilus influenzae Rd
aggaacaagaccugcuu

SEQ ID NO: 701639 - RNA, 13 nt, Haemophilus influenzae Rd
aggaagcauuucu

SEQ ID NO: 701640 - RNA, 16 nt, Haemophilus influenzae Rd
agaaaagcauuaauag

SEQ ID NO: 701641 - RNA, 16 nt, Haemophilus influenzae Rd
agaaaacucauccaau

SEQ ID NO: 701642 - RNA, 16 nt, Haemophilus influenzae Rd
agaaaagacaauaauu

SEQ ID NO: 701643 - RNA, 13 nt, Haemophilus influenzae Rd
agaaaccaacaga

SEQ ID NO: 701644 - RNA, 14 nt, Haemophilus influenzae Rd
agaaaccaauaauu

SEQ ID NO: 701645 - RNA, 21 nt, Haemophilus influenzae Rd
agaaaccacuaucggugaaga

SEQ ID NO: 701646 - RNA, 16 nt, Haemophilus influenzae Rd
agaaaccagaaauaga

SEQ ID NO: 701647 - RNA, 19 nt, Haemophilus influenzae Rd
agaaaauaaugaacgccgc

SEQ ID NO: 701648 - RNA, 20 nt, Haemophilus influenzae Rd
agaaaauaaccaauauaauu

SEQ ID NO: 701649 - RNA, 20 nt, Haemophilus influenzae Rd
agaaaauacaauaucuagca

SEQ ID NO: 701650 - RNA, 21 nt, Haemophilus influenzae Rd
agaaaagcgaauuucuuaaaa

SEQ ID NO: 701651 - RNA, 14 nt, Haemophilus influenzae Rd
agaaaauaaauaag

SEQ ID NO: 701652 - RNA, 15 nt, Haemophilus influenzae Rd
agaaaauaaauaagg

SEQ ID NO: 701653 - RNA, 18 nt, Haemophilus influenzae Rd
agaaaauaaauaaggcac

SEQ ID NO: 701654 - RNA, 17 nt, Haemophilus influenzae Rd
acuuuuuaucuaaaaaa

SEQ ID NO: 701655 - RNA, 20 nt, Haemophilus influenzae Rd
acuuuuuaucuaaaaaagag

SEQ ID NO: 701656 - RNA, 21 nt, Haemophilus influenzae Rd
acuuuuuagcucguugccaua

SEQ ID NO: 701657 - RNA, 20 nt, Haemophilus influenzae Rd
acuuuuuauuaguuacaaac

SEQ ID NO: 701658 - RNA, 21 nt, Haemophilus influenzae Rd
acuuuuuauucaaaucgauca

SEQ ID NO: 701659 - RNA, 20 nt, Haemophilus influenzae Rd
agaaaacaauaaaaaaacuu

SEQ ID NO: 701660 - RNA, 15 nt, Haemophilus influenzae Rd
agaaaaauuguguaa

SEQ ID NO: 701661 - RNA, 15 nt, Haemophilus influenzae Rd
agaaaacaaacgaug

SEQ ID NO: 701662 - RNA, 19 nt, Haemophilus influenzae Rd
acuuuugguggauuauaaa

SEQ ID NO: 701663 - RNA, 21 nt, Haemophilus influenzae Rd
acuuuuguuaucuacuuaauu

SEQ ID NO: 701664 - RNA, 14 nt, Haemophilus influenzae Rd
acuuuuuaauaaau

SEQ ID NO: 701665 - RNA, 18 nt, Haemophilus influenzae Rd
acuuuuuaauaaaucaag

SEQ ID NO: 701666 - RNA, 22 nt, Haemophilus influenzae Rd
acuuuugcccacgcacuuuucc

SEQ ID NO: 701667 - RNA, 18 nt, Haemophilus influenzae Rd
acuuuugcacugcaauga

SEQ ID NO: 701668 - RNA, 21 nt, Haemophilus influenzae Rd
acuuuugcauuugcuaagauu

SEQ ID NO: 701669 - RNA, 18 nt, Haemophilus influenzae Rd
acuuuuggauaaaguauu

SEQ ID NO: 701670 - RNA, 24 nt, Haemophilus influenzae Rd
acuuuuggauaaaguauucauaua

SEQ ID NO: 701671 - RNA, 21 nt, Haemophilus influenzae Rd
acuugauauaaguucuaaaua

SEQ ID NO: 701672 - RNA, 23 nt, Haemophilus influenzae Rd
acuugauguuuuugaaguaaaaa

SEQ ID NO: 701673 - RNA, 22 nt, Haemophilus influenzae Rd
acuuuugaucugcacuccaaaa

SEQ ID NO: 701674 - RNA, 18 nt, Haemophilus influenzae Rd
acuuuugauuuauuaaua

SEQ ID NO: 701675 - RNA, 13 nt, Haemophilus influenzae Rd
acuugcaaaccaa

SEQ ID NO: 701676 - RNA, 17 nt, Haemophilus influenzae Rd
acuugcaaaccaaccua

SEQ ID NO: 701677 - RNA, 18 nt, Haemophilus influenzae Rd
acuuuugcaaaauugcuu

SEQ ID NO: 701678 - RNA, 11 nt, Haemophilus influenzae Rd
agaaagaaauc

SEQ ID NO: 701679 - RNA, 15 nt, Haemophilus influenzae Rd
agaaagaaaucccac

SEQ ID NO: 701680 - RNA, 17 nt, Haemophilus influenzae Rd
agaaacuuucaaaauac

SEQ ID NO: 701681 - RNA, 19 nt, Haemophilus influenzae Rd
agaaacuuucaaaauacga

SEQ ID NO: 701682 - RNA, 12 nt, Haemophilus influenzae Rd
agaaagauuaca

SEQ ID NO: 701683 - RNA, 19 nt, Haemophilus influenzae Rd
agaaagauaggauuccacu

SEQ ID NO: 701684 - RNA, 16 nt, Haemophilus influenzae Rd
agaaagacgauauuuu

SEQ ID NO: 701685 - RNA, 20 nt, Haemophilus influenzae Rd
agaaagacgauauuuuccuu

SEQ ID NO: 701686 - RNA, 16 nt, Haemophilus influenzae Rd
agaaagaguaauccaa

SEQ ID NO: 701687 - RNA, 13 nt, Haemophilus influenzae Rd
agaaagaauauaa

SEQ ID NO: 701688 - RNA, 15 nt, Haemophilus influenzae Rd
agaaagaauauuuaa

SEQ ID NO: 701689 - RNA, 15 nt, Haemophilus influenzae Rd
agaaagggauuuuaa

SEQ ID NO: 701690 - RNA, 16 nt, Haemophilus influenzae Rd
agaaagggauuuuaau

SEQ ID NO: 701691 - RNA, 15 nt, Haemophilus influenzae Rd
agaaaguaaacaauu

SEQ ID NO: 701692 - RNA, 18 nt, Haemophilus influenzae Rd
agaaagguguaauuccau

SEQ ID NO: 701693 - RNA, 23 nt, Haemophilus influenzae Rd
agaaagcuaaugguuggaagaaa

SEQ ID NO: 701694 - RNA, 14 nt, Haemophilus influenzae Rd
agaaauaaguugau

SEQ ID NO: 701695 - RNA, 10 nt, Haemophilus influenzae Rd
agaaauaaua

SEQ ID NO: 701696 - RNA, 16 nt, Haemophilus influenzae Rd
agaaauaauauaaccu

SEQ ID NO: 701697 - RNA, 17 nt, Haemophilus influenzae Rd
agaaauacauuauuaaa

SEQ ID NO: 701698 - RNA, 20 nt, Haemophilus influenzae Rd
agaaauaccgauaauauguu

SEQ ID NO: 701699 - RNA, 21 nt, Haemophilus influenzae Rd
agaaauaccgauaauauguuu

SEQ ID NO: 701700 - RNA, 14 nt, Haemophilus influenzae Rd
agaaauaacgucau

SEQ ID NO: 701701 - RNA, 18 nt, Haemophilus influenzae Rd
agaaauaacgucauuaau

SEQ ID NO: 701702 - RNA, 14 nt, Haemophilus influenzae Rd
agaaagucauuaau

SEQ ID NO: 701703 - RNA, 13 nt, Haemophilus influenzae Rd
agaaaguaaugga

SEQ ID NO: 701704 - RNA, 23 nt, Haemophilus influenzae Rd
agaaaguuuaacuuucaacacgg

SEQ ID NO: 701705 - RNA, 12 nt, Haemophilus influenzae Rd
agaaaguuuuaa

SEQ ID NO: 701706 - RNA, 12 nt, Haemophilus influenzae Rd
agaaaguuuuac

SEQ ID NO: 701707 - RNA, 16 nt, Haemophilus influenzae Rd
agaaaguuuuauccau

SEQ ID NO: 701708 - RNA, 15 nt, Haemophilus influenzae Rd
agaagcugaauaaaa

SEQ ID NO: 701709 - RNA, 22 nt, Haemophilus influenzae Rd
agaagauuuaaaacaagaaccg

SEQ ID NO: 701710 - RNA, 21 nt, Haemophilus influenzae Rd
agaagauuuauauaccuuaac

SEQ ID NO: 701711 - RNA, 22 nt, Haemophilus influenzae Rd
agaacuauuauuccaaauaucu

SEQ ID NO: 701712 - RNA, 15 nt, Haemophilus influenzae Rd
agaaccgucuuuaaa

SEQ ID NO: 701713 - RNA, 23 nt, Haemophilus influenzae Rd
agaacuuagcccuuaaacuaaau

SEQ ID NO: 701714 - RNA, 19 nt, Haemophilus influenzae Rd
agaacuucaaauuguacuu

SEQ ID NO: 701715 - RNA, 21 nt, Haemophilus influenzae Rd
agaaauugauauaaauggguu

SEQ ID NO: 701716 - RNA, 23 nt, Haemophilus influenzae Rd
agaaauucacucaauucaaagaa

SEQ ID NO: 701717 - RNA, 12 nt, Haemophilus influenzae Rd
agaaauauauuu

SEQ ID NO: 701718 - RNA, 14 nt, Haemophilus influenzae Rd
agaaauauauuugu

SEQ ID NO: 701719 - RNA, 19 nt, Haemophilus influenzae Rd
agaaauauauuuguuuuua

SEQ ID NO: 701720 - RNA, 17 nt, Haemophilus influenzae Rd
agaaauaugauuuagaa

SEQ ID NO: 701721 - RNA, 23 nt, Haemophilus influenzae Rd
agaaauaugauuuagaacaauau

SEQ ID NO: 701722 - RNA, 22 nt, Haemophilus influenzae Rd
aaaacaauggcugaaaaauuca

SEQ ID NO: 701723 - RNA, 16 nt, Haemophilus influenzae Rd
agaaauaugaaauuuc

SEQ ID NO: 701724 - RNA, 20 nt, Haemophilus influenzae Rd
agaaauaugaaauuucuuua

SEQ ID NO: 701725 - RNA, 15 nt, Haemophilus influenzae Rd
agaaaucaaaaaugc

SEQ ID NO: 701726 - RNA, 16 nt, Haemophilus influenzae Rd
agaaauauaauaaaua

SEQ ID NO: 701727 - RNA, 23 nt, Haemophilus influenzae Rd
agaaauacuuuuagcuccuaaau

SEQ ID NO: 701728 - RNA, 18 nt, Haemophilus influenzae Rd
agaaauagauuauuagca

SEQ ID NO: 701729 - RNA, 16 nt, Haemophilus influenzae Rd
agaacagguugcugau

SEQ ID NO: 701730 - RNA, 17 nt, Haemophilus influenzae Rd
agaacagguugcugaua

SEQ ID NO: 701731 - RNA, 17 nt, Haemophilus influenzae Rd
agaacccgcuaaaguuc

SEQ ID NO: 701732 - RNA, 17 nt, Haemophilus influenzae Rd
agaaauugccauauaag

SEQ ID NO: 701733 - RNA, 13 nt, Haemophilus influenzae Rd
agaacaauauuua

SEQ ID NO: 701734 - RNA, 14 nt, Haemophilus influenzae Rd
agaacaauauuuau

SEQ ID NO: 701735 - RNA, 20 nt, Haemophilus influenzae Rd
agaacaauauuuauaaugug

SEQ ID NO: 701736 - RNA, 14 nt, Haemophilus influenzae Rd
agaacaauacucuu

SEQ ID NO: 701737 - RNA, 23 nt, Haemophilus influenzae Rd
agaacaauacucuuaacaaaaca

SEQ ID NO: 701738 - RNA, 14 nt, Haemophilus influenzae Rd
agaagucagcaaua

SEQ ID NO: 701739 - RNA, 11 nt, Haemophilus influenzae Rd
agaaguaaauu

SEQ ID NO: 701740 - RNA, 14 nt, Haemophilus influenzae Rd
agaaguaaaaagaa

SEQ ID NO: 701741 - RNA, 21 nt, Haemophilus influenzae Rd
agaagggaugauugacgaaaa

SEQ ID NO: 701742 - RNA, 23 nt, Haemophilus influenzae Rd
agaaucgcccacgaaaagcacuu

SEQ ID NO: 701743 - RNA, 17 nt, Haemophilus influenzae Rd
agaaugauuaucuagaa

SEQ ID NO: 701744 - RNA, 21 nt, Haemophilus influenzae Rd
agaaugauuaucuagaaaacu

SEQ ID NO: 701745 - RNA, 13 nt, Haemophilus influenzae Rd
agaaugcaaacau

SEQ ID NO: 701746 - RNA, 14 nt, Haemophilus influenzae Rd
agaaugcaaacauu

SEQ ID NO: 701747 - RNA, 15 nt, Haemophilus influenzae Rd
agaaugcaaacauuu

SEQ ID NO: 701748 - RNA, 16 nt, Haemophilus influenzae Rd
agaaugcaaacauuug

SEQ ID NO: 701749 - RNA, 17 nt, Haemophilus influenzae Rd
agaauguagcugaaacu

SEQ ID NO: 701750 - RNA, 14 nt, Haemophilus influenzae Rd
agaauguaaauuau

SEQ ID NO: 701751 - RNA, 20 nt, Haemophilus influenzae Rd
agaaugucagguuuaucuac

SEQ ID NO: 701752 - RNA, 20 nt, Haemophilus influenzae Rd
agaauuaagaucuaaaccua

SEQ ID NO: 701753 - RNA, 15 nt, Haemophilus influenzae Rd
agaauguuuugauug

SEQ ID NO: 701754 - RNA, 14 nt, Haemophilus influenzae Rd
agaauuaaaaaugg

SEQ ID NO: 701755 - RNA, 18 nt, Haemophilus influenzae Rd
agaauugaucaaaauuau

SEQ ID NO: 701756 - RNA, 15 nt, Haemophilus influenzae Rd
agaauuggggucgcu

SEQ ID NO: 701757 - RNA, 22 nt, Haemophilus influenzae Rd
agacaacgcuucuuuaacuugc

SEQ ID NO: 701758 - RNA, 20 nt, Haemophilus influenzae Rd
agacaauauaauuaucaaca

SEQ ID NO: 701759 - RNA, 15 nt, Haemophilus influenzae Rd
agacaauauugaaau

SEQ ID NO: 701760 - RNA, 16 nt, Haemophilus influenzae Rd
agacaauauugaaaua

SEQ ID NO: 701761 - RNA, 19 nt, Haemophilus influenzae Rd
agacaauauugaaauaaga

SEQ ID NO: 701762 - RNA, 15 nt, Haemophilus influenzae Rd
agacaaaacuuauca

SEQ ID NO: 701763 - RNA, 17 nt, Haemophilus influenzae Rd
agacaaaacuuaucauu

SEQ ID NO: 701764 - RNA, 16 nt, Haemophilus influenzae Rd
agaauuuuuauuuuua

SEQ ID NO: 701765 - RNA, 13 nt, Haemophilus influenzae Rd
agaauuuugguua

SEQ ID NO: 701766 - RNA, 18 nt, Haemophilus influenzae Rd
agacagaagaaguaaaaa

SEQ ID NO: 701767 - RNA, 15 nt, Haemophilus influenzae Rd
agacagcuauuaaaa

SEQ ID NO: 701768 - RNA, 18 nt, Haemophilus influenzae Rd
agacagcuauuaaaaaaa

SEQ ID NO: 701769 - RNA, 18 nt, Haemophilus influenzae Rd
agaccgcacuuugcacuu

SEQ ID NO: 701770 - RNA, 16 nt, Haemophilus influenzae Rd
agaccgauuucuacca

SEQ ID NO: 701771 - RNA, 20 nt, Haemophilus influenzae Rd
agacgcauucuuucucuuuu

SEQ ID NO: 701772 - RNA, 15 nt, Haemophilus influenzae Rd
agacggucaaauuca

SEQ ID NO: 701773 - RNA, 21 nt, Haemophilus influenzae Rd
aaaacauaauccgcaucuaaa

SEQ ID NO: 701774 - RNA, 21 nt, Haemophilus influenzae Rd
aaaacauaauaaaauuuauua

SEQ ID NO: 701775 - RNA, 15 nt, Haemophilus influenzae Rd
agaccaaacuccccu

SEQ ID NO: 701776 - RNA, 15 nt, Haemophilus influenzae Rd
agaccaaaaaucgca

SEQ ID NO: 701777 - RNA, 13 nt, Haemophilus influenzae Rd
agaccacaugaau

SEQ ID NO: 701778 - RNA, 22 nt, Haemophilus influenzae Rd
agacauagaaaguuuaacuuuc

SEQ ID NO: 701779 - RNA, 19 nt, Haemophilus influenzae Rd
agagcaccaaauuaaaaau

SEQ ID NO: 701780 - RNA, 15 nt, Haemophilus influenzae Rd
agagccuuuuucuaa

SEQ ID NO: 701781 - RNA, 20 nt, Haemophilus influenzae Rd
agagcuuacuucuacuucuu

SEQ ID NO: 701782 - RNA, 22 nt, Haemophilus influenzae Rd
agagaugugcauaucaagagaa

SEQ ID NO: 701783 - RNA, 13 nt, Haemophilus influenzae Rd
agagcaagcaaua

SEQ ID NO: 701784 - RNA, 15 nt, Haemophilus influenzae Rd
agagauuauuugcau

SEQ ID NO: 701785 - RNA, 23 nt, Haemophilus influenzae Rd
agagauuauuugcauauaaaaaa

SEQ ID NO: 701786 - RNA, 15 nt, Haemophilus influenzae Rd
agacuaaaaccacau

SEQ ID NO: 701787 - RNA, 13 nt, Haemophilus influenzae Rd
agaggcaauuuua

SEQ ID NO: 701788 - RNA, 22 nt, Haemophilus influenzae Rd
agaggcauaacccaccaaauua

SEQ ID NO: 701789 - RNA, 14 nt, Haemophilus influenzae Rd
agaggagguagaaa

SEQ ID NO: 701790 - RNA, 19 nt, Haemophilus influenzae Rd
agaggcucugaucacaaug

SEQ ID NO: 701791 - RNA, 18 nt, Haemophilus influenzae Rd
agaggggauaaaauaaac

SEQ ID NO: 701792 - RNA, 13 nt, Haemophilus influenzae Rd
agagguggaacaa

SEQ ID NO: 701793 - RNA, 20 nt, Haemophilus influenzae Rd
agaguaaauuuaacaauccc

SEQ ID NO: 701794 - RNA, 17 nt, Haemophilus influenzae Rd
agauccaaagacuaaaa

SEQ ID NO: 701795 - RNA, 22 nt, Haemophilus influenzae Rd
agauccaaagacuaaaaccaca

SEQ ID NO: 701796 - RNA, 15 nt, Haemophilus influenzae Rd
agaucauuuuuuuaa

SEQ ID NO: 701797 - RNA, 13 nt, Haemophilus influenzae Rd
agaucagaaaacg

SEQ ID NO: 701798 - RNA, 22 nt, Haemophilus influenzae Rd
agaucagauuuuuuucagaaau

SEQ ID NO: 701799 - RNA, 23 nt, Haemophilus influenzae Rd
agaucagauuuuuuucagaaaug

SEQ ID NO: 701800 - RNA, 20 nt, Haemophilus influenzae Rd
agaucagccccuuaauuauu

SEQ ID NO: 701801 - RNA, 16 nt, Haemophilus influenzae Rd
agaucaggaucaaaaa

SEQ ID NO: 701802 - RNA, 18 nt, Haemophilus influenzae Rd
agaucaggaucaaaaaua

SEQ ID NO: 701803 - RNA, 19 nt, Haemophilus influenzae Rd
agaucaggaucaaaaauau

SEQ ID NO: 701804 - RNA, 20 nt, Haemophilus influenzae Rd
agauaugugaauaaaaucaa

SEQ ID NO: 701805 - RNA, 21 nt, Haemophilus influenzae Rd
agauagagccaacucaucaaa

SEQ ID NO: 701806 - RNA, 15 nt, Haemophilus influenzae Rd
agauagcaaaauaug

SEQ ID NO: 701807 - RNA, 15 nt, Haemophilus influenzae Rd
agauagcacuuguuu

SEQ ID NO: 701808 - RNA, 12 nt, Haemophilus influenzae Rd
agauaauaaaau

SEQ ID NO: 701809 - RNA, 15 nt, Haemophilus influenzae Rd
agauacgaaauagcg

SEQ ID NO: 701810 - RNA, 18 nt, Haemophilus influenzae Rd
agauaaguggggaaaaau

SEQ ID NO: 701811 - RNA, 17 nt, Haemophilus influenzae Rd
agauaauaaauauaauu

SEQ ID NO: 701812 - RNA, 16 nt, Haemophilus influenzae Rd
agauacuacacccaaa

SEQ ID NO: 701813 - RNA, 20 nt, Haemophilus influenzae Rd
agauaaaucagcgaguuuga

SEQ ID NO: 701814 - RNA, 15 nt, Haemophilus influenzae Rd
agauaaauaaauuca

SEQ ID NO: 701815 - RNA, 14 nt, Haemophilus influenzae Rd
agauaaauaucaaa

SEQ ID NO: 701816 - RNA, 12 nt, Haemophilus influenzae Rd
agauaaaauuuu

SEQ ID NO: 701817 - RNA, 14 nt, Haemophilus influenzae Rd
agauaaaauuuuua

SEQ ID NO: 701818 - RNA, 16 nt, Haemophilus influenzae Rd
agaguguuauaaagcu

SEQ ID NO: 701819 - RNA, 18 nt, Haemophilus influenzae Rd
agaguaaguaaccauaaa

SEQ ID NO: 701820 - RNA, 19 nt, Haemophilus influenzae Rd
agaguaauagcuucuuuua

SEQ ID NO: 701821 - RNA, 18 nt, Haemophilus influenzae Rd
agaugacgaaaugaaauu

SEQ ID NO: 701822 - RNA, 16 nt, Haemophilus influenzae Rd
agaugacuggcaaaaa

SEQ ID NO: 701823 - RNA, 23 nt, Haemophilus influenzae Rd
agaugacuuguuucauaaaaaau

SEQ ID NO: 701824 - RNA, 20 nt, Haemophilus influenzae Rd
aaaaccgcagcuaauccaaa

SEQ ID NO: 701825 - RNA, 23 nt, Haemophilus influenzae Rd
aaaaccgcagcuaauccaaauca

SEQ ID NO: 701826 - RNA, 17 nt, Haemophilus influenzae Rd
aaaaccauuaaccccau

SEQ ID NO: 701827 - RNA, 16 nt, Haemophilus influenzae Rd
aaaacccaguuuaaaa

SEQ ID NO: 701828 - RNA, 21 nt, Haemophilus influenzae Rd
aaaacccgaaccgauuuuaaa

SEQ ID NO: 701829 - RNA, 16 nt, Haemophilus influenzae Rd
agaugucaaaugugac

SEQ ID NO: 701830 - RNA, 17 nt, Haemophilus influenzae Rd
agauggcuauuuaagcc

SEQ ID NO: 701831 - RNA, 19 nt, Haemophilus influenzae Rd
agauggcuauuuaagccuu

SEQ ID NO: 701832 - RNA, 16 nt, Haemophilus influenzae Rd
agaugccauuucgcuu

SEQ ID NO: 701833 - RNA, 12 nt, Haemophilus influenzae Rd
agaugcauuuuu

SEQ ID NO: 701834 - RNA, 18 nt, Haemophilus influenzae Rd
agaugcauuuuuuaaucu

SEQ ID NO: 701835 - RNA, 22 nt, Haemophilus influenzae Rd
agauuacguagaaaacaauaaa

SEQ ID NO: 701836 - RNA, 22 nt, Haemophilus influenzae Rd
agauuagaucgauuuuccucuu

SEQ ID NO: 701837 - RNA, 18 nt, Haemophilus influenzae Rd
agauuaaucuuuuuucuu

SEQ ID NO: 701838 - RNA, 22 nt, Haemophilus influenzae Rd
agauuaauuuuuuauaaaauuu

SEQ ID NO: 701839 - RNA, 23 nt, Haemophilus influenzae Rd
agauuaauuuuuuauaaaauuuc

SEQ ID NO: 701840 - RNA, 20 nt, Haemophilus influenzae Rd
agauuacccacuaaguauua

SEQ ID NO: 701841 - RNA, 15 nt, Haemophilus influenzae Rd
agauuacgcuuuacu

SEQ ID NO: 701842 - RNA, 16 nt, Haemophilus influenzae Rd
agauuacgcuuuacua

SEQ ID NO: 701843 - RNA, 17 nt, Haemophilus influenzae Rd
agaugugauauuaaaca

SEQ ID NO: 701844 - RNA, 23 nt, Haemophilus influenzae Rd
agauucaucuucagcauuuaaaa

SEQ ID NO: 701845 - RNA, 16 nt, Haemophilus influenzae Rd
agauucaucaaaguaa

SEQ ID NO: 701846 - RNA, 21 nt, Haemophilus influenzae Rd
agauucauuguuucucaauaa

SEQ ID NO: 701847 - RNA, 14 nt, Haemophilus influenzae Rd
agauucaacaauaa

SEQ ID NO: 701848 - RNA, 20 nt, Haemophilus influenzae Rd
agauucaacaauaauuuuua

SEQ ID NO: 701849 - RNA, 19 nt, Haemophilus influenzae Rd
agauuacuuuuagauaaau

SEQ ID NO: 701850 - RNA, 20 nt, Haemophilus influenzae Rd
agauuagugugauuuuagaa

SEQ ID NO: 701851 - RNA, 14 nt, Haemophilus influenzae Rd
agauugauuuaguu

SEQ ID NO: 701852 - RNA, 14 nt, Haemophilus influenzae Rd
agauugauuuucuu

SEQ ID NO: 701853 - RNA, 14 nt, Haemophilus influenzae Rd
agauugaacguuua

SEQ ID NO: 701854 - RNA, 18 nt, Haemophilus influenzae Rd
agauugaacguuuaacuu

SEQ ID NO: 701855 - RNA, 19 nt, Haemophilus influenzae Rd
agauugaacguuuaacuuc

SEQ ID NO: 701856 - RNA, 20 nt, Haemophilus influenzae Rd
agauucuaauuccccuucaa

SEQ ID NO: 701857 - RNA, 14 nt, Haemophilus influenzae Rd
agauucuugcguuu

SEQ ID NO: 701858 - RNA, 16 nt, Haemophilus influenzae Rd
agauucggcuaaaaca

SEQ ID NO: 701859 - RNA, 16 nt, Haemophilus influenzae Rd
agauuuagauaauaaa

SEQ ID NO: 701860 - RNA, 19 nt, Haemophilus influenzae Rd
agauuuagauaauaaaaaa

SEQ ID NO: 701861 - RNA, 14 nt, Haemophilus influenzae Rd
agauuuacagaaca

SEQ ID NO: 701862 - RNA, 17 nt, Haemophilus influenzae Rd
agauuuacagaacaaaa

SEQ ID NO: 701863 - RNA, 20 nt, Haemophilus influenzae Rd
agauuuacccaaauuaucaa

SEQ ID NO: 701864 - RNA, 16 nt, Haemophilus influenzae Rd
agauuuacccaacaaa

SEQ ID NO: 701865 - RNA, 17 nt, Haemophilus influenzae Rd
agauuuaauaccauaca

SEQ ID NO: 701866 - RNA, 20 nt, Haemophilus influenzae Rd
agauuuccaucuaaaaguug

SEQ ID NO: 701867 - RNA, 18 nt, Haemophilus influenzae Rd
agauuuauuuacugauuu

SEQ ID NO: 701868 - RNA, 15 nt, Haemophilus influenzae Rd
agauuuauuucugaa

SEQ ID NO: 701869 - RNA, 21 nt, Haemophilus influenzae Rd
agauugcggcagaauuuuggu

SEQ ID NO: 701870 - RNA, 20 nt, Haemophilus influenzae Rd
agauugcugacaaauuuguu

SEQ ID NO: 701871 - RNA, 14 nt, Haemophilus influenzae Rd
agauuguaugaaaa

SEQ ID NO: 701872 - RNA, 20 nt, Haemophilus influenzae Rd
agauuuuuuucaaugaaaua

SEQ ID NO: 701873 - RNA, 18 nt, Haemophilus influenzae Rd
agauuuuuuucagaaaug

SEQ ID NO: 701874 - RNA, 21 nt, Haemophilus influenzae Rd
agauuuuuuucagaaaugacc

SEQ ID NO: 701875 - RNA, 19 nt, Haemophilus influenzae Rd
agauuuuuuuuauaucuuc

SEQ ID NO: 701876 - RNA, 23 nt, Haemophilus influenzae Rd
agauuuuuuuuauaucuucucuu

SEQ ID NO: 701877 - RNA, 15 nt, Haemophilus influenzae Rd
agauuuuugauaaaa

SEQ ID NO: 701878 - RNA, 12 nt, Haemophilus influenzae Rd
agauuuuugcca

SEQ ID NO: 701879 - RNA, 18 nt, Haemophilus influenzae Rd
agauuuuaguauuuuuga

SEQ ID NO: 701880 - RNA, 19 nt, Haemophilus influenzae Rd
agauuuucucgugugaaau

SEQ ID NO: 701881 - RNA, 13 nt, Haemophilus influenzae Rd
agauuuucuuauu

SEQ ID NO: 701882 - RNA, 14 nt, Haemophilus influenzae Rd
agauuucuucgccu

SEQ ID NO: 701883 - RNA, 15 nt, Haemophilus influenzae Rd
agauuucuaauaaca

SEQ ID NO: 701884 - RNA, 12 nt, Haemophilus influenzae Rd
agauuucuuuga

SEQ ID NO: 701885 - RNA, 16 nt, Haemophilus influenzae Rd
agauuugccaaaauca

SEQ ID NO: 701886 - RNA, 16 nt, Haemophilus influenzae Rd
agcaaauuuaaauaau

SEQ ID NO: 701887 - RNA, 22 nt, Haemophilus influenzae Rd
agcaaauuacccaaaugaugaa

SEQ ID NO: 701888 - RNA, 21 nt, Haemophilus influenzae Rd
agcaaauggacuaaauuuagu

SEQ ID NO: 701889 - RNA, 15 nt, Haemophilus influenzae Rd
agcaaauccuugaau

SEQ ID NO: 701890 - RNA, 23 nt, Haemophilus influenzae Rd
agcaaauccuugaaucauuucau

SEQ ID NO: 701891 - RNA, 16 nt, Haemophilus influenzae Rd
agcaaaugaggaaaau

SEQ ID NO: 701892 - RNA, 20 nt, Haemophilus influenzae Rd
agcaaaugaggaaaauaaag

SEQ ID NO: 701893 - RNA, 21 nt, Haemophilus influenzae Rd
agcaaauauuuagccccuuuu

SEQ ID NO: 701894 - RNA, 11 nt, Haemophilus influenzae Rd
agcaaaucaaa

SEQ ID NO: 701895 - RNA, 12 nt, Haemophilus influenzae Rd
agcaaaucaaaa

SEQ ID NO: 701896 - RNA, 15 nt, Haemophilus influenzae Rd
agcaaaucaaaaccu

SEQ ID NO: 701897 - RNA, 21 nt, Haemophilus influenzae Rd
agcaaauagcgaguauaagca

SEQ ID NO: 701898 - RNA, 22 nt, Haemophilus influenzae Rd
agcaaauagcgaguauaagcaa

SEQ ID NO: 701899 - RNA, 18 nt, Haemophilus influenzae Rd
agcaaacuagguaauaau

SEQ ID NO: 701900 - RNA, 15 nt, Haemophilus influenzae Rd
agcaaagaauuaaaa

SEQ ID NO: 701901 - RNA, 14 nt, Haemophilus influenzae Rd
agcaaacagcaaua

SEQ ID NO: 701902 - RNA, 20 nt, Haemophilus influenzae Rd
agcaaacagcaauaaauaau

SEQ ID NO: 701903 - RNA, 21 nt, Haemophilus influenzae Rd
agcaaacagcaauaaauaaua

SEQ ID NO: 701904 - RNA, 22 nt, Haemophilus influenzae Rd
agcaaacaaguuucuaaaauca

SEQ ID NO: 701905 - RNA, 12 nt, Haemophilus influenzae Rd
agcaaaaucacu

SEQ ID NO: 701906 - RNA, 13 nt, Haemophilus influenzae Rd
agcaaaaucacuc

SEQ ID NO: 701907 - RNA, 23 nt, Haemophilus influenzae Rd
agcaaaacuuuuuccuucugcca

SEQ ID NO: 701908 - RNA, 12 nt, Haemophilus influenzae Rd
agcaaaagcaau

SEQ ID NO: 701909 - RNA, 15 nt, Haemophilus influenzae Rd
agcaaaagcaauaau

SEQ ID NO: 701910 - RNA, 23 nt, Haemophilus influenzae Rd
agauuuuucuugcuauucuuuag

SEQ ID NO: 701911 - RNA, 23 nt, Haemophilus influenzae Rd
agcaaaaaaccuuggaauauccc

SEQ ID NO: 701912 - RNA, 15 nt, Haemophilus influenzae Rd
agcaaaaccauccaa

SEQ ID NO: 701913 - RNA, 18 nt, Haemophilus influenzae Rd
agcaaaacaagacaaaau

SEQ ID NO: 701914 - RNA, 22 nt, Haemophilus influenzae Rd
agcaaaacaagacaaaauaagg

SEQ ID NO: 701915 - RNA, 20 nt, Haemophilus influenzae Rd
agccugaaucgacacaucua

SEQ ID NO: 701916 - RNA, 20 nt, Haemophilus influenzae Rd
agccugcaaagccuucaccu

SEQ ID NO: 701917 - RNA, 14 nt, Haemophilus influenzae Rd
agccuguugauguu

SEQ ID NO: 701918 - RNA, 17 nt, Haemophilus influenzae Rd
agccugggcuugcauuc

SEQ ID NO: 701919 - RNA, 20 nt, Haemophilus influenzae Rd
agccugggcuugcauucacu

SEQ ID NO: 701920 - RNA, 13 nt, Haemophilus influenzae Rd
agccuuucuggcu

SEQ ID NO: 701921 - RNA, 15 nt, Haemophilus influenzae Rd
agccuuuuauuucuu

SEQ ID NO: 701922 - RNA, 12 nt, Haemophilus influenzae Rd
agccuuuucuag

SEQ ID NO: 701923 - RNA, 13 nt, Haemophilus influenzae Rd
agcgaaguuaaac

SEQ ID NO: 701924 - RNA, 22 nt, Haemophilus influenzae Rd
agccuuuuaaaaugaacaaaaa

SEQ ID NO: 701925 - RNA, 21 nt, Haemophilus influenzae Rd
agcgaguauaagcaaugcaag

SEQ ID NO: 701926 - RNA, 13 nt, Haemophilus influenzae Rd
agcgauagaaaua

SEQ ID NO: 701927 - RNA, 18 nt, Haemophilus influenzae Rd
agcgauagaaauaaagau

SEQ ID NO: 701928 - RNA, 20 nt, Haemophilus influenzae Rd
agcgauccguaaucgugccu

SEQ ID NO: 701929 - RNA, 15 nt, Haemophilus influenzae Rd
agcgguuuuuccauu

SEQ ID NO: 701930 - RNA, 13 nt, Haemophilus influenzae Rd
agcguaaaaaugc

SEQ ID NO: 701931 - RNA, 16 nt, Haemophilus influenzae Rd
agcguaacccaaagca

SEQ ID NO: 701932 - RNA, 16 nt, Haemophilus influenzae Rd
agcguaacuuaaugca

SEQ ID NO: 701933 - RNA, 23 nt, Haemophilus influenzae Rd
agcgugaauauaagaaaucucuu

SEQ ID NO: 701934 - RNA, 15 nt, Haemophilus influenzae Rd
agcgucuuuuugcac

SEQ ID NO: 701935 - RNA, 21 nt, Haemophilus influenzae Rd
agcgucuuuuugcacguucuu

SEQ ID NO: 701936 - RNA, 16 nt, Haemophilus influenzae Rd
agcuaauaacacaucu

SEQ ID NO: 701937 - RNA, 15 nt, Haemophilus influenzae Rd
agcuaaguacaaaag

SEQ ID NO: 701938 - RNA, 22 nt, Haemophilus influenzae Rd
agcuaauccuuuaccaaccggu

SEQ ID NO: 701939 - RNA, 21 nt, Haemophilus influenzae Rd
agcuaaugcuuuaauuuguuu

SEQ ID NO: 701940 - RNA, 21 nt, Haemophilus influenzae Rd
agcuaauuggggugcagauuu

SEQ ID NO: 701941 - RNA, 13 nt, Haemophilus influenzae Rd
agcuaauuuuuca

SEQ ID NO: 701942 - RNA, 22 nt, Haemophilus influenzae Rd
agcuaccaauauucuuuaaaac

SEQ ID NO: 701943 - RNA, 20 nt, Haemophilus influenzae Rd
agcuaccaauucaaaaacca

SEQ ID NO: 701944 - RNA, 22 nt, Haemophilus influenzae Rd
agcuacuggugaaauuaauuua

SEQ ID NO: 701945 - RNA, 16 nt, Haemophilus influenzae Rd
agcuaagcauuucagu

SEQ ID NO: 701946 - RNA, 16 nt, Haemophilus influenzae Rd
agcuaaagcaauugcc

SEQ ID NO: 701947 - RNA, 15 nt, Haemophilus influenzae Rd
agcuaaauacuugcu

SEQ ID NO: 701948 - RNA, 10 nt, Haemophilus influenzae Rd
agcuaaaucc

SEQ ID NO: 701949 - RNA, 13 nt, Haemophilus influenzae Rd
agcuaaauccaga

SEQ ID NO: 701950 - RNA, 15 nt, Haemophilus influenzae Rd
agcuaaaaauaauua

SEQ ID NO: 701951 - RNA, 15 nt, Haemophilus influenzae Rd
agcuaaacauccgaa

SEQ ID NO: 701952 - RNA, 18 nt, Haemophilus influenzae Rd
agcguuuuucuacauaau

SEQ ID NO: 701953 - RNA, 13 nt, Haemophilus influenzae Rd
agcuauuaaaaaa

SEQ ID NO: 701954 - RNA, 16 nt, Haemophilus influenzae Rd
agcuauuaaaaaaagc

SEQ ID NO: 701955 - RNA, 12 nt, Haemophilus influenzae Rd
agcuauuaaauu

SEQ ID NO: 701956 - RNA, 20 nt, Haemophilus influenzae Rd
agcuauucccgcauuuauca

SEQ ID NO: 701957 - RNA, 23 nt, Haemophilus influenzae Rd
agcuauuucggcaguacucgaaa

SEQ ID NO: 701958 - RNA, 16 nt, Haemophilus influenzae Rd
agcuauaaguaacuuu

SEQ ID NO: 701959 - RNA, 19 nt, Haemophilus influenzae Rd
agcuaguuuaguuuaaucu

SEQ ID NO: 701960 - RNA, 19 nt, Haemophilus influenzae Rd
agcuagguacguuuuguuu

SEQ ID NO: 701961 - RNA, 12 nt, Haemophilus influenzae Rd
agcucagccaaa

SEQ ID NO: 701962 - RNA, 17 nt, Haemophilus influenzae Rd
agcucagucgguagagc

SEQ ID NO: 701963 - RNA, 19 nt, Haemophilus influenzae Rd
agcaugagcuucaaaauca

SEQ ID NO: 701964 - RNA, 15 nt, Haemophilus influenzae Rd
agcauggauuuuucu

SEQ ID NO: 701965 - RNA, 15 nt, Haemophilus influenzae Rd
agccaaguuguaaaa

SEQ ID NO: 701966 - RNA, 15 nt, Haemophilus influenzae Rd
agccaacuuuuucua

SEQ ID NO: 701967 - RNA, 16 nt, Haemophilus influenzae Rd
agccaucaauaaaaag

SEQ ID NO: 701968 - RNA, 18 nt, Haemophilus influenzae Rd
agccauauccguaucauu

SEQ ID NO: 701969 - RNA, 14 nt, Haemophilus influenzae Rd
agccauaauauuua

SEQ ID NO: 701970 - RNA, 17 nt, Haemophilus influenzae Rd
agccauccccaaaacag

SEQ ID NO: 701971 - RNA, 22 nt, Haemophilus influenzae Rd
agccauccccaaaacaguaaug

SEQ ID NO: 701972 - RNA, 15 nt, Haemophilus influenzae Rd
agccaucacuauaua

SEQ ID NO: 701973 - RNA, 22 nt, Haemophilus influenzae Rd
agccaucgcugaaauuaauaag

SEQ ID NO: 701974 - RNA, 18 nt, Haemophilus influenzae Rd
agccauuaacauuuaaca

SEQ ID NO: 701975 - RNA, 17 nt, Haemophilus influenzae Rd
agccauggcuuuuuccu

SEQ ID NO: 701976 - RNA, 22 nt, Haemophilus influenzae Rd
agccauuuucgcaucaaucaca

SEQ ID NO: 701977 - RNA, 18 nt, Haemophilus influenzae Rd
agccauuuucugcaucca

SEQ ID NO: 701978 - RNA, 14 nt, Haemophilus influenzae Rd
agccauuuugcuca

SEQ ID NO: 701979 - RNA, 13 nt, Haemophilus influenzae Rd
agccauuuuggaa

SEQ ID NO: 701980 - RNA, 13 nt, Haemophilus influenzae Rd
agccauuucuaaa

SEQ ID NO: 701981 - RNA, 21 nt, Haemophilus influenzae Rd
agccauuuaauguucccacaa

SEQ ID NO: 701982 - RNA, 16 nt, Haemophilus influenzae Rd
agcccaaaugcaacaa

SEQ ID NO: 701983 - RNA, 21 nt, Haemophilus influenzae Rd
agcccaagcuuuuucuuguuc

SEQ ID NO: 701984 - RNA, 15 nt, Haemophilus influenzae Rd
agcccacauuuggaa

SEQ ID NO: 701985 - RNA, 14 nt, Haemophilus influenzae Rd
agcccaccaauuaa

SEQ ID NO: 701986 - RNA, 15 nt, Haemophilus influenzae Rd
agcccacaacuacag

SEQ ID NO: 701987 - RNA, 20 nt, Haemophilus influenzae Rd
agcccgaauucugagcaaau

SEQ ID NO: 701988 - RNA, 15 nt, Haemophilus influenzae Rd
agcccuuccaucuuu

SEQ ID NO: 701989 - RNA, 18 nt, Haemophilus influenzae Rd
agcccuuaauacugcuga

SEQ ID NO: 701990 - RNA, 15 nt, Haemophilus influenzae Rd
agccgcaccuugaga

SEQ ID NO: 701991 - RNA, 21 nt, Haemophilus influenzae Rd
agccgacuauuacaagauaau

SEQ ID NO: 701992 - RNA, 13 nt, Haemophilus influenzae Rd
agcacugaaauuc

SEQ ID NO: 701993 - RNA, 16 nt, Haemophilus influenzae Rd
agcacuugcaucuaaa

SEQ ID NO: 701994 - RNA, 13 nt, Haemophilus influenzae Rd
agcacuuuuccuu

SEQ ID NO: 701995 - RNA, 12 nt, Haemophilus influenzae Rd
agcacuaaaagc

SEQ ID NO: 701996 - RNA, 14 nt, Haemophilus influenzae Rd
agcaaccacuaaaa

SEQ ID NO: 701997 - RNA, 17 nt, Haemophilus influenzae Rd
agcaaccacuaaaacac

SEQ ID NO: 701998 - RNA, 20 nt, Haemophilus influenzae Rd
agcaacaucauaagguacaa

SEQ ID NO: 701999 - RNA, 18 nt, Haemophilus influenzae Rd
agcaacgacacacuauua

SEQ ID NO: 702000 - RNA, 14 nt, Haemophilus influenzae Rd
agcagcuaauaggc

SEQ ID NO: 702001 - RNA, 16 nt, Haemophilus influenzae Rd
agcaugaauaaaaaug

SEQ ID NO: 702002 - RNA, 17 nt, Haemophilus influenzae Rd
agcaugaauaaaaaugg

SEQ ID NO: 702003 - RNA, 15 nt, Haemophilus influenzae Rd
agcaucuacccaaua

SEQ ID NO: 702004 - RNA, 17 nt, Haemophilus influenzae Rd
agcaucggcuaaauaag

SEQ ID NO: 702005 - RNA, 14 nt, Haemophilus influenzae Rd
agcaucggauacuu

SEQ ID NO: 702006 - RNA, 19 nt, Haemophilus influenzae Rd
agcaucggauacuuugaac

SEQ ID NO: 702007 - RNA, 22 nt, Haemophilus influenzae Rd
agcaguggcuugcgccauuucc

SEQ ID NO: 702008 - RNA, 23 nt, Haemophilus influenzae Rd
agcaguggcuugcgccauuuccc

SEQ ID NO: 702009 - RNA, 15 nt, Haemophilus influenzae Rd
agcagugccaaccac

SEQ ID NO: 702010 - RNA, 19 nt, Haemophilus influenzae Rd
agcauaccuagcauacgug

SEQ ID NO: 702011 - RNA, 17 nt, Haemophilus influenzae Rd
agcaguuaaacagcuuu

SEQ ID NO: 702012 - RNA, 18 nt, Haemophilus influenzae Rd
accaucauagauaaagua

SEQ ID NO: 702013 - RNA, 13 nt, Haemophilus influenzae Rd
accauccaagcaa

SEQ ID NO: 702014 - RNA, 14 nt, Haemophilus influenzae Rd
accaucacaagcaa

SEQ ID NO: 702015 - RNA, 16 nt, Haemophilus influenzae Rd
accauacauaaaaucu

SEQ ID NO: 702016 - RNA, 22 nt, Haemophilus influenzae Rd
accauacauucagugguaauca

SEQ ID NO: 702017 - RNA, 17 nt, Haemophilus influenzae Rd
accauacuugccacagg

SEQ ID NO: 702018 - RNA, 21 nt, Haemophilus influenzae Rd
accauacaacgaguuaaguaa

SEQ ID NO: 702019 - RNA, 20 nt, Haemophilus influenzae Rd
accauaacuuaugaauaaua

SEQ ID NO: 702020 - RNA, 18 nt, Haemophilus influenzae Rd
accauaacaagaaucauc

SEQ ID NO: 702021 - RNA, 18 nt, Haemophilus influenzae Rd
accagaaacauagauaac

SEQ ID NO: 702022 - RNA, 19 nt, Haemophilus influenzae Rd
accagaaauagaguuaagu

SEQ ID NO: 702023 - RNA, 18 nt, Haemophilus influenzae Rd
accacuugucauuaaaaa

SEQ ID NO: 702024 - RNA, 22 nt, Haemophilus influenzae Rd
accacuugucauuaaaaaauaa

SEQ ID NO: 702025 - RNA, 11 nt, Haemophilus influenzae Rd
accauucuuuc

SEQ ID NO: 702026 - RNA, 16 nt, Haemophilus influenzae Rd
accauuacagcaagca

SEQ ID NO: 702027 - RNA, 14 nt, Haemophilus influenzae Rd
accauuacauaaaa

SEQ ID NO: 702028 - RNA, 15 nt, Haemophilus influenzae Rd
accauuacauccacu

SEQ ID NO: 702029 - RNA, 14 nt, Haemophilus influenzae Rd
accauucaguaaua

SEQ ID NO: 702030 - RNA, 18 nt, Haemophilus influenzae Rd
accauucaugucgcuugc

SEQ ID NO: 702031 - RNA, 19 nt, Haemophilus influenzae Rd
accauuaauaaauuuuucg

SEQ ID NO: 702032 - RNA, 16 nt, Haemophilus influenzae Rd
accauuggggcgacca

SEQ ID NO: 702033 - RNA, 15 nt, Haemophilus influenzae Rd
accauuggugaaagg

SEQ ID NO: 702034 - RNA, 15 nt, Haemophilus influenzae Rd
accauuguuuaauuc

SEQ ID NO: 702035 - RNA, 21 nt, Haemophilus influenzae Rd
accauuuauaaugcaaccaaa

SEQ ID NO: 702036 - RNA, 23 nt, Haemophilus influenzae Rd
accauuuauccaugacuaaucca

SEQ ID NO: 702037 - RNA, 21 nt, Haemophilus influenzae Rd
accauuuaauaaaacaaaugu

SEQ ID NO: 702038 - RNA, 23 nt, Haemophilus influenzae Rd
accauuuauuccuuuauuuugca

SEQ ID NO: 702039 - RNA, 19 nt, Haemophilus influenzae Rd
accauucgccuaaugccuu

SEQ ID NO: 702040 - RNA, 14 nt, Haemophilus influenzae Rd
accauugaauccaa

SEQ ID NO: 702041 - RNA, 22 nt, Haemophilus influenzae Rd
accauugaauccaacguauuua

SEQ ID NO: 702042 - RNA, 15 nt, Haemophilus influenzae Rd
accauugaugaaaug

SEQ ID NO: 702043 - RNA, 12 nt, Haemophilus influenzae Rd
accauugcguuc

SEQ ID NO: 702044 - RNA, 19 nt, Haemophilus influenzae Rd
accauugcguucacucacu

SEQ ID NO: 702045 - RNA, 21 nt, Haemophilus influenzae Rd
accauugcguucacucacuuu

SEQ ID NO: 702046 - RNA, 13 nt, Haemophilus influenzae Rd
acccaaauuaaaa

SEQ ID NO: 702047 - RNA, 14 nt, Haemophilus influenzae Rd
acccaaauuaucaa

SEQ ID NO: 702048 - RNA, 15 nt, Haemophilus influenzae Rd
acccaacaaauuuaa

SEQ ID NO: 702049 - RNA, 11 nt, Haemophilus influenzae Rd
accauuuuucc

SEQ ID NO: 702050 - RNA, 12 nt, Haemophilus influenzae Rd
accauuuuucca

SEQ ID NO: 702051 - RNA, 15 nt, Haemophilus influenzae Rd
accauuuuuccagca

SEQ ID NO: 702052 - RNA, 13 nt, Haemophilus influenzae Rd
accauuuuucgug

SEQ ID NO: 702053 - RNA, 13 nt, Haemophilus influenzae Rd
accauuuccuuug

SEQ ID NO: 702054 - RNA, 11 nt, Haemophilus influenzae Rd
accauuugauu

SEQ ID NO: 702055 - RNA, 13 nt, Haemophilus influenzae Rd
accauuugauuca

SEQ ID NO: 702056 - RNA, 15 nt, Haemophilus influenzae Rd
accauuuuagaggcu

SEQ ID NO: 702057 - RNA, 17 nt, Haemophilus influenzae Rd
accauuuugcccaauuc

SEQ ID NO: 702058 - RNA, 23 nt, Haemophilus influenzae Rd
acccaauuagaugauuuuaaagu

SEQ ID NO: 702059 - RNA, 13 nt, Haemophilus influenzae Rd
acccacacaaacu

SEQ ID NO: 702060 - RNA, 16 nt, Haemophilus influenzae Rd
acccacauacuuauuc

SEQ ID NO: 702061 - RNA, 17 nt, Haemophilus influenzae Rd
acccgcuucaaucgcaa

SEQ ID NO: 702062 - RNA, 16 nt, Haemophilus influenzae Rd
acccgcuuuaauagau

SEQ ID NO: 702063 - RNA, 22 nt, Haemophilus influenzae Rd
acccgcuuuuaacaaauacauc

SEQ ID NO: 702064 - RNA, 21 nt, Haemophilus influenzae Rd
acccgcuaaaguucucaaaaa

SEQ ID NO: 702065 - RNA, 14 nt, Haemophilus influenzae Rd
accccuucuguugc

SEQ ID NO: 702066 - RNA, 15 nt, Haemophilus influenzae Rd
acccgccuuaaucau

SEQ ID NO: 702067 - RNA, 15 nt, Haemophilus influenzae Rd
acccaccacuuaaaa

SEQ ID NO: 702068 - RNA, 16 nt, Haemophilus influenzae Rd
acccacaucaucaagc

SEQ ID NO: 702069 - RNA, 13 nt, Haemophilus influenzae Rd
acccaucaaaucu

SEQ ID NO: 702070 - RNA, 14 nt, Haemophilus influenzae Rd
acccaucaaaucuu

SEQ ID NO: 702071 - RNA, 22 nt, Haemophilus influenzae Rd
acccaucacauuuucaaauugu

SEQ ID NO: 702072 - RNA, 16 nt, Haemophilus influenzae Rd
accccucguucuccca

SEQ ID NO: 702073 - RNA, 21 nt, Haemophilus influenzae Rd
acccguuugaaguacauucaa

SEQ ID NO: 702074 - RNA, 19 nt, Haemophilus influenzae Rd
acccugaauucccaaacgg

SEQ ID NO: 702075 - RNA, 19 nt, Haemophilus influenzae Rd
accgacuuuauauugacaa

SEQ ID NO: 702076 - RNA, 19 nt, Haemophilus influenzae Rd
accgauagcuuuuguugcu

SEQ ID NO: 702077 - RNA, 16 nt, Haemophilus influenzae Rd
accgagcggucagagg

SEQ ID NO: 702078 - RNA, 15 nt, Haemophilus influenzae Rd
accgcaaucuucaca

SEQ ID NO: 702079 - RNA, 19 nt, Haemophilus influenzae Rd
accgccgaaauucccauuu

SEQ ID NO: 702080 - RNA, 22 nt, Haemophilus influenzae Rd
accgcagcagguuuuccuacag

SEQ ID NO: 702081 - RNA, 21 nt, Haemophilus influenzae Rd
accgcacuuauuugacuuaaa

SEQ ID NO: 702082 - RNA, 15 nt, Haemophilus influenzae Rd
accgcacuucaaaaa

SEQ ID NO: 702083 - RNA, 13 nt, Haemophilus influenzae Rd
accgcacuuucuu

SEQ ID NO: 702084 - RNA, 18 nt, Haemophilus influenzae Rd
accgcacuuuuauauuua

SEQ ID NO: 702085 - RNA, 23 nt, Haemophilus influenzae Rd
accgcacuuuuauccaccagcac

SEQ ID NO: 702086 - RNA, 12 nt, Haemophilus influenzae Rd
accgcacuuuug

SEQ ID NO: 702087 - RNA, 16 nt, Haemophilus influenzae Rd
accgcacuuuugcgau

SEQ ID NO: 702088 - RNA, 15 nt, Haemophilus influenzae Rd
accgcacuuuuguau

SEQ ID NO: 702089 - RNA, 21 nt, Haemophilus influenzae Rd
accgcacuuuuuaauaaaaug

SEQ ID NO: 702090 - RNA, 15 nt, Haemophilus influenzae Rd
accgcacuuuuuguu

SEQ ID NO: 702091 - RNA, 19 nt, Haemophilus influenzae Rd
accgcacuuuuuguuuuau

SEQ ID NO: 702092 - RNA, 21 nt, Haemophilus influenzae Rd
accgcacuuuuuucuaccgca

SEQ ID NO: 702093 - RNA, 17 nt, Haemophilus influenzae Rd
accgcacuuuuuuguau

SEQ ID NO: 702094 - RNA, 19 nt, Haemophilus influenzae Rd
accgcacuuuuuuguuuuc

SEQ ID NO: 702095 - RNA, 23 nt, Haemophilus influenzae Rd
accgcacuuuuuuguuuucagga

SEQ ID NO: 702096 - RNA, 21 nt, Haemophilus influenzae Rd
accgcacuuuuuuuauaucuu

SEQ ID NO: 702097 - RNA, 19 nt, Haemophilus influenzae Rd
accgcacuucuaugaagaa

SEQ ID NO: 702098 - RNA, 16 nt, Haemophilus influenzae Rd
accgcacuuuaaacug

SEQ ID NO: 702099 - RNA, 17 nt, Haemophilus influenzae Rd
accgcacuuuaaucucu

SEQ ID NO: 702100 - RNA, 14 nt, Haemophilus influenzae Rd
accgcacuuuagaa

SEQ ID NO: 702101 - RNA, 16 nt, Haemophilus influenzae Rd
accgcacuuuagaaaa

SEQ ID NO: 702102 - RNA, 17 nt, Haemophilus influenzae Rd
accgcacuuuccccccu

SEQ ID NO: 702103 - RNA, 22 nt, Haemophilus influenzae Rd
accgcacuuucgccgaguaaau

SEQ ID NO: 702104 - RNA, 19 nt, Haemophilus influenzae Rd
accgccaagcgcugcagua

SEQ ID NO: 702105 - RNA, 20 nt, Haemophilus influenzae Rd
accgcauuguaaaccaaauu

SEQ ID NO: 702106 - RNA, 22 nt, Haemophilus influenzae Rd
accucgccauuuuucaaaauuu

SEQ ID NO: 702107 - RNA, 17 nt, Haemophilus influenzae Rd
accucgccuuguaauug

SEQ ID NO: 702108 - RNA, 19 nt, Haemophilus influenzae Rd
accucguggcaaaagauca

SEQ ID NO: 702109 - RNA, 22 nt, Haemophilus influenzae Rd
accucuaaaaugcaaacaagau

SEQ ID NO: 702110 - RNA, 16 nt, Haemophilus influenzae Rd
accugaaaaaccuugu

SEQ ID NO: 702111 - RNA, 20 nt, Haemophilus influenzae Rd
accugaaaaaccuugugguu

SEQ ID NO: 702112 - RNA, 13 nt, Haemophilus influenzae Rd
accugaagaauac

SEQ ID NO: 702113 - RNA, 14 nt, Haemophilus influenzae Rd
accugaagaauaca

SEQ ID NO: 702114 - RNA, 19 nt, Haemophilus influenzae Rd
accucgaauagcaauaucu

SEQ ID NO: 702115 - RNA, 15 nt, Haemophilus influenzae Rd
accucagaagaaauu

SEQ ID NO: 702116 - RNA, 16 nt, Haemophilus influenzae Rd
accuaucacaaaacaa

SEQ ID NO: 702117 - RNA, 22 nt, Haemophilus influenzae Rd
accuagucccgcuuuugccaua

SEQ ID NO: 702118 - RNA, 18 nt, Haemophilus influenzae Rd
accuaguuugcuauauua

SEQ ID NO: 702119 - RNA, 16 nt, Haemophilus influenzae Rd
accuagaaauuuuggc

SEQ ID NO: 702120 - RNA, 16 nt, Haemophilus influenzae Rd
acgaaccgagcgguca

SEQ ID NO: 702121 - RNA, 22 nt, Haemophilus influenzae Rd
acgaacaagcgcgauaaagagu

SEQ ID NO: 702122 - RNA, 19 nt, Haemophilus influenzae Rd
acgaacaauuucuuuaccu

SEQ ID NO: 702123 - RNA, 11 nt, Haemophilus influenzae Rd
acgaaaucauc

SEQ ID NO: 702124 - RNA, 23 nt, Haemophilus influenzae Rd
acgaaaucaucgaaaucuaauuu

SEQ ID NO: 702125 - RNA, 16 nt, Haemophilus influenzae Rd
accuuucauauaaaua

SEQ ID NO: 702126 - RNA, 20 nt, Haemophilus influenzae Rd
accuuuuucagcuaaugcuu

SEQ ID NO: 702127 - RNA, 11 nt, Haemophilus influenzae Rd
accuuuuuccu

SEQ ID NO: 702128 - RNA, 12 nt, Haemophilus influenzae Rd
accuuuuucuac

SEQ ID NO: 702129 - RNA, 12 nt, Haemophilus influenzae Rd
accuuuuucuuc

SEQ ID NO: 702130 - RNA, 21 nt, Haemophilus influenzae Rd
accuuuuugcguauccgcugc

SEQ ID NO: 702131 - RNA, 16 nt, Haemophilus influenzae Rd
accuuuuuuuagaauu

SEQ ID NO: 702132 - RNA, 22 nt, Haemophilus influenzae Rd
accuuuuuuuagaauuaaauuu

SEQ ID NO: 702133 - RNA, 14 nt, Haemophilus influenzae Rd
acgaaaaaaaccga

SEQ ID NO: 702134 - RNA, 15 nt, Haemophilus influenzae Rd
acgaaaaaaauaaaa

SEQ ID NO: 702135 - RNA, 17 nt, Haemophilus influenzae Rd
acgaaaaaaauaaaaaa

SEQ ID NO: 702136 - RNA, 16 nt, Haemophilus influenzae Rd
accuugaucuacagaa

SEQ ID NO: 702137 - RNA, 19 nt, Haemophilus influenzae Rd
accuugauaaguaggcaaa

SEQ ID NO: 702138 - RNA, 14 nt, Haemophilus influenzae Rd
accuugauugagau

SEQ ID NO: 702139 - RNA, 14 nt, Haemophilus influenzae Rd
accuugcaaauuuu

SEQ ID NO: 702140 - RNA, 16 nt, Haemophilus influenzae Rd
accuugcgcaauggcu

SEQ ID NO: 702141 - RNA, 17 nt, Haemophilus influenzae Rd
accuuuaaauucuucga

SEQ ID NO: 702142 - RNA, 16 nt, Haemophilus influenzae Rd
accuuuauuaaagccu

SEQ ID NO: 702143 - RNA, 14 nt, Haemophilus influenzae Rd
accuuuauuugcac

SEQ ID NO: 702144 - RNA, 16 nt, Haemophilus influenzae Rd
accuuagcaccacuua

SEQ ID NO: 702145 - RNA, 20 nt, Haemophilus influenzae Rd
accuuagccaaaucaucuag

SEQ ID NO: 702146 - RNA, 21 nt, Haemophilus influenzae Rd
accuuagccaaaucaucuagc

SEQ ID NO: 702147 - RNA, 17 nt, Haemophilus influenzae Rd
accuuaaaggcugaaua

SEQ ID NO: 702148 - RNA, 18 nt, Haemophilus influenzae Rd
accuuaauuagauuuauu

SEQ ID NO: 702149 - RNA, 23 nt, Haemophilus influenzae Rd
accuucaauauagguuaauaguu

SEQ ID NO: 702150 - RNA, 17 nt, Haemophilus influenzae Rd
accuucaacauuuuuug

SEQ ID NO: 702151 - RNA, 21 nt, Haemophilus influenzae Rd
accuuccccagcuguuggugg

SEQ ID NO: 702152 - RNA, 13 nt, Haemophilus influenzae Rd
accuucaaacauc

SEQ ID NO: 702153 - RNA, 12 nt, Haemophilus influenzae Rd
accuuauugcau

SEQ ID NO: 702154 - RNA, 19 nt, Haemophilus influenzae Rd
accuguuggaugaauugcc

SEQ ID NO: 702155 - RNA, 22 nt, Haemophilus influenzae Rd
accuguuggaugaauugccacc

SEQ ID NO: 702156 - RNA, 15 nt, Haemophilus influenzae Rd
accuguuaaugaaac

SEQ ID NO: 702157 - RNA, 23 nt, Haemophilus influenzae Rd
accuguuaccgcaccaaauucgu

SEQ ID NO: 702158 - RNA, 16 nt, Haemophilus influenzae Rd
accugaguaaauaaac

SEQ ID NO: 702159 - RNA, 17 nt, Haemophilus influenzae Rd
accugaugaaaucauua

SEQ ID NO: 702160 - RNA, 19 nt, Haemophilus influenzae Rd
acgaugaugcaggaaaggc

SEQ ID NO: 702161 - RNA, 23 nt, Haemophilus influenzae Rd
acgaugcaacgcauuagcaucca

SEQ ID NO: 702162 - RNA, 16 nt, Haemophilus influenzae Rd
acgaugggcaauggca

SEQ ID NO: 702163 - RNA, 16 nt, Haemophilus influenzae Rd
acgaugauccaaaaau

SEQ ID NO: 702164 - RNA, 15 nt, Haemophilus influenzae Rd
acgauucguuucagu

SEQ ID NO: 702165 - RNA, 16 nt, Haemophilus influenzae Rd
acgauuaaaaaugcuu

SEQ ID NO: 702166 - RNA, 13 nt, Haemophilus influenzae Rd
acgauuuuucucu

SEQ ID NO: 702167 - RNA, 19 nt, Haemophilus influenzae Rd
acgauuuuuuuauaaaaaa

SEQ ID NO: 702168 - RNA, 21 nt, Haemophilus influenzae Rd
acgauuuuuuuauaaaaaaac

SEQ ID NO: 702169 - RNA, 13 nt, Haemophilus influenzae Rd
acgauuguugcau

SEQ ID NO: 702170 - RNA, 21 nt, Haemophilus influenzae Rd
acgauuuaauagcacagaaaa

SEQ ID NO: 702171 - RNA, 18 nt, Haemophilus influenzae Rd
acgauuucuaucacgaaa

SEQ ID NO: 702172 - RNA, 17 nt, Haemophilus influenzae Rd
acgcaaacuacaacuuu

SEQ ID NO: 702173 - RNA, 15 nt, Haemophilus influenzae Rd
acgaguaaauuaauu

SEQ ID NO: 702174 - RNA, 21 nt, Haemophilus influenzae Rd
acgagaaagguguaauuccau

SEQ ID NO: 702175 - RNA, 14 nt, Haemophilus influenzae Rd
acgagaaguuaaac

SEQ ID NO: 702176 - RNA, 19 nt, Haemophilus influenzae Rd
acgagcuugagcugcugca

SEQ ID NO: 702177 - RNA, 13 nt, Haemophilus influenzae Rd
acgauaauauuuu

SEQ ID NO: 702178 - RNA, 20 nt, Haemophilus influenzae Rd
acgauacuuuuaauuaaaua

SEQ ID NO: 702179 - RNA, 14 nt, Haemophilus influenzae Rd
acgagaacugaaag

SEQ ID NO: 702180 - RNA, 16 nt, Haemophilus influenzae Rd
acgagaagaaccacag

SEQ ID NO: 702181 - RNA, 22 nt, Haemophilus influenzae Rd
acgaauaaacgccacucuuuga

SEQ ID NO: 702182 - RNA, 22 nt, Haemophilus influenzae Rd
acgaacguuucaucacuucaaa

SEQ ID NO: 702183 - RNA, 19 nt, Haemophilus influenzae Rd
acgcaaccaucuuuaauuc

SEQ ID NO: 702184 - RNA, 14 nt, Haemophilus influenzae Rd
acgcaagguauuuu

SEQ ID NO: 702185 - RNA, 20 nt, Haemophilus influenzae Rd
acgcaccacuucauauaaau

SEQ ID NO: 702186 - RNA, 17 nt, Haemophilus influenzae Rd
acgcacguaacaaaugc

SEQ ID NO: 702187 - RNA, 16 nt, Haemophilus influenzae Rd
acgcagcaucugccac

SEQ ID NO: 702188 - RNA, 13 nt, Haemophilus influenzae Rd
acgcauagaaauu

SEQ ID NO: 702189 - RNA, 15 nt, Haemophilus influenzae Rd
acgcauaucacgaua

SEQ ID NO: 702190 - RNA, 19 nt, Haemophilus influenzae Rd
acgcauaucacgauaagca

SEQ ID NO: 702191 - RNA, 21 nt, Haemophilus influenzae Rd
acgcauauuaguuaguuuuuu

SEQ ID NO: 702192 - RNA, 15 nt, Haemophilus influenzae Rd
acgcauuagcaucca

SEQ ID NO: 702193 - RNA, 16 nt, Haemophilus influenzae Rd
acgcauuccuucgccu

SEQ ID NO: 702194 - RNA, 22 nt, Haemophilus influenzae Rd
acgccagaaguuguuuuucuuc

SEQ ID NO: 702195 - RNA, 16 nt, Haemophilus influenzae Rd
acgccaauaaaaagua

SEQ ID NO: 702196 - RNA, 20 nt, Haemophilus influenzae Rd
acgcauuguuacaaauuccu

SEQ ID NO: 702197 - RNA, 17 nt, Haemophilus influenzae Rd
acgcuugaauaaauccc

SEQ ID NO: 702198 - RNA, 19 nt, Haemophilus influenzae Rd
acgcuugggcuuuuucaau

SEQ ID NO: 702199 - RNA, 17 nt, Haemophilus influenzae Rd
acgcuuggaaauguuua

SEQ ID NO: 702200 - RNA, 21 nt, Haemophilus influenzae Rd
acgcuuuacuacaucagguuu

SEQ ID NO: 702201 - RNA, 23 nt, Haemophilus influenzae Rd
acggaauacaucacgaacuucag

SEQ ID NO: 702202 - RNA, 20 nt, Haemophilus influenzae Rd
acggaagauuuacccaacaa

SEQ ID NO: 702203 - RNA, 17 nt, Haemophilus influenzae Rd
acggaaaguauuuucuu

SEQ ID NO: 702204 - RNA, 23 nt, Haemophilus influenzae Rd
acggaaaguauuuucuuuccaac

SEQ ID NO: 702205 - RNA, 17 nt, Haemophilus influenzae Rd
acggcaaaaucauuaaa

SEQ ID NO: 702206 - RNA, 23 nt, Haemophilus influenzae Rd
acggauuuauauauugcugucaa

SEQ ID NO: 702207 - RNA, 13 nt, Haemophilus influenzae Rd
acggcaaaaauau

SEQ ID NO: 702208 - RNA, 16 nt, Haemophilus influenzae Rd
acggauaauuucccua

SEQ ID NO: 702209 - RNA, 23 nt, Haemophilus influenzae Rd
acggacuucuguugggaauaauu

SEQ ID NO: 702210 - RNA, 19 nt, Haemophilus influenzae Rd
acggacuaaauaaaucaca

SEQ ID NO: 702211 - RNA, 22 nt, Haemophilus influenzae Rd
acgcucuacauuuacaucuaaa

SEQ ID NO: 702212 - RNA, 20 nt, Haemophilus influenzae Rd
acgcucauaagcauuuugau

SEQ ID NO: 702213 - RNA, 19 nt, Haemophilus influenzae Rd
acgccauaaacgcaccaca

SEQ ID NO: 702214 - RNA, 16 nt, Haemophilus influenzae Rd
acgcucaaucucuuua

SEQ ID NO: 702215 - RNA, 18 nt, Haemophilus influenzae Rd
acgcuaucuuuugguaaa

SEQ ID NO: 702216 - RNA, 19 nt, Haemophilus influenzae Rd
acgcuacccguauuaaaua

SEQ ID NO: 702217 - RNA, 23 nt, Haemophilus influenzae Rd
acgcuguucuucuaauguaguug

SEQ ID NO: 702218 - RNA, 16 nt, Haemophilus influenzae Rd
acgcuguuucuuuuca

SEQ ID NO: 702219 - RNA, 19 nt, Haemophilus influenzae Rd
acgcuguuuugcuuccuua

SEQ ID NO: 702220 - RNA, 18 nt, Haemophilus influenzae Rd
acgcuuacgauacaugga

SEQ ID NO: 702221 - RNA, 15 nt, Haemophilus influenzae Rd
acgcuuacucauuua

SEQ ID NO: 702222 - RNA, 22 nt, Haemophilus influenzae Rd
acgcuuacucauuuaucaaaca

SEQ ID NO: 702223 - RNA, 13 nt, Haemophilus influenzae Rd
acgcuuaaccauc

SEQ ID NO: 702224 - RNA, 21 nt, Haemophilus influenzae Rd
acgguaagccgcuauuucacu

SEQ ID NO: 702225 - RNA, 16 nt, Haemophilus influenzae Rd
acgggcucaucacaaa

SEQ ID NO: 702226 - RNA, 20 nt, Haemophilus influenzae Rd
acggugggcugaagcccacc

SEQ ID NO: 702227 - RNA, 15 nt, Haemophilus influenzae Rd
acggugcgaugggga

SEQ ID NO: 702228 - RNA, 14 nt, Haemophilus influenzae Rd
acguaaauucaaua

SEQ ID NO: 702229 - RNA, 11 nt, Haemophilus influenzae Rd
acguaaccauu

SEQ ID NO: 702230 - RNA, 20 nt, Haemophilus influenzae Rd
acguaaccauuguuuaauuc

SEQ ID NO: 702231 - RNA, 22 nt, Haemophilus influenzae Rd
acguaaaggcgcuuccauagca

SEQ ID NO: 702232 - RNA, 20 nt, Haemophilus influenzae Rd
acguaaaauaucuuucucuu

SEQ ID NO: 702233 - RNA, 21 nt, Haemophilus influenzae Rd
acguaaaaguaaauaagccau

SEQ ID NO: 702234 - RNA, 11 nt, Haemophilus influenzae Rd
acgguuuuaau

SEQ ID NO: 702235 - RNA, 14 nt, Haemophilus influenzae Rd
acguaagaaauaac

SEQ ID NO: 702236 - RNA, 15 nt, Haemophilus influenzae Rd
acguaagcaccaaug

SEQ ID NO: 702237 - RNA, 13 nt, Haemophilus influenzae Rd
acguaagguaaug

SEQ ID NO: 702238 - RNA, 18 nt, Haemophilus influenzae Rd
acguaaguuugcuaauuu

SEQ ID NO: 702239 - RNA, 20 nt, Haemophilus influenzae Rd
acguaauacuuuugcuucac

SEQ ID NO: 702240 - RNA, 14 nt, Haemophilus influenzae Rd
acguaauagauaaa

SEQ ID NO: 702241 - RNA, 20 nt, Haemophilus influenzae Rd
acguaaucccauuucaucuu

SEQ ID NO: 702242 - RNA, 18 nt, Haemophilus influenzae Rd
acguacauugucugacca

SEQ ID NO: 702243 - RNA, 19 nt, Haemophilus influenzae Rd
acuauuucaucuuuaguga

SEQ ID NO: 702244 - RNA, 19 nt, Haemophilus influenzae Rd
acuauuuaaguguuuacua

SEQ ID NO: 702245 - RNA, 16 nt, Haemophilus influenzae Rd
acuauugguagauaau

SEQ ID NO: 702246 - RNA, 16 nt, Haemophilus influenzae Rd
acuauugaaaauuaaa

SEQ ID NO: 702247 - RNA, 19 nt, Haemophilus influenzae Rd
acuauuaaugcucuauauc

SEQ ID NO: 702248 - RNA, 17 nt, Haemophilus influenzae Rd
acuauuaauucucuuuc

SEQ ID NO: 702249 - RNA, 19 nt, Haemophilus influenzae Rd
acuauuaauucucuuucca

SEQ ID NO: 702250 - RNA, 20 nt, Haemophilus influenzae Rd
acuauuaaguucaaauuucu

SEQ ID NO: 702251 - RNA, 16 nt, Haemophilus influenzae Rd
acuauucaaaugaaau

SEQ ID NO: 702252 - RNA, 16 nt, Haemophilus influenzae Rd
acuauuacaagauaau

SEQ ID NO: 702253 - RNA, 15 nt, Haemophilus influenzae Rd
acuauuacccacuuc

SEQ ID NO: 702254 - RNA, 23 nt, Haemophilus influenzae Rd
acuagauaaacgcuguuuugcuu

SEQ ID NO: 702255 - RNA, 13 nt, Haemophilus influenzae Rd
acuagauuuucuu

SEQ ID NO: 702256 - RNA, 14 nt, Haemophilus influenzae Rd
acuagauuuucuuc

SEQ ID NO: 702257 - RNA, 16 nt, Haemophilus influenzae Rd
acuagauauaaaaacu

SEQ ID NO: 702258 - RNA, 18 nt, Haemophilus influenzae Rd
acuagauauaaaaacuau

SEQ ID NO: 702259 - RNA, 19 nt, Haemophilus influenzae Rd
acuacaucagguuuaauaa

SEQ ID NO: 702260 - RNA, 14 nt, Haemophilus influenzae Rd
acuaccaauauuau

SEQ ID NO: 702261 - RNA, 19 nt, Haemophilus influenzae Rd
acuaccgcccgcaucaaug

SEQ ID NO: 702262 - RNA, 14 nt, Haemophilus influenzae Rd
acuaauugugguaa

SEQ ID NO: 702263 - RNA, 16 nt, Haemophilus influenzae Rd
acuaauuguuuuaaaa

SEQ ID NO: 702264 - RNA, 20 nt, Haemophilus influenzae Rd
acuaauucguuucuugguuu

SEQ ID NO: 702265 - RNA, 21 nt, Haemophilus influenzae Rd
acuaauucguuucuugguuua

SEQ ID NO: 702266 - RNA, 22 nt, Haemophilus influenzae Rd
acuaauuugacgauaauauuuu

SEQ ID NO: 702267 - RNA, 21 nt, Haemophilus influenzae Rd
acuaauuugggugcagauuuu

SEQ ID NO: 702268 - RNA, 21 nt, Haemophilus influenzae Rd
acuaauuuguggaaauugcca

SEQ ID NO: 702269 - RNA, 23 nt, Haemophilus influenzae Rd
acuaauuuguggaaauugccaaa

SEQ ID NO: 702270 - RNA, 15 nt, Haemophilus influenzae Rd
acuaauuuuaguauu

SEQ ID NO: 702271 - RNA, 22 nt, Haemophilus influenzae Rd
acuaauucaagcaaauauuuag

SEQ ID NO: 702272 - RNA, 13 nt, Haemophilus influenzae Rd
acuacagcccaau

SEQ ID NO: 702273 - RNA, 22 nt, Haemophilus influenzae Rd
acuacaacuucaucaauggcau

SEQ ID NO: 702274 - RNA, 23 nt, Haemophilus influenzae Rd
acuacaacuuuuuauuuucugca

SEQ ID NO: 702275 - RNA, 21 nt, Haemophilus influenzae Rd
acuacacccucaguuaccaua

SEQ ID NO: 702276 - RNA, 13 nt, Haemophilus influenzae Rd
acuaauaaaccaa

SEQ ID NO: 702277 - RNA, 19 nt, Haemophilus influenzae Rd
acuaauaggaguaaaaaua

SEQ ID NO: 702278 - RNA, 13 nt, Haemophilus influenzae Rd
acuaauauaaaga

SEQ ID NO: 702279 - RNA, 12 nt, Haemophilus influenzae Rd
acuaauuaaaag

SEQ ID NO: 702280 - RNA, 23 nt, Haemophilus influenzae Rd
acuaauuaaaaggacuaaaccua

SEQ ID NO: 702281 - RNA, 22 nt, Haemophilus influenzae Rd
acuaaucgaccuucugcaucag

SEQ ID NO: 702282 - RNA, 19 nt, Haemophilus influenzae Rd
acuaaugccgcaaaaccua

SEQ ID NO: 702283 - RNA, 13 nt, Haemophilus influenzae Rd
acuaacuuuccua

SEQ ID NO: 702284 - RNA, 14 nt, Haemophilus influenzae Rd
acuaagaaagcuaa

SEQ ID NO: 702285 - RNA, 22 nt, Haemophilus influenzae Rd
acuaacuggcuguguaaaacau

SEQ ID NO: 702286 - RNA, 19 nt, Haemophilus influenzae Rd
acuaagcuuuuuuuaauca

SEQ ID NO: 702287 - RNA, 19 nt, Haemophilus influenzae Rd
acuaaguucgguauucaau

SEQ ID NO: 702288 - RNA, 20 nt, Haemophilus influenzae Rd
acuaacacgcgcugcucugu

SEQ ID NO: 702289 - RNA, 19 nt, Haemophilus influenzae Rd
acuaaaugcucgaauauaa

SEQ ID NO: 702290 - RNA, 14 nt, Haemophilus influenzae Rd
acuaaauucuuuug

SEQ ID NO: 702291 - RNA, 16 nt, Haemophilus influenzae Rd
acuaacucaaaauacu

SEQ ID NO: 702292 - RNA, 16 nt, Haemophilus influenzae Rd
acuaacucacauugcc

SEQ ID NO: 702293 - RNA, 17 nt, Haemophilus influenzae Rd
acuaacucacauugcca

SEQ ID NO: 702294 - RNA, 15 nt, Haemophilus influenzae Rd
acguucaaaaauauu

SEQ ID NO: 702295 - RNA, 21 nt, Haemophilus influenzae Rd
acguucaaaaauauuauguuc

SEQ ID NO: 702296 - RNA, 14 nt, Haemophilus influenzae Rd
acguucaacaauca

SEQ ID NO: 702297 - RNA, 22 nt, Haemophilus influenzae Rd
acguucaacaaucacuucgucu

SEQ ID NO: 702298 - RNA, 15 nt, Haemophilus influenzae Rd
acguucuugcucagc

SEQ ID NO: 702299 - RNA, 14 nt, Haemophilus influenzae Rd
acgugcgauaaaau

SEQ ID NO: 702300 - RNA, 17 nt, Haemophilus influenzae Rd
acgugcgauaaaaucaa

SEQ ID NO: 702301 - RNA, 15 nt, Haemophilus influenzae Rd
acgugcgaauuuuua

SEQ ID NO: 702302 - RNA, 16 nt, Haemophilus influenzae Rd
acguuacuaaaauccu

SEQ ID NO: 702303 - RNA, 16 nt, Haemophilus influenzae Rd
acguuaucaaagaaac

SEQ ID NO: 702304 - RNA, 14 nt, Haemophilus influenzae Rd
acguagugcuggau

SEQ ID NO: 702305 - RNA, 17 nt, Haemophilus influenzae Rd
acguaguacaucauuug

SEQ ID NO: 702306 - RNA, 15 nt, Haemophilus influenzae Rd
acguagaaaacaaua

SEQ ID NO: 702307 - RNA, 23 nt, Haemophilus influenzae Rd
acguuggguguguauccacaaaa

SEQ ID NO: 702308 - RNA, 20 nt, Haemophilus influenzae Rd
acguugaguauagucauuca

SEQ ID NO: 702309 - RNA, 19 nt, Haemophilus influenzae Rd
acguugcucuuucaaguuu

SEQ ID NO: 702310 - RNA, 17 nt, Haemophilus influenzae Rd
acguugcaccuuuaaau

SEQ ID NO: 702311 - RNA, 13 nt, Haemophilus influenzae Rd
acguuuucaacag

SEQ ID NO: 702312 - RNA, 16 nt, Haemophilus influenzae Rd
acguuuucaacugcuu

SEQ ID NO: 702313 - RNA, 20 nt, Haemophilus influenzae Rd
acguuguucuucuguuaaac

SEQ ID NO: 702314 - RNA, 17 nt, Haemophilus influenzae Rd
acguuuauggcuuucaa

SEQ ID NO: 702315 - RNA, 16 nt, Haemophilus influenzae Rd
acuaaauauucaaucc

SEQ ID NO: 702316 - RNA, 22 nt, Haemophilus influenzae Rd
acuaaagacggcgcguucuucu

SEQ ID NO: 702317 - RNA, 15 nt, Haemophilus influenzae Rd
acuaaaucuugcuuu

SEQ ID NO: 702318 - RNA, 12 nt, Haemophilus influenzae Rd
acuaaaugugac

SEQ ID NO: 702319 - RNA, 14 nt, Haemophilus influenzae Rd
acuaaacaaauaaa

SEQ ID NO: 702320 - RNA, 15 nt, Haemophilus influenzae Rd
acuaaacaaauaaaa

SEQ ID NO: 702321 - RNA, 23 nt, Haemophilus influenzae Rd
acuaaacagaauuuacgaaaacu

SEQ ID NO: 702322 - RNA, 18 nt, Haemophilus influenzae Rd
acuaaacuguaaucuaaa

SEQ ID NO: 702323 - RNA, 11 nt, Haemophilus influenzae Rd
acuaaaagcau

SEQ ID NO: 702324 - RNA, 13 nt, Haemophilus influenzae Rd
acuaaaauaauuu

SEQ ID NO: 702325 - RNA, 17 nt, Haemophilus influenzae Rd
acuaaaauaucucuguu

SEQ ID NO: 702326 - RNA, 20 nt, Haemophilus influenzae Rd
acuaaaaaauuaaauuguaa

SEQ ID NO: 702327 - RNA, 12 nt, Haemophilus influenzae Rd
acuaaaaacaag

SEQ ID NO: 702328 - RNA, 22 nt, Haemophilus influenzae Rd
acuaaaaaucccauuuagguua

SEQ ID NO: 702329 - RNA, 17 nt, Haemophilus influenzae Rd
acuaaaaccacaucauu

SEQ ID NO: 702330 - RNA, 19 nt, Haemophilus influenzae Rd
acguuuuuccauagauuau

SEQ ID NO: 702331 - RNA, 13 nt, Haemophilus influenzae Rd
acguuuugcacca

SEQ ID NO: 702332 - RNA, 19 nt, Haemophilus influenzae Rd
acguuuuaaauuaauuaag

SEQ ID NO: 702333 - RNA, 13 nt, Haemophilus influenzae Rd
acuaaaaaacuaa

SEQ ID NO: 702334 - RNA, 22 nt, Haemophilus influenzae Rd
acguuuuuuacuugcgauaucu

SEQ ID NO: 702335 - RNA, 20 nt, Haemophilus influenzae Rd
acguuuuugucguucuuuuu

SEQ ID NO: 702336 - RNA, 17 nt, Haemophilus influenzae Rd
acuuaccuaaaaauuua

SEQ ID NO: 702337 - RNA, 20 nt, Haemophilus influenzae Rd
acuuaccuaaaaauuuaaau

SEQ ID NO: 702338 - RNA, 20 nt, Haemophilus influenzae Rd
acuuaccgaucauuucugga

SEQ ID NO: 702339 - RNA, 20 nt, Haemophilus influenzae Rd
acuuacaucugugauaacua

SEQ ID NO: 702340 - RNA, 18 nt, Haemophilus influenzae Rd
acuuaccacguucuugua

SEQ ID NO: 702341 - RNA, 18 nt, Haemophilus influenzae Rd
acuuaauugauuuuaaag

SEQ ID NO: 702342 - RNA, 15 nt, Haemophilus influenzae Rd
acuuaauuucacauu

SEQ ID NO: 702343 - RNA, 14 nt, Haemophilus influenzae Rd
acuuaauuucucag

SEQ ID NO: 702344 - RNA, 15 nt, Haemophilus influenzae Rd
acuuaauuucuuaau

SEQ ID NO: 702345 - RNA, 14 nt, Haemophilus influenzae Rd
acuuaaaagauuaa

SEQ ID NO: 702346 - RNA, 16 nt, Haemophilus influenzae Rd
acuuaaaagauuaaaa

SEQ ID NO: 702347 - RNA, 22 nt, Haemophilus influenzae Rd
acuuaaaaucuugguuuaaauu

SEQ ID NO: 702348 - RNA, 16 nt, Haemophilus influenzae Rd
acuuaacgaaccauca

SEQ ID NO: 702349 - RNA, 20 nt, Haemophilus influenzae Rd
acuuaauguuaauaauuuau

SEQ ID NO: 702350 - RNA, 18 nt, Haemophilus influenzae Rd
acuuaaccaaauaggcac

SEQ ID NO: 702351 - RNA, 16 nt, Haemophilus influenzae Rd
acuuaaaguuaucaaa

SEQ ID NO: 702352 - RNA, 16 nt, Haemophilus influenzae Rd
acuuaaauaguuaauu

SEQ ID NO: 702353 - RNA, 23 nt, Haemophilus influenzae Rd
acuuaaauuacgaccuuuacuuu

SEQ ID NO: 702354 - RNA, 21 nt, Haemophilus influenzae Rd
acuuaaauuuuuauaaaguuu

SEQ ID NO: 702355 - RNA, 20 nt, Haemophilus influenzae Rd
acuuaaagcaccgcauuaau

SEQ ID NO: 702356 - RNA, 16 nt, Haemophilus influenzae Rd
acuggaugaaaucauu

SEQ ID NO: 702357 - RNA, 17 nt, Haemophilus influenzae Rd
acuguugccauaaauuu

SEQ ID NO: 702358 - RNA, 14 nt, Haemophilus influenzae Rd
acugugcauuaaau

SEQ ID NO: 702359 - RNA, 22 nt, Haemophilus influenzae Rd
acuguuccgccacaaguagauu

SEQ ID NO: 702360 - RNA, 21 nt, Haemophilus influenzae Rd
acuucagcagcaaaaucuucu

SEQ ID NO: 702361 - RNA, 17 nt, Haemophilus influenzae Rd
acuucagcauaauguuu

SEQ ID NO: 702362 - RNA, 20 nt, Haemophilus influenzae Rd
acuucagaauucaucacauc

SEQ ID NO: 702363 - RNA, 22 nt, Haemophilus influenzae Rd
acuucagugcguaaugcaagca

SEQ ID NO: 702364 - RNA, 16 nt, Haemophilus influenzae Rd
acuucaggguuuucau

SEQ ID NO: 702365 - RNA, 18 nt, Haemophilus influenzae Rd
acuucaggguuuucauca

SEQ ID NO: 702366 - RNA, 19 nt, Haemophilus influenzae Rd
acuucaggguuuucaucau

SEQ ID NO: 702367 - RNA, 21 nt, Haemophilus influenzae Rd
acuucaggguuuucaucauua

SEQ ID NO: 702368 - RNA, 17 nt, Haemophilus influenzae Rd
acuucagcuaauaaagu

SEQ ID NO: 702369 - RNA, 15 nt, Haemophilus influenzae Rd
acuucaccaaucaca

SEQ ID NO: 702370 - RNA, 20 nt, Haemophilus influenzae Rd
acuucaauuuuuuaucaaau

SEQ ID NO: 702371 - RNA, 16 nt, Haemophilus influenzae Rd
acuucaauuucaccgc

SEQ ID NO: 702372 - RNA, 14 nt, Haemophilus influenzae Rd
acuucaaccacuuc

SEQ ID NO: 702373 - RNA, 23 nt, Haemophilus influenzae Rd
acuucaacgccguauuuggcaaa

SEQ ID NO: 702374 - RNA, 22 nt, Haemophilus influenzae Rd
acuucaauagauaaaucaaaac

SEQ ID NO: 702375 - RNA, 17 nt, Haemophilus influenzae Rd
acuuaucuuaaaaaaga

SEQ ID NO: 702376 - RNA, 16 nt, Haemophilus influenzae Rd
acuuaucuaaaaagau

SEQ ID NO: 702377 - RNA, 17 nt, Haemophilus influenzae Rd
acuuagcgcauuuuucu

SEQ ID NO: 702378 - RNA, 20 nt, Haemophilus influenzae Rd
acuuagcgcauuuuucuuua

SEQ ID NO: 702379 - RNA, 14 nt, Haemophilus influenzae Rd
acuuagauauauua

SEQ ID NO: 702380 - RNA, 22 nt, Haemophilus influenzae Rd
acuuauucgguguucugcauca

SEQ ID NO: 702381 - RNA, 21 nt, Haemophilus influenzae Rd
acuuauuagagugcagauuuu

SEQ ID NO: 702382 - RNA, 18 nt, Haemophilus influenzae Rd
acuucuuuagcugcaaua

SEQ ID NO: 702383 - RNA, 20 nt, Haemophilus influenzae Rd
acuucuuguggagauugcgc

SEQ ID NO: 702384 - RNA, 12 nt, Haemophilus influenzae Rd
acuucuuccgcu

SEQ ID NO: 702385 - RNA, 23 nt, Haemophilus influenzae Rd
acuugagccugaaucgacacauc

SEQ ID NO: 702386 - RNA, 18 nt, Haemophilus influenzae Rd
acuugagcguaacccaaa

SEQ ID NO: 702387 - RNA, 14 nt, Haemophilus influenzae Rd
acuugagauuuuuu

SEQ ID NO: 702388 - RNA, 18 nt, Haemophilus influenzae Rd
acuugacgguuuuuauua

SEQ ID NO: 702389 - RNA, 23 nt, Haemophilus influenzae Rd
acuugacgguuuuuauuagagaa

SEQ ID NO: 702390 - RNA, 15 nt, Haemophilus influenzae Rd
acuugacguaaugcu

SEQ ID NO: 702391 - RNA, 23 nt, Haemophilus influenzae Rd
acuugacguuguucuucuguuaa

SEQ ID NO: 702392 - RNA, 19 nt, Haemophilus influenzae Rd
acuugagaaaguaauggaa

SEQ ID NO: 702393 - RNA, 19 nt, Haemophilus influenzae Rd
acuugaauggcuaaagaaa

SEQ ID NO: 702394 - RNA, 14 nt, Haemophilus influenzae Rd
acuugaauugaaga

SEQ ID NO: 702395 - RNA, 15 nt, Haemophilus influenzae Rd
acuugaccagagcca

SEQ ID NO: 702396 - RNA, 16 nt, Haemophilus influenzae Rd
acuugaccagagccaa

SEQ ID NO: 702397 - RNA, 23 nt, Haemophilus influenzae Rd
acuugaccagagccaaauacaau

SEQ ID NO: 702398 - RNA, 12 nt, Haemophilus influenzae Rd
acuucuaugaag

SEQ ID NO: 702399 - RNA, 14 nt, Haemophilus influenzae Rd
acuucuaaaaccaa

SEQ ID NO: 702400 - RNA, 16 nt, Haemophilus influenzae Rd
acuucuaacuaaaaaa

SEQ ID NO: 702401 - RNA, 18 nt, Haemophilus influenzae Rd
acuucugcgccuaaucca

SEQ ID NO: 702402 - RNA, 15 nt, Haemophilus influenzae Rd
acuucugcugcacga

SEQ ID NO: 702403 - RNA, 17 nt, Haemophilus influenzae Rd
acuucucuuauuugugu

SEQ ID NO: 702404 - RNA, 13 nt, Haemophilus influenzae Rd
acuucuucaauac

SEQ ID NO: 702405 - RNA, 17 nt, Haemophilus influenzae Rd
acuucuguaagcagcua

SEQ ID NO: 702406 - RNA, 13 nt, Haemophilus influenzae Rd
acuucgcuuacgc

SEQ ID NO: 702407 - RNA, 16 nt, Haemophilus influenzae Rd
acuucgcuuacguuca

SEQ ID NO: 702408 - RNA, 17 nt, Haemophilus influenzae Rd
acuucggggaucauuuc

SEQ ID NO: 702409 - RNA, 16 nt, Haemophilus influenzae Rd
acuucgauauuuuccg

SEQ ID NO: 702410 - RNA, 20 nt, Haemophilus influenzae Rd
acuuccuaaacuacaacagc

SEQ ID NO: 702411 - RNA, 20 nt, Haemophilus influenzae Rd
acuucaucaauggcaucgcu

SEQ ID NO: 702412 - RNA, 13 nt, Haemophilus influenzae Rd
acuucauccauug

SEQ ID NO: 702413 - RNA, 16 nt, Haemophilus influenzae Rd
acuuccacaggcuuga

SEQ ID NO: 702414 - RNA, 14 nt, Haemophilus influenzae Rd
acuuccacaucgcu

SEQ ID NO: 702415 - RNA, 22 nt, Haemophilus influenzae Rd
acuucauuaaaaccaauuuuuu

SEQ ID NO: 702416 - RNA, 17 nt, Haemophilus influenzae Rd
acuucaucuauauuaua

SEQ ID NO: 702417 - RNA, 15 nt, Haemophilus influenzae Rd
acugaucauaaucca

SEQ ID NO: 702418 - RNA, 19 nt, Haemophilus influenzae Rd
acugaguucuguaauucac

SEQ ID NO: 702419 - RNA, 20 nt, Haemophilus influenzae Rd
acugcaacguuacucaucau

SEQ ID NO: 702420 - RNA, 20 nt, Haemophilus influenzae Rd
acugcauauccaaagcaauu

SEQ ID NO: 702421 - RNA, 20 nt, Haemophilus influenzae Rd
acugcauauucauaaaaggc

SEQ ID NO: 702422 - RNA, 22 nt, Haemophilus influenzae Rd
acugcauauucauaaaaggcaa

SEQ ID NO: 702423 - RNA, 15 nt, Haemophilus influenzae Rd
acugauuuaaaaaaa

SEQ ID NO: 702424 - RNA, 12 nt, Haemophilus influenzae Rd
acugauuucacg

SEQ ID NO: 702425 - RNA, 19 nt, Haemophilus influenzae Rd
acugauuuccuguaaaaaa

SEQ ID NO: 702426 - RNA, 20 nt, Haemophilus influenzae Rd
acugauuuccuguaaaaaac

SEQ ID NO: 702427 - RNA, 15 nt, Haemophilus influenzae Rd
acugauuuaguucaa

SEQ ID NO: 702428 - RNA, 21 nt, Haemophilus influenzae Rd
acugauuuugaguuaggcauu

SEQ ID NO: 702429 - RNA, 14 nt, Haemophilus influenzae Rd
acugauuuuuuuau

SEQ ID NO: 702430 - RNA, 22 nt, Haemophilus influenzae Rd
acugagcuuaucgcaaucacga

SEQ ID NO: 702431 - RNA, 17 nt, Haemophilus influenzae Rd
acugagcccacaacuac

SEQ ID NO: 702432 - RNA, 18 nt, Haemophilus influenzae Rd
acugagcccacaacuaca

SEQ ID NO: 702433 - RNA, 14 nt, Haemophilus influenzae Rd
acugagaucucuau

SEQ ID NO: 702434 - RNA, 15 nt, Haemophilus influenzae Rd
acugaaauucauuca

SEQ ID NO: 702435 - RNA, 12 nt, Haemophilus influenzae Rd
acugaaaucaag

SEQ ID NO: 702436 - RNA, 17 nt, Haemophilus influenzae Rd
acucuuucaaaaaucaa

SEQ ID NO: 702437 - RNA, 20 nt, Haemophilus influenzae Rd
acucuuuuuuagauaaaaag

SEQ ID NO: 702438 - RNA, 15 nt, Haemophilus influenzae Rd
acugaaaaaagugcg

SEQ ID NO: 702439 - RNA, 18 nt, Haemophilus influenzae Rd
acugcucuuggauuuuuu

SEQ ID NO: 702440 - RNA, 16 nt, Haemophilus influenzae Rd
acugcugaauaaaccu

SEQ ID NO: 702441 - RNA, 16 nt, Haemophilus influenzae Rd
acuggaaauucuucaa

SEQ ID NO: 702442 - RNA, 14 nt, Haemophilus influenzae Rd
acuggaauaaagca

SEQ ID NO: 702443 - RNA, 14 nt, Haemophilus influenzae Rd
acugcuuuuuucca

SEQ ID NO: 702444 - RNA, 17 nt, Haemophilus influenzae Rd
acuggaccuaaucccau

SEQ ID NO: 702445 - RNA, 13 nt, Haemophilus influenzae Rd
acuggacuccaag

SEQ ID NO: 702446 - RNA, 20 nt, Haemophilus influenzae Rd
acugcgcagauuaauccgcu

SEQ ID NO: 702447 - RNA, 13 nt, Haemophilus influenzae Rd
acucgaauuauuu

SEQ ID NO: 702448 - RNA, 13 nt, Haemophilus influenzae Rd
acucgaaaaggca

SEQ ID NO: 702449 - RNA, 15 nt, Haemophilus influenzae Rd
acuccuauuaguauu

SEQ ID NO: 702450 - RNA, 20 nt, Haemophilus influenzae Rd
acuccuauuaguauuuaagc

SEQ ID NO: 702451 - RNA, 17 nt, Haemophilus influenzae Rd
acucgcuguaacaucaa

SEQ ID NO: 702452 - RNA, 16 nt, Haemophilus influenzae Rd
acuauuuuuuucucug

SEQ ID NO: 702453 - RNA, 13 nt, Haemophilus influenzae Rd
acuauuuuauaau

SEQ ID NO: 702454 - RNA, 17 nt, Haemophilus influenzae Rd
acuauuuuuuauuuaua

SEQ ID NO: 702455 - RNA, 14 nt, Haemophilus influenzae Rd
acuccguccuucag

SEQ ID NO: 702456 - RNA, 18 nt, Haemophilus influenzae Rd
acucuaccaucuaaaguu

SEQ ID NO: 702457 - RNA, 19 nt, Haemophilus influenzae Rd
acucguuuuuuauuuugug

SEQ ID NO: 702458 - RNA, 13 nt, Haemophilus influenzae Rd
acucuaaauugau

SEQ ID NO: 702459 - RNA, 23 nt, Haemophilus influenzae Rd
acucuaagcuuaauauguucuuu

SEQ ID NO: 702460 - RNA, 21 nt, Haemophilus influenzae Rd
acucugacaguuuaucucuuu

SEQ ID NO: 702461 - RNA, 18 nt, Haemophilus influenzae Rd
acucucuugggugguaaa

SEQ ID NO: 702462 - RNA, 21 nt, Haemophilus influenzae Rd
acucucugacuucuagccaua

SEQ ID NO: 702463 - RNA, 23 nt, Haemophilus influenzae Rd
acucuuggcuaacuucuuccacu

SEQ ID NO: 702464 - RNA, 16 nt, Haemophilus influenzae Rd
acucuuccauuuuuau

SEQ ID NO: 702465 - RNA, 13 nt, Haemophilus influenzae Rd
acucuucaaguuu

SEQ ID NO: 702466 - RNA, 14 nt, Haemophilus influenzae Rd
acucuuaauuuuug

SEQ ID NO: 702467 - RNA, 19 nt, Haemophilus influenzae Rd
acucuuaauuuuugauuua

SEQ ID NO: 702468 - RNA, 12 nt, Haemophilus influenzae Rd
acucuuaacaaa

SEQ ID NO: 702469 - RNA, 15 nt, Haemophilus influenzae Rd
acucuuaacaaaaca

SEQ ID NO: 702470 - RNA, 17 nt, Haemophilus influenzae Rd
acucuuaacaaaacaga

SEQ ID NO: 702471 - RNA, 17 nt, Haemophilus influenzae Rd
acucuuaaccuaccgga

SEQ ID NO: 702472 - RNA, 18 nt, Haemophilus influenzae Rd
aaucauaccaauugcaac

SEQ ID NO: 702473 - RNA, 12 nt, Haemophilus influenzae Rd
aaucauacuaaa

SEQ ID NO: 702474 - RNA, 16 nt, Haemophilus influenzae Rd
aaucauagaaaucccu

SEQ ID NO: 702475 - RNA, 17 nt, Haemophilus influenzae Rd
aaucauagaaaucccuu

SEQ ID NO: 702476 - RNA, 22 nt, Haemophilus influenzae Rd
aaucauagaaaucccuugacca

SEQ ID NO: 702477 - RNA, 19 nt, Haemophilus influenzae Rd
aaucauaaaaaaaucugca

SEQ ID NO: 702478 - RNA, 13 nt, Haemophilus influenzae Rd
aaucauaaaaaca

SEQ ID NO: 702479 - RNA, 16 nt, Haemophilus influenzae Rd
aaucauaaaaacaaua

SEQ ID NO: 702480 - RNA, 15 nt, Haemophilus influenzae Rd
aaucauaaaauuucc

SEQ ID NO: 702481 - RNA, 17 nt, Haemophilus influenzae Rd
aaucauaaucgccaaaa

SEQ ID NO: 702482 - RNA, 16 nt, Haemophilus influenzae Rd
aaucauaaucugaaag

SEQ ID NO: 702483 - RNA, 16 nt, Haemophilus influenzae Rd
aaaaauuacuuaauua

SEQ ID NO: 702484 - RNA, 18 nt, Haemophilus influenzae Rd
aaaaauuaaggaaagccc

SEQ ID NO: 702485 - RNA, 13 nt, Haemophilus influenzae Rd
aaaaauuaauacu

SEQ ID NO: 702486 - RNA, 16 nt, Haemophilus influenzae Rd
aaaaauuaucaucauu

SEQ ID NO: 702487 - RNA, 14 nt, Haemophilus influenzae Rd
aaaaauuaucaaaa

SEQ ID NO: 702488 - RNA, 22 nt, Haemophilus influenzae Rd
aaaaauuaucaaaagaaaagau

SEQ ID NO: 702489 - RNA, 21 nt, Haemophilus influenzae Rd
aaaaauuaaccgcacuuuaaa

SEQ ID NO: 702490 - RNA, 21 nt, Haemophilus influenzae Rd
aaucauauacucguucguuau

SEQ ID NO: 702491 - RNA, 20 nt, Haemophilus influenzae Rd
aaucauaggcuucuuguuua

SEQ ID NO: 702492 - RNA, 17 nt, Haemophilus influenzae Rd
aaaaauguuauaaauaa

SEQ ID NO: 702493 - RNA, 19 nt, Haemophilus influenzae Rd
aaaaauguucauuuuuaug

SEQ ID NO: 702494 - RNA, 15 nt, Haemophilus influenzae Rd
aaucauaucuaacau

SEQ ID NO: 702495 - RNA, 15 nt, Haemophilus influenzae Rd
aaucaggcuuucauu

SEQ ID NO: 702496 - RNA, 17 nt, Haemophilus influenzae Rd
aaucaggcuuucauuuu

SEQ ID NO: 702497 - RNA, 19 nt, Haemophilus influenzae Rd
aaucaggguuauuugcaau

SEQ ID NO: 702498 - RNA, 20 nt, Haemophilus influenzae Rd
aaucagcgaauuaaagugca

SEQ ID NO: 702499 - RNA, 16 nt, Haemophilus influenzae Rd
aaucagcgaguuugau

SEQ ID NO: 702500 - RNA, 18 nt, Haemophilus influenzae Rd
aaucagcuaauaacacau

SEQ ID NO: 702501 - RNA, 20 nt, Haemophilus influenzae Rd
aaucagcuaauaacacaucu

SEQ ID NO: 702502 - RNA, 13 nt, Haemophilus influenzae Rd
aaucaucaaacac

SEQ ID NO: 702503 - RNA, 14 nt, Haemophilus influenzae Rd
aaucaucaaagcuc

SEQ ID NO: 702504 - RNA, 13 nt, Haemophilus influenzae Rd
aaucaucagaaua

SEQ ID NO: 702505 - RNA, 14 nt, Haemophilus influenzae Rd
aaucaucagaauaa

SEQ ID NO: 702506 - RNA, 14 nt, Haemophilus influenzae Rd
aaaaauuauugcau

SEQ ID NO: 702507 - RNA, 20 nt, Haemophilus influenzae Rd
aaaaauuauugcauuuuuaa

SEQ ID NO: 702508 - RNA, 22 nt, Haemophilus influenzae Rd
aaaaauuauugcauuuuuaacc

SEQ ID NO: 702509 - RNA, 24 nt, Haemophilus influenzae Rd
aaaaauuccaguucuccuucucca

SEQ ID NO: 702510 - RNA, 19 nt, Haemophilus influenzae Rd
aaucaucgcgaugacuaaa

SEQ ID NO: 702511 - RNA, 22 nt, Haemophilus influenzae Rd
aaucaucgcgaugacuaaacaa

SEQ ID NO: 702512 - RNA, 13 nt, Haemophilus influenzae Rd
aaucaucccuucu

SEQ ID NO: 702513 - RNA, 23 nt, Haemophilus influenzae Rd
aaucaucuaccacgauaaauccu

SEQ ID NO: 702514 - RNA, 13 nt, Haemophilus influenzae Rd
aaucauuaaauaa

SEQ ID NO: 702515 - RNA, 15 nt, Haemophilus influenzae Rd
aaucauuaacaaauu

SEQ ID NO: 702516 - RNA, 12 nt, Haemophilus influenzae Rd
aaucauugcaag

SEQ ID NO: 702517 - RNA, 17 nt, Haemophilus influenzae Rd
aauccaacguuuuaauc

SEQ ID NO: 702518 - RNA, 14 nt, Haemophilus influenzae Rd
aaucauugcugcaa

SEQ ID NO: 702519 - RNA, 15 nt, Haemophilus influenzae Rd
aaucauugcugcaau

SEQ ID NO: 702520 - RNA, 13 nt, Haemophilus influenzae Rd
aauccaaguauaa

SEQ ID NO: 702521 - RNA, 23 nt, Haemophilus influenzae Rd
aauccauaauuucagcaucagaa

SEQ ID NO: 702522 - RNA, 17 nt, Haemophilus influenzae Rd
aauccacgccagcuaca

SEQ ID NO: 702523 - RNA, 16 nt, Haemophilus influenzae Rd
aauccacacuuuaaaa

SEQ ID NO: 702524 - RNA, 14 nt, Haemophilus influenzae Rd
aauccaauuucaca

SEQ ID NO: 702525 - RNA, 12 nt, Haemophilus influenzae Rd
aaucuaucccaa

SEQ ID NO: 702526 - RNA, 13 nt, Haemophilus influenzae Rd
aaucuaucccaac

SEQ ID NO: 702527 - RNA, 14 nt, Haemophilus influenzae Rd
aaucguuugucgua

SEQ ID NO: 702528 - RNA, 18 nt, Haemophilus influenzae Rd
aaucguuugucguaauaa

SEQ ID NO: 702529 - RNA, 13 nt, Haemophilus influenzae Rd
aaucguuuguucu

SEQ ID NO: 702530 - RNA, 23 nt, Haemophilus influenzae Rd
aaucguugaucagcaaucaacac

SEQ ID NO: 702531 - RNA, 13 nt, Haemophilus influenzae Rd
aaucuaaacuugu

SEQ ID NO: 702532 - RNA, 19 nt, Haemophilus influenzae Rd
aaucuaaacuuguuaaaua

SEQ ID NO: 702533 - RNA, 20 nt, Haemophilus influenzae Rd
aaucuaaagcgaucaucauu

SEQ ID NO: 702534 - RNA, 16 nt, Haemophilus influenzae Rd
aaucuaaauauucucu

SEQ ID NO: 702535 - RNA, 16 nt, Haemophilus influenzae Rd
aaucuaaaaaaccuug

SEQ ID NO: 702536 - RNA, 13 nt, Haemophilus influenzae Rd
aaucuaaaaauau

SEQ ID NO: 702537 - RNA, 23 nt, Haemophilus influenzae Rd
aaucuaaaaauauguauuugcau

SEQ ID NO: 702538 - RNA, 15 nt, Haemophilus influenzae Rd
aaucuagaagaucaa

SEQ ID NO: 702539 - RNA, 21 nt, Haemophilus influenzae Rd
aaucuagagauuguaugaaaa

SEQ ID NO: 702540 - RNA, 23 nt, Haemophilus influenzae Rd
aaucuagagauuguaugaaaaau

SEQ ID NO: 702541 - RNA, 17 nt, Haemophilus influenzae Rd
aaucuaacguauuuaaa

SEQ ID NO: 702542 - RNA, 14 nt, Haemophilus influenzae Rd
aaucgcuucauucu

SEQ ID NO: 702543 - RNA, 19 nt, Haemophilus influenzae Rd
aaucgcuugugcagaauau

SEQ ID NO: 702544 - RNA, 19 nt, Haemophilus influenzae Rd
aaucgcuuuauacugcucu

SEQ ID NO: 702545 - RNA, 16 nt, Haemophilus influenzae Rd
aaucggcaauucugcu

SEQ ID NO: 702546 - RNA, 20 nt, Haemophilus influenzae Rd
aaucguacaucgaaaacaua

SEQ ID NO: 702547 - RNA, 15 nt, Haemophilus influenzae Rd
aauccugcuucuuua

SEQ ID NO: 702548 - RNA, 21 nt, Haemophilus influenzae Rd
aauccugcgggucuuguucca

SEQ ID NO: 702549 - RNA, 17 nt, Haemophilus influenzae Rd
aauccugcgugaaugac

SEQ ID NO: 702550 - RNA, 24 nt, Haemophilus influenzae Rd
aauccugcgugaaugacuuucacu

SEQ ID NO: 702551 - RNA, 14 nt, Haemophilus influenzae Rd
aauccucuuuaaaa

SEQ ID NO: 702552 - RNA, 12 nt, Haemophilus influenzae Rd
aauccugaagau

SEQ ID NO: 702553 - RNA, 21 nt, Haemophilus influenzae Rd
aaucccauagcggauaaccaa

SEQ ID NO: 702554 - RNA, 23 nt, Haemophilus influenzae Rd
aaucccauagcggauaaccaaaa

SEQ ID NO: 702555 - RNA, 14 nt, Haemophilus influenzae Rd
aauccccuaaacua

SEQ ID NO: 702556 - RNA, 14 nt, Haemophilus influenzae Rd
aauccccuuucuuc

SEQ ID NO: 702557 - RNA, 14 nt, Haemophilus influenzae Rd
aaucgccuuuuuga

SEQ ID NO: 702558 - RNA, 21 nt, Haemophilus influenzae Rd
aaaaauuuuacauauaaaagu

SEQ ID NO: 702559 - RNA, 19 nt, Haemophilus influenzae Rd
aaaaauuucuuuuuuauca

SEQ ID NO: 702560 - RNA, 13 nt, Haemophilus influenzae Rd
aaaaauuugaaug

SEQ ID NO: 702561 - RNA, 15 nt, Haemophilus influenzae Rd
aaucgcguagugugc

SEQ ID NO: 702562 - RNA, 15 nt, Haemophilus influenzae Rd
aaucgaaguaugaaa

SEQ ID NO: 702563 - RNA, 19 nt, Haemophilus influenzae Rd
aaucgaagaaauaugauuu

SEQ ID NO: 702564 - RNA, 15 nt, Haemophilus influenzae Rd
aaucgaaauuaaaau

SEQ ID NO: 702565 - RNA, 16 nt, Haemophilus influenzae Rd
aaucgcccuauuaaaa

SEQ ID NO: 702566 - RNA, 23 nt, Haemophilus influenzae Rd
aaucgcccuuuuguuauuaaaua

SEQ ID NO: 702567 - RNA, 18 nt, Haemophilus influenzae Rd
aaucgcccacgaaaagca

SEQ ID NO: 702568 - RNA, 21 nt, Haemophilus influenzae Rd
aaucgccccaaaagcugccau

SEQ ID NO: 702569 - RNA, 12 nt, Haemophilus influenzae Rd
aaucuuuaagug

SEQ ID NO: 702570 - RNA, 14 nt, Haemophilus influenzae Rd
aaucuuuacgaauu

SEQ ID NO: 702571 - RNA, 14 nt, Haemophilus influenzae Rd
aaucuuguuuuaau

SEQ ID NO: 702572 - RNA, 17 nt, Haemophilus influenzae Rd
aaucuuuaaaauguaaa

SEQ ID NO: 702573 - RNA, 16 nt, Haemophilus influenzae Rd
aaucuuuaucaaucaa

SEQ ID NO: 702574 - RNA, 14 nt, Haemophilus influenzae Rd
aaucucucaaaaau

SEQ ID NO: 702575 - RNA, 23 nt, Haemophilus influenzae Rd
aaucuugcuuuugguuuucuggu

SEQ ID NO: 702576 - RNA, 20 nt, Haemophilus influenzae Rd
aaucuuggugccaauccauu

SEQ ID NO: 702577 - RNA, 21 nt, Haemophilus influenzae Rd
aaucuugguuuaaauuuuaaa

SEQ ID NO: 702578 - RNA, 18 nt, Haemophilus influenzae Rd
aaucuuggcucauuuuaa

SEQ ID NO: 702579 - RNA, 23 nt, Haemophilus influenzae Rd
aaucuuggcucauuuuaaagagu

SEQ ID NO: 702580 - RNA, 19 nt, Haemophilus influenzae Rd
aaucuuguuggaucuucca

SEQ ID NO: 702581 - RNA, 20 nt, Haemophilus influenzae Rd
aaucuuuuuguuaauaaaag

SEQ ID NO: 702582 - RNA, 22 nt, Haemophilus influenzae Rd
aaucuuuuuucuugcuaaaaag

SEQ ID NO: 702583 - RNA, 23 nt, Haemophilus influenzae Rd
aaucuuuuuucuugcuaaaaaga

SEQ ID NO: 702584 - RNA, 17 nt, Haemophilus influenzae Rd
aaugaaaacuaugcucu

SEQ ID NO: 702585 - RNA, 15 nt, Haemophilus influenzae Rd
aaucuuugaauuggu

SEQ ID NO: 702586 - RNA, 17 nt, Haemophilus influenzae Rd
aaucuuuggcaaaaaau

SEQ ID NO: 702587 - RNA, 12 nt, Haemophilus influenzae Rd
aaucuuuuauuc

SEQ ID NO: 702588 - RNA, 13 nt, Haemophilus influenzae Rd
aaugaauuaaaag

SEQ ID NO: 702589 - RNA, 23 nt, Haemophilus influenzae Rd
aaugaaguucacuucaucuauau

SEQ ID NO: 702590 - RNA, 14 nt, Haemophilus influenzae Rd
aaugaauaaaacuu

SEQ ID NO: 702591 - RNA, 14 nt, Haemophilus influenzae Rd
aaugaaauuuuuga

SEQ ID NO: 702592 - RNA, 12 nt, Haemophilus influenzae Rd
aaugaacuuucu

SEQ ID NO: 702593 - RNA, 13 nt, Haemophilus influenzae Rd
aaugaacuuucua

SEQ ID NO: 702594 - RNA, 18 nt, Haemophilus influenzae Rd
aaugaacuuucuacgaca

SEQ ID NO: 702595 - RNA, 20 nt, Haemophilus influenzae Rd
aaugaacuuucuacgacauu

SEQ ID NO: 702596 - RNA, 15 nt, Haemophilus influenzae Rd
aaugaaauauuccaa

SEQ ID NO: 702597 - RNA, 23 nt, Haemophilus influenzae Rd
aaugaaacuucaccagugaauuu

SEQ ID NO: 702598 - RNA, 19 nt, Haemophilus influenzae Rd
aaugaaauuucuugcucua

SEQ ID NO: 702599 - RNA, 22 nt, Haemophilus influenzae Rd
aaugaaauuaaccccagaaaug

SEQ ID NO: 702600 - RNA, 19 nt, Haemophilus influenzae Rd
aaugaaauuaauaagcccu

SEQ ID NO: 702601 - RNA, 12 nt, Haemophilus influenzae Rd
aaugaaauucag

SEQ ID NO: 702602 - RNA, 23 nt, Haemophilus influenzae Rd
aaugauaaccuugcgcugcuuua

SEQ ID NO: 702603 - RNA, 18 nt, Haemophilus influenzae Rd
aaugaggaaaauaaagga

SEQ ID NO: 702604 - RNA, 18 nt, Haemophilus influenzae Rd
aaugagacuuaaccaaau

SEQ ID NO: 702605 - RNA, 18 nt, Haemophilus influenzae Rd
aaugacuggcuugugaaa

SEQ ID NO: 702606 - RNA, 16 nt, Haemophilus influenzae Rd
aaugacgagugagaua

SEQ ID NO: 702607 - RNA, 19 nt, Haemophilus influenzae Rd
aaugacgcguuaauuuuua

SEQ ID NO: 702608 - RNA, 20 nt, Haemophilus influenzae Rd
aaugacgcguuaauuuuuaa

SEQ ID NO: 702609 - RNA, 15 nt, Haemophilus influenzae Rd
aaugacagaaucuaa

SEQ ID NO: 702610 - RNA, 12 nt, Haemophilus influenzae Rd
aaugacaucaau

SEQ ID NO: 702611 - RNA, 22 nt, Haemophilus influenzae Rd
aaugaccgcacuuuuuugauau

SEQ ID NO: 702612 - RNA, 22 nt, Haemophilus influenzae Rd
aaugacauuaaagcaauugcua

SEQ ID NO: 702613 - RNA, 16 nt, Haemophilus influenzae Rd
aaugcucgaauauaag

SEQ ID NO: 702614 - RNA, 17 nt, Haemophilus influenzae Rd
aaugcucucuuuuaauc

SEQ ID NO: 702615 - RNA, 16 nt, Haemophilus influenzae Rd
aaugcucacuucgcuu

SEQ ID NO: 702616 - RNA, 23 nt, Haemophilus influenzae Rd
aaugcgugguuacgaaaaguuga

SEQ ID NO: 702617 - RNA, 13 nt, Haemophilus influenzae Rd
aaugcuaaaccaa

SEQ ID NO: 702618 - RNA, 23 nt, Haemophilus influenzae Rd
aaugcuaaacguucuuggaaauc

SEQ ID NO: 702619 - RNA, 23 nt, Haemophilus influenzae Rd
aauggcaucgcuggcuaaauuuu

SEQ ID NO: 702620 - RNA, 20 nt, Haemophilus influenzae Rd
aauggcaauuuuauauucau

SEQ ID NO: 702621 - RNA, 17 nt, Haemophilus influenzae Rd
aauggcaaacaaaauaa

SEQ ID NO: 702622 - RNA, 19 nt, Haemophilus influenzae Rd
aauggcaaacaaaauaaau

SEQ ID NO: 702623 - RNA, 19 nt, Haemophilus influenzae Rd
aauggcaacgccaauaaaa

SEQ ID NO: 702624 - RNA, 13 nt, Haemophilus influenzae Rd
aauggcaaucaca

SEQ ID NO: 702625 - RNA, 19 nt, Haemophilus influenzae Rd
aauggcaaucacaaaucca

SEQ ID NO: 702626 - RNA, 13 nt, Haemophilus influenzae Rd
aauggauuauaaa

SEQ ID NO: 702627 - RNA, 15 nt, Haemophilus influenzae Rd
aauggggcaauuuuu

SEQ ID NO: 702628 - RNA, 18 nt, Haemophilus influenzae Rd
aaugggggaauaaauucu

SEQ ID NO: 702629 - RNA, 15 nt, Haemophilus influenzae Rd
aaugggacaaagcag

SEQ ID NO: 702630 - RNA, 15 nt, Haemophilus influenzae Rd
aauggcuuuuuugcc

SEQ ID NO: 702631 - RNA, 13 nt, Haemophilus influenzae Rd
aauggcuugcucu

SEQ ID NO: 702632 - RNA, 15 nt, Haemophilus influenzae Rd
aauggcuugcucugu

SEQ ID NO: 702633 - RNA, 17 nt, Haemophilus influenzae Rd
aauggcuuuaauuuaca

SEQ ID NO: 702634 - RNA, 14 nt, Haemophilus influenzae Rd
aauggcuuuccaau

SEQ ID NO: 702635 - RNA, 16 nt, Haemophilus influenzae Rd
aauggcuaucugcuuu

SEQ ID NO: 702636 - RNA, 14 nt, Haemophilus influenzae Rd
aauggcgguauauu

SEQ ID NO: 702637 - RNA, 20 nt, Haemophilus influenzae Rd
aaugaucagcuaaacgcacu

SEQ ID NO: 702638 - RNA, 16 nt, Haemophilus influenzae Rd
aaugaucauuuugggc

SEQ ID NO: 702639 - RNA, 20 nt, Haemophilus influenzae Rd
aaugaucauuuugggcucaa

SEQ ID NO: 702640 - RNA, 13 nt, Haemophilus influenzae Rd
aaugaugaaacaa

SEQ ID NO: 702641 - RNA, 22 nt, Haemophilus influenzae Rd
aaugaucgaguaaaaauaaaau

SEQ ID NO: 702642 - RNA, 19 nt, Haemophilus influenzae Rd
aaugauguaggcaaaaaca

SEQ ID NO: 702643 - RNA, 12 nt, Haemophilus influenzae Rd
aaugauuaauau

SEQ ID NO: 702644 - RNA, 16 nt, Haemophilus influenzae Rd
aaugauuaauuaaauu

SEQ ID NO: 702645 - RNA, 19 nt, Haemophilus influenzae Rd
aaugauuaucuagaaaacu

SEQ ID NO: 702646 - RNA, 16 nt, Haemophilus influenzae Rd
aaugaugaguagauuu

SEQ ID NO: 702647 - RNA, 20 nt, Haemophilus influenzae Rd
aaugaugaguagauuuuuau

SEQ ID NO: 702648 - RNA, 18 nt, Haemophilus influenzae Rd
aaugcccguuacuuuuau

SEQ ID NO: 702649 - RNA, 22 nt, Haemophilus influenzae Rd
aaugccccagcaagaagcauga

SEQ ID NO: 702650 - RNA, 23 nt, Haemophilus influenzae Rd
aaugcccacuaacucacauugcc

SEQ ID NO: 702651 - RNA, 20 nt, Haemophilus influenzae Rd
aaugcccagcaauuuauugu

SEQ ID NO: 702652 - RNA, 20 nt, Haemophilus influenzae Rd
aaugccgcaaaaccuaacau

SEQ ID NO: 702653 - RNA, 15 nt, Haemophilus influenzae Rd
aaugccgaagccuug

SEQ ID NO: 702654 - RNA, 18 nt, Haemophilus influenzae Rd
aaugccgauaauagacau

SEQ ID NO: 702655 - RNA, 18 nt, Haemophilus influenzae Rd
aaugcauugaugacugca

SEQ ID NO: 702656 - RNA, 16 nt, Haemophilus influenzae Rd
aaugcauugauugcua

SEQ ID NO: 702657 - RNA, 23 nt, Haemophilus influenzae Rd
aaugcauugauugcuaaauaaau

SEQ ID NO: 702658 - RNA, 23 nt, Haemophilus influenzae Rd
aaugcauuggcugaauuuaauuc

SEQ ID NO: 702659 - RNA, 21 nt, Haemophilus influenzae Rd
aaugauucguggcaauuuuuc

SEQ ID NO: 702660 - RNA, 20 nt, Haemophilus influenzae Rd
aaugauugagcgauagaaau

SEQ ID NO: 702661 - RNA, 15 nt, Haemophilus influenzae Rd
aaugcaggcaacuca

SEQ ID NO: 702662 - RNA, 15 nt, Haemophilus influenzae Rd
aaugcaguaacgcga

SEQ ID NO: 702663 - RNA, 14 nt, Haemophilus influenzae Rd
aaugcaguaauaaa

SEQ ID NO: 702664 - RNA, 16 nt, Haemophilus influenzae Rd
aaugcaguaauaaauc

SEQ ID NO: 702665 - RNA, 18 nt, Haemophilus influenzae Rd
aaugcaguaauaaauccu

SEQ ID NO: 702666 - RNA, 21 nt, Haemophilus influenzae Rd
aaugcaguagguauguuuagu

SEQ ID NO: 702667 - RNA, 13 nt, Haemophilus influenzae Rd
aauuuucaucaau

SEQ ID NO: 702668 - RNA, 17 nt, Haemophilus influenzae Rd
aauuuuauuccaccaca

SEQ ID NO: 702669 - RNA, 20 nt, Haemophilus influenzae Rd
aauuuucaaacacaacauaa

SEQ ID NO: 702670 - RNA, 13 nt, Haemophilus influenzae Rd
aauuuucaauagc

SEQ ID NO: 702671 - RNA, 18 nt, Haemophilus influenzae Rd
aauuuucgacuugugcaa

SEQ ID NO: 702672 - RNA, 18 nt, Haemophilus influenzae Rd
aauuuucggcaagaaauu

SEQ ID NO: 702673 - RNA, 20 nt, Haemophilus influenzae Rd
aauuuucggcaagaaauuca

SEQ ID NO: 702674 - RNA, 19 nt, Haemophilus influenzae Rd
aauuuuccuguuugagcaa

SEQ ID NO: 702675 - RNA, 22 nt, Haemophilus influenzae Rd
aauuuuccgcauaaauaauaaa

SEQ ID NO: 702676 - RNA, 18 nt, Haemophilus influenzae Rd
aauuuuccaaauuccauc

SEQ ID NO: 702677 - RNA, 18 nt, Haemophilus influenzae Rd
aauuuuccaauucuaguu

SEQ ID NO: 702678 - RNA, 15 nt, Haemophilus influenzae Rd
aauuuucccauuuaa

SEQ ID NO: 702679 - RNA, 12 nt, Haemophilus influenzae Rd
aauuuucccauu

SEQ ID NO: 702680 - RNA, 16 nt, Haemophilus influenzae Rd
aauuuuacguuucauu

SEQ ID NO: 702681 - RNA, 18 nt, Haemophilus influenzae Rd
aauuuuacguuucauuuu

SEQ ID NO: 702682 - RNA, 13 nt, Haemophilus influenzae Rd
aauuuuacuucuu

SEQ ID NO: 702683 - RNA, 17 nt, Haemophilus influenzae Rd
aauuuuauauucauuga

SEQ ID NO: 702684 - RNA, 17 nt, Haemophilus influenzae Rd
aauuuuaucuaugaaaa

SEQ ID NO: 702685 - RNA, 18 nt, Haemophilus influenzae Rd
aauuuuaucuaugaaaaa

SEQ ID NO: 702686 - RNA, 15 nt, Haemophilus influenzae Rd
aauuuuauuauguuu

SEQ ID NO: 702687 - RNA, 23 nt, Haemophilus influenzae Rd
aauuuuauuauguuuuguagauu

SEQ ID NO: 702688 - RNA, 13 nt, Haemophilus influenzae Rd
aauuuuaugccgu

SEQ ID NO: 702689 - RNA, 12 nt, Haemophilus influenzae Rd
aauuuugaugaa

SEQ ID NO: 702690 - RNA, 15 nt, Haemophilus influenzae Rd
aauuuugaugugauu

SEQ ID NO: 702691 - RNA, 22 nt, Haemophilus influenzae Rd
aauuuucuuuucaaacaacaag

SEQ ID NO: 702692 - RNA, 22 nt, Haemophilus influenzae Rd
aauuuucugugagucuugcuuu

SEQ ID NO: 702693 - RNA, 19 nt, Haemophilus influenzae Rd
aauuuuguaagcauuaaaa

SEQ ID NO: 702694 - RNA, 23 nt, Haemophilus influenzae Rd
aauuuuguaagcauuaaaaauuu

SEQ ID NO: 702695 - RNA, 19 nt, Haemophilus influenzae Rd
aauuuuguccgaaaaaacu

SEQ ID NO: 702696 - RNA, 13 nt, Haemophilus influenzae Rd
aauuuugguuaaa

SEQ ID NO: 702697 - RNA, 22 nt, Haemophilus influenzae Rd
aauuuugcguguguuaucacaa

SEQ ID NO: 702698 - RNA, 21 nt, Haemophilus influenzae Rd
aauuuugcuuuaaaucaaaua

SEQ ID NO: 702699 - RNA, 20 nt, Haemophilus influenzae Rd
aauuuuggaucauuagcaac

SEQ ID NO: 702700 - RNA, 18 nt, Haemophilus influenzae Rd
aauuuuggcgaaccuuuc

SEQ ID NO: 702701 - RNA, 21 nt, Haemophilus influenzae Rd
aauuuuuccacauuaaacuga

SEQ ID NO: 702702 - RNA, 12 nt, Haemophilus influenzae Rd
aauuuuucaccu

SEQ ID NO: 702703 - RNA, 22 nt, Haemophilus influenzae Rd
aauuuuucacuguauuggaaaa

SEQ ID NO: 702704 - RNA, 21 nt, Haemophilus influenzae Rd
aauuuuucgcaagauagcaaa

SEQ ID NO: 702705 - RNA, 21 nt, Haemophilus influenzae Rd
aauuuuucgucaaucaucccu

SEQ ID NO: 702706 - RNA, 22 nt, Haemophilus influenzae Rd
aauuuuguuagcggauaaaaua

SEQ ID NO: 702707 - RNA, 21 nt, Haemophilus influenzae Rd
aauuuuuaacgcgcuacaaua

SEQ ID NO: 702708 - RNA, 18 nt, Haemophilus influenzae Rd
aauuuuuaccgcacuuuu

SEQ ID NO: 702709 - RNA, 15 nt, Haemophilus influenzae Rd
aauuuuuagugauuu

SEQ ID NO: 702710 - RNA, 18 nt, Haemophilus influenzae Rd
aauuuuuauaauuuugau

SEQ ID NO: 702711 - RNA, 17 nt, Haemophilus influenzae Rd
aauuugcucaauaauuu

SEQ ID NO: 702712 - RNA, 22 nt, Haemophilus influenzae Rd
aauuugcucaauaauuucaaua

SEQ ID NO: 702713 - RNA, 14 nt, Haemophilus influenzae Rd
aauuugccaucacu

SEQ ID NO: 702714 - RNA, 17 nt, Haemophilus influenzae Rd
aauuuggcucacaagac

SEQ ID NO: 702715 - RNA, 16 nt, Haemophilus influenzae Rd
aauuugcaucauuucu

SEQ ID NO: 702716 - RNA, 19 nt, Haemophilus influenzae Rd
aauuugaucauauuagaau

SEQ ID NO: 702717 - RNA, 19 nt, Haemophilus influenzae Rd
aauuugaucuaauuugcca

SEQ ID NO: 702718 - RNA, 21 nt, Haemophilus influenzae Rd
aauuugaucuaauuugccaag

SEQ ID NO: 702719 - RNA, 14 nt, Haemophilus influenzae Rd
aauuugaucuuaga

SEQ ID NO: 702720 - RNA, 15 nt, Haemophilus influenzae Rd
aauuucuuguuuaaa

SEQ ID NO: 702721 - RNA, 23 nt, Haemophilus influenzae Rd
aauuucuuguuuaaauucaggcu

SEQ ID NO: 702722 - RNA, 23 nt, Haemophilus influenzae Rd
aauuucuuuaauugauuaaaaaa

SEQ ID NO: 702723 - RNA, 11 nt, Haemophilus influenzae Rd
aauuucuuuug

SEQ ID NO: 702724 - RNA, 17 nt, Haemophilus influenzae Rd
aauuucuuuugcaagaa

SEQ ID NO: 702725 - RNA, 11 nt, Haemophilus influenzae Rd
aauuucuuuuu

SEQ ID NO: 702726 - RNA, 15 nt, Haemophilus influenzae Rd
aauuugaaaagaauu

SEQ ID NO: 702727 - RNA, 23 nt, Haemophilus influenzae Rd
aauuugacgauaauauuuuugcc

SEQ ID NO: 702728 - RNA, 22 nt, Haemophilus influenzae Rd
aauuugacauuccuauucuaaa

SEQ ID NO: 702729 - RNA, 23 nt, Haemophilus influenzae Rd
aauuugagcggugaauucuuuuc

SEQ ID NO: 702730 - RNA, 22 nt, Haemophilus influenzae Rd
aauuugagguauuguccuucau

SEQ ID NO: 702731 - RNA, 18 nt, Haemophilus influenzae Rd
aauuugagucucaaauuu

SEQ ID NO: 702732 - RNA, 22 nt, Haemophilus influenzae Rd
aauuugagucucaaauuuuuca

SEQ ID NO: 702733 - RNA, 16 nt, Haemophilus influenzae Rd
aauuugguuuugcucu

SEQ ID NO: 702734 - RNA, 23 nt, Haemophilus influenzae Rd
aauuugguuuugcucuuuuucca

SEQ ID NO: 702735 - RNA, 23 nt, Haemophilus influenzae Rd
aauuugggugguuuuuguuuaau

SEQ ID NO: 702736 - RNA, 19 nt, Haemophilus influenzae Rd
aauuugcgucuuaaauuag

SEQ ID NO: 702737 - RNA, 16 nt, Haemophilus influenzae Rd
aauuuggguaguuuau

SEQ ID NO: 702738 - RNA, 19 nt, Haemophilus influenzae Rd
aauuuggucuguuucuucu

SEQ ID NO: 702739 - RNA, 16 nt, Haemophilus influenzae Rd
aauuuguacaucccau

SEQ ID NO: 702740 - RNA, 14 nt, Haemophilus influenzae Rd
aauuuguaagauuu

SEQ ID NO: 702741 - RNA, 22 nt, Haemophilus influenzae Rd
aauuugucgauaaaagaagcua

SEQ ID NO: 702742 - RNA, 13 nt, Haemophilus influenzae Rd
aauuugugcauaa

SEQ ID NO: 702743 - RNA, 21 nt, Haemophilus influenzae Rd
aauuuuaaauuuucugcguuu

SEQ ID NO: 702744 - RNA, 19 nt, Haemophilus influenzae Rd
aauuuuaacgccugcugca

SEQ ID NO: 702745 - RNA, 18 nt, Haemophilus influenzae Rd
aauuugugugguggaaag

SEQ ID NO: 702746 - RNA, 19 nt, Haemophilus influenzae Rd
aauuuguuagaucaaauuu

SEQ ID NO: 702747 - RNA, 11 nt, Haemophilus influenzae Rd
aauuuguuguu

SEQ ID NO: 702748 - RNA, 14 nt, Haemophilus influenzae Rd
aauuuuaaaaccac

SEQ ID NO: 702749 - RNA, 15 nt, Haemophilus influenzae Rd
aauuuuaaaauaguu

SEQ ID NO: 702750 - RNA, 18 nt, Haemophilus influenzae Rd
aauuuuaaacagcaaaag

SEQ ID NO: 702751 - RNA, 23 nt, Haemophilus influenzae Rd
aauuuuaaaccgucauuuauaaa

SEQ ID NO: 702752 - RNA, 17 nt, Haemophilus influenzae Rd
aauuuuaaucgcacuua

SEQ ID NO: 702753 - RNA, 18 nt, Haemophilus influenzae Rd
aauuuuacagguguaguu

SEQ ID NO: 702754 - RNA, 13 nt, Haemophilus influenzae Rd
aauuuuacaguuu

SEQ ID NO: 702755 - RNA, 22 nt, Haemophilus influenzae Rd
aauuuuacguaguacaucauuu

SEQ ID NO: 702756 - RNA, 22 nt, Haemophilus influenzae Rd
aauuucacguaguuaaaccaaa

SEQ ID NO: 702757 - RNA, 15 nt, Haemophilus influenzae Rd
aauuucacugaaagu

SEQ ID NO: 702758 - RNA, 17 nt, Haemophilus influenzae Rd
aauuucacugaaaguaa

SEQ ID NO: 702759 - RNA, 15 nt, Haemophilus influenzae Rd
aauuucacaauuuuu

SEQ ID NO: 702760 - RNA, 16 nt, Haemophilus influenzae Rd
aauuucaauuaaauca

SEQ ID NO: 702761 - RNA, 20 nt, Haemophilus influenzae Rd
aauuucaauuaaaucaaaaa

SEQ ID NO: 702762 - RNA, 15 nt, Haemophilus influenzae Rd
aauuucaaaaucaca

SEQ ID NO: 702763 - RNA, 18 nt, Haemophilus influenzae Rd
aauuucacauuaugauau

SEQ ID NO: 702764 - RNA, 19 nt, Haemophilus influenzae Rd
aauuucaccgcauucuucu

SEQ ID NO: 702765 - RNA, 23 nt, Haemophilus influenzae Rd
aauuucaccgcauucuucuuuua

SEQ ID NO: 702766 - RNA, 22 nt, Haemophilus influenzae Rd
aauuucagcgaaacuugagauu

SEQ ID NO: 702767 - RNA, 16 nt, Haemophilus influenzae Rd
aauuucagcacccaca

SEQ ID NO: 702768 - RNA, 18 nt, Haemophilus influenzae Rd
aauuucagaauuaguaaa

SEQ ID NO: 702769 - RNA, 22 nt, Haemophilus influenzae Rd
aauuucagaauuaguaaagaaa

SEQ ID NO: 702770 - RNA, 15 nt, Haemophilus influenzae Rd
aauuucagcuuaaau

SEQ ID NO: 702771 - RNA, 14 nt, Haemophilus influenzae Rd
aauuucauuuuaac

SEQ ID NO: 702772 - RNA, 20 nt, Haemophilus influenzae Rd
aauuuccauaugaccauuaa

SEQ ID NO: 702773 - RNA, 16 nt, Haemophilus influenzae Rd
aauuucaucuuuuaaa

SEQ ID NO: 702774 - RNA, 19 nt, Haemophilus influenzae Rd
aauuucauucaacaauuca

SEQ ID NO: 702775 - RNA, 18 nt, Haemophilus influenzae Rd
aauuucauaaaaauuagg

SEQ ID NO: 702776 - RNA, 17 nt, Haemophilus influenzae Rd
aauuucaucgcauuuuu

SEQ ID NO: 702777 - RNA, 21 nt, Haemophilus influenzae Rd
aauuucauaguuuucugauuu

SEQ ID NO: 702778 - RNA, 17 nt, Haemophilus influenzae Rd
aauuucauaucuucuuc

SEQ ID NO: 702779 - RNA, 22 nt, Haemophilus influenzae Rd
aauuucugcugccauaauggaa

SEQ ID NO: 702780 - RNA, 20 nt, Haemophilus influenzae Rd
aauuucuuaauuaagauaau

SEQ ID NO: 702781 - RNA, 15 nt, Haemophilus influenzae Rd
aauuucuucaacuaa

SEQ ID NO: 702782 - RNA, 18 nt, Haemophilus influenzae Rd
aauuucucuacuaauuca

SEQ ID NO: 702783 - RNA, 13 nt, Haemophilus influenzae Rd
aauuucucagcuu

SEQ ID NO: 702784 - RNA, 14 nt, Haemophilus influenzae Rd
aauuucccuaaaau

SEQ ID NO: 702785 - RNA, 20 nt, Haemophilus influenzae Rd
aauuuccuguauaauuuuuc

SEQ ID NO: 702786 - RNA, 20 nt, Haemophilus influenzae Rd
aauuucgccgccuuugauuu

SEQ ID NO: 702787 - RNA, 20 nt, Haemophilus influenzae Rd
aauuucgacauauucuaccg

SEQ ID NO: 702788 - RNA, 15 nt, Haemophilus influenzae Rd
aauuuaugcuguuuu

SEQ ID NO: 702789 - RNA, 13 nt, Haemophilus influenzae Rd
aauuuauguuaca

SEQ ID NO: 702790 - RNA, 13 nt, Haemophilus influenzae Rd
aauuuauuacaaa

SEQ ID NO: 702791 - RNA, 18 nt, Haemophilus influenzae Rd
aauuuauuacaaacaaaa

SEQ ID NO: 702792 - RNA, 12 nt, Haemophilus influenzae Rd
aauuuauuauaa

SEQ ID NO: 702793 - RNA, 19 nt, Haemophilus influenzae Rd
aauuuauuauaaaaauauu

SEQ ID NO: 702794 - RNA, 22 nt, Haemophilus influenzae Rd
aauuuauucgggcuuaaaaaag

SEQ ID NO: 702795 - RNA, 13 nt, Haemophilus influenzae Rd
aauuuauuuucua

SEQ ID NO: 702796 - RNA, 15 nt, Haemophilus influenzae Rd
aauuuauucaaaaua

SEQ ID NO: 702797 - RNA, 12 nt, Haemophilus influenzae Rd
aauuucaaaauc

SEQ ID NO: 702798 - RNA, 14 nt, Haemophilus influenzae Rd
aauuuaucaucaau

SEQ ID NO: 702799 - RNA, 17 nt, Haemophilus influenzae Rd
aauuuaucaucuaguuu

SEQ ID NO: 702800 - RNA, 18 nt, Haemophilus influenzae Rd
aauuuaucgcacuguuuc

SEQ ID NO: 702801 - RNA, 20 nt, Haemophilus influenzae Rd
aauuuaucgccauagaaaau

SEQ ID NO: 702802 - RNA, 18 nt, Haemophilus influenzae Rd
aauuuaucgggaauaaua

SEQ ID NO: 702803 - RNA, 16 nt, Haemophilus influenzae Rd
aauuuaucuaaaagua

SEQ ID NO: 702804 - RNA, 20 nt, Haemophilus influenzae Rd
aauuuagcguauuuuguucu

SEQ ID NO: 702805 - RNA, 23 nt, Haemophilus influenzae Rd
aauuuaacauaacuuuccauaua

SEQ ID NO: 702806 - RNA, 13 nt, Haemophilus influenzae Rd
aauuuaaauuuau

SEQ ID NO: 702807 - RNA, 13 nt, Haemophilus influenzae Rd
aauuuaagaaaaa

SEQ ID NO: 702808 - RNA, 13 nt, Haemophilus influenzae Rd
aauuuaaauauaa

SEQ ID NO: 702809 - RNA, 16 nt, Haemophilus influenzae Rd
aauuuaccgcacuuua

SEQ ID NO: 702810 - RNA, 19 nt, Haemophilus influenzae Rd
aauuuaccgcacuuugauu

SEQ ID NO: 702811 - RNA, 22 nt, Haemophilus influenzae Rd
aauuuacucacaacaaagaugg

SEQ ID NO: 702812 - RNA, 13 nt, Haemophilus influenzae Rd
aauuuaaauaaag

SEQ ID NO: 702813 - RNA, 18 nt, Haemophilus influenzae Rd
aauuuaaauaaagcauua

SEQ ID NO: 702814 - RNA, 13 nt, Haemophilus influenzae Rd
aauuuaaauaaua

SEQ ID NO: 702815 - RNA, 15 nt, Haemophilus influenzae Rd
aauuuaaauaauaaa

SEQ ID NO: 702816 - RNA, 20 nt, Haemophilus influenzae Rd
aauuuaaauaauaaauccaa

SEQ ID NO: 702817 - RNA, 22 nt, Haemophilus influenzae Rd
aauugcguguuuauauaccauu

SEQ ID NO: 702818 - RNA, 21 nt, Haemophilus influenzae Rd
aauugcgguggaagucugcua

SEQ ID NO: 702819 - RNA, 20 nt, Haemophilus influenzae Rd
aauggucuucaucgccuguu

SEQ ID NO: 702820 - RNA, 20 nt, Haemophilus influenzae Rd
aauguagagauaauaaauau

SEQ ID NO: 702821 - RNA, 22 nt, Haemophilus influenzae Rd
aaugguguuuuaugaauaacuu

SEQ ID NO: 702822 - RNA, 15 nt, Haemophilus influenzae Rd
aauguaguuggcaua

SEQ ID NO: 702823 - RNA, 14 nt, Haemophilus influenzae Rd
aauguaucugauuu

SEQ ID NO: 702824 - RNA, 21 nt, Haemophilus influenzae Rd
aauguaucugauuuuuuaaga

SEQ ID NO: 702825 - RNA, 17 nt, Haemophilus influenzae Rd
aauuaaggacuaaacuu

SEQ ID NO: 702826 - RNA, 23 nt, Haemophilus influenzae Rd
aauuaaggauuucuuaugaaaaa

SEQ ID NO: 702827 - RNA, 16 nt, Haemophilus influenzae Rd
aauuaauacgccaaga

SEQ ID NO: 702828 - RNA, 22 nt, Haemophilus influenzae Rd
aauuaauacgucaauugcuaaa

SEQ ID NO: 702829 - RNA, 14 nt, Haemophilus influenzae Rd
aauuaauaagcccu

SEQ ID NO: 702830 - RNA, 14 nt, Haemophilus influenzae Rd
aauuaauaaaaaau

SEQ ID NO: 702831 - RNA, 20 nt, Haemophilus influenzae Rd
aauuaccugaugaaaucauu

SEQ ID NO: 702832 - RNA, 17 nt, Haemophilus influenzae Rd
aauuaccugugaaaaca

SEQ ID NO: 702833 - RNA, 19 nt, Haemophilus influenzae Rd
aauuaccugugaaaacacg

SEQ ID NO: 702834 - RNA, 20 nt, Haemophilus influenzae Rd
aauuaccgcacuuuagguuu

SEQ ID NO: 702835 - RNA, 17 nt, Haemophilus influenzae Rd
aauuaccgcacuuuuua

SEQ ID NO: 702836 - RNA, 15 nt, Haemophilus influenzae Rd
aauuaccgcucuuuu

SEQ ID NO: 702837 - RNA, 13 nt, Haemophilus influenzae Rd
aauuaccuuguuu

SEQ ID NO: 702838 - RNA, 17 nt, Haemophilus influenzae Rd
aauuacgacauucuuua

SEQ ID NO: 702839 - RNA, 18 nt, Haemophilus influenzae Rd
aauuacgacauucuuuag

SEQ ID NO: 702840 - RNA, 23 nt, Haemophilus influenzae Rd
aauuacgaaguggcguuugcucu

SEQ ID NO: 702841 - RNA, 17 nt, Haemophilus influenzae Rd
aauuacccaaaugauga

SEQ ID NO: 702842 - RNA, 18 nt, Haemophilus influenzae Rd
aauuacccaaaugaugaa

SEQ ID NO: 702843 - RNA, 19 nt, Haemophilus influenzae Rd
aauuacccaaaugaugaaa

SEQ ID NO: 702844 - RNA, 20 nt, Haemophilus influenzae Rd
aauuacauucccaaauaaua

SEQ ID NO: 702845 - RNA, 14 nt, Haemophilus influenzae Rd
aauuaccacaugca

SEQ ID NO: 702846 - RNA, 15 nt, Haemophilus influenzae Rd
aauuaccacguucau

SEQ ID NO: 702847 - RNA, 20 nt, Haemophilus influenzae Rd
aauuaauccaucauuuuucg

SEQ ID NO: 702848 - RNA, 14 nt, Haemophilus influenzae Rd
aauuaaucugcauu

SEQ ID NO: 702849 - RNA, 22 nt, Haemophilus influenzae Rd
aauuaaucugcauucuaaaagu

SEQ ID NO: 702850 - RNA, 20 nt, Haemophilus influenzae Rd
aauuaauggcaauucgugaa

SEQ ID NO: 702851 - RNA, 20 nt, Haemophilus influenzae Rd
aauuaauggcucgauuaaac

SEQ ID NO: 702852 - RNA, 16 nt, Haemophilus influenzae Rd
aauuaaugggcuaguu

SEQ ID NO: 702853 - RNA, 21 nt, Haemophilus influenzae Rd
aauuaaugugcuauagcuugc

SEQ ID NO: 702854 - RNA, 23 nt, Haemophilus influenzae Rd
aauuaaucuuuuuucuuucuagu

SEQ ID NO: 702855 - RNA, 11 nt, Haemophilus influenzae Rd
aauuaaugaac

SEQ ID NO: 702856 - RNA, 13 nt, Haemophilus influenzae Rd
aauuacaaaacca

SEQ ID NO: 702857 - RNA, 14 nt, Haemophilus influenzae Rd
aauuacaaaaccaa

SEQ ID NO: 702858 - RNA, 16 nt, Haemophilus influenzae Rd
aauuaauucucccuca

SEQ ID NO: 702859 - RNA, 13 nt, Haemophilus influenzae Rd
aauuaauugcucu

SEQ ID NO: 702860 - RNA, 22 nt, Haemophilus influenzae Rd
aauuacuggcguagcugcaggg

SEQ ID NO: 702861 - RNA, 19 nt, Haemophilus influenzae Rd
aauuacugcaaaugcaggg

SEQ ID NO: 702862 - RNA, 18 nt, Haemophilus influenzae Rd
aauuacuucuuacaacaa

SEQ ID NO: 702863 - RNA, 19 nt, Haemophilus influenzae Rd
aauuacuucuuacaacaaa

SEQ ID NO: 702864 - RNA, 22 nt, Haemophilus influenzae Rd
aauuacuaaugccgcaaaaccu

SEQ ID NO: 702865 - RNA, 16 nt, Haemophilus influenzae Rd
aauuacgccuaaccaa

SEQ ID NO: 702866 - RNA, 22 nt, Haemophilus influenzae Rd
aauuacguuguuguucuaacau

SEQ ID NO: 702867 - RNA, 21 nt, Haemophilus influenzae Rd
aauuagauuucuguuaaaucu

SEQ ID NO: 702868 - RNA, 22 nt, Haemophilus influenzae Rd
aauuagauuucuguuaaaucua

SEQ ID NO: 702869 - RNA, 15 nt, Haemophilus influenzae Rd
aauuagaugauuuua

SEQ ID NO: 702870 - RNA, 17 nt, Haemophilus influenzae Rd
aauuagaugauuuuaaa

SEQ ID NO: 702871 - RNA, 20 nt, Haemophilus influenzae Rd
aauuagaugauuuuaaaaua

SEQ ID NO: 702872 - RNA, 23 nt, Haemophilus influenzae Rd
aauuagaugauuuuaaaauaaau

SEQ ID NO: 702873 - RNA, 20 nt, Haemophilus influenzae Rd
aauuagaugauuuuaaagua

SEQ ID NO: 702874 - RNA, 15 nt, Haemophilus influenzae Rd
aauuagcuaaauacu

SEQ ID NO: 702875 - RNA, 21 nt, Haemophilus influenzae Rd
aauuagcucaauagauuuaau

SEQ ID NO: 702876 - RNA, 16 nt, Haemophilus influenzae Rd
aauuacuuuuauaucu

SEQ ID NO: 702877 - RNA, 14 nt, Haemophilus influenzae Rd
aauuagacuuucuu

SEQ ID NO: 702878 - RNA, 16 nt, Haemophilus influenzae Rd
aauuagacuuucuuaa

SEQ ID NO: 702879 - RNA, 16 nt, Haemophilus influenzae Rd
aauuagauaauacaga

SEQ ID NO: 702880 - RNA, 20 nt, Haemophilus influenzae Rd
aauuagaauaacaacaaaag

SEQ ID NO: 702881 - RNA, 17 nt, Haemophilus influenzae Rd
aauuauuuuaaauaaau

SEQ ID NO: 702882 - RNA, 16 nt, Haemophilus influenzae Rd
aauuauuucaguaacu

SEQ ID NO: 702883 - RNA, 17 nt, Haemophilus influenzae Rd
aauuauuucaguaacuu

SEQ ID NO: 702884 - RNA, 20 nt, Haemophilus influenzae Rd
aauuauuucaguaacuuuaa

SEQ ID NO: 702885 - RNA, 19 nt, Haemophilus influenzae Rd
aauuauguauuuucuuuaa

SEQ ID NO: 702886 - RNA, 23 nt, Haemophilus influenzae Rd
aauuauggguguuuaaauuuuua

SEQ ID NO: 702887 - RNA, 22 nt, Haemophilus influenzae Rd
aauuaguaguuagaauuuuaac

SEQ ID NO: 702888 - RNA, 22 nt, Haemophilus influenzae Rd
aauuaguauaaacaucagugau

SEQ ID NO: 702889 - RNA, 19 nt, Haemophilus influenzae Rd
aauuagguugaauuuuugu

SEQ ID NO: 702890 - RNA, 23 nt, Haemophilus influenzae Rd
aauuagguacagugaucacaagg

SEQ ID NO: 702891 - RNA, 18 nt, Haemophilus influenzae Rd
aauuagcugguuuauuua

SEQ ID NO: 702892 - RNA, 15 nt, Haemophilus influenzae Rd
aauuagcuuaauaaa

SEQ ID NO: 702893 - RNA, 18 nt, Haemophilus influenzae Rd
aauugacggcuucagaaa

SEQ ID NO: 702894 - RNA, 19 nt, Haemophilus influenzae Rd
aauugacggcuucagaaaa

SEQ ID NO: 702895 - RNA, 19 nt, Haemophilus influenzae Rd
aauugacgggcuaggcuuu

SEQ ID NO: 702896 - RNA, 20 nt, Haemophilus influenzae Rd
aauugacggugcauuugcau

SEQ ID NO: 702897 - RNA, 15 nt, Haemophilus influenzae Rd
aauugacguucuugc

SEQ ID NO: 702898 - RNA, 14 nt, Haemophilus influenzae Rd
aauugaauuaaaag

SEQ ID NO: 702899 - RNA, 16 nt, Haemophilus influenzae Rd
aauugacaauuaauau

SEQ ID NO: 702900 - RNA, 17 nt, Haemophilus influenzae Rd
aauugacaauuaauaua

SEQ ID NO: 702901 - RNA, 18 nt, Haemophilus influenzae Rd
aauugaauaucuaaauga

SEQ ID NO: 702902 - RNA, 21 nt, Haemophilus influenzae Rd
aauucuugucuuuuaaguuag

SEQ ID NO: 702903 - RNA, 19 nt, Haemophilus influenzae Rd
aauucuugugcaaaauaac

SEQ ID NO: 702904 - RNA, 14 nt, Haemophilus influenzae Rd
aauucuuguuuaau

SEQ ID NO: 702905 - RNA, 19 nt, Haemophilus influenzae Rd
aauucuuguuuaauauuuu

SEQ ID NO: 702906 - RNA, 14 nt, Haemophilus influenzae Rd
aauucuugccauaa

SEQ ID NO: 702907 - RNA, 17 nt, Haemophilus influenzae Rd
aauucuugaaugucuua

SEQ ID NO: 702908 - RNA, 19 nt, Haemophilus influenzae Rd
aauucuugaaugucuuaaa

SEQ ID NO: 702909 - RNA, 14 nt, Haemophilus influenzae Rd
aauucuugacguaa

SEQ ID NO: 702910 - RNA, 15 nt, Haemophilus influenzae Rd
aauucuucuaauuca

SEQ ID NO: 702911 - RNA, 19 nt, Haemophilus influenzae Rd
aauucuuuaaucguuacca

SEQ ID NO: 702912 - RNA, 14 nt, Haemophilus influenzae Rd
aauucuuuuaaaug

SEQ ID NO: 702913 - RNA, 12 nt, Haemophilus influenzae Rd
aauugaugcaca

SEQ ID NO: 702914 - RNA, 11 nt, Haemophilus influenzae Rd
aaaaauuuuug

SEQ ID NO: 702915 - RNA, 16 nt, Haemophilus influenzae Rd
aauugaucuaaauuau

SEQ ID NO: 702916 - RNA, 16 nt, Haemophilus influenzae Rd
aauugaucugcuggug

SEQ ID NO: 702917 - RNA, 16 nt, Haemophilus influenzae Rd
aauugaucaaaauuau

SEQ ID NO: 702918 - RNA, 18 nt, Haemophilus influenzae Rd
aauugauaccaagauaau

SEQ ID NO: 702919 - RNA, 17 nt, Haemophilus influenzae Rd
aauugagugaauuucuu

SEQ ID NO: 702920 - RNA, 19 nt, Haemophilus influenzae Rd
aauugagugaauuucuugc

SEQ ID NO: 702921 - RNA, 19 nt, Haemophilus influenzae Rd
aauugaguguggugaacag

SEQ ID NO: 702922 - RNA, 22 nt, Haemophilus influenzae Rd
aauugauuuuaaagaauguuug

SEQ ID NO: 702923 - RNA, 17 nt, Haemophilus influenzae Rd
aauugauuuucagaaag

SEQ ID NO: 702924 - RNA, 23 nt, Haemophilus influenzae Rd
aaaacaaaagcaguuaaacagcu

SEQ ID NO: 702925 - RNA, 15 nt, Haemophilus influenzae Rd
aauugauuaaaaaag

SEQ ID NO: 702926 - RNA, 21 nt, Haemophilus influenzae Rd
aauugauucauuugaugguaa

SEQ ID NO: 702927 - RNA, 17 nt, Haemophilus influenzae Rd
aauugauuccgauuuua

SEQ ID NO: 702928 - RNA, 13 nt, Haemophilus influenzae Rd
aauugcaaaaaac

SEQ ID NO: 702929 - RNA, 13 nt, Haemophilus influenzae Rd
aauugauuuuuca

SEQ ID NO: 702930 - RNA, 14 nt, Haemophilus influenzae Rd
aauucaauuuuccc

SEQ ID NO: 702931 - RNA, 17 nt, Haemophilus influenzae Rd
aauucaaugaaaugccc

SEQ ID NO: 702932 - RNA, 21 nt, Haemophilus influenzae Rd
aauuccgacuaaaaccaagaa

SEQ ID NO: 702933 - RNA, 15 nt, Haemophilus influenzae Rd
aauuccuaaaauaca

SEQ ID NO: 702934 - RNA, 23 nt, Haemophilus influenzae Rd
aauuccuacacccauuacaccga

SEQ ID NO: 702935 - RNA, 23 nt, Haemophilus influenzae Rd
aauucacagggcugaguccuuuu

SEQ ID NO: 702936 - RNA, 18 nt, Haemophilus influenzae Rd
aauucaagcaaauauuua

SEQ ID NO: 702937 - RNA, 17 nt, Haemophilus influenzae Rd
aauucaaccgcacuuua

SEQ ID NO: 702938 - RNA, 14 nt, Haemophilus influenzae Rd
aauucaaaaaccaa

SEQ ID NO: 702939 - RNA, 14 nt, Haemophilus influenzae Rd
aauucaagaugaua

SEQ ID NO: 702940 - RNA, 12 nt, Haemophilus influenzae Rd
aauucaaacaau

SEQ ID NO: 702941 - RNA, 13 nt, Haemophilus influenzae Rd
aauucaaacaaua

SEQ ID NO: 702942 - RNA, 13 nt, Haemophilus influenzae Rd
aauucaaagauuu

SEQ ID NO: 702943 - RNA, 18 nt, Haemophilus influenzae Rd
aauucaaaucuugacaua

SEQ ID NO: 702944 - RNA, 20 nt, Haemophilus influenzae Rd
aauucaaaucuugacauaau

SEQ ID NO: 702945 - RNA, 11 nt, Haemophilus influenzae Rd
aauucaacacg

SEQ ID NO: 702946 - RNA, 18 nt, Haemophilus influenzae Rd
aauucguuaauaaaucca

SEQ ID NO: 702947 - RNA, 17 nt, Haemophilus influenzae Rd
aauucgugccacaugau

SEQ ID NO: 702948 - RNA, 17 nt, Haemophilus influenzae Rd
aauucguacuuuugauu

SEQ ID NO: 702949 - RNA, 16 nt, Haemophilus influenzae Rd
aauucguuguaauuga

SEQ ID NO: 702950 - RNA, 17 nt, Haemophilus influenzae Rd
aauucguuucuugguuu

SEQ ID NO: 702951 - RNA, 19 nt, Haemophilus influenzae Rd
aauucguuuuucaaacuga

SEQ ID NO: 702952 - RNA, 13 nt, Haemophilus influenzae Rd
aauucuaaaacaa

SEQ ID NO: 702953 - RNA, 12 nt, Haemophilus influenzae Rd
aauucuaaaaaa

SEQ ID NO: 702954 - RNA, 15 nt, Haemophilus influenzae Rd
aauucgcugauuuau

SEQ ID NO: 702955 - RNA, 16 nt, Haemophilus influenzae Rd
aauucgcuuuuuuagu

SEQ ID NO: 702956 - RNA, 22 nt, Haemophilus influenzae Rd
aauucuucaauaacaacuggaa

SEQ ID NO: 702957 - RNA, 16 nt, Haemophilus influenzae Rd
aauucuguuuagucuu

SEQ ID NO: 702958 - RNA, 11 nt, Haemophilus influenzae Rd
aauucuuccaa

SEQ ID NO: 702959 - RNA, 21 nt, Haemophilus influenzae Rd
aauucuucccagcguaaaaau

SEQ ID NO: 702960 - RNA, 14 nt, Haemophilus influenzae Rd
aauucuguuuuugg

SEQ ID NO: 702961 - RNA, 21 nt, Haemophilus influenzae Rd
aauucuaauucugcuuuucca

SEQ ID NO: 702962 - RNA, 21 nt, Haemophilus influenzae Rd
acaagaugacugcaauuauca

SEQ ID NO: 702963 - RNA, 19 nt, Haemophilus influenzae Rd
acaagaugucaaaugugac

SEQ ID NO: 702964 - RNA, 17 nt, Haemophilus influenzae Rd
acaagaccaauauaauc

SEQ ID NO: 702965 - RNA, 12 nt, Haemophilus influenzae Rd
acaagaaauuuu

SEQ ID NO: 702966 - RNA, 12 nt, Haemophilus influenzae Rd
acaagcaacaau

SEQ ID NO: 702967 - RNA, 17 nt, Haemophilus influenzae Rd
acaagcaaguuugcgau

SEQ ID NO: 702968 - RNA, 23 nt, Haemophilus influenzae Rd
acaagcaaguuugcgaucaucac

SEQ ID NO: 702969 - RNA, 16 nt, Haemophilus influenzae Rd
acaagcaccacuucca

SEQ ID NO: 702970 - RNA, 23 nt, Haemophilus influenzae Rd
acaagcccacauuuggaaauguu

SEQ ID NO: 702971 - RNA, 16 nt, Haemophilus influenzae Rd
acaagccauauuuuag

SEQ ID NO: 702972 - RNA, 14 nt, Haemophilus influenzae Rd
acaagccccacagg

SEQ ID NO: 702973 - RNA, 14 nt, Haemophilus influenzae Rd
acaauauaaccagc

SEQ ID NO: 702974 - RNA, 13 nt, Haemophilus influenzae Rd
acaauaauaagca

SEQ ID NO: 702975 - RNA, 15 nt, Haemophilus influenzae Rd
acaauaacugccaca

SEQ ID NO: 702976 - RNA, 19 nt, Haemophilus influenzae Rd
acaauaacugccacaucau

SEQ ID NO: 702977 - RNA, 21 nt, Haemophilus influenzae Rd
acaauaacugcgccaauauaa

SEQ ID NO: 702978 - RNA, 14 nt, Haemophilus influenzae Rd
acaacggaagauuu

SEQ ID NO: 702979 - RNA, 21 nt, Haemophilus influenzae Rd
acaacggaagauuuacccaac

SEQ ID NO: 702980 - RNA, 23 nt, Haemophilus influenzae Rd
acaacguacguugguaaagccaa

SEQ ID NO: 702981 - RNA, 16 nt, Haemophilus influenzae Rd
aauuuuuucugaauaa

SEQ ID NO: 702982 - RNA, 19 nt, Haemophilus influenzae Rd
aauuuuuucuguuuuucca

SEQ ID NO: 702983 - RNA, 20 nt, Haemophilus influenzae Rd
aauuuuuucagauaaucaaa

SEQ ID NO: 702984 - RNA, 23 nt, Haemophilus influenzae Rd
aauuuuuugucugaaauuuugau

SEQ ID NO: 702985 - RNA, 13 nt, Haemophilus influenzae Rd
aauuuuuuaaccg

SEQ ID NO: 702986 - RNA, 16 nt, Haemophilus influenzae Rd
aauuuuuuacgauauu

SEQ ID NO: 702987 - RNA, 18 nt, Haemophilus influenzae Rd
aauuuuuuaucaaauaac

SEQ ID NO: 702988 - RNA, 16 nt, Haemophilus influenzae Rd
aauuuuuuauucaaaa

SEQ ID NO: 702989 - RNA, 18 nt, Haemophilus influenzae Rd
aauuuuuuauucaaaauu

SEQ ID NO: 702990 - RNA, 17 nt, Haemophilus influenzae Rd
aauuuuucuuuucuucu

SEQ ID NO: 702991 - RNA, 20 nt, Haemophilus influenzae Rd
aauuuuugcaaaaaguacuu

SEQ ID NO: 702992 - RNA, 13 nt, Haemophilus influenzae Rd
aauuuuugugauu

SEQ ID NO: 702993 - RNA, 13 nt, Haemophilus influenzae Rd
aauuuuuuauaaa

SEQ ID NO: 702994 - RNA, 17 nt, Haemophilus influenzae Rd
aauuuuuuauaaaauuu

SEQ ID NO: 702995 - RNA, 18 nt, Haemophilus influenzae Rd
acaacuucggaagaaaaa

SEQ ID NO: 702996 - RNA, 19 nt, Haemophilus influenzae Rd
acaacuucggaagaaaaag

SEQ ID NO: 702997 - RNA, 15 nt, Haemophilus influenzae Rd
acaacuucaucaaug

SEQ ID NO: 702998 - RNA, 22 nt, Haemophilus influenzae Rd
acaacugcuaggacauagccuu

SEQ ID NO: 702999 - RNA, 16 nt, Haemophilus influenzae Rd
acaacuuuuuauuuuc

SEQ ID NO: 703000 - RNA, 21 nt, Haemophilus influenzae Rd
acaacuuuuuauuuucugcag

SEQ ID NO: 703001 - RNA, 24 nt, Haemophilus influenzae Rd
acaagaaaccaaaauagcugugca

SEQ ID NO: 703002 - RNA, 18 nt, Haemophilus influenzae Rd
acaagaaauaauaaaaua

SEQ ID NO: 703003 - RNA, 14 nt, Haemophilus influenzae Rd
acaacuaccacagg

SEQ ID NO: 703004 - RNA, 15 nt, Haemophilus influenzae Rd
acaacucacaauaau

SEQ ID NO: 703005 - RNA, 21 nt, Haemophilus influenzae Rd
acaacuaaauaaggcguaaaa

SEQ ID NO: 703006 - RNA, 13 nt, Haemophilus influenzae Rd
acaacuaacauuu

SEQ ID NO: 703007 - RNA, 21 nt, Haemophilus influenzae Rd
acacaauaauauaggcgaaca

SEQ ID NO: 703008 - RNA, 15 nt, Haemophilus influenzae Rd
acacaccauuuuugc

SEQ ID NO: 703009 - RNA, 21 nt, Haemophilus influenzae Rd
acaauuucuaacaauguaguu

SEQ ID NO: 703010 - RNA, 17 nt, Haemophilus influenzae Rd
acaaugucagaaaagau

SEQ ID NO: 703011 - RNA, 17 nt, Haemophilus influenzae Rd
acaauuacuucuuacaa

SEQ ID NO: 703012 - RNA, 13 nt, Haemophilus influenzae Rd
acaauuacugcaa

SEQ ID NO: 703013 - RNA, 12 nt, Haemophilus influenzae Rd
acaaucuuguug

SEQ ID NO: 703014 - RNA, 15 nt, Haemophilus influenzae Rd
acaauauaauuauca

SEQ ID NO: 703015 - RNA, 19 nt, Haemophilus influenzae Rd
acaauauguauaauuccua

SEQ ID NO: 703016 - RNA, 20 nt, Haemophilus influenzae Rd
acaauguaguuucuucuuuc

SEQ ID NO: 703017 - RNA, 14 nt, Haemophilus influenzae Rd
acaaugcucacuuc

SEQ ID NO: 703018 - RNA, 18 nt, Haemophilus influenzae Rd
acaaugcuauaaaaccuu

SEQ ID NO: 703019 - RNA, 19 nt, Haemophilus influenzae Rd
acaaugcuaucaggcuuaa

SEQ ID NO: 703020 - RNA, 13 nt, Haemophilus influenzae Rd
acacaguuauuuu

SEQ ID NO: 703021 - RNA, 15 nt, Haemophilus influenzae Rd
acacaguuauuuuuu

SEQ ID NO: 703022 - RNA, 17 nt, Haemophilus influenzae Rd
acacaguuauuuuuuau

SEQ ID NO: 703023 - RNA, 13 nt, Haemophilus influenzae Rd
acacacuaaucaa

SEQ ID NO: 703024 - RNA, 14 nt, Haemophilus influenzae Rd
acacacuaaucaau

SEQ ID NO: 703025 - RNA, 16 nt, Haemophilus influenzae Rd
acacaccuauuuuuuc

SEQ ID NO: 703026 - RNA, 17 nt, Haemophilus influenzae Rd
acaccagucaauaaacu

SEQ ID NO: 703027 - RNA, 17 nt, Haemophilus influenzae Rd
acacugcccuucucugc

SEQ ID NO: 703028 - RNA, 12 nt, Haemophilus influenzae Rd
acacucuaucua

SEQ ID NO: 703029 - RNA, 13 nt, Haemophilus influenzae Rd
acacucuaucuaa

SEQ ID NO: 703030 - RNA, 19 nt, Haemophilus influenzae Rd
acacccuuuucaaacaaca

SEQ ID NO: 703031 - RNA, 22 nt, Haemophilus influenzae Rd
acacuaaucuaaacuuguuaaa

SEQ ID NO: 703032 - RNA, 15 nt, Haemophilus influenzae Rd
acacuauuaauuacu

SEQ ID NO: 703033 - RNA, 22 nt, Haemophilus influenzae Rd
acacuaaccaagcguuaaucca

SEQ ID NO: 703034 - RNA, 14 nt, Haemophilus influenzae Rd
acacguuugccaga

SEQ ID NO: 703035 - RNA, 20 nt, Haemophilus influenzae Rd
acacguuaugcguuuuuaau

SEQ ID NO: 703036 - RNA, 13 nt, Haemophilus influenzae Rd
acacguucauuac

SEQ ID NO: 703037 - RNA, 19 nt, Haemophilus influenzae Rd
acagaagacgauuuuagag

SEQ ID NO: 703038 - RNA, 23 nt, Haemophilus influenzae Rd
acagaagacgauuuuagagguga

SEQ ID NO: 703039 - RNA, 19 nt, Haemophilus influenzae Rd
acagaauaacuagcaaucu

SEQ ID NO: 703040 - RNA, 18 nt, Haemophilus influenzae Rd
acagaaguauuuacugau

SEQ ID NO: 703041 - RNA, 17 nt, Haemophilus influenzae Rd
acagacgcugcccaaau

SEQ ID NO: 703042 - RNA, 15 nt, Haemophilus influenzae Rd
acagaccaaaauucu

SEQ ID NO: 703043 - RNA, 15 nt, Haemophilus influenzae Rd
acagaaacaaauccu

SEQ ID NO: 703044 - RNA, 20 nt, Haemophilus influenzae Rd
acagaacccgcuaaaguucu

SEQ ID NO: 703045 - RNA, 17 nt, Haemophilus influenzae Rd
acagaaaucauuucaau

SEQ ID NO: 703046 - RNA, 22 nt, Haemophilus influenzae Rd
acagaaaucauuucaauguuug

SEQ ID NO: 703047 - RNA, 18 nt, Haemophilus influenzae Rd
acacuugguucgcuucau

SEQ ID NO: 703048 - RNA, 19 nt, Haemophilus influenzae Rd
acacuuuaaaaguuuacua

SEQ ID NO: 703049 - RNA, 18 nt, Haemophilus influenzae Rd
acacuuuaaauuuuccug

SEQ ID NO: 703050 - RNA, 19 nt, Haemophilus influenzae Rd
acacuuuaauaguaaacuu

SEQ ID NO: 703051 - RNA, 20 nt, Haemophilus influenzae Rd
acacuuuaauaguaaacuuu

SEQ ID NO: 703052 - RNA, 21 nt, Haemophilus influenzae Rd
acacuugcaccaccaauuaag

SEQ ID NO: 703053 - RNA, 18 nt, Haemophilus influenzae Rd
acacuuuguauggcaaau

SEQ ID NO: 703054 - RNA, 22 nt, Haemophilus influenzae Rd
acacuuuguauggcaaauuagc

SEQ ID NO: 703055 - RNA, 18 nt, Haemophilus influenzae Rd
acagauuuuuaaaucaau

SEQ ID NO: 703056 - RNA, 21 nt, Haemophilus influenzae Rd
acagauuuuuacuucaucaaa

SEQ ID NO: 703057 - RNA, 23 nt, Haemophilus influenzae Rd
acagauuuuuacuucaucaaaac

SEQ ID NO: 703058 - RNA, 18 nt, Haemophilus influenzae Rd
acagagcgucaaaauuau

SEQ ID NO: 703059 - RNA, 21 nt, Haemophilus influenzae Rd
acagagcgucaaaauuaugcu

SEQ ID NO: 703060 - RNA, 17 nt, Haemophilus influenzae Rd
acagaggggauaaaaua

SEQ ID NO: 703061 - RNA, 22 nt, Haemophilus influenzae Rd
acagagugcgaucaccauaauc

SEQ ID NO: 703062 - RNA, 15 nt, Haemophilus influenzae Rd
acagauacagaagga

SEQ ID NO: 703063 - RNA, 21 nt, Haemophilus influenzae Rd
acagauagcauaaguuaauuc

SEQ ID NO: 703064 - RNA, 16 nt, Haemophilus influenzae Rd
acagcccaauuauugg

SEQ ID NO: 703065 - RNA, 15 nt, Haemophilus influenzae Rd
acaggauaaaaacca

SEQ ID NO: 703066 - RNA, 18 nt, Haemophilus influenzae Rd
acaucaaaccugcuucau

SEQ ID NO: 703067 - RNA, 16 nt, Haemophilus influenzae Rd
acaucaacaaauguca

SEQ ID NO: 703068 - RNA, 17 nt, Haemophilus influenzae Rd
acaucaacgguuuucau

SEQ ID NO: 703069 - RNA, 20 nt, Haemophilus influenzae Rd
acauccacuuuuucugccaa

SEQ ID NO: 703070 - RNA, 11 nt, Haemophilus influenzae Rd
acaucaucacc

SEQ ID NO: 703071 - RNA, 16 nt, Haemophilus influenzae Rd
acaucagcuucaauuu

SEQ ID NO: 703072 - RNA, 15 nt, Haemophilus influenzae Rd
acaucagcaaucauu

SEQ ID NO: 703073 - RNA, 11 nt, Haemophilus influenzae Rd
acauauaaaga

SEQ ID NO: 703074 - RNA, 19 nt, Haemophilus influenzae Rd
acauauagugaaaaaauaa

SEQ ID NO: 703075 - RNA, 15 nt, Haemophilus influenzae Rd
acauauaacccauag

SEQ ID NO: 703076 - RNA, 22 nt, Haemophilus influenzae Rd
acauauccucaacaucaaaacc

SEQ ID NO: 703077 - RNA, 21 nt, Haemophilus influenzae Rd
acauauucuaccgcauuuuua

SEQ ID NO: 703078 - RNA, 22 nt, Haemophilus influenzae Rd
acauauucuaccgcauuuuuaa

SEQ ID NO: 703079 - RNA, 17 nt, Haemophilus influenzae Rd
acauauuguuucuucuc

SEQ ID NO: 703080 - RNA, 18 nt, Haemophilus influenzae Rd
acauauuguuucuucucu

SEQ ID NO: 703081 - RNA, 21 nt, Haemophilus influenzae Rd
acauauuguuucuucucuuua

SEQ ID NO: 703082 - RNA, 15 nt, Haemophilus influenzae Rd
acauaauuucacaau

SEQ ID NO: 703083 - RNA, 14 nt, Haemophilus influenzae Rd
acauaccuaaaaau

SEQ ID NO: 703084 - RNA, 12 nt, Haemophilus influenzae Rd
acauacaucuaa

SEQ ID NO: 703085 - RNA, 18 nt, Haemophilus influenzae Rd
acauacaucuaauuuuag

SEQ ID NO: 703086 - RNA, 17 nt, Haemophilus influenzae Rd
acaggaugcaccaauac

SEQ ID NO: 703087 - RNA, 23 nt, Haemophilus influenzae Rd
acauagcuugaauugcuccuccu

SEQ ID NO: 703088 - RNA, 22 nt, Haemophilus influenzae Rd
acauagccuuuuucuuucagga

SEQ ID NO: 703089 - RNA, 20 nt, Haemophilus influenzae Rd
acauagauugaaaaguaaau

SEQ ID NO: 703090 - RNA, 22 nt, Haemophilus influenzae Rd
acauagauuuaagcuuauuuca

SEQ ID NO: 703091 - RNA, 15 nt, Haemophilus influenzae Rd
acauagaaaguuuaa

SEQ ID NO: 703092 - RNA, 18 nt, Haemophilus influenzae Rd
acauaccuagauugcuuu

SEQ ID NO: 703093 - RNA, 12 nt, Haemophilus influenzae Rd
acauuauuuuua

SEQ ID NO: 703094 - RNA, 12 nt, Haemophilus influenzae Rd
acauucaaaucc

SEQ ID NO: 703095 - RNA, 13 nt, Haemophilus influenzae Rd
acauucaaaucca

SEQ ID NO: 703096 - RNA, 21 nt, Haemophilus influenzae Rd
acauucaucuuagcuuuuuuc

SEQ ID NO: 703097 - RNA, 20 nt, Haemophilus influenzae Rd
acauuaaagcaauugcuaaa

SEQ ID NO: 703098 - RNA, 11 nt, Haemophilus influenzae Rd
acauuaacaau

SEQ ID NO: 703099 - RNA, 22 nt, Haemophilus influenzae Rd
acauuaagugcguguauauauu

SEQ ID NO: 703100 - RNA, 18 nt, Haemophilus influenzae Rd
acauuaaggcuuugguau

SEQ ID NO: 703101 - RNA, 20 nt, Haemophilus influenzae Rd
acauuauuaaccguuuuuau

SEQ ID NO: 703102 - RNA, 16 nt, Haemophilus influenzae Rd
acauuaauaaaccaac

SEQ ID NO: 703103 - RNA, 21 nt, Haemophilus influenzae Rd
acauuaauaaaccaacauaca

SEQ ID NO: 703104 - RNA, 21 nt, Haemophilus influenzae Rd
acauuaugauauuucaauuua

SEQ ID NO: 703105 - RNA, 17 nt, Haemophilus influenzae Rd
acauuauuuaauuuuuu

SEQ ID NO: 703106 - RNA, 16 nt, Haemophilus influenzae Rd
acauucccuuuccaau

SEQ ID NO: 703107 - RNA, 15 nt, Haemophilus influenzae Rd
acauucccaaauaau

SEQ ID NO: 703108 - RNA, 11 nt, Haemophilus influenzae Rd
acauugccaaa

SEQ ID NO: 703109 - RNA, 21 nt, Haemophilus influenzae Rd
acauugcguuuuacaccaaca

SEQ ID NO: 703110 - RNA, 20 nt, Haemophilus influenzae Rd
acauugcuuaacauuaauaa

SEQ ID NO: 703111 - RNA, 15 nt, Haemophilus influenzae Rd
acauuucacuaaaua

SEQ ID NO: 703112 - RNA, 20 nt, Haemophilus influenzae Rd
acauuuauuuuucuuaugaa

SEQ ID NO: 703113 - RNA, 12 nt, Haemophilus influenzae Rd
acauuucauaac

SEQ ID NO: 703114 - RNA, 15 nt, Haemophilus influenzae Rd
acauuguaaagugau

SEQ ID NO: 703115 - RNA, 16 nt, Haemophilus influenzae Rd
acauguugggcuaaaa

SEQ ID NO: 703116 - RNA, 16 nt, Haemophilus influenzae Rd
acauggccaauuucau

SEQ ID NO: 703117 - RNA, 18 nt, Haemophilus influenzae Rd
acauccgaauaaaugcau

SEQ ID NO: 703118 - RNA, 17 nt, Haemophilus influenzae Rd
acaucgccaacuugaau

SEQ ID NO: 703119 - RNA, 14 nt, Haemophilus influenzae Rd
acaucgcagugauc

SEQ ID NO: 703120 - RNA, 20 nt, Haemophilus influenzae Rd
acaugaacaagcacccauuu

SEQ ID NO: 703121 - RNA, 14 nt, Haemophilus influenzae Rd
acaucuuaaauuau

SEQ ID NO: 703122 - RNA, 15 nt, Haemophilus influenzae Rd
acaucuuaaauuaua

SEQ ID NO: 703123 - RNA, 17 nt, Haemophilus influenzae Rd
acaucuuaaauuauaga

SEQ ID NO: 703124 - RNA, 19 nt, Haemophilus influenzae Rd
acaucuuaaauuauagaua

SEQ ID NO: 703125 - RNA, 13 nt, Haemophilus influenzae Rd
acaucuugcguua

SEQ ID NO: 703126 - RNA, 15 nt, Haemophilus influenzae Rd
accacaaaauaaaug

SEQ ID NO: 703127 - RNA, 14 nt, Haemophilus influenzae Rd
accaauuuuuucau

SEQ ID NO: 703128 - RNA, 15 nt, Haemophilus influenzae Rd
accacaagcugacca

SEQ ID NO: 703129 - RNA, 23 nt, Haemophilus influenzae Rd
accacaauaaaauaauauauuau

SEQ ID NO: 703130 - RNA, 17 nt, Haemophilus influenzae Rd
accaauucaaaaaccaa

SEQ ID NO: 703131 - RNA, 16 nt, Haemophilus influenzae Rd
accaauucaaagauuu

SEQ ID NO: 703132 - RNA, 15 nt, Haemophilus influenzae Rd
accaauggcaaucac

SEQ ID NO: 703133 - RNA, 23 nt, Haemophilus influenzae Rd
accaauggcaaucacaaauccau

SEQ ID NO: 703134 - RNA, 11 nt, Haemophilus influenzae Rd
accaauuccaa

SEQ ID NO: 703135 - RNA, 17 nt, Haemophilus influenzae Rd
accaauugaugcacaac

SEQ ID NO: 703136 - RNA, 14 nt, Haemophilus influenzae Rd
accaauugauuuuu

SEQ ID NO: 703137 - RNA, 19 nt, Haemophilus influenzae Rd
accaauugcaacuucgccu

SEQ ID NO: 703138 - RNA, 21 nt, Haemophilus influenzae Rd
accaauugcaacuucgccuug

SEQ ID NO: 703139 - RNA, 16 nt, Haemophilus influenzae Rd
accaccaauguuggca

SEQ ID NO: 703140 - RNA, 17 nt, Haemophilus influenzae Rd
accacauucaaauccaa

SEQ ID NO: 703141 - RNA, 13 nt, Haemophilus influenzae Rd
accacauaaaugu

SEQ ID NO: 703142 - RNA, 14 nt, Haemophilus influenzae Rd
accacaugaauuuc

SEQ ID NO: 703143 - RNA, 21 nt, Haemophilus influenzae Rd
accacaugaauuucuaauuuu

SEQ ID NO: 703144 - RNA, 18 nt, Haemophilus influenzae Rd
accacagcccaaaauuca

SEQ ID NO: 703145 - RNA, 21 nt, Haemophilus influenzae Rd
accacacccuuuucaaacaac

SEQ ID NO: 703146 - RNA, 17 nt, Haemophilus influenzae Rd
accaauaauccuuuuuu

SEQ ID NO: 703147 - RNA, 23 nt, Haemophilus influenzae Rd
accaauaauccuuuuuuugaacg

SEQ ID NO: 703148 - RNA, 21 nt, Haemophilus influenzae Rd
accaauaauuaaacagccaaa

SEQ ID NO: 703149 - RNA, 13 nt, Haemophilus influenzae Rd
accaauaccaaua

SEQ ID NO: 703150 - RNA, 17 nt, Haemophilus influenzae Rd
accaaucacaacacaau

SEQ ID NO: 703151 - RNA, 17 nt, Haemophilus influenzae Rd
accaauauuuguugcca

SEQ ID NO: 703152 - RNA, 15 nt, Haemophilus influenzae Rd
accaaucaaagugcg

SEQ ID NO: 703153 - RNA, 22 nt, Haemophilus influenzae Rd
accaaucauuggauaauugcca

SEQ ID NO: 703154 - RNA, 12 nt, Haemophilus influenzae Rd
accaauauaauc

SEQ ID NO: 703155 - RNA, 11 nt, Haemophilus influenzae Rd
accaaugaaua

SEQ ID NO: 703156 - RNA, 13 nt, Haemophilus influenzae Rd
accaacgaaaaua

SEQ ID NO: 703157 - RNA, 14 nt, Haemophilus influenzae Rd
accaacgaaaauag

SEQ ID NO: 703158 - RNA, 13 nt, Haemophilus influenzae Rd
acauuucccuuag

SEQ ID NO: 703159 - RNA, 21 nt, Haemophilus influenzae Rd
acauuuccuuuacauuuaaac

SEQ ID NO: 703160 - RNA, 21 nt, Haemophilus influenzae Rd
acauuuccaagcguaaaagua

SEQ ID NO: 703161 - RNA, 14 nt, Haemophilus influenzae Rd
acauuucuaaaaua

SEQ ID NO: 703162 - RNA, 19 nt, Haemophilus influenzae Rd
accaaccgguaaaauuaau

SEQ ID NO: 703163 - RNA, 19 nt, Haemophilus influenzae Rd
accaaccuaaguuugcccc

SEQ ID NO: 703164 - RNA, 15 nt, Haemophilus influenzae Rd
accaacguggcuuuu

SEQ ID NO: 703165 - RNA, 18 nt, Haemophilus influenzae Rd
accaacguggcuuuucug

SEQ ID NO: 703166 - RNA, 18 nt, Haemophilus influenzae Rd
accaacuaaggugcagau

SEQ ID NO: 703167 - RNA, 22 nt, Haemophilus influenzae Rd
accaaggaauuguaauuuugug

SEQ ID NO: 703168 - RNA, 19 nt, Haemophilus influenzae Rd
accaauaagauagaaaugu

SEQ ID NO: 703169 - RNA, 18 nt, Haemophilus influenzae Rd
accaauaagccuuuucau

SEQ ID NO: 703170 - RNA, 21 nt, Haemophilus influenzae Rd
accaagugcugguagcaauaa

SEQ ID NO: 703171 - RNA, 14 nt, Haemophilus influenzae Rd
accaagugaaauuc

SEQ ID NO: 703172 - RNA, 22 nt, Haemophilus influenzae Rd
accacgauacggcaaauuaaau

SEQ ID NO: 703173 - RNA, 21 nt, Haemophilus influenzae Rd
accacguucuuguaagccaaa

SEQ ID NO: 703174 - RNA, 14 nt, Haemophilus influenzae Rd
accacuaaaaaagc

SEQ ID NO: 703175 - RNA, 14 nt, Haemophilus influenzae Rd
accacuaaaaacaa

SEQ ID NO: 703176 - RNA, 16 nt, Haemophilus influenzae Rd
accacuaaaaacaagu

SEQ ID NO: 703177 - RNA, 21 nt, Haemophilus influenzae Rd
accacucacuggcucaaguaa

SEQ ID NO: 703178 - RNA, 14 nt, Haemophilus influenzae Rd
accacuuucaauuu

SEQ ID NO: 703179 - RNA, 17 nt, Haemophilus influenzae Rd
accacuugccaaacauu

SEQ ID NO: 703180 - RNA, 14 nt, Haemophilus influenzae Rd
accacuucauccaa

SEQ ID NO: 703181 - RNA, 18 nt, Haemophilus influenzae Rd
accacuucagcagauaca

SEQ ID NO: 703182 - RNA, 14 nt, Haemophilus influenzae Rd
accacuuaaaaaua

SEQ ID NO: 703183 - RNA, 13 nt, Haemophilus influenzae Rd
accacccaaauau

SEQ ID NO: 703184 - RNA, 22 nt, Haemophilus influenzae Rd
accacccuucuuucaaauuccc

SEQ ID NO: 703185 - RNA, 20 nt, Haemophilus influenzae Rd
accacccgauaaaugcacau

SEQ ID NO: 703186 - RNA, 19 nt, Haemophilus influenzae Rd
aauagcuuccgcuuuuuuc

SEQ ID NO: 703187 - RNA, 13 nt, Haemophilus influenzae Rd
aauagcuuuuuaa

SEQ ID NO: 703188 - RNA, 13 nt, Haemophilus influenzae Rd
aauagcuucuuuu

SEQ ID NO: 703189 - RNA, 18 nt, Haemophilus influenzae Rd
aauaggcaaguucguuuu

SEQ ID NO: 703190 - RNA, 16 nt, Haemophilus influenzae Rd
aauaggauaaauaaac

SEQ ID NO: 703191 - RNA, 17 nt, Haemophilus influenzae Rd
aauagguuuguacuguu

SEQ ID NO: 703192 - RNA, 16 nt, Haemophilus influenzae Rd
  misc_feature (6)..(6): n is a, c, g or u
aauagnaaaaauuuag

SEQ ID NO: 703193 - RNA, 13 nt, Haemophilus influenzae Rd
aauaguaaagaau

SEQ ID NO: 703194 - RNA, 15 nt, Haemophilus influenzae Rd
aauaguaaagaauau

SEQ ID NO: 703195 - RNA, 17 nt, Haemophilus influenzae Rd
aauaguaaagaauauuu

SEQ ID NO: 703196 - RNA, 16 nt, Haemophilus influenzae Rd
aauaguuaaagaaaau

SEQ ID NO: 703197 - RNA, 14 nt, Haemophilus influenzae Rd
aauaguuaaagccu

SEQ ID NO: 703198 - RNA, 20 nt, Haemophilus influenzae Rd
aauaguuaauaaucacaauu

SEQ ID NO: 703199 - RNA, 16 nt, Haemophilus influenzae Rd
aauaguuaauugauuu

SEQ ID NO: 703200 - RNA, 14 nt, Haemophilus influenzae Rd
aauauaaaauaaaa

SEQ ID NO: 703201 - RNA, 20 nt, Haemophilus influenzae Rd
aauauaaauaguuaaagccu

SEQ ID NO: 703202 - RNA, 15 nt, Haemophilus influenzae Rd
aauauaacaccaaac

SEQ ID NO: 703203 - RNA, 18 nt, Haemophilus influenzae Rd
aauaguuggguaaucaaa

SEQ ID NO: 703204 - RNA, 19 nt, Haemophilus influenzae Rd
aauaguuggguaaucaaau

SEQ ID NO: 703205 - RNA, 14 nt, Haemophilus influenzae Rd
aauauaaaaaauaa

SEQ ID NO: 703206 - RNA, 17 nt, Haemophilus influenzae Rd
aauagaagcguucaucu

SEQ ID NO: 703207 - RNA, 14 nt, Haemophilus influenzae Rd
aauaccuucuugau

SEQ ID NO: 703208 - RNA, 20 nt, Haemophilus influenzae Rd
aauaccuucuugauuauuua

SEQ ID NO: 703209 - RNA, 22 nt, Haemophilus influenzae Rd
aauaccuucuugauuauuuaau

SEQ ID NO: 703210 - RNA, 16 nt, Haemophilus influenzae Rd
aauagaaugaaaaaca

SEQ ID NO: 703211 - RNA, 17 nt, Haemophilus influenzae Rd
aauagaaugaaaaacau

SEQ ID NO: 703212 - RNA, 14 nt, Haemophilus influenzae Rd
aauagaauuggugc

SEQ ID NO: 703213 - RNA, 22 nt, Haemophilus influenzae Rd
aauagaauuggugcgucuuuua

SEQ ID NO: 703214 - RNA, 17 nt, Haemophilus influenzae Rd
aauagcaauaucugcua

SEQ ID NO: 703215 - RNA, 22 nt, Haemophilus influenzae Rd
aauagcaauaucugcuaauacu

SEQ ID NO: 703216 - RNA, 16 nt, Haemophilus influenzae Rd
aauagacuacuuaaaa

SEQ ID NO: 703217 - RNA, 13 nt, Haemophilus influenzae Rd
aauagaauuuuac

SEQ ID NO: 703218 - RNA, 16 nt, Haemophilus influenzae Rd
aauagauacaagaaag

SEQ ID NO: 703219 - RNA, 21 nt, Haemophilus influenzae Rd
aauagauacaagaaagaaaua

SEQ ID NO: 703220 - RNA, 20 nt, Haemophilus influenzae Rd
aauagacuuaauaauauauu

SEQ ID NO: 703221 - RNA, 17 nt, Haemophilus influenzae Rd
aauagccuaaauauuua

SEQ ID NO: 703222 - RNA, 23 nt, Haemophilus influenzae Rd
aauagccgacaucuauuuugcuu

SEQ ID NO: 703223 - RNA, 14 nt, Haemophilus influenzae Rd
aauagcacagaaaa

SEQ ID NO: 703224 - RNA, 23 nt, Haemophilus influenzae Rd
aauagccgcucuuuuuguugauc

SEQ ID NO: 703225 - RNA, 15 nt, Haemophilus influenzae Rd
aauagcgugaaaagc

SEQ ID NO: 703226 - RNA, 23 nt, Haemophilus influenzae Rd
aauagcgugcauuccuaaaaucg

SEQ ID NO: 703227 - RNA, 14 nt, Haemophilus influenzae Rd
aauagcuaacaaau

SEQ ID NO: 703228 - RNA, 18 nt, Haemophilus influenzae Rd
aauagcuaacaaauuuaa

SEQ ID NO: 703229 - RNA, 23 nt, Haemophilus influenzae Rd
aauagcucaacgcuuuucguuuc

SEQ ID NO: 703230 - RNA, 18 nt, Haemophilus influenzae Rd
aauagcugggcaaaauca

SEQ ID NO: 703231 - RNA, 16 nt, Haemophilus influenzae Rd
aauagcuguaagauaa

SEQ ID NO: 703232 - RNA, 17 nt, Haemophilus influenzae Rd
aauagcugugcaaaauc

SEQ ID NO: 703233 - RNA, 14 nt, Haemophilus influenzae Rd
aauauaacauuuau

SEQ ID NO: 703234 - RNA, 17 nt, Haemophilus influenzae Rd
aauauaaguuauuuaua

SEQ ID NO: 703235 - RNA, 20 nt, Haemophilus influenzae Rd
aauauaaguuauuuauauaa

SEQ ID NO: 703236 - RNA, 21 nt, Haemophilus influenzae Rd
aauauaaguuauuuauauaau

SEQ ID NO: 703237 - RNA, 22 nt, Haemophilus influenzae Rd
aauauaaguuauuuauauaauu

SEQ ID NO: 703238 - RNA, 22 nt, Haemophilus influenzae Rd
aauauaauuaucaacaucaacu

SEQ ID NO: 703239 - RNA, 19 nt, Haemophilus influenzae Rd
aauauaauucagcaagaaa

SEQ ID NO: 703240 - RNA, 15 nt, Haemophilus influenzae Rd
aauauaauuuagcau

SEQ ID NO: 703241 - RNA, 14 nt, Haemophilus influenzae Rd
aauauaauuuccua

SEQ ID NO: 703242 - RNA, 15 nt, Haemophilus influenzae Rd
aauauaaugaaaaca

SEQ ID NO: 703243 - RNA, 18 nt, Haemophilus influenzae Rd
aauauagcaaacuaggua

SEQ ID NO: 703244 - RNA, 21 nt, Haemophilus influenzae Rd
aauauaggauuuuaauguuug

SEQ ID NO: 703245 - RNA, 17 nt, Haemophilus influenzae Rd
aauauaggcgaacaaaa

SEQ ID NO: 703246 - RNA, 21 nt, Haemophilus influenzae Rd
aauauaggcuauauuuuccac

SEQ ID NO: 703247 - RNA, 19 nt, Haemophilus influenzae Rd
aauauaggguaaauaaaaa

SEQ ID NO: 703248 - RNA, 22 nt, Haemophilus influenzae Rd
aauauacgccaggcucuguaau

SEQ ID NO: 703249 - RNA, 20 nt, Haemophilus influenzae Rd
aauauaccccaaacuauaua

SEQ ID NO: 703250 - RNA, 16 nt, Haemophilus influenzae Rd
aauauagguuaauagu

SEQ ID NO: 703251 - RNA, 17 nt, Haemophilus influenzae Rd
aauauagguuaauaguu

SEQ ID NO: 703252 - RNA, 16 nt, Haemophilus influenzae Rd
aauauagucaaauaac

SEQ ID NO: 703253 - RNA, 23 nt, Haemophilus influenzae Rd
aauauauaucauggcacaaaaua

SEQ ID NO: 703254 - RNA, 15 nt, Haemophilus influenzae Rd
aauauaucaagcaga

SEQ ID NO: 703255 - RNA, 15 nt, Haemophilus influenzae Rd
aauauaucagacaau

SEQ ID NO: 703256 - RNA, 16 nt, Haemophilus influenzae Rd
aauauauucggaaaaa

SEQ ID NO: 703257 - RNA, 17 nt, Haemophilus influenzae Rd
aauauauucggaaaaaa

SEQ ID NO: 703258 - RNA, 18 nt, Haemophilus influenzae Rd
aauauauucggaaaaaau

SEQ ID NO: 703259 - RNA, 20 nt, Haemophilus influenzae Rd
aauauauucggaaaaaauuu

SEQ ID NO: 703260 - RNA, 18 nt, Haemophilus influenzae Rd
aauauauuuagauacaaa

SEQ ID NO: 703261 - RNA, 18 nt, Haemophilus influenzae Rd
aauauaugggaaacaaua

SEQ ID NO: 703262 - RNA, 20 nt, Haemophilus influenzae Rd
aauauauuaauuauuuuaga

SEQ ID NO: 703263 - RNA, 14 nt, Haemophilus influenzae Rd
aauauaugaaaaau

SEQ ID NO: 703264 - RNA, 22 nt, Haemophilus influenzae Rd
aauaucaaagaaaaauugugua

SEQ ID NO: 703265 - RNA, 23 nt, Haemophilus influenzae Rd
aauaucaagucaaaaaccgcuuu

SEQ ID NO: 703266 - RNA, 18 nt, Haemophilus influenzae Rd
aauaucaaaauuauguuu

SEQ ID NO: 703267 - RNA, 13 nt, Haemophilus influenzae Rd
aauaucaaaaaaa

SEQ ID NO: 703268 - RNA, 17 nt, Haemophilus influenzae Rd
aauaucaaaaaaauuua

SEQ ID NO: 703269 - RNA, 22 nt, Haemophilus influenzae Rd
aauaucagcccuuuguuuuaau

SEQ ID NO: 703270 - RNA, 17 nt, Haemophilus influenzae Rd
aauaucacaaccaccaa

SEQ ID NO: 703271 - RNA, 14 nt, Haemophilus influenzae Rd
aauaucacuuugua

SEQ ID NO: 703272 - RNA, 20 nt, Haemophilus influenzae Rd
aauaucagaagaaucuucua

SEQ ID NO: 703273 - RNA, 14 nt, Haemophilus influenzae Rd
aauaucaucuagau

SEQ ID NO: 703274 - RNA, 23 nt, Haemophilus influenzae Rd
aauaucccuuauuuuaguagauu

SEQ ID NO: 703275 - RNA, 17 nt, Haemophilus influenzae Rd
aauauccguaauauuug

SEQ ID NO: 703276 - RNA, 12 nt, Haemophilus influenzae Rd
aauaucauuuuu

SEQ ID NO: 703277 - RNA, 14 nt, Haemophilus influenzae Rd
aauaucauuagcau

SEQ ID NO: 703278 - RNA, 15 nt, Haemophilus influenzae Rd
aauaucauuagcaua

SEQ ID NO: 703279 - RNA, 20 nt, Haemophilus influenzae Rd
aauauccaagaaguuuucca

SEQ ID NO: 703280 - RNA, 20 nt, Haemophilus influenzae Rd
aauauccacuucauuaaaac

SEQ ID NO: 703281 - RNA, 15 nt, Haemophilus influenzae Rd
aauaucuucaauuuc

SEQ ID NO: 703282 - RNA, 16 nt, Haemophilus influenzae Rd
aauaucuuugacuaaa

SEQ ID NO: 703283 - RNA, 14 nt, Haemophilus influenzae Rd
aauaucuucuaaua

SEQ ID NO: 703284 - RNA, 18 nt, Haemophilus influenzae Rd
aauaucuucuaauaaaau

SEQ ID NO: 703285 - RNA, 19 nt, Haemophilus influenzae Rd
aauaucuuccacaacaacc

SEQ ID NO: 703286 - RNA, 22 nt, Haemophilus influenzae Rd
aauaucuuccguuuuuuucacg

SEQ ID NO: 703287 - RNA, 20 nt, Haemophilus influenzae Rd
aauaucugcacguaaaguug

SEQ ID NO: 703288 - RNA, 17 nt, Haemophilus influenzae Rd
aauaucuaagauuuuag

SEQ ID NO: 703289 - RNA, 14 nt, Haemophilus influenzae Rd
aauaucuagcacag

SEQ ID NO: 703290 - RNA, 14 nt, Haemophilus influenzae Rd
aauaucuaggcuaa

SEQ ID NO: 703291 - RNA, 16 nt, Haemophilus influenzae Rd
aauaucucgugaugca

SEQ ID NO: 703292 - RNA, 21 nt, Haemophilus influenzae Rd
aauaucgcaaucaauucuuuc

SEQ ID NO: 703293 - RNA, 23 nt, Haemophilus influenzae Rd
aauaucggcaucuacaccuucug

SEQ ID NO: 703294 - RNA, 13 nt, Haemophilus influenzae Rd
aauaagauuuuua

SEQ ID NO: 703295 - RNA, 14 nt, Haemophilus influenzae Rd
aauaagauuuuuaa

SEQ ID NO: 703296 - RNA, 18 nt, Haemophilus influenzae Rd
aauaagauuuuugauaaa

SEQ ID NO: 703297 - RNA, 21 nt, Haemophilus influenzae Rd
aauaagauuuuugauaaaaaa

SEQ ID NO: 703298 - RNA, 23 nt, Haemophilus influenzae Rd
aauaagauuuuugauaaaaaaga

SEQ ID NO: 703299 - RNA, 17 nt, Haemophilus influenzae Rd
aauaagcaauuucacga

SEQ ID NO: 703300 - RNA, 17 nt, Haemophilus influenzae Rd
aauaagccgaagaagau

SEQ ID NO: 703301 - RNA, 16 nt, Haemophilus influenzae Rd
aauaagccuugcauaa

SEQ ID NO: 703302 - RNA, 20 nt, Haemophilus influenzae Rd
aaaaagugcggugauuuuac

SEQ ID NO: 703303 - RNA, 19 nt, Haemophilus influenzae Rd
aaaaagugcgguuaaaaua

SEQ ID NO: 703304 - RNA, 22 nt, Haemophilus influenzae Rd
aauaagcuaucgucaaauuuaa

SEQ ID NO: 703305 - RNA, 22 nt, Haemophilus influenzae Rd
aaaaauaaauagauacaagaaa

SEQ ID NO: 703306 - RNA, 16 nt, Haemophilus influenzae Rd
aaaaauaaccuaauuu

SEQ ID NO: 703307 - RNA, 22 nt, Haemophilus influenzae Rd
aaaaauaagggcugauuuuaaa

SEQ ID NO: 703308 - RNA, 12 nt, Haemophilus influenzae Rd
aaaaauaaaugg

SEQ ID NO: 703309 - RNA, 17 nt, Haemophilus influenzae Rd
aaaaaguugaauuuuca

SEQ ID NO: 703310 - RNA, 13 nt, Haemophilus influenzae Rd
aaaaauaaaaaaa

SEQ ID NO: 703311 - RNA, 13 nt, Haemophilus influenzae Rd
aaaaauaaaaaca

SEQ ID NO: 703312 - RNA, 19 nt, Haemophilus influenzae Rd
aaaaaguuugauaaaguuu

SEQ ID NO: 703313 - RNA, 13 nt, Haemophilus influenzae Rd
aaaaauaaaaagu

SEQ ID NO: 703314 - RNA, 14 nt, Haemophilus influenzae Rd
aauaaguuuucauc

SEQ ID NO: 703315 - RNA, 17 nt, Haemophilus influenzae Rd
aauaaguuuucaucaau

SEQ ID NO: 703316 - RNA, 23 nt, Haemophilus influenzae Rd
aauaaguuuucaucaaugccauu

SEQ ID NO: 703317 - RNA, 18 nt, Haemophilus influenzae Rd
aauaauaaucuucuugaa

SEQ ID NO: 703318 - RNA, 13 nt, Haemophilus influenzae Rd
aauaauaaaaagu

SEQ ID NO: 703319 - RNA, 15 nt, Haemophilus influenzae Rd
aauaauaaauccaaa

SEQ ID NO: 703320 - RNA, 13 nt, Haemophilus influenzae Rd
aauaauaaauccu

SEQ ID NO: 703321 - RNA, 17 nt, Haemophilus influenzae Rd
aauaaguucaucaacug

SEQ ID NO: 703322 - RNA, 19 nt, Haemophilus influenzae Rd
aauaaggcguaaaacuauu

SEQ ID NO: 703323 - RNA, 19 nt, Haemophilus influenzae Rd
aauaagcuuggcuuauuua

SEQ ID NO: 703324 - RNA, 19 nt, Haemophilus influenzae Rd
aauaaggucagcaaauuau

SEQ ID NO: 703325 - RNA, 21 nt, Haemophilus influenzae Rd
aauaagggcugauuuuaaaua

SEQ ID NO: 703326 - RNA, 16 nt, Haemophilus influenzae Rd
aauaagugagaaaguu

SEQ ID NO: 703327 - RNA, 18 nt, Haemophilus influenzae Rd
aauaagugagaaaguuaa

SEQ ID NO: 703328 - RNA, 19 nt, Haemophilus influenzae Rd
aauaagugcgguaaaaaaa

SEQ ID NO: 703329 - RNA, 17 nt, Haemophilus influenzae Rd
aauaagugcgguuaauu

SEQ ID NO: 703330 - RNA, 13 nt, Haemophilus influenzae Rd
aauaaguaguuac

SEQ ID NO: 703331 - RNA, 15 nt, Haemophilus influenzae Rd
aaguugauagugcca

SEQ ID NO: 703332 - RNA, 21 nt, Haemophilus influenzae Rd
aaguugggauuuaucuucccc

SEQ ID NO: 703333 - RNA, 21 nt, Haemophilus influenzae Rd
aaguugguuuugcaauuuuua

SEQ ID NO: 703334 - RNA, 13 nt, Haemophilus influenzae Rd
aaguugugccaau

SEQ ID NO: 703335 - RNA, 23 nt, Haemophilus influenzae Rd
aaguuguuuugcuuuugcacaga

SEQ ID NO: 703336 - RNA, 17 nt, Haemophilus influenzae Rd
aaguuuaacuuucaaca

SEQ ID NO: 703337 - RNA, 19 nt, Haemophilus influenzae Rd
aaguuuaacuuucaacacg

SEQ ID NO: 703338 - RNA, 14 nt, Haemophilus influenzae Rd
aaguuuaagaaaag

SEQ ID NO: 703339 - RNA, 13 nt, Haemophilus influenzae Rd
aaguuuaagcccg

SEQ ID NO: 703340 - RNA, 20 nt, Haemophilus influenzae Rd
aauaaaugcaucauuaauac

SEQ ID NO: 703341 - RNA, 21 nt, Haemophilus influenzae Rd
aauaaaucuuuugaaagauuu

SEQ ID NO: 703342 - RNA, 22 nt, Haemophilus influenzae Rd
aauaaauauucugcauuaaauu

SEQ ID NO: 703343 - RNA, 11 nt, Haemophilus influenzae Rd
aauaaaucaaa

SEQ ID NO: 703344 - RNA, 12 nt, Haemophilus influenzae Rd
aauaaaucacac

SEQ ID NO: 703345 - RNA, 20 nt, Haemophilus influenzae Rd
aauaaaucacacaguuauac

SEQ ID NO: 703346 - RNA, 18 nt, Haemophilus influenzae Rd
aauaagaggcauaaccca

SEQ ID NO: 703347 - RNA, 19 nt, Haemophilus influenzae Rd
aauaagaauuaccgcacuu

SEQ ID NO: 703348 - RNA, 16 nt, Haemophilus influenzae Rd
aauaagauagaaaugu

SEQ ID NO: 703349 - RNA, 15 nt, Haemophilus influenzae Rd
aauaagaugguaucc

SEQ ID NO: 703350 - RNA, 13 nt, Haemophilus influenzae Rd
aauaagaaagaau

SEQ ID NO: 703351 - RNA, 13 nt, Haemophilus influenzae Rd
aauaacuuuauuu

SEQ ID NO: 703352 - RNA, 15 nt, Haemophilus influenzae Rd
aauaacuucauccau

SEQ ID NO: 703353 - RNA, 19 nt, Haemophilus influenzae Rd
aauaaccacuccaaauaau

SEQ ID NO: 703354 - RNA, 22 nt, Haemophilus influenzae Rd
aauaaccacgccuucgaaugcu

SEQ ID NO: 703355 - RNA, 19 nt, Haemophilus influenzae Rd
aauaacaugguuaaaauau

SEQ ID NO: 703356 - RNA, 15 nt, Haemophilus influenzae Rd
aauaacauuccguuu

SEQ ID NO: 703357 - RNA, 12 nt, Haemophilus influenzae Rd
aauaaccaauaa

SEQ ID NO: 703358 - RNA, 13 nt, Haemophilus influenzae Rd
aauaacccuugua

SEQ ID NO: 703359 - RNA, 17 nt, Haemophilus influenzae Rd
aauaacucuauaaaaug

SEQ ID NO: 703360 - RNA, 20 nt, Haemophilus influenzae Rd
aauaacugaauaauuuccaa

SEQ ID NO: 703361 - RNA, 20 nt, Haemophilus influenzae Rd
aauaacugcgccaauauaag

SEQ ID NO: 703362 - RNA, 24 nt, Haemophilus influenzae Rd
aauaacugaucgccaucuucuucu

SEQ ID NO: 703363 - RNA, 19 nt, Haemophilus influenzae Rd
aauaacugccacaucaucg

SEQ ID NO: 703364 - RNA, 23 nt, Haemophilus influenzae Rd
aaaaaucggugcaacaauaucau

SEQ ID NO: 703365 - RNA, 23 nt, Haemophilus influenzae Rd
aaaaauccuuguuugccaucuaa

SEQ ID NO: 703366 - RNA, 16 nt, Haemophilus influenzae Rd
aaaaaucgaagaaaua

SEQ ID NO: 703367 - RNA, 21 nt, Haemophilus influenzae Rd
aaaaaucgaagaaauaugauu

SEQ ID NO: 703368 - RNA, 23 nt, Haemophilus influenzae Rd
aaaaaucguacaucgaaaacaua

SEQ ID NO: 703369 - RNA, 21 nt, Haemophilus influenzae Rd
aaaaaucugugauauauauca

SEQ ID NO: 703370 - RNA, 14 nt, Haemophilus influenzae Rd
aaaaaucuagagau

SEQ ID NO: 703371 - RNA, 22 nt, Haemophilus influenzae Rd
aaaaaucuaucccaacagaaaa

SEQ ID NO: 703372 - RNA, 14 nt, Haemophilus influenzae Rd
aauaauguauuucu

SEQ ID NO: 703373 - RNA, 15 nt, Haemophilus influenzae Rd
aauaauguauuucua

SEQ ID NO: 703374 - RNA, 16 nt, Haemophilus influenzae Rd
aaaaauccucaaaaac

SEQ ID NO: 703375 - RNA, 23 nt, Haemophilus influenzae Rd
aauaauuuuuaauucuuuuucac

SEQ ID NO: 703376 - RNA, 11 nt, Haemophilus influenzae Rd
aauaauuuuuc

SEQ ID NO: 703377 - RNA, 22 nt, Haemophilus influenzae Rd
aauaauuuuacguuucauuuuu

SEQ ID NO: 703378 - RNA, 21 nt, Haemophilus influenzae Rd
  misc_feature (9)..(11): n is a, c, g or u
aauaauuunnngcaaaaagua

SEQ ID NO: 703379 - RNA, 16 nt, Haemophilus influenzae Rd
aauaauuuccaacaca

SEQ ID NO: 703380 - RNA, 15 nt, Haemophilus influenzae Rd
aaaaaugaauaaaau

SEQ ID NO: 703381 - RNA, 16 nt, Haemophilus influenzae Rd
aauaauuucauuguua

SEQ ID NO: 703382 - RNA, 18 nt, Haemophilus influenzae Rd
aaaaaucuuuaccaaaaa

SEQ ID NO: 703383 - RNA, 20 nt, Haemophilus influenzae Rd
aaaaaucuuuaccaaaaaau

SEQ ID NO: 703384 - RNA, 21 nt, Haemophilus influenzae Rd
aaaaaucuuuaccaaaaaauu

SEQ ID NO: 703385 - RNA, 16 nt, Haemophilus influenzae Rd
aaaaaucuuugaauug

SEQ ID NO: 703386 - RNA, 18 nt, Haemophilus influenzae Rd
aaaaaucuccaacuucau

SEQ ID NO: 703387 - RNA, 13 nt, Haemophilus influenzae Rd
aauaauacugcuu

SEQ ID NO: 703388 - RNA, 22 nt, Haemophilus influenzae Rd
aaaaauaguuaaucgaaaauuu

SEQ ID NO: 703389 - RNA, 16 nt, Haemophilus influenzae Rd
aauaaugaaagggaaa

SEQ ID NO: 703390 - RNA, 13 nt, Haemophilus influenzae Rd
aauaaugaaauau

SEQ ID NO: 703391 - RNA, 17 nt, Haemophilus influenzae Rd
aauaaugaaauauucca

SEQ ID NO: 703392 - RNA, 16 nt, Haemophilus influenzae Rd
aauaauaggcgaauca

SEQ ID NO: 703393 - RNA, 18 nt, Haemophilus influenzae Rd
aauaauaggcgaaucaaa

SEQ ID NO: 703394 - RNA, 12 nt, Haemophilus influenzae Rd
aauaaugaauaa

SEQ ID NO: 703395 - RNA, 21 nt, Haemophilus influenzae Rd
aauaaugccauuggacacaau

SEQ ID NO: 703396 - RNA, 23 nt, Haemophilus influenzae Rd
aauaaugccauuggacacaauaa

SEQ ID NO: 703397 - RNA, 18 nt, Haemophilus influenzae Rd
aauaauggauuaauucga

SEQ ID NO: 703398 - RNA, 13 nt, Haemophilus influenzae Rd
aauaccaaaauug

SEQ ID NO: 703399 - RNA, 18 nt, Haemophilus influenzae Rd
aauacauuuuugauugca

SEQ ID NO: 703400 - RNA, 15 nt, Haemophilus influenzae Rd
aauaccaauaauuaa

SEQ ID NO: 703401 - RNA, 14 nt, Haemophilus influenzae Rd
aauaccaauaauaa

SEQ ID NO: 703402 - RNA, 17 nt, Haemophilus influenzae Rd
aauaccaauugaugcac

SEQ ID NO: 703403 - RNA, 19 nt, Haemophilus influenzae Rd
aauaccaauugaugcacaa

SEQ ID NO: 703404 - RNA, 17 nt, Haemophilus influenzae Rd
aauacauuaaguauauu

SEQ ID NO: 703405 - RNA, 14 nt, Haemophilus influenzae Rd
aauacauuauuaaa

SEQ ID NO: 703406 - RNA, 15 nt, Haemophilus influenzae Rd
aauacacuuuaaauu

SEQ ID NO: 703407 - RNA, 20 nt, Haemophilus influenzae Rd
aauacacuuuaaauuuuccu

SEQ ID NO: 703408 - RNA, 23 nt, Haemophilus influenzae Rd
aauacacuuuaaauuuuccuguu

SEQ ID NO: 703409 - RNA, 22 nt, Haemophilus influenzae Rd
aauacacuuuuacuuugauucg

SEQ ID NO: 703410 - RNA, 13 nt, Haemophilus influenzae Rd
aauacacgaggaa

SEQ ID NO: 703411 - RNA, 15 nt, Haemophilus influenzae Rd
aauacacgaugcucu

SEQ ID NO: 703412 - RNA, 13 nt, Haemophilus influenzae Rd
aauacacuucuaa

SEQ ID NO: 703413 - RNA, 14 nt, Haemophilus influenzae Rd
aauacacuucuaaa

SEQ ID NO: 703414 - RNA, 19 nt, Haemophilus influenzae Rd
aaaaaugauuaaguuaaaa

SEQ ID NO: 703415 - RNA, 10 nt, Haemophilus influenzae Rd
aaaaaugccu

SEQ ID NO: 703416 - RNA, 19 nt, Haemophilus influenzae Rd
aaaaaugcguucagaauuu

SEQ ID NO: 703417 - RNA, 18 nt, Haemophilus influenzae Rd
aaaaaugcuggaucggcu

SEQ ID NO: 703418 - RNA, 19 nt, Haemophilus influenzae Rd
aaaaauggaaaaagcaaaa

SEQ ID NO: 703419 - RNA, 21 nt, Haemophilus influenzae Rd
aaaaauggaaaaagcaaaacc

SEQ ID NO: 703420 - RNA, 22 nt, Haemophilus influenzae Rd
aaaaaugaauuaguuucaacuu

SEQ ID NO: 703421 - RNA, 17 nt, Haemophilus influenzae Rd
aaaaaugaauaaaauuu

SEQ ID NO: 703422 - RNA, 23 nt, Haemophilus influenzae Rd
aaaaauguagagauaauaaauau

SEQ ID NO: 703423 - RNA, 13 nt, Haemophilus influenzae Rd
aauaccauguaaa

SEQ ID NO: 703424 - RNA, 16 nt, Haemophilus influenzae Rd
aauaccauguaaaccc

SEQ ID NO: 703425 - RNA, 20 nt, Haemophilus influenzae Rd
aauaccauguaaacccacaa

SEQ ID NO: 703426 - RNA, 20 nt, Haemophilus influenzae Rd
aaaaauggacagaauaacua

SEQ ID NO: 703427 - RNA, 15 nt, Haemophilus influenzae Rd
aauacccauaaaauu

SEQ ID NO: 703428 - RNA, 14 nt, Haemophilus influenzae Rd
aaguaaaaauaaaa

SEQ ID NO: 703429 - RNA, 14 nt, Haemophilus influenzae Rd
aaguaaaaccauua

SEQ ID NO: 703430 - RNA, 22 nt, Haemophilus influenzae Rd
aaguaaacccuuuagcauaaaa

SEQ ID NO: 703431 - RNA, 15 nt, Haemophilus influenzae Rd
aaguaaacaauuuuc

SEQ ID NO: 703432 - RNA, 17 nt, Haemophilus influenzae Rd
aaguaaacaauuuuccu

SEQ ID NO: 703433 - RNA, 20 nt, Haemophilus influenzae Rd
aaguaaaccaaauccaguga

SEQ ID NO: 703434 - RNA, 11 nt, Haemophilus influenzae Rd
aaguaaaaaaa

SEQ ID NO: 703435 - RNA, 16 nt, Haemophilus influenzae Rd
aagguuuuauuuugaa

SEQ ID NO: 703436 - RNA, 23 nt, Haemophilus influenzae Rd
aagguuuuauuuugaacaauguc

SEQ ID NO: 703437 - RNA, 21 nt, Haemophilus influenzae Rd
aaggcuuuguaaugcuuuuag

SEQ ID NO: 703438 - RNA, 20 nt, Haemophilus influenzae Rd
aaggcuuuuuuaauuacuca

SEQ ID NO: 703439 - RNA, 23 nt, Haemophilus influenzae Rd
aagggcgagcaacuuggaaugca

SEQ ID NO: 703440 - RNA, 17 nt, Haemophilus influenzae Rd
aaguagcacuuuccauc

SEQ ID NO: 703441 - RNA, 19 nt, Haemophilus influenzae Rd
aaguagcacuuuccaucau

SEQ ID NO: 703442 - RNA, 13 nt, Haemophilus influenzae Rd
aaguagaaauugc

SEQ ID NO: 703443 - RNA, 13 nt, Haemophilus influenzae Rd
aaguagaaccagg

SEQ ID NO: 703444 - RNA, 18 nt, Haemophilus influenzae Rd
aaguaccaaaaucguaau

SEQ ID NO: 703445 - RNA, 17 nt, Haemophilus influenzae Rd
aaguacgacaucuuaaa

SEQ ID NO: 703446 - RNA, 19 nt, Haemophilus influenzae Rd
aaguacauucaaccacugu

SEQ ID NO: 703447 - RNA, 21 nt, Haemophilus influenzae Rd
aaguacaacugagcccacaac

SEQ ID NO: 703448 - RNA, 12 nt, Haemophilus influenzae Rd
aaguaauuuaaa

SEQ ID NO: 703449 - RNA, 14 nt, Haemophilus influenzae Rd
aaguaauuuaaaaa

SEQ ID NO: 703450 - RNA, 16 nt, Haemophilus influenzae Rd
aagucaagcuaaucuc

SEQ ID NO: 703451 - RNA, 17 nt, Haemophilus influenzae Rd
aagucacauauuguuuc

SEQ ID NO: 703452 - RNA, 13 nt, Haemophilus influenzae Rd
aaguauuaaauau

SEQ ID NO: 703453 - RNA, 21 nt, Haemophilus influenzae Rd
aaguauucagugccuaaauuu

SEQ ID NO: 703454 - RNA, 12 nt, Haemophilus influenzae Rd
aaguauuuuccu

SEQ ID NO: 703455 - RNA, 22 nt, Haemophilus influenzae Rd
aaguauuuuccuucugccauaa

SEQ ID NO: 703456 - RNA, 22 nt, Haemophilus influenzae Rd
aaguauuuucuuuccaaccagg

SEQ ID NO: 703457 - RNA, 12 nt, Haemophilus influenzae Rd
aaguauuuugug

SEQ ID NO: 703458 - RNA, 21 nt, Haemophilus influenzae Rd
aaguauuuuguggaauaucaa

SEQ ID NO: 703459 - RNA, 17 nt, Haemophilus influenzae Rd
aaguaugccauaaaaua

SEQ ID NO: 703460 - RNA, 21 nt, Haemophilus influenzae Rd
aaguauacuuuucaacacuuu

SEQ ID NO: 703461 - RNA, 22 nt, Haemophilus influenzae Rd
aaguauacuuuucaacacuuua

SEQ ID NO: 703462 - RNA, 18 nt, Haemophilus influenzae Rd
aaguauaacuaauuaaga

SEQ ID NO: 703463 - RNA, 21 nt, Haemophilus influenzae Rd
aaguauaagccgcaccaauaa

SEQ ID NO: 703464 - RNA, 19 nt, Haemophilus influenzae Rd
aaguauaaguuauuuuuac

SEQ ID NO: 703465 - RNA, 13 nt, Haemophilus influenzae Rd
aaguaguaaaguu

SEQ ID NO: 703466 - RNA, 15 nt, Haemophilus influenzae Rd
aaguagucagcgcag

SEQ ID NO: 703467 - RNA, 20 nt, Haemophilus influenzae Rd
aaguaguguuuuauuuauag

SEQ ID NO: 703468 - RNA, 13 nt, Haemophilus influenzae Rd
aaguauaaagagu

SEQ ID NO: 703469 - RNA, 21 nt, Haemophilus influenzae Rd
aaguaggcauuaugccuacuu

SEQ ID NO: 703470 - RNA, 15 nt, Haemophilus influenzae Rd
aaguccaucacuuuu

SEQ ID NO: 703471 - RNA, 24 nt, Haemophilus influenzae Rd
aaguccaucacuuuuaauucuuua

SEQ ID NO: 703472 - RNA, 18 nt, Haemophilus influenzae Rd
aagucccagcaauaccac

SEQ ID NO: 703473 - RNA, 16 nt, Haemophilus influenzae Rd
aagucaggaauaaaag

SEQ ID NO: 703474 - RNA, 22 nt, Haemophilus influenzae Rd
aagucaguaaaccaagugaaau

SEQ ID NO: 703475 - RNA, 17 nt, Haemophilus influenzae Rd
aagugaaccaauauagc

SEQ ID NO: 703476 - RNA, 15 nt, Haemophilus influenzae Rd
aagugaaagauaaau

SEQ ID NO: 703477 - RNA, 14 nt, Haemophilus influenzae Rd
aagugaaauauuuc

SEQ ID NO: 703478 - RNA, 11 nt, Haemophilus influenzae Rd
aagugaaauua

SEQ ID NO: 703479 - RNA, 16 nt, Haemophilus influenzae Rd
aagugaaauuacucau

SEQ ID NO: 703480 - RNA, 17 nt, Haemophilus influenzae Rd
aagucgauucaaauaac

SEQ ID NO: 703481 - RNA, 16 nt, Haemophilus influenzae Rd
aagucgcuaauuuuuu

SEQ ID NO: 703482 - RNA, 14 nt, Haemophilus influenzae Rd
aagucgcuuaaguc

SEQ ID NO: 703483 - RNA, 22 nt, Haemophilus influenzae Rd
aagucguuucaucgagaaauac

SEQ ID NO: 703484 - RNA, 17 nt, Haemophilus influenzae Rd
aagucgugaucugcauc

SEQ ID NO: 703485 - RNA, 21 nt, Haemophilus influenzae Rd
aagucgugaucugcaucagau

SEQ ID NO: 703486 - RNA, 22 nt, Haemophilus influenzae Rd
aaguugaagagaauuuucauca

SEQ ID NO: 703487 - RNA, 16 nt, Haemophilus influenzae Rd
aaguucauaaaagggg

SEQ ID NO: 703488 - RNA, 22 nt, Haemophilus influenzae Rd
aaguucaccgggcgauaaaauc

SEQ ID NO: 703489 - RNA, 22 nt, Haemophilus influenzae Rd
aaguucagcucgagaaauagca

SEQ ID NO: 703490 - RNA, 21 nt, Haemophilus influenzae Rd
aaguuacuuaauuuugcuaaa

SEQ ID NO: 703491 - RNA, 23 nt, Haemophilus influenzae Rd
aaguucaacaccuaaaugagaaa

SEQ ID NO: 703492 - RNA, 22 nt, Haemophilus influenzae Rd
aaguuauuuauauaauuuaaca

SEQ ID NO: 703493 - RNA, 19 nt, Haemophilus influenzae Rd
aaguuauuuuuacaaggac

SEQ ID NO: 703494 - RNA, 14 nt, Haemophilus influenzae Rd
aaguuaaucaaacu

SEQ ID NO: 703495 - RNA, 15 nt, Haemophilus influenzae Rd
aaguuaaucaaacuu

SEQ ID NO: 703496 - RNA, 17 nt, Haemophilus influenzae Rd
aaguuaauggguuaaaa

SEQ ID NO: 703497 - RNA, 15 nt, Haemophilus influenzae Rd
aaguuacacaaugcc

SEQ ID NO: 703498 - RNA, 21 nt, Haemophilus influenzae Rd
aaguuaccauuuauuccuuua

SEQ ID NO: 703499 - RNA, 20 nt, Haemophilus influenzae Rd
aagugagaaaguuaaucaaa

SEQ ID NO: 703500 - RNA, 16 nt, Haemophilus influenzae Rd
aagugcggagaaaauu

SEQ ID NO: 703501 - RNA, 19 nt, Haemophilus influenzae Rd
aagugcaugagcuuugcuu

SEQ ID NO: 703502 - RNA, 18 nt, Haemophilus influenzae Rd
aagugcggcuucauuuug

SEQ ID NO: 703503 - RNA, 17 nt, Haemophilus influenzae Rd
aagugcggucaauaaaa

SEQ ID NO: 703504 - RNA, 17 nt, Haemophilus influenzae Rd
aagugcggucaauuuca

SEQ ID NO: 703505 - RNA, 17 nt, Haemophilus influenzae Rd
aagugcggucaauuuuc

SEQ ID NO: 703506 - RNA, 17 nt, Haemophilus influenzae Rd
aagugcggucauuuuug

SEQ ID NO: 703507 - RNA, 20 nt, Haemophilus influenzae Rd
aagugcggucugaaaaucaa

SEQ ID NO: 703508 - RNA, 15 nt, Haemophilus influenzae Rd
aagugcgguaaaaaa

SEQ ID NO: 703509 - RNA, 19 nt, Haemophilus influenzae Rd
aagugcgguaaaaauuuac

SEQ ID NO: 703510 - RNA, 22 nt, Haemophilus influenzae Rd
aagugcgguaaauucuucaagu

SEQ ID NO: 703511 - RNA, 19 nt, Haemophilus influenzae Rd
aagugcgguaaauuuuuag

SEQ ID NO: 703512 - RNA, 16 nt, Haemophilus influenzae Rd
aagugcgguaagaaaa

SEQ ID NO: 703513 - RNA, 18 nt, Haemophilus influenzae Rd
aagugcgguaagaaaauc

SEQ ID NO: 703514 - RNA, 21 nt, Haemophilus influenzae Rd
aagugcgguaagguuucuaaa

SEQ ID NO: 703515 - RNA, 20 nt, Haemophilus influenzae Rd
aagugcgguaaucuuucacu

SEQ ID NO: 703516 - RNA, 17 nt, Haemophilus influenzae Rd
aagugcgguauuuuuau

SEQ ID NO: 703517 - RNA, 15 nt, Haemophilus influenzae Rd
aagugcguguauaua

SEQ ID NO: 703518 - RNA, 22 nt, Haemophilus influenzae Rd
aagugcguguauauauuuuccu

SEQ ID NO: 703519 - RNA, 20 nt, Haemophilus influenzae Rd
aagugcgguuaauuuucacc

SEQ ID NO: 703520 - RNA, 17 nt, Haemophilus influenzae Rd
aagugcgguuaauuuuu

SEQ ID NO: 703521 - RNA, 18 nt, Haemophilus influenzae Rd
aagugcgguuauguguuc

SEQ ID NO: 703522 - RNA, 18 nt, Haemophilus influenzae Rd
aagugcgguugaaaaauu

SEQ ID NO: 703523 - RNA, 17 nt, Haemophilus influenzae Rd
aagugcgguugaaaauu

SEQ ID NO: 703524 - RNA, 18 nt, Haemophilus influenzae Rd
aagugcgguugaaauuua

SEQ ID NO: 703525 - RNA, 18 nt, Haemophilus influenzae Rd
aagugcgguugaaauuuc

SEQ ID NO: 703526 - RNA, 20 nt, Haemophilus influenzae Rd
aagugcgguugauuuuccug

SEQ ID NO: 703527 - RNA, 18 nt, Haemophilus influenzae Rd
aagugcgguuguuuuugc

SEQ ID NO: 703528 - RNA, 23 nt, Haemophilus influenzae Rd
aaguguuuuugcuuguaaaaacg

SEQ ID NO: 703529 - RNA, 13 nt, Haemophilus influenzae Rd
aaguuaaaacuug

SEQ ID NO: 703530 - RNA, 14 nt, Haemophilus influenzae Rd
aaguuaaaacuuga

SEQ ID NO: 703531 - RNA, 18 nt, Haemophilus influenzae Rd
aaguuaaaacuugauuga

SEQ ID NO: 703532 - RNA, 23 nt, Haemophilus influenzae Rd
aaguuaaaacuugauugaaaugc

SEQ ID NO: 703533 - RNA, 22 nt, Haemophilus influenzae Rd
aagcuggcguuuacuuggcauu

SEQ ID NO: 703534 - RNA, 23 nt, Haemophilus influenzae Rd
aagcuggcuuucuuuuucaaguu

SEQ ID NO: 703535 - RNA, 15 nt, Haemophilus influenzae Rd
aaggacgaaggauaa

SEQ ID NO: 703536 - RNA, 14 nt, Haemophilus influenzae Rd
aaggaccaagcaau

SEQ ID NO: 703537 - RNA, 14 nt, Haemophilus influenzae Rd
aaggaucuuguaaa

SEQ ID NO: 703538 - RNA, 18 nt, Haemophilus influenzae Rd
aaggaaucgaaauuaaaa

SEQ ID NO: 703539 - RNA, 22 nt, Haemophilus influenzae Rd
aaggaaucgaaauuaaaauaau

SEQ ID NO: 703540 - RNA, 20 nt, Haemophilus influenzae Rd
aaggaaucccauauuuaaaa

SEQ ID NO: 703541 - RNA, 19 nt, Haemophilus influenzae Rd
aaggaauuggauuugaacg

SEQ ID NO: 703542 - RNA, 20 nt, Haemophilus influenzae Rd
aaggcucuaccuaaaauaaa

SEQ ID NO: 703543 - RNA, 13 nt, Haemophilus influenzae Rd
aaggcucaucauu

SEQ ID NO: 703544 - RNA, 18 nt, Haemophilus influenzae Rd
aaggcuccaguuguaaag

SEQ ID NO: 703545 - RNA, 20 nt, Haemophilus influenzae Rd
aaggcuccaguuguaaagau

SEQ ID NO: 703546 - RNA, 22 nt, Haemophilus influenzae Rd
aaggcuccaguuguaaagauug

SEQ ID NO: 703547 - RNA, 23 nt, Haemophilus influenzae Rd
aaggcugcuugauauaauauuuu

SEQ ID NO: 703548 - RNA, 17 nt, Haemophilus influenzae Rd
aaggcuuauuuuuaaac

SEQ ID NO: 703549 - RNA, 16 nt, Haemophilus influenzae Rd
aaggcuucauuugcuu

SEQ ID NO: 703550 - RNA, 17 nt, Haemophilus influenzae Rd
aaggcuucauuugcuuc

SEQ ID NO: 703551 - RNA, 18 nt, Haemophilus influenzae Rd
aaggcuucauuugcuucu

SEQ ID NO: 703552 - RNA, 21 nt, Haemophilus influenzae Rd
aaggcuuucuguguuagaaag

SEQ ID NO: 703553 - RNA, 16 nt, Haemophilus influenzae Rd
aaggcuaguucuuccu

SEQ ID NO: 703554 - RNA, 15 nt, Haemophilus influenzae Rd
aaggcauuuauuacg

SEQ ID NO: 703555 - RNA, 19 nt, Haemophilus influenzae Rd
aaggcauuuauuucaauau

SEQ ID NO: 703556 - RNA, 15 nt, Haemophilus influenzae Rd
aaggcauuuuuuaua

SEQ ID NO: 703557 - RNA, 16 nt, Haemophilus influenzae Rd
aaggcauuuuuuauaa

SEQ ID NO: 703558 - RNA, 19 nt, Haemophilus influenzae Rd
aaggcagccauaaaugcua

SEQ ID NO: 703559 - RNA, 23 nt, Haemophilus influenzae Rd
aaggcaauucccaguaaucuuuu

SEQ ID NO: 703560 - RNA, 22 nt, Haemophilus influenzae Rd
aaggauuaguaagugcuuugag

SEQ ID NO: 703561 - RNA, 15 nt, Haemophilus influenzae Rd
aaggauucgaaccuu

SEQ ID NO: 703562 - RNA, 14 nt, Haemophilus influenzae Rd
aaggcagaaaugaa

SEQ ID NO: 703563 - RNA, 20 nt, Haemophilus influenzae Rd
aaggcacugauuuuuuuaua

SEQ ID NO: 703564 - RNA, 11 nt, Haemophilus influenzae Rd
aaggcacugcg

SEQ ID NO: 703565 - RNA, 23 nt, Haemophilus influenzae Rd
aaggcaccgugggugugaaauau

SEQ ID NO: 703566 - RNA, 19 nt, Haemophilus influenzae Rd
aaggcaggacguuuuaaua

SEQ ID NO: 703567 - RNA, 18 nt, Haemophilus influenzae Rd
aagcuaucgucaaauuua

SEQ ID NO: 703568 - RNA, 22 nt, Haemophilus influenzae Rd
aagcuaucgucaaauuuaaaua

SEQ ID NO: 703569 - RNA, 21 nt, Haemophilus influenzae Rd
aagcuauuacucuuaauuuuu

SEQ ID NO: 703570 - RNA, 15 nt, Haemophilus influenzae Rd
aagcucaccugcccu

SEQ ID NO: 703571 - RNA, 12 nt, Haemophilus influenzae Rd
aagcuacuaaaa

SEQ ID NO: 703572 - RNA, 14 nt, Haemophilus influenzae Rd
aagcuacuaaaaau

SEQ ID NO: 703573 - RNA, 13 nt, Haemophilus influenzae Rd
aagcuaauuuuuc

SEQ ID NO: 703574 - RNA, 18 nt, Haemophilus influenzae Rd
aagcuaaugguuggaaga

SEQ ID NO: 703575 - RNA, 22 nt, Haemophilus influenzae Rd
aagcgcaaucgggcguucuuua

SEQ ID NO: 703576 - RNA, 15 nt, Haemophilus influenzae Rd
aagcgcauuuaaaua

SEQ ID NO: 703577 - RNA, 20 nt, Haemophilus influenzae Rd
aagccugcuacagaagcugc

SEQ ID NO: 703578 - RNA, 19 nt, Haemophilus influenzae Rd
aagccuguugauguuuuaa

SEQ ID NO: 703579 - RNA, 15 nt, Haemophilus influenzae Rd
aagccuugauuucag

SEQ ID NO: 703580 - RNA, 23 nt, Haemophilus influenzae Rd
aagcgaauuucuuuuaagaaauu

SEQ ID NO: 703581 - RNA, 14 nt, Haemophilus influenzae Rd
aagcgaacaccuug

SEQ ID NO: 703582 - RNA, 15 nt, Haemophilus influenzae Rd
aagcgaaaaacauau

SEQ ID NO: 703583 - RNA, 16 nt, Haemophilus influenzae Rd
aagaucaguuaccaua

SEQ ID NO: 703584 - RNA, 20 nt, Haemophilus influenzae Rd
aagaucaguuaccauacauu

SEQ ID NO: 703585 - RNA, 16 nt, Haemophilus influenzae Rd
aagauccaaagacuaa

SEQ ID NO: 703586 - RNA, 15 nt, Haemophilus influenzae Rd
aagauccuuccacca

SEQ ID NO: 703587 - RNA, 22 nt, Haemophilus influenzae Rd
aagaucgccccaauuagauuac

SEQ ID NO: 703588 - RNA, 21 nt, Haemophilus influenzae Rd
aagaucuaaaaacuuuuguuc

SEQ ID NO: 703589 - RNA, 12 nt, Haemophilus influenzae Rd
aagccuaaaucu

SEQ ID NO: 703590 - RNA, 18 nt, Haemophilus influenzae Rd
aagccuaaaucuucuuua

SEQ ID NO: 703591 - RNA, 21 nt, Haemophilus influenzae Rd
aacagggugucguagaaauaa

SEQ ID NO: 703592 - RNA, 22 nt, Haemophilus influenzae Rd
aacagggugucguagaaauaag

SEQ ID NO: 703593 - RNA, 17 nt, Haemophilus influenzae Rd
aacaguagaaaucacaa

SEQ ID NO: 703594 - RNA, 19 nt, Haemophilus influenzae Rd
aacaguaaugaaagaaaca

SEQ ID NO: 703595 - RNA, 15 nt, Haemophilus influenzae Rd
aacagcucuguaaaa

SEQ ID NO: 703596 - RNA, 15 nt, Haemophilus influenzae Rd
aacagcuaaaaauga

SEQ ID NO: 703597 - RNA, 19 nt, Haemophilus influenzae Rd
aacagcuaaaaaugaauua

SEQ ID NO: 703598 - RNA, 17 nt, Haemophilus influenzae Rd
aacagcggucaaaauag

SEQ ID NO: 703599 - RNA, 21 nt, Haemophilus influenzae Rd
aacaaggaaucgaaauuaaaa

SEQ ID NO: 703600 - RNA, 21 nt, Haemophilus influenzae Rd
aacaucgcagaaauagauucu

SEQ ID NO: 703601 - RNA, 16 nt, Haemophilus influenzae Rd
aacaucgcagugaucc

SEQ ID NO: 703602 - RNA, 19 nt, Haemophilus influenzae Rd
aacaucggcaaccaaguau

SEQ ID NO: 703603 - RNA, 15 nt, Haemophilus influenzae Rd
aacaucgcuucauca

SEQ ID NO: 703604 - RNA, 16 nt, Haemophilus influenzae Rd
aacaucgcuucaucau

SEQ ID NO: 703605 - RNA, 17 nt, Haemophilus influenzae Rd
aacaucgcuucaucauc

SEQ ID NO: 703606 - RNA, 14 nt, Haemophilus influenzae Rd
aacaucagcuucaa

SEQ ID NO: 703607 - RNA, 22 nt, Haemophilus influenzae Rd
aacaucauaagguacaacagac

SEQ ID NO: 703608 - RNA, 22 nt, Haemophilus influenzae Rd
aacauaucggcaaucaauucau

SEQ ID NO: 703609 - RNA, 22 nt, Haemophilus influenzae Rd
aacaucaccuguaaacaaauau

SEQ ID NO: 703610 - RNA, 20 nt, Haemophilus influenzae Rd
aacaucacgccaucgccauu

SEQ ID NO: 703611 - RNA, 15 nt, Haemophilus influenzae Rd
aacauauaacccaua

SEQ ID NO: 703612 - RNA, 16 nt, Haemophilus influenzae Rd
aacauauaacccauag

SEQ ID NO: 703613 - RNA, 20 nt, Haemophilus influenzae Rd
aacauaucaaaaaguugaau

SEQ ID NO: 703614 - RNA, 12 nt, Haemophilus influenzae Rd
aacauaguuaau

SEQ ID NO: 703615 - RNA, 14 nt, Haemophilus influenzae Rd
aacauaguuaaugu

SEQ ID NO: 703616 - RNA, 18 nt, Haemophilus influenzae Rd
aacauaauaaaauuuauu

SEQ ID NO: 703617 - RNA, 20 nt, Haemophilus influenzae Rd
aacauaauaaaauuuauuac

SEQ ID NO: 703618 - RNA, 15 nt, Haemophilus influenzae Rd
aacauaagaaauguu

SEQ ID NO: 703619 - RNA, 17 nt, Haemophilus influenzae Rd
aacauagcugaaaaaua

SEQ ID NO: 703620 - RNA, 22 nt, Haemophilus influenzae Rd
aacauagcugaaaaauaaaaaa

SEQ ID NO: 703621 - RNA, 22 nt, Haemophilus influenzae Rd
aacagucugcgccuaaaauauu

SEQ ID NO: 703622 - RNA, 16 nt, Haemophilus influenzae Rd
aacaguggguuaugua

SEQ ID NO: 703623 - RNA, 16 nt, Haemophilus influenzae Rd
aacaguucaauaaaaa

SEQ ID NO: 703624 - RNA, 22 nt, Haemophilus influenzae Rd
aacaguucaauaaaaauauauu

SEQ ID NO: 703625 - RNA, 17 nt, Haemophilus influenzae Rd
aacauuucacuaaauaa

SEQ ID NO: 703626 - RNA, 21 nt, Haemophilus influenzae Rd
aacauuuccaagcguaaaagu

SEQ ID NO: 703627 - RNA, 22 nt, Haemophilus influenzae Rd
aacauuuccaagcguaaaagua

SEQ ID NO: 703628 - RNA, 18 nt, Haemophilus influenzae Rd
aacauuucuaucgcauuu

SEQ ID NO: 703629 - RNA, 16 nt, Haemophilus influenzae Rd
aacauuuucugcucuu

SEQ ID NO: 703630 - RNA, 14 nt, Haemophilus influenzae Rd
aacauuuuucauuu

SEQ ID NO: 703631 - RNA, 11 nt, Haemophilus influenzae Rd
aacauuuugac

SEQ ID NO: 703632 - RNA, 13 nt, Haemophilus influenzae Rd
aaccaaacaaaaa

SEQ ID NO: 703633 - RNA, 15 nt, Haemophilus influenzae Rd
aaccaaacgagaaaa

SEQ ID NO: 703634 - RNA, 16 nt, Haemophilus influenzae Rd
aaccaaacgagaaaau

SEQ ID NO: 703635 - RNA, 22 nt, Haemophilus influenzae Rd
aaccaaagaguuugaauaauug

SEQ ID NO: 703636 - RNA, 16 nt, Haemophilus influenzae Rd
aacauuuuuauuuuua

SEQ ID NO: 703637 - RNA, 16 nt, Haemophilus influenzae Rd
aaccaaaacauaagaa

SEQ ID NO: 703638 - RNA, 17 nt, Haemophilus influenzae Rd
aaccaaaauauuucauu

SEQ ID NO: 703639 - RNA, 21 nt, Haemophilus influenzae Rd
aacauuuuuuuuauccaaaau

SEQ ID NO: 703640 - RNA, 22 nt, Haemophilus influenzae Rd
aaccaccguagucagauaauac

SEQ ID NO: 703641 - RNA, 16 nt, Haemophilus influenzae Rd
aaccaccccauuucuu

SEQ ID NO: 703642 - RNA, 18 nt, Haemophilus influenzae Rd
aaccaccccauuucuuga

SEQ ID NO: 703643 - RNA, 21 nt, Haemophilus influenzae Rd
aaccaccgauuaauaaaauca

SEQ ID NO: 703644 - RNA, 17 nt, Haemophilus influenzae Rd
aaccacauucaaaucca

SEQ ID NO: 703645 - RNA, 19 nt, Haemophilus influenzae Rd
aaccacuugucauuaaaaa

SEQ ID NO: 703646 - RNA, 19 nt, Haemophilus influenzae Rd
aaccagguaauguuucaua

SEQ ID NO: 703647 - RNA, 21 nt, Haemophilus influenzae Rd
aaccagccugaaaaagcuaaa

SEQ ID NO: 703648 - RNA, 23 nt, Haemophilus influenzae Rd
aaccagaaauagaguuaaguugg

SEQ ID NO: 703649 - RNA, 22 nt, Haemophilus influenzae Rd
aaccccugaauuuuguaccaac

SEQ ID NO: 703650 - RNA, 13 nt, Haemophilus influenzae Rd
aaccccuuuucug

SEQ ID NO: 703651 - RNA, 18 nt, Haemophilus influenzae Rd
aaccccguuuuuuagaaa

SEQ ID NO: 703652 - RNA, 22 nt, Haemophilus influenzae Rd
aaccaguuuguguuuauuuaac

SEQ ID NO: 703653 - RNA, 12 nt, Haemophilus influenzae Rd
aacccauuuauu

SEQ ID NO: 703654 - RNA, 20 nt, Haemophilus influenzae Rd
aaccucgccuuguaauugau

SEQ ID NO: 703655 - RNA, 18 nt, Haemophilus influenzae Rd
aaccucccaaaaacuaaa

SEQ ID NO: 703656 - RNA, 20 nt, Haemophilus influenzae Rd
aaccucccaaaaacuaaaua

SEQ ID NO: 703657 - RNA, 12 nt, Haemophilus influenzae Rd
aaccuaaaauag

SEQ ID NO: 703658 - RNA, 16 nt, Haemophilus influenzae Rd
aaccuaaaauugauuu

SEQ ID NO: 703659 - RNA, 14 nt, Haemophilus influenzae Rd
aaccuaaacgauca

SEQ ID NO: 703660 - RNA, 13 nt, Haemophilus influenzae Rd
aaccuaugauuau

SEQ ID NO: 703661 - RNA, 19 nt, Haemophilus influenzae Rd
aaccuaugauuauagauuu

SEQ ID NO: 703662 - RNA, 15 nt, Haemophilus influenzae Rd
aaccuauuagaauuu

SEQ ID NO: 703663 - RNA, 19 nt, Haemophilus influenzae Rd
aaccuacauuaaucaccau

SEQ ID NO: 703664 - RNA, 13 nt, Haemophilus influenzae Rd
aaccuaauuucau

SEQ ID NO: 703665 - RNA, 23 nt, Haemophilus influenzae Rd
aaccuacaacaaaggguaaauaa

SEQ ID NO: 703666 - RNA, 18 nt, Haemophilus influenzae Rd
aaccuaacguagauagca

SEQ ID NO: 703667 - RNA, 18 nt, Haemophilus influenzae Rd
aaccguggcauaauuugg

SEQ ID NO: 703668 - RNA, 19 nt, Haemophilus influenzae Rd
aaccguaauuucaaaucuu

SEQ ID NO: 703669 - RNA, 20 nt, Haemophilus influenzae Rd
aaccguacacgcgcaaauuu

SEQ ID NO: 703670 - RNA, 12 nt, Haemophilus influenzae Rd
aaccuguuggau

SEQ ID NO: 703671 - RNA, 21 nt, Haemophilus influenzae Rd
aaccuuauugcauaguuuuau

SEQ ID NO: 703672 - RNA, 16 nt, Haemophilus influenzae Rd
aaccuuauuuuaaaua

SEQ ID NO: 703673 - RNA, 17 nt, Haemophilus influenzae Rd
aaccugucgcaaugaag

SEQ ID NO: 703674 - RNA, 17 nt, Haemophilus influenzae Rd
aaccuguggcagguggg

SEQ ID NO: 703675 - RNA, 11 nt, Haemophilus influenzae Rd
aaccugcccuu

SEQ ID NO: 703676 - RNA, 20 nt, Haemophilus influenzae Rd
aaccugauaaguagaaaaau

SEQ ID NO: 703677 - RNA, 13 nt, Haemophilus influenzae Rd
aaccugcaaggau

SEQ ID NO: 703678 - RNA, 20 nt, Haemophilus influenzae Rd
aaccugcaaggauauuucca

SEQ ID NO: 703679 - RNA, 22 nt, Haemophilus influenzae Rd
aaccuuucauauaaauaagaau

SEQ ID NO: 703680 - RNA, 22 nt, Haemophilus influenzae Rd
aaccuuugguaaaagaaauggc

SEQ ID NO: 703681 - RNA, 13 nt, Haemophilus influenzae Rd
aaccuuuuucuaa

SEQ ID NO: 703682 - RNA, 17 nt, Haemophilus influenzae Rd
aaccuuuuucuuccauu

SEQ ID NO: 703683 - RNA, 20 nt, Haemophilus influenzae Rd
aaccuuuuucuuccauuuca

SEQ ID NO: 703684 - RNA, 22 nt, Haemophilus influenzae Rd
aaccuuuuucuuccauuucaau

SEQ ID NO: 703685 - RNA, 14 nt, Haemophilus influenzae Rd
aacgaaaaaaauaa

SEQ ID NO: 703686 - RNA, 16 nt, Haemophilus influenzae Rd
aacgaaaaaaauaaaa

SEQ ID NO: 703687 - RNA, 18 nt, Haemophilus influenzae Rd
aaccuucacuuaaauuca

SEQ ID NO: 703688 - RNA, 22 nt, Haemophilus influenzae Rd
aaccuuggucggaauguaaaau

SEQ ID NO: 703689 - RNA, 14 nt, Haemophilus influenzae Rd
aaccuuguaaauac

SEQ ID NO: 703690 - RNA, 19 nt, Haemophilus influenzae Rd
aacgcaucuuuauaacaua

SEQ ID NO: 703691 - RNA, 17 nt, Haemophilus influenzae Rd
aacgcauucaaaucuaa

SEQ ID NO: 703692 - RNA, 21 nt, Haemophilus influenzae Rd
aacgcauucuccguaaaaauc

SEQ ID NO: 703693 - RNA, 15 nt, Haemophilus influenzae Rd
aacgcauaauuugcu

SEQ ID NO: 703694 - RNA, 18 nt, Haemophilus influenzae Rd
aacgcacgccuacuauug

SEQ ID NO: 703695 - RNA, 18 nt, Haemophilus influenzae Rd
aacgagguuggcaauaaa

SEQ ID NO: 703696 - RNA, 21 nt, Haemophilus influenzae Rd
aacgaaucgguaacauaugau

SEQ ID NO: 703697 - RNA, 22 nt, Haemophilus influenzae Rd
aacgaaucgguaacauaugauu

SEQ ID NO: 703698 - RNA, 14 nt, Haemophilus influenzae Rd
aacgacaauuaaag

SEQ ID NO: 703699 - RNA, 15 nt, Haemophilus influenzae Rd
aacgacaauuaaagu

SEQ ID NO: 703700 - RNA, 23 nt, Haemophilus influenzae Rd
aacgacccaauuagaugauuuua

SEQ ID NO: 703701 - RNA, 20 nt, Haemophilus influenzae Rd
aacgacgcacuguugugaag

SEQ ID NO: 703702 - RNA, 14 nt, Haemophilus influenzae Rd
aacgcucgcuggaa

SEQ ID NO: 703703 - RNA, 17 nt, Haemophilus influenzae Rd
aacgcucgcuggaauca

SEQ ID NO: 703704 - RNA, 19 nt, Haemophilus influenzae Rd
aacgcugaaacgggcucau

SEQ ID NO: 703705 - RNA, 17 nt, Haemophilus influenzae Rd
aacgcucugcaccuuca

SEQ ID NO: 703706 - RNA, 18 nt, Haemophilus influenzae Rd
aacgcucugcaccuucac

SEQ ID NO: 703707 - RNA, 22 nt, Haemophilus influenzae Rd
aacgcucuuuaauacgagcuga

SEQ ID NO: 703708 - RNA, 13 nt, Haemophilus influenzae Rd
aacggauuaaaag

SEQ ID NO: 703709 - RNA, 17 nt, Haemophilus influenzae Rd
aacggauuaacacaucc

SEQ ID NO: 703710 - RNA, 16 nt, Haemophilus influenzae Rd
aacggcagccagcagc

SEQ ID NO: 703711 - RNA, 15 nt, Haemophilus influenzae Rd
aacggcgaagauuac

SEQ ID NO: 703712 - RNA, 18 nt, Haemophilus influenzae Rd
aacgcgcauuaaacugga

SEQ ID NO: 703713 - RNA, 18 nt, Haemophilus influenzae Rd
aacgcgaugaaauuauca

SEQ ID NO: 703714 - RNA, 13 nt, Haemophilus influenzae Rd
aacgccugcugca

SEQ ID NO: 703715 - RNA, 18 nt, Haemophilus influenzae Rd
aagaaacaggacaccgcu

SEQ ID NO: 703716 - RNA, 18 nt, Haemophilus influenzae Rd
aagaaaauagaaagaaua

SEQ ID NO: 703717 - RNA, 19 nt, Haemophilus influenzae Rd
aagaaaauagaaagaauau

SEQ ID NO: 703718 - RNA, 22 nt, Haemophilus influenzae Rd
aagaaaauugucgcuaacauau

SEQ ID NO: 703719 - RNA, 23 nt, Haemophilus influenzae Rd
aacuuuuuuauaaucuuuaaauu

SEQ ID NO: 703720 - RNA, 13 nt, Haemophilus influenzae Rd
aagaaaauacaua

SEQ ID NO: 703721 - RNA, 21 nt, Haemophilus influenzae Rd
aagaaaauacauaauuaaauu

SEQ ID NO: 703722 - RNA, 14 nt, Haemophilus influenzae Rd
aagaaaauauuuaa

SEQ ID NO: 703723 - RNA, 20 nt, Haemophilus influenzae Rd
aagaaaauauuuaacuaauu

SEQ ID NO: 703724 - RNA, 12 nt, Haemophilus influenzae Rd
aagaaaaucaaa

SEQ ID NO: 703725 - RNA, 14 nt, Haemophilus influenzae Rd
aacuuugugccauu

SEQ ID NO: 703726 - RNA, 16 nt, Haemophilus influenzae Rd
aacuuuuguucuugcu

SEQ ID NO: 703727 - RNA, 16 nt, Haemophilus influenzae Rd
aacuuuagagauuuua

SEQ ID NO: 703728 - RNA, 21 nt, Haemophilus influenzae Rd
aacuuuacggauaauuucccu

SEQ ID NO: 703729 - RNA, 13 nt, Haemophilus influenzae Rd
aacuuucaaaaua

SEQ ID NO: 703730 - RNA, 19 nt, Haemophilus influenzae Rd
aacuuuccaccccagaauu

SEQ ID NO: 703731 - RNA, 21 nt, Haemophilus influenzae Rd
aacuuucuacgacauuuuuaa

SEQ ID NO: 703732 - RNA, 15 nt, Haemophilus influenzae Rd
aacuuuccuacuaua

SEQ ID NO: 703733 - RNA, 13 nt, Haemophilus influenzae Rd
aacuguugccaua

SEQ ID NO: 703734 - RNA, 23 nt, Haemophilus influenzae Rd
aacuucagcagcaaaaucuucuu

SEQ ID NO: 703735 - RNA, 19 nt, Haemophilus influenzae Rd
aacuucagcuaagccaaua

SEQ ID NO: 703736 - RNA, 19 nt, Haemophilus influenzae Rd
aacuguucuucugggauug

SEQ ID NO: 703737 - RNA, 15 nt, Haemophilus influenzae Rd
aacuuccuaaugcca

SEQ ID NO: 703738 - RNA, 19 nt, Haemophilus influenzae Rd
aacuucggaagaaaaagac

SEQ ID NO: 703739 - RNA, 13 nt, Haemophilus influenzae Rd
aacuucuaaaaaa

SEQ ID NO: 703740 - RNA, 19 nt, Haemophilus influenzae Rd
aacugccacaucaucguuu

SEQ ID NO: 703741 - RNA, 21 nt, Haemophilus influenzae Rd
aacugccacuaauaagccgcc

SEQ ID NO: 703742 - RNA, 15 nt, Haemophilus influenzae Rd
aacugaguuuucacg

SEQ ID NO: 703743 - RNA, 16 nt, Haemophilus influenzae Rd
aacugccgccuucuuc

SEQ ID NO: 703744 - RNA, 20 nt, Haemophilus influenzae Rd
aacugugaggcaaaggcuuc

SEQ ID NO: 703745 - RNA, 15 nt, Haemophilus influenzae Rd
aacuguaauuucggu

SEQ ID NO: 703746 - RNA, 18 nt, Haemophilus influenzae Rd
aacugguuuaucacuaau

SEQ ID NO: 703747 - RNA, 21 nt, Haemophilus influenzae Rd
aacucauccaaucaucagaau

SEQ ID NO: 703748 - RNA, 19 nt, Haemophilus influenzae Rd
aacucaugcugagugaaac

SEQ ID NO: 703749 - RNA, 17 nt, Haemophilus influenzae Rd
aacucauuacacaaaau

SEQ ID NO: 703750 - RNA, 12 nt, Haemophilus influenzae Rd
aacucauucauc

SEQ ID NO: 703751 - RNA, 21 nt, Haemophilus influenzae Rd
aacucauucaucaaaucauuu

SEQ ID NO: 703752 - RNA, 13 nt, Haemophilus influenzae Rd
aacucacuuuguu

SEQ ID NO: 703753 - RNA, 18 nt, Haemophilus influenzae Rd
aacucacuaaauuaggaa

SEQ ID NO: 703754 - RNA, 16 nt, Haemophilus influenzae Rd
aacucacauugccauu

SEQ ID NO: 703755 - RNA, 14 nt, Haemophilus influenzae Rd
aacucacauaaagu

SEQ ID NO: 703756 - RNA, 18 nt, Haemophilus influenzae Rd
aacggcgugaguugcaua

SEQ ID NO: 703757 - RNA, 19 nt, Haemophilus influenzae Rd
aacuaugcagaaucagaau

SEQ ID NO: 703758 - RNA, 19 nt, Haemophilus influenzae Rd
aacucaaugaauuaaaagu

SEQ ID NO: 703759 - RNA, 20 nt, Haemophilus influenzae Rd
aacuauuaccuaaccaaagc

SEQ ID NO: 703760 - RNA, 15 nt, Haemophilus influenzae Rd
aacuauuaucuacua

SEQ ID NO: 703761 - RNA, 22 nt, Haemophilus influenzae Rd
aacuauauagccuguuguucuc

SEQ ID NO: 703762 - RNA, 13 nt, Haemophilus influenzae Rd
aacucgaauagaa

SEQ ID NO: 703763 - RNA, 23 nt, Haemophilus influenzae Rd
aacucggcuuuuucaauacuuuu

SEQ ID NO: 703764 - RNA, 13 nt, Haemophilus influenzae Rd
aacucuauaaaau

SEQ ID NO: 703765 - RNA, 21 nt, Haemophilus influenzae Rd
aacucuaagcuuaauauguuc

SEQ ID NO: 703766 - RNA, 19 nt, Haemophilus influenzae Rd
aacucuguuugcauauaca

SEQ ID NO: 703767 - RNA, 17 nt, Haemophilus influenzae Rd
aacucugguucaaaaug

SEQ ID NO: 703768 - RNA, 23 nt, Haemophilus influenzae Rd
aagacaucauauauucaacuaaa

SEQ ID NO: 703769 - RNA, 16 nt, Haemophilus influenzae Rd
aagacagcuauuaaaa

SEQ ID NO: 703770 - RNA, 15 nt, Haemophilus influenzae Rd
aagaaaguucuuuuu

SEQ ID NO: 703771 - RNA, 18 nt, Haemophilus influenzae Rd
aagaaacgccuacaucuu

SEQ ID NO: 703772 - RNA, 15 nt, Haemophilus influenzae Rd
aagaaaguuaaaaca

SEQ ID NO: 703773 - RNA, 18 nt, Haemophilus influenzae Rd
aagaaaguuaaaacagag

SEQ ID NO: 703774 - RNA, 20 nt, Haemophilus influenzae Rd
aagaaauaacgucauuaauu

SEQ ID NO: 703775 - RNA, 14 nt, Haemophilus influenzae Rd
aagaaauaagcaau

SEQ ID NO: 703776 - RNA, 14 nt, Haemophilus influenzae Rd
aagaaauaauaaaa

SEQ ID NO: 703777 - RNA, 19 nt, Haemophilus influenzae Rd
aagaaauaauaaaauagcu

SEQ ID NO: 703778 - RNA, 11 nt, Haemophilus influenzae Rd
aagaaauaaaa

SEQ ID NO: 703779 - RNA, 20 nt, Haemophilus influenzae Rd
aagaaaguuucacggauuuc

SEQ ID NO: 703780 - RNA, 20 nt, Haemophilus influenzae Rd
aagaaauaaauuuauuuaau

SEQ ID NO: 703781 - RNA, 18 nt, Haemophilus influenzae Rd
aagaaauccccuacagau

SEQ ID NO: 703782 - RNA, 21 nt, Haemophilus influenzae Rd
aagaaauccccuacagauaca

SEQ ID NO: 703783 - RNA, 22 nt, Haemophilus influenzae Rd
aagaaucuucuaauuugccauc

SEQ ID NO: 703784 - RNA, 16 nt, Haemophilus influenzae Rd
aagaaugaaguagaaa

SEQ ID NO: 703785 - RNA, 20 nt, Haemophilus influenzae Rd
aagaaugacguaauuugugc

SEQ ID NO: 703786 - RNA, 16 nt, Haemophilus influenzae Rd
aagacuaaaaccacau

SEQ ID NO: 703787 - RNA, 18 nt, Haemophilus influenzae Rd
aagacuaaacagaauuua

SEQ ID NO: 703788 - RNA, 15 nt, Haemophilus influenzae Rd
aagacuaaacucaau

SEQ ID NO: 703789 - RNA, 16 nt, Haemophilus influenzae Rd
aagacuauuaaguuca

SEQ ID NO: 703790 - RNA, 19 nt, Haemophilus influenzae Rd
aagacucucgccuuauuac

SEQ ID NO: 703791 - RNA, 19 nt, Haemophilus influenzae Rd
aagacccaccgcaaaagcc

SEQ ID NO: 703792 - RNA, 16 nt, Haemophilus influenzae Rd
aagaccccaagcaaau

SEQ ID NO: 703793 - RNA, 17 nt, Haemophilus influenzae Rd
aagaccugcuucuuuua

SEQ ID NO: 703794 - RNA, 22 nt, Haemophilus influenzae Rd
aagaguacggauuggaccguuu

SEQ ID NO: 703795 - RNA, 23 nt, Haemophilus influenzae Rd
aagaggagguagaaaaucgcaau

SEQ ID NO: 703796 - RNA, 17 nt, Haemophilus influenzae Rd
aagagcggucaauuuuu

SEQ ID NO: 703797 - RNA, 18 nt, Haemophilus influenzae Rd
aagagcggucgguuuuuc

SEQ ID NO: 703798 - RNA, 17 nt, Haemophilus influenzae Rd
aagagcgguugaaaauu

SEQ ID NO: 703799 - RNA, 20 nt, Haemophilus influenzae Rd
aagagaucacuguaaauaau

SEQ ID NO: 703800 - RNA, 15 nt, Haemophilus influenzae Rd
aagagauugauuuuc

SEQ ID NO: 703801 - RNA, 21 nt, Haemophilus influenzae Rd
aagagauuauuugcauauaaa

SEQ ID NO: 703802 - RNA, 13 nt, Haemophilus influenzae Rd
aagagcaaauuua

SEQ ID NO: 703803 - RNA, 15 nt, Haemophilus influenzae Rd
aagagcaaauuuaaa

SEQ ID NO: 703804 - RNA, 22 nt, Haemophilus influenzae Rd
aagagcaaauuuaaauaauaaa

SEQ ID NO: 703805 - RNA, 21 nt, Haemophilus influenzae Rd
aagagacucuguuccacaggu

SEQ ID NO: 703806 - RNA, 13 nt, Haemophilus influenzae Rd
aagagaauauuuc

SEQ ID NO: 703807 - RNA, 21 nt, Haemophilus influenzae Rd
aagagaauuuucaucaauuuu

SEQ ID NO: 703808 - RNA, 18 nt, Haemophilus influenzae Rd
aagagagcuucucuuuuu

SEQ ID NO: 703809 - RNA, 20 nt, Haemophilus influenzae Rd
aagauacacucacuuuuccu

SEQ ID NO: 703810 - RNA, 17 nt, Haemophilus influenzae Rd
aagauacccauuucgau

SEQ ID NO: 703811 - RNA, 14 nt, Haemophilus influenzae Rd
aagauagcaaaaua

SEQ ID NO: 703812 - RNA, 13 nt, Haemophilus influenzae Rd
aagauauuauuau

SEQ ID NO: 703813 - RNA, 23 nt, Haemophilus influenzae Rd
aagauauuauuauuaaauccaaa

SEQ ID NO: 703814 - RNA, 15 nt, Haemophilus influenzae Rd
aagaucaauggguuu

SEQ ID NO: 703815 - RNA, 19 nt, Haemophilus influenzae Rd
aagaucaauggguuuaaaa

SEQ ID NO: 703816 - RNA, 19 nt, Haemophilus influenzae Rd
aagaucaagcacuuuuccu

SEQ ID NO: 703817 - RNA, 20 nt, Haemophilus influenzae Rd
aagauauuuuuaccgcacuu

SEQ ID NO: 703818 - RNA, 16 nt, Haemophilus influenzae Rd
aagauauaaacugauu

SEQ ID NO: 703819 - RNA, 18 nt, Haemophilus influenzae Rd
aagauaaauuacauaaaa

SEQ ID NO: 703820 - RNA, 20 nt, Haemophilus influenzae Rd
aagauaaauuacauaaaagc

SEQ ID NO: 703821 - RNA, 22 nt, Haemophilus influenzae Rd
aagauaaauuacauaaaagcgg

SEQ ID NO: 703822 - RNA, 14 nt, Haemophilus influenzae Rd
aagauaaauuuaaa

SEQ ID NO: 703823 - RNA, 20 nt, Haemophilus influenzae Rd
aagauaaguggggaaaaaua

SEQ ID NO: 703824 - RNA, 13 nt, Haemophilus influenzae Rd
aagauaaucccuu

SEQ ID NO: 703825 - RNA, 18 nt, Haemophilus influenzae Rd
aagauaaucgcaaagaau

SEQ ID NO: 703826 - RNA, 17 nt, Haemophilus influenzae Rd
aagaguuauaaacccau

SEQ ID NO: 703827 - RNA, 14 nt, Haemophilus influenzae Rd
aagaguuugaauaa

SEQ ID NO: 703828 - RNA, 17 nt, Haemophilus influenzae Rd
cgcuugggcuuuuucaa

SEQ ID NO: 703829 - RNA, 20 nt, Haemophilus influenzae Rd
cgcuugggcuuuuucaaucg

SEQ ID NO: 703830 - RNA, 20 nt, Haemophilus influenzae Rd
cgcuugccagucauuuuuua

SEQ ID NO: 703831 - RNA, 15 nt, Haemophilus influenzae Rd
cggcaugccaugauc

SEQ ID NO: 703832 - RNA, 20 nt, Haemophilus influenzae Rd
cggcaucaaaccaaccacag

SEQ ID NO: 703833 - RNA, 21 nt, Haemophilus influenzae Rd
cggcaucaaaccaaccacagc

SEQ ID NO: 703834 - RNA, 11 nt, Haemophilus influenzae Rd
cgcgcggacgu

SEQ ID NO: 703835 - RNA, 14 nt, Haemophilus influenzae Rd
cgcgaguaaaauaa

SEQ ID NO: 703836 - RNA, 15 nt, Haemophilus influenzae Rd
cgccucagcaauuuu

SEQ ID NO: 703837 - RNA, 19 nt, Haemophilus influenzae Rd
cgccguuaguuuguauuug

SEQ ID NO: 703838 - RNA, 14 nt, Haemophilus influenzae Rd
cgccuaaccaagcc

SEQ ID NO: 703839 - RNA, 15 nt, Haemophilus influenzae Rd
cgccuacaugaucac

SEQ ID NO: 703840 - RNA, 15 nt, Haemophilus influenzae Rd
cgcucuucagcuucu

SEQ ID NO: 703841 - RNA, 15 nt, Haemophilus influenzae Rd
cgcuauguuuaaaua

SEQ ID NO: 703842 - RNA, 12 nt, Haemophilus influenzae Rd
cgcuauuucacu

SEQ ID NO: 703843 - RNA, 17 nt, Haemophilus influenzae Rd
cgcuauuuucuaaugaa

SEQ ID NO: 703844 - RNA, 13 nt, Haemophilus influenzae Rd
cgcuauuuuuaau

SEQ ID NO: 703845 - RNA, 23 nt, Haemophilus influenzae Rd
cgcucaaauaaauugcccucugc

SEQ ID NO: 703846 - RNA, 23 nt, Haemophilus influenzae Rd
cgcucaauaaggugcuaauuaaa

SEQ ID NO: 703847 - RNA, 19 nt, Haemophilus influenzae Rd
cgcucaacuuaaacaagcu

SEQ ID NO: 703848 - RNA, 22 nt, Haemophilus influenzae Rd
cgcuggauaaaugccgccacag

SEQ ID NO: 703849 - RNA, 15 nt, Haemophilus influenzae Rd
cgcuggcauagcuuc

SEQ ID NO: 703850 - RNA, 18 nt, Haemophilus influenzae Rd
cgcugacuuaaugcaaaa

SEQ ID NO: 703851 - RNA, 16 nt, Haemophilus influenzae Rd
cgcugcagcugcugcu

SEQ ID NO: 703852 - RNA, 15 nt, Haemophilus influenzae Rd
cgcugcaacaaauaa

SEQ ID NO: 703853 - RNA, 22 nt, Haemophilus influenzae Rd
cgcuuaagucagcauaaacaaa

SEQ ID NO: 703854 - RNA, 12 nt, Haemophilus influenzae Rd
cgcuguuuugcu

SEQ ID NO: 703855 - RNA, 19 nt, Haemophilus influenzae Rd
cgcuuaggcguucuaaagc

SEQ ID NO: 703856 - RNA, 13 nt, Haemophilus influenzae Rd
cgcuucagcaagg

SEQ ID NO: 703857 - RNA, 19 nt, Haemophilus influenzae Rd
cgcuucuuucgcagccacu

SEQ ID NO: 703858 - RNA, 22 nt, Haemophilus influenzae Rd
cgcuuccauagcacguaaugca

SEQ ID NO: 703859 - RNA, 12 nt, Haemophilus influenzae Rd
cgcuucauuaaa

SEQ ID NO: 703860 - RNA, 13 nt, Haemophilus influenzae Rd
cgcuguaacauca

SEQ ID NO: 703861 - RNA, 14 nt, Haemophilus influenzae Rd
cgcuguauugggac

SEQ ID NO: 703862 - RNA, 20 nt, Haemophilus influenzae Rd
cgcuguccaauaauuaaacu

SEQ ID NO: 703863 - RNA, 13 nt, Haemophilus influenzae Rd
cgccagcaccacg

SEQ ID NO: 703864 - RNA, 20 nt, Haemophilus influenzae Rd
cgccagaaguuguuuuucuu

SEQ ID NO: 703865 - RNA, 19 nt, Haemophilus influenzae Rd
cgccacgguaaaucugauu

SEQ ID NO: 703866 - RNA, 14 nt, Haemophilus influenzae Rd
cgcauaaccauucc

SEQ ID NO: 703867 - RNA, 16 nt, Haemophilus influenzae Rd
cgcauaauacuugaca

SEQ ID NO: 703868 - RNA, 20 nt, Haemophilus influenzae Rd
cgcauaauacuugacaacgc

SEQ ID NO: 703869 - RNA, 16 nt, Haemophilus influenzae Rd
cgccagucacuucuuc

SEQ ID NO: 703870 - RNA, 18 nt, Haemophilus influenzae Rd
cgccauaaacgcaccaca

SEQ ID NO: 703871 - RNA, 19 nt, Haemophilus influenzae Rd
cgcccuuuauuuuguuaaa

SEQ ID NO: 703872 - RNA, 21 nt, Haemophilus influenzae Rd
cgcccccccagcgaccaccaa

SEQ ID NO: 703873 - RNA, 14 nt, Haemophilus influenzae Rd
cgccaucaauuuuu

SEQ ID NO: 703874 - RNA, 22 nt, Haemophilus influenzae Rd
cgccauuaaaauucacgggcaa

SEQ ID NO: 703875 - RNA, 20 nt, Haemophilus influenzae Rd
cgcccaacagauuuaauacc

SEQ ID NO: 703876 - RNA, 12 nt, Haemophilus influenzae Rd
cgcccaagguua

SEQ ID NO: 703877 - RNA, 16 nt, Haemophilus influenzae Rd
cgccauugaaaggguu

SEQ ID NO: 703878 - RNA, 16 nt, Haemophilus influenzae Rd
cgccauuuuuaaaaau

SEQ ID NO: 703879 - RNA, 23 nt, Haemophilus influenzae Rd
cgauaauagacauagaaaguuua

SEQ ID NO: 703880 - RNA, 17 nt, Haemophilus influenzae Rd
cgaucacgauuuuucuc

SEQ ID NO: 703881 - RNA, 17 nt, Haemophilus influenzae Rd
cgaucacggcgcaauau

SEQ ID NO: 703882 - RNA, 18 nt, Haemophilus influenzae Rd
cgauaguggaauaaugaa

SEQ ID NO: 703883 - RNA, 20 nt, Haemophilus influenzae Rd
cgauaguuaauggcaauuuc

SEQ ID NO: 703884 - RNA, 12 nt, Haemophilus influenzae Rd
cgauaguaaaaa

SEQ ID NO: 703885 - RNA, 20 nt, Haemophilus influenzae Rd
cgaucaugagcgaaccgccc

SEQ ID NO: 703886 - RNA, 15 nt, Haemophilus influenzae Rd
cgaucguuuuccguu

SEQ ID NO: 703887 - RNA, 22 nt, Haemophilus influenzae Rd
cgaucuauauucguuaaauaau

SEQ ID NO: 703888 - RNA, 21 nt, Haemophilus influenzae Rd
cgaucuuuagcuaaugcaaaa

SEQ ID NO: 703889 - RNA, 16 nt, Haemophilus influenzae Rd
cgaugacuaaacaaau

SEQ ID NO: 703890 - RNA, 17 nt, Haemophilus influenzae Rd
cgaugccgaaugaagaa

SEQ ID NO: 703891 - RNA, 11 nt, Haemophilus influenzae Rd
cgauuaauaua

SEQ ID NO: 703892 - RNA, 13 nt, Haemophilus influenzae Rd
cgauuacaaaaac

SEQ ID NO: 703893 - RNA, 19 nt, Haemophilus influenzae Rd
cgauuuaacacuuuuucua

SEQ ID NO: 703894 - RNA, 19 nt, Haemophilus influenzae Rd
cgcaaugcaaaaguaaaua

SEQ ID NO: 703895 - RNA, 15 nt, Haemophilus influenzae Rd
cgcaaugaagauuaa

SEQ ID NO: 703896 - RNA, 20 nt, Haemophilus influenzae Rd
cgcaaugaagauuaacucag

SEQ ID NO: 703897 - RNA, 13 nt, Haemophilus influenzae Rd
cgcaaucaagcaa

SEQ ID NO: 703898 - RNA, 20 nt, Haemophilus influenzae Rd
cgcaagguauuuuuuuuaaa

SEQ ID NO: 703899 - RNA, 16 nt, Haemophilus influenzae Rd
cgauuucaguaucaau

SEQ ID NO: 703900 - RNA, 21 nt, Haemophilus influenzae Rd
cgauuucauuggcgguuuugc

SEQ ID NO: 703901 - RNA, 14 nt, Haemophilus influenzae Rd
cgcagacugcauau

SEQ ID NO: 703902 - RNA, 20 nt, Haemophilus influenzae Rd
cgcacggaugaguucauuuu

SEQ ID NO: 703903 - RNA, 15 nt, Haemophilus influenzae Rd
aaacgguuaauaaau

SEQ ID NO: 703904 - RNA, 22 nt, Haemophilus influenzae Rd
aaacggucgaguuuuucaaaaa

SEQ ID NO: 703905 - RNA, 16 nt, Haemophilus influenzae Rd
cgcaggugucacagca

SEQ ID NO: 703906 - RNA, 16 nt, Haemophilus influenzae Rd
cgcagguucgaguccc

SEQ ID NO: 703907 - RNA, 21 nt, Haemophilus influenzae Rd
aaacgguuuggauuauuaaaa

SEQ ID NO: 703908 - RNA, 22 nt, Haemophilus influenzae Rd
aaacguaaaauaucuuucucuu

SEQ ID NO: 703909 - RNA, 15 nt, Haemophilus influenzae Rd
aaacguaaacaaaau

SEQ ID NO: 703910 - RNA, 13 nt, Haemophilus influenzae Rd
cgcagcugggcug

SEQ ID NO: 703911 - RNA, 20 nt, Haemophilus influenzae Rd
cgcaguauucgggcuucuca

SEQ ID NO: 703912 - RNA, 20 nt, Haemophilus influenzae Rd
cgcagugaucccagcauaaa

SEQ ID NO: 703913 - RNA, 16 nt, Haemophilus influenzae Rd
cgcagcaccaaagaaa

SEQ ID NO: 703914 - RNA, 16 nt, Haemophilus influenzae Rd
cgcagcaucugccacu

SEQ ID NO: 703915 - RNA, 15 nt, Haemophilus influenzae Rd
ccaguuuucuagcuu

SEQ ID NO: 703916 - RNA, 17 nt, Haemophilus influenzae Rd
ccaguuggguuaaauau

SEQ ID NO: 703917 - RNA, 13 nt, Haemophilus influenzae Rd
ccauaaaaaaugg

SEQ ID NO: 703918 - RNA, 22 nt, Haemophilus influenzae Rd
ccauaaaagaccucucuaggcu

SEQ ID NO: 703919 - RNA, 12 nt, Haemophilus influenzae Rd
ccauaaacauug

SEQ ID NO: 703920 - RNA, 13 nt, Haemophilus influenzae Rd
ccauaaacaauau

SEQ ID NO: 703921 - RNA, 21 nt, Haemophilus influenzae Rd
ccauaaacaauauaaccagcc

SEQ ID NO: 703922 - RNA, 20 nt, Haemophilus influenzae Rd
ccauaauguucccuauaaau

SEQ ID NO: 703923 - RNA, 17 nt, Haemophilus influenzae Rd
ccauacaguaaaaauag

SEQ ID NO: 703924 - RNA, 14 nt, Haemophilus influenzae Rd
ccauaccucuauuu

SEQ ID NO: 703925 - RNA, 15 nt, Haemophilus influenzae Rd
ccauaccgcccauuc

SEQ ID NO: 703926 - RNA, 19 nt, Haemophilus influenzae Rd
ccauaggauuauucacccc

SEQ ID NO: 703927 - RNA, 23 nt, Haemophilus influenzae Rd
ccauagcgaagcguaaaaguagc

SEQ ID NO: 703928 - RNA, 22 nt, Haemophilus influenzae Rd
ccaguuacuuauuuagcaagcg

SEQ ID NO: 703929 - RNA, 19 nt, Haemophilus influenzae Rd
ccaguuauucuucagaacu

SEQ ID NO: 703930 - RNA, 14 nt, Haemophilus influenzae Rd
ccagugaauuucuu

SEQ ID NO: 703931 - RNA, 15 nt, Haemophilus influenzae Rd
ccaguaucaaucaua

SEQ ID NO: 703932 - RNA, 18 nt, Haemophilus influenzae Rd
ccaguaucaaucauauca

SEQ ID NO: 703933 - RNA, 22 nt, Haemophilus influenzae Rd
ccaguaucaaucauaucaucaa

SEQ ID NO: 703934 - RNA, 18 nt, Haemophilus influenzae Rd
ccaguagaaaaucagauu

SEQ ID NO: 703935 - RNA, 23 nt, Haemophilus influenzae Rd
ccagucaucauagucaggugcac

SEQ ID NO: 703936 - RNA, 14 nt, Haemophilus influenzae Rd
ccagucacuucuuc

SEQ ID NO: 703937 - RNA, 15 nt, Haemophilus influenzae Rd
ccagucacuucuuca

SEQ ID NO: 703938 - RNA, 19 nt, Haemophilus influenzae Rd
ccaguauuaaucugauaaa

SEQ ID NO: 703939 - RNA, 15 nt, Haemophilus influenzae Rd
ccagucaauaaacuc

SEQ ID NO: 703940 - RNA, 17 nt, Haemophilus influenzae Rd
ccaucgcugaaauuaau

SEQ ID NO: 703941 - RNA, 19 nt, Haemophilus influenzae Rd
ccaucgcugaaauuaauaa

SEQ ID NO: 703942 - RNA, 19 nt, Haemophilus influenzae Rd
ccaucgggcuguaaaaaau

SEQ ID NO: 703943 - RNA, 21 nt, Haemophilus influenzae Rd
ccaugaauauugguuuuauuc

SEQ ID NO: 703944 - RNA, 22 nt, Haemophilus influenzae Rd
ccaugaacguuugccgaagccu

SEQ ID NO: 703945 - RNA, 12 nt, Haemophilus influenzae Rd
ccaucuucuucu

SEQ ID NO: 703946 - RNA, 23 nt, Haemophilus influenzae Rd
ccaucuucuucuggauuaucugu

SEQ ID NO: 703947 - RNA, 19 nt, Haemophilus influenzae Rd
ccauccauaacggcaagca

SEQ ID NO: 703948 - RNA, 11 nt, Haemophilus influenzae Rd
ccauauuuucc

SEQ ID NO: 703949 - RNA, 12 nt, Haemophilus influenzae Rd
ccauauuuuccc

SEQ ID NO: 703950 - RNA, 23 nt, Haemophilus influenzae Rd
aaacaaucuguggcguauuuaga

SEQ ID NO: 703951 - RNA, 15 nt, Haemophilus influenzae Rd
aaacaaucacugaaa

SEQ ID NO: 703952 - RNA, 13 nt, Haemophilus influenzae Rd
ccauauuaucugc

SEQ ID NO: 703953 - RNA, 15 nt, Haemophilus influenzae Rd
ccauauuauuccuuu

SEQ ID NO: 703954 - RNA, 19 nt, Haemophilus influenzae Rd
ccauauuaaucgcaauaac

SEQ ID NO: 703955 - RNA, 21 nt, Haemophilus influenzae Rd
aaacaaugcaaauacaagugg

SEQ ID NO: 703956 - RNA, 22 nt, Haemophilus influenzae Rd
ccaucauuuuagguucaauaau

SEQ ID NO: 703957 - RNA, 17 nt, Haemophilus influenzae Rd
cccaagagucuugccaa

SEQ ID NO: 703958 - RNA, 16 nt, Haemophilus influenzae Rd
cccaagauucuaaaua

SEQ ID NO: 703959 - RNA, 14 nt, Haemophilus influenzae Rd
cccaagcaauucuu

SEQ ID NO: 703960 - RNA, 20 nt, Haemophilus influenzae Rd
cccaaccgauauacucuccc

SEQ ID NO: 703961 - RNA, 22 nt, Haemophilus influenzae Rd
ccauuuuuuggaguuguuuaaa

SEQ ID NO: 703962 - RNA, 13 nt, Haemophilus influenzae Rd
ccauuuuuuucua

SEQ ID NO: 703963 - RNA, 22 nt, Haemophilus influenzae Rd
ccauuuuuaaguucuacccauu

SEQ ID NO: 703964 - RNA, 11 nt, Haemophilus influenzae Rd
ccauuuuucaa

SEQ ID NO: 703965 - RNA, 13 nt, Haemophilus influenzae Rd
ccauuuuucaaaa

SEQ ID NO: 703966 - RNA, 15 nt, Haemophilus influenzae Rd
ccauuuuucaaaauu

SEQ ID NO: 703967 - RNA, 11 nt, Haemophilus influenzae Rd
ccauuuugcuc

SEQ ID NO: 703968 - RNA, 11 nt, Haemophilus influenzae Rd
ccauuuuucca

SEQ ID NO: 703969 - RNA, 14 nt, Haemophilus influenzae Rd
ccauuuuuccagca

SEQ ID NO: 703970 - RNA, 19 nt, Haemophilus influenzae Rd
ccauuuucggacucgcugu

SEQ ID NO: 703971 - RNA, 23 nt, Haemophilus influenzae Rd
ccauuuuagaggcuaugauuuua

SEQ ID NO: 703972 - RNA, 19 nt, Haemophilus influenzae Rd
ccauuugcccacauagcuu

SEQ ID NO: 703973 - RNA, 20 nt, Haemophilus influenzae Rd
ccauuugcccacauagcuug

SEQ ID NO: 703974 - RNA, 22 nt, Haemophilus influenzae Rd
ccauuugaauuuuacuucuuca

SEQ ID NO: 703975 - RNA, 12 nt, Haemophilus influenzae Rd
ccauuucuaaac

SEQ ID NO: 703976 - RNA, 20 nt, Haemophilus influenzae Rd
ccauuucuaaugcaauuuca

SEQ ID NO: 703977 - RNA, 21 nt, Haemophilus influenzae Rd
ccauuucuaaugcaauuucaa

SEQ ID NO: 703978 - RNA, 14 nt, Haemophilus influenzae Rd
ccauucucaaauga

SEQ ID NO: 703979 - RNA, 19 nt, Haemophilus influenzae Rd
ccauucuaaaaaaauccua

SEQ ID NO: 703980 - RNA, 23 nt, Haemophilus influenzae Rd
ccauucuaaaaaaauccuaaaua

SEQ ID NO: 703981 - RNA, 16 nt, Haemophilus influenzae Rd
ccauugcguucacuca

SEQ ID NO: 703982 - RNA, 19 nt, Haemophilus influenzae Rd
ccauugcuagccaauaauc

SEQ ID NO: 703983 - RNA, 20 nt, Haemophilus influenzae Rd
ccauugcuagccaauaaucu

SEQ ID NO: 703984 - RNA, 16 nt, Haemophilus influenzae Rd
ccauuccugcaagaaa

SEQ ID NO: 703985 - RNA, 18 nt, Haemophilus influenzae Rd
ccauuaaccaacauaaac

SEQ ID NO: 703986 - RNA, 18 nt, Haemophilus influenzae Rd
ccauuacaagcauuaaau

SEQ ID NO: 703987 - RNA, 13 nt, Haemophilus influenzae Rd
ccauuacagcaag

SEQ ID NO: 703988 - RNA, 20 nt, Haemophilus influenzae Rd
ccauuaccacugcauuuucu

SEQ ID NO: 703989 - RNA, 15 nt, Haemophilus influenzae Rd
ccauuacaaguauaa

SEQ ID NO: 703990 - RNA, 21 nt, Haemophilus influenzae Rd
ccauguacauuaauguaauca

SEQ ID NO: 703991 - RNA, 20 nt, Haemophilus influenzae Rd
ccauggcuuuuuccugauca

SEQ ID NO: 703992 - RNA, 20 nt, Haemophilus influenzae Rd
cccagcguaaaaaugcuguu

SEQ ID NO: 703993 - RNA, 18 nt, Haemophilus influenzae Rd
cccaucauuuuagguuca

SEQ ID NO: 703994 - RNA, 23 nt, Haemophilus influenzae Rd
cccauauuuaaaaccaaaagauu

SEQ ID NO: 703995 - RNA, 15 nt, Haemophilus influenzae Rd
cccauauuauuccuu

SEQ ID NO: 703996 - RNA, 19 nt, Haemophilus influenzae Rd
aaacaccaaauauucuucu

SEQ ID NO: 703997 - RNA, 19 nt, Haemophilus influenzae Rd
cccauacaaguauuuuccu

SEQ ID NO: 703998 - RNA, 15 nt, Haemophilus influenzae Rd
aaacacaaaauaagg

SEQ ID NO: 703999 - RNA, 17 nt, Haemophilus influenzae Rd
aaacacaacauaauuaa

SEQ ID NO: 704000 - RNA, 20 nt, Haemophilus influenzae Rd
aaacacaacauaauuaaagc

SEQ ID NO: 704001 - RNA, 21 nt, Haemophilus influenzae Rd
cccauaaaucggcguauuuua

SEQ ID NO: 704002 - RNA, 20 nt, Haemophilus influenzae Rd
aaacaauucuauauuauuua

SEQ ID NO: 704003 - RNA, 16 nt, Haemophilus influenzae Rd
aaacaauggcugaaaa

SEQ ID NO: 704004 - RNA, 15 nt, Haemophilus influenzae Rd
cccagugcugaaaua

SEQ ID NO: 704005 - RNA, 23 nt, Haemophilus influenzae Rd
cccaguaaaacuugcaaaccaac

SEQ ID NO: 704006 - RNA, 20 nt, Haemophilus influenzae Rd
cccaguaaauauccacgaau

SEQ ID NO: 704007 - RNA, 16 nt, Haemophilus influenzae Rd
cccgcacuuuuaacca

SEQ ID NO: 704008 - RNA, 15 nt, Haemophilus influenzae Rd
ccccgcucuuuccau

SEQ ID NO: 704009 - RNA, 15 nt, Haemophilus influenzae Rd
ccccgaugauuuuua

SEQ ID NO: 704010 - RNA, 16 nt, Haemophilus influenzae Rd
ccccauaucucugcca

SEQ ID NO: 704011 - RNA, 23 nt, Haemophilus influenzae Rd
cccauuugaauuuuacuucuuca

SEQ ID NO: 704012 - RNA, 23 nt, Haemophilus influenzae Rd
ccccaaaaaguuagauugauuua

SEQ ID NO: 704013 - RNA, 19 nt, Haemophilus influenzae Rd
ccccaaaagcugccaucug

SEQ ID NO: 704014 - RNA, 20 nt, Haemophilus influenzae Rd
cccaugcgaacagguucauu

SEQ ID NO: 704015 - RNA, 11 nt, Haemophilus influenzae Rd
cccaugcuuug

SEQ ID NO: 704016 - RNA, 12 nt, Haemophilus influenzae Rd
cccucaaccacu

SEQ ID NO: 704017 - RNA, 18 nt, Haemophilus influenzae Rd
cccucgccuugcaaauuu

SEQ ID NO: 704018 - RNA, 15 nt, Haemophilus influenzae Rd
cccugaaagucgauu

SEQ ID NO: 704019 - RNA, 18 nt, Haemophilus influenzae Rd
cccugaaugcguucaugg

SEQ ID NO: 704020 - RNA, 13 nt, Haemophilus influenzae Rd
cccugaagccaau

SEQ ID NO: 704021 - RNA, 14 nt, Haemophilus influenzae Rd
cccuacaggcuucc

SEQ ID NO: 704022 - RNA, 12 nt, Haemophilus influenzae Rd
cccuauagcuua

SEQ ID NO: 704023 - RNA, 16 nt, Haemophilus influenzae Rd
cccuauuacuuuccau

SEQ ID NO: 704024 - RNA, 17 nt, Haemophilus influenzae Rd
cccuagccuuuucuagc

SEQ ID NO: 704025 - RNA, 21 nt, Haemophilus influenzae Rd
cccguuguguuucaacaaaaa

SEQ ID NO: 704026 - RNA, 12 nt, Haemophilus influenzae Rd
cccuaauuauuu

SEQ ID NO: 704027 - RNA, 19 nt, Haemophilus influenzae Rd
cccuacaaugcucacuucg

SEQ ID NO: 704028 - RNA, 20 nt, Haemophilus influenzae Rd
cccgucaauuccauaauauc

SEQ ID NO: 704029 - RNA, 20 nt, Haemophilus influenzae Rd
cccgugcagacuagugaaau

SEQ ID NO: 704030 - RNA, 22 nt, Haemophilus influenzae Rd
cccguuaaauuuaucauuuaac

SEQ ID NO: 704031 - RNA, 14 nt, Haemophilus influenzae Rd
cccguauuaaauac

SEQ ID NO: 704032 - RNA, 14 nt, Haemophilus influenzae Rd
aaacaguaaugaaa

SEQ ID NO: 704033 - RNA, 22 nt, Haemophilus influenzae Rd
aaacaggaauacucacagagcc

SEQ ID NO: 704034 - RNA, 23 nt, Haemophilus influenzae Rd
aaacagguguguuuuucaaaaaa

SEQ ID NO: 704035 - RNA, 13 nt, Haemophilus influenzae Rd
ccgaaaaaacaag

SEQ ID NO: 704036 - RNA, 17 nt, Haemophilus influenzae Rd
cccuuuuucaauuauua

SEQ ID NO: 704037 - RNA, 19 nt, Haemophilus influenzae Rd
aaacagccaaacaaauuag

SEQ ID NO: 704038 - RNA, 21 nt, Haemophilus influenzae Rd
cccuucaaauauaacgacguu

SEQ ID NO: 704039 - RNA, 18 nt, Haemophilus influenzae Rd
cccuucauaagcccccac

SEQ ID NO: 704040 - RNA, 10 nt, Haemophilus influenzae Rd
aaacagcaaa

SEQ ID NO: 704041 - RNA, 17 nt, Haemophilus influenzae Rd
aaacagaucgugauauu

SEQ ID NO: 704042 - RNA, 15 nt, Haemophilus influenzae Rd
aaacagcaauaaaua

SEQ ID NO: 704043 - RNA, 18 nt, Haemophilus influenzae Rd
aaacagcaauaaauaaua

SEQ ID NO: 704044 - RNA, 12 nt, Haemophilus influenzae Rd
cccuuacuuuau

SEQ ID NO: 704045 - RNA, 16 nt, Haemophilus influenzae Rd
cccuuacuuuauacua

SEQ ID NO: 704046 - RNA, 12 nt, Haemophilus influenzae Rd
cccuuauggugg

SEQ ID NO: 704047 - RNA, 16 nt, Haemophilus influenzae Rd
ccgaaagauauauaau

SEQ ID NO: 704048 - RNA, 17 nt, Haemophilus influenzae Rd
aaacauaauauuuuccc

SEQ ID NO: 704049 - RNA, 21 nt, Haemophilus influenzae Rd
aaacauacaucuaauuuuagu

SEQ ID NO: 704050 - RNA, 13 nt, Haemophilus influenzae Rd
aaacauaccacuu

SEQ ID NO: 704051 - RNA, 18 nt, Haemophilus influenzae Rd
ccgaaaaccgaaaaaaua

SEQ ID NO: 704052 - RNA, 18 nt, Haemophilus influenzae Rd
aaacaucaucacccccac

SEQ ID NO: 704053 - RNA, 13 nt, Haemophilus influenzae Rd
aaacauauuccaa

SEQ ID NO: 704054 - RNA, 19 nt, Haemophilus influenzae Rd
aaacauauugaugauuaac

SEQ ID NO: 704055 - RNA, 21 nt, Haemophilus influenzae Rd
aaacaucacgccaucgccauu

SEQ ID NO: 704056 - RNA, 13 nt, Haemophilus influenzae Rd
aaacauuacugcu

SEQ ID NO: 704057 - RNA, 22 nt, Haemophilus influenzae Rd
ccgaaugaagaaauggcgacca

SEQ ID NO: 704058 - RNA, 21 nt, Haemophilus influenzae Rd
aaacaucgcagaaauagauuc

SEQ ID NO: 704059 - RNA, 16 nt, Haemophilus influenzae Rd
aaacauugccaaagca

SEQ ID NO: 704060 - RNA, 22 nt, Haemophilus influenzae Rd
aaacauuguuuuguucaucuaa

SEQ ID NO: 704061 - RNA, 19 nt, Haemophilus influenzae Rd
aaacauugcucgugauuau

SEQ ID NO: 704062 - RNA, 23 nt, Haemophilus influenzae Rd
aaaccaccguucuauauuuugaa

SEQ ID NO: 704063 - RNA, 15 nt, Haemophilus influenzae Rd
aaaccacuaaaaaca

SEQ ID NO: 704064 - RNA, 23 nt, Haemophilus influenzae Rd
ccgacuuuauauugacaaagucg

SEQ ID NO: 704065 - RNA, 14 nt, Haemophilus influenzae Rd
ccgcccaacauuuc

SEQ ID NO: 704066 - RNA, 15 nt, Haemophilus influenzae Rd
ccgccccacagccaa

SEQ ID NO: 704067 - RNA, 16 nt, Haemophilus influenzae Rd
aaacccgcuuuuaaca

SEQ ID NO: 704068 - RNA, 14 nt, Haemophilus influenzae Rd
aaacccaucauaaa

SEQ ID NO: 704069 - RNA, 20 nt, Haemophilus influenzae Rd
aaaccccguucaauuugaac

SEQ ID NO: 704070 - RNA, 12 nt, Haemophilus influenzae Rd
ccgccaguaaga

SEQ ID NO: 704071 - RNA, 20 nt, Haemophilus influenzae Rd
aaaccaucauaggcuuuaac

SEQ ID NO: 704072 - RNA, 20 nt, Haemophilus influenzae Rd
aaaccagauaaaaacugugc

SEQ ID NO: 704073 - RNA, 19 nt, Haemophilus influenzae Rd
ccgccaaaaugagcuuuuc

SEQ ID NO: 704074 - RNA, 14 nt, Haemophilus influenzae Rd
ccgccaaugcuuuu

SEQ ID NO: 704075 - RNA, 15 nt, Haemophilus influenzae Rd
ccgcauuacuuuuug

SEQ ID NO: 704076 - RNA, 12 nt, Haemophilus influenzae Rd
ccgcauauaaaa

SEQ ID NO: 704077 - RNA, 13 nt, Haemophilus influenzae Rd
ccgcauauaaaau

SEQ ID NO: 704078 - RNA, 14 nt, Haemophilus influenzae Rd
ccgcauaggccuca

SEQ ID NO: 704079 - RNA, 16 nt, Haemophilus influenzae Rd
ccgcacuucuaugaag

SEQ ID NO: 704080 - RNA, 17 nt, Haemophilus influenzae Rd
ccgcacuuucuucuuuu

SEQ ID NO: 704081 - RNA, 21 nt, Haemophilus influenzae Rd
ccgcacuuugugcuccccccc

SEQ ID NO: 704082 - RNA, 21 nt, Haemophilus influenzae Rd
ccgcacuuuuauccaccagca

SEQ ID NO: 704083 - RNA, 23 nt, Haemophilus influenzae Rd
ccgcacuuuuaucuauaaaaaga

SEQ ID NO: 704084 - RNA, 19 nt, Haemophilus influenzae Rd
ccgcacuuuuguauuuuau

SEQ ID NO: 704085 - RNA, 19 nt, Haemophilus influenzae Rd
ccgcacuuuuuauauuuuu

SEQ ID NO: 704086 - RNA, 17 nt, Haemophilus influenzae Rd
ccgcacuuuuuauuuuu

SEQ ID NO: 704087 - RNA, 17 nt, Haemophilus influenzae Rd
ccgcacuuuauuagaaa

SEQ ID NO: 704088 - RNA, 19 nt, Haemophilus influenzae Rd
ccgcaguuaaaacugugcc

SEQ ID NO: 704089 - RNA, 22 nt, Haemophilus influenzae Rd
ccgcaauugggauuauuuuugu

SEQ ID NO: 704090 - RNA, 19 nt, Haemophilus influenzae Rd
ccgauuaagaauacugcac

SEQ ID NO: 704091 - RNA, 12 nt, Haemophilus influenzae Rd
ccgauuuuaaac

SEQ ID NO: 704092 - RNA, 12 nt, Haemophilus influenzae Rd
ccgauuuuaaau

SEQ ID NO: 704093 - RNA, 15 nt, Haemophilus influenzae Rd
ccuaaccaagccaaa

SEQ ID NO: 704094 - RNA, 16 nt, Haemophilus influenzae Rd
ccuaaaucuuuaucaa

SEQ ID NO: 704095 - RNA, 19 nt, Haemophilus influenzae Rd
ccuaaaugagaaaaauccu

SEQ ID NO: 704096 - RNA, 14 nt, Haemophilus influenzae Rd
ccuaaauauuuaua

SEQ ID NO: 704097 - RNA, 17 nt, Haemophilus influenzae Rd
ccuaaauauuuauacac

SEQ ID NO: 704098 - RNA, 15 nt, Haemophilus influenzae Rd
ccuaagauuuuaucu

SEQ ID NO: 704099 - RNA, 22 nt, Haemophilus influenzae Rd
ccuaagauuuuaucuaacucuu

SEQ ID NO: 704100 - RNA, 20 nt, Haemophilus influenzae Rd
ccuaagcacaaagaaaaacu

SEQ ID NO: 704101 - RNA, 22 nt, Haemophilus influenzae Rd
ccuaagcacaaagaaaaacuaa

SEQ ID NO: 704102 - RNA, 14 nt, Haemophilus influenzae Rd
ccuaauaaaaaaua

SEQ ID NO: 704103 - RNA, 13 nt, Haemophilus influenzae Rd
ccuaaaaaacccg

SEQ ID NO: 704104 - RNA, 17 nt, Haemophilus influenzae Rd
ccguuuuuucauucacu

SEQ ID NO: 704105 - RNA, 18 nt, Haemophilus influenzae Rd
ccguuuuuucuuuuuccu

SEQ ID NO: 704106 - RNA, 19 nt, Haemophilus influenzae Rd
ccguuuuuucuuuuuccug

SEQ ID NO: 704107 - RNA, 13 nt, Haemophilus influenzae Rd
ccuaaaauacaaa

SEQ ID NO: 704108 - RNA, 15 nt, Haemophilus influenzae Rd
ccuaaaauacaaaua

SEQ ID NO: 704109 - RNA, 13 nt, Haemophilus influenzae Rd
ccuaaaauagagc

SEQ ID NO: 704110 - RNA, 11 nt, Haemophilus influenzae Rd
ccuaaaauauu

SEQ ID NO: 704111 - RNA, 19 nt, Haemophilus influenzae Rd
ccuaaacguaacaacgcac

SEQ ID NO: 704112 - RNA, 19 nt, Haemophilus influenzae Rd
ccuaaacuacaacagcgaa

SEQ ID NO: 704113 - RNA, 19 nt, Haemophilus influenzae Rd
ccuaaacgaacuggcugag

SEQ ID NO: 704114 - RNA, 14 nt, Haemophilus influenzae Rd
ccguuuucuacuuc

SEQ ID NO: 704115 - RNA, 18 nt, Haemophilus influenzae Rd
ccguuuuuauuuguucua

SEQ ID NO: 704116 - RNA, 21 nt, Haemophilus influenzae Rd
ccguuuuuauuuguucuacuu

SEQ ID NO: 704117 - RNA, 16 nt, Haemophilus influenzae Rd
ccguuugaccauucau

SEQ ID NO: 704118 - RNA, 14 nt, Haemophilus influenzae Rd
ccguucuuaucuac

SEQ ID NO: 704119 - RNA, 21 nt, Haemophilus influenzae Rd
ccguuguguuucaacaaaaau

SEQ ID NO: 704120 - RNA, 21 nt, Haemophilus influenzae Rd
ccguuccacuuccugcuaccu

SEQ ID NO: 704121 - RNA, 17 nt, Haemophilus influenzae Rd
ccguuaaauuuagauuu

SEQ ID NO: 704122 - RNA, 16 nt, Haemophilus influenzae Rd
ccguuagguuuaaaag

SEQ ID NO: 704123 - RNA, 22 nt, Haemophilus influenzae Rd
ccgucguuguuccuaaugugca

SEQ ID NO: 704124 - RNA, 20 nt, Haemophilus influenzae Rd
ccgucuaaaaauccugaaga

SEQ ID NO: 704125 - RNA, 14 nt, Haemophilus influenzae Rd
ccgugccaaagcau

SEQ ID NO: 704126 - RNA, 19 nt, Haemophilus influenzae Rd
ccgugggugugaaauauuc

SEQ ID NO: 704127 - RNA, 21 nt, Haemophilus influenzae Rd
aaacgagacauuauuuuuaca

SEQ ID NO: 704128 - RNA, 18 nt, Haemophilus influenzae Rd
aaacgaugaagaaaauuu

SEQ ID NO: 704129 - RNA, 21 nt, Haemophilus influenzae Rd
aaacgaugugcauugaauuuu

SEQ ID NO: 704130 - RNA, 15 nt, Haemophilus influenzae Rd
aaacgaccuucauca

SEQ ID NO: 704131 - RNA, 18 nt, Haemophilus influenzae Rd
aaacgagcauauuuucca

SEQ ID NO: 704132 - RNA, 17 nt, Haemophilus influenzae Rd
aaacgacuuaauuuuau

SEQ ID NO: 704133 - RNA, 16 nt, Haemophilus influenzae Rd
ccuacgccguuagaua

SEQ ID NO: 704134 - RNA, 21 nt, Haemophilus influenzae Rd
ccuacgccguuagauacuuua

SEQ ID NO: 704135 - RNA, 16 nt, Haemophilus influenzae Rd
ccuaccggacuugaac

SEQ ID NO: 704136 - RNA, 14 nt, Haemophilus influenzae Rd
ccuagaguaaguaa

SEQ ID NO: 704137 - RNA, 18 nt, Haemophilus influenzae Rd
ccuacuuuuuauuuuuga

SEQ ID NO: 704138 - RNA, 13 nt, Haemophilus influenzae Rd
ccuagaacaaaag

SEQ ID NO: 704139 - RNA, 21 nt, Haemophilus influenzae Rd
ccuaaugcaguaacuucugcu

SEQ ID NO: 704140 - RNA, 19 nt, Haemophilus influenzae Rd
ccuaauaugauuucuucaa

SEQ ID NO: 704141 - RNA, 12 nt, Haemophilus influenzae Rd
ccuaaucccaua

SEQ ID NO: 704142 - RNA, 17 nt, Haemophilus influenzae Rd
ccuaauggauauagaaa

SEQ ID NO: 704143 - RNA, 22 nt, Haemophilus influenzae Rd
ccuaauuaauuuagauaaaaau

SEQ ID NO: 704144 - RNA, 12 nt, Haemophilus influenzae Rd
ccuaauucaaua

SEQ ID NO: 704145 - RNA, 14 nt, Haemophilus influenzae Rd
ccuaauucaauauc

SEQ ID NO: 704146 - RNA, 13 nt, Haemophilus influenzae Rd
ccuaauucacuau

SEQ ID NO: 704147 - RNA, 13 nt, Haemophilus influenzae Rd
ccuaauucaucuu

SEQ ID NO: 704148 - RNA, 14 nt, Haemophilus influenzae Rd
ccuaauucuuucac

SEQ ID NO: 704149 - RNA, 23 nt, Haemophilus influenzae Rd
ccuaauugcugggcaauauaaac

SEQ ID NO: 704150 - RNA, 12 nt, Haemophilus influenzae Rd
ccuacaacuaau

SEQ ID NO: 704151 - RNA, 14 nt, Haemophilus influenzae Rd
ccuacauuaaaaga

SEQ ID NO: 704152 - RNA, 13 nt, Haemophilus influenzae Rd
ccuauaaaacaaa

SEQ ID NO: 704153 - RNA, 20 nt, Haemophilus influenzae Rd
ccuagcgcuguuacuucuuu

SEQ ID NO: 704154 - RNA, 23 nt, Haemophilus influenzae Rd
ccuagcgcuguuacuucuuucac

SEQ ID NO: 704155 - RNA, 17 nt, Haemophilus influenzae Rd
ccuauucgcugauaaac

SEQ ID NO: 704156 - RNA, 12 nt, Haemophilus influenzae Rd
ccuauucuaaau

SEQ ID NO: 704157 - RNA, 15 nt, Haemophilus influenzae Rd
ccuauucuaaauuua

SEQ ID NO: 704158 - RNA, 15 nt, Haemophilus influenzae Rd
ccucagcaauuuucu

SEQ ID NO: 704159 - RNA, 20 nt, Haemophilus influenzae Rd
ccucagauaaucuacaaaac

SEQ ID NO: 704160 - RNA, 14 nt, Haemophilus influenzae Rd
ccucagauaaugau

SEQ ID NO: 704161 - RNA, 13 nt, Haemophilus influenzae Rd
ccucagagauaau

SEQ ID NO: 704162 - RNA, 18 nt, Haemophilus influenzae Rd
ccucaaguuuguggagua

SEQ ID NO: 704163 - RNA, 21 nt, Haemophilus influenzae Rd
ccucaauguucgauuuuacuu

SEQ ID NO: 704164 - RNA, 12 nt, Haemophilus influenzae Rd
ccuauuuuuaga

SEQ ID NO: 704165 - RNA, 12 nt, Haemophilus influenzae Rd
ccuauuuuuucc

SEQ ID NO: 704166 - RNA, 15 nt, Haemophilus influenzae Rd
ccuauuuuuuccugc

SEQ ID NO: 704167 - RNA, 12 nt, Haemophilus influenzae Rd
ccuccauuaguu

SEQ ID NO: 704168 - RNA, 17 nt, Haemophilus influenzae Rd
ccuccauuaguuguuuu

SEQ ID NO: 704169 - RNA, 19 nt, Haemophilus influenzae Rd
ccuccauuaguuguuuuag

SEQ ID NO: 704170 - RNA, 20 nt, Haemophilus influenzae Rd
ccucgaauagcaauaucugc

SEQ ID NO: 704171 - RNA, 15 nt, Haemophilus influenzae Rd
ccucgccuugcaaau

SEQ ID NO: 704172 - RNA, 15 nt, Haemophilus influenzae Rd
ccgguaaaucuacuu

SEQ ID NO: 704173 - RNA, 16 nt, Haemophilus influenzae Rd
aaaccguggcauaauu

SEQ ID NO: 704174 - RNA, 21 nt, Haemophilus influenzae Rd
aaaccguggcauaauuugguu

SEQ ID NO: 704175 - RNA, 16 nt, Haemophilus influenzae Rd
aaaccgugguuuaaac

SEQ ID NO: 704176 - RNA, 21 nt, Haemophilus influenzae Rd
aaaccguuuagcaaacaaugg

SEQ ID NO: 704177 - RNA, 18 nt, Haemophilus influenzae Rd
aaaccuaaaauugauuuc

SEQ ID NO: 704178 - RNA, 21 nt, Haemophilus influenzae Rd
aaaccuacacccacugauuuu

SEQ ID NO: 704179 - RNA, 14 nt, Haemophilus influenzae Rd
aaaccuaaauccca

SEQ ID NO: 704180 - RNA, 22 nt, Haemophilus influenzae Rd
aaaccuaacguagauagcacga

SEQ ID NO: 704181 - RNA, 14 nt, Haemophilus influenzae Rd
ccugccaguagaaa

SEQ ID NO: 704182 - RNA, 15 nt, Haemophilus influenzae Rd
ccugcccugaagcaa

SEQ ID NO: 704183 - RNA, 21 nt, Haemophilus influenzae Rd
ccugcccuugauauucaauua

SEQ ID NO: 704184 - RNA, 20 nt, Haemophilus influenzae Rd
ccugcccauaagugagaaaa

SEQ ID NO: 704185 - RNA, 23 nt, Haemophilus influenzae Rd
ccugcgggucuuguuccaacaga

SEQ ID NO: 704186 - RNA, 18 nt, Haemophilus influenzae Rd
ccugcuggguuugcacuu

SEQ ID NO: 704187 - RNA, 19 nt, Haemophilus influenzae Rd
ccugggcggaagcuaggua

SEQ ID NO: 704188 - RNA, 23 nt, Haemophilus influenzae Rd
ccuggucgggcugaguacacaaa

SEQ ID NO: 704189 - RNA, 18 nt, Haemophilus influenzae Rd
ccuuauucgcugcaaaau

SEQ ID NO: 704190 - RNA, 17 nt, Haemophilus influenzae Rd
ccuuaccgcauuuuuaa

SEQ ID NO: 704191 - RNA, 16 nt, Haemophilus influenzae Rd
ccuguacguuaucuga

SEQ ID NO: 704192 - RNA, 21 nt, Haemophilus influenzae Rd
ccuuaauggggcaauuuuuug

SEQ ID NO: 704193 - RNA, 12 nt, Haemophilus influenzae Rd
ccuuaauuauuu

SEQ ID NO: 704194 - RNA, 13 nt, Haemophilus influenzae Rd
ccuuaauucuaag

SEQ ID NO: 704195 - RNA, 19 nt, Haemophilus influenzae Rd
ccuuaauacugcugaauaa

SEQ ID NO: 704196 - RNA, 20 nt, Haemophilus influenzae Rd
ccuuauuuuaaauaaaaaau

SEQ ID NO: 704197 - RNA, 23 nt, Haemophilus influenzae Rd
ccuuauuuuuuggaauauuaucu

SEQ ID NO: 704198 - RNA, 15 nt, Haemophilus influenzae Rd
ccuucaacauuuuuu

SEQ ID NO: 704199 - RNA, 12 nt, Haemophilus influenzae Rd
ccuucaaucgca

SEQ ID NO: 704200 - RNA, 17 nt, Haemophilus influenzae Rd
ccuucaauauagguuaa

SEQ ID NO: 704201 - RNA, 19 nt, Haemophilus influenzae Rd
ccuucacagauuucaauua

SEQ ID NO: 704202 - RNA, 17 nt, Haemophilus influenzae Rd
ccuucaaugggcaucca

SEQ ID NO: 704203 - RNA, 16 nt, Haemophilus influenzae Rd
ccuucaccuaauccua

SEQ ID NO: 704204 - RNA, 12 nt, Haemophilus influenzae Rd
ccuucacgaccc

SEQ ID NO: 704205 - RNA, 23 nt, Haemophilus influenzae Rd
ccuucgaccaacggauuaaaagu

SEQ ID NO: 704206 - RNA, 12 nt, Haemophilus influenzae Rd
ccuucagccacu

SEQ ID NO: 704207 - RNA, 13 nt, Haemophilus influenzae Rd
ccuucagccacua

SEQ ID NO: 704208 - RNA, 22 nt, Haemophilus influenzae Rd
ccuucagccugcucacgaguua

SEQ ID NO: 704209 - RNA, 19 nt, Haemophilus influenzae Rd
ccuucagggcggagauaua

SEQ ID NO: 704210 - RNA, 18 nt, Haemophilus influenzae Rd
ccuucgccuucggcuccc

SEQ ID NO: 704211 - RNA, 22 nt, Haemophilus influenzae Rd
ccuucggcauauaagauuuuug

SEQ ID NO: 704212 - RNA, 14 nt, Haemophilus influenzae Rd
ccuucuguuuucaa

SEQ ID NO: 704213 - RNA, 19 nt, Haemophilus influenzae Rd
ccuugagaaauaauauaac

SEQ ID NO: 704214 - RNA, 21 nt, Haemophilus influenzae Rd
ccuugacauacuuuguugaau

SEQ ID NO: 704215 - RNA, 15 nt, Haemophilus influenzae Rd
ccuugacauauucug

SEQ ID NO: 704216 - RNA, 14 nt, Haemophilus influenzae Rd
ccuuguuacaccuu

SEQ ID NO: 704217 - RNA, 20 nt, Haemophilus influenzae Rd
ccuugugcuuugugcggaau

SEQ ID NO: 704218 - RNA, 21 nt, Haemophilus influenzae Rd
ccuuguuccaggaaaauuuua

SEQ ID NO: 704219 - RNA, 21 nt, Haemophilus influenzae Rd
ccuuguuuccaaguauuuucu

SEQ ID NO: 704220 - RNA, 17 nt, Haemophilus influenzae Rd
ccuugguuuucuugcca

SEQ ID NO: 704221 - RNA, 21 nt, Haemophilus influenzae Rd
ccuuguaaacuuuccucaagu

SEQ ID NO: 704222 - RNA, 21 nt, Haemophilus influenzae Rd
ccuuguaaccaagcuguacca

SEQ ID NO: 704223 - RNA, 19 nt, Haemophilus influenzae Rd
ccuuuaaggugcagauuaa

SEQ ID NO: 704224 - RNA, 16 nt, Haemophilus influenzae Rd
ccuuguuuugcaauaa

SEQ ID NO: 704225 - RNA, 17 nt, Haemophilus influenzae Rd
ccuuuacauuuggcaaa

SEQ ID NO: 704226 - RNA, 19 nt, Haemophilus influenzae Rd
ccuuuacauuuggcaaaau

SEQ ID NO: 704227 - RNA, 22 nt, Haemophilus influenzae Rd
ccuuuacauuuggcaaaauaau

SEQ ID NO: 704228 - RNA, 23 nt, Haemophilus influenzae Rd
ccuuuaaucugucacgagcuaaa

SEQ ID NO: 704229 - RNA, 24 nt, Haemophilus influenzae Rd
ccuuuauugauccuagauguaacu

SEQ ID NO: 704230 - RNA, 15 nt, Haemophilus influenzae Rd
ccuuuauuuugcaac

SEQ ID NO: 704231 - RNA, 16 nt, Haemophilus influenzae Rd
ccuuucacacugcccu

SEQ ID NO: 704232 - RNA, 23 nt, Haemophilus influenzae Rd
ccuuuacuuuuuaauaaaucaag

SEQ ID NO: 704233 - RNA, 17 nt, Haemophilus influenzae Rd
ccuuuaugacuauuuuu

SEQ ID NO: 704234 - RNA, 18 nt, Haemophilus influenzae Rd
ccuuuaugacuauuuuuu

SEQ ID NO: 704235 - RNA, 23 nt, Haemophilus influenzae Rd
ccuuuacuuauucguucuuuugg

SEQ ID NO: 704236 - RNA, 20 nt, Haemophilus influenzae Rd
ccuuuugcauuauugaacca

SEQ ID NO: 704237 - RNA, 20 nt, Haemophilus influenzae Rd
ccuuuguagccauuuucaga

SEQ ID NO: 704238 - RNA, 17 nt, Haemophilus influenzae Rd
ccuuuguagcgacguuc

SEQ ID NO: 704239 - RNA, 18 nt, Haemophilus influenzae Rd
ccuuugcugacaauuucu

SEQ ID NO: 704240 - RNA, 14 nt, Haemophilus influenzae Rd
ccuuucaauaauuu

SEQ ID NO: 704241 - RNA, 15 nt, Haemophilus influenzae Rd
ccuuuccauugggaa

SEQ ID NO: 704242 - RNA, 18 nt, Haemophilus influenzae Rd
cgaccauuacagcaagca

SEQ ID NO: 704243 - RNA, 16 nt, Haemophilus influenzae Rd
cgaccaauauugaaaa

SEQ ID NO: 704244 - RNA, 16 nt, Haemophilus influenzae Rd
cgacaucugguuuugu

SEQ ID NO: 704245 - RNA, 18 nt, Haemophilus influenzae Rd
cgacauucgcauauuuuu

SEQ ID NO: 704246 - RNA, 20 nt, Haemophilus influenzae Rd
cgaccauuggggcgaccauu

SEQ ID NO: 704247 - RNA, 18 nt, Haemophilus influenzae Rd
cgacgcaagguauuuuuu

SEQ ID NO: 704248 - RNA, 18 nt, Haemophilus influenzae Rd
cgaccucgccauuuuuca

SEQ ID NO: 704249 - RNA, 11 nt, Haemophilus influenzae Rd
cgaccugaaga

SEQ ID NO: 704250 - RNA, 18 nt, Haemophilus influenzae Rd
cgacgcugcaaaaugaac

SEQ ID NO: 704251 - RNA, 19 nt, Haemophilus influenzae Rd
cgaacguuucaucacuuca

SEQ ID NO: 704252 - RNA, 17 nt, Haemophilus influenzae Rd
cgaacgugggaauuuuc

SEQ ID NO: 704253 - RNA, 18 nt, Haemophilus influenzae Rd
cgaaccuuucauauaaau

SEQ ID NO: 704254 - RNA, 22 nt, Haemophilus influenzae Rd
ccuuuuguuuuaucagaaugau

SEQ ID NO: 704255 - RNA, 22 nt, Haemophilus influenzae Rd
ccuuuuucauauucccaaggcu

SEQ ID NO: 704256 - RNA, 15 nt, Haemophilus influenzae Rd
ccuuuuuaucuauuu

SEQ ID NO: 704257 - RNA, 14 nt, Haemophilus influenzae Rd
cgaagaauccacau

SEQ ID NO: 704258 - RNA, 13 nt, Haemophilus influenzae Rd
cgaaucaaaaucu

SEQ ID NO: 704259 - RNA, 21 nt, Haemophilus influenzae Rd
cgaauaaaugcaucauuaaua

SEQ ID NO: 704260 - RNA, 19 nt, Haemophilus influenzae Rd
cgaauuaaagugcagauuu

SEQ ID NO: 704261 - RNA, 23 nt, Haemophilus influenzae Rd
cgaaugguaacauucauauuggu

SEQ ID NO: 704262 - RNA, 16 nt, Haemophilus influenzae Rd
cgaauguggcagcaaa

SEQ ID NO: 704263 - RNA, 24 nt, Haemophilus influenzae Rd
cgacacuaaaaagcccaaaugcaa

SEQ ID NO: 704264 - RNA, 11 nt, Haemophilus influenzae Rd
cgaauuuuuau

SEQ ID NO: 704265 - RNA, 20 nt, Haemophilus influenzae Rd
cgaauuugugagguuuugag

SEQ ID NO: 704266 - RNA, 20 nt, Haemophilus influenzae Rd
cgaauugcaucguuuacauc

SEQ ID NO: 704267 - RNA, 19 nt, Haemophilus influenzae Rd
cgaauugcgguuucaguuu

SEQ ID NO: 704268 - RNA, 17 nt, Haemophilus influenzae Rd
cgaauugguucuaaaua

SEQ ID NO: 704269 - RNA, 21 nt, Haemophilus influenzae Rd
cgacacacuauuaauuacuuu

SEQ ID NO: 704270 - RNA, 23 nt, Haemophilus influenzae Rd
cgacaaguuugauccacaaauaa

SEQ ID NO: 704271 - RNA, 14 nt, Haemophilus influenzae Rd
cauacuuagauaaa

SEQ ID NO: 704272 - RNA, 21 nt, Haemophilus influenzae Rd
cauacuuagauaaauucggau

SEQ ID NO: 704273 - RNA, 12 nt, Haemophilus influenzae Rd
cauacuuuaacu

SEQ ID NO: 704274 - RNA, 17 nt, Haemophilus influenzae Rd
cauagaaggcuaguucu

SEQ ID NO: 704275 - RNA, 23 nt, Haemophilus influenzae Rd
cauagaaggcuaguucuuccuug

SEQ ID NO: 704276 - RNA, 18 nt, Haemophilus influenzae Rd
cauagaaccgucuuuaaa

SEQ ID NO: 704277 - RNA, 19 nt, Haemophilus influenzae Rd
cauagaaccgucuuuaaau

SEQ ID NO: 704278 - RNA, 13 nt, Haemophilus influenzae Rd
cauagaaaagccc

SEQ ID NO: 704279 - RNA, 12 nt, Haemophilus influenzae Rd
cauagaaaucac

SEQ ID NO: 704280 - RNA, 20 nt, Haemophilus influenzae Rd
cauagaaaucacuaaauuuc

SEQ ID NO: 704281 - RNA, 21 nt, Haemophilus influenzae Rd
cauagaaaucacuaaauuuca

SEQ ID NO: 704282 - RNA, 16 nt, Haemophilus influenzae Rd
cauagaaaguuuaacu

SEQ ID NO: 704283 - RNA, 16 nt, Haemophilus influenzae Rd
cauagaauaacgccau

SEQ ID NO: 704284 - RNA, 19 nt, Haemophilus influenzae Rd
cauagaaugcaacaaguac

SEQ ID NO: 704285 - RNA, 16 nt, Haemophilus influenzae Rd
cauagagacuuguaaa

SEQ ID NO: 704286 - RNA, 15 nt, Haemophilus influenzae Rd
cauagaggaaccaug

SEQ ID NO: 704287 - RNA, 17 nt, Haemophilus influenzae Rd
cauagauaacuucuuca

SEQ ID NO: 704288 - RNA, 23 nt, Haemophilus influenzae Rd
cauagcaaaaaaccuuggaauau

SEQ ID NO: 704289 - RNA, 14 nt, Haemophilus influenzae Rd
cauauaaauaagaa

SEQ ID NO: 704290 - RNA, 15 nt, Haemophilus influenzae Rd
cauauaaauaagaau

SEQ ID NO: 704291 - RNA, 17 nt, Haemophilus influenzae Rd
cauauaaaucucccgcu

SEQ ID NO: 704292 - RNA, 17 nt, Haemophilus influenzae Rd
cauauagugaaaaaaua

SEQ ID NO: 704293 - RNA, 14 nt, Haemophilus influenzae Rd
cauauaaauuugau

SEQ ID NO: 704294 - RNA, 16 nt, Haemophilus influenzae Rd
cauauaagauuuuugc

SEQ ID NO: 704295 - RNA, 21 nt, Haemophilus influenzae Rd
cauauaagcaaagaaauuuaa

SEQ ID NO: 704296 - RNA, 14 nt, Haemophilus influenzae Rd
cauaggcuucuugu

SEQ ID NO: 704297 - RNA, 22 nt, Haemophilus influenzae Rd
cauagcuaaacauccgaauaaa

SEQ ID NO: 704298 - RNA, 13 nt, Haemophilus influenzae Rd
cauagcuauuagc

SEQ ID NO: 704299 - RNA, 18 nt, Haemophilus influenzae Rd
cauagcugaaaaauaaaa

SEQ ID NO: 704300 - RNA, 22 nt, Haemophilus influenzae Rd
cauagcuugaauugcuccuccu

SEQ ID NO: 704301 - RNA, 21 nt, Haemophilus influenzae Rd
cauaggacaggcuaucaucau

SEQ ID NO: 704302 - RNA, 21 nt, Haemophilus influenzae Rd
cauagcuucuaauuuuugcaa

SEQ ID NO: 704303 - RNA, 23 nt, Haemophilus influenzae Rd
cauagcuucuaauuuuugcaaug

SEQ ID NO: 704304 - RNA, 16 nt, Haemophilus influenzae Rd
cauagccguucuuauc

SEQ ID NO: 704305 - RNA, 21 nt, Haemophilus influenzae Rd
cauauuuuaggauacaaauaa

SEQ ID NO: 704306 - RNA, 16 nt, Haemophilus influenzae Rd
cauauugaugauuaac

SEQ ID NO: 704307 - RNA, 15 nt, Haemophilus influenzae Rd
cauauugauuuacau

SEQ ID NO: 704308 - RNA, 21 nt, Haemophilus influenzae Rd
cauauuuucccaguaaauauc

SEQ ID NO: 704309 - RNA, 23 nt, Haemophilus influenzae Rd
caucaaagcucaccugcccugaa

SEQ ID NO: 704310 - RNA, 20 nt, Haemophilus influenzae Rd
caucaaauccuuguuuuuca

SEQ ID NO: 704311 - RNA, 14 nt, Haemophilus influenzae Rd
caucaaauugauua

SEQ ID NO: 704312 - RNA, 15 nt, Haemophilus influenzae Rd
caucaacaaauguca

SEQ ID NO: 704313 - RNA, 19 nt, Haemophilus influenzae Rd
cauaucggcaaucaauuca

SEQ ID NO: 704314 - RNA, 17 nt, Haemophilus influenzae Rd
cauauucccaaggcucc

SEQ ID NO: 704315 - RNA, 19 nt, Haemophilus influenzae Rd
cauauucuaccgcauuuuu

SEQ ID NO: 704316 - RNA, 14 nt, Haemophilus influenzae Rd
cauaucgagcagac

SEQ ID NO: 704317 - RNA, 18 nt, Haemophilus influenzae Rd
cauaucgagcagacaaaa

SEQ ID NO: 704318 - RNA, 22 nt, Haemophilus influenzae Rd
cauaucgagcagacaaaauugg

SEQ ID NO: 704319 - RNA, 22 nt, Haemophilus influenzae Rd
cauaucgauaauuuaacugaau

SEQ ID NO: 704320 - RNA, 15 nt, Haemophilus influenzae Rd
cauauccucaacauc

SEQ ID NO: 704321 - RNA, 16 nt, Haemophilus influenzae Rd
caucagcaaucauuug

SEQ ID NO: 704322 - RNA, 15 nt, Haemophilus influenzae Rd
caucagaaaaucaaa

SEQ ID NO: 704323 - RNA, 13 nt, Haemophilus influenzae Rd
caucacuucuugu

SEQ ID NO: 704324 - RNA, 13 nt, Haemophilus influenzae Rd
caucacuucaaaa

SEQ ID NO: 704325 - RNA, 15 nt, Haemophilus influenzae Rd
caucacuucaaaaaa

SEQ ID NO: 704326 - RNA, 16 nt, Haemophilus influenzae Rd
caucacuucaaaaaac

SEQ ID NO: 704327 - RNA, 17 nt, Haemophilus influenzae Rd
caucacuucaaaaaacu

SEQ ID NO: 704328 - RNA, 16 nt, Haemophilus influenzae Rd
caucacauuuucaaau

SEQ ID NO: 704329 - RNA, 19 nt, Haemophilus influenzae Rd
caucacauuuucaaauugu

SEQ ID NO: 704330 - RNA, 16 nt, Haemophilus influenzae Rd
caucacauccacaaaa

SEQ ID NO: 704331 - RNA, 12 nt, Haemophilus influenzae Rd
caucaauaauac

SEQ ID NO: 704332 - RNA, 16 nt, Haemophilus influenzae Rd
cauccacaaaauuccg

SEQ ID NO: 704333 - RNA, 15 nt, Haemophilus influenzae Rd
cauccacuuuuucug

SEQ ID NO: 704334 - RNA, 20 nt, Haemophilus influenzae Rd
cauccagaaaauugcaccuu

SEQ ID NO: 704335 - RNA, 21 nt, Haemophilus influenzae Rd
cauccagaaaauugcaccuuc

SEQ ID NO: 704336 - RNA, 17 nt, Haemophilus influenzae Rd
cauccacuucauccauu

SEQ ID NO: 704337 - RNA, 15 nt, Haemophilus influenzae Rd
cauccacuaaaccau

SEQ ID NO: 704338 - RNA, 13 nt, Haemophilus influenzae Rd
cauccacuaauuc

SEQ ID NO: 704339 - RNA, 15 nt, Haemophilus influenzae Rd
caucauuaaacgauc

SEQ ID NO: 704340 - RNA, 17 nt, Haemophilus influenzae Rd
caucauuucucgggcug

SEQ ID NO: 704341 - RNA, 14 nt, Haemophilus influenzae Rd
caucauuugcucua

SEQ ID NO: 704342 - RNA, 16 nt, Haemophilus influenzae Rd
caucauuuuuuaccgc

SEQ ID NO: 704343 - RNA, 18 nt, Haemophilus influenzae Rd
cauccaaaacuaauaaaa

SEQ ID NO: 704344 - RNA, 21 nt, Haemophilus influenzae Rd
cauccaagcaaagaaauuuua

SEQ ID NO: 704345 - RNA, 14 nt, Haemophilus influenzae Rd
caucccaauuauug

SEQ ID NO: 704346 - RNA, 16 nt, Haemophilus influenzae Rd
cauccaugacagaauu

SEQ ID NO: 704347 - RNA, 22 nt, Haemophilus influenzae Rd
cauccauuccugcaagaaaaau

SEQ ID NO: 704348 - RNA, 13 nt, Haemophilus influenzae Rd
cauccaucaaauc

SEQ ID NO: 704349 - RNA, 17 nt, Haemophilus influenzae Rd
cauccauucucaaauga

SEQ ID NO: 704350 - RNA, 17 nt, Haemophilus influenzae Rd
caucgcaucuaaacccc

SEQ ID NO: 704351 - RNA, 21 nt, Haemophilus influenzae Rd
caucgagcuuucaugauuaac

SEQ ID NO: 704352 - RNA, 15 nt, Haemophilus influenzae Rd
caucgucuuuaccug

SEQ ID NO: 704353 - RNA, 22 nt, Haemophilus influenzae Rd
caucgcuggauaaaugccgcca

SEQ ID NO: 704354 - RNA, 14 nt, Haemophilus influenzae Rd
caugagguuugcca

SEQ ID NO: 704355 - RNA, 16 nt, Haemophilus influenzae Rd
caugaguuguuuuuuc

SEQ ID NO: 704356 - RNA, 15 nt, Haemophilus influenzae Rd
caugagcuuugcuuu

SEQ ID NO: 704357 - RNA, 20 nt, Haemophilus influenzae Rd
caugaauuucuaauuuuugu

SEQ ID NO: 704358 - RNA, 15 nt, Haemophilus influenzae Rd
caugaauauugguuu

SEQ ID NO: 704359 - RNA, 14 nt, Haemophilus influenzae Rd
caugaauaaaaaug

SEQ ID NO: 704360 - RNA, 14 nt, Haemophilus influenzae Rd
caucuuuuaaauaa

SEQ ID NO: 704361 - RNA, 15 nt, Haemophilus influenzae Rd
caucuuuuaaauaac

SEQ ID NO: 704362 - RNA, 19 nt, Haemophilus influenzae Rd
caucuuuggcuaugucaau

SEQ ID NO: 704363 - RNA, 22 nt, Haemophilus influenzae Rd
caucuuuuucuguaauauauga

SEQ ID NO: 704364 - RNA, 14 nt, Haemophilus influenzae Rd
caucuuuuuauaaa

SEQ ID NO: 704365 - RNA, 15 nt, Haemophilus influenzae Rd
caucuuuauaacaua

SEQ ID NO: 704366 - RNA, 15 nt, Haemophilus influenzae Rd
caucuuuaaaguguu

SEQ ID NO: 704367 - RNA, 14 nt, Haemophilus influenzae Rd
caucuuguuuaucg

SEQ ID NO: 704368 - RNA, 18 nt, Haemophilus influenzae Rd
caucuuuaagaguaaauu

SEQ ID NO: 704369 - RNA, 17 nt, Haemophilus influenzae Rd
caucuucuuuugcccau

SEQ ID NO: 704370 - RNA, 13 nt, Haemophilus influenzae Rd
caucuucuggguu

SEQ ID NO: 704371 - RNA, 16 nt, Haemophilus influenzae Rd
caucgugaugauuuuc

SEQ ID NO: 704372 - RNA, 16 nt, Haemophilus influenzae Rd
caucguguacuuuucg

SEQ ID NO: 704373 - RNA, 15 nt, Haemophilus influenzae Rd
caugcauuaaaaaac

SEQ ID NO: 704374 - RNA, 15 nt, Haemophilus influenzae Rd
caugcacaacaugcc

SEQ ID NO: 704375 - RNA, 18 nt, Haemophilus influenzae Rd
caugauguaauucugcuu

SEQ ID NO: 704376 - RNA, 14 nt, Haemophilus influenzae Rd
caugauccacauag

SEQ ID NO: 704377 - RNA, 22 nt, Haemophilus influenzae Rd
caugauccacauagcaaaaaac

SEQ ID NO: 704378 - RNA, 20 nt, Haemophilus influenzae Rd
caugccgcaaucaagcaaau

SEQ ID NO: 704379 - RNA, 14 nt, Haemophilus influenzae Rd
caugccauuuccua

SEQ ID NO: 704380 - RNA, 18 nt, Haemophilus influenzae Rd
caugguuuguuccaauuc

SEQ ID NO: 704381 - RNA, 19 nt, Haemophilus influenzae Rd
cauguaaauaguuauuuau

SEQ ID NO: 704382 - RNA, 18 nt, Haemophilus influenzae Rd
caugggauaaacauuucu

SEQ ID NO: 704383 - RNA, 15 nt, Haemophilus influenzae Rd
cauguugauguaaaa

SEQ ID NO: 704384 - RNA, 21 nt, Haemophilus influenzae Rd
cauuaaccaacauaaacauug

SEQ ID NO: 704385 - RNA, 22 nt, Haemophilus influenzae Rd
cauuaacagcacuaaauucuaa

SEQ ID NO: 704386 - RNA, 23 nt, Haemophilus influenzae Rd
cauuaacaaugcggagaaaagca

SEQ ID NO: 704387 - RNA, 15 nt, Haemophilus influenzae Rd
cauuaacuaaaccau

SEQ ID NO: 704388 - RNA, 20 nt, Haemophilus influenzae Rd
cauuaacuaaaccauuuaau

SEQ ID NO: 704389 - RNA, 18 nt, Haemophilus influenzae Rd
cauuaaucggcaauguuu

SEQ ID NO: 704390 - RNA, 22 nt, Haemophilus influenzae Rd
cauuaaucggcaauguuuuaag

SEQ ID NO: 704391 - RNA, 19 nt, Haemophilus influenzae Rd
cauuaaacuucuguaaaug

SEQ ID NO: 704392 - RNA, 21 nt, Haemophilus influenzae Rd
cauuaaacuucuguaaauggc

SEQ ID NO: 704393 - RNA, 16 nt, Haemophilus influenzae Rd
cauuaaagcaauugcu

SEQ ID NO: 704394 - RNA, 19 nt, Haemophilus influenzae Rd
cauuaaagcaauugcuaaa

SEQ ID NO: 704395 - RNA, 14 nt, Haemophilus influenzae Rd
cauuaaauaaaaau

SEQ ID NO: 704396 - RNA, 14 nt, Haemophilus influenzae Rd
cauuaaaaaauaau

SEQ ID NO: 704397 - RNA, 16 nt, Haemophilus influenzae Rd
cauuaaaaaauaauuc

SEQ ID NO: 704398 - RNA, 17 nt, Haemophilus influenzae Rd
cauuaaaacaaagggcu

SEQ ID NO: 704399 - RNA, 12 nt, Haemophilus influenzae Rd
cauuaaaagaag

SEQ ID NO: 704400 - RNA, 16 nt, Haemophilus influenzae Rd
cauucacuaacaaaua

SEQ ID NO: 704401 - RNA, 15 nt, Haemophilus influenzae Rd
cauucacaggguuca

SEQ ID NO: 704402 - RNA, 12 nt, Haemophilus influenzae Rd
cauucauuuugu

SEQ ID NO: 704403 - RNA, 13 nt, Haemophilus influenzae Rd
cauucauuuuguc

SEQ ID NO: 704404 - RNA, 23 nt, Haemophilus influenzae Rd
cauucauuuugucguaaugaaaa

SEQ ID NO: 704405 - RNA, 19 nt, Haemophilus influenzae Rd
cauuccacccauaccgccc

SEQ ID NO: 704406 - RNA, 18 nt, Haemophilus influenzae Rd
cauucacuuucacauaaa

SEQ ID NO: 704407 - RNA, 14 nt, Haemophilus influenzae Rd
cauuaugugcaauu

SEQ ID NO: 704408 - RNA, 15 nt, Haemophilus influenzae Rd
cauuauguaauauaa

SEQ ID NO: 704409 - RNA, 14 nt, Haemophilus influenzae Rd
cauuaugaaaaaaa

SEQ ID NO: 704410 - RNA, 18 nt, Haemophilus influenzae Rd
cauuaugaaaaaaacugu

SEQ ID NO: 704411 - RNA, 20 nt, Haemophilus influenzae Rd
cauuacaagcauuaaauacc

SEQ ID NO: 704412 - RNA, 13 nt, Haemophilus influenzae Rd
cauuacagcaagc

SEQ ID NO: 704413 - RNA, 20 nt, Haemophilus influenzae Rd
cauuauauuuaauacuuucu

SEQ ID NO: 704414 - RNA, 13 nt, Haemophilus influenzae Rd
cauuaucaaaugc

SEQ ID NO: 704415 - RNA, 19 nt, Haemophilus influenzae Rd
cauuaaugcauugauugcu

SEQ ID NO: 704416 - RNA, 22 nt, Haemophilus influenzae Rd
cauuaaugcauugauugcuaaa

SEQ ID NO: 704417 - RNA, 12 nt, Haemophilus influenzae Rd
cauucucuucug

SEQ ID NO: 704418 - RNA, 17 nt, Haemophilus influenzae Rd
cauucuccguaaaaauc

SEQ ID NO: 704419 - RNA, 18 nt, Haemophilus influenzae Rd
cauucucaauugcaaaau

SEQ ID NO: 704420 - RNA, 15 nt, Haemophilus influenzae Rd
cauucuauuuuaaaa

SEQ ID NO: 704421 - RNA, 17 nt, Haemophilus influenzae Rd
cauucuauuuuaaaaau

SEQ ID NO: 704422 - RNA, 18 nt, Haemophilus influenzae Rd
cauucuauuuuaaaaauu

SEQ ID NO: 704423 - RNA, 22 nt, Haemophilus influenzae Rd
cauucucaaaugaggaauacuc

SEQ ID NO: 704424 - RNA, 14 nt, Haemophilus influenzae Rd
cauucccaaauaau

SEQ ID NO: 704425 - RNA, 15 nt, Haemophilus influenzae Rd
cauucccaaauaaua

SEQ ID NO: 704426 - RNA, 23 nt, Haemophilus influenzae Rd
cauugaaaccugaguaaauaaac

SEQ ID NO: 704427 - RNA, 17 nt, Haemophilus influenzae Rd
cauugaaaccuuguaaa

SEQ ID NO: 704428 - RNA, 18 nt, Haemophilus influenzae Rd
cauugaaaccuuguaaau

SEQ ID NO: 704429 - RNA, 14 nt, Haemophilus influenzae Rd
cauucuuuuaaaua

SEQ ID NO: 704430 - RNA, 14 nt, Haemophilus influenzae Rd
cauucuuaaaucau

SEQ ID NO: 704431 - RNA, 23 nt, Haemophilus influenzae Rd
cauugaagcgggcgaugaaagcg

SEQ ID NO: 704432 - RNA, 16 nt, Haemophilus influenzae Rd
cauugaauuaaaaaug

SEQ ID NO: 704433 - RNA, 20 nt, Haemophilus influenzae Rd
cauuuuggauacguuuuguu

SEQ ID NO: 704434 - RNA, 20 nt, Haemophilus influenzae Rd
cauuuugcucaugauuauaa

SEQ ID NO: 704435 - RNA, 13 nt, Haemophilus influenzae Rd
cauuuugcccaau

SEQ ID NO: 704436 - RNA, 20 nt, Haemophilus influenzae Rd
cauuuugauugcuacagcaa

SEQ ID NO: 704437 - RNA, 15 nt, Haemophilus influenzae Rd
cauuuucuuccaaug

SEQ ID NO: 704438 - RNA, 16 nt, Haemophilus influenzae Rd
cauuuucuuccaaugu

SEQ ID NO: 704439 - RNA, 18 nt, Haemophilus influenzae Rd
cauuuugagauaaauuuu

SEQ ID NO: 704440 - RNA, 22 nt, Haemophilus influenzae Rd
cauuuugagauaaauuuuuagc

SEQ ID NO: 704441 - RNA, 18 nt, Haemophilus influenzae Rd
cauuuugaggaauaaauu

SEQ ID NO: 704442 - RNA, 19 nt, Haemophilus influenzae Rd
cauuuugaggaauaaauug

SEQ ID NO: 704443 - RNA, 21 nt, Haemophilus influenzae Rd
cauuuucgguuaaguaaucug

SEQ ID NO: 704444 - RNA, 19 nt, Haemophilus influenzae Rd
cauugaugacugcaucaau

SEQ ID NO: 704445 - RNA, 17 nt, Haemophilus influenzae Rd
cauugaguuuagucuuu

SEQ ID NO: 704446 - RNA, 20 nt, Haemophilus influenzae Rd
cauuuuucauacaaucucua

SEQ ID NO: 704447 - RNA, 13 nt, Haemophilus influenzae Rd
cauuuuucauuuu

SEQ ID NO: 704448 - RNA, 15 nt, Haemophilus influenzae Rd
cauuuuucauuuucg

SEQ ID NO: 704449 - RNA, 21 nt, Haemophilus influenzae Rd
cauuuuuauuaguaaaauaau

SEQ ID NO: 704450 - RNA, 16 nt, Haemophilus influenzae Rd
cauuuuucaaaauuuu

SEQ ID NO: 704451 - RNA, 21 nt, Haemophilus influenzae Rd
cauuuuuaaccgcacuuuuua

SEQ ID NO: 704452 - RNA, 14 nt, Haemophilus influenzae Rd
cauuuuuaaaaaua

SEQ ID NO: 704453 - RNA, 20 nt, Haemophilus influenzae Rd
cauuuuguaagcaacacaga

SEQ ID NO: 704454 - RNA, 18 nt, Haemophilus influenzae Rd
cauuuuguuucuaaauua

SEQ ID NO: 704455 - RNA, 11 nt, Haemophilus influenzae Rd
cauuuuuaaaa

SEQ ID NO: 704456 - RNA, 21 nt, Haemophilus influenzae Rd
cauuuuugcuggcguuuuuua

SEQ ID NO: 704457 - RNA, 22 nt, Haemophilus influenzae Rd
cauuuuuucuacgguuuuaaua

SEQ ID NO: 704458 - RNA, 13 nt, Haemophilus influenzae Rd
cauuuuuuuaaau

SEQ ID NO: 704459 - RNA, 15 nt, Haemophilus influenzae Rd
cauuuuuuuaaauau

SEQ ID NO: 704460 - RNA, 12 nt, Haemophilus influenzae Rd
cauuuuuuucua

SEQ ID NO: 704461 - RNA, 17 nt, Haemophilus influenzae Rd
cauuuuuuuugcauuua

SEQ ID NO: 704462 - RNA, 13 nt, Haemophilus influenzae Rd
ccaaaaccauuca

SEQ ID NO: 704463 - RNA, 17 nt, Haemophilus influenzae Rd
ccaaaacgaauagaaau

SEQ ID NO: 704464 - RNA, 13 nt, Haemophilus influenzae Rd
ccaaaauauuuuc

SEQ ID NO: 704465 - RNA, 23 nt, Haemophilus influenzae Rd
ccaaaaucucuaccacagucaaa

SEQ ID NO: 704466 - RNA, 17 nt, Haemophilus influenzae Rd
ccaaaaugcuugaauaa

SEQ ID NO: 704467 - RNA, 19 nt, Haemophilus influenzae Rd
ccaaaaugcuugaauaaau

SEQ ID NO: 704468 - RNA, 12 nt, Haemophilus influenzae Rd
ccaaaaaccaga

SEQ ID NO: 704469 - RNA, 11 nt, Haemophilus influenzae Rd
ccaaacauuuu

SEQ ID NO: 704470 - RNA, 19 nt, Haemophilus influenzae Rd
ccaaaccaucauaggcuuu

SEQ ID NO: 704471 - RNA, 16 nt, Haemophilus influenzae Rd
ccaaacauuaccaagc

SEQ ID NO: 704472 - RNA, 19 nt, Haemophilus influenzae Rd
ccaaacauuaccaagccca

SEQ ID NO: 704473 - RNA, 23 nt, Haemophilus influenzae Rd
ccaaacaaauugccgaagccauc

SEQ ID NO: 704474 - RNA, 13 nt, Haemophilus influenzae Rd
ccaaaauuaaauu

SEQ ID NO: 704475 - RNA, 23 nt, Haemophilus influenzae Rd
ccaaaauuaaauugaaaaaaucu

SEQ ID NO: 704476 - RNA, 16 nt, Haemophilus influenzae Rd
ccaaaauuuaaaaucg

SEQ ID NO: 704477 - RNA, 19 nt, Haemophilus influenzae Rd
ccaaaauuuaaagugguuu

SEQ ID NO: 704478 - RNA, 16 nt, Haemophilus influenzae Rd
ccaaacgguauuucaa

SEQ ID NO: 704479 - RNA, 18 nt, Haemophilus influenzae Rd
ccaaacuccccuuaacua

SEQ ID NO: 704480 - RNA, 19 nt, Haemophilus influenzae Rd
ccaaacuccccuuaacuaa

SEQ ID NO: 704481 - RNA, 19 nt, Haemophilus influenzae Rd
ccaaacugccaaacaaauu

SEQ ID NO: 704482 - RNA, 17 nt, Haemophilus influenzae Rd
ccaacuugaauaccuga

SEQ ID NO: 704483 - RNA, 23 nt, Haemophilus influenzae Rd
ccaacuaaggugcagauuuuuua

SEQ ID NO: 704484 - RNA, 19 nt, Haemophilus influenzae Rd
ccaacucauuacacaaaau

SEQ ID NO: 704485 - RNA, 14 nt, Haemophilus influenzae Rd
ccaagguugcucaa

SEQ ID NO: 704486 - RNA, 19 nt, Haemophilus influenzae Rd
ccaagguuuuuuagauuau

SEQ ID NO: 704487 - RNA, 13 nt, Haemophilus influenzae Rd
ccaacacauuauc

SEQ ID NO: 704488 - RNA, 13 nt, Haemophilus influenzae Rd
ccaaauuaaaaau

SEQ ID NO: 704489 - RNA, 14 nt, Haemophilus influenzae Rd
ccaaauucguuacc

SEQ ID NO: 704490 - RNA, 14 nt, Haemophilus influenzae Rd
ccaaauugauucau

SEQ ID NO: 704491 - RNA, 23 nt, Haemophilus influenzae Rd
ccaaauugauucauuugauggua

SEQ ID NO: 704492 - RNA, 16 nt, Haemophilus influenzae Rd
ccaaauucauuuuuua

SEQ ID NO: 704493 - RNA, 19 nt, Haemophilus influenzae Rd
ccaaauucauuuuuuauuu

SEQ ID NO: 704494 - RNA, 22 nt, Haemophilus influenzae Rd
ccaaauuggguucgcaaauaac

SEQ ID NO: 704495 - RNA, 14 nt, Haemophilus influenzae Rd
ccaaauuuaaaaaa

SEQ ID NO: 704496 - RNA, 12 nt, Haemophilus influenzae Rd
ccaacaauuuca

SEQ ID NO: 704497 - RNA, 19 nt, Haemophilus influenzae Rd
ccaacauuucacuaaauaa

SEQ ID NO: 704498 - RNA, 12 nt, Haemophilus influenzae Rd
ccaacagaaaau

SEQ ID NO: 704499 - RNA, 20 nt, Haemophilus influenzae Rd
ccaacagaaaauuugagccc

SEQ ID NO: 704500 - RNA, 15 nt, Haemophilus influenzae Rd
ccaacagagcgagau

SEQ ID NO: 704501 - RNA, 22 nt, Haemophilus influenzae Rd
ccaaagcauuuagagcaagcaa

SEQ ID NO: 704502 - RNA, 22 nt, Haemophilus influenzae Rd
ccaaagccaaugccaaaaccau

SEQ ID NO: 704503 - RNA, 20 nt, Haemophilus influenzae Rd
ccaaagaaucaucuucaucu

SEQ ID NO: 704504 - RNA, 21 nt, Haemophilus influenzae Rd
ccaaagcaauccaagggaaau

SEQ ID NO: 704505 - RNA, 22 nt, Haemophilus influenzae Rd
ccaaagaguuugaauaauugau

SEQ ID NO: 704506 - RNA, 14 nt, Haemophilus influenzae Rd
ccaaagaaagcgua

SEQ ID NO: 704507 - RNA, 22 nt, Haemophilus influenzae Rd
ccaaauaauacuugaccaaaau

SEQ ID NO: 704508 - RNA, 18 nt, Haemophilus influenzae Rd
ccaaauaaugaccauugg

SEQ ID NO: 704509 - RNA, 15 nt, Haemophilus influenzae Rd
ccaaauacauuuuug

SEQ ID NO: 704510 - RNA, 16 nt, Haemophilus influenzae Rd
ccaaauacauuuuuga

SEQ ID NO: 704511 - RNA, 16 nt, Haemophilus influenzae Rd
ccaaauaccacacccu

SEQ ID NO: 704512 - RNA, 13 nt, Haemophilus influenzae Rd
ccaaauacuucac

SEQ ID NO: 704513 - RNA, 20 nt, Haemophilus influenzae Rd
ccaaaugcacauaacaaaau

SEQ ID NO: 704514 - RNA, 15 nt, Haemophilus influenzae Rd
ccaaauauaaaauaa

SEQ ID NO: 704515 - RNA, 18 nt, Haemophilus influenzae Rd
ccaauucuaguucuuccc

SEQ ID NO: 704516 - RNA, 20 nt, Haemophilus influenzae Rd
ccaauucuaguucuuccccu

SEQ ID NO: 704517 - RNA, 16 nt, Haemophilus influenzae Rd
ccaauucucugcaucg

SEQ ID NO: 704518 - RNA, 16 nt, Haemophilus influenzae Rd
ccaauucuucagauuu

SEQ ID NO: 704519 - RNA, 13 nt, Haemophilus influenzae Rd
ccacaaaaacgag

SEQ ID NO: 704520 - RNA, 15 nt, Haemophilus influenzae Rd
ccacaaaaacgagcu

SEQ ID NO: 704521 - RNA, 20 nt, Haemophilus influenzae Rd
ccaauuagaugauuuuaaag

SEQ ID NO: 704522 - RNA, 21 nt, Haemophilus influenzae Rd
ccaauuagaugauuuuaaagu

SEQ ID NO: 704523 - RNA, 19 nt, Haemophilus influenzae Rd
ccaauuagcuucaagcugc

SEQ ID NO: 704524 - RNA, 12 nt, Haemophilus influenzae Rd
ccaauuauugga

SEQ ID NO: 704525 - RNA, 20 nt, Haemophilus influenzae Rd
ccaauucaaagauuuuaaaa

SEQ ID NO: 704526 - RNA, 23 nt, Haemophilus influenzae Rd
ccacaaagguaaaacuuucuagu

SEQ ID NO: 704527 - RNA, 15 nt, Haemophilus influenzae Rd
ccacaagauuacgug

SEQ ID NO: 704528 - RNA, 18 nt, Haemophilus influenzae Rd
ccacaagcuuguccauga

SEQ ID NO: 704529 - RNA, 15 nt, Haemophilus influenzae Rd
ccacaauacuuauca

SEQ ID NO: 704530 - RNA, 20 nt, Haemophilus influenzae Rd
ccacaacugaagcuucuuca

SEQ ID NO: 704531 - RNA, 18 nt, Haemophilus influenzae Rd
ccacaagcaacaauauua

SEQ ID NO: 704532 - RNA, 18 nt, Haemophilus influenzae Rd
ccaauaauuaaacuuuca

SEQ ID NO: 704533 - RNA, 22 nt, Haemophilus influenzae Rd
ccaauaaucuccccguccaaag

SEQ ID NO: 704534 - RNA, 18 nt, Haemophilus influenzae Rd
ccaauaauugaugcuaaa

SEQ ID NO: 704535 - RNA, 12 nt, Haemophilus influenzae Rd
ccaauaaaaugu

SEQ ID NO: 704536 - RNA, 20 nt, Haemophilus influenzae Rd
ccaauaaacccgaaauauaa

SEQ ID NO: 704537 - RNA, 14 nt, Haemophilus influenzae Rd
ccaaguaauacacc

SEQ ID NO: 704538 - RNA, 22 nt, Haemophilus influenzae Rd
ccaaguuuuuuaucuuuuucga

SEQ ID NO: 704539 - RNA, 23 nt, Haemophilus influenzae Rd
ccaaugaugacgacuagccgcag

SEQ ID NO: 704540 - RNA, 23 nt, Haemophilus influenzae Rd
ccaauuaccugaugaaaucauua

SEQ ID NO: 704541 - RNA, 21 nt, Haemophilus influenzae Rd
ccaauguuugguauaaauaau

SEQ ID NO: 704542 - RNA, 16 nt, Haemophilus influenzae Rd
ccacaugggcaucaua

SEQ ID NO: 704543 - RNA, 17 nt, Haemophilus influenzae Rd
ccacaugauaaaaaccg

SEQ ID NO: 704544 - RNA, 18 nt, Haemophilus influenzae Rd
ccacauuuggaaauguuu

SEQ ID NO: 704545 - RNA, 19 nt, Haemophilus influenzae Rd
ccacauuuuuuguaauucg

SEQ ID NO: 704546 - RNA, 11 nt, Haemophilus influenzae Rd
ccaccaaaaug

SEQ ID NO: 704547 - RNA, 20 nt, Haemophilus influenzae Rd
ccacauauagugaaaaaaua

SEQ ID NO: 704548 - RNA, 24 nt, Haemophilus influenzae Rd
ccacaucaaagcguuuuucuacau

SEQ ID NO: 704549 - RNA, 17 nt, Haemophilus influenzae Rd
ccacauaaccaaagggc

SEQ ID NO: 704550 - RNA, 15 nt, Haemophilus influenzae Rd
ccacauagcuugaau

SEQ ID NO: 704551 - RNA, 20 nt, Haemophilus influenzae Rd
ccacagguaaagaaccacaa

SEQ ID NO: 704552 - RNA, 18 nt, Haemophilus influenzae Rd
ccacagucaaauugugau

SEQ ID NO: 704553 - RNA, 17 nt, Haemophilus influenzae Rd
ccacacgguauaaucag

SEQ ID NO: 704554 - RNA, 18 nt, Haemophilus influenzae Rd
ccacacuucaucacuaaa

SEQ ID NO: 704555 - RNA, 16 nt, Haemophilus influenzae Rd
ccaccccagaauuaag

SEQ ID NO: 704556 - RNA, 20 nt, Haemophilus influenzae Rd
ccaccccauuucuugaccuu

SEQ ID NO: 704557 - RNA, 15 nt, Haemophilus influenzae Rd
ccaccaauuaauucu

SEQ ID NO: 704558 - RNA, 21 nt, Haemophilus influenzae Rd
ccaccuugaauugcauuuucu

SEQ ID NO: 704559 - RNA, 18 nt, Haemophilus influenzae Rd
ccaccuugauugagaugc

SEQ ID NO: 704560 - RNA, 19 nt, Haemophilus influenzae Rd
ccacuucuuccgcugucca

SEQ ID NO: 704561 - RNA, 19 nt, Haemophilus influenzae Rd
ccacuucuugcgugcgaau

SEQ ID NO: 704562 - RNA, 22 nt, Haemophilus influenzae Rd
ccacuucauuaaaaccaauuuu

SEQ ID NO: 704563 - RNA, 20 nt, Haemophilus influenzae Rd
ccacuucugaauccaaugca

SEQ ID NO: 704564 - RNA, 14 nt, Haemophilus influenzae Rd
ccacuuucaacugu

SEQ ID NO: 704565 - RNA, 14 nt, Haemophilus influenzae Rd
ccacuugugcauca

SEQ ID NO: 704566 - RNA, 20 nt, Haemophilus influenzae Rd
ccacuugugcaucaaagcgu

SEQ ID NO: 704567 - RNA, 21 nt, Haemophilus influenzae Rd
ccacuugggcuaaaagcuguu

SEQ ID NO: 704568 - RNA, 16 nt, Haemophilus influenzae Rd
ccacuuggugcaacca

SEQ ID NO: 704569 - RNA, 18 nt, Haemophilus influenzae Rd
ccacuucacaacuuuuua

SEQ ID NO: 704570 - RNA, 13 nt, Haemophilus influenzae Rd
ccacuucagcaga

SEQ ID NO: 704571 - RNA, 23 nt, Haemophilus influenzae Rd
ccacuuaacgaaccaucagcucc

SEQ ID NO: 704572 - RNA, 13 nt, Haemophilus influenzae Rd
ccacuguugugaa

SEQ ID NO: 704573 - RNA, 22 nt, Haemophilus influenzae Rd
ccacugugcauuaaaucaaauu

SEQ ID NO: 704574 - RNA, 20 nt, Haemophilus influenzae Rd
ccacuuccccaaguuugcac

SEQ ID NO: 704575 - RNA, 17 nt, Haemophilus influenzae Rd
ccagaauuaagaucuaa

SEQ ID NO: 704576 - RNA, 13 nt, Haemophilus influenzae Rd
ccagaaaugcuua

SEQ ID NO: 704577 - RNA, 19 nt, Haemophilus influenzae Rd
ccagaaaugcuuacaggaa

SEQ ID NO: 704578 - RNA, 15 nt, Haemophilus influenzae Rd
ccacuuuuucugcca

SEQ ID NO: 704579 - RNA, 13 nt, Haemophilus influenzae Rd
ccagaaaauugca

SEQ ID NO: 704580 - RNA, 17 nt, Haemophilus influenzae Rd
ccagaaaauugcaccuu

SEQ ID NO: 704581 - RNA, 18 nt, Haemophilus influenzae Rd
ccagaaaauugcaccuuc

SEQ ID NO: 704582 - RNA, 22 nt, Haemophilus influenzae Rd
ccagaaaauugcaccuucuuuu

SEQ ID NO: 704583 - RNA, 14 nt, Haemophilus influenzae Rd
ccagauaaaaacug

SEQ ID NO: 704584 - RNA, 19 nt, Haemophilus influenzae Rd
ccagauaagguauguacca

SEQ ID NO: 704585 - RNA, 17 nt, Haemophilus influenzae Rd
ccagagccaaauacaau

SEQ ID NO: 704586 - RNA, 16 nt, Haemophilus influenzae Rd
ccagcagaaaauaacg

SEQ ID NO: 704587 - RNA, 12 nt, Haemophilus influenzae Rd
ccagauuuuuag

SEQ ID NO: 704588 - RNA, 22 nt, Haemophilus influenzae Rd
ccagcagugacguuuauuuuua

SEQ ID NO: 704589 - RNA, 20 nt, Haemophilus influenzae Rd
cagcuccuacauuaaaagau

SEQ ID NO: 704590 - RNA, 19 nt, Haemophilus influenzae Rd
aaaauuuauuacaaacaaa

SEQ ID NO: 704591 - RNA, 22 nt, Haemophilus influenzae Rd
aaaauuuacucacaacaaagau

SEQ ID NO: 704592 - RNA, 12 nt, Haemophilus influenzae Rd
aaaauuuaagcc

SEQ ID NO: 704593 - RNA, 23 nt, Haemophilus influenzae Rd
aaaauuuauacgcauaauaaaaa

SEQ ID NO: 704594 - RNA, 13 nt, Haemophilus influenzae Rd
cagcuaaacauug

SEQ ID NO: 704595 - RNA, 16 nt, Haemophilus influenzae Rd
cagcuaaagaaagcaa

SEQ ID NO: 704596 - RNA, 16 nt, Haemophilus influenzae Rd
cagcuaauaacacauc

SEQ ID NO: 704597 - RNA, 14 nt, Haemophilus influenzae Rd
cagcuaaugcuuua

SEQ ID NO: 704598 - RNA, 18 nt, Haemophilus influenzae Rd
cagcuaauucagcuaaac

SEQ ID NO: 704599 - RNA, 18 nt, Haemophilus influenzae Rd
cagcuaagccaauaauuu

SEQ ID NO: 704600 - RNA, 15 nt, Haemophilus influenzae Rd
aaaauuggaaaauaa

SEQ ID NO: 704601 - RNA, 17 nt, Haemophilus influenzae Rd
aaaauuggaaaauaaaa

SEQ ID NO: 704602 - RNA, 23 nt, Haemophilus influenzae Rd
aaaauuggccgcacuuuugaucu

SEQ ID NO: 704603 - RNA, 13 nt, Haemophilus influenzae Rd
aaaauugcaccuu

SEQ ID NO: 704604 - RNA, 15 nt, Haemophilus influenzae Rd
aaaauugcaccuucu

SEQ ID NO: 704605 - RNA, 17 nt, Haemophilus influenzae Rd
aaaauugaucuaaauua

SEQ ID NO: 704606 - RNA, 20 nt, Haemophilus influenzae Rd
aaaauugaugaaaauucucu

SEQ ID NO: 704607 - RNA, 17 nt, Haemophilus influenzae Rd
cagcuacauucaucaaa

SEQ ID NO: 704608 - RNA, 17 nt, Haemophilus influenzae Rd
cagcuuccauccaccau

SEQ ID NO: 704609 - RNA, 13 nt, Haemophilus influenzae Rd
cagcuuuccugua

SEQ ID NO: 704610 - RNA, 23 nt, Haemophilus influenzae Rd
cagcuuuccuguacucgaauuau

SEQ ID NO: 704611 - RNA, 12 nt, Haemophilus influenzae Rd
caggaaaaauaa

SEQ ID NO: 704612 - RNA, 14 nt, Haemophilus influenzae Rd
caggaaaaauaaau

SEQ ID NO: 704613 - RNA, 14 nt, Haemophilus influenzae Rd
caggaaaaccacaa

SEQ ID NO: 704614 - RNA, 18 nt, Haemophilus influenzae Rd
cagcuucaaugacacgac

SEQ ID NO: 704615 - RNA, 12 nt, Haemophilus influenzae Rd
cagcuguugcaa

SEQ ID NO: 704616 - RNA, 13 nt, Haemophilus influenzae Rd
aaaauuucuucua

SEQ ID NO: 704617 - RNA, 16 nt, Haemophilus influenzae Rd
aaaauuuggaauaaac

SEQ ID NO: 704618 - RNA, 17 nt, Haemophilus influenzae Rd
aaaauuuggaauaaacu

SEQ ID NO: 704619 - RNA, 20 nt, Haemophilus influenzae Rd
aaaauuucuuuuguuuuaac

SEQ ID NO: 704620 - RNA, 19 nt, Haemophilus influenzae Rd
aaaauuuguaccauugugc

SEQ ID NO: 704621 - RNA, 12 nt, Haemophilus influenzae Rd
aaaauuuuaaac

SEQ ID NO: 704622 - RNA, 15 nt, Haemophilus influenzae Rd
aaaauuuuaaacagc

SEQ ID NO: 704623 - RNA, 14 nt, Haemophilus influenzae Rd
aaaauuuuaaauaa

SEQ ID NO: 704624 - RNA, 15 nt, Haemophilus influenzae Rd
aaaauuuuaaauaaa

SEQ ID NO: 704625 - RNA, 13 nt, Haemophilus influenzae Rd
caggaucaaaaau

SEQ ID NO: 704626 - RNA, 16 nt, Haemophilus influenzae Rd
caggaucaaaaauauc

SEQ ID NO: 704627 - RNA, 18 nt, Haemophilus influenzae Rd
aaaauuuugccaauuaca

SEQ ID NO: 704628 - RNA, 22 nt, Haemophilus influenzae Rd
aaaauuuuuaucuuuaaagaau

SEQ ID NO: 704629 - RNA, 16 nt, Haemophilus influenzae Rd
aaaauuuuucucacca

SEQ ID NO: 704630 - RNA, 16 nt, Haemophilus influenzae Rd
aaaauuuuugcaaaaa

SEQ ID NO: 704631 - RNA, 15 nt, Haemophilus influenzae Rd
cagggcugauaaauu

SEQ ID NO: 704632 - RNA, 13 nt, Haemophilus influenzae Rd
caggcuucaauuu

SEQ ID NO: 704633 - RNA, 17 nt, Haemophilus influenzae Rd
caggcuuauuaaaaacu

SEQ ID NO: 704634 - RNA, 19 nt, Haemophilus influenzae Rd
caggcuuauuaaaaacuaa

SEQ ID NO: 704635 - RNA, 18 nt, Haemophilus influenzae Rd
caggcuuaacuuucucuc

SEQ ID NO: 704636 - RNA, 15 nt, Haemophilus influenzae Rd
caggcugugcauaau

SEQ ID NO: 704637 - RNA, 20 nt, Haemophilus influenzae Rd
caggucgagggucaaaagaa

SEQ ID NO: 704638 - RNA, 14 nt, Haemophilus influenzae Rd
caggugcuauuuua

SEQ ID NO: 704639 - RNA, 18 nt, Haemophilus influenzae Rd
caggugcuauuuuauuua

SEQ ID NO: 704640 - RNA, 21 nt, Haemophilus influenzae Rd
caggugcuauuuuauuuagaa

SEQ ID NO: 704641 - RNA, 15 nt, Haemophilus influenzae Rd
caggugucacagcaa

SEQ ID NO: 704642 - RNA, 19 nt, Haemophilus influenzae Rd
caggugucucugcccauaa

SEQ ID NO: 704643 - RNA, 20 nt, Haemophilus influenzae Rd
cagguuuuucuuuuaauuuu

SEQ ID NO: 704644 - RNA, 18 nt, Haemophilus influenzae Rd
aaacaacgcguaagcggu

SEQ ID NO: 704645 - RNA, 16 nt, Haemophilus influenzae Rd
aaacaaauauauuucu

SEQ ID NO: 704646 - RNA, 18 nt, Haemophilus influenzae Rd
aaacaacaguagaaauca

SEQ ID NO: 704647 - RNA, 19 nt, Haemophilus influenzae Rd
aaacaacaguagaaaucac

SEQ ID NO: 704648 - RNA, 15 nt, Haemophilus influenzae Rd
aaacaacgaauaucc

SEQ ID NO: 704649 - RNA, 20 nt, Haemophilus influenzae Rd
aaacaacgaauauccgcauu

SEQ ID NO: 704650 - RNA, 21 nt, Haemophilus influenzae Rd
aaacaaagggcugauauuuaa

SEQ ID NO: 704651 - RNA, 12 nt, Haemophilus influenzae Rd
cagguugcugau

SEQ ID NO: 704652 - RNA, 18 nt, Haemophilus influenzae Rd
cagguugcugauaaagau

SEQ ID NO: 704653 - RNA, 21 nt, Haemophilus influenzae Rd
cagguuguuuuuguaaaauag

SEQ ID NO: 704654 - RNA, 20 nt, Haemophilus influenzae Rd
cagguucgccacuggugcug

SEQ ID NO: 704655 - RNA, 19 nt, Haemophilus influenzae Rd
caguaaaggcacuucaaua

SEQ ID NO: 704656 - RNA, 19 nt, Haemophilus influenzae Rd
caguaaacaaguauaaaaa

SEQ ID NO: 704657 - RNA, 21 nt, Haemophilus influenzae Rd
caguaaaacuugcaaaccaac

SEQ ID NO: 704658 - RNA, 14 nt, Haemophilus influenzae Rd
caguaagcauauuu

SEQ ID NO: 704659 - RNA, 15 nt, Haemophilus influenzae Rd
caguaagaucuucua

SEQ ID NO: 704660 - RNA, 17 nt, Haemophilus influenzae Rd
caguaacuucugcugca

SEQ ID NO: 704661 - RNA, 19 nt, Haemophilus influenzae Rd
caguacaauuaauuaaaua

SEQ ID NO: 704662 - RNA, 18 nt, Haemophilus influenzae Rd
caguaaugguuacuuuau

SEQ ID NO: 704663 - RNA, 15 nt, Haemophilus influenzae Rd
cagucuuuuaacaca

SEQ ID NO: 704664 - RNA, 17 nt, Haemophilus influenzae Rd
cagucuuuuaacacaua

SEQ ID NO: 704665 - RNA, 22 nt, Haemophilus influenzae Rd
cagucugcgccuaaaauauuuu

SEQ ID NO: 704666 - RNA, 14 nt, Haemophilus influenzae Rd
cagugacguuuauu

SEQ ID NO: 704667 - RNA, 16 nt, Haemophilus influenzae Rd
cagugacuaaaacaac

SEQ ID NO: 704668 - RNA, 13 nt, Haemophilus influenzae Rd
cagugaguucaua

SEQ ID NO: 704669 - RNA, 19 nt, Haemophilus influenzae Rd
cagucuaccauuugggaag

SEQ ID NO: 704670 - RNA, 18 nt, Haemophilus influenzae Rd
caguauuaagaacuucua

SEQ ID NO: 704671 - RNA, 21 nt, Haemophilus influenzae Rd
caguaugaugauuguuauugu

SEQ ID NO: 704672 - RNA, 12 nt, Haemophilus influenzae Rd
caguaucuggcu

SEQ ID NO: 704673 - RNA, 17 nt, Haemophilus influenzae Rd
caguauuuuauuuugua

SEQ ID NO: 704674 - RNA, 21 nt, Haemophilus influenzae Rd
caguauuuuuucgaucuaauc

SEQ ID NO: 704675 - RNA, 15 nt, Haemophilus influenzae Rd
cagucacuucuucaa

SEQ ID NO: 704676 - RNA, 18 nt, Haemophilus influenzae Rd
cagucacuucuucaauac

SEQ ID NO: 704677 - RNA, 12 nt, Haemophilus influenzae Rd
caguaccuuuaa

SEQ ID NO: 704678 - RNA, 16 nt, Haemophilus influenzae Rd
caguaccuauauacuu

SEQ ID NO: 704679 - RNA, 16 nt, Haemophilus influenzae Rd
caguagaaaaucagau

SEQ ID NO: 704680 - RNA, 19 nt, Haemophilus influenzae Rd
caguacucgaaaaggcaaa

SEQ ID NO: 704681 - RNA, 19 nt, Haemophilus influenzae Rd
caguauccgccaaugcuuu

SEQ ID NO: 704682 - RNA, 20 nt, Haemophilus influenzae Rd
caguaucacgcacaccaccu

SEQ ID NO: 704683 - RNA, 18 nt, Haemophilus influenzae Rd
cagcaugagcuucaaaau

SEQ ID NO: 704684 - RNA, 20 nt, Haemophilus influenzae Rd
cagcaucugccacuucuugc

SEQ ID NO: 704685 - RNA, 22 nt, Haemophilus influenzae Rd
cagcaucugccacuucuugcgu

SEQ ID NO: 704686 - RNA, 19 nt, Haemophilus influenzae Rd
cagcauauugaaauuggaa

SEQ ID NO: 704687 - RNA, 15 nt, Haemophilus influenzae Rd
cagcagaguuaauua

SEQ ID NO: 704688 - RNA, 11 nt, Haemophilus influenzae Rd
cagcagauaca

SEQ ID NO: 704689 - RNA, 21 nt, Haemophilus influenzae Rd
cagcagcuaauaggcuuaauu

SEQ ID NO: 704690 - RNA, 22 nt, Haemophilus influenzae Rd
cagcaguuuggcaagucuuaau

SEQ ID NO: 704691 - RNA, 14 nt, Haemophilus influenzae Rd
cagcauaaauaaau

SEQ ID NO: 704692 - RNA, 14 nt, Haemophilus influenzae Rd
cagcauaaagagaa

SEQ ID NO: 704693 - RNA, 23 nt, Haemophilus influenzae Rd
cagccugaauggcgaauuucacg

SEQ ID NO: 704694 - RNA, 23 nt, Haemophilus influenzae Rd
cagccugaaaaagcuaaaaaaac

SEQ ID NO: 704695 - RNA, 21 nt, Haemophilus influenzae Rd
cagccugcgagcaguuuucgu

SEQ ID NO: 704696 - RNA, 14 nt, Haemophilus influenzae Rd
cagcgaaguuaaac

SEQ ID NO: 704697 - RNA, 22 nt, Haemophilus influenzae Rd
cagcgaaguuaaacgcuccucu

SEQ ID NO: 704698 - RNA, 16 nt, Haemophilus influenzae Rd
cagcccuuuguuuuaa

SEQ ID NO: 704699 - RNA, 21 nt, Haemophilus influenzae Rd
cagcccuuuuaguuuccccug

SEQ ID NO: 704700 - RNA, 21 nt, Haemophilus influenzae Rd
cagcccuuuuuuaaugggauu

SEQ ID NO: 704701 - RNA, 23 nt, Haemophilus influenzae Rd
cagcccguuguguuucaacaaaa

SEQ ID NO: 704702 - RNA, 17 nt, Haemophilus influenzae Rd
cagccauggcuuuuucc

SEQ ID NO: 704703 - RNA, 19 nt, Haemophilus influenzae Rd
cagccauggcuuuuuccug

SEQ ID NO: 704704 - RNA, 21 nt, Haemophilus influenzae Rd
cagccauggcuuuuuccugau

SEQ ID NO: 704705 - RNA, 14 nt, Haemophilus influenzae Rd
cagccaucaauaaa

SEQ ID NO: 704706 - RNA, 19 nt, Haemophilus influenzae Rd
cagccaucaauaaaaagcu

SEQ ID NO: 704707 - RNA, 15 nt, Haemophilus influenzae Rd
cagccgcaacggcag

SEQ ID NO: 704708 - RNA, 12 nt, Haemophilus influenzae Rd
cagcgcaccaca

SEQ ID NO: 704709 - RNA, 16 nt, Haemophilus influenzae Rd
cacuuuuuugauaugc

SEQ ID NO: 704710 - RNA, 20 nt, Haemophilus influenzae Rd
cacuuuuuuguauaaaaauu

SEQ ID NO: 704711 - RNA, 17 nt, Haemophilus influenzae Rd
cacuuuuuuuauaucuu

SEQ ID NO: 704712 - RNA, 19 nt, Haemophilus influenzae Rd
cagaaacauagauaacuuc

SEQ ID NO: 704713 - RNA, 15 nt, Haemophilus influenzae Rd
cagaaacaaauccug

SEQ ID NO: 704714 - RNA, 17 nt, Haemophilus influenzae Rd
cagaaacagaaauaaca

SEQ ID NO: 704715 - RNA, 19 nt, Haemophilus influenzae Rd
cagaaauauaaucaauuuc

SEQ ID NO: 704716 - RNA, 20 nt, Haemophilus influenzae Rd
cagaaauauaaucaauuucu

SEQ ID NO: 704717 - RNA, 16 nt, Haemophilus influenzae Rd
cagaaauauguuuuac

SEQ ID NO: 704718 - RNA, 19 nt, Haemophilus influenzae Rd
cagaaauacuuuuagcucc

SEQ ID NO: 704719 - RNA, 20 nt, Haemophilus influenzae Rd
cagaaaugcuuacaggaaag

SEQ ID NO: 704720 - RNA, 21 nt, Haemophilus influenzae Rd
cacuuuauuagaaauauauuu

SEQ ID NO: 704721 - RNA, 17 nt, Haemophilus influenzae Rd
cacuuuuuauauuuuuu

SEQ ID NO: 704722 - RNA, 18 nt, Haemophilus influenzae Rd
cacuuuuuaucuaaaaaa

SEQ ID NO: 704723 - RNA, 11 nt, Haemophilus influenzae Rd
cacuuuuucua

SEQ ID NO: 704724 - RNA, 13 nt, Haemophilus influenzae Rd
cacuuuuugaaag

SEQ ID NO: 704725 - RNA, 16 nt, Haemophilus influenzae Rd
cacuuuuguuguuauu

SEQ ID NO: 704726 - RNA, 21 nt, Haemophilus influenzae Rd
cacuuucauuccauucuaaaa

SEQ ID NO: 704727 - RNA, 13 nt, Haemophilus influenzae Rd
cacuuucaacugu

SEQ ID NO: 704728 - RNA, 19 nt, Haemophilus influenzae Rd
cacuuucaacuguucuucu

SEQ ID NO: 704729 - RNA, 16 nt, Haemophilus influenzae Rd
cacuuuccguuuacua

SEQ ID NO: 704730 - RNA, 22 nt, Haemophilus influenzae Rd
cagaauuacguaauauucuuua

SEQ ID NO: 704731 - RNA, 12 nt, Haemophilus influenzae Rd
cagaauuacguu

SEQ ID NO: 704732 - RNA, 18 nt, Haemophilus influenzae Rd
cagaauuacguuguuguu

SEQ ID NO: 704733 - RNA, 17 nt, Haemophilus influenzae Rd
cagaagcccguugcuaa

SEQ ID NO: 704734 - RNA, 17 nt, Haemophilus influenzae Rd
cagaacaagcauuuuuc

SEQ ID NO: 704735 - RNA, 22 nt, Haemophilus influenzae Rd
cagaauuuauucccccauuaaa

SEQ ID NO: 704736 - RNA, 20 nt, Haemophilus influenzae Rd
cagaauuucaucuguuggaa

SEQ ID NO: 704737 - RNA, 19 nt, Haemophilus influenzae Rd
cagaauuucgucaaaaaug

SEQ ID NO: 704738 - RNA, 21 nt, Haemophilus influenzae Rd
cagaauuucgucaaaaauguc

SEQ ID NO: 704739 - RNA, 18 nt, Haemophilus influenzae Rd
cagagccaaauacaaucg

SEQ ID NO: 704740 - RNA, 12 nt, Haemophilus influenzae Rd
aaaaucaucaua

SEQ ID NO: 704741 - RNA, 19 nt, Haemophilus influenzae Rd
aaaaucauaguguuuuuaa

SEQ ID NO: 704742 - RNA, 18 nt, Haemophilus influenzae Rd
aaaaucagcuaauaacac

SEQ ID NO: 704743 - RNA, 23 nt, Haemophilus influenzae Rd
cagagcaagauuuaaacuuucga

SEQ ID NO: 704744 - RNA, 17 nt, Haemophilus influenzae Rd
cagagcaccaaauuaaa

SEQ ID NO: 704745 - RNA, 16 nt, Haemophilus influenzae Rd
aaaauccaaguuuguu

SEQ ID NO: 704746 - RNA, 12 nt, Haemophilus influenzae Rd
aaaauccacacu

SEQ ID NO: 704747 - RNA, 17 nt, Haemophilus influenzae Rd
aaaauccacacuuuaaa

SEQ ID NO: 704748 - RNA, 20 nt, Haemophilus influenzae Rd
aaaauccacacuuuaaaagu

SEQ ID NO: 704749 - RNA, 22 nt, Haemophilus influenzae Rd
aaaauccacacuuuaaaaguuu

SEQ ID NO: 704750 - RNA, 18 nt, Haemophilus influenzae Rd
aaaaucauuaaaaucugu

SEQ ID NO: 704751 - RNA, 18 nt, Haemophilus influenzae Rd
aaaaucauuaaauaacuc

SEQ ID NO: 704752 - RNA, 18 nt, Haemophilus influenzae Rd
cagacuagugaaauauuu

SEQ ID NO: 704753 - RNA, 21 nt, Haemophilus influenzae Rd
cagacuagugaaauauuuacu

SEQ ID NO: 704754 - RNA, 23 nt, Haemophilus influenzae Rd
cagacuagugaaauauuuacuuc

SEQ ID NO: 704755 - RNA, 15 nt, Haemophilus influenzae Rd
cagacuauuucugua

SEQ ID NO: 704756 - RNA, 22 nt, Haemophilus influenzae Rd
cagacuauuucuguauuuuuua

SEQ ID NO: 704757 - RNA, 13 nt, Haemophilus influenzae Rd
aaaauauuuucaa

SEQ ID NO: 704758 - RNA, 14 nt, Haemophilus influenzae Rd
aaaauauuuucccc

SEQ ID NO: 704759 - RNA, 20 nt, Haemophilus influenzae Rd
aaaauauuuuccccuuucca

SEQ ID NO: 704760 - RNA, 19 nt, Haemophilus influenzae Rd
aaaauauuuuaauaaagau

SEQ ID NO: 704761 - RNA, 20 nt, Haemophilus influenzae Rd
aaaauauuuacgacuaaaau

SEQ ID NO: 704762 - RNA, 14 nt, Haemophilus influenzae Rd
aaaaucaaagauau

SEQ ID NO: 704763 - RNA, 13 nt, Haemophilus influenzae Rd
cagagaagaaaua

SEQ ID NO: 704764 - RNA, 16 nt, Haemophilus influenzae Rd
cagcacuuaauacgac

SEQ ID NO: 704765 - RNA, 21 nt, Haemophilus influenzae Rd
cagcacuuucgcuuaaaaauc

SEQ ID NO: 704766 - RNA, 16 nt, Haemophilus influenzae Rd
aaaauggcaaacaaaa

SEQ ID NO: 704767 - RNA, 17 nt, Haemophilus influenzae Rd
aaaauggcaaacaaaau

SEQ ID NO: 704768 - RNA, 18 nt, Haemophilus influenzae Rd
aaaauggcaaacaaaaua

SEQ ID NO: 704769 - RNA, 16 nt, Haemophilus influenzae Rd
aaaaugcucuuuggga

SEQ ID NO: 704770 - RNA, 17 nt, Haemophilus influenzae Rd
aaaauggaauaaaaacg

SEQ ID NO: 704771 - RNA, 16 nt, Haemophilus influenzae Rd
aaaauggcccugaaag

SEQ ID NO: 704772 - RNA, 15 nt, Haemophilus influenzae Rd
cagcaaccuaaauug

SEQ ID NO: 704773 - RNA, 16 nt, Haemophilus influenzae Rd
cagcaaccuaaauugu

SEQ ID NO: 704774 - RNA, 19 nt, Haemophilus influenzae Rd
aaaaugcuuauaaaacaga

SEQ ID NO: 704775 - RNA, 19 nt, Haemophilus influenzae Rd
aaaaugcuugaauaaauga

SEQ ID NO: 704776 - RNA, 22 nt, Haemophilus influenzae Rd
aaaaugacagucgauuacaaaa

SEQ ID NO: 704777 - RNA, 24 nt, Haemophilus influenzae Rd
cagcaagggcuuuuucugcuggcu

SEQ ID NO: 704778 - RNA, 14 nt, Haemophilus influenzae Rd
cagcaauuaaaaag

SEQ ID NO: 704779 - RNA, 15 nt, Haemophilus influenzae Rd
cagauaaucaaaaau

SEQ ID NO: 704780 - RNA, 16 nt, Haemophilus influenzae Rd
cagaucgugauauuuc

SEQ ID NO: 704781 - RNA, 21 nt, Haemophilus influenzae Rd
cagaugaaaauccccucuuaa

SEQ ID NO: 704782 - RNA, 20 nt, Haemophilus influenzae Rd
cagaugcacgagcaggaaaa

SEQ ID NO: 704783 - RNA, 14 nt, Haemophilus influenzae Rd
aaaaucuccaacuu

SEQ ID NO: 704784 - RNA, 20 nt, Haemophilus influenzae Rd
aaaaucuccaacuucauguu

SEQ ID NO: 704785 - RNA, 20 nt, Haemophilus influenzae Rd
aaaaucugcacucuaauaag

SEQ ID NO: 704786 - RNA, 17 nt, Haemophilus influenzae Rd
aaaaucucuauugcuuu

SEQ ID NO: 704787 - RNA, 16 nt, Haemophilus influenzae Rd
aaaaucucuggagaaa

SEQ ID NO: 704788 - RNA, 19 nt, Haemophilus influenzae Rd
aaaaucucuggagaaaauu

SEQ ID NO: 704789 - RNA, 22 nt, Haemophilus influenzae Rd
aaaaucucuggagaaaauugcu

SEQ ID NO: 704790 - RNA, 15 nt, Haemophilus influenzae Rd
cagauuaauuauauu

SEQ ID NO: 704791 - RNA, 22 nt, Haemophilus influenzae Rd
cagauuaauuuuuuauaaaauu

SEQ ID NO: 704792 - RNA, 14 nt, Haemophilus influenzae Rd
cagauuucaauuaa

SEQ ID NO: 704793 - RNA, 20 nt, Haemophilus influenzae Rd
aaaaugaaagggaaauaaca

SEQ ID NO: 704794 - RNA, 12 nt, Haemophilus influenzae Rd
aaaaugaaauau

SEQ ID NO: 704795 - RNA, 21 nt, Haemophilus influenzae Rd
aaaaucuugaacgcaaauacc

SEQ ID NO: 704796 - RNA, 15 nt, Haemophilus influenzae Rd
aaaaucuuuuauucu

SEQ ID NO: 704797 - RNA, 18 nt, Haemophilus influenzae Rd
aaaaucuuuuauucugca

SEQ ID NO: 704798 - RNA, 13 nt, Haemophilus influenzae Rd
uuuuuuauuuuau

SEQ ID NO: 704799 - RNA, 13 nt, Haemophilus influenzae Rd
uuuuuuauuuuuu

SEQ ID NO: 704800 - RNA, 18 nt, Haemophilus influenzae Rd
uuuuuuugcucaaaauca

SEQ ID NO: 704801 - RNA, 13 nt, Haemophilus influenzae Rd
uuuuuuauuuguu

SEQ ID NO: 704802 - RNA, 12 nt, Haemophilus influenzae Rd
uuuuuuauuucu

SEQ ID NO: 704803 - RNA, 11 nt, Haemophilus influenzae Rd
uuuuuuuguuu

SEQ ID NO: 704804 - RNA, 13 nt, Haemophilus influenzae Rd
uuuuuuaucuaau

SEQ ID NO: 704805 - RNA, 15 nt, Haemophilus influenzae Rd
uuuuuuagaauuaaa

SEQ ID NO: 704806 - RNA, 16 nt, Haemophilus influenzae Rd
uuuuuuauaaaauuuc

SEQ ID NO: 704807 - RNA, 16 nt, Haemophilus influenzae Rd
uuuuuuaucaaaaauc

SEQ ID NO: 704808 - RNA, 17 nt, Haemophilus influenzae Rd
uuuuuuauuacauuaaa

SEQ ID NO: 704809 - RNA, 20 nt, Haemophilus influenzae Rd
uuuuuuauuaucuaaaucuc

SEQ ID NO: 704810 - RNA, 19 nt, Haemophilus influenzae Rd
uuuuuuacucaaagaaaua

SEQ ID NO: 704811 - RNA, 11 nt, Haemophilus influenzae Rd
uuuuuuaauuc

SEQ ID NO: 704812 - RNA, 17 nt, Haemophilus influenzae Rd
uuuuuuaaucaauuaaa

SEQ ID NO: 704813 - RNA, 19 nt, Haemophilus influenzae Rd
uuuuuuaaucaauuaaaga

SEQ ID NO: 704814 - RNA, 20 nt, Haemophilus influenzae Rd
uuuuugucguucuuuuucca

SEQ ID NO: 704815 - RNA, 19 nt, Haemophilus influenzae Rd
uuuuugugccaauccauaa

SEQ ID NO: 704816 - RNA, 11 nt, Haemophilus influenzae Rd
uuuuuguugau

SEQ ID NO: 704817 - RNA, 12 nt, Haemophilus influenzae Rd
uuuuuguuugag

SEQ ID NO: 704818 - RNA, 19 nt, Haemophilus influenzae Rd
uuuuucuucaaugccuuuu

SEQ ID NO: 704819 - RNA, 13 nt, Haemophilus influenzae Rd
uuuuucuuguucu

SEQ ID NO: 704820 - RNA, 12 nt, Haemophilus influenzae Rd
uuuuucuuuucu

SEQ ID NO: 704821 - RNA, 13 nt, Haemophilus influenzae Rd
uuuuucuuuucuu

SEQ ID NO: 704822 - RNA, 18 nt, Haemophilus influenzae Rd
uuuuugaggcuaaacuuu

SEQ ID NO: 704823 - RNA, 11 nt, Haemophilus influenzae Rd
uuuuuggcugc

SEQ ID NO: 704824 - RNA, 23 nt, Haemophilus influenzae Rd
uuuuugcucaaaaucaaguuaaa

SEQ ID NO: 704825 - RNA, 19 nt, Haemophilus influenzae Rd
uuuuuggacuuuauuugau

SEQ ID NO: 704826 - RNA, 20 nt, Haemophilus influenzae Rd
uuuuuggacuuuauuugauu

SEQ ID NO: 704827 - RNA, 22 nt, Haemophilus influenzae Rd
uuuuugcuuucuuauauauaaa

SEQ ID NO: 704828 - RNA, 15 nt, Haemophilus influenzae Rd
uuuuugcuuuucccu

SEQ ID NO: 704829 - RNA, 17 nt, Haemophilus influenzae Rd
uuuuugcaagauuuuuu

SEQ ID NO: 704830 - RNA, 20 nt, Haemophilus influenzae Rd
uuuuugccaaaauucuguuu

SEQ ID NO: 704831 - RNA, 16 nt, Haemophilus influenzae Rd
uuuuugccaauuuuuu

SEQ ID NO: 704832 - RNA, 22 nt, Haemophilus influenzae Rd
uuuuugcagggauuucaauaaa

SEQ ID NO: 704833 - RNA, 18 nt, Haemophilus influenzae Rd
uuuuucccacaaagguaa

SEQ ID NO: 704834 - RNA, 21 nt, Haemophilus influenzae Rd
uuuuuccccacuuaucuuaaa

SEQ ID NO: 704835 - RNA, 12 nt, Haemophilus influenzae Rd
uuuuuccagcaa

SEQ ID NO: 704836 - RNA, 21 nt, Haemophilus influenzae Rd
uuuuuccagcaaaaaaauuuc

SEQ ID NO: 704837 - RNA, 13 nt, Haemophilus influenzae Rd
uuuugaugugauu

SEQ ID NO: 704838 - RNA, 17 nt, Haemophilus influenzae Rd
uuuugaucucuuucuau

SEQ ID NO: 704839 - RNA, 14 nt, Haemophilus influenzae Rd
uuuugaucugcacu

SEQ ID NO: 704840 - RNA, 23 nt, Haemophilus influenzae Rd
uuuugauacuaacucaaaauacu

SEQ ID NO: 704841 - RNA, 14 nt, Haemophilus influenzae Rd
uuuugauaauuuuu

SEQ ID NO: 704842 - RNA, 12 nt, Haemophilus influenzae Rd
uuuuucugcauu

SEQ ID NO: 704843 - RNA, 14 nt, Haemophilus influenzae Rd
uuuuucuauuuaaa

SEQ ID NO: 704844 - RNA, 20 nt, Haemophilus influenzae Rd
uuuuuccguuuucuacugaa

SEQ ID NO: 704845 - RNA, 11 nt, Haemophilus influenzae Rd
uuuuuccugau

SEQ ID NO: 704846 - RNA, 15 nt, Haemophilus influenzae Rd
uuuuucgaucuaauc

SEQ ID NO: 704847 - RNA, 18 nt, Haemophilus influenzae Rd
uuuuucgcugcagcugcu

SEQ ID NO: 704848 - RNA, 21 nt, Haemophilus influenzae Rd
uuuuaaggaaacguaaaauau

SEQ ID NO: 704849 - RNA, 21 nt, Haemophilus influenzae Rd
uuuuaacuuaaucauuuuuua

SEQ ID NO: 704850 - RNA, 23 nt, Haemophilus influenzae Rd
uuuuaagugcgguugauuuuuga

SEQ ID NO: 704851 - RNA, 23 nt, Haemophilus influenzae Rd
uuuuaaguuucacucuaccaucu

SEQ ID NO: 704852 - RNA, 15 nt, Haemophilus influenzae Rd
uuuuaauaaaucaag

SEQ ID NO: 704853 - RNA, 22 nt, Haemophilus influenzae Rd
uuuuaauaacauagaaaucacu

SEQ ID NO: 704854 - RNA, 16 nt, Haemophilus influenzae Rd
uuuuaaguaguauuuu

SEQ ID NO: 704855 - RNA, 17 nt, Haemophilus influenzae Rd
uuuuaaguaguauuuua

SEQ ID NO: 704856 - RNA, 19 nt, Haemophilus influenzae Rd
uuuuaagucgcuaauuuuu

SEQ ID NO: 704857 - RNA, 12 nt, Haemophilus influenzae Rd
uuuuaaauauca

SEQ ID NO: 704858 - RNA, 18 nt, Haemophilus influenzae Rd
uuuuaaaucccaaucucc

SEQ ID NO: 704859 - RNA, 13 nt, Haemophilus influenzae Rd
uuuuaaauuuuua

SEQ ID NO: 704860 - RNA, 19 nt, Haemophilus influenzae Rd
uuuuaaccgcacuuuuaau

SEQ ID NO: 704861 - RNA, 22 nt, Haemophilus influenzae Rd
uuuuaaccgcacuuuuauuauu

SEQ ID NO: 704862 - RNA, 20 nt, Haemophilus influenzae Rd
uuuuaaccgcacuuuuuaau

SEQ ID NO: 704863 - RNA, 22 nt, Haemophilus influenzae Rd
uuuuaaccgcacuuuuuaauaa

SEQ ID NO: 704864 - RNA, 22 nt, Haemophilus influenzae Rd
uuuuaacgcgcuacaauauuua

SEQ ID NO: 704865 - RNA, 21 nt, Haemophilus influenzae Rd
uuuuaaacagcaaaagugcuu

SEQ ID NO: 704866 - RNA, 22 nt, Haemophilus influenzae Rd
uuuuaaaccgucauuuauaaaa

SEQ ID NO: 704867 - RNA, 19 nt, Haemophilus influenzae Rd
uuuuaaacguuuauuuauu

SEQ ID NO: 704868 - RNA, 12 nt, Haemophilus influenzae Rd
uuuuaaauauuu

SEQ ID NO: 704869 - RNA, 15 nt, Haemophilus influenzae Rd
uuuuaaauauuuuua

SEQ ID NO: 704870 - RNA, 20 nt, Haemophilus influenzae Rd
uuuuaaauauuuuuacaaaa

SEQ ID NO: 704871 - RNA, 11 nt, Haemophilus influenzae Rd
uuuuaaauaaa

SEQ ID NO: 704872 - RNA, 15 nt, Haemophilus influenzae Rd
uuuuaaauaaaauau

SEQ ID NO: 704873 - RNA, 16 nt, Haemophilus influenzae Rd
uuuuaaauaaaauauu

SEQ ID NO: 704874 - RNA, 15 nt, Haemophilus influenzae Rd
uuuuaaaaaauaauu

SEQ ID NO: 704875 - RNA, 12 nt, Haemophilus influenzae Rd
uuuuaaaacuau

SEQ ID NO: 704876 - RNA, 20 nt, Haemophilus influenzae Rd
uuuuaaaacuauuuuuaauu

SEQ ID NO: 704877 - RNA, 22 nt, Haemophilus influenzae Rd
uuuuaaaagaccacauucuaau

SEQ ID NO: 704878 - RNA, 13 nt, Haemophilus influenzae Rd
uuuuaaaauacug

SEQ ID NO: 704879 - RNA, 11 nt, Haemophilus influenzae Rd
uuuuaaaauag

SEQ ID NO: 704880 - RNA, 18 nt, Haemophilus influenzae Rd
uuuuaaaauaucaaaguu

SEQ ID NO: 704881 - RNA, 15 nt, Haemophilus influenzae Rd
uuuuaaaaucaucua

SEQ ID NO: 704882 - RNA, 13 nt, Haemophilus influenzae Rd
uuuuaaaaucucu

SEQ ID NO: 704883 - RNA, 19 nt, Haemophilus influenzae Rd
uuuuaaaaugaacaaaaaa

SEQ ID NO: 704884 - RNA, 20 nt, Haemophilus influenzae Rd
uuuuaaaauggaaauuugag

SEQ ID NO: 704885 - RNA, 23 nt, Haemophilus influenzae Rd
uuuuaaaauguaaaaauuggaaa

SEQ ID NO: 704886 - RNA, 21 nt, Haemophilus influenzae Rd
uuugucgcaggugucacagca

SEQ ID NO: 704887 - RNA, 15 nt, Haemophilus influenzae Rd
uuugucggaaaauaa

SEQ ID NO: 704888 - RNA, 15 nt, Haemophilus influenzae Rd
uuugucguaaugaaa

SEQ ID NO: 704889 - RNA, 16 nt, Haemophilus influenzae Rd
uuugucucaaaaucca

SEQ ID NO: 704890 - RNA, 14 nt, Haemophilus influenzae Rd
uuugucugaaauuu

SEQ ID NO: 704891 - RNA, 17 nt, Haemophilus influenzae Rd
uuugucuuauucaaacu

SEQ ID NO: 704892 - RNA, 18 nt, Haemophilus influenzae Rd
uuugucagauuuauaaau

SEQ ID NO: 704893 - RNA, 15 nt, Haemophilus influenzae Rd
uuuguccuuuaucaa

SEQ ID NO: 704894 - RNA, 13 nt, Haemophilus influenzae Rd
uuuguccaaaaau

SEQ ID NO: 704895 - RNA, 23 nt, Haemophilus influenzae Rd
uuugucccaaaauauuuucaaau

SEQ ID NO: 704896 - RNA, 17 nt, Haemophilus influenzae Rd
uuuguccgaaaaaacua

SEQ ID NO: 704897 - RNA, 18 nt, Haemophilus influenzae Rd
uuuguccgccaccaaaau

SEQ ID NO: 704898 - RNA, 15 nt, Haemophilus influenzae Rd
uuugugccauuucua

SEQ ID NO: 704899 - RNA, 16 nt, Haemophilus influenzae Rd
uuugugccauuucuaa

SEQ ID NO: 704900 - RNA, 14 nt, Haemophilus influenzae Rd
uuugugcguuuuuu

SEQ ID NO: 704901 - RNA, 17 nt, Haemophilus influenzae Rd
uuugugcguuuuuuaau

SEQ ID NO: 704902 - RNA, 13 nt, Haemophilus influenzae Rd
uuuguggaauacc

SEQ ID NO: 704903 - RNA, 20 nt, Haemophilus influenzae Rd
uuuguggcaaucguucuaaa

SEQ ID NO: 704904 - RNA, 21 nt, Haemophilus influenzae Rd
uuuguggcacgcccaaaggcu

SEQ ID NO: 704905 - RNA, 20 nt, Haemophilus influenzae Rd
uuuguggcuuuucagcuaaa

SEQ ID NO: 704906 - RNA, 16 nt, Haemophilus influenzae Rd
uuugugaguucaagca

SEQ ID NO: 704907 - RNA, 21 nt, Haemophilus influenzae Rd
uuugugcaagcacauuaauca

SEQ ID NO: 704908 - RNA, 14 nt, Haemophilus influenzae Rd
uuugugauuucaau

SEQ ID NO: 704909 - RNA, 15 nt, Haemophilus influenzae Rd
uuugugacauugcgu

SEQ ID NO: 704910 - RNA, 14 nt, Haemophilus influenzae Rd
uuugugacuucgcu

SEQ ID NO: 704911 - RNA, 23 nt, Haemophilus influenzae Rd
uuuguguaacagcucuguaaaac

SEQ ID NO: 704912 - RNA, 14 nt, Haemophilus influenzae Rd
uuuguuacucgcau

SEQ ID NO: 704913 - RNA, 19 nt, Haemophilus influenzae Rd
uuuguuagaucaaauuuga

SEQ ID NO: 704914 - RNA, 14 nt, Haemophilus influenzae Rd
uuuguucauuuuaa

SEQ ID NO: 704915 - RNA, 12 nt, Haemophilus influenzae Rd
uuuguuucuaaa

SEQ ID NO: 704916 - RNA, 23 nt, Haemophilus influenzae Rd
uuuguuucuaaaaaugcguucag

SEQ ID NO: 704917 - RNA, 13 nt, Haemophilus influenzae Rd
uuuguuucuaaau

SEQ ID NO: 704918 - RNA, 12 nt, Haemophilus influenzae Rd
uuuguuuaaaag

SEQ ID NO: 704919 - RNA, 14 nt, Haemophilus influenzae Rd
uuuguuuaauugga

SEQ ID NO: 704920 - RNA, 13 nt, Haemophilus influenzae Rd
uuuguuuaugaua

SEQ ID NO: 704921 - RNA, 17 nt, Haemophilus influenzae Rd
uuuguugguaaaucuaa

SEQ ID NO: 704922 - RNA, 15 nt, Haemophilus influenzae Rd
uuuguuccaauucug

SEQ ID NO: 704923 - RNA, 16 nt, Haemophilus influenzae Rd
uuuguugauaaacaua

SEQ ID NO: 704924 - RNA, 17 nt, Haemophilus influenzae Rd
uuuguugauaaacauaa

SEQ ID NO: 704925 - RNA, 13 nt, Haemophilus influenzae Rd
uuuguuucuaauu

SEQ ID NO: 704926 - RNA, 15 nt, Haemophilus influenzae Rd
uuuguuuuauuuauu

SEQ ID NO: 704927 - RNA, 18 nt, Haemophilus influenzae Rd
uuugcugcaccaaucaaa

SEQ ID NO: 704928 - RNA, 15 nt, Haemophilus influenzae Rd
uuugcucgcucgcca

SEQ ID NO: 704929 - RNA, 23 nt, Haemophilus influenzae Rd
uuugcucuaaaugugauuuccau

SEQ ID NO: 704930 - RNA, 16 nt, Haemophilus influenzae Rd
uuugcgucuucaaguc

SEQ ID NO: 704931 - RNA, 23 nt, Haemophilus influenzae Rd
uuugcuaacucuuuagaaaguuu

SEQ ID NO: 704932 - RNA, 21 nt, Haemophilus influenzae Rd
uuugcggagaaaacaaacgau

SEQ ID NO: 704933 - RNA, 22 nt, Haemophilus influenzae Rd
uuugcuuaaaagcuuccauaau

SEQ ID NO: 704934 - RNA, 21 nt, Haemophilus influenzae Rd
uuugcuuauuuuguugcagcu

SEQ ID NO: 704935 - RNA, 13 nt, Haemophilus influenzae Rd
uuugcuuuaccaa

SEQ ID NO: 704936 - RNA, 15 nt, Haemophilus influenzae Rd
uuugcuuugauaaau

SEQ ID NO: 704937 - RNA, 18 nt, Haemophilus influenzae Rd
uuuggacuuuauuugauu

SEQ ID NO: 704938 - RNA, 16 nt, Haemophilus influenzae Rd
uuuggaauauucuuuu

SEQ ID NO: 704939 - RNA, 21 nt, Haemophilus influenzae Rd
uuuggaauauucuuuuuaaau

SEQ ID NO: 704940 - RNA, 18 nt, Haemophilus influenzae Rd
uuuggaaacuaugcagaa

SEQ ID NO: 704941 - RNA, 19 nt, Haemophilus influenzae Rd
uuuggacaccuuuuuccuu

SEQ ID NO: 704942 - RNA, 23 nt, Haemophilus influenzae Rd
uuuggaguuguuuaaaauuagua

SEQ ID NO: 704943 - RNA, 22 nt, Haemophilus influenzae Rd
uuuggauaauguucuuuuaaaa

SEQ ID NO: 704944 - RNA, 15 nt, Haemophilus influenzae Rd
uuuggauaguuuauu

SEQ ID NO: 704945 - RNA, 17 nt, Haemophilus influenzae Rd
uuuggauugguguuuaa

SEQ ID NO: 704946 - RNA, 10 nt, Haemophilus influenzae Rd
uuuggcaaaa

SEQ ID NO: 704947 - RNA, 16 nt, Haemophilus influenzae Rd
uuuggcaaaauaauca

SEQ ID NO: 704948 - RNA, 22 nt, Haemophilus influenzae Rd
uuugguauaucuguaauuggua

SEQ ID NO: 704949 - RNA, 12 nt, Haemophilus influenzae Rd
uuugguauuuuu

SEQ ID NO: 704950 - RNA, 23 nt, Haemophilus influenzae Rd
uuugguaagcaauagauucuaag

SEQ ID NO: 704951 - RNA, 14 nt, Haemophilus influenzae Rd
uuugguagaguaaa

SEQ ID NO: 704952 - RNA, 13 nt, Haemophilus influenzae Rd
uuuggucuaacau

SEQ ID NO: 704953 - RNA, 20 nt, Haemophilus influenzae Rd
uuuggucuaacauuucauaa

SEQ ID NO: 704954 - RNA, 23 nt, Haemophilus influenzae Rd
uuuggcgcauuaaacucacuaaa

SEQ ID NO: 704955 - RNA, 13 nt, Haemophilus influenzae Rd
uuuggcauuuuca

SEQ ID NO: 704956 - RNA, 22 nt, Haemophilus influenzae Rd
uuugggaaauggcuuuucaauu

SEQ ID NO: 704957 - RNA, 16 nt, Haemophilus influenzae Rd
uuuguaagcauuaaaa

SEQ ID NO: 704958 - RNA, 18 nt, Haemophilus influenzae Rd
uuuguaagcauuaaaaau

SEQ ID NO: 704959 - RNA, 19 nt, Haemophilus influenzae Rd
uuuguaccauugugccaaa

SEQ ID NO: 704960 - RNA, 12 nt, Haemophilus influenzae Rd
uuuguauuuuau

SEQ ID NO: 704961 - RNA, 16 nt, Haemophilus influenzae Rd
uuuucuucagcaucaa

SEQ ID NO: 704962 - RNA, 21 nt, Haemophilus influenzae Rd
uuuucuuauagauaaaauguu

SEQ ID NO: 704963 - RNA, 15 nt, Haemophilus influenzae Rd
uuuucuuauuucuuu

SEQ ID NO: 704964 - RNA, 22 nt, Haemophilus influenzae Rd
uuuucuuaauuuuauuaauucu

SEQ ID NO: 704965 - RNA, 13 nt, Haemophilus influenzae Rd
uuuugaacaaggu

SEQ ID NO: 704966 - RNA, 16 nt, Haemophilus influenzae Rd
uuuugaacaagguuuc

SEQ ID NO: 704967 - RNA, 13 nt, Haemophilus influenzae Rd
uuuugaacaaugu

SEQ ID NO: 704968 - RNA, 11 nt, Haemophilus influenzae Rd
uuuugaauaaa

SEQ ID NO: 704969 - RNA, 12 nt, Haemophilus influenzae Rd
uuuugaauaaua

SEQ ID NO: 704970 - RNA, 21 nt, Haemophilus influenzae Rd
uuuugagugcuguacacacac

SEQ ID NO: 704971 - RNA, 21 nt, Haemophilus influenzae Rd
uuuucccuaaugcuaaacguu

SEQ ID NO: 704972 - RNA, 23 nt, Haemophilus influenzae Rd
uuuucgugaggucugcaauaaua

SEQ ID NO: 704973 - RNA, 22 nt, Haemophilus influenzae Rd
uuuucccacaaagguaaaacuu

SEQ ID NO: 704974 - RNA, 14 nt, Haemophilus influenzae Rd
uuuuccauuuuuuu

SEQ ID NO: 704975 - RNA, 15 nt, Haemophilus influenzae Rd
uuuucuaauaauuca

SEQ ID NO: 704976 - RNA, 22 nt, Haemophilus influenzae Rd
uuuucuaauaauucauuauuug

SEQ ID NO: 704977 - RNA, 15 nt, Haemophilus influenzae Rd
uuuucuaauauuucu

SEQ ID NO: 704978 - RNA, 18 nt, Haemophilus influenzae Rd
uuuucuaaugaaauuucu

SEQ ID NO: 704979 - RNA, 13 nt, Haemophilus influenzae Rd
uuuucuacagaaa

SEQ ID NO: 704980 - RNA, 13 nt, Haemophilus influenzae Rd
uuuucuacauaau

SEQ ID NO: 704981 - RNA, 16 nt, Haemophilus influenzae Rd
uuuucguguuuaguuu

SEQ ID NO: 704982 - RNA, 21 nt, Haemophilus influenzae Rd
uuuucuacuuccgauuuuaau

SEQ ID NO: 704983 - RNA, 13 nt, Haemophilus influenzae Rd
uuuucuagcaaua

SEQ ID NO: 704984 - RNA, 14 nt, Haemophilus influenzae Rd
uuuucucaaaacau

SEQ ID NO: 704985 - RNA, 15 nt, Haemophilus influenzae Rd
uuuucucaaaacauc

SEQ ID NO: 704986 - RNA, 21 nt, Haemophilus influenzae Rd
uuuucucaaaacaucuuuaau

SEQ ID NO: 704987 - RNA, 13 nt, Haemophilus influenzae Rd
uuuucaauaguuu

SEQ ID NO: 704988 - RNA, 11 nt, Haemophilus influenzae Rd
uuuucaauauc

SEQ ID NO: 704989 - RNA, 17 nt, Haemophilus influenzae Rd
uuuucaaguuacuuaau

SEQ ID NO: 704990 - RNA, 20 nt, Haemophilus influenzae Rd
uuuucaagccaccagagaaa

SEQ ID NO: 704991 - RNA, 15 nt, Haemophilus influenzae Rd
uuuucaaaacguucu

SEQ ID NO: 704992 - RNA, 14 nt, Haemophilus influenzae Rd
uuuucaaaaauuuu

SEQ ID NO: 704993 - RNA, 16 nt, Haemophilus influenzae Rd
uuuucaaaaauuuuug

SEQ ID NO: 704994 - RNA, 12 nt, Haemophilus influenzae Rd
uuuuauuuucuu

SEQ ID NO: 704995 - RNA, 12 nt, Haemophilus influenzae Rd
uuuuauuuuucc

SEQ ID NO: 704996 - RNA, 13 nt, Haemophilus influenzae Rd
uuuuauuuuugau

SEQ ID NO: 704997 - RNA, 12 nt, Haemophilus influenzae Rd
uuuucaaaaaau

SEQ ID NO: 704998 - RNA, 23 nt, Haemophilus influenzae Rd
uuuuccaauaaagagaaagugca

SEQ ID NO: 704999 - RNA, 16 nt, Haemophilus influenzae Rd
uuuuccacauuuugau

SEQ ID NO: 705000 - RNA, 21 nt, Haemophilus influenzae Rd
uuuucacauaauaaacauaca

SEQ ID NO: 705001 - RNA, 17 nt, Haemophilus influenzae Rd
uuuucauugaaaaaguu

SEQ ID NO: 705002 - RNA, 15 nt, Haemophilus influenzae Rd
uuuucacaccgucua

SEQ ID NO: 705003 - RNA, 12 nt, Haemophilus influenzae Rd
uuuucacagaaa

SEQ ID NO: 705004 - RNA, 23 nt, Haemophilus influenzae Rd
uuuucaaugcuuuuugcguugcu

SEQ ID NO: 705005 - RNA, 12 nt, Haemophilus influenzae Rd
uuuucaauuuga

SEQ ID NO: 705006 - RNA, 12 nt, Haemophilus influenzae Rd
uuuucauugcau

SEQ ID NO: 705007 - RNA, 21 nt, Haemophilus influenzae Rd
uuuucauuuuagaauccaaaa

SEQ ID NO: 705008 - RNA, 22 nt, Haemophilus influenzae Rd
uuuuauugaaauuuuaauuuag

SEQ ID NO: 705009 - RNA, 15 nt, Haemophilus influenzae Rd
uuuuauucaauaaua

SEQ ID NO: 705010 - RNA, 19 nt, Haemophilus influenzae Rd
uuuuauucaauaauauauu

SEQ ID NO: 705011 - RNA, 23 nt, Haemophilus influenzae Rd
uuuuauucaauaauauauuuaau

SEQ ID NO: 705012 - RNA, 14 nt, Haemophilus influenzae Rd
uuuuauucaaaauu

SEQ ID NO: 705013 - RNA, 15 nt, Haemophilus influenzae Rd
uuuuauuuaucagcc

SEQ ID NO: 705014 - RNA, 15 nt, Haemophilus influenzae Rd
uuuuauuuauauaaa

SEQ ID NO: 705015 - RNA, 12 nt, Haemophilus influenzae Rd
uuuuauuuaauu

SEQ ID NO: 705016 - RNA, 17 nt, Haemophilus influenzae Rd
uuuuauuucuaaucauu

SEQ ID NO: 705017 - RNA, 21 nt, Haemophilus influenzae Rd
uuuuauuugcggacaguauau

SEQ ID NO: 705018 - RNA, 13 nt, Haemophilus influenzae Rd
uuuuauuuguucu

SEQ ID NO: 705019 - RNA, 17 nt, Haemophilus influenzae Rd
uuuuauuuguucuacuu

SEQ ID NO: 705020 - RNA, 21 nt, Haemophilus influenzae Rd
uuuuauggcauacuuaacaaa

SEQ ID NO: 705021 - RNA, 18 nt, Haemophilus influenzae Rd
uuuuauguguuuuuaauu

SEQ ID NO: 705022 - RNA, 23 nt, Haemophilus influenzae Rd
uuuuauguuucucucuauucauc

SEQ ID NO: 705023 - RNA, 22 nt, Haemophilus influenzae Rd
uuuuauuagagaacguauuauu

SEQ ID NO: 705024 - RNA, 19 nt, Haemophilus influenzae Rd
uuuuauuagcgaaaauuuu

SEQ ID NO: 705025 - RNA, 20 nt, Haemophilus influenzae Rd
uuuuauuagugauauuguuu

SEQ ID NO: 705026 - RNA, 12 nt, Haemophilus influenzae Rd
uuuuauuaaaaa

SEQ ID NO: 705027 - RNA, 12 nt, Haemophilus influenzae Rd
uuuuauuaauaa

SEQ ID NO: 705028 - RNA, 19 nt, Haemophilus influenzae Rd
uuuuauuacauuaaaauca

SEQ ID NO: 705029 - RNA, 21 nt, Haemophilus influenzae Rd
uuuuauuacccuauucuaaau

SEQ ID NO: 705030 - RNA, 17 nt, Haemophilus influenzae Rd
uuuuagaauccaaaauu

SEQ ID NO: 705031 - RNA, 18 nt, Haemophilus influenzae Rd
uuuuacuuuuacuuaaag

SEQ ID NO: 705032 - RNA, 17 nt, Haemophilus influenzae Rd
uuuuagaauuaaauuug

SEQ ID NO: 705033 - RNA, 13 nt, Haemophilus influenzae Rd
uuuuacuucuuca

SEQ ID NO: 705034 - RNA, 21 nt, Haemophilus influenzae Rd
uuuuacuuggaauaucaucua

SEQ ID NO: 705035 - RNA, 19 nt, Haemophilus influenzae Rd
uuuuacuuucuuucaauaa

SEQ ID NO: 705036 - RNA, 15 nt, Haemophilus influenzae Rd
uuuuagaaaaucacu

SEQ ID NO: 705037 - RNA, 15 nt, Haemophilus influenzae Rd
uuuuacgacuaauuu

SEQ ID NO: 705038 - RNA, 22 nt, Haemophilus influenzae Rd
uuuuacgacuaauuuuuuaauu

SEQ ID NO: 705039 - RNA, 14 nt, Haemophilus influenzae Rd
uuuuacgauauuuu

SEQ ID NO: 705040 - RNA, 16 nt, Haemophilus influenzae Rd
uuuuacgauauuuuua

SEQ ID NO: 705041 - RNA, 14 nt, Haemophilus influenzae Rd
uuuuaccuuuggcu

SEQ ID NO: 705042 - RNA, 20 nt, Haemophilus influenzae Rd
uuuuaccgccgaaauuccca

SEQ ID NO: 705043 - RNA, 18 nt, Haemophilus influenzae Rd
uuuuaccuucaguuuuca

SEQ ID NO: 705044 - RNA, 21 nt, Haemophilus influenzae Rd
uuuuacgcuguucuucuaaug

SEQ ID NO: 705045 - RNA, 22 nt, Haemophilus influenzae Rd
uuuuacgcuuggaaauguuuaa

SEQ ID NO: 705046 - RNA, 23 nt, Haemophilus influenzae Rd
uuuuacgccuccauuaguuguuu

SEQ ID NO: 705047 - RNA, 21 nt, Haemophilus influenzae Rd
uuuuacgcgcugauucuaaug

SEQ ID NO: 705048 - RNA, 14 nt, Haemophilus influenzae Rd
uuuuacguuucauu

SEQ ID NO: 705049 - RNA, 19 nt, Haemophilus influenzae Rd
uuuuacgugcgaauuuuua

SEQ ID NO: 705050 - RNA, 21 nt, Haemophilus influenzae Rd
uuuuacucguccaaauucauu

SEQ ID NO: 705051 - RNA, 17 nt, Haemophilus influenzae Rd
uuuuaaugauaaauuuu

SEQ ID NO: 705052 - RNA, 22 nt, Haemophilus influenzae Rd
uuuuaaucguccaaagaaguuu

SEQ ID NO: 705053 - RNA, 19 nt, Haemophilus influenzae Rd
uuuuaaucaaauaaaauau

SEQ ID NO: 705054 - RNA, 15 nt, Haemophilus influenzae Rd
uuuuaauuacucacu

SEQ ID NO: 705055 - RNA, 15 nt, Haemophilus influenzae Rd
uuuuaauuaucuaaa

SEQ ID NO: 705056 - RNA, 13 nt, Haemophilus influenzae Rd
uuuuaauugguuu

SEQ ID NO: 705057 - RNA, 16 nt, Haemophilus influenzae Rd
uuuuaauugugcaauu

SEQ ID NO: 705058 - RNA, 13 nt, Haemophilus influenzae Rd
uuuuaauuuaaau

SEQ ID NO: 705059 - RNA, 14 nt, Haemophilus influenzae Rd
uuuuaauuuaaaua

SEQ ID NO: 705060 - RNA, 18 nt, Haemophilus influenzae Rd
uuuuaauuaaauacaaaa

SEQ ID NO: 705061 - RNA, 16 nt, Haemophilus influenzae Rd
uuuuaccauauccauu

SEQ ID NO: 705062 - RNA, 14 nt, Haemophilus influenzae Rd
uuuuacaucaauug

SEQ ID NO: 705063 - RNA, 15 nt, Haemophilus influenzae Rd
uuuuacaaaaaguac

SEQ ID NO: 705064 - RNA, 14 nt, Haemophilus influenzae Rd
uuuuacaauaccaa

SEQ ID NO: 705065 - RNA, 15 nt, Haemophilus influenzae Rd
uuuuacaauaccaau

SEQ ID NO: 705066 - RNA, 13 nt, Haemophilus influenzae Rd
uuuuaauuuuuua

SEQ ID NO: 705067 - RNA, 19 nt, Haemophilus influenzae Rd
uuuuacagguguaguuagc

SEQ ID NO: 705068 - RNA, 13 nt, Haemophilus influenzae Rd
uuuuauccgaguu

SEQ ID NO: 705069 - RNA, 23 nt, Haemophilus influenzae Rd
uuuuauccaaccuacauuaauca

SEQ ID NO: 705070 - RNA, 21 nt, Haemophilus influenzae Rd
uuuuauccuauuaauuuaauu

SEQ ID NO: 705071 - RNA, 15 nt, Haemophilus influenzae Rd
uuuuauccaucaaac

SEQ ID NO: 705072 - RNA, 20 nt, Haemophilus influenzae Rd
uuuuauccaugaugaaauaa

SEQ ID NO: 705073 - RNA, 24 nt, Haemophilus influenzae Rd
uuuuauccaugaugaaauaauuca

SEQ ID NO: 705074 - RNA, 14 nt, Haemophilus influenzae Rd
uuuuauaguuuuau

SEQ ID NO: 705075 - RNA, 13 nt, Haemophilus influenzae Rd
uuuuauauguucc

SEQ ID NO: 705076 - RNA, 17 nt, Haemophilus influenzae Rd
uuuuauauuuaguuagu

SEQ ID NO: 705077 - RNA, 18 nt, Haemophilus influenzae Rd
uuuuaucaacuaaaaaau

SEQ ID NO: 705078 - RNA, 19 nt, Haemophilus influenzae Rd
uuuuaucaaguaauacuuu

SEQ ID NO: 705079 - RNA, 14 nt, Haemophilus influenzae Rd
uuuuaucaauaacu

SEQ ID NO: 705080 - RNA, 14 nt, Haemophilus influenzae Rd
uuuuauauuuuuuc

SEQ ID NO: 705081 - RNA, 15 nt, Haemophilus influenzae Rd
uuuuaucaaaaaucu

SEQ ID NO: 705082 - RNA, 16 nt, Haemophilus influenzae Rd
uuuuaucuuuuacauc

SEQ ID NO: 705083 - RNA, 16 nt, Haemophilus influenzae Rd
uuuuaucuuuuauauu

SEQ ID NO: 705084 - RNA, 20 nt, Haemophilus influenzae Rd
uuuuaugaauaacuuuaauu

SEQ ID NO: 705085 - RNA, 20 nt, Haemophilus influenzae Rd
uuuuaugaccaaauaccaca

SEQ ID NO: 705086 - RNA, 18 nt, Haemophilus influenzae Rd
uuuuaugauaaccaucua

SEQ ID NO: 705087 - RNA, 20 nt, Haemophilus influenzae Rd
uuuuaucuauaaaaagaacu

SEQ ID NO: 705088 - RNA, 22 nt, Haemophilus influenzae Rd
uuuuaucgaccgcacuucuaau

SEQ ID NO: 705089 - RNA, 18 nt, Haemophilus influenzae Rd
uuuuaucgagauuucuuu

SEQ ID NO: 705090 - RNA, 14 nt, Haemophilus influenzae Rd
uuuuauaauuaaau

SEQ ID NO: 705091 - RNA, 13 nt, Haemophilus influenzae Rd
uuuuauaagugaa

SEQ ID NO: 705092 - RNA, 13 nt, Haemophilus influenzae Rd
uuuuauaauuaau

SEQ ID NO: 705093 - RNA, 15 nt, Haemophilus influenzae Rd
uuuuauaauuuugau

SEQ ID NO: 705094 - RNA, 11 nt, Haemophilus influenzae Rd
uuuuauaaaau

SEQ ID NO: 705095 - RNA, 17 nt, Haemophilus influenzae Rd
uuuuauaaagaucaaug

SEQ ID NO: 705096 - RNA, 20 nt, Haemophilus influenzae Rd
uuuuaguuucuaauucuucc

SEQ ID NO: 705097 - RNA, 20 nt, Haemophilus influenzae Rd
uuuuaguuuuuuuauaaaaa

SEQ ID NO: 705098 - RNA, 11 nt, Haemophilus influenzae Rd
uuuuauaaaaa

SEQ ID NO: 705099 - RNA, 13 nt, Haemophilus influenzae Rd
uuuuaguuuguuu

SEQ ID NO: 705100 - RNA, 22 nt, Haemophilus influenzae Rd
uuuuaggauugcguucuccgca

SEQ ID NO: 705101 - RNA, 22 nt, Haemophilus influenzae Rd
uuuuagcugauuuuuuaaagua

SEQ ID NO: 705102 - RNA, 14 nt, Haemophilus influenzae Rd
uuuuagcuaccaau

SEQ ID NO: 705103 - RNA, 17 nt, Haemophilus influenzae Rd
uuuuagggaagauuaau

SEQ ID NO: 705104 - RNA, 17 nt, Haemophilus influenzae Rd
uuuuagguucaauaaug

SEQ ID NO: 705105 - RNA, 21 nt, Haemophilus influenzae Rd
uuuuagugguuucagaauaaa

SEQ ID NO: 705106 - RNA, 21 nt, Haemophilus influenzae Rd
uuucugcguuuggcacaacau

SEQ ID NO: 705107 - RNA, 17 nt, Haemophilus influenzae Rd
uuucugcauuuaauggu

SEQ ID NO: 705108 - RNA, 17 nt, Haemophilus influenzae Rd
uuucugauaauuuuuca

SEQ ID NO: 705109 - RNA, 14 nt, Haemophilus influenzae Rd
uuucucuuuucuca

SEQ ID NO: 705110 - RNA, 15 nt, Haemophilus influenzae Rd
uuucucuuuucucaa

SEQ ID NO: 705111 - RNA, 12 nt, Haemophilus influenzae Rd
uuucugaacacu

SEQ ID NO: 705112 - RNA, 16 nt, Haemophilus influenzae Rd
uuucugaacuaaaaua

SEQ ID NO: 705113 - RNA, 21 nt, Haemophilus influenzae Rd
uuucucgugccuauuuauuua

SEQ ID NO: 705114 - RNA, 14 nt, Haemophilus influenzae Rd
uuucucuacuaauu

SEQ ID NO: 705115 - RNA, 15 nt, Haemophilus influenzae Rd
uuucucgcucuaguu

SEQ ID NO: 705116 - RNA, 14 nt, Haemophilus influenzae Rd
uuucucacuucuuu

SEQ ID NO: 705117 - RNA, 18 nt, Haemophilus influenzae Rd
uuucucaucauuauuuuu

SEQ ID NO: 705118 - RNA, 12 nt, Haemophilus influenzae Rd
uuucucaccaaa

SEQ ID NO: 705119 - RNA, 21 nt, Haemophilus influenzae Rd
uuucuauuguuuuuuucuaaa

SEQ ID NO: 705120 - RNA, 12 nt, Haemophilus influenzae Rd
uuucuauuuaaa

SEQ ID NO: 705121 - RNA, 14 nt, Haemophilus influenzae Rd
uuucuauuaaaaaa

SEQ ID NO: 705122 - RNA, 15 nt, Haemophilus influenzae Rd
uuucguauuucguau

SEQ ID NO: 705123 - RNA, 21 nt, Haemophilus influenzae Rd
uuucgcgccaccuccaauuag

SEQ ID NO: 705124 - RNA, 23 nt, Haemophilus influenzae Rd
uuucgccgaguaaauucaccaau

SEQ ID NO: 705125 - RNA, 23 nt, Haemophilus influenzae Rd
uuucgcccaugcgaacagguuca

SEQ ID NO: 705126 - RNA, 22 nt, Haemophilus influenzae Rd
uuucggaugacggaauacauca

SEQ ID NO: 705127 - RNA, 18 nt, Haemophilus influenzae Rd
uuucguuguuuuaauaaa

SEQ ID NO: 705128 - RNA, 23 nt, Haemophilus influenzae Rd
uuucguuugacagcaauauauaa

SEQ ID NO: 705129 - RNA, 13 nt, Haemophilus influenzae Rd
uuucuaaaaucac

SEQ ID NO: 705130 - RNA, 21 nt, Haemophilus influenzae Rd
uuucuaaaugaauaaaacuuc

SEQ ID NO: 705131 - RNA, 23 nt, Haemophilus influenzae Rd
uuucuaaaauaauaucacaacca

SEQ ID NO: 705132 - RNA, 16 nt, Haemophilus influenzae Rd
uuucuaaauaaaauug

SEQ ID NO: 705133 - RNA, 14 nt, Haemophilus influenzae Rd
uuucuaauuuuuca

SEQ ID NO: 705134 - RNA, 14 nt, Haemophilus influenzae Rd
uuucuaauauuucu

SEQ ID NO: 705135 - RNA, 17 nt, Haemophilus influenzae Rd
uuucuaauaacaaucuu

SEQ ID NO: 705136 - RNA, 17 nt, Haemophilus influenzae Rd
uuucuaauaagaagcug

SEQ ID NO: 705137 - RNA, 15 nt, Haemophilus influenzae Rd
uuucuaacgcaaacu

SEQ ID NO: 705138 - RNA, 17 nt, Haemophilus influenzae Rd
uuucuaacgcaaacuac

SEQ ID NO: 705139 - RNA, 15 nt, Haemophilus influenzae Rd
uuucuaacuuuuaau

SEQ ID NO: 705140 - RNA, 20 nt, Haemophilus influenzae Rd
uuucuaacuuuuaauucuug

SEQ ID NO: 705141 - RNA, 20 nt, Haemophilus influenzae Rd
uuucuaagccugggcuugca

SEQ ID NO: 705142 - RNA, 23 nt, Haemophilus influenzae Rd
uuucuaaggcuuguuguucaaaa

SEQ ID NO: 705143 - RNA, 18 nt, Haemophilus influenzae Rd
uuucuaagguauccacuu

SEQ ID NO: 705144 - RNA, 14 nt, Haemophilus influenzae Rd
uuucuacgacauuu

SEQ ID NO: 705145 - RNA, 17 nt, Haemophilus influenzae Rd
uuucuacgacauuuuua

SEQ ID NO: 705146 - RNA, 20 nt, Haemophilus influenzae Rd
uuucuacuuuugugccagcu

SEQ ID NO: 705147 - RNA, 23 nt, Haemophilus influenzae Rd
uuucuacucguagaguuuuuuca

SEQ ID NO: 705148 - RNA, 18 nt, Haemophilus influenzae Rd
uuucuagcuuaccuuaau

SEQ ID NO: 705149 - RNA, 22 nt, Haemophilus influenzae Rd
uuucuagcgguaaaccaacucu

SEQ ID NO: 705150 - RNA, 16 nt, Haemophilus influenzae Rd
uuuccuuuuuuauuua

SEQ ID NO: 705151 - RNA, 15 nt, Haemophilus influenzae Rd
uuuccuuugcugcca

SEQ ID NO: 705152 - RNA, 22 nt, Haemophilus influenzae Rd
uuuccuuauucgcugcaaaauc

SEQ ID NO: 705153 - RNA, 20 nt, Haemophilus influenzae Rd
uuucgcagccacuugugcau

SEQ ID NO: 705154 - RNA, 19 nt, Haemophilus influenzae Rd
uuucgcaggaucacaauca

SEQ ID NO: 705155 - RNA, 19 nt, Haemophilus influenzae Rd
uuucgcaucaaucacagca

SEQ ID NO: 705156 - RNA, 14 nt, Haemophilus influenzae Rd
uuucgacuugugca

SEQ ID NO: 705157 - RNA, 22 nt, Haemophilus influenzae Rd
uuucgauaagauugugcaauaa

SEQ ID NO: 705158 - RNA, 15 nt, Haemophilus influenzae Rd
uuuccuaugccuuuu

SEQ ID NO: 705159 - RNA, 14 nt, Haemophilus influenzae Rd
uuuccuauucuaaa

SEQ ID NO: 705160 - RNA, 17 nt, Haemophilus influenzae Rd
uuuccucgacauaaaaa

SEQ ID NO: 705161 - RNA, 15 nt, Haemophilus influenzae Rd
uuuccugaugaauuu

SEQ ID NO: 705162 - RNA, 18 nt, Haemophilus influenzae Rd
uuuccgugauuucuuucg

SEQ ID NO: 705163 - RNA, 16 nt, Haemophilus influenzae Rd
uuuccguuuuuucauu

SEQ ID NO: 705164 - RNA, 15 nt, Haemophilus influenzae Rd
uuucccuuuucuuau

SEQ ID NO: 705165 - RNA, 18 nt, Haemophilus influenzae Rd
uuuccgacaacacuugcu

SEQ ID NO: 705166 - RNA, 16 nt, Haemophilus influenzae Rd
uuucccucuuuuucag

SEQ ID NO: 705167 - RNA, 16 nt, Haemophilus influenzae Rd
uuucccauuuaacccc

SEQ ID NO: 705168 - RNA, 23 nt, Haemophilus influenzae Rd
uuucccauuugucucaaaaucca

SEQ ID NO: 705169 - RNA, 22 nt, Haemophilus influenzae Rd
uuuccauuuuugagguguuuau

SEQ ID NO: 705170 - RNA, 15 nt, Haemophilus influenzae Rd
uuuccccugaaugug

SEQ ID NO: 705171 - RNA, 17 nt, Haemophilus influenzae Rd
uuuccauaaaugacaga

SEQ ID NO: 705172 - RNA, 21 nt, Haemophilus influenzae Rd
uuuccauaauguucccuauaa

SEQ ID NO: 705173 - RNA, 17 nt, Haemophilus influenzae Rd
uuuccauaccucuauuu

SEQ ID NO: 705174 - RNA, 18 nt, Haemophilus influenzae Rd
uuuccauaugaccauuaa

SEQ ID NO: 705175 - RNA, 17 nt, Haemophilus influenzae Rd
uuuccaucuaaaaguug

SEQ ID NO: 705176 - RNA, 21 nt, Haemophilus influenzae Rd
uuuccagcaaaaaaauuucuu

SEQ ID NO: 705177 - RNA, 21 nt, Haemophilus influenzae Rd
uuuccacuauucguaaugccu

SEQ ID NO: 705178 - RNA, 14 nt, Haemophilus influenzae Rd
uuucuuuuuuucuu

SEQ ID NO: 705179 - RNA, 17 nt, Haemophilus influenzae Rd
uuucuuuucuucuaauu

SEQ ID NO: 705180 - RNA, 22 nt, Haemophilus influenzae Rd
uuugaaaagaauuucaucgcau

SEQ ID NO: 705181 - RNA, 17 nt, Haemophilus influenzae Rd
uuucuuugaguaaaaaa

SEQ ID NO: 705182 - RNA, 22 nt, Haemophilus influenzae Rd
uuucuuucguucaacccauuuu

SEQ ID NO: 705183 - RNA, 21 nt, Haemophilus influenzae Rd
uuugaacccauuaaccaacau

SEQ ID NO: 705184 - RNA, 14 nt, Haemophilus influenzae Rd
uuugaaguaaaaaa

SEQ ID NO: 705185 - RNA, 15 nt, Haemophilus influenzae Rd
uuugaaguacauuca

SEQ ID NO: 705186 - RNA, 17 nt, Haemophilus influenzae Rd
uuugacgcgcacauacu

SEQ ID NO: 705187 - RNA, 23 nt, Haemophilus influenzae Rd
uuugacuucccagccuuguaauu

SEQ ID NO: 705188 - RNA, 23 nt, Haemophilus influenzae Rd
uuugacuaaaucaugaauaauuu

SEQ ID NO: 705189 - RNA, 23 nt, Haemophilus influenzae Rd
uuugacgagauuuuuugaauaaa

SEQ ID NO: 705190 - RNA, 23 nt, Haemophilus influenzae Rd
uuugacgauaauauuuuugccaa

SEQ ID NO: 705191 - RNA, 16 nt, Haemophilus influenzae Rd
uuugacgcagcaucug

SEQ ID NO: 705192 - RNA, 13 nt, Haemophilus influenzae Rd
uuugacauauuuu

SEQ ID NO: 705193 - RNA, 17 nt, Haemophilus influenzae Rd
uuugacccgcuuuuaau

SEQ ID NO: 705194 - RNA, 15 nt, Haemophilus influenzae Rd
uuugaccgacaagau

SEQ ID NO: 705195 - RNA, 19 nt, Haemophilus influenzae Rd
uuugaccgcggaaaauauc

SEQ ID NO: 705196 - RNA, 14 nt, Haemophilus influenzae Rd
uuucugguuccauu

SEQ ID NO: 705197 - RNA, 16 nt, Haemophilus influenzae Rd
uuucuggguuuuaaaa

SEQ ID NO: 705198 - RNA, 17 nt, Haemophilus influenzae Rd
uuucugguacaaauuua

SEQ ID NO: 705199 - RNA, 23 nt, Haemophilus influenzae Rd
uuucugguacaaauuuagauaac

SEQ ID NO: 705200 - RNA, 17 nt, Haemophilus influenzae Rd
uuucuguggcuaauucg

SEQ ID NO: 705201 - RNA, 16 nt, Haemophilus influenzae Rd
uuucuguuaaaucuac

SEQ ID NO: 705202 - RNA, 14 nt, Haemophilus influenzae Rd
uuucuguugauuua

SEQ ID NO: 705203 - RNA, 14 nt, Haemophilus influenzae Rd
uuucuuaugaaccu

SEQ ID NO: 705204 - RNA, 17 nt, Haemophilus influenzae Rd
uuucuuagauuucuaau

SEQ ID NO: 705205 - RNA, 16 nt, Haemophilus influenzae Rd
uuucuucacugcaucu

SEQ ID NO: 705206 - RNA, 23 nt, Haemophilus influenzae Rd
uuucuucaauaauugaagcaauu

SEQ ID NO: 705207 - RNA, 21 nt, Haemophilus influenzae Rd
uuucuucagcaucaacauaaa

SEQ ID NO: 705208 - RNA, 21 nt, Haemophilus influenzae Rd
uuucuuauauucaaauuucau

SEQ ID NO: 705209 - RNA, 12 nt, Haemophilus influenzae Rd
uuucuuaaaaua

SEQ ID NO: 705210 - RNA, 13 nt, Haemophilus influenzae Rd
uuucuuaaauaua

SEQ ID NO: 705211 - RNA, 15 nt, Haemophilus influenzae Rd
uuucuucuaauucuu

SEQ ID NO: 705212 - RNA, 17 nt, Haemophilus influenzae Rd
uuucuucuacuucuucu

SEQ ID NO: 705213 - RNA, 21 nt, Haemophilus influenzae Rd
uuucuucgcgagaauuaccac

SEQ ID NO: 705214 - RNA, 20 nt, Haemophilus influenzae Rd
uuucuuccauuucaauaucu

SEQ ID NO: 705215 - RNA, 14 nt, Haemophilus influenzae Rd
uuucuuuaauugau

SEQ ID NO: 705216 - RNA, 16 nt, Haemophilus influenzae Rd
uuucuuguucuccauu

SEQ ID NO: 705217 - RNA, 18 nt, Haemophilus influenzae Rd
uuucuuguucuccauuaa

SEQ ID NO: 705218 - RNA, 14 nt, Haemophilus influenzae Rd
uuucuuuaaaauua

SEQ ID NO: 705219 - RNA, 14 nt, Haemophilus influenzae Rd
uuucuugcuaaaaa

SEQ ID NO: 705220 - RNA, 17 nt, Haemophilus influenzae Rd
uuucuugcuaaaaagaa

SEQ ID NO: 705221 - RNA, 22 nt, Haemophilus influenzae Rd
uuucuugcuaaaaagaaauaaa

SEQ ID NO: 705222 - RNA, 15 nt, Haemophilus influenzae Rd
uuucuugcuauucuu

SEQ ID NO: 705223 - RNA, 22 nt, Haemophilus influenzae Rd
uuucuugcuguugguuaaaaau

SEQ ID NO: 705224 - RNA, 17 nt, Haemophilus influenzae Rd
uuucuugaccuucaauu

SEQ ID NO: 705225 - RNA, 14 nt, Haemophilus influenzae Rd
uuucuugagcagac

SEQ ID NO: 705226 - RNA, 16 nt, Haemophilus influenzae Rd
uuugagcaaaucaaaa

SEQ ID NO: 705227 - RNA, 14 nt, Haemophilus influenzae Rd
uuugaggcuaauaa

SEQ ID NO: 705228 - RNA, 17 nt, Haemophilus influenzae Rd
uuugagaugaaaaaaag

SEQ ID NO: 705229 - RNA, 23 nt, Haemophilus influenzae Rd
uuugauacuaacucaaaauacuc

SEQ ID NO: 705230 - RNA, 14 nt, Haemophilus influenzae Rd
uuugauaaaaacac

SEQ ID NO: 705231 - RNA, 12 nt, Haemophilus influenzae Rd
uuugaguuauuu

SEQ ID NO: 705232 - RNA, 17 nt, Haemophilus influenzae Rd
uuugaguuauuuuuaau

SEQ ID NO: 705233 - RNA, 17 nt, Haemophilus influenzae Rd
uuugauuuaguccuaaa

SEQ ID NO: 705234 - RNA, 16 nt, Haemophilus influenzae Rd
uuugauuacaguacaa

SEQ ID NO: 705235 - RNA, 16 nt, Haemophilus influenzae Rd
uuugauggucauugcu

SEQ ID NO: 705236 - RNA, 20 nt, Haemophilus influenzae Rd
uuugauuucagaacaugacu

SEQ ID NO: 705237 - RNA, 18 nt, Haemophilus influenzae Rd
uuugcaaaccaaaucaca

SEQ ID NO: 705238 - RNA, 16 nt, Haemophilus influenzae Rd
uuugaucguauugcau

SEQ ID NO: 705239 - RNA, 17 nt, Haemophilus influenzae Rd
uuugaucucuuucuauu

SEQ ID NO: 705240 - RNA, 20 nt, Haemophilus influenzae Rd
uuugaucuuagacaaauuaa

SEQ ID NO: 705241 - RNA, 18 nt, Haemophilus influenzae Rd
uuugaucuuccgcgucau

SEQ ID NO: 705242 - RNA, 22 nt, Haemophilus influenzae Rd
uuugauccacaaauaauaaucu

SEQ ID NO: 705243 - RNA, 18 nt, Haemophilus influenzae Rd
uuugauccacacuucauc

SEQ ID NO: 705244 - RNA, 13 nt, Haemophilus influenzae Rd
uuugauaugccac

SEQ ID NO: 705245 - RNA, 20 nt, Haemophilus influenzae Rd
uuugcagugcauuaaugccu

SEQ ID NO: 705246 - RNA, 14 nt, Haemophilus influenzae Rd
uuugcaaauacagu

SEQ ID NO: 705247 - RNA, 21 nt, Haemophilus influenzae Rd
uuugcaaauacagugacaaau

SEQ ID NO: 705248 - RNA, 18 nt, Haemophilus influenzae Rd
uuugcaagccaauagauu

SEQ ID NO: 705249 - RNA, 17 nt, Haemophilus influenzae Rd
uuugcaaggcucgcgau

SEQ ID NO: 705250 - RNA, 21 nt, Haemophilus influenzae Rd
uuugcaagguuuccaagaauu

SEQ ID NO: 705251 - RNA, 19 nt, Haemophilus influenzae Rd
uuugcaccacguucuuuua

SEQ ID NO: 705252 - RNA, 21 nt, Haemophilus influenzae Rd
uuugcaccacguucuuuuaau

SEQ ID NO: 705253 - RNA, 14 nt, Haemophilus influenzae Rd
uuugcacccgccau

SEQ ID NO: 705254 - RNA, 19 nt, Haemophilus influenzae Rd
uuugcacccgccauaaaac

SEQ ID NO: 705255 - RNA, 16 nt, Haemophilus influenzae Rd
uuugcaccugcaucaa

SEQ ID NO: 705256 - RNA, 17 nt, Haemophilus influenzae Rd
uuugcgcauuaucuucg

SEQ ID NO: 705257 - RNA, 16 nt, Haemophilus influenzae Rd
uuugcgaugauaaagu

SEQ ID NO: 705258 - RNA, 12 nt, Haemophilus influenzae Rd
uuugcgccuuca

SEQ ID NO: 705259 - RNA, 21 nt, Haemophilus influenzae Rd
uuugcgccuucaagccuugcu

SEQ ID NO: 705260 - RNA, 16 nt, Haemophilus influenzae Rd
uuugccgccaaaauga

SEQ ID NO: 705261 - RNA, 16 nt, Haemophilus influenzae Rd
uuugcccauucuaaug

SEQ ID NO: 705262 - RNA, 15 nt, Haemophilus influenzae Rd
uuugccccaauauuu

SEQ ID NO: 705263 - RNA, 20 nt, Haemophilus influenzae Rd
uuugcauuuuggaaaauaga

SEQ ID NO: 705264 - RNA, 18 nt, Haemophilus influenzae Rd
uuugccaaauccacaacc

SEQ ID NO: 705265 - RNA, 20 nt, Haemophilus influenzae Rd
uuugccaacaccuaagaacu

SEQ ID NO: 705266 - RNA, 13 nt, Haemophilus influenzae Rd
uuugccaauacuu

SEQ ID NO: 705267 - RNA, 16 nt, Haemophilus influenzae Rd
uuucacauaaauuaca

SEQ ID NO: 705268 - RNA, 19 nt, Haemophilus influenzae Rd
uuucacaccauuuuuaauu

SEQ ID NO: 705269 - RNA, 17 nt, Haemophilus influenzae Rd
uuucacacccaugaauc

SEQ ID NO: 705270 - RNA, 22 nt, Haemophilus influenzae Rd
uuucacauuugagaugaaaaaa

SEQ ID NO: 705271 - RNA, 20 nt, Haemophilus influenzae Rd
uuucaccaacaaauucuaau

SEQ ID NO: 705272 - RNA, 19 nt, Haemophilus influenzae Rd
uuucacccaagauucuaaa

SEQ ID NO: 705273 - RNA, 20 nt, Haemophilus influenzae Rd
uuucacccaagauucuaaau

SEQ ID NO: 705274 - RNA, 19 nt, Haemophilus influenzae Rd
uuucaauguugcgccaucu

SEQ ID NO: 705275 - RNA, 13 nt, Haemophilus influenzae Rd
uuucaauugccau

SEQ ID NO: 705276 - RNA, 13 nt, Haemophilus influenzae Rd
uuucaauuucucu

SEQ ID NO: 705277 - RNA, 22 nt, Haemophilus influenzae Rd
uuucaauuucucuacuaauuca

SEQ ID NO: 705278 - RNA, 19 nt, Haemophilus influenzae Rd
uuucacaaccuuguuccag

SEQ ID NO: 705279 - RNA, 15 nt, Haemophilus influenzae Rd
uuucacaacuaccac

SEQ ID NO: 705280 - RNA, 21 nt, Haemophilus influenzae Rd
uuucacaacuaccacagguuu

SEQ ID NO: 705281 - RNA, 22 nt, Haemophilus influenzae Rd
uuucacgcgugguauucuuucc

SEQ ID NO: 705282 - RNA, 20 nt, Haemophilus influenzae Rd
uuucacgguacgcugcaucu

SEQ ID NO: 705283 - RNA, 15 nt, Haemophilus influenzae Rd
uuucacuaauuugcu

SEQ ID NO: 705284 - RNA, 22 nt, Haemophilus influenzae Rd
uuucacuguauuggaaaaguuc

SEQ ID NO: 705285 - RNA, 22 nt, Haemophilus influenzae Rd
uuucacugcauuuucuuuuuca

SEQ ID NO: 705286 - RNA, 19 nt, Haemophilus influenzae Rd
uuucacuauuucaucuuua

SEQ ID NO: 705287 - RNA, 22 nt, Haemophilus influenzae Rd
uuucacucguauccguuccacu

SEQ ID NO: 705288 - RNA, 17 nt, Haemophilus influenzae Rd
uuucaccgcacuuaauc

SEQ ID NO: 705289 - RNA, 17 nt, Haemophilus influenzae Rd
uuucacgcccaaauacu

SEQ ID NO: 705290 - RNA, 18 nt, Haemophilus influenzae Rd
uuucacgcccaaauacuu

SEQ ID NO: 705291 - RNA, 17 nt, Haemophilus influenzae Rd
uuucaaucccuucugcu

SEQ ID NO: 705292 - RNA, 13 nt, Haemophilus influenzae Rd
uuucaaugaaaua

SEQ ID NO: 705293 - RNA, 16 nt, Haemophilus influenzae Rd
uuucaaugaaauauua

SEQ ID NO: 705294 - RNA, 11 nt, Haemophilus influenzae Rd
uuucaaugacu

SEQ ID NO: 705295 - RNA, 11 nt, Haemophilus influenzae Rd
uuucaauaauc

SEQ ID NO: 705296 - RNA, 18 nt, Haemophilus influenzae Rd
uuucaauagccaauaaua

SEQ ID NO: 705297 - RNA, 14 nt, Haemophilus influenzae Rd
uuucaauauaaguu

SEQ ID NO: 705298 - RNA, 15 nt, Haemophilus influenzae Rd
uuucaauauaaucaa

SEQ ID NO: 705299 - RNA, 17 nt, Haemophilus influenzae Rd
uuucaaguaacuuucac

SEQ ID NO: 705300 - RNA, 15 nt, Haemophilus influenzae Rd
uuucaacuuggaaag

SEQ ID NO: 705301 - RNA, 14 nt, Haemophilus influenzae Rd
uuucaacuuggcua

SEQ ID NO: 705302 - RNA, 21 nt, Haemophilus influenzae Rd
uuucaacuacgccguuuuuca

SEQ ID NO: 705303 - RNA, 15 nt, Haemophilus influenzae Rd
uuucaagaacagaaa

SEQ ID NO: 705304 - RNA, 14 nt, Haemophilus influenzae Rd
uuucaagcuuugca

SEQ ID NO: 705305 - RNA, 16 nt, Haemophilus influenzae Rd
uuucaagcuuugcaac

SEQ ID NO: 705306 - RNA, 23 nt, Haemophilus influenzae Rd
uuucaagcacuuuauuuaauuca

SEQ ID NO: 705307 - RNA, 18 nt, Haemophilus influenzae Rd
uuucaagcccuuccaucu

SEQ ID NO: 705308 - RNA, 19 nt, Haemophilus influenzae Rd
uuucaacacuuccaaagua

SEQ ID NO: 705309 - RNA, 17 nt, Haemophilus influenzae Rd
uuucaacacaacaucag

SEQ ID NO: 705310 - RNA, 21 nt, Haemophilus influenzae Rd
uuucaaccgcacuuuuuuuca

SEQ ID NO: 705311 - RNA, 21 nt, Haemophilus influenzae Rd
uuucaaccgcucuuuuuauuu

SEQ ID NO: 705312 - RNA, 22 nt, Haemophilus influenzae Rd
uuucaaccgcucuuuuuauuua

SEQ ID NO: 705313 - RNA, 16 nt, Haemophilus influenzae Rd
uuuauuuugguauuuu

SEQ ID NO: 705314 - RNA, 13 nt, Haemophilus influenzae Rd
uuuauuuuuacuc

SEQ ID NO: 705315 - RNA, 20 nt, Haemophilus influenzae Rd
uuuauuuuuaucauauauaa

SEQ ID NO: 705316 - RNA, 22 nt, Haemophilus influenzae Rd
uuuauuuuauauauuaaaaaaa

SEQ ID NO: 705317 - RNA, 22 nt, Haemophilus influenzae Rd
uuuauuugucagauuuacccaa

SEQ ID NO: 705318 - RNA, 12 nt, Haemophilus influenzae Rd
uuuauuuuaaaa

SEQ ID NO: 705319 - RNA, 13 nt, Haemophilus influenzae Rd
uuucaaaaagaua

SEQ ID NO: 705320 - RNA, 21 nt, Haemophilus influenzae Rd
uuucaaaacaguuuucaaauu

SEQ ID NO: 705321 - RNA, 15 nt, Haemophilus influenzae Rd
uuucaacaaaaauac

SEQ ID NO: 705322 - RNA, 13 nt, Haemophilus influenzae Rd
uuucaaacacaaa

SEQ ID NO: 705323 - RNA, 22 nt, Haemophilus influenzae Rd
uuuauuagaaauauauuuguuu

SEQ ID NO: 705324 - RNA, 16 nt, Haemophilus influenzae Rd
uuuauuaguaaaauaa

SEQ ID NO: 705325 - RNA, 21 nt, Haemophilus influenzae Rd
uuuauuaguaaaauaauaagc

SEQ ID NO: 705326 - RNA, 15 nt, Haemophilus influenzae Rd
uuuauuagaauauaa

SEQ ID NO: 705327 - RNA, 22 nt, Haemophilus influenzae Rd
uuuauuacgauaguaaaaaauc

SEQ ID NO: 705328 - RNA, 17 nt, Haemophilus influenzae Rd
uuuauucuccaaauaua

SEQ ID NO: 705329 - RNA, 22 nt, Haemophilus influenzae Rd
uuuauucaaaucgaucacuuaa

SEQ ID NO: 705330 - RNA, 13 nt, Haemophilus influenzae Rd
uuuauuauuuccu

SEQ ID NO: 705331 - RNA, 14 nt, Haemophilus influenzae Rd
uuuauucaaaauaa

SEQ ID NO: 705332 - RNA, 13 nt, Haemophilus influenzae Rd
uuuauucaguaaa

SEQ ID NO: 705333 - RNA, 17 nt, Haemophilus influenzae Rd
uuuauucauaaauuccu

SEQ ID NO: 705334 - RNA, 20 nt, Haemophilus influenzae Rd
uuuauucugaaaccacuaaa

SEQ ID NO: 705335 - RNA, 15 nt, Haemophilus influenzae Rd
uuuauugaagaguaa

SEQ ID NO: 705336 - RNA, 21 nt, Haemophilus influenzae Rd
uuuauugaccgcuucauuaaa

SEQ ID NO: 705337 - RNA, 19 nt, Haemophilus influenzae Rd
uuuauugguaacaacugcu

SEQ ID NO: 705338 - RNA, 18 nt, Haemophilus influenzae Rd
uuuauuguagccuaguau

SEQ ID NO: 705339 - RNA, 21 nt, Haemophilus influenzae Rd
uuuauuguagccuaguauuuu

SEQ ID NO: 705340 - RNA, 14 nt, Haemophilus influenzae Rd
uuuauuuacaagcu

SEQ ID NO: 705341 - RNA, 20 nt, Haemophilus influenzae Rd
uuuauuuacccaagccaauu

SEQ ID NO: 705342 - RNA, 21 nt, Haemophilus influenzae Rd
uuuauuucaauauaaucaauu

SEQ ID NO: 705343 - RNA, 12 nt, Haemophilus influenzae Rd
uuuauuucuaua

SEQ ID NO: 705344 - RNA, 14 nt, Haemophilus influenzae Rd
uuucaguaucaaua

SEQ ID NO: 705345 - RNA, 21 nt, Haemophilus influenzae Rd
uuucaguggggaauaaaauaa

SEQ ID NO: 705346 - RNA, 19 nt, Haemophilus influenzae Rd
uuucaguuacguaauauuu

SEQ ID NO: 705347 - RNA, 14 nt, Haemophilus influenzae Rd
uuucaguuaucucc

SEQ ID NO: 705348 - RNA, 18 nt, Haemophilus influenzae Rd
  misc_feature (6)..(6): n is a, c, g or u
uuucanagagguuuccuu

SEQ ID NO: 705349 - RNA, 19 nt, Haemophilus influenzae Rd
  misc_feature (6)..(6): n is a, c, g or u
uuucanagagguuuccuua

SEQ ID NO: 705350 - RNA, 22 nt, Haemophilus influenzae Rd
uuucauaaacgguauuuucucg

SEQ ID NO: 705351 - RNA, 20 nt, Haemophilus influenzae Rd
uuucauacaaucucuagauu

SEQ ID NO: 705352 - RNA, 22 nt, Haemophilus influenzae Rd
uuucauaaugcgaucuuuuguu

SEQ ID NO: 705353 - RNA, 18 nt, Haemophilus influenzae Rd
uuucauaagauaacaaga

SEQ ID NO: 705354 - RNA, 16 nt, Haemophilus influenzae Rd
uuucauaguuuucuga

SEQ ID NO: 705355 - RNA, 13 nt, Haemophilus influenzae Rd
uuucauauaaaua

SEQ ID NO: 705356 - RNA, 16 nt, Haemophilus influenzae Rd
uuucauaucuucuucu

SEQ ID NO: 705357 - RNA, 15 nt, Haemophilus influenzae Rd
uuucagcgaaacuug

SEQ ID NO: 705358 - RNA, 16 nt, Haemophilus influenzae Rd
uuucagcuaguccugc

SEQ ID NO: 705359 - RNA, 22 nt, Haemophilus influenzae Rd
uuucagcugcgaugcauacuug

SEQ ID NO: 705360 - RNA, 17 nt, Haemophilus influenzae Rd
uuucagcuuaaauacua

SEQ ID NO: 705361 - RNA, 21 nt, Haemophilus influenzae Rd
uuucagccuauuuuuagaaaa

SEQ ID NO: 705362 - RNA, 12 nt, Haemophilus influenzae Rd
uuucagaaaucg

SEQ ID NO: 705363 - RNA, 14 nt, Haemophilus influenzae Rd
uuucagacaaaacu

SEQ ID NO: 705364 - RNA, 16 nt, Haemophilus influenzae Rd
uuucacuuuacauuuc

SEQ ID NO: 705365 - RNA, 20 nt, Haemophilus influenzae Rd
uuucauuugcgccaauaaua

SEQ ID NO: 705366 - RNA, 21 nt, Haemophilus influenzae Rd
uuucauucaacaauucauaaa

SEQ ID NO: 705367 - RNA, 15 nt, Haemophilus influenzae Rd
uuucauuaaagaaga

SEQ ID NO: 705368 - RNA, 22 nt, Haemophilus influenzae Rd
uuucauuuuuuggugcauacgu

SEQ ID NO: 705369 - RNA, 18 nt, Haemophilus influenzae Rd
uuuccaaaaaccaacgcc

SEQ ID NO: 705370 - RNA, 16 nt, Haemophilus influenzae Rd
uuuccaaccaaucagu

SEQ ID NO: 705371 - RNA, 17 nt, Haemophilus influenzae Rd
uuuccaaacauuuuuau

SEQ ID NO: 705372 - RNA, 13 nt, Haemophilus influenzae Rd
uuuccaaguauuu

SEQ ID NO: 705373 - RNA, 21 nt, Haemophilus influenzae Rd
uuuccacgccuguggcaaaau

SEQ ID NO: 705374 - RNA, 18 nt, Haemophilus influenzae Rd
uuuccaagcguaaaagua

SEQ ID NO: 705375 - RNA, 21 nt, Haemophilus influenzae Rd
uuucaucuuccgugacaucau

SEQ ID NO: 705376 - RNA, 18 nt, Haemophilus influenzae Rd
uuucaucuuuuuauaaaa

SEQ ID NO: 705377 - RNA, 19 nt, Haemophilus influenzae Rd
uuucauuaauuuuauuuuu

SEQ ID NO: 705378 - RNA, 17 nt, Haemophilus influenzae Rd
uuucaucuggugaguga

SEQ ID NO: 705379 - RNA, 18 nt, Haemophilus influenzae Rd
uuucaucuacaccaaaac

SEQ ID NO: 705380 - RNA, 17 nt, Haemophilus influenzae Rd
uuucaucgcgcaaaaua

SEQ ID NO: 705381 - RNA, 18 nt, Haemophilus influenzae Rd
uuucaucgagaaauacga

SEQ ID NO: 705382 - RNA, 15 nt, Haemophilus influenzae Rd
uuucauccuaaaaaa

SEQ ID NO: 705383 - RNA, 19 nt, Haemophilus influenzae Rd
uuucauauuucuguauuau

SEQ ID NO: 705384 - RNA, 16 nt, Haemophilus influenzae Rd
uuucaucaaugccauu

SEQ ID NO: 705385 - RNA, 21 nt, Haemophilus influenzae Rd
uuuagcauaaaacaguauuuu

SEQ ID NO: 705386 - RNA, 12 nt, Haemophilus influenzae Rd
uuuagcccacca

SEQ ID NO: 705387 - RNA, 22 nt, Haemophilus influenzae Rd
uuuagcaucuagcuuaacaaca

SEQ ID NO: 705388 - RNA, 16 nt, Haemophilus influenzae Rd
uuuagcccgaaaauua

SEQ ID NO: 705389 - RNA, 14 nt, Haemophilus influenzae Rd
uuuagauauaaaaa

SEQ ID NO: 705390 - RNA, 19 nt, Haemophilus influenzae Rd
uuuagauaauaaaaaaaca

SEQ ID NO: 705391 - RNA, 22 nt, Haemophilus influenzae Rd
uuuagauuaucauuaaauauaa

SEQ ID NO: 705392 - RNA, 19 nt, Haemophilus influenzae Rd
uuuagauugcucaauauaa

SEQ ID NO: 705393 - RNA, 18 nt, Haemophilus influenzae Rd
uuuagauuugugaacuug

SEQ ID NO: 705394 - RNA, 19 nt, Haemophilus influenzae Rd
uuuagcaaggcguucaaua

SEQ ID NO: 705395 - RNA, 13 nt, Haemophilus influenzae Rd
uuuagacaacaac

SEQ ID NO: 705396 - RNA, 21 nt, Haemophilus influenzae Rd
uuuagaauccaaaauuacuuu

SEQ ID NO: 705397 - RNA, 16 nt, Haemophilus influenzae Rd
uuuagaauuuuuauuu

SEQ ID NO: 705398 - RNA, 23 nt, Haemophilus influenzae Rd
uuuagaacaauacucuuaacaaa

SEQ ID NO: 705399 - RNA, 15 nt, Haemophilus influenzae Rd
uuuagaacaauauuu

SEQ ID NO: 705400 - RNA, 19 nt, Haemophilus influenzae Rd
uuuagaacaauauuuauaa

SEQ ID NO: 705401 - RNA, 19 nt, Haemophilus influenzae Rd
uuuagucauacagaaacca

SEQ ID NO: 705402 - RNA, 21 nt, Haemophilus influenzae Rd
uuuagucauacagaaaccaga

SEQ ID NO: 705403 - RNA, 20 nt, Haemophilus influenzae Rd
uuuaguggcuaaauuaguuu

SEQ ID NO: 705404 - RNA, 17 nt, Haemophilus influenzae Rd
uuuagugguuugcaaag

SEQ ID NO: 705405 - RNA, 16 nt, Haemophilus influenzae Rd
uuuaguuucuaauucu

SEQ ID NO: 705406 - RNA, 17 nt, Haemophilus influenzae Rd
uuuaguuucuaauucuu

SEQ ID NO: 705407 - RNA, 16 nt, Haemophilus influenzae Rd
uuuaguugguaaagau

SEQ ID NO: 705408 - RNA, 12 nt, Haemophilus influenzae Rd
uuuaguuuuagg

SEQ ID NO: 705409 - RNA, 20 nt, Haemophilus influenzae Rd
uuuaguuuuuuuauaaaaaa

SEQ ID NO: 705410 - RNA, 13 nt, Haemophilus influenzae Rd
uuuaguuuacuuu

SEQ ID NO: 705411 - RNA, 21 nt, Haemophilus influenzae Rd
uuuauaaaaaaaucugcacuu

SEQ ID NO: 705412 - RNA, 22 nt, Haemophilus influenzae Rd
uuuaguaaaauaaaaaauccac

SEQ ID NO: 705413 - RNA, 20 nt, Haemophilus influenzae Rd
uuuaggguauuuauuauucu

SEQ ID NO: 705414 - RNA, 23 nt, Haemophilus influenzae Rd
uuuaggauuguugauuuugguuc

SEQ ID NO: 705415 - RNA, 21 nt, Haemophilus influenzae Rd
uuuagcuaaacgcucaaauaa

SEQ ID NO: 705416 - RNA, 21 nt, Haemophilus influenzae Rd
uuuagcucguugccauaaaaa

SEQ ID NO: 705417 - RNA, 19 nt, Haemophilus influenzae Rd
uuuacagguuugacauuca

SEQ ID NO: 705418 - RNA, 16 nt, Haemophilus influenzae Rd
uuuacacauugccaua

SEQ ID NO: 705419 - RNA, 14 nt, Haemophilus influenzae Rd
uuuacaccaacacu

SEQ ID NO: 705420 - RNA, 18 nt, Haemophilus influenzae Rd
uuuacaccaacggcauuu

SEQ ID NO: 705421 - RNA, 16 nt, Haemophilus influenzae Rd
uuuacauauaaaagug

SEQ ID NO: 705422 - RNA, 19 nt, Haemophilus influenzae Rd
uuuacauauaaagauugca

SEQ ID NO: 705423 - RNA, 22 nt, Haemophilus influenzae Rd
uuuacgagaaagguguaauucc

SEQ ID NO: 705424 - RNA, 18 nt, Haemophilus influenzae Rd
uuuacgauauuuuuauca

SEQ ID NO: 705425 - RNA, 18 nt, Haemophilus influenzae Rd
uuuacgauuucugccucu

SEQ ID NO: 705426 - RNA, 23 nt, Haemophilus influenzae Rd
uuuacgccccuacuuuaaagaau

SEQ ID NO: 705427 - RNA, 15 nt, Haemophilus influenzae Rd
uuuacguuucauuuu

SEQ ID NO: 705428 - RNA, 22 nt, Haemophilus influenzae Rd
uuuacuaaacguaacuaaaaaa

SEQ ID NO: 705429 - RNA, 20 nt, Haemophilus influenzae Rd
uuuacuaaaugcuguagaaa

SEQ ID NO: 705430 - RNA, 18 nt, Haemophilus influenzae Rd
uuuacguauguauuuuca

SEQ ID NO: 705431 - RNA, 18 nt, Haemophilus influenzae Rd
uuuacuggaaauucuuca

SEQ ID NO: 705432 - RNA, 22 nt, Haemophilus influenzae Rd
uuuacuuaaagcaccgcauuaa

SEQ ID NO: 705433 - RNA, 17 nt, Haemophilus influenzae Rd
uuuacuucacguuguac

SEQ ID NO: 705434 - RNA, 11 nt, Haemophilus influenzae Rd
uuuacuucauc

SEQ ID NO: 705435 - RNA, 18 nt, Haemophilus influenzae Rd
uuuacuucaucaaaacca

SEQ ID NO: 705436 - RNA, 13 nt, Haemophilus influenzae Rd
uuuacuugaccag

SEQ ID NO: 705437 - RNA, 19 nt, Haemophilus influenzae Rd
uuuagaaaaagaaaaccug

SEQ ID NO: 705438 - RNA, 15 nt, Haemophilus influenzae Rd
uuuacuuuuacaauc

SEQ ID NO: 705439 - RNA, 23 nt, Haemophilus influenzae Rd
uuuacuuuugauuuuauuuacuu

SEQ ID NO: 705440 - RNA, 15 nt, Haemophilus influenzae Rd
uuuacuuuauuuaac

SEQ ID NO: 705441 - RNA, 21 nt, Haemophilus influenzae Rd
uuuacuugcgauaucuucuaa

SEQ ID NO: 705442 - RNA, 21 nt, Haemophilus influenzae Rd
uuuacuuggcaaaugggugcu

SEQ ID NO: 705443 - RNA, 16 nt, Haemophilus influenzae Rd
uuuacugaauaaaaaa

SEQ ID NO: 705444 - RNA, 22 nt, Haemophilus influenzae Rd
uuuacucggcaccguuccugga

SEQ ID NO: 705445 - RNA, 15 nt, Haemophilus influenzae Rd
uuuacucguauaagc

SEQ ID NO: 705446 - RNA, 21 nt, Haemophilus influenzae Rd
uuuacugcuucauaaauguaa

SEQ ID NO: 705447 - RNA, 15 nt, Haemophilus influenzae Rd
uuuacugauucuucg

SEQ ID NO: 705448 - RNA, 12 nt, Haemophilus influenzae Rd
uuuacugauuua

SEQ ID NO: 705449 - RNA, 16 nt, Haemophilus influenzae Rd
uuuacugauuuaaaaa

SEQ ID NO: 705450 - RNA, 17 nt, Haemophilus influenzae Rd
uuuacugauuuaaaaaa

SEQ ID NO: 705451 - RNA, 20 nt, Haemophilus influenzae Rd
uuuacugauuuaaaaaaacg

SEQ ID NO: 705452 - RNA, 18 nt, Haemophilus influenzae Rd
uuuacugauuuuaagaaa

SEQ ID NO: 705453 - RNA, 16 nt, Haemophilus influenzae Rd
uuuacuaaauucuuuu

SEQ ID NO: 705454 - RNA, 22 nt, Haemophilus influenzae Rd
uuuacuauuaaaguguggauuu

SEQ ID NO: 705455 - RNA, 17 nt, Haemophilus influenzae Rd
uuuacuauuaaugcucu

SEQ ID NO: 705456 - RNA, 17 nt, Haemophilus influenzae Rd
uuuaucaagcacaauca

SEQ ID NO: 705457 - RNA, 19 nt, Haemophilus influenzae Rd
uuuauauuuuuucuuaaau

SEQ ID NO: 705458 - RNA, 15 nt, Haemophilus influenzae Rd
uuuaucaacuaaaaa

SEQ ID NO: 705459 - RNA, 16 nt, Haemophilus influenzae Rd
uuuaucaacuaaaaaa

SEQ ID NO: 705460 - RNA, 19 nt, Haemophilus influenzae Rd
uuuaucaacuaaaaaauag

SEQ ID NO: 705461 - RNA, 13 nt, Haemophilus influenzae Rd
uuuaucacaaguu

SEQ ID NO: 705462 - RNA, 16 nt, Haemophilus influenzae Rd
uuuaucacaaguuaaa

SEQ ID NO: 705463 - RNA, 22 nt, Haemophilus influenzae Rd
uuuaucaggcggguauuuauau

SEQ ID NO: 705464 - RNA, 13 nt, Haemophilus influenzae Rd
uuuauauaauuua

SEQ ID NO: 705465 - RNA, 16 nt, Haemophilus influenzae Rd
uuuauauauuaaaaaa

SEQ ID NO: 705466 - RNA, 14 nt, Haemophilus influenzae Rd
uuuauaguuuuauu

SEQ ID NO: 705467 - RNA, 20 nt, Haemophilus influenzae Rd
uuuauaucaagcugugcaaa

SEQ ID NO: 705468 - RNA, 20 nt, Haemophilus influenzae Rd
uuuauaugcaaauaaucucu

SEQ ID NO: 705469 - RNA, 13 nt, Haemophilus influenzae Rd
uuuauauuuauaa

SEQ ID NO: 705470 - RNA, 18 nt, Haemophilus influenzae Rd
uuuauauuuccaucaaaa

SEQ ID NO: 705471 - RNA, 22 nt, Haemophilus influenzae Rd
uuuauaaauuaauucucauaca

SEQ ID NO: 705472 - RNA, 14 nt, Haemophilus influenzae Rd
uuuauaacaaguua

SEQ ID NO: 705473 - RNA, 14 nt, Haemophilus influenzae Rd
uuuauaacguuaau

SEQ ID NO: 705474 - RNA, 13 nt, Haemophilus influenzae Rd
uuuauaagcuauu

SEQ ID NO: 705475 - RNA, 12 nt, Haemophilus influenzae Rd
uuuauaaguaau

SEQ ID NO: 705476 - RNA, 17 nt, Haemophilus influenzae Rd
uuuauaagugaaaugcu

SEQ ID NO: 705477 - RNA, 20 nt, Haemophilus influenzae Rd
uuuauaagugccaacaauau

SEQ ID NO: 705478 - RNA, 13 nt, Haemophilus influenzae Rd
uuuauaauagacu

SEQ ID NO: 705479 - RNA, 19 nt, Haemophilus influenzae Rd
uuuauaauagacugaaaaa

SEQ ID NO: 705480 - RNA, 20 nt, Haemophilus influenzae Rd
uuuauaauagacugaaaaaa

SEQ ID NO: 705481 - RNA, 20 nt, Haemophilus influenzae Rd
uuuauaaaguuuugcaucag

SEQ ID NO: 705482 - RNA, 16 nt, Haemophilus influenzae Rd
uuuauacuaaaaguac

SEQ ID NO: 705483 - RNA, 21 nt, Haemophilus influenzae Rd
uuuauacuaaaaguaccaaaa

SEQ ID NO: 705484 - RNA, 20 nt, Haemophilus influenzae Rd
uuuauagaaaugguuaccua

SEQ ID NO: 705485 - RNA, 16 nt, Haemophilus influenzae Rd
uuuauagcauuuaaau

SEQ ID NO: 705486 - RNA, 16 nt, Haemophilus influenzae Rd
uuuauagccuauaauu

SEQ ID NO: 705487 - RNA, 20 nt, Haemophilus influenzae Rd
uuuauagccuucugccauau

SEQ ID NO: 705488 - RNA, 15 nt, Haemophilus influenzae Rd
uuuauaauuaauaaa

SEQ ID NO: 705489 - RNA, 15 nt, Haemophilus influenzae Rd
uuuaucgucugcacg

SEQ ID NO: 705490 - RNA, 21 nt, Haemophilus influenzae Rd
uuuaucguguaaaaguuguuu

SEQ ID NO: 705491 - RNA, 12 nt, Haemophilus influenzae Rd
uuuaucuaaaaa

SEQ ID NO: 705492 - RNA, 16 nt, Haemophilus influenzae Rd
uuuaucgcucacuacg

SEQ ID NO: 705493 - RNA, 22 nt, Haemophilus influenzae Rd
uuuaucggauauuuuauuugga

SEQ ID NO: 705494 - RNA, 14 nt, Haemophilus influenzae Rd
uuuaucuauaaaaa

SEQ ID NO: 705495 - RNA, 15 nt, Haemophilus influenzae Rd
uuuaucucggcuaaa

SEQ ID NO: 705496 - RNA, 14 nt, Haemophilus influenzae Rd
uuuaucucuuucuu

SEQ ID NO: 705497 - RNA, 13 nt, Haemophilus influenzae Rd
uuuaucuugcuca

SEQ ID NO: 705498 - RNA, 16 nt, Haemophilus influenzae Rd
uuuaucuuuaaagaau

SEQ ID NO: 705499 - RNA, 18 nt, Haemophilus influenzae Rd
uuuaucuuuuacaucaau

SEQ ID NO: 705500 - RNA, 19 nt, Haemophilus influenzae Rd
uuuaucuuuuacaucaauu

SEQ ID NO: 705501 - RNA, 15 nt, Haemophilus influenzae Rd
uuuauccaugaugaa

SEQ ID NO: 705502 - RNA, 20 nt, Haemophilus influenzae Rd
uuuaucauugcuccacuucu

SEQ ID NO: 705503 - RNA, 10 nt, Haemophilus influenzae Rd
uuuaucaucu

SEQ ID NO: 705504 - RNA, 11 nt, Haemophilus influenzae Rd
uuuaucaucug

SEQ ID NO: 705505 - RNA, 16 nt, Haemophilus influenzae Rd
uuuaucaucugcauaa

SEQ ID NO: 705506 - RNA, 16 nt, Haemophilus influenzae Rd
uuuaucgagauuucuu

SEQ ID NO: 705507 - RNA, 19 nt, Haemophilus influenzae Rd
uuuauccuauuaauuuaau

SEQ ID NO: 705508 - RNA, 13 nt, Haemophilus influenzae Rd
uuuauccccuaca

SEQ ID NO: 705509 - RNA, 19 nt, Haemophilus influenzae Rd
uuuauccacaugauauauu

SEQ ID NO: 705510 - RNA, 12 nt, Haemophilus influenzae Rd
uuuaugauuaaa

SEQ ID NO: 705511 - RNA, 14 nt, Haemophilus influenzae Rd
uuuauggaaauaaa

SEQ ID NO: 705512 - RNA, 16 nt, Haemophilus influenzae Rd
uuuaugaccaaauaca

SEQ ID NO: 705513 - RNA, 23 nt, Haemophilus influenzae Rd
uuuaugaacucuguuugcauaua

SEQ ID NO: 705514 - RNA, 18 nt, Haemophilus influenzae Rd
uuuaucuucaaaauagua

SEQ ID NO: 705515 - RNA, 23 nt, Haemophilus influenzae Rd
uuuauggcuugugcuauacaaaa

SEQ ID NO: 705516 - RNA, 16 nt, Haemophilus influenzae Rd
uuuauuaauuauaaaa

SEQ ID NO: 705517 - RNA, 14 nt, Haemophilus influenzae Rd
uuuauuacaaacaa

SEQ ID NO: 705518 - RNA, 15 nt, Haemophilus influenzae Rd
uuuauuacauuaaaa

SEQ ID NO: 705519 - RNA, 20 nt, Haemophilus influenzae Rd
uuuauuacccuauucuaaau

SEQ ID NO: 705520 - RNA, 23 nt, Haemophilus influenzae Rd
uuuauuacccuauucuaaauuua

SEQ ID NO: 705521 - RNA, 20 nt, Haemophilus influenzae Rd
uuuauuaaaaguaaacaauu

SEQ ID NO: 705522 - RNA, 12 nt, Haemophilus influenzae Rd
uuuauuaaaaaa

SEQ ID NO: 705523 - RNA, 15 nt, Haemophilus influenzae Rd
uuuauuaagauauaa

SEQ ID NO: 705524 - RNA, 22 nt, Haemophilus influenzae Rd
uugcacuuuaaagaaauaaauu

SEQ ID NO: 705525 - RNA, 18 nt, Haemophilus influenzae Rd
uugcacuuucuauacuau

SEQ ID NO: 705526 - RNA, 21 nt, Haemophilus influenzae Rd
uugcacguucuucagcacuug

SEQ ID NO: 705527 - RNA, 16 nt, Haemophilus influenzae Rd
uugcauccacuucauc

SEQ ID NO: 705528 - RNA, 21 nt, Haemophilus influenzae Rd
uugcauauugaacuugagaaa

SEQ ID NO: 705529 - RNA, 22 nt, Haemophilus influenzae Rd
uugcaugauauuuuacguuuuu

SEQ ID NO: 705530 - RNA, 14 nt, Haemophilus influenzae Rd
uugcaucuucuauu

SEQ ID NO: 705531 - RNA, 15 nt, Haemophilus influenzae Rd
uugcauuuacauaaa

SEQ ID NO: 705532 - RNA, 22 nt, Haemophilus influenzae Rd
uugcauuggaaugguauaaaaa

SEQ ID NO: 705533 - RNA, 13 nt, Haemophilus influenzae Rd
uugcauuucuaaa

SEQ ID NO: 705534 - RNA, 16 nt, Haemophilus influenzae Rd
uugcauuuucuuccaa

SEQ ID NO: 705535 - RNA, 12 nt, Haemophilus influenzae Rd
uugccaaaaaag

SEQ ID NO: 705536 - RNA, 18 nt, Haemophilus influenzae Rd
uugcauucacaaaaguuu

SEQ ID NO: 705537 - RNA, 19 nt, Haemophilus influenzae Rd
uugcauucacaaaaguuug

SEQ ID NO: 705538 - RNA, 15 nt, Haemophilus influenzae Rd
uugcauugaguuuuu

SEQ ID NO: 705539 - RNA, 18 nt, Haemophilus influenzae Rd
uugccgacacuaaaaagc

SEQ ID NO: 705540 - RNA, 16 nt, Haemophilus influenzae Rd
uugccaaaauucuguu

SEQ ID NO: 705541 - RNA, 17 nt, Haemophilus influenzae Rd
uugccaauuacauugaa

SEQ ID NO: 705542 - RNA, 22 nt, Haemophilus influenzae Rd
uugccaauuauccgagagaaag

SEQ ID NO: 705543 - RNA, 23 nt, Haemophilus influenzae Rd
uugccaauugaauuaaaaguaga

SEQ ID NO: 705544 - RNA, 12 nt, Haemophilus influenzae Rd
uugccaauuuuu

SEQ ID NO: 705545 - RNA, 15 nt, Haemophilus influenzae Rd
uugccaaugccaaau

SEQ ID NO: 705546 - RNA, 20 nt, Haemophilus influenzae Rd
uugccuuuuaauaaacccuc

SEQ ID NO: 705547 - RNA, 13 nt, Haemophilus influenzae Rd
uugccuugugacu

SEQ ID NO: 705548 - RNA, 22 nt, Haemophilus influenzae Rd
uugccgcuuccacaccaaaaau

SEQ ID NO: 705549 - RNA, 18 nt, Haemophilus influenzae Rd
uugccgccaguaagaucu

SEQ ID NO: 705550 - RNA, 18 nt, Haemophilus influenzae Rd
uugcgugauuccaaaaau

SEQ ID NO: 705551 - RNA, 23 nt, Haemophilus influenzae Rd
uugcucaaaaucaaguuaaaaaa

SEQ ID NO: 705552 - RNA, 13 nt, Haemophilus influenzae Rd
uugcgucuucaag

SEQ ID NO: 705553 - RNA, 13 nt, Haemophilus influenzae Rd
uugcuaaaaagaa

SEQ ID NO: 705554 - RNA, 23 nt, Haemophilus influenzae Rd
uugcuaaaaagaaauaaaagaua

SEQ ID NO: 705555 - RNA, 19 nt, Haemophilus influenzae Rd
uugcucagccaguuuucua

SEQ ID NO: 705556 - RNA, 23 nt, Haemophilus influenzae Rd
uugcucagccaguuuucuagcuu

SEQ ID NO: 705557 - RNA, 17 nt, Haemophilus influenzae Rd
uugcucacuaauucccc

SEQ ID NO: 705558 - RNA, 18 nt, Haemophilus influenzae Rd
uugcucaauaauuucaau

SEQ ID NO: 705559 - RNA, 20 nt, Haemophilus influenzae Rd
uugcuguggaguuauuucuu

SEQ ID NO: 705560 - RNA, 18 nt, Haemophilus influenzae Rd
uugcugugguuuugugag

SEQ ID NO: 705561 - RNA, 13 nt, Haemophilus influenzae Rd
uugcuguguugau

SEQ ID NO: 705562 - RNA, 15 nt, Haemophilus influenzae Rd
uugcuguugguuaaa

SEQ ID NO: 705563 - RNA, 19 nt, Haemophilus influenzae Rd
uugcuguugguuaaaaaua

SEQ ID NO: 705564 - RNA, 22 nt, Haemophilus influenzae Rd
uugcuuagugaaaagaaaacuu

SEQ ID NO: 705565 - RNA, 23 nt, Haemophilus influenzae Rd
uugcuuaagugcgguauuuuuau

SEQ ID NO: 705566 - RNA, 13 nt, Haemophilus influenzae Rd
uugcuccacuucu

SEQ ID NO: 705567 - RNA, 23 nt, Haemophilus influenzae Rd
uugcugacaauuucuaaaaaucu

SEQ ID NO: 705568 - RNA, 17 nt, Haemophilus influenzae Rd
uugcugauaaauuccuu

SEQ ID NO: 705569 - RNA, 14 nt, Haemophilus influenzae Rd
uuggagauuuuuua

SEQ ID NO: 705570 - RNA, 23 nt, Haemophilus influenzae Rd
uuggagguuaaaaaauuaaaaga

SEQ ID NO: 705571 - RNA, 13 nt, Haemophilus influenzae Rd
uuggaguagugca

SEQ ID NO: 705572 - RNA, 13 nt, Haemophilus influenzae Rd
uuggaguuagaau

SEQ ID NO: 705573 - RNA, 20 nt, Haemophilus influenzae Rd
uuggaguucuugaauacaaa

SEQ ID NO: 705574 - RNA, 16 nt, Haemophilus influenzae Rd
uuggauaacaaauugc

SEQ ID NO: 705575 - RNA, 15 nt, Haemophilus influenzae Rd
uuggaauuucaaaau

SEQ ID NO: 705576 - RNA, 16 nt, Haemophilus influenzae Rd
uuggacaagaaauaau

SEQ ID NO: 705577 - RNA, 15 nt, Haemophilus influenzae Rd
uuggacacaauaaua

SEQ ID NO: 705578 - RNA, 12 nt, Haemophilus influenzae Rd
uuggaaaaguaa

SEQ ID NO: 705579 - RNA, 15 nt, Haemophilus influenzae Rd
uuggaaugcuaauca

SEQ ID NO: 705580 - RNA, 13 nt, Haemophilus influenzae Rd
uugcuuuuuaauu

SEQ ID NO: 705581 - RNA, 16 nt, Haemophilus influenzae Rd
uugcuuuuuuaauuug

SEQ ID NO: 705582 - RNA, 11 nt, Haemophilus influenzae Rd
uuggcauuuug

SEQ ID NO: 705583 - RNA, 19 nt, Haemophilus influenzae Rd
uuggccaauuugcauaugu

SEQ ID NO: 705584 - RNA, 20 nt, Haemophilus influenzae Rd
uuggcgaaccuucacuuaaa

SEQ ID NO: 705585 - RNA, 18 nt, Haemophilus influenzae Rd
uuggcgacaaugcguaau

SEQ ID NO: 705586 - RNA, 19 nt, Haemophilus influenzae Rd
uuggcgcaggcaaaccaag

SEQ ID NO: 705587 - RNA, 23 nt, Haemophilus influenzae Rd
uuggcuaaaccgauuuugacuuu

SEQ ID NO: 705588 - RNA, 18 nt, Haemophilus influenzae Rd
uugggcgacguuuuaagu

SEQ ID NO: 705589 - RNA, 19 nt, Haemophilus influenzae Rd
uugggcggaucgcuuguug

SEQ ID NO: 705590 - RNA, 14 nt, Haemophilus influenzae Rd
uugggcguaauguu

SEQ ID NO: 705591 - RNA, 23 nt, Haemophilus influenzae Rd
uugggcaagucccuguucaaauu

SEQ ID NO: 705592 - RNA, 20 nt, Haemophilus influenzae Rd
uugguacgagaaaaaucuuu

SEQ ID NO: 705593 - RNA, 22 nt, Haemophilus influenzae Rd
uugguaauuugcgucuuaaauu

SEQ ID NO: 705594 - RNA, 21 nt, Haemophilus influenzae Rd
uugggcuuuuucaaucgccuc

SEQ ID NO: 705595 - RNA, 15 nt, Haemophilus influenzae Rd
uugguaguuuuucac

SEQ ID NO: 705596 - RNA, 14 nt, Haemophilus influenzae Rd
uugguauaaauaau

SEQ ID NO: 705597 - RNA, 16 nt, Haemophilus influenzae Rd
uugguagccuuuauga

SEQ ID NO: 705598 - RNA, 15 nt, Haemophilus influenzae Rd
uugggcuuauuuguu

SEQ ID NO: 705599 - RNA, 13 nt, Haemophilus influenzae Rd
uugggcuaaaaau

SEQ ID NO: 705600 - RNA, 18 nt, Haemophilus influenzae Rd
uuggugggcaaauaaaga

SEQ ID NO: 705601 - RNA, 23 nt, Haemophilus influenzae Rd
uuggugguaagccguguucuagu

SEQ ID NO: 705602 - RNA, 15 nt, Haemophilus influenzae Rd
uuggugguuugugac

SEQ ID NO: 705603 - RNA, 15 nt, Haemophilus influenzae Rd
uuuaaccccugaauu

SEQ ID NO: 705604 - RNA, 22 nt, Haemophilus influenzae Rd
uuuaaccaguuuguguuuauuu

SEQ ID NO: 705605 - RNA, 19 nt, Haemophilus influenzae Rd
uuuaaccgcacuuaagaua

SEQ ID NO: 705606 - RNA, 17 nt, Haemophilus influenzae Rd
uuuaaccgcacuugcca

SEQ ID NO: 705607 - RNA, 22 nt, Haemophilus influenzae Rd
uuuaaccgcacuuuuaauuaau

SEQ ID NO: 705608 - RNA, 23 nt, Haemophilus influenzae Rd
uuuaaccgcacuuuuuaauaaaa

SEQ ID NO: 705609 - RNA, 20 nt, Haemophilus influenzae Rd
uuuaaccgcacuuuuuguuu

SEQ ID NO: 705610 - RNA, 16 nt, Haemophilus influenzae Rd
uuuaacugaauuaaau

SEQ ID NO: 705611 - RNA, 22 nt, Haemophilus influenzae Rd
uuuaacugcgauagaaucuaca

SEQ ID NO: 705612 - RNA, 18 nt, Haemophilus influenzae Rd
uuuaaguaguguuuuauu

SEQ ID NO: 705613 - RNA, 19 nt, Haemophilus influenzae Rd
uuuaaguaguguuuuauuu

SEQ ID NO: 705614 - RNA, 19 nt, Haemophilus influenzae Rd
uuuaauaaaacaaauguaa

SEQ ID NO: 705615 - RNA, 17 nt, Haemophilus influenzae Rd
uuuaauaaaaccauauu

SEQ ID NO: 705616 - RNA, 12 nt, Haemophilus influenzae Rd
uuuaauaaaaac

SEQ ID NO: 705617 - RNA, 20 nt, Haemophilus influenzae Rd
uuuaaguguuuacuauuaau

SEQ ID NO: 705618 - RNA, 19 nt, Haemophilus influenzae Rd
uuuaauaaaauguaagagu

SEQ ID NO: 705619 - RNA, 18 nt, Haemophilus influenzae Rd
uuuaauaaacggauugca

SEQ ID NO: 705620 - RNA, 14 nt, Haemophilus influenzae Rd
uuuaauaaagauaa

SEQ ID NO: 705621 - RNA, 22 nt, Haemophilus influenzae Rd
uuuaauaacauagaaaucacua

SEQ ID NO: 705622 - RNA, 19 nt, Haemophilus influenzae Rd
uuuaauaagaauuuuaauc

SEQ ID NO: 705623 - RNA, 17 nt, Haemophilus influenzae Rd
uuuaauaagauuuuuaa

SEQ ID NO: 705624 - RNA, 21 nt, Haemophilus influenzae Rd
uuuaauucaggugggaaauaa

SEQ ID NO: 705625 - RNA, 23 nt, Haemophilus influenzae Rd
uuuaauucgugcaaauuuuuuca

SEQ ID NO: 705626 - RNA, 13 nt, Haemophilus influenzae Rd
uuuaauucuaaau

SEQ ID NO: 705627 - RNA, 18 nt, Haemophilus influenzae Rd
uuuaauucuaaauucuca

SEQ ID NO: 705628 - RNA, 14 nt, Haemophilus influenzae Rd
uuuaauagaauuuu

SEQ ID NO: 705629 - RNA, 19 nt, Haemophilus influenzae Rd
uuuaauaccauacauaaaa

SEQ ID NO: 705630 - RNA, 17 nt, Haemophilus influenzae Rd
uuuaauaaggcaaaacc

SEQ ID NO: 705631 - RNA, 20 nt, Haemophilus influenzae Rd
uuuaauaaucgaaaaaguuc

SEQ ID NO: 705632 - RNA, 18 nt, Haemophilus influenzae Rd
uuuaauaaucuuaaauaa

SEQ ID NO: 705633 - RNA, 19 nt, Haemophilus influenzae Rd
uuuaauaaugaaagggaaa

SEQ ID NO: 705634 - RNA, 19 nt, Haemophilus influenzae Rd
uuuaauacaaucuguccau

SEQ ID NO: 705635 - RNA, 15 nt, Haemophilus influenzae Rd
uuuaauuaaagccac

SEQ ID NO: 705636 - RNA, 22 nt, Haemophilus influenzae Rd
uuuaauuaaagccacauaauaa

SEQ ID NO: 705637 - RNA, 15 nt, Haemophilus influenzae Rd
uuuaauucugcccuu

SEQ ID NO: 705638 - RNA, 20 nt, Haemophilus influenzae Rd
uuuaauucugcccuuuuuca

SEQ ID NO: 705639 - RNA, 20 nt, Haemophilus influenzae Rd
uuuaauucuucgauuaguuu

SEQ ID NO: 705640 - RNA, 23 nt, Haemophilus influenzae Rd
uuuaauugacguucuugcucagc

SEQ ID NO: 705641 - RNA, 17 nt, Haemophilus influenzae Rd
uuuaauuggaaauaaua

SEQ ID NO: 705642 - RNA, 24 nt, Haemophilus influenzae Rd
uuuaauuggaaauaauauucaaaa

SEQ ID NO: 705643 - RNA, 16 nt, Haemophilus influenzae Rd
uuuaauugucguugaa

SEQ ID NO: 705644 - RNA, 20 nt, Haemophilus influenzae Rd
uuuaauugucguugaacuca

SEQ ID NO: 705645 - RNA, 15 nt, Haemophilus influenzae Rd
uuuaauugugcaauu

SEQ ID NO: 705646 - RNA, 15 nt, Haemophilus influenzae Rd
uuuaauuuaaauaaa

SEQ ID NO: 705647 - RNA, 13 nt, Haemophilus influenzae Rd
uuuaauuuuaugc

SEQ ID NO: 705648 - RNA, 14 nt, Haemophilus influenzae Rd
uuuaauuuuccaaa

SEQ ID NO: 705649 - RNA, 12 nt, Haemophilus influenzae Rd
uuuaauuuugaa

SEQ ID NO: 705650 - RNA, 20 nt, Haemophilus influenzae Rd
uuuaauuucauucaacaauu

SEQ ID NO: 705651 - RNA, 18 nt, Haemophilus influenzae Rd
uuuaauuugccccaauau

SEQ ID NO: 705652 - RNA, 14 nt, Haemophilus influenzae Rd
uuuaauuuggugcu

SEQ ID NO: 705653 - RNA, 22 nt, Haemophilus influenzae Rd
uuuaacaggaauuugcucaaua

SEQ ID NO: 705654 - RNA, 22 nt, Haemophilus influenzae Rd
uuuaaccacuugucauuaaaaa

SEQ ID NO: 705655 - RNA, 15 nt, Haemophilus influenzae Rd
uuuaacauaacuuuc

SEQ ID NO: 705656 - RNA, 12 nt, Haemophilus influenzae Rd
uuuaacauaauu

SEQ ID NO: 705657 - RNA, 21 nt, Haemophilus influenzae Rd
uuuaaaucuucuaucuacuac

SEQ ID NO: 705658 - RNA, 16 nt, Haemophilus influenzae Rd
uuuaaaacuauaaaaa

SEQ ID NO: 705659 - RNA, 12 nt, Haemophilus influenzae Rd
uuuaaaaguuua

SEQ ID NO: 705660 - RNA, 20 nt, Haemophilus influenzae Rd
uuuaaaauacugcacaauca

SEQ ID NO: 705661 - RNA, 17 nt, Haemophilus influenzae Rd
uuuaaaauagaaugaaa

SEQ ID NO: 705662 - RNA, 12 nt, Haemophilus influenzae Rd
uuuaaaauaguu

SEQ ID NO: 705663 - RNA, 19 nt, Haemophilus influenzae Rd
uuuaaaauauauauuaucg

SEQ ID NO: 705664 - RNA, 12 nt, Haemophilus influenzae Rd
uuuaaaaucgcu

SEQ ID NO: 705665 - RNA, 16 nt, Haemophilus influenzae Rd
uuuaaauaaccaauau

SEQ ID NO: 705666 - RNA, 17 nt, Haemophilus influenzae Rd
uuuaaauaauuaaaaau

SEQ ID NO: 705667 - RNA, 19 nt, Haemophilus influenzae Rd
uuuaaauaauuaaaaauaa

SEQ ID NO: 705668 - RNA, 12 nt, Haemophilus influenzae Rd
uuguuuuuccaa

SEQ ID NO: 705669 - RNA, 18 nt, Haemophilus influenzae Rd
uuguuuuugccaaaauuc

SEQ ID NO: 705670 - RNA, 21 nt, Haemophilus influenzae Rd
uuguuuuugcuuucagauuca

SEQ ID NO: 705671 - RNA, 11 nt, Haemophilus influenzae Rd
uuguuuuaaaa

SEQ ID NO: 705672 - RNA, 21 nt, Haemophilus influenzae Rd
uuguuuucaggauagagaaac

SEQ ID NO: 705673 - RNA, 12 nt, Haemophilus influenzae Rd
uuguuuuccaaa

SEQ ID NO: 705674 - RNA, 18 nt, Haemophilus influenzae Rd
uuguuguucuaacauuuu

SEQ ID NO: 705675 - RNA, 20 nt, Haemophilus influenzae Rd
uuguuguaaauugguuuuau

SEQ ID NO: 705676 - RNA, 23 nt, Haemophilus influenzae Rd
uuguuggcauauucgcaccuuca

SEQ ID NO: 705677 - RNA, 21 nt, Haemophilus influenzae Rd
uuguuggcggaauuauguauu

SEQ ID NO: 705678 - RNA, 17 nt, Haemophilus influenzae Rd
uuguucugacacuuccc

SEQ ID NO: 705679 - RNA, 17 nt, Haemophilus influenzae Rd
uugucauuaaaaaauaa

SEQ ID NO: 705680 - RNA, 13 nt, Haemophilus influenzae Rd
uugucaucagaaa

SEQ ID NO: 705681 - RNA, 12 nt, Haemophilus influenzae Rd
uuguauaaaaau

SEQ ID NO: 705682 - RNA, 20 nt, Haemophilus influenzae Rd
uuguauaagauuaaugauaa

SEQ ID NO: 705683 - RNA, 19 nt, Haemophilus influenzae Rd
uuguacaacagcaauaagc

SEQ ID NO: 705684 - RNA, 21 nt, Haemophilus influenzae Rd
uuguacaacagcaauaagcaa

SEQ ID NO: 705685 - RNA, 14 nt, Haemophilus influenzae Rd
uuguacaucccaua

SEQ ID NO: 705686 - RNA, 16 nt, Haemophilus influenzae Rd
uuguacaucccauaua

SEQ ID NO: 705687 - RNA, 13 nt, Haemophilus influenzae Rd
uuguacuucagug

SEQ ID NO: 705688 - RNA, 15 nt, Haemophilus influenzae Rd
uuguaccaaucaaag

SEQ ID NO: 705689 - RNA, 14 nt, Haemophilus influenzae Rd
uuguacgccacaua

SEQ ID NO: 705690 - RNA, 15 nt, Haemophilus influenzae Rd
uugguuaaaaauagc

SEQ ID NO: 705691 - RNA, 15 nt, Haemophilus influenzae Rd
uugguucgauaaaca

SEQ ID NO: 705692 - RNA, 16 nt, Haemophilus influenzae Rd
uugguucgauaaacau

SEQ ID NO: 705693 - RNA, 19 nt, Haemophilus influenzae Rd
uuguaaugcuuuuagugcu

SEQ ID NO: 705694 - RNA, 19 nt, Haemophilus influenzae Rd
uuguaaugucgugaaagaa

SEQ ID NO: 705695 - RNA, 15 nt, Haemophilus influenzae Rd
uuguaauugauuuuc

SEQ ID NO: 705696 - RNA, 18 nt, Haemophilus influenzae Rd
uuguaauugauuuucaga

SEQ ID NO: 705697 - RNA, 22 nt, Haemophilus influenzae Rd
uuguaauugauuuucagaaagu

SEQ ID NO: 705698 - RNA, 13 nt, Haemophilus influenzae Rd
uuguaauugcucu

SEQ ID NO: 705699 - RNA, 16 nt, Haemophilus influenzae Rd
uuguaaucuucauacu

SEQ ID NO: 705700 - RNA, 16 nt, Haemophilus influenzae Rd
uuguguuuuagaaagc

SEQ ID NO: 705701 - RNA, 17 nt, Haemophilus influenzae Rd
uuguggaauaaaauaau

SEQ ID NO: 705702 - RNA, 19 nt, Haemophilus influenzae Rd
uuguggcaaucguucuaaa

SEQ ID NO: 705703 - RNA, 20 nt, Haemophilus influenzae Rd
uuguggcaguaaaggcacuu

SEQ ID NO: 705704 - RNA, 16 nt, Haemophilus influenzae Rd
uugugcuauacaaaau

SEQ ID NO: 705705 - RNA, 18 nt, Haemophilus influenzae Rd
uugugcuauacaaaauuu

SEQ ID NO: 705706 - RNA, 16 nt, Haemophilus influenzae Rd
uugugcgcguaccaaa

SEQ ID NO: 705707 - RNA, 19 nt, Haemophilus influenzae Rd
uuguuagcggauaaaauaa

SEQ ID NO: 705708 - RNA, 15 nt, Haemophilus influenzae Rd
uuguuagaucaaauu

SEQ ID NO: 705709 - RNA, 15 nt, Haemophilus influenzae Rd
uuguuacuaaaauaa

SEQ ID NO: 705710 - RNA, 13 nt, Haemophilus influenzae Rd
uuguuccacauua

SEQ ID NO: 705711 - RNA, 17 nt, Haemophilus influenzae Rd
uuguuccacgagaaaag

SEQ ID NO: 705712 - RNA, 23 nt, Haemophilus influenzae Rd
uuguuccacuucauaaauccaau

SEQ ID NO: 705713 - RNA, 19 nt, Haemophilus influenzae Rd
uuguuacucgcaucaauau

SEQ ID NO: 705714 - RNA, 11 nt, Haemophilus influenzae Rd
uugugauuacu

SEQ ID NO: 705715 - RNA, 15 nt, Haemophilus influenzae Rd
uugugauguucuaaa

SEQ ID NO: 705716 - RNA, 16 nt, Haemophilus influenzae Rd
uugugcacagauuuua

SEQ ID NO: 705717 - RNA, 22 nt, Haemophilus influenzae Rd
uugugcaagaaauugauauaaa

SEQ ID NO: 705718 - RNA, 17 nt, Haemophilus influenzae Rd
uugugcagaauauugua

SEQ ID NO: 705719 - RNA, 20 nt, Haemophilus influenzae Rd
uugugcagaauauuguaaug

SEQ ID NO: 705720 - RNA, 20 nt, Haemophilus influenzae Rd
uugugccagcuggaaauucc

SEQ ID NO: 705721 - RNA, 21 nt, Haemophilus influenzae Rd
uugugccagcuggaaauucca

SEQ ID NO: 705722 - RNA, 14 nt, Haemophilus influenzae Rd
uugugccaauacuu

SEQ ID NO: 705723 - RNA, 16 nt, Haemophilus influenzae Rd
uugugcgguucauaag

SEQ ID NO: 705724 - RNA, 16 nt, Haemophilus influenzae Rd
uugugcgauuaacaau

SEQ ID NO: 705725 - RNA, 14 nt, Haemophilus influenzae Rd
uugugcuaaauaau

SEQ ID NO: 705726 - RNA, 15 nt, Haemophilus influenzae Rd
uugugcuaaauuuuu

SEQ ID NO: 705727 - RNA, 13 nt, Haemophilus influenzae Rd
uuguccgccauca

SEQ ID NO: 705728 - RNA, 17 nt, Haemophilus influenzae Rd
uugucgcgccaccaucu

SEQ ID NO: 705729 - RNA, 18 nt, Haemophilus influenzae Rd
uugucgcgccaccaucua

SEQ ID NO: 705730 - RNA, 19 nt, Haemophilus influenzae Rd
uuguccgauaguggcaccg

SEQ ID NO: 705731 - RNA, 22 nt, Haemophilus influenzae Rd
uugucccgcauauaaaauaaag

SEQ ID NO: 705732 - RNA, 21 nt, Haemophilus influenzae Rd
uugucuauuuuauuugccuug

SEQ ID NO: 705733 - RNA, 12 nt, Haemophilus influenzae Rd
uucuuuaaaaca

SEQ ID NO: 705734 - RNA, 20 nt, Haemophilus influenzae Rd
uucuuuaaaauuauaauauu

SEQ ID NO: 705735 - RNA, 21 nt, Haemophilus influenzae Rd
uucuucuuucauuugaacaau

SEQ ID NO: 705736 - RNA, 16 nt, Haemophilus influenzae Rd
uucuuuaacuugcucu

SEQ ID NO: 705737 - RNA, 13 nt, Haemophilus influenzae Rd
uucuuuaaaggca

SEQ ID NO: 705738 - RNA, 16 nt, Haemophilus influenzae Rd
uucuuuaaauauucaa

SEQ ID NO: 705739 - RNA, 15 nt, Haemophilus influenzae Rd
uucuuuauuaaacaa

SEQ ID NO: 705740 - RNA, 13 nt, Haemophilus influenzae Rd
uucuuuauucguu

SEQ ID NO: 705741 - RNA, 14 nt, Haemophilus influenzae Rd
uucuuuauucguuu

SEQ ID NO: 705742 - RNA, 15 nt, Haemophilus influenzae Rd
uucuuuagcugcaau

SEQ ID NO: 705743 - RNA, 21 nt, Haemophilus influenzae Rd
uucuuuaccuugcauuucuuu

SEQ ID NO: 705744 - RNA, 17 nt, Haemophilus influenzae Rd
uucuuuaauuucuucaa

SEQ ID NO: 705745 - RNA, 17 nt, Haemophilus influenzae Rd
uucuuucguucaaccca

SEQ ID NO: 705746 - RNA, 15 nt, Haemophilus influenzae Rd
uucuuuccauuuuuu

SEQ ID NO: 705747 - RNA, 12 nt, Haemophilus influenzae Rd
uucuuucauuug

SEQ ID NO: 705748 - RNA, 14 nt, Haemophilus influenzae Rd
uucuuuugccauau

SEQ ID NO: 705749 - RNA, 11 nt, Haemophilus influenzae Rd
uucuuuuucaa

SEQ ID NO: 705750 - RNA, 16 nt, Haemophilus influenzae Rd
uucuuuugcuaguaag

SEQ ID NO: 705751 - RNA, 12 nt, Haemophilus influenzae Rd
uucuuuuggaua

SEQ ID NO: 705752 - RNA, 20 nt, Haemophilus influenzae Rd
uugaaaacgucgauccauug

SEQ ID NO: 705753 - RNA, 22 nt, Haemophilus influenzae Rd
uugaaaaauuauugcauuuuua

SEQ ID NO: 705754 - RNA, 22 nt, Haemophilus influenzae Rd
uugaaaagaaaguauuaaauau

SEQ ID NO: 705755 - RNA, 16 nt, Haemophilus influenzae Rd
uugaaaagaaauauau

SEQ ID NO: 705756 - RNA, 13 nt, Haemophilus influenzae Rd
uugaaaagaauuu

SEQ ID NO: 705757 - RNA, 17 nt, Haemophilus influenzae Rd
uugaaaaucucuauaau

SEQ ID NO: 705758 - RNA, 14 nt, Haemophilus influenzae Rd
uugaaguaaugcga

SEQ ID NO: 705759 - RNA, 15 nt, Haemophilus influenzae Rd
uugaaguacauucaa

SEQ ID NO: 705760 - RNA, 18 nt, Haemophilus influenzae Rd
uugaaguacauucaagcc

SEQ ID NO: 705761 - RNA, 16 nt, Haemophilus influenzae Rd
uugaagaucuucauau

SEQ ID NO: 705762 - RNA, 22 nt, Haemophilus influenzae Rd
uugaaauugucguccuucaaau

SEQ ID NO: 705763 - RNA, 13 nt, Haemophilus influenzae Rd
uugaagucuuaau

SEQ ID NO: 705764 - RNA, 22 nt, Haemophilus influenzae Rd
uugaaggucauacgaucuacau

SEQ ID NO: 705765 - RNA, 21 nt, Haemophilus influenzae Rd
uugaauaauggcuuuucucaa

SEQ ID NO: 705766 - RNA, 19 nt, Haemophilus influenzae Rd
uugaauaauuacuugcucu

SEQ ID NO: 705767 - RNA, 14 nt, Haemophilus influenzae Rd
uugaauaauaacgu

SEQ ID NO: 705768 - RNA, 15 nt, Haemophilus influenzae Rd
uugaauaccugauuu

SEQ ID NO: 705769 - RNA, 22 nt, Haemophilus influenzae Rd
uugaauagcaagaacaauuaau

SEQ ID NO: 705770 - RNA, 16 nt, Haemophilus influenzae Rd
uugaauaguaaagaau

SEQ ID NO: 705771 - RNA, 13 nt, Haemophilus influenzae Rd
uugacauacuuug

SEQ ID NO: 705772 - RNA, 14 nt, Haemophilus influenzae Rd
uugacauacuuugu

SEQ ID NO: 705773 - RNA, 22 nt, Haemophilus influenzae Rd
uugacauacuuuguugaaugcc

SEQ ID NO: 705774 - RNA, 15 nt, Haemophilus influenzae Rd
uugacauaauuucac

SEQ ID NO: 705775 - RNA, 15 nt, Haemophilus influenzae Rd
uugacauauucuguu

SEQ ID NO: 705776 - RNA, 21 nt, Haemophilus influenzae Rd
uugacauuccuauucuaaaua

SEQ ID NO: 705777 - RNA, 15 nt, Haemophilus influenzae Rd
uugacauuuuacuuu

SEQ ID NO: 705778 - RNA, 12 nt, Haemophilus influenzae Rd
uugaauaugaug

SEQ ID NO: 705779 - RNA, 15 nt, Haemophilus influenzae Rd
uugaauauuuaguuu

SEQ ID NO: 705780 - RNA, 22 nt, Haemophilus influenzae Rd
uugaauaucuaaaugacgugcu

SEQ ID NO: 705781 - RNA, 15 nt, Haemophilus influenzae Rd
uugaaucauuucauc

SEQ ID NO: 705782 - RNA, 14 nt, Haemophilus influenzae Rd
uugaaucuaauccu

SEQ ID NO: 705783 - RNA, 15 nt, Haemophilus influenzae Rd
uugagaucuuugcca

SEQ ID NO: 705784 - RNA, 16 nt, Haemophilus influenzae Rd
uugagaucuuugccaa

SEQ ID NO: 705785 - RNA, 18 nt, Haemophilus influenzae Rd
uugagcaaaggcuguuuu

SEQ ID NO: 705786 - RNA, 15 nt, Haemophilus influenzae Rd
uugagcaaaucaaaa

SEQ ID NO: 705787 - RNA, 23 nt, Haemophilus influenzae Rd
uugagcaaaucaaaaccuuucug

SEQ ID NO: 705788 - RNA, 14 nt, Haemophilus influenzae Rd
uugagauuuaaucc

SEQ ID NO: 705789 - RNA, 16 nt, Haemophilus influenzae Rd
uugagcaauccaauca

SEQ ID NO: 705790 - RNA, 20 nt, Haemophilus influenzae Rd
uugagcaagaacuugauaau

SEQ ID NO: 705791 - RNA, 22 nt, Haemophilus influenzae Rd
uugagcacuucuguaccugcau

SEQ ID NO: 705792 - RNA, 16 nt, Haemophilus influenzae Rd
uugacguuguucuucu

SEQ ID NO: 705793 - RNA, 20 nt, Haemophilus influenzae Rd
uugacguaaaaguuuuccga

SEQ ID NO: 705794 - RNA, 22 nt, Haemophilus influenzae Rd
uugaccgaaaaccgaaaaaaua

SEQ ID NO: 705795 - RNA, 20 nt, Haemophilus influenzae Rd
uugaggggaauuuuuuacug

SEQ ID NO: 705796 - RNA, 20 nt, Haemophilus influenzae Rd
uugauaccaagauaauaaag

SEQ ID NO: 705797 - RNA, 20 nt, Haemophilus influenzae Rd
uugauauaaauuguuuuucc

SEQ ID NO: 705798 - RNA, 18 nt, Haemophilus influenzae Rd
uugauauaaguucuaaau

SEQ ID NO: 705799 - RNA, 20 nt, Haemophilus influenzae Rd
uugauauaaguucuaaauaa

SEQ ID NO: 705800 - RNA, 22 nt, Haemophilus influenzae Rd
uugauauaccauucuuucaaua

SEQ ID NO: 705801 - RNA, 23 nt, Haemophilus influenzae Rd
uugauauaccauucuuucaauaa

SEQ ID NO: 705802 - RNA, 19 nt, Haemophilus influenzae Rd
uugauagcugccgaauaga

SEQ ID NO: 705803 - RNA, 20 nt, Haemophilus influenzae Rd
uugauagcugccgaauagau

SEQ ID NO: 705804 - RNA, 18 nt, Haemophilus influenzae Rd
uugauagacaauauaauu

SEQ ID NO: 705805 - RNA, 22 nt, Haemophilus influenzae Rd
uugauagguauaaauggcaucu

SEQ ID NO: 705806 - RNA, 16 nt, Haemophilus influenzae Rd
uugcacccacuaaaau

SEQ ID NO: 705807 - RNA, 21 nt, Haemophilus influenzae Rd
uugcacccgccauaaaacaca

SEQ ID NO: 705808 - RNA, 11 nt, Haemophilus influenzae Rd
uugcaccuucu

SEQ ID NO: 705809 - RNA, 14 nt, Haemophilus influenzae Rd
uugcaaauuuuuca

SEQ ID NO: 705810 - RNA, 22 nt, Haemophilus influenzae Rd
uugcacaauuuggcgcauuaaa

SEQ ID NO: 705811 - RNA, 14 nt, Haemophilus influenzae Rd
uugcaacuaauagc

SEQ ID NO: 705812 - RNA, 13 nt, Haemophilus influenzae Rd
uugauucacuaau

SEQ ID NO: 705813 - RNA, 12 nt, Haemophilus influenzae Rd
uugcaaaccaaa

SEQ ID NO: 705814 - RNA, 14 nt, Haemophilus influenzae Rd
uugauuaucaaggc

SEQ ID NO: 705815 - RNA, 21 nt, Haemophilus influenzae Rd
uugauuaagucgauaaagaau

SEQ ID NO: 705816 - RNA, 13 nt, Haemophilus influenzae Rd
uugauuaccacga

SEQ ID NO: 705817 - RNA, 19 nt, Haemophilus influenzae Rd
uugauuacccauuaauggu

SEQ ID NO: 705818 - RNA, 19 nt, Haemophilus influenzae Rd
uugaugcucugcauaaaag

SEQ ID NO: 705819 - RNA, 22 nt, Haemophilus influenzae Rd
uugauguaaaaacucgaauaga

SEQ ID NO: 705820 - RNA, 18 nt, Haemophilus influenzae Rd
uugauguaaaagauaaaa

SEQ ID NO: 705821 - RNA, 23 nt, Haemophilus influenzae Rd
uugauguuuuugaaguaaaaaaa

SEQ ID NO: 705822 - RNA, 22 nt, Haemophilus influenzae Rd
uugauccccauacaaguauuuu

SEQ ID NO: 705823 - RNA, 18 nt, Haemophilus influenzae Rd
uugaucaccuaucacaaa

SEQ ID NO: 705824 - RNA, 15 nt, Haemophilus influenzae Rd
uucuguuuugccugc

SEQ ID NO: 705825 - RNA, 13 nt, Haemophilus influenzae Rd
uucuguuuuuacc

SEQ ID NO: 705826 - RNA, 15 nt, Haemophilus influenzae Rd
uucuguuuuuccauu

SEQ ID NO: 705827 - RNA, 14 nt, Haemophilus influenzae Rd
uucuuaaaauaccc

SEQ ID NO: 705828 - RNA, 22 nt, Haemophilus influenzae Rd
uucuuaaaauacccauaaaauu

SEQ ID NO: 705829 - RNA, 14 nt, Haemophilus influenzae Rd
uucuguguuuuguc

SEQ ID NO: 705830 - RNA, 17 nt, Haemophilus influenzae Rd
uucuguugggaauaauu

SEQ ID NO: 705831 - RNA, 19 nt, Haemophilus influenzae Rd
uucuguugggaauaauucu

SEQ ID NO: 705832 - RNA, 12 nt, Haemophilus influenzae Rd
uucugcuacuug

SEQ ID NO: 705833 - RNA, 18 nt, Haemophilus influenzae Rd
uucugcgcuaaauaagcu

SEQ ID NO: 705834 - RNA, 24 nt, Haemophilus influenzae Rd
uucugccucuguauuuuucauauc

SEQ ID NO: 705835 - RNA, 18 nt, Haemophilus influenzae Rd
uucuguauuaucuaauua

SEQ ID NO: 705836 - RNA, 21 nt, Haemophilus influenzae Rd
uucuguauuaucuaauuauuu

SEQ ID NO: 705837 - RNA, 20 nt, Haemophilus influenzae Rd
uucugucauuuauggaaaua

SEQ ID NO: 705838 - RNA, 19 nt, Haemophilus influenzae Rd
uucuucgcuccaaucauca

SEQ ID NO: 705839 - RNA, 17 nt, Haemophilus influenzae Rd
uucuucgaugcuuuuuc

SEQ ID NO: 705840 - RNA, 22 nt, Haemophilus influenzae Rd
uucuucgccuuagccuguucuu

SEQ ID NO: 705841 - RNA, 17 nt, Haemophilus influenzae Rd
uucuucggcgaggcauu

SEQ ID NO: 705842 - RNA, 23 nt, Haemophilus influenzae Rd
uucuucugcggucaucucuuguu

SEQ ID NO: 705843 - RNA, 21 nt, Haemophilus influenzae Rd
uucuucuaguuuuccuuucuu

SEQ ID NO: 705844 - RNA, 21 nt, Haemophilus influenzae Rd
uucuucuaauucaguguaaug

SEQ ID NO: 705845 - RNA, 16 nt, Haemophilus influenzae Rd
uucuucuacaccuucu

SEQ ID NO: 705846 - RNA, 22 nt, Haemophilus influenzae Rd
uucuucuaacauuucuuuuggc

SEQ ID NO: 705847 - RNA, 17 nt, Haemophilus influenzae Rd
uucuuaugaaaaaaaau

SEQ ID NO: 705848 - RNA, 22 nt, Haemophilus influenzae Rd
uucuuauagauaaaauguugaa

SEQ ID NO: 705849 - RNA, 15 nt, Haemophilus influenzae Rd
uucucaauugcaaaa

SEQ ID NO: 705850 - RNA, 18 nt, Haemophilus influenzae Rd
uucucaauugcaaaauca

SEQ ID NO: 705851 - RNA, 19 nt, Haemophilus influenzae Rd
uucucaauaaauaucuaaa

SEQ ID NO: 705852 - RNA, 23 nt, Haemophilus influenzae Rd
uucuccgauacauaauacuggca

SEQ ID NO: 705853 - RNA, 23 nt, Haemophilus influenzae Rd
uucucccgccgcauaggccucag

SEQ ID NO: 705854 - RNA, 21 nt, Haemophilus influenzae Rd
uucucuagccgaacaagcccc

SEQ ID NO: 705855 - RNA, 15 nt, Haemophilus influenzae Rd
uucucuaguguugcu

SEQ ID NO: 705856 - RNA, 14 nt, Haemophilus influenzae Rd
uucucuauaauuac

SEQ ID NO: 705857 - RNA, 22 nt, Haemophilus influenzae Rd
uucucugccgcuucgcuaaacc

SEQ ID NO: 705858 - RNA, 15 nt, Haemophilus influenzae Rd
uucucuuuucucaag

SEQ ID NO: 705859 - RNA, 12 nt, Haemophilus influenzae Rd
uucucuuuuuau

SEQ ID NO: 705860 - RNA, 23 nt, Haemophilus influenzae Rd
uucucuugcguuugguucaucau

SEQ ID NO: 705861 - RNA, 15 nt, Haemophilus influenzae Rd
uucugccuaauaagc

SEQ ID NO: 705862 - RNA, 18 nt, Haemophilus influenzae Rd
uucugccgcgccacaagc

SEQ ID NO: 705863 - RNA, 14 nt, Haemophilus influenzae Rd
uucugcauuuaaug

SEQ ID NO: 705864 - RNA, 22 nt, Haemophilus influenzae Rd
uucugccauuucaggaucgucu

SEQ ID NO: 705865 - RNA, 20 nt, Haemophilus influenzae Rd
uucugauuuagguuucaauu

SEQ ID NO: 705866 - RNA, 22 nt, Haemophilus influenzae Rd
uucugauuuagguuucaauuua

SEQ ID NO: 705867 - RNA, 19 nt, Haemophilus influenzae Rd
uucugcagcguuugcugcc

SEQ ID NO: 705868 - RNA, 20 nt, Haemophilus influenzae Rd
uucugcagcguuugcugccu

SEQ ID NO: 705869 - RNA, 16 nt, Haemophilus influenzae Rd
uucugcaucaauaauu

SEQ ID NO: 705870 - RNA, 20 nt, Haemophilus influenzae Rd
uucugcaguuuuuuguuuuu

SEQ ID NO: 705871 - RNA, 13 nt, Haemophilus influenzae Rd
uucugcauaaaau

SEQ ID NO: 705872 - RNA, 20 nt, Haemophilus influenzae Rd
uucgggaugugaauauccaa

SEQ ID NO: 705873 - RNA, 17 nt, Haemophilus influenzae Rd
uucggcuaaaacagaag

SEQ ID NO: 705874 - RNA, 14 nt, Haemophilus influenzae Rd
uucgucaauguuau

SEQ ID NO: 705875 - RNA, 19 nt, Haemophilus influenzae Rd
uucgucaauguuauugccu

SEQ ID NO: 705876 - RNA, 18 nt, Haemophilus influenzae Rd
uucguauuucguaugcca

SEQ ID NO: 705877 - RNA, 13 nt, Haemophilus influenzae Rd
uucgucaucauca

SEQ ID NO: 705878 - RNA, 15 nt, Haemophilus influenzae Rd
uucgucaucuucauu

SEQ ID NO: 705879 - RNA, 18 nt, Haemophilus influenzae Rd
uucgucaucuucauuaaa

SEQ ID NO: 705880 - RNA, 12 nt, Haemophilus influenzae Rd
uucguuucuugg

SEQ ID NO: 705881 - RNA, 19 nt, Haemophilus influenzae Rd
uucguuguuuuaauaaaca

SEQ ID NO: 705882 - RNA, 22 nt, Haemophilus influenzae Rd
uucuaaaaauaggcugaaaaaa

SEQ ID NO: 705883 - RNA, 12 nt, Haemophilus influenzae Rd
uucuaaaaacuc

SEQ ID NO: 705884 - RNA, 19 nt, Haemophilus influenzae Rd
uucguuugguucgauaaac

SEQ ID NO: 705885 - RNA, 23 nt, Haemophilus influenzae Rd
uucuaaaaaaauccuaaauaaag

SEQ ID NO: 705886 - RNA, 15 nt, Haemophilus influenzae Rd
uucuauucucuguug

SEQ ID NO: 705887 - RNA, 13 nt, Haemophilus influenzae Rd
uucuauuaaaaua

SEQ ID NO: 705888 - RNA, 16 nt, Haemophilus influenzae Rd
uucucaagaauauauu

SEQ ID NO: 705889 - RNA, 21 nt, Haemophilus influenzae Rd
uucucaagaauauauuuuauc

SEQ ID NO: 705890 - RNA, 16 nt, Haemophilus influenzae Rd
uucuauuuauaaucca

SEQ ID NO: 705891 - RNA, 14 nt, Haemophilus influenzae Rd
uucuauuuuaucaa

SEQ ID NO: 705892 - RNA, 15 nt, Haemophilus influenzae Rd
uucuacguaauuuaa

SEQ ID NO: 705893 - RNA, 17 nt, Haemophilus influenzae Rd
uucuacgucaaagccau

SEQ ID NO: 705894 - RNA, 14 nt, Haemophilus influenzae Rd
uucuauaucagaaa

SEQ ID NO: 705895 - RNA, 18 nt, Haemophilus influenzae Rd
uucuaugccaaucacaau

SEQ ID NO: 705896 - RNA, 21 nt, Haemophilus influenzae Rd
uucuaccgcacuuuaacccau

SEQ ID NO: 705897 - RNA, 13 nt, Haemophilus influenzae Rd
uucuaccugcugu

SEQ ID NO: 705898 - RNA, 12 nt, Haemophilus influenzae Rd
uucuacauaaug

SEQ ID NO: 705899 - RNA, 17 nt, Haemophilus influenzae Rd
uucuaauuuuugcaaug

SEQ ID NO: 705900 - RNA, 22 nt, Haemophilus influenzae Rd
uucuacaaucauagaaaucccu

SEQ ID NO: 705901 - RNA, 17 nt, Haemophilus influenzae Rd
uucuacaccuucccaau

SEQ ID NO: 705902 - RNA, 10 nt, Haemophilus influenzae Rd
uucuaauucc

SEQ ID NO: 705903 - RNA, 18 nt, Haemophilus influenzae Rd
uucuaauugcugcucugc

SEQ ID NO: 705904 - RNA, 12 nt, Haemophilus influenzae Rd
uucuaaaaguuu

SEQ ID NO: 705905 - RNA, 16 nt, Haemophilus influenzae Rd
uucuaaaauaauauca

SEQ ID NO: 705906 - RNA, 16 nt, Haemophilus influenzae Rd
uucuaaaaccaauaau

SEQ ID NO: 705907 - RNA, 21 nt, Haemophilus influenzae Rd
uucuaaacaugagguguuauu

SEQ ID NO: 705908 - RNA, 22 nt, Haemophilus influenzae Rd
ugacacccaaauuaaaaaagca

SEQ ID NO: 705909 - RNA, 20 nt, Haemophilus influenzae Rd
ugacaacgcgacuaaaucuu

SEQ ID NO: 705910 - RNA, 18 nt, Haemophilus influenzae Rd
ugacaaagucgguuuuua

SEQ ID NO: 705911 - RNA, 14 nt, Haemophilus influenzae Rd
ugacaaaucugccu

SEQ ID NO: 705912 - RNA, 19 nt, Haemophilus influenzae Rd
ugacaaauuuguugaucug

SEQ ID NO: 705913 - RNA, 17 nt, Haemophilus influenzae Rd
ugacaaauuuugcauua

SEQ ID NO: 705914 - RNA, 15 nt, Haemophilus influenzae Rd
ugaauuuaucaucaa

SEQ ID NO: 705915 - RNA, 15 nt, Haemophilus influenzae Rd
ugaauugguguuuaa

SEQ ID NO: 705916 - RNA, 15 nt, Haemophilus influenzae Rd
ugaauugcuccuccu

SEQ ID NO: 705917 - RNA, 15 nt, Haemophilus influenzae Rd
ugaauuauugucuuu

SEQ ID NO: 705918 - RNA, 21 nt, Haemophilus influenzae Rd
ugaauuauugucuuuucuaua

SEQ ID NO: 705919 - RNA, 23 nt, Haemophilus influenzae Rd
ugaauuauugucuuuucuauaau

SEQ ID NO: 705920 - RNA, 20 nt, Haemophilus influenzae Rd
ugaaugcauuggcugaauuu

SEQ ID NO: 705921 - RNA, 23 nt, Haemophilus influenzae Rd
ugaaugcauuggcugaauuuaau

SEQ ID NO: 705922 - RNA, 13 nt, Haemophilus influenzae Rd
ugaaugaugagua

SEQ ID NO: 705923 - RNA, 18 nt, Haemophilus influenzae Rd
ugaauaauguuuucauua

SEQ ID NO: 705924 - RNA, 19 nt, Haemophilus influenzae Rd
ugaauaauguuuucauuaa

SEQ ID NO: 705925 - RNA, 14 nt, Haemophilus influenzae Rd
ugaauaauuacuug

SEQ ID NO: 705926 - RNA, 21 nt, Haemophilus influenzae Rd
ugaauacacuuuaaauuuucc

SEQ ID NO: 705927 - RNA, 16 nt, Haemophilus influenzae Rd
ugaauacgaucugcau

SEQ ID NO: 705928 - RNA, 15 nt, Haemophilus influenzae Rd
ugaauaauuuuuaua

SEQ ID NO: 705929 - RNA, 19 nt, Haemophilus influenzae Rd
ugaauaauuuuuauaauuu

SEQ ID NO: 705930 - RNA, 19 nt, Haemophilus influenzae Rd
ugaauaauuuccaacacau

SEQ ID NO: 705931 - RNA, 23 nt, Haemophilus influenzae Rd
ugaauaauuuccaacacauuauc

SEQ ID NO: 705932 - RNA, 14 nt, Haemophilus influenzae Rd
ucuuuauaacauaa

SEQ ID NO: 705933 - RNA, 18 nt, Haemophilus influenzae Rd
ucuuuauaagaaaguuuc

SEQ ID NO: 705934 - RNA, 17 nt, Haemophilus influenzae Rd
ucuuuauagccuauaau

SEQ ID NO: 705935 - RNA, 13 nt, Haemophilus influenzae Rd
ucuuucaauaauu

SEQ ID NO: 705936 - RNA, 12 nt, Haemophilus influenzae Rd
ucuuucaauguu

SEQ ID NO: 705937 - RNA, 14 nt, Haemophilus influenzae Rd
ucuuucaaaaauca

SEQ ID NO: 705938 - RNA, 23 nt, Haemophilus influenzae Rd
ucuuucaaaaaucaaauuaauuu

SEQ ID NO: 705939 - RNA, 18 nt, Haemophilus influenzae Rd
ugaaucguuuuuuccagu

SEQ ID NO: 705940 - RNA, 22 nt, Haemophilus influenzae Rd
ugaaucuaauccuaaaaugcuc

SEQ ID NO: 705941 - RNA, 12 nt, Haemophilus influenzae Rd
ugaaucucagca

SEQ ID NO: 705942 - RNA, 14 nt, Haemophilus influenzae Rd
ugaaucucagcaag

SEQ ID NO: 705943 - RNA, 17 nt, Haemophilus influenzae Rd
ugaaucucagcaagcug

SEQ ID NO: 705944 - RNA, 14 nt, Haemophilus influenzae Rd
ugaauaucuaacau

SEQ ID NO: 705945 - RNA, 21 nt, Haemophilus influenzae Rd
ugaauaugaucuuuaauuaaa

SEQ ID NO: 705946 - RNA, 19 nt, Haemophilus influenzae Rd
ugaccaccgccaauacaaa

SEQ ID NO: 705947 - RNA, 21 nt, Haemophilus influenzae Rd
ugacagauauuggauuuacuu

SEQ ID NO: 705948 - RNA, 17 nt, Haemophilus influenzae Rd
ugacagaaacaaauccu

SEQ ID NO: 705949 - RNA, 17 nt, Haemophilus influenzae Rd
ugacacgguaguaaaua

SEQ ID NO: 705950 - RNA, 16 nt, Haemophilus influenzae Rd
ugaccucguggcaaaa

SEQ ID NO: 705951 - RNA, 15 nt, Haemophilus influenzae Rd
ugaccugcagagaag

SEQ ID NO: 705952 - RNA, 19 nt, Haemophilus influenzae Rd
ugacgagaagaugccagca

SEQ ID NO: 705953 - RNA, 14 nt, Haemophilus influenzae Rd
ugaccauuaaucac

SEQ ID NO: 705954 - RNA, 21 nt, Haemophilus influenzae Rd
ugaccauuggcuuucauuaca

SEQ ID NO: 705955 - RNA, 18 nt, Haemophilus influenzae Rd
ugaccgcuguuuucauua

SEQ ID NO: 705956 - RNA, 13 nt, Haemophilus influenzae Rd
ugaccccaaaaag

SEQ ID NO: 705957 - RNA, 22 nt, Haemophilus influenzae Rd
ugacugcaauuaucaagcugau

SEQ ID NO: 705958 - RNA, 16 nt, Haemophilus influenzae Rd
ugacuuguuuuaaaac

SEQ ID NO: 705959 - RNA, 13 nt, Haemophilus influenzae Rd
ugacuggcaaaaa

SEQ ID NO: 705960 - RNA, 20 nt, Haemophilus influenzae Rd
ugacuuucuaacuuuuaauu

SEQ ID NO: 705961 - RNA, 14 nt, Haemophilus influenzae Rd
ugagaaaaauguua

SEQ ID NO: 705962 - RNA, 14 nt, Haemophilus influenzae Rd
ugagcacuucugua

SEQ ID NO: 705963 - RNA, 16 nt, Haemophilus influenzae Rd
ugagauuuaauuuauu

SEQ ID NO: 705964 - RNA, 17 nt, Haemophilus influenzae Rd
ugagauuuuauuucgcu

SEQ ID NO: 705965 - RNA, 19 nt, Haemophilus influenzae Rd
ugagauguuucgcgauacu

SEQ ID NO: 705966 - RNA, 14 nt, Haemophilus influenzae Rd
ugagauuauuucua

SEQ ID NO: 705967 - RNA, 14 nt, Haemophilus influenzae Rd
ugagcuuuucgcgc

SEQ ID NO: 705968 - RNA, 13 nt, Haemophilus influenzae Rd
ugaggaaaauaaa

SEQ ID NO: 705969 - RNA, 18 nt, Haemophilus influenzae Rd
ugagcuuguuggaaaaau

SEQ ID NO: 705970 - RNA, 22 nt, Haemophilus influenzae Rd
ugagcuuguuggaaaaaugcug

SEQ ID NO: 705971 - RNA, 15 nt, Haemophilus influenzae Rd
ugagcuugauuuuca

SEQ ID NO: 705972 - RNA, 15 nt, Haemophilus influenzae Rd
ugagcugcugcaaga

SEQ ID NO: 705973 - RNA, 19 nt, Haemophilus influenzae Rd
ugagcgauagccaaagguu

SEQ ID NO: 705974 - RNA, 16 nt, Haemophilus influenzae Rd
ugagcgcauuauggaa

SEQ ID NO: 705975 - RNA, 17 nt, Haemophilus influenzae Rd
ugagcggugaauucuuu

SEQ ID NO: 705976 - RNA, 17 nt, Haemophilus influenzae Rd
ugagcuaagcauuucag

SEQ ID NO: 705977 - RNA, 19 nt, Haemophilus influenzae Rd
ugagguauuguccuucauu

SEQ ID NO: 705978 - RNA, 13 nt, Haemophilus influenzae Rd
ugagggagcaaug

SEQ ID NO: 705979 - RNA, 15 nt, Haemophilus influenzae Rd
ugaggcuaauaauaa

SEQ ID NO: 705980 - RNA, 17 nt, Haemophilus influenzae Rd
ugaggcuaauaaugcca

SEQ ID NO: 705981 - RNA, 23 nt, Haemophilus influenzae Rd
ugaguaaaccacaauacuuauca

SEQ ID NO: 705982 - RNA, 13 nt, Haemophilus influenzae Rd
ugaguaaaauacg

SEQ ID NO: 705983 - RNA, 21 nt, Haemophilus influenzae Rd
ugaguaaugcuugggaaucug

SEQ ID NO: 705984 - RNA, 14 nt, Haemophilus influenzae Rd
ugaguauagucauu

SEQ ID NO: 705985 - RNA, 18 nt, Haemophilus influenzae Rd
ugaguaucuuuuaauuca

SEQ ID NO: 705986 - RNA, 14 nt, Haemophilus influenzae Rd
ugaguauguugcuu

SEQ ID NO: 705987 - RNA, 19 nt, Haemophilus influenzae Rd
ugaucccagcauaaauaaa

SEQ ID NO: 705988 - RNA, 22 nt, Haemophilus influenzae Rd
ugauccauaauggcaauuuuau

SEQ ID NO: 705989 - RNA, 12 nt, Haemophilus influenzae Rd
ugauccacuuac

SEQ ID NO: 705990 - RNA, 21 nt, Haemophilus influenzae Rd
ugauccacgguauuuucuuau

SEQ ID NO: 705991 - RNA, 20 nt, Haemophilus influenzae Rd
ugaucacuucauaaauugug

SEQ ID NO: 705992 - RNA, 22 nt, Haemophilus influenzae Rd
ugaucacuucauaaauugugau

SEQ ID NO: 705993 - RNA, 19 nt, Haemophilus influenzae Rd
ugaucagaaguuaaaacuu

SEQ ID NO: 705994 - RNA, 22 nt, Haemophilus influenzae Rd
ugaucagaaguuaaaacuugaa

SEQ ID NO: 705995 - RNA, 18 nt, Haemophilus influenzae Rd
ugauauaugauuauaaau

SEQ ID NO: 705996 - RNA, 13 nt, Haemophilus influenzae Rd
ugauauucaauuu

SEQ ID NO: 705997 - RNA, 18 nt, Haemophilus influenzae Rd
ugauauuccauaguucac

SEQ ID NO: 705998 - RNA, 19 nt, Haemophilus influenzae Rd
ugauauuccauaguucacu

SEQ ID NO: 705999 - RNA, 22 nt, Haemophilus influenzae Rd
ugauauuccauaguucacuaaa

SEQ ID NO: 706000 - RNA, 12 nt, Haemophilus influenzae Rd
ugauauuuaaaa

SEQ ID NO: 706001 - RNA, 16 nt, Haemophilus influenzae Rd
ugauauuuaacaucau

SEQ ID NO: 706002 - RNA, 13 nt, Haemophilus influenzae Rd
ugauauuucacua

SEQ ID NO: 706003 - RNA, 15 nt, Haemophilus influenzae Rd
ugauauuucacuaaa

SEQ ID NO: 706004 - RNA, 23 nt, Haemophilus influenzae Rd
ugaugauuugcauaaaaccagca

SEQ ID NO: 706005 - RNA, 17 nt, Haemophilus influenzae Rd
ugaugcaacauuuaaug

SEQ ID NO: 706006 - RNA, 19 nt, Haemophilus influenzae Rd
ugaugauuguuauugugau

SEQ ID NO: 706007 - RNA, 18 nt, Haemophilus influenzae Rd
ugaugauuuucauuccuu

SEQ ID NO: 706008 - RNA, 19 nt, Haemophilus influenzae Rd
ugaugcagaaagcacuugu

SEQ ID NO: 706009 - RNA, 19 nt, Haemophilus influenzae Rd
ugaugcgguuuauuuaaua

SEQ ID NO: 706010 - RNA, 21 nt, Haemophilus influenzae Rd
ugaucgaguaaaaauaaaaug

SEQ ID NO: 706011 - RNA, 21 nt, Haemophilus influenzae Rd
ugaugaauuuaguacuuccgc

SEQ ID NO: 706012 - RNA, 18 nt, Haemophilus influenzae Rd
ugaucggauuucuuuauu

SEQ ID NO: 706013 - RNA, 13 nt, Haemophilus influenzae Rd
ugauuguugcuug

SEQ ID NO: 706014 - RNA, 14 nt, Haemophilus influenzae Rd
ugauuguggugaga

SEQ ID NO: 706015 - RNA, 14 nt, Haemophilus influenzae Rd
ugauucgauaaauu

SEQ ID NO: 706016 - RNA, 17 nt, Haemophilus influenzae Rd
ugauuuccuguaaaaaa

SEQ ID NO: 706017 - RNA, 23 nt, Haemophilus influenzae Rd
ugauuuaaaaaaacguuaaauuu

SEQ ID NO: 706018 - RNA, 18 nt, Haemophilus influenzae Rd
ugauuuguuacuaaaaua

SEQ ID NO: 706019 - RNA, 21 nt, Haemophilus influenzae Rd
ugauuuuaaagccauuuugcu

SEQ ID NO: 706020 - RNA, 16 nt, Haemophilus influenzae Rd
ugauuuuaaaguaaau

SEQ ID NO: 706021 - RNA, 22 nt, Haemophilus influenzae Rd
ugauuuuaaaguaaauuuuaaa

SEQ ID NO: 706022 - RNA, 15 nt, Haemophilus influenzae Rd
ugauuuuagaaaaau

SEQ ID NO: 706023 - RNA, 23 nt, Haemophilus influenzae Rd
ugauuuuaguuucuaauucuucc

SEQ ID NO: 706024 - RNA, 13 nt, Haemophilus influenzae Rd
ugauuuuuuuaua

SEQ ID NO: 706025 - RNA, 17 nt, Haemophilus influenzae Rd
ugauuuuuuuauuuguu

SEQ ID NO: 706026 - RNA, 14 nt, Haemophilus influenzae Rd
ugauuuuuuucauu

SEQ ID NO: 706027 - RNA, 20 nt, Haemophilus influenzae Rd
ugauuuuuuucauuuuagaa

SEQ ID NO: 706028 - RNA, 20 nt, Haemophilus influenzae Rd
ugcaaaccaaaucacaauaa

SEQ ID NO: 706029 - RNA, 15 nt, Haemophilus influenzae Rd
ugcaaaccauuuauc

SEQ ID NO: 706030 - RNA, 15 nt, Haemophilus influenzae Rd
ugcaaacgagacauu

SEQ ID NO: 706031 - RNA, 16 nt, Haemophilus influenzae Rd
ugauguaaauuuucag

SEQ ID NO: 706032 - RNA, 14 nt, Haemophilus influenzae Rd
ugauguaccaaaau

SEQ ID NO: 706033 - RNA, 20 nt, Haemophilus influenzae Rd
ugauguuuuaacaaaagcua

SEQ ID NO: 706034 - RNA, 15 nt, Haemophilus influenzae Rd
ugauguucagccacu

SEQ ID NO: 706035 - RNA, 20 nt, Haemophilus influenzae Rd
ugaugucagugaauuuagcc

SEQ ID NO: 706036 - RNA, 14 nt, Haemophilus influenzae Rd
ugauuaucuaaauu

SEQ ID NO: 706037 - RNA, 15 nt, Haemophilus influenzae Rd
ugauuaucuaaauuu

SEQ ID NO: 706038 - RNA, 18 nt, Haemophilus influenzae Rd
ugauuaucuaaauuucgc

SEQ ID NO: 706039 - RNA, 23 nt, Haemophilus influenzae Rd
ugauucaauuugaccuugaaguu

SEQ ID NO: 706040 - RNA, 14 nt, Haemophilus influenzae Rd
ugauucaaugcuuc

SEQ ID NO: 706041 - RNA, 16 nt, Haemophilus influenzae Rd
ugauucaauucuucua

SEQ ID NO: 706042 - RNA, 14 nt, Haemophilus influenzae Rd
ugauuauuuaagcu

SEQ ID NO: 706043 - RNA, 19 nt, Haemophilus influenzae Rd
ugauuauuuaauuucaaaa

SEQ ID NO: 706044 - RNA, 13 nt, Haemophilus influenzae Rd
ugauuauuuuuua

SEQ ID NO: 706045 - RNA, 19 nt, Haemophilus influenzae Rd
ugcaagugcgguaaaauuu

SEQ ID NO: 706046 - RNA, 20 nt, Haemophilus influenzae Rd
ugcaagugcgguaaaauuuu

SEQ ID NO: 706047 - RNA, 21 nt, Haemophilus influenzae Rd
ugcaagggauuugaaaauccc

SEQ ID NO: 706048 - RNA, 15 nt, Haemophilus influenzae Rd
ugcaagguuuccaag

SEQ ID NO: 706049 - RNA, 12 nt, Haemophilus influenzae Rd
ugcaauaaccac

SEQ ID NO: 706050 - RNA, 21 nt, Haemophilus influenzae Rd
ugcaauaagugcgguaaaaaa

SEQ ID NO: 706051 - RNA, 23 nt, Haemophilus influenzae Rd
ugcaaaggcagccauaaaugcua

SEQ ID NO: 706052 - RNA, 21 nt, Haemophilus influenzae Rd
ugcaaaggcaggacguuuuaa

SEQ ID NO: 706053 - RNA, 19 nt, Haemophilus influenzae Rd
ugcaaagugcgguaagaaa

SEQ ID NO: 706054 - RNA, 20 nt, Haemophilus influenzae Rd
ugcaaagugcgguaagaaaa

SEQ ID NO: 706055 - RNA, 12 nt, Haemophilus influenzae Rd
ugcaaaguuaua

SEQ ID NO: 706056 - RNA, 15 nt, Haemophilus influenzae Rd
ugcaaagccuucacc

SEQ ID NO: 706057 - RNA, 16 nt, Haemophilus influenzae Rd
ugcaagccccugaagc

SEQ ID NO: 706058 - RNA, 18 nt, Haemophilus influenzae Rd
ugcaagcaguuuacgguu

SEQ ID NO: 706059 - RNA, 22 nt, Haemophilus influenzae Rd
ugcaaagcuaccuacuaaugaa

SEQ ID NO: 706060 - RNA, 20 nt, Haemophilus influenzae Rd
ugcacaauuuggcgcauuaa

SEQ ID NO: 706061 - RNA, 14 nt, Haemophilus influenzae Rd
ugcacaagcaccac

SEQ ID NO: 706062 - RNA, 13 nt, Haemophilus influenzae Rd
ugcacaacaugcc

SEQ ID NO: 706063 - RNA, 18 nt, Haemophilus influenzae Rd
ugcacaacgaucacgaaa

SEQ ID NO: 706064 - RNA, 20 nt, Haemophilus influenzae Rd
ugcacaacgaucacgaaaac

SEQ ID NO: 706065 - RNA, 17 nt, Haemophilus influenzae Rd
ugcaauuuuuaauucuu

SEQ ID NO: 706066 - RNA, 21 nt, Haemophilus influenzae Rd
ugcaauuuuacgagaaaggug

SEQ ID NO: 706067 - RNA, 23 nt, Haemophilus influenzae Rd
ugcaauaauuuuacguuucauuu

SEQ ID NO: 706068 - RNA, 16 nt, Haemophilus influenzae Rd
ugcacauuaauuugug

SEQ ID NO: 706069 - RNA, 20 nt, Haemophilus influenzae Rd
ugcaccaauaauugaugcua

SEQ ID NO: 706070 - RNA, 17 nt, Haemophilus influenzae Rd
ugcaccaaucaaauaaa

SEQ ID NO: 706071 - RNA, 15 nt, Haemophilus influenzae Rd
ugcaccuucaacauu

SEQ ID NO: 706072 - RNA, 22 nt, Haemophilus influenzae Rd
ugcaccuucaacauuuuuugcu

SEQ ID NO: 706073 - RNA, 18 nt, Haemophilus influenzae Rd
ugcaccuucuuuuggaua

SEQ ID NO: 706074 - RNA, 15 nt, Haemophilus influenzae Rd
ugcaccuuuaaaucg

SEQ ID NO: 706075 - RNA, 20 nt, Haemophilus influenzae Rd
ugcacgaauaauuaaaucuu

SEQ ID NO: 706076 - RNA, 21 nt, Haemophilus influenzae Rd
ugcacgaauaauuaaaucuuc

SEQ ID NO: 706077 - RNA, 22 nt, Haemophilus influenzae Rd
ugcacgaccacccauuaaauag

SEQ ID NO: 706078 - RNA, 22 nt, Haemophilus influenzae Rd
ugcacgagcuugagcugcugca

SEQ ID NO: 706079 - RNA, 20 nt, Haemophilus influenzae Rd
ugcacagaaaggacagccag

SEQ ID NO: 706080 - RNA, 19 nt, Haemophilus influenzae Rd
ugcacauccugauugcuuu

SEQ ID NO: 706081 - RNA, 13 nt, Haemophilus influenzae Rd
ugcacuucuucag

SEQ ID NO: 706082 - RNA, 17 nt, Haemophilus influenzae Rd
ugcacuuggguaaauau

SEQ ID NO: 706083 - RNA, 20 nt, Haemophilus influenzae Rd
ugcacuuggguaaauauaaa

SEQ ID NO: 706084 - RNA, 20 nt, Haemophilus influenzae Rd
ugcacuuuaaagaaauaaau

SEQ ID NO: 706085 - RNA, 16 nt, Haemophilus influenzae Rd
ugcagaaauacuuuua

SEQ ID NO: 706086 - RNA, 22 nt, Haemophilus influenzae Rd
ugcagaacccgcuugcuuacau

SEQ ID NO: 706087 - RNA, 19 nt, Haemophilus influenzae Rd
ugcacugguucuggguauu

SEQ ID NO: 706088 - RNA, 23 nt, Haemophilus influenzae Rd
ugcacugguucuggguauugauu

SEQ ID NO: 706089 - RNA, 16 nt, Haemophilus influenzae Rd
ugcacgugagacuaaa

SEQ ID NO: 706090 - RNA, 16 nt, Haemophilus influenzae Rd
ugcacgguguuuucuu

SEQ ID NO: 706091 - RNA, 16 nt, Haemophilus influenzae Rd
ugcagcccaaauuguu

SEQ ID NO: 706092 - RNA, 17 nt, Haemophilus influenzae Rd
ugcagcaggaagaacau

SEQ ID NO: 706093 - RNA, 17 nt, Haemophilus influenzae Rd
ugcagauuaauuauauu

SEQ ID NO: 706094 - RNA, 18 nt, Haemophilus influenzae Rd
ugcagauuaauuauauuu

SEQ ID NO: 706095 - RNA, 22 nt, Haemophilus influenzae Rd
ugcagauugcugacaaauuugu

SEQ ID NO: 706096 - RNA, 16 nt, Haemophilus influenzae Rd
ugcagauuuuuuauua

SEQ ID NO: 706097 - RNA, 22 nt, Haemophilus influenzae Rd
ugcagauuuuuuauuuauuaag

SEQ ID NO: 706098 - RNA, 21 nt, Haemophilus influenzae Rd
ugcagauuuuuuuaugauuaa

SEQ ID NO: 706099 - RNA, 17 nt, Haemophilus influenzae Rd
ugcagaauuuggaucuu

SEQ ID NO: 706100 - RNA, 19 nt, Haemophilus influenzae Rd
ugcaggggcuuuuaaugau

SEQ ID NO: 706101 - RNA, 16 nt, Haemophilus influenzae Rd
ugcagggaaaaauuuu

SEQ ID NO: 706102 - RNA, 18 nt, Haemophilus influenzae Rd
ugcagcuugcgccauuga

SEQ ID NO: 706103 - RNA, 17 nt, Haemophilus influenzae Rd
ugcagcugcugcuuuaa

SEQ ID NO: 706104 - RNA, 15 nt, Haemophilus influenzae Rd
ugcaguaaaaucuuc

SEQ ID NO: 706105 - RNA, 19 nt, Haemophilus influenzae Rd
ugcaguaacuucugcugca

SEQ ID NO: 706106 - RNA, 18 nt, Haemophilus influenzae Rd
ugcaguauaaaccgcauu

SEQ ID NO: 706107 - RNA, 15 nt, Haemophilus influenzae Rd
ugccaaccacccaaa

SEQ ID NO: 706108 - RNA, 18 nt, Haemophilus influenzae Rd
ugccacagguaaagaacc

SEQ ID NO: 706109 - RNA, 17 nt, Haemophilus influenzae Rd
ugccaauaugaacauua

SEQ ID NO: 706110 - RNA, 19 nt, Haemophilus influenzae Rd
ugccaauccauuuuuaaau

SEQ ID NO: 706111 - RNA, 15 nt, Haemophilus influenzae Rd
ugccacuaaggguua

SEQ ID NO: 706112 - RNA, 13 nt, Haemophilus influenzae Rd
ugccacuaauaag

SEQ ID NO: 706113 - RNA, 22 nt, Haemophilus influenzae Rd
ugccagcagaacauugugacau

SEQ ID NO: 706114 - RNA, 19 nt, Haemophilus influenzae Rd
ugccacuucagcuaauaaa

SEQ ID NO: 706115 - RNA, 17 nt, Haemophilus influenzae Rd
ugcccaauaaaaguaau

SEQ ID NO: 706116 - RNA, 23 nt, Haemophilus influenzae Rd
ugccaucacagucuuuuaacaca

SEQ ID NO: 706117 - RNA, 17 nt, Haemophilus influenzae Rd
ugccaucacauccacaa

SEQ ID NO: 706118 - RNA, 15 nt, Haemophilus influenzae Rd
ugccauaaauuugga

SEQ ID NO: 706119 - RNA, 17 nt, Haemophilus influenzae Rd
ugccauaauaacgccac

SEQ ID NO: 706120 - RNA, 21 nt, Haemophilus influenzae Rd
ugccauaauaaucacaacaaa

SEQ ID NO: 706121 - RNA, 16 nt, Haemophilus influenzae Rd
ugcccuuucgcuuaca

SEQ ID NO: 706122 - RNA, 19 nt, Haemophilus influenzae Rd
ugcccuuucucaaauauuu

SEQ ID NO: 706123 - RNA, 14 nt, Haemophilus influenzae Rd
ugccgaaaauuuac

SEQ ID NO: 706124 - RNA, 16 nt, Haemophilus influenzae Rd
ugccgaaccugaaauu

SEQ ID NO: 706125 - RNA, 21 nt, Haemophilus influenzae Rd
ugccgaauagauuuaaacaau

SEQ ID NO: 706126 - RNA, 13 nt, Haemophilus influenzae Rd
ugccgaagccuaa

SEQ ID NO: 706127 - RNA, 18 nt, Haemophilus influenzae Rd
ugccgaagccuaaaucuu

SEQ ID NO: 706128 - RNA, 17 nt, Haemophilus influenzae Rd
ugcccauaagugagaaa

SEQ ID NO: 706129 - RNA, 19 nt, Haemophilus influenzae Rd
ugcccaucuugccaaugcc

SEQ ID NO: 706130 - RNA, 18 nt, Haemophilus influenzae Rd
ugccuacuuuuuauuuuu

SEQ ID NO: 706131 - RNA, 15 nt, Haemophilus influenzae Rd
ugccugcauuaauaa

SEQ ID NO: 706132 - RNA, 17 nt, Haemophilus influenzae Rd
ugccuauuuauuuauug

SEQ ID NO: 706133 - RNA, 15 nt, Haemophilus influenzae Rd
ugccuucauauaaua

SEQ ID NO: 706134 - RNA, 16 nt, Haemophilus influenzae Rd
ugccuucauauaauaa

SEQ ID NO: 706135 - RNA, 20 nt, Haemophilus influenzae Rd
ugccuugaugcucugcauaa

SEQ ID NO: 706136 - RNA, 19 nt, Haemophilus influenzae Rd
ugccuucaaugggcaucca

SEQ ID NO: 706137 - RNA, 14 nt, Haemophilus influenzae Rd
ugccuugugcauaa

SEQ ID NO: 706138 - RNA, 13 nt, Haemophilus influenzae Rd
ugcgcaauggcuu

SEQ ID NO: 706139 - RNA, 17 nt, Haemophilus influenzae Rd
ugcgcauauacuucuuu

SEQ ID NO: 706140 - RNA, 19 nt, Haemophilus influenzae Rd
ugcgcauauacuucuuuag

SEQ ID NO: 706141 - RNA, 17 nt, Haemophilus influenzae Rd
ugcgauuuccaagcugg

SEQ ID NO: 706142 - RNA, 23 nt, Haemophilus influenzae Rd
ugcgauuuuugcacgaauuucag

SEQ ID NO: 706143 - RNA, 18 nt, Haemophilus influenzae Rd
ugcgauuaacaauaaugu

SEQ ID NO: 706144 - RNA, 15 nt, Haemophilus influenzae Rd
ugcgaucuuuuguua

SEQ ID NO: 706145 - RNA, 14 nt, Haemophilus influenzae Rd
ugcgaucacugcac

SEQ ID NO: 706146 - RNA, 16 nt, Haemophilus influenzae Rd
ugcgaucacugcaccg

SEQ ID NO: 706147 - RNA, 16 nt, Haemophilus influenzae Rd
ugcgauacguuucaua

SEQ ID NO: 706148 - RNA, 23 nt, Haemophilus influenzae Rd
ugcgaacaaggguuccugcauca

SEQ ID NO: 706149 - RNA, 15 nt, Haemophilus influenzae Rd
ugccuuuuucuucuu

SEQ ID NO: 706150 - RNA, 15 nt, Haemophilus influenzae Rd
ugcgaagcccgaauu

SEQ ID NO: 706151 - RNA, 15 nt, Haemophilus influenzae Rd
ugcgaauuuuuauuu

SEQ ID NO: 706152 - RNA, 19 nt, Haemophilus influenzae Rd
ugcgacaggggcuucuaau

SEQ ID NO: 706153 - RNA, 21 nt, Haemophilus influenzae Rd
ugcgaccucgccauuuuucaa

SEQ ID NO: 706154 - RNA, 14 nt, Haemophilus influenzae Rd
ugcuacuuuugacg

SEQ ID NO: 706155 - RNA, 16 nt, Haemophilus influenzae Rd
ugcuagccaauaaucu

SEQ ID NO: 706156 - RNA, 14 nt, Haemophilus influenzae Rd
ugcuaguacuuguu

SEQ ID NO: 706157 - RNA, 15 nt, Haemophilus influenzae Rd
ugcuauucuuuagau

SEQ ID NO: 706158 - RNA, 16 nt, Haemophilus influenzae Rd
ugcuauuuuauuuaga

SEQ ID NO: 706159 - RNA, 19 nt, Haemophilus influenzae Rd
ugcuauuuuauuuagaaag

SEQ ID NO: 706160 - RNA, 14 nt, Haemophilus influenzae Rd
ugcuacauuugccc

SEQ ID NO: 706161 - RNA, 20 nt, Haemophilus influenzae Rd
ugcuaauucugcuaaaucug

SEQ ID NO: 706162 - RNA, 19 nt, Haemophilus influenzae Rd
ugcuaaugcggcgaauagc

SEQ ID NO: 706163 - RNA, 20 nt, Haemophilus influenzae Rd
ugcuaauagaacuguuauuu

SEQ ID NO: 706164 - RNA, 17 nt, Haemophilus influenzae Rd
ugcuaagauugcaagug

SEQ ID NO: 706165 - RNA, 20 nt, Haemophilus influenzae Rd
ugcuaacucaucaacaaaau

SEQ ID NO: 706166 - RNA, 17 nt, Haemophilus influenzae Rd
ugcuaaaucaccuaaau

SEQ ID NO: 706167 - RNA, 19 nt, Haemophilus influenzae Rd
ugcuaaaucaccuaaaucu

SEQ ID NO: 706168 - RNA, 20 nt, Haemophilus influenzae Rd
ugcuaaaucaccuaaaucuu

SEQ ID NO: 706169 - RNA, 15 nt, Haemophilus influenzae Rd
ugcuaaauuuauuac

SEQ ID NO: 706170 - RNA, 23 nt, Haemophilus influenzae Rd
ugcuaaacguucuuggaaaucuu

SEQ ID NO: 706171 - RNA, 21 nt, Haemophilus influenzae Rd
ugcuaaaggguuuacuuuaau

SEQ ID NO: 706172 - RNA, 16 nt, Haemophilus influenzae Rd
ugcuaaaaagaaauaa

SEQ ID NO: 706173 - RNA, 14 nt, Haemophilus influenzae Rd
ugcguuuuuuaauu

SEQ ID NO: 706174 - RNA, 17 nt, Haemophilus influenzae Rd
ugcguuuuacaccaaca

SEQ ID NO: 706175 - RNA, 17 nt, Haemophilus influenzae Rd
ugcguucgauaacaauu

SEQ ID NO: 706176 - RNA, 21 nt, Haemophilus influenzae Rd
ugcguucgauaacaauuuuug

SEQ ID NO: 706177 - RNA, 19 nt, Haemophilus influenzae Rd
ugcucuaccaacugagcua

SEQ ID NO: 706178 - RNA, 17 nt, Haemophilus influenzae Rd
ugcucuaccaacugagc

SEQ ID NO: 706179 - RNA, 13 nt, Haemophilus influenzae Rd
ugcucuaaaugug

SEQ ID NO: 706180 - RNA, 20 nt, Haemophilus influenzae Rd
ugcucuaaaugugauuucca

SEQ ID NO: 706181 - RNA, 23 nt, Haemophilus influenzae Rd
ugcucugguggaagguaauuuaa

SEQ ID NO: 706182 - RNA, 13 nt, Haemophilus influenzae Rd
ugcucuguauuuu

SEQ ID NO: 706183 - RNA, 16 nt, Haemophilus influenzae Rd
ugcucuuuaacaauau

SEQ ID NO: 706184 - RNA, 21 nt, Haemophilus influenzae Rd
ugcugaauaaaccuaaagcca

SEQ ID NO: 706185 - RNA, 12 nt, Haemophilus influenzae Rd
ugcucugccacg

SEQ ID NO: 706186 - RNA, 20 nt, Haemophilus influenzae Rd
ugcucugcguucaagccuuu

SEQ ID NO: 706187 - RNA, 15 nt, Haemophilus influenzae Rd
ugcucucuuuuaauc

SEQ ID NO: 706188 - RNA, 21 nt, Haemophilus influenzae Rd
ugcucccccccaauaaaaaga

SEQ ID NO: 706189 - RNA, 14 nt, Haemophilus influenzae Rd
ugcgugucaaauua

SEQ ID NO: 706190 - RNA, 17 nt, Haemophilus influenzae Rd
ugcguucaagccuuugc

SEQ ID NO: 706191 - RNA, 18 nt, Haemophilus influenzae Rd
ugcguucacucacuuuaa

SEQ ID NO: 706192 - RNA, 20 nt, Haemophilus influenzae Rd
ugcguaucacuuaaaccaaa

SEQ ID NO: 706193 - RNA, 16 nt, Haemophilus influenzae Rd
ugcgggaauagcucag

SEQ ID NO: 706194 - RNA, 18 nt, Haemophilus influenzae Rd
ugcguagccuagugcuaa

SEQ ID NO: 706195 - RNA, 15 nt, Haemophilus influenzae Rd
ugcgguagauuuuca

SEQ ID NO: 706196 - RNA, 16 nt, Haemophilus influenzae Rd
ugcgguaaaaaaaagc

SEQ ID NO: 706197 - RNA, 16 nt, Haemophilus influenzae Rd
ugcgguaaaaauuaac

SEQ ID NO: 706198 - RNA, 19 nt, Haemophilus influenzae Rd
ugcgguaaaauuuuucuca

SEQ ID NO: 706199 - RNA, 18 nt, Haemophilus influenzae Rd
ugcgguaaauuuuaaaau

SEQ ID NO: 706200 - RNA, 14 nt, Haemophilus influenzae Rd
ugcgguaaauuuuc

SEQ ID NO: 706201 - RNA, 15 nt, Haemophilus influenzae Rd
ugcgguaaauuuuua

SEQ ID NO: 706202 - RNA, 15 nt, Haemophilus influenzae Rd
ugcggauuucacuag

SEQ ID NO: 706203 - RNA, 14 nt, Haemophilus influenzae Rd
ugcggcaaaaaaug

SEQ ID NO: 706204 - RNA, 13 nt, Haemophilus influenzae Rd
ugcgcugauuuuu

SEQ ID NO: 706205 - RNA, 16 nt, Haemophilus influenzae Rd
ugcuuaacauuaauaa

SEQ ID NO: 706206 - RNA, 17 nt, Haemophilus influenzae Rd
ugcuuaaucggcacaag

SEQ ID NO: 706207 - RNA, 13 nt, Haemophilus influenzae Rd
ugcuguuuuuccg

SEQ ID NO: 706208 - RNA, 13 nt, Haemophilus influenzae Rd
ugcuguuuucaau

SEQ ID NO: 706209 - RNA, 12 nt, Haemophilus influenzae Rd
ugcuuaauggac

SEQ ID NO: 706210 - RNA, 21 nt, Haemophilus influenzae Rd
ugcuucuguugcuucaauugu

SEQ ID NO: 706211 - RNA, 17 nt, Haemophilus influenzae Rd
ugcuucuaauuuuaaaa

SEQ ID NO: 706212 - RNA, 15 nt, Haemophilus influenzae Rd
ugcuucgugaauacg

SEQ ID NO: 706213 - RNA, 14 nt, Haemophilus influenzae Rd
ugcuuguuuuaaaa

SEQ ID NO: 706214 - RNA, 15 nt, Haemophilus influenzae Rd
ugcuuguuuuaaaau

SEQ ID NO: 706215 - RNA, 22 nt, Haemophilus influenzae Rd
ugcuuguucacguguuuuuuca

SEQ ID NO: 706216 - RNA, 17 nt, Haemophilus influenzae Rd
ugcuuguucaugugggc

SEQ ID NO: 706217 - RNA, 21 nt, Haemophilus influenzae Rd
ugcuugcgccgaauaaaaagg

SEQ ID NO: 706218 - RNA, 18 nt, Haemophilus influenzae Rd
ugcuugggcaauuaauag

SEQ ID NO: 706219 - RNA, 21 nt, Haemophilus influenzae Rd
ugcuugcgcuugugcuggagu

SEQ ID NO: 706220 - RNA, 15 nt, Haemophilus influenzae Rd
ugcuuucuuauucag

SEQ ID NO: 706221 - RNA, 22 nt, Haemophilus influenzae Rd
ugcuuucuagaugaugaaauuu

SEQ ID NO: 706222 - RNA, 18 nt, Haemophilus influenzae Rd
ugcuuuugccgaaaaugg

SEQ ID NO: 706223 - RNA, 13 nt, Haemophilus influenzae Rd
ugcuuuugcuuca

SEQ ID NO: 706224 - RNA, 12 nt, Haemophilus influenzae Rd
ugcuuuuguagc

SEQ ID NO: 706225 - RNA, 22 nt, Haemophilus influenzae Rd
ugcuggauucaguugauagaca

SEQ ID NO: 706226 - RNA, 13 nt, Haemophilus influenzae Rd
ugcugaaugugcg

SEQ ID NO: 706227 - RNA, 17 nt, Haemophilus influenzae Rd
ugcugucgcuucuaauu

SEQ ID NO: 706228 - RNA, 16 nt, Haemophilus influenzae Rd
ugcugguguggagaaa

SEQ ID NO: 706229 - RNA, 15 nt, Haemophilus influenzae Rd
uggaagguaauuuaa

SEQ ID NO: 706230 - RNA, 12 nt, Haemophilus influenzae Rd
uggaacuucuaa

SEQ ID NO: 706231 - RNA, 23 nt, Haemophilus influenzae Rd
uggaacuuguuuuccaaacauuu

SEQ ID NO: 706232 - RNA, 12 nt, Haemophilus influenzae Rd
uggaaaugagua

SEQ ID NO: 706233 - RNA, 19 nt, Haemophilus influenzae Rd
uggaaaugcuuaaucggca

SEQ ID NO: 706234 - RNA, 18 nt, Haemophilus influenzae Rd
uggaaauugccaaaaaag

SEQ ID NO: 706235 - RNA, 16 nt, Haemophilus influenzae Rd
uggaaauguuuaauua

SEQ ID NO: 706236 - RNA, 21 nt, Haemophilus influenzae Rd
uggaaauguuuaauuauagaa

SEQ ID NO: 706237 - RNA, 14 nt, Haemophilus influenzae Rd
uggaaauucuucaa

SEQ ID NO: 706238 - RNA, 14 nt, Haemophilus influenzae Rd
uggaaauaauauuc

SEQ ID NO: 706239 - RNA, 14 nt, Haemophilus influenzae Rd
uggaaauaaauccu

SEQ ID NO: 706240 - RNA, 18 nt, Haemophilus influenzae Rd
ugcuuuuugcuauuaauu

SEQ ID NO: 706241 - RNA, 12 nt, Haemophilus influenzae Rd
ugcuuuuuaauu

SEQ ID NO: 706242 - RNA, 23 nt, Haemophilus influenzae Rd
uggaaacgguuaauaaauucuug

SEQ ID NO: 706243 - RNA, 22 nt, Haemophilus influenzae Rd
uggaaacgugcaauuaauucuu

SEQ ID NO: 706244 - RNA, 23 nt, Haemophilus influenzae Rd
uggaaaccugcaaggauauuucc

SEQ ID NO: 706245 - RNA, 20 nt, Haemophilus influenzae Rd
uggacauuguuguuuaauaa

SEQ ID NO: 706246 - RNA, 14 nt, Haemophilus influenzae Rd
uggacagaauaacu

SEQ ID NO: 706247 - RNA, 22 nt, Haemophilus influenzae Rd
uggaauggaggauuagaaauga

SEQ ID NO: 706248 - RNA, 15 nt, Haemophilus influenzae Rd
uggaauggauaaacg

SEQ ID NO: 706249 - RNA, 16 nt, Haemophilus influenzae Rd
uggaaugcaucacugc

SEQ ID NO: 706250 - RNA, 20 nt, Haemophilus influenzae Rd
uggaauggauguaaugagca

SEQ ID NO: 706251 - RNA, 22 nt, Haemophilus influenzae Rd
uggaaugguaguggcaauccaa

SEQ ID NO: 706252 - RNA, 20 nt, Haemophilus influenzae Rd
uggaauugugcuaaauuuuu

SEQ ID NO: 706253 - RNA, 20 nt, Haemophilus influenzae Rd
uggaauuuucacauuaguga

SEQ ID NO: 706254 - RNA, 18 nt, Haemophilus influenzae Rd
uggaauaccagaggaaua

SEQ ID NO: 706255 - RNA, 20 nt, Haemophilus influenzae Rd
uggaauauggaaaugcuuaa

SEQ ID NO: 706256 - RNA, 22 nt, Haemophilus influenzae Rd
uggaauauucuuuuuaaauauu

SEQ ID NO: 706257 - RNA, 14 nt, Haemophilus influenzae Rd
uggaauauuuuucu

SEQ ID NO: 706258 - RNA, 16 nt, Haemophilus influenzae Rd
uggaauauacaguuca

SEQ ID NO: 706259 - RNA, 17 nt, Haemophilus influenzae Rd
uggaaucaaugaguggu

SEQ ID NO: 706260 - RNA, 18 nt, Haemophilus influenzae Rd
uuaguaucuuccauuaau

SEQ ID NO: 706261 - RNA, 14 nt, Haemophilus influenzae Rd
uuaguaacagguaa

SEQ ID NO: 706262 - RNA, 21 nt, Haemophilus influenzae Rd
uuagggugcauuugguuagau

SEQ ID NO: 706263 - RNA, 21 nt, Haemophilus influenzae Rd
uuagguaaauuugguucaauu

SEQ ID NO: 706264 - RNA, 16 nt, Haemophilus influenzae Rd
uuaggguaauuuuuuc

SEQ ID NO: 706265 - RNA, 21 nt, Haemophilus influenzae Rd
uuaggcuauuuuauaauuaau

SEQ ID NO: 706266 - RNA, 17 nt, Haemophilus influenzae Rd
uuagguuucaauuuacc

SEQ ID NO: 706267 - RNA, 14 nt, Haemophilus influenzae Rd
uuaguccuuuagaa

SEQ ID NO: 706268 - RNA, 18 nt, Haemophilus influenzae Rd
uuagucuuuuuaauuuaa

SEQ ID NO: 706269 - RNA, 13 nt, Haemophilus influenzae Rd
uuagugaaaagaa

SEQ ID NO: 706270 - RNA, 15 nt, Haemophilus influenzae Rd
uuagugaaaagaaaa

SEQ ID NO: 706271 - RNA, 21 nt, Haemophilus influenzae Rd
uuagugaaaagaaaacuuaua

SEQ ID NO: 706272 - RNA, 20 nt, Haemophilus influenzae Rd
uuagugauuucuauguuauu

SEQ ID NO: 706273 - RNA, 18 nt, Haemophilus influenzae Rd
uuagugcuguauauuuuu

SEQ ID NO: 706274 - RNA, 19 nt, Haemophilus influenzae Rd
uuagugguuucagaauaaa

SEQ ID NO: 706275 - RNA, 14 nt, Haemophilus influenzae Rd
uuaguuuuuuauuu

SEQ ID NO: 706276 - RNA, 18 nt, Haemophilus influenzae Rd
uuaguuuuuuuauaaaaa

SEQ ID NO: 706277 - RNA, 15 nt, Haemophilus influenzae Rd
uuauaaaaaaacuaa

SEQ ID NO: 706278 - RNA, 18 nt, Haemophilus influenzae Rd
uuaguuuaagggcuaagu

SEQ ID NO: 706279 - RNA, 13 nt, Haemophilus influenzae Rd
uuaguuuccccug

SEQ ID NO: 706280 - RNA, 17 nt, Haemophilus influenzae Rd
uuaguuugauuacagua

SEQ ID NO: 706281 - RNA, 20 nt, Haemophilus influenzae Rd
uuauaugaaccuauuagaau

SEQ ID NO: 706282 - RNA, 15 nt, Haemophilus influenzae Rd
uuauaugccuaaaaa

SEQ ID NO: 706283 - RNA, 18 nt, Haemophilus influenzae Rd
uuauaugccuaaaaagaa

SEQ ID NO: 706284 - RNA, 16 nt, Haemophilus influenzae Rd
uuauauucauuuaaaa

SEQ ID NO: 706285 - RNA, 22 nt, Haemophilus influenzae Rd
uuauauuccauuauuuaucauc

SEQ ID NO: 706286 - RNA, 16 nt, Haemophilus influenzae Rd
uuauauuccuuauuca

SEQ ID NO: 706287 - RNA, 20 nt, Haemophilus influenzae Rd
uuauauuccuuauucaaaua

SEQ ID NO: 706288 - RNA, 22 nt, Haemophilus influenzae Rd
uuauauucuggcaauauuucaa

SEQ ID NO: 706289 - RNA, 17 nt, Haemophilus influenzae Rd
uuauauuuuuucuuaaa

SEQ ID NO: 706290 - RNA, 15 nt, Haemophilus influenzae Rd
uuaucaaaaaacgaa

SEQ ID NO: 706291 - RNA, 14 nt, Haemophilus influenzae Rd
uuaucaaaaagaaa

SEQ ID NO: 706292 - RNA, 14 nt, Haemophilus influenzae Rd
uuaucaaaaaucuu

SEQ ID NO: 706293 - RNA, 14 nt, Haemophilus influenzae Rd
uuauauuuuuaauu

SEQ ID NO: 706294 - RNA, 21 nt, Haemophilus influenzae Rd
uuauauuuccaucaaaagauc

SEQ ID NO: 706295 - RNA, 22 nt, Haemophilus influenzae Rd
uuauacuaaggguauacuuuau

SEQ ID NO: 706296 - RNA, 18 nt, Haemophilus influenzae Rd
uuauacuuaaucaaauaa

SEQ ID NO: 706297 - RNA, 15 nt, Haemophilus influenzae Rd
uuauaguauauuuau

SEQ ID NO: 706298 - RNA, 13 nt, Haemophilus influenzae Rd
uuauaguuuuauu

SEQ ID NO: 706299 - RNA, 14 nt, Haemophilus influenzae Rd
uuauaacguuuaaa

SEQ ID NO: 706300 - RNA, 15 nt, Haemophilus influenzae Rd
uuauaaauuaccuug

SEQ ID NO: 706301 - RNA, 19 nt, Haemophilus influenzae Rd
uuauaaauuaccuuguuuu

SEQ ID NO: 706302 - RNA, 19 nt, Haemophilus influenzae Rd
uuauaaauuagcuuaauaa

SEQ ID NO: 706303 - RNA, 17 nt, Haemophilus influenzae Rd
uuauacauuuaaccaaa

SEQ ID NO: 706304 - RNA, 19 nt, Haemophilus influenzae Rd
uuauacauuuaaccaaaac

SEQ ID NO: 706305 - RNA, 16 nt, Haemophilus influenzae Rd
uuauacgaguaaaaaa

SEQ ID NO: 706306 - RNA, 17 nt, Haemophilus influenzae Rd
uuauacgaguaaaaaau

SEQ ID NO: 706307 - RNA, 16 nt, Haemophilus influenzae Rd
uuauacgcauaauaaa

SEQ ID NO: 706308 - RNA, 15 nt, Haemophilus influenzae Rd
uuacgaccuuuacuu

SEQ ID NO: 706309 - RNA, 16 nt, Haemophilus influenzae Rd
uuacuuagauauauua

SEQ ID NO: 706310 - RNA, 15 nt, Haemophilus influenzae Rd
uuacuuauaagauga

SEQ ID NO: 706311 - RNA, 16 nt, Haemophilus influenzae Rd
uuaccuguugcauuag

SEQ ID NO: 706312 - RNA, 19 nt, Haemophilus influenzae Rd
uuaccuucagcacuuaaug

SEQ ID NO: 706313 - RNA, 14 nt, Haemophilus influenzae Rd
uuacgaaaacuuuc

SEQ ID NO: 706314 - RNA, 14 nt, Haemophilus influenzae Rd
uuacuucuacuucu

SEQ ID NO: 706315 - RNA, 14 nt, Haemophilus influenzae Rd
uuacuugaaauugu

SEQ ID NO: 706316 - RNA, 16 nt, Haemophilus influenzae Rd
uuagaaaguaaacaau

SEQ ID NO: 706317 - RNA, 16 nt, Haemophilus influenzae Rd
uuacuuggcauuucaa

SEQ ID NO: 706318 - RNA, 16 nt, Haemophilus influenzae Rd
uuagaaaucaacacac

SEQ ID NO: 706319 - RNA, 16 nt, Haemophilus influenzae Rd
uuagaacuuagccuuu

SEQ ID NO: 706320 - RNA, 18 nt, Haemophilus influenzae Rd
uuagacaacaacuuuucu

SEQ ID NO: 706321 - RNA, 19 nt, Haemophilus influenzae Rd
uuagacagacuauuucugu

SEQ ID NO: 706322 - RNA, 20 nt, Haemophilus influenzae Rd
uuagacggugaaaauuuacu

SEQ ID NO: 706323 - RNA, 14 nt, Haemophilus influenzae Rd
uuagauuugaaccu

SEQ ID NO: 706324 - RNA, 19 nt, Haemophilus influenzae Rd
uuagaugcuguaaaucuuu

SEQ ID NO: 706325 - RNA, 14 nt, Haemophilus influenzae Rd
uuagauuacuuuua

SEQ ID NO: 706326 - RNA, 23 nt, Haemophilus influenzae Rd
uuagauuauggcugacuagauaa

SEQ ID NO: 706327 - RNA, 15 nt, Haemophilus influenzae Rd
uuagaucagaaaacg

SEQ ID NO: 706328 - RNA, 12 nt, Haemophilus influenzae Rd
uuagauauaaaa

SEQ ID NO: 706329 - RNA, 16 nt, Haemophilus influenzae Rd
uuagaugauuuuaaaa

SEQ ID NO: 706330 - RNA, 14 nt, Haemophilus influenzae Rd
uuagauacaaagau

SEQ ID NO: 706331 - RNA, 19 nt, Haemophilus influenzae Rd
uuagauacaaagauuucau

SEQ ID NO: 706332 - RNA, 15 nt, Haemophilus influenzae Rd
uuagauacauaaaaa

SEQ ID NO: 706333 - RNA, 21 nt, Haemophilus influenzae Rd
uuagcgaguucuuggauaauu

SEQ ID NO: 706334 - RNA, 13 nt, Haemophilus influenzae Rd
uuagccuguucuu

SEQ ID NO: 706335 - RNA, 16 nt, Haemophilus influenzae Rd
uuagccuguucuucca

SEQ ID NO: 706336 - RNA, 10 nt, Haemophilus influenzae Rd
uuagcgauua

SEQ ID NO: 706337 - RNA, 19 nt, Haemophilus influenzae Rd
uuagccuagauauuucuag

SEQ ID NO: 706338 - RNA, 15 nt, Haemophilus influenzae Rd
uuagcuaaaaaaacu

SEQ ID NO: 706339 - RNA, 18 nt, Haemophilus influenzae Rd
uuagcguacagaccauug

SEQ ID NO: 706340 - RNA, 19 nt, Haemophilus influenzae Rd
uuagcuauuaaauuagacu

SEQ ID NO: 706341 - RNA, 19 nt, Haemophilus influenzae Rd
uuagcuccuaaauuaggca

SEQ ID NO: 706342 - RNA, 21 nt, Haemophilus influenzae Rd
uuagcucguugccauaaaaaa

SEQ ID NO: 706343 - RNA, 20 nt, Haemophilus influenzae Rd
uuaggaauaucuuugacuaa

SEQ ID NO: 706344 - RNA, 21 nt, Haemophilus influenzae Rd
uuaggcgacgcugcaaaauga

SEQ ID NO: 706345 - RNA, 18 nt, Haemophilus influenzae Rd
uuagccacgaaagcuuca

SEQ ID NO: 706346 - RNA, 23 nt, Haemophilus influenzae Rd
uuagauuuucuuauuauacauuu

SEQ ID NO: 706347 - RNA, 15 nt, Haemophilus influenzae Rd
uuaccgcacuuuaaa

SEQ ID NO: 706348 - RNA, 21 nt, Haemophilus influenzae Rd
uuaccgcacuuuauaguugua

SEQ ID NO: 706349 - RNA, 15 nt, Haemophilus influenzae Rd
uuaccgcacuuuuuu

SEQ ID NO: 706350 - RNA, 20 nt, Haemophilus influenzae Rd
uuaccgccgaaauucccauu

SEQ ID NO: 706351 - RNA, 16 nt, Haemophilus influenzae Rd
uuaccgaucauuucug

SEQ ID NO: 706352 - RNA, 23 nt, Haemophilus influenzae Rd
uuacccuauuacuuuccauaaua

SEQ ID NO: 706353 - RNA, 21 nt, Haemophilus influenzae Rd
uuaccaucacguuaucaaaga

SEQ ID NO: 706354 - RNA, 17 nt, Haemophilus influenzae Rd
uuaccgcucgccaauaa

SEQ ID NO: 706355 - RNA, 18 nt, Haemophilus influenzae Rd
uuaccgcucgccaauaaa

SEQ ID NO: 706356 - RNA, 15 nt, Haemophilus influenzae Rd
uuaccuaaaaauuua

SEQ ID NO: 706357 - RNA, 19 nt, Haemophilus influenzae Rd
uuaccugauucauugcauu

SEQ ID NO: 706358 - RNA, 16 nt, Haemophilus influenzae Rd
uuaccuguaauccuuu

SEQ ID NO: 706359 - RNA, 12 nt, Haemophilus influenzae Rd
uuaccugugaaa

SEQ ID NO: 706360 - RNA, 11 nt, Haemophilus influenzae Rd
uuaccuaacca

SEQ ID NO: 706361 - RNA, 19 nt, Haemophilus influenzae Rd
uuacacagaugccauuaaa

SEQ ID NO: 706362 - RNA, 21 nt, Haemophilus influenzae Rd
uuacaauccuaacuuuucuuc

SEQ ID NO: 706363 - RNA, 18 nt, Haemophilus influenzae Rd
uuacagguuugacauuca

SEQ ID NO: 706364 - RNA, 13 nt, Haemophilus influenzae Rd
uuacagguguagu

SEQ ID NO: 706365 - RNA, 20 nt, Haemophilus influenzae Rd
uuacaguacaauuaauuaaa

SEQ ID NO: 706366 - RNA, 18 nt, Haemophilus influenzae Rd
uuacaguuugcgugaaua

SEQ ID NO: 706367 - RNA, 17 nt, Haemophilus influenzae Rd
uuaccaccgcuaaauca

SEQ ID NO: 706368 - RNA, 22 nt, Haemophilus influenzae Rd
uuaccacgaguauauugcauaa

SEQ ID NO: 706369 - RNA, 23 nt, Haemophilus influenzae Rd
uuaccacguucuuguaagccaaa

SEQ ID NO: 706370 - RNA, 17 nt, Haemophilus influenzae Rd
uuaauccuaguuuuuuc

SEQ ID NO: 706371 - RNA, 17 nt, Haemophilus influenzae Rd
uuaaucgaucuauauuc

SEQ ID NO: 706372 - RNA, 14 nt, Haemophilus influenzae Rd
uuaaucguuaccaa

SEQ ID NO: 706373 - RNA, 17 nt, Haemophilus influenzae Rd
uuaaucguuaccaagaa

SEQ ID NO: 706374 - RNA, 18 nt, Haemophilus influenzae Rd
uuaauuacucacuauaac

SEQ ID NO: 706375 - RNA, 19 nt, Haemophilus influenzae Rd
uuaauucuucgauuaguuu

SEQ ID NO: 706376 - RNA, 23 nt, Haemophilus influenzae Rd
uuaauucuaaauucucaagaaua

SEQ ID NO: 706377 - RNA, 16 nt, Haemophilus influenzae Rd
uuaauguuauuaaaua

SEQ ID NO: 706378 - RNA, 14 nt, Haemophilus influenzae Rd
uuaauuaaauacaa

SEQ ID NO: 706379 - RNA, 15 nt, Haemophilus influenzae Rd
uuaauuaaauacaaa

SEQ ID NO: 706380 - RNA, 17 nt, Haemophilus influenzae Rd
uuaauuaaauacaaaac

SEQ ID NO: 706381 - RNA, 18 nt, Haemophilus influenzae Rd
uuaauuaaucaauaagaa

SEQ ID NO: 706382 - RNA, 13 nt, Haemophilus influenzae Rd
uuaauuuuuuaua

SEQ ID NO: 706383 - RNA, 13 nt, Haemophilus influenzae Rd
uuaauuuuuucac

SEQ ID NO: 706384 - RNA, 22 nt, Haemophilus influenzae Rd
uuacaaaaaguacuugcaaggg

SEQ ID NO: 706385 - RNA, 18 nt, Haemophilus influenzae Rd
uuaauuuuuucuguuuuu

SEQ ID NO: 706386 - RNA, 14 nt, Haemophilus influenzae Rd
uuacaaaaaaguac

SEQ ID NO: 706387 - RNA, 15 nt, Haemophilus influenzae Rd
uuaauuuuuagauua

SEQ ID NO: 706388 - RNA, 19 nt, Haemophilus influenzae Rd
uuaauuuuaucuugcugcu

SEQ ID NO: 706389 - RNA, 12 nt, Haemophilus influenzae Rd
uuaauuuuccua

SEQ ID NO: 706390 - RNA, 17 nt, Haemophilus influenzae Rd
uuaauugaaagauuaau

SEQ ID NO: 706391 - RNA, 13 nt, Haemophilus influenzae Rd
uuaauuucgcuuu

SEQ ID NO: 706392 - RNA, 22 nt, Haemophilus influenzae Rd
uuaauuggaaauaauauucaaa

SEQ ID NO: 706393 - RNA, 16 nt, Haemophilus influenzae Rd
uuaauuucuuaauuaa

SEQ ID NO: 706394 - RNA, 22 nt, Haemophilus influenzae Rd
uuaauuucuuuuccuugcugau

SEQ ID NO: 706395 - RNA, 12 nt, Haemophilus influenzae Rd
uuaaucauugca

SEQ ID NO: 706396 - RNA, 22 nt, Haemophilus influenzae Rd
uuaauccaauccauaacaacca

SEQ ID NO: 706397 - RNA, 13 nt, Haemophilus influenzae Rd
uuaaucauuuuca

SEQ ID NO: 706398 - RNA, 18 nt, Haemophilus influenzae Rd
uuaaucauuuuuuaacuu

SEQ ID NO: 706399 - RNA, 13 nt, Haemophilus influenzae Rd
uuaaucaauaaga

SEQ ID NO: 706400 - RNA, 18 nt, Haemophilus influenzae Rd
uuaauauuauucuuuuca

SEQ ID NO: 706401 - RNA, 17 nt, Haemophilus influenzae Rd
uuaauauuuuuuucaaa

SEQ ID NO: 706402 - RNA, 15 nt, Haemophilus influenzae Rd
uuaaucaaacuuuua

SEQ ID NO: 706403 - RNA, 14 nt, Haemophilus influenzae Rd
uuaaucaaauaaaa

SEQ ID NO: 706404 - RNA, 13 nt, Haemophilus influenzae Rd
uuaauauauuuuu

SEQ ID NO: 706405 - RNA, 16 nt, Haemophilus influenzae Rd
uuaauauauuuuuuua

SEQ ID NO: 706406 - RNA, 12 nt, Haemophilus influenzae Rd
uuaauauguucu

SEQ ID NO: 706407 - RNA, 20 nt, Haemophilus influenzae Rd
uuaauaucaugcaauucccu

SEQ ID NO: 706408 - RNA, 14 nt, Haemophilus influenzae Rd
uuaauaucuucuaa

SEQ ID NO: 706409 - RNA, 15 nt, Haemophilus influenzae Rd
uuaauaauggauuaa

SEQ ID NO: 706410 - RNA, 16 nt, Haemophilus influenzae Rd
uuaaguguuuacuauu

SEQ ID NO: 706411 - RNA, 17 nt, Haemophilus influenzae Rd
uuaaguguuuacuauua

SEQ ID NO: 706412 - RNA, 13 nt, Haemophilus influenzae Rd
uuaaguuaaaagu

SEQ ID NO: 706413 - RNA, 18 nt, Haemophilus influenzae Rd
uuaaguucaacaccuaaa

SEQ ID NO: 706414 - RNA, 14 nt, Haemophilus influenzae Rd
uuaaguucaucaua

SEQ ID NO: 706415 - RNA, 17 nt, Haemophilus influenzae Rd
uuaauaccaauaauaau

SEQ ID NO: 706416 - RNA, 12 nt, Haemophilus influenzae Rd
uuaauaauuuaa

SEQ ID NO: 706417 - RNA, 23 nt, Haemophilus influenzae Rd
uuaauaguugagcuaaagugcgg

SEQ ID NO: 706418 - RNA, 17 nt, Haemophilus influenzae Rd
uuaauagagaauaauua

SEQ ID NO: 706419 - RNA, 14 nt, Haemophilus influenzae Rd
uuaauagcauugua

SEQ ID NO: 706420 - RNA, 18 nt, Haemophilus influenzae Rd
uuaauagcugggcaaaau

SEQ ID NO: 706421 - RNA, 15 nt, Haemophilus influenzae Rd
uuaauaggaauaaca

SEQ ID NO: 706422 - RNA, 22 nt, Haemophilus influenzae Rd
uuaauauaaaggauuuuaucau

SEQ ID NO: 706423 - RNA, 18 nt, Haemophilus influenzae Rd
uuaaguaguauuuuauuu

SEQ ID NO: 706424 - RNA, 21 nt, Haemophilus influenzae Rd
uuaaguaguauuuuauuuaua

SEQ ID NO: 706425 - RNA, 18 nt, Haemophilus influenzae Rd
uuaaguaguguuuuauuu

SEQ ID NO: 706426 - RNA, 15 nt, Haemophilus influenzae Rd
uuaaguauagcuuuu

SEQ ID NO: 706427 - RNA, 20 nt, Haemophilus influenzae Rd
uuaagucgauaaagaaugca

SEQ ID NO: 706428 - RNA, 18 nt, Haemophilus influenzae Rd
uuaagucagcauaaacaa

SEQ ID NO: 706429 - RNA, 13 nt, Haemophilus influenzae Rd
uuaagguuucuuc

SEQ ID NO: 706430 - RNA, 15 nt, Haemophilus influenzae Rd
uuaagugaauuuaua

SEQ ID NO: 706431 - RNA, 13 nt, Haemophilus influenzae Rd
uuaagugcaacug

SEQ ID NO: 706432 - RNA, 23 nt, Haemophilus influenzae Rd
uuaagggcgcagacugcauaucc

SEQ ID NO: 706433 - RNA, 20 nt, Haemophilus influenzae Rd
uuaaggcacagauuaaagug

SEQ ID NO: 706434 - RNA, 18 nt, Haemophilus influenzae Rd
uuaagagaggagaaauaa

SEQ ID NO: 706435 - RNA, 21 nt, Haemophilus influenzae Rd
uuaacugaaaauucauuauua

SEQ ID NO: 706436 - RNA, 18 nt, Haemophilus influenzae Rd
uuaacucggcuuuuucaa

SEQ ID NO: 706437 - RNA, 23 nt, Haemophilus influenzae Rd
uuaaauccugacaaccuguuugg

SEQ ID NO: 706438 - RNA, 15 nt, Haemophilus influenzae Rd
uuaaauaaaauaaca

SEQ ID NO: 706439 - RNA, 18 nt, Haemophilus influenzae Rd
uuaaauaaaauaacaaaa

SEQ ID NO: 706440 - RNA, 20 nt, Haemophilus influenzae Rd
uuaaauaaaauauuuaauuu

SEQ ID NO: 706441 - RNA, 15 nt, Haemophilus influenzae Rd
uuaaauaaacauuau

SEQ ID NO: 706442 - RNA, 21 nt, Haemophilus influenzae Rd
uuaaauaaacauuaugaaaaa

SEQ ID NO: 706443 - RNA, 19 nt, Haemophilus influenzae Rd
uuaaauaaaccgcaucaaa

SEQ ID NO: 706444 - RNA, 14 nt, Haemophilus influenzae Rd
uuaaauaaauaaua

SEQ ID NO: 706445 - RNA, 18 nt, Haemophilus influenzae Rd
uuaaauaaauccuuaauu

SEQ ID NO: 706446 - RNA, 19 nt, Haemophilus influenzae Rd
uuaaaucuucuaucuacua

SEQ ID NO: 706447 - RNA, 21 nt, Haemophilus influenzae Rd
uuaaaugaaguuuuacugauu

SEQ ID NO: 706448 - RNA, 20 nt, Haemophilus influenzae Rd
uuaaaucgauuacucugcua

SEQ ID NO: 706449 - RNA, 18 nt, Haemophilus influenzae Rd
ugugcaccuucaacauuu

SEQ ID NO: 706450 - RNA, 12 nt, Haemophilus influenzae Rd
ugugcaauuuga

SEQ ID NO: 706451 - RNA, 20 nt, Haemophilus influenzae Rd
ugugcaauaacguuacuaaa

SEQ ID NO: 706452 - RNA, 16 nt, Haemophilus influenzae Rd
ugugaguaaaauacga

SEQ ID NO: 706453 - RNA, 22 nt, Haemophilus influenzae Rd
ugugcauuaaaucaaauuuagg

SEQ ID NO: 706454 - RNA, 18 nt, Haemophilus influenzae Rd
ugugcgauggcccaaaac

SEQ ID NO: 706455 - RNA, 20 nt, Haemophilus influenzae Rd
ugugcgauucaucacuucuu

SEQ ID NO: 706456 - RNA, 23 nt, Haemophilus influenzae Rd
ugugcgauuuucucuugcagaac

SEQ ID NO: 706457 - RNA, 14 nt, Haemophilus influenzae Rd
ugugcgaccugaag

SEQ ID NO: 706458 - RNA, 18 nt, Haemophilus influenzae Rd
ugucaccaaauacauuuu

SEQ ID NO: 706459 - RNA, 14 nt, Haemophilus influenzae Rd
ugucagauuuaccc

SEQ ID NO: 706460 - RNA, 15 nt, Haemophilus influenzae Rd
ugucagauuuauaaa

SEQ ID NO: 706461 - RNA, 14 nt, Haemophilus influenzae Rd
ugugaccaaauaau

SEQ ID NO: 706462 - RNA, 19 nt, Haemophilus influenzae Rd
uguggcgugagauccuuua

SEQ ID NO: 706463 - RNA, 21 nt, Haemophilus influenzae Rd
uguggcuuuugucgcuaacug

SEQ ID NO: 706464 - RNA, 23 nt, Haemophilus influenzae Rd
uguggcuuuugucgcuaacugau

SEQ ID NO: 706465 - RNA, 21 nt, Haemophilus influenzae Rd
ugugguaaagcuacaucaaca

SEQ ID NO: 706466 - RNA, 23 nt, Haemophilus influenzae Rd
uguggguuccagguuguuuuucu

SEQ ID NO: 706467 - RNA, 17 nt, Haemophilus influenzae Rd
uguggguuuauugguaa

SEQ ID NO: 706468 - RNA, 18 nt, Haemophilus influenzae Rd
ugugggugcugcaacugg

SEQ ID NO: 706469 - RNA, 19 nt, Haemophilus influenzae Rd
ugugggauaaauucauuuu

SEQ ID NO: 706470 - RNA, 21 nt, Haemophilus influenzae Rd
ugugcucccccccaauaaaaa

SEQ ID NO: 706471 - RNA, 18 nt, Haemophilus influenzae Rd
ugugcucaaguuuuauuu

SEQ ID NO: 706472 - RNA, 20 nt, Haemophilus influenzae Rd
uguuaaauugaacugaauua

SEQ ID NO: 706473 - RNA, 16 nt, Haemophilus influenzae Rd
uguuaaauugcaaaaa

SEQ ID NO: 706474 - RNA, 14 nt, Haemophilus influenzae Rd
uguuaaauaaaucc

SEQ ID NO: 706475 - RNA, 19 nt, Haemophilus influenzae Rd
uguguuuuuaauuagagag

SEQ ID NO: 706476 - RNA, 15 nt, Haemophilus influenzae Rd
uguguuuuucaaaaa

SEQ ID NO: 706477 - RNA, 14 nt, Haemophilus influenzae Rd
uguguuucagcuuc

SEQ ID NO: 706478 - RNA, 19 nt, Haemophilus influenzae Rd
uguucacugcggcaaaauc

SEQ ID NO: 706479 - RNA, 21 nt, Haemophilus influenzae Rd
uguucagccaauuuuucaaaa

SEQ ID NO: 706480 - RNA, 18 nt, Haemophilus influenzae Rd
uguucagccacuucuuca

SEQ ID NO: 706481 - RNA, 13 nt, Haemophilus influenzae Rd
uguuauugaugaa

SEQ ID NO: 706482 - RNA, 17 nt, Haemophilus influenzae Rd
uguuauugaugaagaug

SEQ ID NO: 706483 - RNA, 20 nt, Haemophilus influenzae Rd
uguuauugaugaagaugaag

SEQ ID NO: 706484 - RNA, 16 nt, Haemophilus influenzae Rd
uguuauuggaaaauuc

SEQ ID NO: 706485 - RNA, 22 nt, Haemophilus influenzae Rd
uguuauugugaugggaaacuga

SEQ ID NO: 706486 - RNA, 14 nt, Haemophilus influenzae Rd
uguucacaucaaaa

SEQ ID NO: 706487 - RNA, 20 nt, Haemophilus influenzae Rd
uguucacuaaagagaaacau

SEQ ID NO: 706488 - RNA, 14 nt, Haemophilus influenzae Rd
uguuauuaaaauua

SEQ ID NO: 706489 - RNA, 13 nt, Haemophilus influenzae Rd
uguuaauaagccc

SEQ ID NO: 706490 - RNA, 20 nt, Haemophilus influenzae Rd
uguuaauaagcccaacuuaa

SEQ ID NO: 706491 - RNA, 15 nt, Haemophilus influenzae Rd
uguuaaguucaucau

SEQ ID NO: 706492 - RNA, 20 nt, Haemophilus influenzae Rd
uguuaaguucaucauaaauu

SEQ ID NO: 706493 - RNA, 21 nt, Haemophilus influenzae Rd
uguuaaguaugccauaaaaua

SEQ ID NO: 706494 - RNA, 14 nt, Haemophilus influenzae Rd
uguuaauaaaccuu

SEQ ID NO: 706495 - RNA, 12 nt, Haemophilus influenzae Rd
uguuaagcacca

SEQ ID NO: 706496 - RNA, 24 nt, Haemophilus influenzae Rd
uguucaggugucaucacucguugg

SEQ ID NO: 706497 - RNA, 16 nt, Haemophilus influenzae Rd
uguucguuuguuugaa

SEQ ID NO: 706498 - RNA, 16 nt, Haemophilus influenzae Rd
uguucuaagguauaaa

SEQ ID NO: 706499 - RNA, 19 nt, Haemophilus influenzae Rd
uguucgacaauuuguccuu

SEQ ID NO: 706500 - RNA, 16 nt, Haemophilus influenzae Rd
uguugcauuucuaaau

SEQ ID NO: 706501 - RNA, 18 nt, Haemophilus influenzae Rd
uguugccauaaauuugga

SEQ ID NO: 706502 - RNA, 22 nt, Haemophilus influenzae Rd
uguuggaaugaucgaccauugc

SEQ ID NO: 706503 - RNA, 14 nt, Haemophilus influenzae Rd
uguuggauaucuug

SEQ ID NO: 706504 - RNA, 13 nt, Haemophilus influenzae Rd
uguuggaucuucc

SEQ ID NO: 706505 - RNA, 14 nt, Haemophilus influenzae Rd
uguuggaaauuuaa

SEQ ID NO: 706506 - RNA, 20 nt, Haemophilus influenzae Rd
uguucuagugcaacaacaaa

SEQ ID NO: 706507 - RNA, 23 nt, Haemophilus influenzae Rd
uguugcaaugacaguuucgccug

SEQ ID NO: 706508 - RNA, 13 nt, Haemophilus influenzae Rd
uguugcaaauuuu

SEQ ID NO: 706509 - RNA, 16 nt, Haemophilus influenzae Rd
uguugcaaauuuuuca

SEQ ID NO: 706510 - RNA, 13 nt, Haemophilus influenzae Rd
uguugauuuauca

SEQ ID NO: 706511 - RNA, 22 nt, Haemophilus influenzae Rd
uguugauugacuuguuuuaaaa

SEQ ID NO: 706512 - RNA, 12 nt, Haemophilus influenzae Rd
uguugauuucua

SEQ ID NO: 706513 - RNA, 14 nt, Haemophilus influenzae Rd
uguuguuuaauaag

SEQ ID NO: 706514 - RNA, 20 nt, Haemophilus influenzae Rd
uguuguuccaccuugaauaa

SEQ ID NO: 706515 - RNA, 16 nt, Haemophilus influenzae Rd
uguuguucuaacauuu

SEQ ID NO: 706516 - RNA, 19 nt, Haemophilus influenzae Rd
uguuguucuaacauuuuuu

SEQ ID NO: 706517 - RNA, 13 nt, Haemophilus influenzae Rd
uguuguuauucua

SEQ ID NO: 706518 - RNA, 12 nt, Haemophilus influenzae Rd
uguuguucuuuc

SEQ ID NO: 706519 - RNA, 22 nt, Haemophilus influenzae Rd
uguugugaguaagucuucuuua

SEQ ID NO: 706520 - RNA, 20 nt, Haemophilus influenzae Rd
uguugugaaguuuuuuaagu

SEQ ID NO: 706521 - RNA, 15 nt, Haemophilus influenzae Rd
uguugguaauucagc

SEQ ID NO: 706522 - RNA, 18 nt, Haemophilus influenzae Rd
uguugguuaaaaauagcc

SEQ ID NO: 706523 - RNA, 11 nt, Haemophilus influenzae Rd
uguuuuggaua

SEQ ID NO: 706524 - RNA, 16 nt, Haemophilus influenzae Rd
uguuuuguucaucuaa

SEQ ID NO: 706525 - RNA, 19 nt, Haemophilus influenzae Rd
uguuuuuccaauucuuuua

SEQ ID NO: 706526 - RNA, 22 nt, Haemophilus influenzae Rd
uguuuuuccaauucuuuuaaau

SEQ ID NO: 706527 - RNA, 23 nt, Haemophilus influenzae Rd
uguuuuucugggaagaaaauauc

SEQ ID NO: 706528 - RNA, 23 nt, Haemophilus influenzae Rd
uuaaaaaaauaguuaaucgaaaa

SEQ ID NO: 706529 - RNA, 19 nt, Haemophilus influenzae Rd
uuaaaaaaacguuaaauuu

SEQ ID NO: 706530 - RNA, 23 nt, Haemophilus influenzae Rd
uuaaaaaagaugaggcguuuuuc

SEQ ID NO: 706531 - RNA, 15 nt, Haemophilus influenzae Rd
uguuuuuuucuaaau

SEQ ID NO: 706532 - RNA, 16 nt, Haemophilus influenzae Rd
uguuuuuucauauuuu

SEQ ID NO: 706533 - RNA, 19 nt, Haemophilus influenzae Rd
uguuuuuucauauuuuaaa

SEQ ID NO: 706534 - RNA, 20 nt, Haemophilus influenzae Rd
uguuuuuucauauuuuaaau

SEQ ID NO: 706535 - RNA, 22 nt, Haemophilus influenzae Rd
uuaaaaacacuaugauuuuuaa

SEQ ID NO: 706536 - RNA, 16 nt, Haemophilus influenzae Rd
uuaaaaaauaauuuag

SEQ ID NO: 706537 - RNA, 20 nt, Haemophilus influenzae Rd
uuaaaaaaucagauacauuu

SEQ ID NO: 706538 - RNA, 15 nt, Haemophilus influenzae Rd
uuaaaaacggaauca

SEQ ID NO: 706539 - RNA, 17 nt, Haemophilus influenzae Rd
uuaaaaacuaaccgcac

SEQ ID NO: 706540 - RNA, 17 nt, Haemophilus influenzae Rd
uuaaaaauaaguucauc

SEQ ID NO: 706541 - RNA, 22 nt, Haemophilus influenzae Rd
uuaaaaauaaguucaucaacug

SEQ ID NO: 706542 - RNA, 21 nt, Haemophilus influenzae Rd
uuaaaacuauuuuuaauuuug

SEQ ID NO: 706543 - RNA, 11 nt, Haemophilus influenzae Rd
uuaaaacauga

SEQ ID NO: 706544 - RNA, 11 nt, Haemophilus influenzae Rd
uuaaaacauuc

SEQ ID NO: 706545 - RNA, 20 nt, Haemophilus influenzae Rd
uuaaaaauccgccacuuuga

SEQ ID NO: 706546 - RNA, 16 nt, Haemophilus influenzae Rd
uuaaaaauuuaaaagc

SEQ ID NO: 706547 - RNA, 18 nt, Haemophilus influenzae Rd
uuaaaacaaaagaaauuu

SEQ ID NO: 706548 - RNA, 15 nt, Haemophilus influenzae Rd
uuaaaacaaaaggcc

SEQ ID NO: 706549 - RNA, 17 nt, Haemophilus influenzae Rd
uuaaaaugguuuaaaua

SEQ ID NO: 706550 - RNA, 18 nt, Haemophilus influenzae Rd
uuaaaaugguuuaaauaa

SEQ ID NO: 706551 - RNA, 23 nt, Haemophilus influenzae Rd
uuaaaauuaguaacagguaaaau

SEQ ID NO: 706552 - RNA, 17 nt, Haemophilus influenzae Rd
uuaaacggucauuuaca

SEQ ID NO: 706553 - RNA, 21 nt, Haemophilus influenzae Rd
uuaaacggucauuuacaaaca

SEQ ID NO: 706554 - RNA, 11 nt, Haemophilus influenzae Rd
uuaaaauuuaa

SEQ ID NO: 706555 - RNA, 13 nt, Haemophilus influenzae Rd
uuaaaauuuauuu

SEQ ID NO: 706556 - RNA, 15 nt, Haemophilus influenzae Rd
uuaaaaucucucaaa

SEQ ID NO: 706557 - RNA, 13 nt, Haemophilus influenzae Rd
uuaaaauaguuuu

SEQ ID NO: 706558 - RNA, 15 nt, Haemophilus influenzae Rd
uuaaaaguaaaaaua

SEQ ID NO: 706559 - RNA, 20 nt, Haemophilus influenzae Rd
uuaaaacuugacguuguucu

SEQ ID NO: 706560 - RNA, 14 nt, Haemophilus influenzae Rd
uuaaaagccaauau

SEQ ID NO: 706561 - RNA, 15 nt, Haemophilus influenzae Rd
uuaaaagccaauaug

SEQ ID NO: 706562 - RNA, 23 nt, Haemophilus influenzae Rd
uuaaaaggcuuucuaacacagaa

SEQ ID NO: 706563 - RNA, 17 nt, Haemophilus influenzae Rd
uuaaagucagauuuccu

SEQ ID NO: 706564 - RNA, 19 nt, Haemophilus influenzae Rd
uuaaagccguagucugcua

SEQ ID NO: 706565 - RNA, 21 nt, Haemophilus influenzae Rd
uuaaagcaaucaaaaaugaaa

SEQ ID NO: 706566 - RNA, 21 nt, Haemophilus influenzae Rd
uuaaagccacauaauaagaaa

SEQ ID NO: 706567 - RNA, 16 nt, Haemophilus influenzae Rd
uuaaaguugcugaaua

SEQ ID NO: 706568 - RNA, 12 nt, Haemophilus influenzae Rd
uuaaauaaaaaa

SEQ ID NO: 706569 - RNA, 15 nt, Haemophilus influenzae Rd
uuaaauaaaaaauaa

SEQ ID NO: 706570 - RNA, 12 nt, Haemophilus influenzae Rd
uuaaauaaaaau

SEQ ID NO: 706571 - RNA, 16 nt, Haemophilus influenzae Rd
uuaaacuguauuaaag

SEQ ID NO: 706572 - RNA, 19 nt, Haemophilus influenzae Rd
uuaaacuauugaaaauuaa

SEQ ID NO: 706573 - RNA, 21 nt, Haemophilus influenzae Rd
uuaaacucauccguucaauaa

SEQ ID NO: 706574 - RNA, 18 nt, Haemophilus influenzae Rd
uuaaagaguucguccaaa

SEQ ID NO: 706575 - RNA, 23 nt, Haemophilus influenzae Rd
uuaaagaguucguccaaaaucuc

SEQ ID NO: 706576 - RNA, 19 nt, Haemophilus influenzae Rd
uuaaagauaguaauguucu

SEQ ID NO: 706577 - RNA, 20 nt, Haemophilus influenzae Rd
uuaaagagcaaauuuaaaua

SEQ ID NO: 706578 - RNA, 12 nt, Haemophilus influenzae Rd
uguuucaucauu

SEQ ID NO: 706579 - RNA, 20 nt, Haemophilus influenzae Rd
uguuucauaagauaacaaga

SEQ ID NO: 706580 - RNA, 17 nt, Haemophilus influenzae Rd
uguuuccguguuuuaau

SEQ ID NO: 706581 - RNA, 14 nt, Haemophilus influenzae Rd
uguuucgauaaaaa

SEQ ID NO: 706582 - RNA, 17 nt, Haemophilus influenzae Rd
uguuucgauacuuucuu

SEQ ID NO: 706583 - RNA, 18 nt, Haemophilus influenzae Rd
uguuucgcaguguuaaau

SEQ ID NO: 706584 - RNA, 21 nt, Haemophilus influenzae Rd
uguuucgcaguguuaaaugca

SEQ ID NO: 706585 - RNA, 13 nt, Haemophilus influenzae Rd
uguuuauuauuuc

SEQ ID NO: 706586 - RNA, 14 nt, Haemophilus influenzae Rd
uguuuauuuaacaa

SEQ ID NO: 706587 - RNA, 21 nt, Haemophilus influenzae Rd
uguuucacgaucauaaauuuu

SEQ ID NO: 706588 - RNA, 14 nt, Haemophilus influenzae Rd
uguuucacuaaaaa

SEQ ID NO: 706589 - RNA, 13 nt, Haemophilus influenzae Rd
uguuucacuuugc

SEQ ID NO: 706590 - RNA, 17 nt, Haemophilus influenzae Rd
uguuucaacaaaaauac

SEQ ID NO: 706591 - RNA, 18 nt, Haemophilus influenzae Rd
uguuucaacaaaaauacg

SEQ ID NO: 706592 - RNA, 19 nt, Haemophilus influenzae Rd
uguuuaccaccgauaaaca

SEQ ID NO: 706593 - RNA, 22 nt, Haemophilus influenzae Rd
uguuuaauucgugccacaugau

SEQ ID NO: 706594 - RNA, 23 nt, Haemophilus influenzae Rd
uguuuaauuggaaauaauauuca

SEQ ID NO: 706595 - RNA, 12 nt, Haemophilus influenzae Rd
uguuuaaauggu

SEQ ID NO: 706596 - RNA, 11 nt, Haemophilus influenzae Rd
uguuuaaaagc

SEQ ID NO: 706597 - RNA, 12 nt, Haemophilus influenzae Rd
uguuuaaaauua

SEQ ID NO: 706598 - RNA, 17 nt, Haemophilus influenzae Rd
uguuuaaaguaagaauu

SEQ ID NO: 706599 - RNA, 13 nt, Haemophilus influenzae Rd
uguuuagauuuua

SEQ ID NO: 706600 - RNA, 16 nt, Haemophilus influenzae Rd
uguuuagauuuuacuu

SEQ ID NO: 706601 - RNA, 23 nt, Haemophilus influenzae Rd
uguuuagcaaggcguucaauauu

SEQ ID NO: 706602 - RNA, 16 nt, Haemophilus influenzae Rd
uguuuacuuaaaucuu

SEQ ID NO: 706603 - RNA, 17 nt, Haemophilus influenzae Rd
uguuuacgcuaauuuaa

SEQ ID NO: 706604 - RNA, 22 nt, Haemophilus influenzae Rd
uguuuacgcuaauuuaagaaaa

SEQ ID NO: 706605 - RNA, 22 nt, Haemophilus influenzae Rd
uguuuacggaugcaauccacua

SEQ ID NO: 706606 - RNA, 13 nt, Haemophilus influenzae Rd
uguuuaguuuuau

SEQ ID NO: 706607 - RNA, 14 nt, Haemophilus influenzae Rd
uguuuaguuuuaua

SEQ ID NO: 706608 - RNA, 19 nt, Haemophilus influenzae Rd
uguuuauaacguuaauuca

SEQ ID NO: 706609 - RNA, 22 nt, Haemophilus influenzae Rd
uguuuauaacguuaauucaaac

SEQ ID NO: 706610 - RNA, 22 nt, Haemophilus influenzae Rd
uguuuauauucuggcaauauuu

SEQ ID NO: 706611 - RNA, 19 nt, Haemophilus influenzae Rd
uguuugcgaguaacgucua

SEQ ID NO: 706612 - RNA, 15 nt, Haemophilus influenzae Rd
uguuugcgcauuauc

SEQ ID NO: 706613 - RNA, 23 nt, Haemophilus influenzae Rd
uguuugggauaagcaaucuugcc

SEQ ID NO: 706614 - RNA, 21 nt, Haemophilus influenzae Rd
uguuuggcaaauagcaaaacc

SEQ ID NO: 706615 - RNA, 17 nt, Haemophilus influenzae Rd
uguuugauaaauaucuu

SEQ ID NO: 706616 - RNA, 19 nt, Haemophilus influenzae Rd
uguuugauaaauaucuugc

SEQ ID NO: 706617 - RNA, 15 nt, Haemophilus influenzae Rd
uguuucuucucuuua

SEQ ID NO: 706618 - RNA, 18 nt, Haemophilus influenzae Rd
uguuugaaaauucuucua

SEQ ID NO: 706619 - RNA, 22 nt, Haemophilus influenzae Rd
uguuugaaaucaaauugaucaa

SEQ ID NO: 706620 - RNA, 19 nt, Haemophilus influenzae Rd
uguuugaacuauauccaaa

SEQ ID NO: 706621 - RNA, 23 nt, Haemophilus influenzae Rd
uguuugaacuauauccaaaucaa

SEQ ID NO: 706622 - RNA, 17 nt, Haemophilus influenzae Rd
uguuucuuuaaauaguu

SEQ ID NO: 706623 - RNA, 23 nt, Haemophilus influenzae Rd
uguuucuaauucggcuucaguau

SEQ ID NO: 706624 - RNA, 12 nt, Haemophilus influenzae Rd
uguuucucucua

SEQ ID NO: 706625 - RNA, 19 nt, Haemophilus influenzae Rd
uguuuucaauuuuaaaauu

SEQ ID NO: 706626 - RNA, 18 nt, Haemophilus influenzae Rd
uguuuucccccaguacau

SEQ ID NO: 706627 - RNA, 17 nt, Haemophilus influenzae Rd
uguuuuaucuuuuacau

SEQ ID NO: 706628 - RNA, 20 nt, Haemophilus influenzae Rd
uguuuugauugagauuuaau

SEQ ID NO: 706629 - RNA, 13 nt, Haemophilus influenzae Rd
uguuuucuuuugc

SEQ ID NO: 706630 - RNA, 20 nt, Haemophilus influenzae Rd
uguuuugagugagauaaaug

SEQ ID NO: 706631 - RNA, 11 nt, Haemophilus influenzae Rd
uguuuucuuga

SEQ ID NO: 706632 - RNA, 21 nt, Haemophilus influenzae Rd
uguuuucgucacaaugauuaa

SEQ ID NO: 706633 - RNA, 14 nt, Haemophilus influenzae Rd
uguuuuaaaauuug

SEQ ID NO: 706634 - RNA, 16 nt, Haemophilus influenzae Rd
uguuuguuuuauuuau

SEQ ID NO: 706635 - RNA, 22 nt, Haemophilus influenzae Rd
uguuuuaaaacuauuuuuaauu

SEQ ID NO: 706636 - RNA, 12 nt, Haemophilus influenzae Rd
uguuuuaaaauu

SEQ ID NO: 706637 - RNA, 24 nt, Haemophilus influenzae Rd
uguuugucgcaggugucacagcaa

SEQ ID NO: 706638 - RNA, 19 nt, Haemophilus influenzae Rd
uguuugugcguuuuuuaau

SEQ ID NO: 706639 - RNA, 18 nt, Haemophilus influenzae Rd
uguuuguuaugaaauugc

SEQ ID NO: 706640 - RNA, 13 nt, Haemophilus influenzae Rd
uguuuuaccuucu

SEQ ID NO: 706641 - RNA, 17 nt, Haemophilus influenzae Rd
uguuuuacgccauucuu

SEQ ID NO: 706642 - RNA, 15 nt, Haemophilus influenzae Rd
uguuuuacuucaucc

SEQ ID NO: 706643 - RNA, 21 nt, Haemophilus influenzae Rd
uguuuuaucagaaugauuauc

SEQ ID NO: 706644 - RNA, 13 nt, Haemophilus influenzae Rd
uggagaacuucaa

SEQ ID NO: 706645 - RNA, 20 nt, Haemophilus influenzae Rd
uggagaaaugucguaagaac

SEQ ID NO: 706646 - RNA, 18 nt, Haemophilus influenzae Rd
uggagaaacauuuuuccc

SEQ ID NO: 706647 - RNA, 13 nt, Haemophilus influenzae Rd
uggagaaagaaau

SEQ ID NO: 706648 - RNA, 20 nt, Haemophilus influenzae Rd
uggacgcucuacauuuacau

SEQ ID NO: 706649 - RNA, 15 nt, Haemophilus influenzae Rd
uggacugaaggugcg

SEQ ID NO: 706650 - RNA, 22 nt, Haemophilus influenzae Rd
uggauacauuccaucaaaacuu

SEQ ID NO: 706651 - RNA, 14 nt, Haemophilus influenzae Rd
uggauauucugcau

SEQ ID NO: 706652 - RNA, 15 nt, Haemophilus influenzae Rd
uggauauagaaauca

SEQ ID NO: 706653 - RNA, 12 nt, Haemophilus influenzae Rd
uggauaauguuc

SEQ ID NO: 706654 - RNA, 19 nt, Haemophilus influenzae Rd
uggauaauguucuuuuaaa

SEQ ID NO: 706655 - RNA, 21 nt, Haemophilus influenzae Rd
uggaguuguuuaaaauuagua

SEQ ID NO: 706656 - RNA, 15 nt, Haemophilus influenzae Rd
uggaguuggcucgcc

SEQ ID NO: 706657 - RNA, 21 nt, Haemophilus influenzae Rd
uggaucugugacgccauccaa

SEQ ID NO: 706658 - RNA, 16 nt, Haemophilus influenzae Rd
uggaucacccauuaaa

SEQ ID NO: 706659 - RNA, 18 nt, Haemophilus influenzae Rd
uggaugcccaagugcgau

SEQ ID NO: 706660 - RNA, 13 nt, Haemophilus influenzae Rd
uggaucuucagca

SEQ ID NO: 706661 - RNA, 20 nt, Haemophilus influenzae Rd
uggaucuuccaauaauucuu

SEQ ID NO: 706662 - RNA, 21 nt, Haemophilus influenzae Rd
uggaucuuccaauaauucuuu

SEQ ID NO: 706663 - RNA, 16 nt, Haemophilus influenzae Rd
uggauguaaugagcac

SEQ ID NO: 706664 - RNA, 21 nt, Haemophilus influenzae Rd
uggauucauuugcaaaucaag

SEQ ID NO: 706665 - RNA, 16 nt, Haemophilus influenzae Rd
uggauuccaucauugu

SEQ ID NO: 706666 - RNA, 14 nt, Haemophilus influenzae Rd
uggauuauuuagau

SEQ ID NO: 706667 - RNA, 22 nt, Haemophilus influenzae Rd
uggauuaauuggcgaaggcaaa

SEQ ID NO: 706668 - RNA, 18 nt, Haemophilus influenzae Rd
uggauugauauuuggaua

SEQ ID NO: 706669 - RNA, 21 nt, Haemophilus influenzae Rd
uggauugcaugaaauguagca

SEQ ID NO: 706670 - RNA, 15 nt, Haemophilus influenzae Rd
uggcaaaaaauacau

SEQ ID NO: 706671 - RNA, 13 nt, Haemophilus influenzae Rd
uggcaaaagauca

SEQ ID NO: 706672 - RNA, 16 nt, Haemophilus influenzae Rd
uggcaaaaaugucagg

SEQ ID NO: 706673 - RNA, 14 nt, Haemophilus influenzae Rd
uggauuuuguaaua

SEQ ID NO: 706674 - RNA, 21 nt, Haemophilus influenzae Rd
uggauuugcaauccagugcau

SEQ ID NO: 706675 - RNA, 18 nt, Haemophilus influenzae Rd
uggauuuguugugaaaac

SEQ ID NO: 706676 - RNA, 17 nt, Haemophilus influenzae Rd
uggcaaacucuugugcc

SEQ ID NO: 706677 - RNA, 21 nt, Haemophilus influenzae Rd
uggcaaaaucucuggagaaaa

SEQ ID NO: 706678 - RNA, 15 nt, Haemophilus influenzae Rd
uggcaaagaauacac

SEQ ID NO: 706679 - RNA, 19 nt, Haemophilus influenzae Rd
uggcaauaugcacuaacac

SEQ ID NO: 706680 - RNA, 12 nt, Haemophilus influenzae Rd
uggcaauauuaa

SEQ ID NO: 706681 - RNA, 15 nt, Haemophilus influenzae Rd
uggcaauauuuaaua

SEQ ID NO: 706682 - RNA, 16 nt, Haemophilus influenzae Rd
uggcaauauuucaaua

SEQ ID NO: 706683 - RNA, 19 nt, Haemophilus influenzae Rd
uggcaaggucgugcucuac

SEQ ID NO: 706684 - RNA, 16 nt, Haemophilus influenzae Rd
uggcaauaauguugcu

SEQ ID NO: 706685 - RNA, 22 nt, Haemophilus influenzae Rd
uggcaauaauguugcugauugc

SEQ ID NO: 706686 - RNA, 15 nt, Haemophilus influenzae Rd
uggcaaugaauaaac

SEQ ID NO: 706687 - RNA, 18 nt, Haemophilus influenzae Rd
uggcaaucguucuaaaau

SEQ ID NO: 706688 - RNA, 19 nt, Haemophilus influenzae Rd
uggcaauucgugaagugau

SEQ ID NO: 706689 - RNA, 22 nt, Haemophilus influenzae Rd
uggcaauuucccagccuacaac

SEQ ID NO: 706690 - RNA, 15 nt, Haemophilus influenzae Rd
uggcacaacaucaga

SEQ ID NO: 706691 - RNA, 23 nt, Haemophilus influenzae Rd
uggcaucaaaacguucuaagaau

SEQ ID NO: 706692 - RNA, 16 nt, Haemophilus influenzae Rd
uggcaguuuggaaaga

SEQ ID NO: 706693 - RNA, 23 nt, Haemophilus influenzae Rd
uggcccugaaagucgauucaaau

SEQ ID NO: 706694 - RNA, 22 nt, Haemophilus influenzae Rd
uggcauuagcguaguauggcaa

SEQ ID NO: 706695 - RNA, 17 nt, Haemophilus influenzae Rd
uggcauugaaaccuaaa

SEQ ID NO: 706696 - RNA, 13 nt, Haemophilus influenzae Rd
uggcauuugcaua

SEQ ID NO: 706697 - RNA, 16 nt, Haemophilus influenzae Rd
uggcauuuucaagccc

SEQ ID NO: 706698 - RNA, 17 nt, Haemophilus influenzae Rd
uggcauuuuguaagcaa

SEQ ID NO: 706699 - RNA, 23 nt, Haemophilus influenzae Rd
uggcauuuuguaagcaacacaga

SEQ ID NO: 706700 - RNA, 13 nt, Haemophilus influenzae Rd
uggcaucaauaau

SEQ ID NO: 706701 - RNA, 16 nt, Haemophilus influenzae Rd
uggcgaaaaucaucau

SEQ ID NO: 706702 - RNA, 23 nt, Haemophilus influenzae Rd
uggcgaccgcccucuugcacaau

SEQ ID NO: 706703 - RNA, 22 nt, Haemophilus influenzae Rd
uggcgacagaggggauaaaaua

SEQ ID NO: 706704 - RNA, 17 nt, Haemophilus influenzae Rd
uggcgaauuugguuuug

SEQ ID NO: 706705 - RNA, 19 nt, Haemophilus influenzae Rd
uggcgcacccgaaaggauu

SEQ ID NO: 706706 - RNA, 17 nt, Haemophilus influenzae Rd
uggcuuuucugauaauu

SEQ ID NO: 706707 - RNA, 16 nt, Haemophilus influenzae Rd
uggcuuucuuuuucaa

SEQ ID NO: 706708 - RNA, 21 nt, Haemophilus influenzae Rd
uggcuuuuuugccuuuuaaua

SEQ ID NO: 706709 - RNA, 16 nt, Haemophilus influenzae Rd
ugggauauuccaaggu

SEQ ID NO: 706710 - RNA, 14 nt, Haemophilus influenzae Rd
ugggauaaacauuu

SEQ ID NO: 706711 - RNA, 15 nt, Haemophilus influenzae Rd
ugggcaaucaaauuc

SEQ ID NO: 706712 - RNA, 21 nt, Haemophilus influenzae Rd
ugggcacgauaguggaauaau

SEQ ID NO: 706713 - RNA, 14 nt, Haemophilus influenzae Rd
ugggaugaaaucaa

SEQ ID NO: 706714 - RNA, 16 nt, Haemophilus influenzae Rd
ugggaugaaaucaaaa

SEQ ID NO: 706715 - RNA, 15 nt, Haemophilus influenzae Rd
ugggauuugccauca

SEQ ID NO: 706716 - RNA, 23 nt, Haemophilus influenzae Rd
ugggcuguucggacuuacaucug

SEQ ID NO: 706717 - RNA, 21 nt, Haemophilus influenzae Rd
ugggcuaacauugcaucagcc

SEQ ID NO: 706718 - RNA, 17 nt, Haemophilus influenzae Rd
ugggucguuagcucagu

SEQ ID NO: 706719 - RNA, 20 nt, Haemophilus influenzae Rd
uggguauugauucaauucuu

SEQ ID NO: 706720 - RNA, 14 nt, Haemophilus influenzae Rd
ugguggauuauaaa

SEQ ID NO: 706721 - RNA, 13 nt, Haemophilus influenzae Rd
ugguguuauugga

SEQ ID NO: 706722 - RNA, 17 nt, Haemophilus influenzae Rd
ugguguuauuggaaaau

SEQ ID NO: 706723 - RNA, 18 nt, Haemophilus influenzae Rd
uggucuaacauuucauaa

SEQ ID NO: 706724 - RNA, 16 nt, Haemophilus influenzae Rd
uggucgcaacaaacau

SEQ ID NO: 706725 - RNA, 17 nt, Haemophilus influenzae Rd
ugguaugguuuuccaaa

SEQ ID NO: 706726 - RNA, 20 nt, Haemophilus influenzae Rd
uggucacgauuuuuuuauaa

SEQ ID NO: 706727 - RNA, 23 nt, Haemophilus influenzae Rd
ugguacgccagucacuucuucaa

SEQ ID NO: 706728 - RNA, 14 nt, Haemophilus influenzae Rd
ugguacgagaaaaa

SEQ ID NO: 706729 - RNA, 18 nt, Haemophilus influenzae Rd
uggguuaaaagccaauau

SEQ ID NO: 706730 - RNA, 23 nt, Haemophilus influenzae Rd
uggguucaucuaauaauaagauu

SEQ ID NO: 706731 - RNA, 14 nt, Haemophilus influenzae Rd
ugggugugaaauau

SEQ ID NO: 706732 - RNA, 14 nt, Haemophilus influenzae Rd
uggguuuaaaaagu

SEQ ID NO: 706733 - RNA, 21 nt, Haemophilus influenzae Rd
uggguuuauugguaacaacug

SEQ ID NO: 706734 - RNA, 21 nt, Haemophilus influenzae Rd
uguaguagauaacaacuaaaa

SEQ ID NO: 706735 - RNA, 23 nt, Haemophilus influenzae Rd
uguagucacuauuaauguuauua

SEQ ID NO: 706736 - RNA, 17 nt, Haemophilus influenzae Rd
uguaguuggaucauuau

SEQ ID NO: 706737 - RNA, 21 nt, Haemophilus influenzae Rd
uguaguuggaucauuauccaa

SEQ ID NO: 706738 - RNA, 18 nt, Haemophilus influenzae Rd
uguaguuuaggaaguaaa

SEQ ID NO: 706739 - RNA, 22 nt, Haemophilus influenzae Rd
uguaguuuaggaaguaaauagu

SEQ ID NO: 706740 - RNA, 23 nt, Haemophilus influenzae Rd
uguaguuagaccaucuaaaccug

SEQ ID NO: 706741 - RNA, 13 nt, Haemophilus influenzae Rd
uguaggcaaaaac

SEQ ID NO: 706742 - RNA, 14 nt, Haemophilus influenzae Rd
uguaggcaaaaaca

SEQ ID NO: 706743 - RNA, 23 nt, Haemophilus influenzae Rd
uguagagcucaauuauuuauacu

SEQ ID NO: 706744 - RNA, 19 nt, Haemophilus influenzae Rd
uguagauaaaauauucaaa

SEQ ID NO: 706745 - RNA, 20 nt, Haemophilus influenzae Rd
uguagauaaaauauucaaac

SEQ ID NO: 706746 - RNA, 22 nt, Haemophilus influenzae Rd
uguagauuaucugaggauuaaa

SEQ ID NO: 706747 - RNA, 23 nt, Haemophilus influenzae Rd
uguagcaauaaacagaaauauug

SEQ ID NO: 706748 - RNA, 13 nt, Haemophilus influenzae Rd
uguagaaaggcaa

SEQ ID NO: 706749 - RNA, 19 nt, Haemophilus influenzae Rd
uguagagauaauaaauaua

SEQ ID NO: 706750 - RNA, 23 nt, Haemophilus influenzae Rd
uguauaacaaauaggauaaaaau

SEQ ID NO: 706751 - RNA, 14 nt, Haemophilus influenzae Rd
uguauaagauuaau

SEQ ID NO: 706752 - RNA, 18 nt, Haemophilus influenzae Rd
uguauaagauuaaugaua

SEQ ID NO: 706753 - RNA, 21 nt, Haemophilus influenzae Rd
uguauagaacgguuaugaaaa

SEQ ID NO: 706754 - RNA, 21 nt, Haemophilus influenzae Rd
uguauaguauagcuuugcuuu

SEQ ID NO: 706755 - RNA, 14 nt, Haemophilus influenzae Rd
uguauauauuuucc

SEQ ID NO: 706756 - RNA, 20 nt, Haemophilus influenzae Rd
ugucacagcaagaacagcca

SEQ ID NO: 706757 - RNA, 13 nt, Haemophilus influenzae Rd
uguauuuuucaua

SEQ ID NO: 706758 - RNA, 18 nt, Haemophilus influenzae Rd
uguauuuuucauaucuuc

SEQ ID NO: 706759 - RNA, 16 nt, Haemophilus influenzae Rd
uguauuuugugagggc

SEQ ID NO: 706760 - RNA, 18 nt, Haemophilus influenzae Rd
uguaucuaaauauauuuu

SEQ ID NO: 706761 - RNA, 16 nt, Haemophilus influenzae Rd
uguauguuggcgaauu

SEQ ID NO: 706762 - RNA, 23 nt, Haemophilus influenzae Rd
uguauuaaagguuauuucuugcc

SEQ ID NO: 706763 - RNA, 17 nt, Haemophilus influenzae Rd
uguauuaucuaauuauu

SEQ ID NO: 706764 - RNA, 20 nt, Haemophilus influenzae Rd
uguacuguugcgauuuccac

SEQ ID NO: 706765 - RNA, 14 nt, Haemophilus influenzae Rd
uguacuagauaacu

SEQ ID NO: 706766 - RNA, 16 nt, Haemophilus influenzae Rd
uguacuagauaacuag

SEQ ID NO: 706767 - RNA, 14 nt, Haemophilus influenzae Rd
uguacuauuuuaua

SEQ ID NO: 706768 - RNA, 13 nt, Haemophilus influenzae Rd
uguacucaauaag

SEQ ID NO: 706769 - RNA, 22 nt, Haemophilus influenzae Rd
uguacucaauaaggcuuuuuua

SEQ ID NO: 706770 - RNA, 15 nt, Haemophilus influenzae Rd
uguacguccaugaac

SEQ ID NO: 706771 - RNA, 16 nt, Haemophilus influenzae Rd
uguacaacagcaauaa

SEQ ID NO: 706772 - RNA, 17 nt, Haemophilus influenzae Rd
uguacaacagcaauaag

SEQ ID NO: 706773 - RNA, 14 nt, Haemophilus influenzae Rd
uguacaagugcuac

SEQ ID NO: 706774 - RNA, 18 nt, Haemophilus influenzae Rd
uguaauaaauuuuauuau

SEQ ID NO: 706775 - RNA, 21 nt, Haemophilus influenzae Rd
uguaauaaauuuuauuauguu

SEQ ID NO: 706776 - RNA, 15 nt, Haemophilus influenzae Rd
uguaauaguaaaauu

SEQ ID NO: 706777 - RNA, 15 nt, Haemophilus influenzae Rd
uguaauuucucacca

SEQ ID NO: 706778 - RNA, 17 nt, Haemophilus influenzae Rd
uguaauuucucaccaaa

SEQ ID NO: 706779 - RNA, 23 nt, Haemophilus influenzae Rd
uguaauuuuaccuguaauccuuu

SEQ ID NO: 706780 - RNA, 14 nt, Haemophilus influenzae Rd
uguaauuugugcgu

SEQ ID NO: 706781 - RNA, 13 nt, Haemophilus influenzae Rd
uguaauuguugaa

SEQ ID NO: 706782 - RNA, 19 nt, Haemophilus influenzae Rd
uguaauauaugaaaaauaa

SEQ ID NO: 706783 - RNA, 15 nt, Haemophilus influenzae Rd
ugguucaaaaccaaa

SEQ ID NO: 706784 - RNA, 13 nt, Haemophilus influenzae Rd
ugguucaaaaugg

SEQ ID NO: 706785 - RNA, 13 nt, Haemophilus influenzae Rd
ugguucauagcug

SEQ ID NO: 706786 - RNA, 16 nt, Haemophilus influenzae Rd
ugguucauaugcgauc

SEQ ID NO: 706787 - RNA, 17 nt, Haemophilus influenzae Rd
ugguucagauuucuucg

SEQ ID NO: 706788 - RNA, 15 nt, Haemophilus influenzae Rd
uguaaaaauuggaaa

SEQ ID NO: 706789 - RNA, 16 nt, Haemophilus influenzae Rd
uguaaaaauuggaaaa

SEQ ID NO: 706790 - RNA, 19 nt, Haemophilus influenzae Rd
uguaaaaauuggaaaauaa

SEQ ID NO: 706791 - RNA, 21 nt, Haemophilus influenzae Rd
uguaaaaauuggaaaauaaaa

SEQ ID NO: 706792 - RNA, 22 nt, Haemophilus influenzae Rd
uguaaacgauuucgugcaauaa

SEQ ID NO: 706793 - RNA, 15 nt, Haemophilus influenzae Rd
uguaaacgccaucaa

SEQ ID NO: 706794 - RNA, 16 nt, Haemophilus influenzae Rd
uguaaacuuuccucaa

SEQ ID NO: 706795 - RNA, 14 nt, Haemophilus influenzae Rd
uguaaacaaaaaua

SEQ ID NO: 706796 - RNA, 21 nt, Haemophilus influenzae Rd
uguaaacaaaaauacagccac

SEQ ID NO: 706797 - RNA, 22 nt, Haemophilus influenzae Rd
uguaaaauucguacuuuugauu

SEQ ID NO: 706798 - RNA, 12 nt, Haemophilus influenzae Rd
uguaaaauagug

SEQ ID NO: 706799 - RNA, 18 nt, Haemophilus influenzae Rd
uguaaaaucucuauugcu

SEQ ID NO: 706800 - RNA, 15 nt, Haemophilus influenzae Rd
uguaagacgcauuac

SEQ ID NO: 706801 - RNA, 17 nt, Haemophilus influenzae Rd
uguaacguuaaaugaac

SEQ ID NO: 706802 - RNA, 18 nt, Haemophilus influenzae Rd
uguaacguauuuaaaauc

SEQ ID NO: 706803 - RNA, 21 nt, Haemophilus influenzae Rd
uguaaccaagcuguaccagcg

SEQ ID NO: 706804 - RNA, 18 nt, Haemophilus influenzae Rd
ucuuccgugacaucaucu

SEQ ID NO: 706805 - RNA, 16 nt, Haemophilus influenzae Rd
ucuuccaauaauucuu

SEQ ID NO: 706806 - RNA, 23 nt, Haemophilus influenzae Rd
ucuuccaauacaaucagcugcuc

SEQ ID NO: 706807 - RNA, 12 nt, Haemophilus influenzae Rd
ucuuccaaugug

SEQ ID NO: 706808 - RNA, 17 nt, Haemophilus influenzae Rd
ucuuccaaugugaccaa

SEQ ID NO: 706809 - RNA, 16 nt, Haemophilus influenzae Rd
ucuucauuccauuuug

SEQ ID NO: 706810 - RNA, 15 nt, Haemophilus influenzae Rd
ucuucauuuuaaauu

SEQ ID NO: 706811 - RNA, 15 nt, Haemophilus influenzae Rd
ucuucauuaaacuga

SEQ ID NO: 706812 - RNA, 16 nt, Haemophilus influenzae Rd
ucuucaucaaaaugaa

SEQ ID NO: 706813 - RNA, 23 nt, Haemophilus influenzae Rd
ucuucaucaauaacacucauugu

SEQ ID NO: 706814 - RNA, 21 nt, Haemophilus influenzae Rd
ucuuacagggcuuuauuuuug

SEQ ID NO: 706815 - RNA, 17 nt, Haemophilus influenzae Rd
ucuuaauuuuauuaauu

SEQ ID NO: 706816 - RNA, 15 nt, Haemophilus influenzae Rd
ucuuacagauucauu

SEQ ID NO: 706817 - RNA, 15 nt, Haemophilus influenzae Rd
ucuucauagaagugc

SEQ ID NO: 706818 - RNA, 13 nt, Haemophilus influenzae Rd
ucuucauaaaaaa

SEQ ID NO: 706819 - RNA, 14 nt, Haemophilus influenzae Rd
ucuucauauccacc

SEQ ID NO: 706820 - RNA, 22 nt, Haemophilus influenzae Rd
ucuucaguacgcaccacuucgc

SEQ ID NO: 706821 - RNA, 15 nt, Haemophilus influenzae Rd
ucuuaauuuuuuaac

SEQ ID NO: 706822 - RNA, 20 nt, Haemophilus influenzae Rd
ucuuaauuaagauaauuuuu

SEQ ID NO: 706823 - RNA, 21 nt, Haemophilus influenzae Rd
ucuucgcgagaauuaccacaa

SEQ ID NO: 706824 - RNA, 17 nt, Haemophilus influenzae Rd
ucuucgauuuuucuaaa

SEQ ID NO: 706825 - RNA, 23 nt, Haemophilus influenzae Rd
ucuucgauuuuucuaaaaucaca

SEQ ID NO: 706826 - RNA, 20 nt, Haemophilus influenzae Rd
ucuucgaaaauaacuucauc

SEQ ID NO: 706827 - RNA, 20 nt, Haemophilus influenzae Rd
ucuucgauuaguuuaucaga

SEQ ID NO: 706828 - RNA, 15 nt, Haemophilus influenzae Rd
ucuucuaauuguuug

SEQ ID NO: 706829 - RNA, 16 nt, Haemophilus influenzae Rd
ucuucuaauucuuccc

SEQ ID NO: 706830 - RNA, 15 nt, Haemophilus influenzae Rd
ucuucuaauaaaaua

SEQ ID NO: 706831 - RNA, 16 nt, Haemophilus influenzae Rd
ucuucuaguuuuccuu

SEQ ID NO: 706832 - RNA, 21 nt, Haemophilus influenzae Rd
ucuucuacggucgcaccaccu

SEQ ID NO: 706833 - RNA, 16 nt, Haemophilus influenzae Rd
ucuucuauuuuaucaa

SEQ ID NO: 706834 - RNA, 20 nt, Haemophilus influenzae Rd
ucuucugcggucaucucuug

SEQ ID NO: 706835 - RNA, 18 nt, Haemophilus influenzae Rd
ucuucugaucaauuuaau

SEQ ID NO: 706836 - RNA, 23 nt, Haemophilus influenzae Rd
ucuucuguuaaacgcauauuuug

SEQ ID NO: 706837 - RNA, 17 nt, Haemophilus influenzae Rd
ucuucuguuuugccugc

SEQ ID NO: 706838 - RNA, 16 nt, Haemophilus influenzae Rd
ucuucugggucuuuuu

SEQ ID NO: 706839 - RNA, 21 nt, Haemophilus influenzae Rd
ucuucugguggaagcuucaua

SEQ ID NO: 706840 - RNA, 23 nt, Haemophilus influenzae Rd
ucuucuucgcuccaaucaucauc

SEQ ID NO: 706841 - RNA, 10 nt, Haemophilus influenzae Rd
ucuucuuccc

SEQ ID NO: 706842 - RNA, 20 nt, Haemophilus influenzae Rd
ucuucuuggcaauauuuaau

SEQ ID NO: 706843 - RNA, 19 nt, Haemophilus influenzae Rd
ucuucuuuaauuucuucaa

SEQ ID NO: 706844 - RNA, 20 nt, Haemophilus influenzae Rd
ucuucuuguucaaauaaugu

SEQ ID NO: 706845 - RNA, 23 nt, Haemophilus influenzae Rd
ucuucuuuaaacaccaaauauuc

SEQ ID NO: 706846 - RNA, 12 nt, Haemophilus influenzae Rd
ucuucuuuuaau

SEQ ID NO: 706847 - RNA, 18 nt, Haemophilus influenzae Rd
ucuucuuugacuaaagua

SEQ ID NO: 706848 - RNA, 16 nt, Haemophilus influenzae Rd
ucuugaacgcaaauac

SEQ ID NO: 706849 - RNA, 16 nt, Haemophilus influenzae Rd
ucuugacguaauucuc

SEQ ID NO: 706850 - RNA, 22 nt, Haemophilus influenzae Rd
ucuugaguaccgcuaauaaucg

SEQ ID NO: 706851 - RNA, 16 nt, Haemophilus influenzae Rd
ucuugaugauaaucuu

SEQ ID NO: 706852 - RNA, 20 nt, Haemophilus influenzae Rd
ucuugaugauaaucuuccca

SEQ ID NO: 706853 - RNA, 22 nt, Haemophilus influenzae Rd
ucuugaugauaaucuucccauu

SEQ ID NO: 706854 - RNA, 17 nt, Haemophilus influenzae Rd
ucuucuuuuaauaauag

SEQ ID NO: 706855 - RNA, 15 nt, Haemophilus influenzae Rd
ucuucuuuuuucuca

SEQ ID NO: 706856 - RNA, 23 nt, Haemophilus influenzae Rd
ucuugaaaccucccaaaaacuaa

SEQ ID NO: 706857 - RNA, 18 nt, Haemophilus influenzae Rd
ucuugacauaauuucaca

SEQ ID NO: 706858 - RNA, 14 nt, Haemophilus influenzae Rd
ucuuuagaaaguuu

SEQ ID NO: 706859 - RNA, 18 nt, Haemophilus influenzae Rd
ucuuuagaaaguuuugca

SEQ ID NO: 706860 - RNA, 20 nt, Haemophilus influenzae Rd
ucuuuacuguucaaauaagc

SEQ ID NO: 706861 - RNA, 20 nt, Haemophilus influenzae Rd
ucuuuagcuaaugcaaaauu

SEQ ID NO: 706862 - RNA, 18 nt, Haemophilus influenzae Rd
ucuuuagcuauuaaauua

SEQ ID NO: 706863 - RNA, 23 nt, Haemophilus influenzae Rd
ucuuuaccuugcauuucuuuaau

SEQ ID NO: 706864 - RNA, 12 nt, Haemophilus influenzae Rd
ucuuuaccaaaa

SEQ ID NO: 706865 - RNA, 15 nt, Haemophilus influenzae Rd
ucuuuaccaaaaaau

SEQ ID NO: 706866 - RNA, 13 nt, Haemophilus influenzae Rd
ucuuuaaauauuc

SEQ ID NO: 706867 - RNA, 16 nt, Haemophilus influenzae Rd
ucuuuaaauucaauaa

SEQ ID NO: 706868 - RNA, 13 nt, Haemophilus influenzae Rd
ucuuuaacaaauu

SEQ ID NO: 706869 - RNA, 21 nt, Haemophilus influenzae Rd
ucuuuaacaauauaucagaca

SEQ ID NO: 706870 - RNA, 22 nt, Haemophilus influenzae Rd
ucuuuaaacaucgcuucaucau

SEQ ID NO: 706871 - RNA, 20 nt, Haemophilus influenzae Rd
ucuuuaaagagcaaauuuaa

SEQ ID NO: 706872 - RNA, 22 nt, Haemophilus influenzae Rd
ucuuuaaagagcaaauuuaaau

SEQ ID NO: 706873 - RNA, 17 nt, Haemophilus influenzae Rd
ucuuuaaaauuauaaua

SEQ ID NO: 706874 - RNA, 20 nt, Haemophilus influenzae Rd
ucuuuaaaauuauaauauuu

SEQ ID NO: 706875 - RNA, 21 nt, Haemophilus influenzae Rd
ucuuuaaaauuauaauauuua

SEQ ID NO: 706876 - RNA, 22 nt, Haemophilus influenzae Rd
ucuuuaaacaccaaauauucuu

SEQ ID NO: 706877 - RNA, 23 nt, Haemophilus influenzae Rd
ucuuggugccaauccauuuuuaa

SEQ ID NO: 706878 - RNA, 16 nt, Haemophilus influenzae Rd
ucuugguuuaaauuuu

SEQ ID NO: 706879 - RNA, 23 nt, Haemophilus influenzae Rd
ucuugcccgcaccgcuucuuugu

SEQ ID NO: 706880 - RNA, 19 nt, Haemophilus influenzae Rd
ucuugccgaaaauuuaccg

SEQ ID NO: 706881 - RNA, 17 nt, Haemophilus influenzae Rd
ucuugauuauuuaauuu

SEQ ID NO: 706882 - RNA, 18 nt, Haemophilus influenzae Rd
ucuugcauaaaccaacua

SEQ ID NO: 706883 - RNA, 23 nt, Haemophilus influenzae Rd
ucuugcaacuuuuuuaggauugc

SEQ ID NO: 706884 - RNA, 13 nt, Haemophilus influenzae Rd
ucuggcaaucgcc

SEQ ID NO: 706885 - RNA, 19 nt, Haemophilus influenzae Rd
ucuggcccgaauccaaugc

SEQ ID NO: 706886 - RNA, 18 nt, Haemophilus influenzae Rd
ucuggcaaaucuuucgcu

SEQ ID NO: 706887 - RNA, 20 nt, Haemophilus influenzae Rd
ucuggauuaucuuguugcca

SEQ ID NO: 706888 - RNA, 23 nt, Haemophilus influenzae Rd
ucugcuugguaauaaucaauuaa

SEQ ID NO: 706889 - RNA, 18 nt, Haemophilus influenzae Rd
ucugcuuuacguuuugcu

SEQ ID NO: 706890 - RNA, 17 nt, Haemophilus influenzae Rd
ucugcgccuaauccaaa

SEQ ID NO: 706891 - RNA, 22 nt, Haemophilus influenzae Rd
ucugcuuaguuccaccacccuu

SEQ ID NO: 706892 - RNA, 16 nt, Haemophilus influenzae Rd
ucuguaugacuauuua

SEQ ID NO: 706893 - RNA, 19 nt, Haemophilus influenzae Rd
ucuguaugacuauuuagaa

SEQ ID NO: 706894 - RNA, 18 nt, Haemophilus influenzae Rd
ucuguauaccaaccauua

SEQ ID NO: 706895 - RNA, 14 nt, Haemophilus influenzae Rd
ucugugcaauauuu

SEQ ID NO: 706896 - RNA, 15 nt, Haemophilus influenzae Rd
ucugugagucuugcu

SEQ ID NO: 706897 - RNA, 16 nt, Haemophilus influenzae Rd
ucugugagucuugcuu

SEQ ID NO: 706898 - RNA, 22 nt, Haemophilus influenzae Rd
ucuguugggauagauuuuuuac

SEQ ID NO: 706899 - RNA, 13 nt, Haemophilus influenzae Rd
ucuguugcucagc

SEQ ID NO: 706900 - RNA, 22 nt, Haemophilus influenzae Rd
ucuguugcucagccaguuuucu

SEQ ID NO: 706901 - RNA, 19 nt, Haemophilus influenzae Rd
ucuguugcaaauuuuucau

SEQ ID NO: 706902 - RNA, 20 nt, Haemophilus influenzae Rd
ucuguugcaaauuuuucauu

SEQ ID NO: 706903 - RNA, 22 nt, Haemophilus influenzae Rd
ucuguugcaaauuuuucauucu

SEQ ID NO: 706904 - RNA, 13 nt, Haemophilus influenzae Rd
ucuguugccauca

SEQ ID NO: 706905 - RNA, 13 nt, Haemophilus influenzae Rd
ucuguuuaaaaac

SEQ ID NO: 706906 - RNA, 22 nt, Haemophilus influenzae Rd
ucuguuugauaaauaucuugca

SEQ ID NO: 706907 - RNA, 14 nt, Haemophilus influenzae Rd
ucuguuuguuggcc

SEQ ID NO: 706908 - RNA, 20 nt, Haemophilus influenzae Rd
ucuguuuuaccugaaaaacc

SEQ ID NO: 706909 - RNA, 18 nt, Haemophilus influenzae Rd
ucuuaaaagaaauucgcu

SEQ ID NO: 706910 - RNA, 13 nt, Haemophilus influenzae Rd
ucuuaaaaaagau

SEQ ID NO: 706911 - RNA, 14 nt, Haemophilus influenzae Rd
ucuuaaaaaagaug

SEQ ID NO: 706912 - RNA, 19 nt, Haemophilus influenzae Rd
ucuguuuuuccauucacua

SEQ ID NO: 706913 - RNA, 13 nt, Haemophilus influenzae Rd
ucuuaaagauaaa

SEQ ID NO: 706914 - RNA, 14 nt, Haemophilus influenzae Rd
ucuuaaaucauaaa

SEQ ID NO: 706915 - RNA, 18 nt, Haemophilus influenzae Rd
ucuuaaaugggaaacuga

SEQ ID NO: 706916 - RNA, 15 nt, Haemophilus influenzae Rd
ucuuaaauucauaau

SEQ ID NO: 706917 - RNA, 17 nt, Haemophilus influenzae Rd
ucugaaagauauuauua

SEQ ID NO: 706918 - RNA, 20 nt, Haemophilus influenzae Rd
ucugaacacucuaucuaaaa

SEQ ID NO: 706919 - RNA, 14 nt, Haemophilus influenzae Rd
ucugaaauuuugau

SEQ ID NO: 706920 - RNA, 22 nt, Haemophilus influenzae Rd
ucugaaauuuuuaucuaaauua

SEQ ID NO: 706921 - RNA, 14 nt, Haemophilus influenzae Rd
ucugaacuaaaaua

SEQ ID NO: 706922 - RNA, 16 nt, Haemophilus influenzae Rd
ucuccuugguuuucuu

SEQ ID NO: 706923 - RNA, 16 nt, Haemophilus influenzae Rd
ucugauaauuuuucac

SEQ ID NO: 706924 - RNA, 21 nt, Haemophilus influenzae Rd
ucugauguagcuugaauauuu

SEQ ID NO: 706925 - RNA, 15 nt, Haemophilus influenzae Rd
ucugaccccaaaaag

SEQ ID NO: 706926 - RNA, 18 nt, Haemophilus influenzae Rd
ucugacaguuuaucucuu

SEQ ID NO: 706927 - RNA, 12 nt, Haemophilus influenzae Rd
ucugccucugua

SEQ ID NO: 706928 - RNA, 16 nt, Haemophilus influenzae Rd
ucugccugauuuuuuu

SEQ ID NO: 706929 - RNA, 21 nt, Haemophilus influenzae Rd
ucugccauaacgcuaucuuuu

SEQ ID NO: 706930 - RNA, 18 nt, Haemophilus influenzae Rd
ucugcauucuaaaaguuu

SEQ ID NO: 706931 - RNA, 16 nt, Haemophilus influenzae Rd
ucugcauuuaaugguu

SEQ ID NO: 706932 - RNA, 13 nt, Haemophilus influenzae Rd
ucugccaaugcuu

SEQ ID NO: 706933 - RNA, 20 nt, Haemophilus influenzae Rd
ucugcagggaaaaauuuuac

SEQ ID NO: 706934 - RNA, 18 nt, Haemophilus influenzae Rd
ucugcaggaaaaauaaau

SEQ ID NO: 706935 - RNA, 19 nt, Haemophilus influenzae Rd
ucugcauaacuuaaauuuu

SEQ ID NO: 706936 - RNA, 16 nt, Haemophilus influenzae Rd
ucugcaguuucugguu

SEQ ID NO: 706937 - RNA, 20 nt, Haemophilus influenzae Rd
ucugcaguuucugguuccau

SEQ ID NO: 706938 - RNA, 22 nt, Haemophilus influenzae Rd
ucugcaguuuuuuguuuuuccg

SEQ ID NO: 706939 - RNA, 15 nt, Haemophilus influenzae Rd
ucugcauaaaauaau

SEQ ID NO: 706940 - RNA, 14 nt, Haemophilus influenzae Rd
ucugauugagaaaa

SEQ ID NO: 706941 - RNA, 17 nt, Haemophilus influenzae Rd
ucugauugagaaaaugu

SEQ ID NO: 706942 - RNA, 16 nt, Haemophilus influenzae Rd
ucugauuuagguuuca

SEQ ID NO: 706943 - RNA, 20 nt, Haemophilus influenzae Rd
ucugauuuagguuucaauuu

SEQ ID NO: 706944 - RNA, 16 nt, Haemophilus influenzae Rd
ucugauuauucucuau

SEQ ID NO: 706945 - RNA, 15 nt, Haemophilus influenzae Rd
ucugcaggcauuuuc

SEQ ID NO: 706946 - RNA, 17 nt, Haemophilus influenzae Rd
ucugcaggcauuuucaa

SEQ ID NO: 706947 - RNA, 22 nt, Haemophilus influenzae Rd
ucgucaaucaucccuucuuuua

SEQ ID NO: 706948 - RNA, 15 nt, Haemophilus influenzae Rd
ucgucaaauuuaaau

SEQ ID NO: 706949 - RNA, 16 nt, Haemophilus influenzae Rd
ucgucaaauuuaaaua

SEQ ID NO: 706950 - RNA, 18 nt, Haemophilus influenzae Rd
ucguagucuuucaauguu

SEQ ID NO: 706951 - RNA, 18 nt, Haemophilus influenzae Rd
ucgucaaaggaacagaca

SEQ ID NO: 706952 - RNA, 14 nt, Haemophilus influenzae Rd
ucgucaaaaucauu

SEQ ID NO: 706953 - RNA, 15 nt, Haemophilus influenzae Rd
ucguagaaauaaguu

SEQ ID NO: 706954 - RNA, 19 nt, Haemophilus influenzae Rd
ucguagaguuuuuucacuu

SEQ ID NO: 706955 - RNA, 14 nt, Haemophilus influenzae Rd
ucguagccaauuuu

SEQ ID NO: 706956 - RNA, 16 nt, Haemophilus influenzae Rd
ucguagccaauuuugu

SEQ ID NO: 706957 - RNA, 16 nt, Haemophilus influenzae Rd
ucgguuguuuuuuaau

SEQ ID NO: 706958 - RNA, 16 nt, Haemophilus influenzae Rd
ucgguuucaugauugg

SEQ ID NO: 706959 - RNA, 16 nt, Haemophilus influenzae Rd
ucgucuggcacaucaa

SEQ ID NO: 706960 - RNA, 22 nt, Haemophilus influenzae Rd
ucgucucaguaacgauguugca

SEQ ID NO: 706961 - RNA, 18 nt, Haemophilus influenzae Rd
ucguccaaagaaguuuuc

SEQ ID NO: 706962 - RNA, 18 nt, Haemophilus influenzae Rd
ucguccuucaaauucuuu

SEQ ID NO: 706963 - RNA, 14 nt, Haemophilus influenzae Rd
ucgugccuauuuau

SEQ ID NO: 706964 - RNA, 14 nt, Haemophilus influenzae Rd
ucgugccugccacc

SEQ ID NO: 706965 - RNA, 15 nt, Haemophilus influenzae Rd
ucgugcuguuuucaa

SEQ ID NO: 706966 - RNA, 15 nt, Haemophilus influenzae Rd
ucguguaaaaguugu

SEQ ID NO: 706967 - RNA, 19 nt, Haemophilus influenzae Rd
ucgugugccaucaguuccu

SEQ ID NO: 706968 - RNA, 14 nt, Haemophilus influenzae Rd
ucguggaauuucau

SEQ ID NO: 706969 - RNA, 16 nt, Haemophilus influenzae Rd
ucguggauuggcaaug

SEQ ID NO: 706970 - RNA, 15 nt, Haemophilus influenzae Rd
ucuaaacuuaauucu

SEQ ID NO: 706971 - RNA, 15 nt, Haemophilus influenzae Rd
ucuaaaaucacuuuu

SEQ ID NO: 706972 - RNA, 21 nt, Haemophilus influenzae Rd
ucuaaaagcuguucugcauua

SEQ ID NO: 706973 - RNA, 18 nt, Haemophilus influenzae Rd
ucuaaacuuguuaaauaa

SEQ ID NO: 706974 - RNA, 12 nt, Haemophilus influenzae Rd
ucuaaagcgauc

SEQ ID NO: 706975 - RNA, 22 nt, Haemophilus influenzae Rd
ucuaaagauuuauguugaauuu

SEQ ID NO: 706976 - RNA, 18 nt, Haemophilus influenzae Rd
ucuaacaaucgacuuugu

SEQ ID NO: 706977 - RNA, 21 nt, Haemophilus influenzae Rd
ucuaaauuucgcucaauaauu

SEQ ID NO: 706978 - RNA, 14 nt, Haemophilus influenzae Rd
ucuaacauuuuuuu

SEQ ID NO: 706979 - RNA, 15 nt, Haemophilus influenzae Rd
ucguugcaucuucua

SEQ ID NO: 706980 - RNA, 14 nt, Haemophilus influenzae Rd
ucguucuuuuucca

SEQ ID NO: 706981 - RNA, 19 nt, Haemophilus influenzae Rd
ucguuugauauaccauucu

SEQ ID NO: 706982 - RNA, 14 nt, Haemophilus influenzae Rd
ucguuuguuugaaa

SEQ ID NO: 706983 - RNA, 15 nt, Haemophilus influenzae Rd
ucguuuguuugaaaa

SEQ ID NO: 706984 - RNA, 21 nt, Haemophilus influenzae Rd
ucuacggcaauuggauaaaac

SEQ ID NO: 706985 - RNA, 17 nt, Haemophilus influenzae Rd
ucuacguaauuuaauuu

SEQ ID NO: 706986 - RNA, 13 nt, Haemophilus influenzae Rd
ucuacaccuucug

SEQ ID NO: 706987 - RNA, 19 nt, Haemophilus influenzae Rd
ucuaccacagucaaauugu

SEQ ID NO: 706988 - RNA, 15 nt, Haemophilus influenzae Rd
ucuacccacacaccu

SEQ ID NO: 706989 - RNA, 23 nt, Haemophilus influenzae Rd
ucuacccacacaccuuuuaagug

SEQ ID NO: 706990 - RNA, 19 nt, Haemophilus influenzae Rd
ucuaaugccgcaaauacuu

SEQ ID NO: 706991 - RNA, 17 nt, Haemophilus influenzae Rd
ucuaauguuaauuuuaa

SEQ ID NO: 706992 - RNA, 16 nt, Haemophilus influenzae Rd
ucuaauuauuucagua

SEQ ID NO: 706993 - RNA, 16 nt, Haemophilus influenzae Rd
ucuaauucagcaaaaa

SEQ ID NO: 706994 - RNA, 22 nt, Haemophilus influenzae Rd
ucuaauuccccuucaaauauaa

SEQ ID NO: 706995 - RNA, 14 nt, Haemophilus influenzae Rd
ucuaauucggcuuc

SEQ ID NO: 706996 - RNA, 17 nt, Haemophilus influenzae Rd
ucuaauugcugcucugc

SEQ ID NO: 706997 - RNA, 20 nt, Haemophilus influenzae Rd
ucuaauuggacaagaaauaa

SEQ ID NO: 706998 - RNA, 20 nt, Haemophilus influenzae Rd
ucuaauugugcuaaauaauu

SEQ ID NO: 706999 - RNA, 11 nt, Haemophilus influenzae Rd
ucuaauucuuc

SEQ ID NO: 707000 - RNA, 12 nt, Haemophilus influenzae Rd
ucuaauucuucc

SEQ ID NO: 707001 - RNA, 23 nt, Haemophilus influenzae Rd
ucuaauugauggcgugaaauauu

SEQ ID NO: 707002 - RNA, 16 nt, Haemophilus influenzae Rd
ucuaauugauucaaau

SEQ ID NO: 707003 - RNA, 19 nt, Haemophilus influenzae Rd
ucuaauugauucaaaucua

SEQ ID NO: 707004 - RNA, 19 nt, Haemophilus influenzae Rd
ucuaaccgcacucuuucaa

SEQ ID NO: 707005 - RNA, 20 nt, Haemophilus influenzae Rd
ucuaaccgcacuuuuuaaua

SEQ ID NO: 707006 - RNA, 23 nt, Haemophilus influenzae Rd
ucuaaccgcacuuuuuaauaaaa

SEQ ID NO: 707007 - RNA, 14 nt, Haemophilus influenzae Rd
ucuaaccuaaaaua

SEQ ID NO: 707008 - RNA, 14 nt, Haemophilus influenzae Rd
ucuaacgcauucaa

SEQ ID NO: 707009 - RNA, 16 nt, Haemophilus influenzae Rd
ucuaacgcauucaaau

SEQ ID NO: 707010 - RNA, 18 nt, Haemophilus influenzae Rd
ucuaacgcauucaaaucu

SEQ ID NO: 707011 - RNA, 15 nt, Haemophilus influenzae Rd
ucuaauaugauuaau

SEQ ID NO: 707012 - RNA, 16 nt, Haemophilus influenzae Rd
ucuaaugcaauuucaa

SEQ ID NO: 707013 - RNA, 22 nt, Haemophilus influenzae Rd
ucuaaugcaggcaacucaguuu

SEQ ID NO: 707014 - RNA, 23 nt, Haemophilus influenzae Rd
ucuaaugcaggcaacucaguuuu

SEQ ID NO: 707015 - RNA, 19 nt, Haemophilus influenzae Rd
ucuaaucgggcuuuaucau

SEQ ID NO: 707016 - RNA, 23 nt, Haemophilus influenzae Rd
ucuaaucgggcuuuaucauaacu

SEQ ID NO: 707017 - RNA, 16 nt, Haemophilus influenzae Rd
ucuaauccuaaaaugc

SEQ ID NO: 707018 - RNA, 21 nt, Haemophilus influenzae Rd
ucuaauccuaaaaugcucgcu

SEQ ID NO: 707019 - RNA, 17 nt, Haemophilus influenzae Rd
ucuaaucgccaaucuaa

SEQ ID NO: 707020 - RNA, 15 nt, Haemophilus influenzae Rd
ucuauuacuaaaauu

SEQ ID NO: 707021 - RNA, 14 nt, Haemophilus influenzae Rd
ucuauuauaaauuu

SEQ ID NO: 707022 - RNA, 14 nt, Haemophilus influenzae Rd
ucuaugaaaaaacc

SEQ ID NO: 707023 - RNA, 17 nt, Haemophilus influenzae Rd
ucuaugccaaucacaau

SEQ ID NO: 707024 - RNA, 14 nt, Haemophilus influenzae Rd
ucuaucuaaaauau

SEQ ID NO: 707025 - RNA, 15 nt, Haemophilus influenzae Rd
ucuaucuaaaauaua

SEQ ID NO: 707026 - RNA, 21 nt, Haemophilus influenzae Rd
ucuaucuuguaauuuuuucuc

SEQ ID NO: 707027 - RNA, 15 nt, Haemophilus influenzae Rd
ucuaucuuauuaaag

SEQ ID NO: 707028 - RNA, 18 nt, Haemophilus influenzae Rd
ucuauaucagaaaagaca

SEQ ID NO: 707029 - RNA, 14 nt, Haemophilus influenzae Rd
ucuauaucuuuaaa

SEQ ID NO: 707030 - RNA, 16 nt, Haemophilus influenzae Rd
ucuauaucuuuaaauu

SEQ ID NO: 707031 - RNA, 19 nt, Haemophilus influenzae Rd
ucuauaucuuuaaauucua

SEQ ID NO: 707032 - RNA, 22 nt, Haemophilus influenzae Rd
ucuauaucuuuaaauucuacgu

SEQ ID NO: 707033 - RNA, 15 nt, Haemophilus influenzae Rd
ucuauauuauuuaag

SEQ ID NO: 707034 - RNA, 12 nt, Haemophilus influenzae Rd
ucuauagauuua

SEQ ID NO: 707035 - RNA, 17 nt, Haemophilus influenzae Rd
ucuauauuuugaauaau

SEQ ID NO: 707036 - RNA, 19 nt, Haemophilus influenzae Rd
ucuauauuuugaauaauaa

SEQ ID NO: 707037 - RNA, 21 nt, Haemophilus influenzae Rd
ucuagaaaauaaccaauauaa

SEQ ID NO: 707038 - RNA, 13 nt, Haemophilus influenzae Rd
ucuacuuguucaa

SEQ ID NO: 707039 - RNA, 13 nt, Haemophilus influenzae Rd
ucuacuuuauuca

SEQ ID NO: 707040 - RNA, 15 nt, Haemophilus influenzae Rd
ucuacuuucaggauu

SEQ ID NO: 707041 - RNA, 19 nt, Haemophilus influenzae Rd
ucuacugcuucauaaaaac

SEQ ID NO: 707042 - RNA, 16 nt, Haemophilus influenzae Rd
ucuacuguuaauuugc

SEQ ID NO: 707043 - RNA, 23 nt, Haemophilus influenzae Rd
ucuacuuuuuuugcgcuuucaau

SEQ ID NO: 707044 - RNA, 16 nt, Haemophilus influenzae Rd
ucuagcuuaacaacaa

SEQ ID NO: 707045 - RNA, 16 nt, Haemophilus influenzae Rd
ucuagcuuaccuuaau

SEQ ID NO: 707046 - RNA, 22 nt, Haemophilus influenzae Rd
ucuagcuucaucagccgcuuuu

SEQ ID NO: 707047 - RNA, 14 nt, Haemophilus influenzae Rd
ucuaguaaaacuaa

SEQ ID NO: 707048 - RNA, 16 nt, Haemophilus influenzae Rd
ucuaggcuuucaccaa

SEQ ID NO: 707049 - RNA, 13 nt, Haemophilus influenzae Rd
ucuaguucuuccc

SEQ ID NO: 707050 - RNA, 21 nt, Haemophilus influenzae Rd
ucuaguucuuccccucauguu

SEQ ID NO: 707051 - RNA, 17 nt, Haemophilus influenzae Rd
ucuauaagaaaauuauc

SEQ ID NO: 707052 - RNA, 18 nt, Haemophilus influenzae Rd
ucuauaagaaaauuaucu

SEQ ID NO: 707053 - RNA, 21 nt, Haemophilus influenzae Rd
ucuauaauccgcagaauuuag

SEQ ID NO: 707054 - RNA, 14 nt, Haemophilus influenzae Rd
ucuccguaaaaauc

SEQ ID NO: 707055 - RNA, 16 nt, Haemophilus influenzae Rd
ucuccuaauagacagg

SEQ ID NO: 707056 - RNA, 21 nt, Haemophilus influenzae Rd
ucucaggaaagggauuuuuua

SEQ ID NO: 707057 - RNA, 12 nt, Haemophilus influenzae Rd
ucucauaauaga

SEQ ID NO: 707058 - RNA, 19 nt, Haemophilus influenzae Rd
ucucauaauagaaaacauu

SEQ ID NO: 707059 - RNA, 18 nt, Haemophilus influenzae Rd
ucucauaaaguauacuuu

SEQ ID NO: 707060 - RNA, 20 nt, Haemophilus influenzae Rd
ucucauaaaguauacuuuuc

SEQ ID NO: 707061 - RNA, 23 nt, Haemophilus influenzae Rd
ucucauuuugcucaugauuauaa

SEQ ID NO: 707062 - RNA, 18 nt, Haemophilus influenzae Rd
ucuccaaauauaaaauaa

SEQ ID NO: 707063 - RNA, 22 nt, Haemophilus influenzae Rd
ucuccaaauauaaaauaaaauu

SEQ ID NO: 707064 - RNA, 16 nt, Haemophilus influenzae Rd
ucuauugauucuaaaa

SEQ ID NO: 707065 - RNA, 17 nt, Haemophilus influenzae Rd
ucuauugauucuaaaaa

SEQ ID NO: 707066 - RNA, 16 nt, Haemophilus influenzae Rd
ucuauucucuguugcu

SEQ ID NO: 707067 - RNA, 18 nt, Haemophilus influenzae Rd
ucuauuggauaaauuauu

SEQ ID NO: 707068 - RNA, 23 nt, Haemophilus influenzae Rd
ucuauuggauaaauuauucugca

SEQ ID NO: 707069 - RNA, 22 nt, Haemophilus influenzae Rd
ucuauuuaaagcucguauaaua

SEQ ID NO: 707070 - RNA, 20 nt, Haemophilus influenzae Rd
ucuauuugucggaaaauaau

SEQ ID NO: 707071 - RNA, 14 nt, Haemophilus influenzae Rd
ucuauuuuaaaaau

SEQ ID NO: 707072 - RNA, 15 nt, Haemophilus influenzae Rd
ucuauuuauuuucac

SEQ ID NO: 707073 - RNA, 15 nt, Haemophilus influenzae Rd
ucuauuuuaaaaauu

SEQ ID NO: 707074 - RNA, 22 nt, Haemophilus influenzae Rd
ucuauuucuuugaguaaaaaau

SEQ ID NO: 707075 - RNA, 21 nt, Haemophilus influenzae Rd
ucucaaagaggagguagaaaa

SEQ ID NO: 707076 - RNA, 11 nt, Haemophilus influenzae Rd
ucucaaauuuu

SEQ ID NO: 707077 - RNA, 15 nt, Haemophilus influenzae Rd
ucucaaauuuuucac

SEQ ID NO: 707078 - RNA, 15 nt, Haemophilus influenzae Rd
ucuauuuuuucugca

SEQ ID NO: 707079 - RNA, 14 nt, Haemophilus influenzae Rd
ucucaaaaaguuaa

SEQ ID NO: 707080 - RNA, 15 nt, Haemophilus influenzae Rd
ucucaaaaaucaacc

SEQ ID NO: 707081 - RNA, 19 nt, Haemophilus influenzae Rd
ucucaauuuuuucaaauaa

SEQ ID NO: 707082 - RNA, 14 nt, Haemophilus influenzae Rd
ucucacaucaucaa

SEQ ID NO: 707083 - RNA, 20 nt, Haemophilus influenzae Rd
ucucaccaccagauaaggua

SEQ ID NO: 707084 - RNA, 14 nt, Haemophilus influenzae Rd
ucucacuaacuuuc

SEQ ID NO: 707085 - RNA, 23 nt, Haemophilus influenzae Rd
ucgcgugauuuagggaaguuaug

SEQ ID NO: 707086 - RNA, 18 nt, Haemophilus influenzae Rd
ucgcuaacugaucuaaau

SEQ ID NO: 707087 - RNA, 14 nt, Haemophilus influenzae Rd
ucgcguuguucaau

SEQ ID NO: 707088 - RNA, 20 nt, Haemophilus influenzae Rd
ucgcucuucagcuucuucau

SEQ ID NO: 707089 - RNA, 15 nt, Haemophilus influenzae Rd
ucgcugaaauuaaua

SEQ ID NO: 707090 - RNA, 12 nt, Haemophilus influenzae Rd
ucgcuauuuaau

SEQ ID NO: 707091 - RNA, 13 nt, Haemophilus influenzae Rd
ucgcuauuuaaua

SEQ ID NO: 707092 - RNA, 15 nt, Haemophilus influenzae Rd
ucgcuauuuucuaau

SEQ ID NO: 707093 - RNA, 13 nt, Haemophilus influenzae Rd
ucgcuauuuuucg

SEQ ID NO: 707094 - RNA, 17 nt, Haemophilus influenzae Rd
ucgcuccccuucauaag

SEQ ID NO: 707095 - RNA, 20 nt, Haemophilus influenzae Rd
ucgcuccaaucaucauccca

SEQ ID NO: 707096 - RNA, 12 nt, Haemophilus influenzae Rd
ucggcacaagac

SEQ ID NO: 707097 - RNA, 19 nt, Haemophilus influenzae Rd
ucggaauguuuuaaagaau

SEQ ID NO: 707098 - RNA, 16 nt, Haemophilus influenzae Rd
ucggacgaaucacaac

SEQ ID NO: 707099 - RNA, 21 nt, Haemophilus influenzae Rd
ucggaauauuuuuuugcuuuu

SEQ ID NO: 707100 - RNA, 16 nt, Haemophilus influenzae Rd
ucggaauuuuuuucaa

SEQ ID NO: 707101 - RNA, 14 nt, Haemophilus influenzae Rd
ucggaauauucaac

SEQ ID NO: 707102 - RNA, 20 nt, Haemophilus influenzae Rd
ucggaaaauaauauugagua

SEQ ID NO: 707103 - RNA, 14 nt, Haemophilus influenzae Rd
ucgcuuaagucagc

SEQ ID NO: 707104 - RNA, 17 nt, Haemophilus influenzae Rd
ucgcuugcauuucuuca

SEQ ID NO: 707105 - RNA, 14 nt, Haemophilus influenzae Rd
ucgcggaauuucag

SEQ ID NO: 707106 - RNA, 18 nt, Haemophilus influenzae Rd
ucgccugaggauuuugua

SEQ ID NO: 707107 - RNA, 17 nt, Haemophilus influenzae Rd
ucgcgagaauuaccaca

SEQ ID NO: 707108 - RNA, 13 nt, Haemophilus influenzae Rd
ucgccuuuuucaa

SEQ ID NO: 707109 - RNA, 15 nt, Haemophilus influenzae Rd
uccuguuugagcaag

SEQ ID NO: 707110 - RNA, 16 nt, Haemophilus influenzae Rd
uccuguuguuuuuuac

SEQ ID NO: 707111 - RNA, 16 nt, Haemophilus influenzae Rd
ucgaauuaaagaaaaa

SEQ ID NO: 707112 - RNA, 14 nt, Haemophilus influenzae Rd
ucgaccauugcacg

SEQ ID NO: 707113 - RNA, 23 nt, Haemophilus influenzae Rd
ucgacauaacauuguuuuaaugu

SEQ ID NO: 707114 - RNA, 15 nt, Haemophilus influenzae Rd
ucgagaaacuuucaa

SEQ ID NO: 707115 - RNA, 19 nt, Haemophilus influenzae Rd
ucgagaaacuuucaaaaua

SEQ ID NO: 707116 - RNA, 21 nt, Haemophilus influenzae Rd
ucgacuuuuucaccauugauu

SEQ ID NO: 707117 - RNA, 20 nt, Haemophilus influenzae Rd
ucgcagccacuugugcauca

SEQ ID NO: 707118 - RNA, 16 nt, Haemophilus influenzae Rd
ucgcaaauccuacaac

SEQ ID NO: 707119 - RNA, 14 nt, Haemophilus influenzae Rd
ucgcaaaagaauga

SEQ ID NO: 707120 - RNA, 19 nt, Haemophilus influenzae Rd
ucgcaaacaugcucccaaa

SEQ ID NO: 707121 - RNA, 19 nt, Haemophilus influenzae Rd
ucgcagccuuguucugcag

SEQ ID NO: 707122 - RNA, 18 nt, Haemophilus influenzae Rd
ucgcaggauaagaugaua

SEQ ID NO: 707123 - RNA, 18 nt, Haemophilus influenzae Rd
ucgcaggaucacaaucau

SEQ ID NO: 707124 - RNA, 22 nt, Haemophilus influenzae Rd
ucgcauuguuaucuaaauaauu

SEQ ID NO: 707125 - RNA, 20 nt, Haemophilus influenzae Rd
ucgccagcagugccaaccac

SEQ ID NO: 707126 - RNA, 14 nt, Haemophilus influenzae Rd
ucgcauuuuaacuc

SEQ ID NO: 707127 - RNA, 15 nt, Haemophilus influenzae Rd
ucgccaccuuuuacc

SEQ ID NO: 707128 - RNA, 20 nt, Haemophilus influenzae Rd
ucgccacuggugcugaaaau

SEQ ID NO: 707129 - RNA, 19 nt, Haemophilus influenzae Rd
ucgauuacaaaaacacucu

SEQ ID NO: 707130 - RNA, 21 nt, Haemophilus influenzae Rd
ucgauucgccuugcuuuuaau

SEQ ID NO: 707131 - RNA, 21 nt, Haemophilus influenzae Rd
ucgauggauuuauugcguucc

SEQ ID NO: 707132 - RNA, 12 nt, Haemophilus influenzae Rd
ucgaucauuuuu

SEQ ID NO: 707133 - RNA, 22 nt, Haemophilus influenzae Rd
ucgauaggcgguaucaaugcca

SEQ ID NO: 707134 - RNA, 19 nt, Haemophilus influenzae Rd
ucgauacaagguacuugaa

SEQ ID NO: 707135 - RNA, 18 nt, Haemophilus influenzae Rd
uccgguuggaaaagccuu

SEQ ID NO: 707136 - RNA, 20 nt, Haemophilus influenzae Rd
uccguaguuauuuauuuaag

SEQ ID NO: 707137 - RNA, 18 nt, Haemophilus influenzae Rd
uccguaucauuuaauaau

SEQ ID NO: 707138 - RNA, 17 nt, Haemophilus influenzae Rd
uccgucaauaucccaac

SEQ ID NO: 707139 - RNA, 13 nt, Haemophilus influenzae Rd
uccgcugcucuac

SEQ ID NO: 707140 - RNA, 13 nt, Haemophilus influenzae Rd
uccgcuaaaaaug

SEQ ID NO: 707141 - RNA, 11 nt, Haemophilus influenzae Rd
uccgcuaaugc

SEQ ID NO: 707142 - RNA, 17 nt, Haemophilus influenzae Rd
uccgcuuguaauuucau

SEQ ID NO: 707143 - RNA, 21 nt, Haemophilus influenzae Rd
uccgcuuguaauuucauuuua

SEQ ID NO: 707144 - RNA, 15 nt, Haemophilus influenzae Rd
uccgcuuuuuucgca

SEQ ID NO: 707145 - RNA, 17 nt, Haemophilus influenzae Rd
uccgccuugagauguuu

SEQ ID NO: 707146 - RNA, 14 nt, Haemophilus influenzae Rd
uccgccugaagccu

SEQ ID NO: 707147 - RNA, 22 nt, Haemophilus influenzae Rd
uccgcacguaguaaauuuucca

SEQ ID NO: 707148 - RNA, 16 nt, Haemophilus influenzae Rd
uccgcaauuaauccau

SEQ ID NO: 707149 - RNA, 15 nt, Haemophilus influenzae Rd
uccgcaauauaguca

SEQ ID NO: 707150 - RNA, 23 nt, Haemophilus influenzae Rd
uccgccaagugcgguugaaaaau

SEQ ID NO: 707151 - RNA, 13 nt, Haemophilus influenzae Rd
uccgccaaugcuu

SEQ ID NO: 707152 - RNA, 15 nt, Haemophilus influenzae Rd
uccgcauuugguggg

SEQ ID NO: 707153 - RNA, 23 nt, Haemophilus influenzae Rd
uccugaaaguagauauuucucac

SEQ ID NO: 707154 - RNA, 12 nt, Haemophilus influenzae Rd
uccucugcaggc

SEQ ID NO: 707155 - RNA, 20 nt, Haemophilus influenzae Rd
uccucugcaggcauuuucaa

SEQ ID NO: 707156 - RNA, 16 nt, Haemophilus influenzae Rd
uccucuuuuauguuuc

SEQ ID NO: 707157 - RNA, 21 nt, Haemophilus influenzae Rd
uccugauaaugucccugcccu

SEQ ID NO: 707158 - RNA, 22 nt, Haemophilus influenzae Rd
uccugagaaagggauuuuaauu

SEQ ID NO: 707159 - RNA, 20 nt, Haemophilus influenzae Rd
uccucagauaaucuacaaaa

SEQ ID NO: 707160 - RNA, 23 nt, Haemophilus influenzae Rd
uccucagauaaucuacaaaacau

SEQ ID NO: 707161 - RNA, 14 nt, Haemophilus influenzae Rd
uccuauuaauuuaa

SEQ ID NO: 707162 - RNA, 22 nt, Haemophilus influenzae Rd
uccuauuaauuuaauucuaaau

SEQ ID NO: 707163 - RNA, 21 nt, Haemophilus influenzae Rd
uccuaggguucgaaucccuau

SEQ ID NO: 707164 - RNA, 16 nt, Haemophilus influenzae Rd
uccuagaguaaguaac

SEQ ID NO: 707165 - RNA, 13 nt, Haemophilus influenzae Rd
uccuauacuaauu

SEQ ID NO: 707166 - RNA, 12 nt, Haemophilus influenzae Rd
uccucagguuca

SEQ ID NO: 707167 - RNA, 18 nt, Haemophilus influenzae Rd
uccucagguucaaacauc

SEQ ID NO: 707168 - RNA, 16 nt, Haemophilus influenzae Rd
uccucccauucuuaaa

SEQ ID NO: 707169 - RNA, 13 nt, Haemophilus influenzae Rd
uccgugaacugag

SEQ ID NO: 707170 - RNA, 12 nt, Haemophilus influenzae Rd
uccguucuaaag

SEQ ID NO: 707171 - RNA, 17 nt, Haemophilus influenzae Rd
uccguuggcucaagccu

SEQ ID NO: 707172 - RNA, 18 nt, Haemophilus influenzae Rd
uccguuggcucaagccuu

SEQ ID NO: 707173 - RNA, 21 nt, Haemophilus influenzae Rd
uccguguacacaaugcuauca

SEQ ID NO: 707174 - RNA, 13 nt, Haemophilus influenzae Rd
uccguuaauaaug

SEQ ID NO: 707175 - RNA, 18 nt, Haemophilus influenzae Rd
uccguuccacuuccugcu

SEQ ID NO: 707176 - RNA, 14 nt, Haemophilus influenzae Rd
uccuacagaacccg

SEQ ID NO: 707177 - RNA, 22 nt, Haemophilus influenzae Rd
uccuacagugacuaaaacaaca

SEQ ID NO: 707178 - RNA, 15 nt, Haemophilus influenzae Rd
uccuacaucgccuug

SEQ ID NO: 707179 - RNA, 12 nt, Haemophilus influenzae Rd
uccuacauuaaa

SEQ ID NO: 707180 - RNA, 17 nt, Haemophilus influenzae Rd
uccuacauuaaaagaua

SEQ ID NO: 707181 - RNA, 23 nt, Haemophilus influenzae Rd
uccuaacaauaauuugccaaauc

SEQ ID NO: 707182 - RNA, 19 nt, Haemophilus influenzae Rd
uccuaaugugcaaucagca

SEQ ID NO: 707183 - RNA, 14 nt, Haemophilus influenzae Rd
uccuacuacagccc

SEQ ID NO: 707184 - RNA, 18 nt, Haemophilus influenzae Rd
uccuacuacagcccaauu

SEQ ID NO: 707185 - RNA, 18 nt, Haemophilus influenzae Rd
uccuacacccauuacacc

SEQ ID NO: 707186 - RNA, 12 nt, Haemophilus influenzae Rd
uccuaaauaaag

SEQ ID NO: 707187 - RNA, 18 nt, Haemophilus influenzae Rd
uccccuuaacuaauuguu

SEQ ID NO: 707188 - RNA, 21 nt, Haemophilus influenzae Rd
uccccuugauuauuuuuuaac

SEQ ID NO: 707189 - RNA, 16 nt, Haemophilus influenzae Rd
uccccuuguucuaaag

SEQ ID NO: 707190 - RNA, 18 nt, Haemophilus influenzae Rd
ucccgaaaauuguucagc

SEQ ID NO: 707191 - RNA, 14 nt, Haemophilus influenzae Rd
uccccguuaaauuu

SEQ ID NO: 707192 - RNA, 21 nt, Haemophilus influenzae Rd
uccccucauguuuucgguuua

SEQ ID NO: 707193 - RNA, 14 nt, Haemophilus influenzae Rd
ucccgcaggaggag

SEQ ID NO: 707194 - RNA, 15 nt, Haemophilus influenzae Rd
ucccgcauauaaaau

SEQ ID NO: 707195 - RNA, 14 nt, Haemophilus influenzae Rd
ucccuauaaauaaa

SEQ ID NO: 707196 - RNA, 17 nt, Haemophilus influenzae Rd
ucccucuuuaucuuuuu

SEQ ID NO: 707197 - RNA, 14 nt, Haemophilus influenzae Rd
ucccucuuuuucag

SEQ ID NO: 707198 - RNA, 14 nt, Haemophilus influenzae Rd
ucccugucuggcaa

SEQ ID NO: 707199 - RNA, 12 nt, Haemophilus influenzae Rd
ucccuguucaaa

SEQ ID NO: 707200 - RNA, 14 nt, Haemophilus influenzae Rd
ucccuugugucuac

SEQ ID NO: 707201 - RNA, 11 nt, Haemophilus influenzae Rd
ucccuuuucuu

SEQ ID NO: 707202 - RNA, 14 nt, Haemophilus influenzae Rd
ucccuuuucuuauu

SEQ ID NO: 707203 - RNA, 17 nt, Haemophilus influenzae Rd
uccgaaauuaauuuggg

SEQ ID NO: 707204 - RNA, 15 nt, Haemophilus influenzae Rd
uccgacauuuuacua

SEQ ID NO: 707205 - RNA, 21 nt, Haemophilus influenzae Rd
uccgauuuuaauugugcaauu

SEQ ID NO: 707206 - RNA, 16 nt, Haemophilus influenzae Rd
uccgauacauaauacu

SEQ ID NO: 707207 - RNA, 18 nt, Haemophilus influenzae Rd
uccgaucaaauugucaaa

SEQ ID NO: 707208 - RNA, 14 nt, Haemophilus influenzae Rd
uccgagcucuuuca

SEQ ID NO: 707209 - RNA, 16 nt, Haemophilus influenzae Rd
uccgagcucuuucauu

SEQ ID NO: 707210 - RNA, 18 nt, Haemophilus influenzae Rd
ucccccuuauuuuuuaau

SEQ ID NO: 707211 - RNA, 19 nt, Haemophilus influenzae Rd
ucccccccaauaaaaagau

SEQ ID NO: 707212 - RNA, 17 nt, Haemophilus influenzae Rd
uccccacuuaucuuaaa

SEQ ID NO: 707213 - RNA, 14 nt, Haemophilus influenzae Rd
ucccccaguacauc

SEQ ID NO: 707214 - RNA, 19 nt, Haemophilus influenzae Rd
uccccauacaaguauuuuc

SEQ ID NO: 707215 - RNA, 14 nt, Haemophilus influenzae Rd
uccccauaucucug

SEQ ID NO: 707216 - RNA, 19 nt, Haemophilus influenzae Rd
ucccagcguaaaaaugcug

SEQ ID NO: 707217 - RNA, 14 nt, Haemophilus influenzae Rd
ucccagucaaaaau

SEQ ID NO: 707218 - RNA, 17 nt, Haemophilus influenzae Rd
ucccaguaaucuuuuaa

SEQ ID NO: 707219 - RNA, 12 nt, Haemophilus influenzae Rd
ucccaguaaaua

SEQ ID NO: 707220 - RNA, 18 nt, Haemophilus influenzae Rd
ucccauaacaagugcuag

SEQ ID NO: 707221 - RNA, 21 nt, Haemophilus influenzae Rd
ucccauaaaucggcguauuuu

SEQ ID NO: 707222 - RNA, 22 nt, Haemophilus influenzae Rd
ucccauuuagguuagaauaaac

SEQ ID NO: 707223 - RNA, 22 nt, Haemophilus influenzae Rd
ucccauuucuaaugcaauuuca

SEQ ID NO: 707224 - RNA, 17 nt, Haemophilus influenzae Rd
ucccauugugcaauuaa

SEQ ID NO: 707225 - RNA, 15 nt, Haemophilus influenzae Rd
ucccauuuaaccccu

SEQ ID NO: 707226 - RNA, 20 nt, Haemophilus influenzae Rd
uccccaaguuugcacuucuu

SEQ ID NO: 707227 - RNA, 21 nt, Haemophilus influenzae Rd
ucccaucuuuaagaguaaauu

SEQ ID NO: 707228 - RNA, 22 nt, Haemophilus influenzae Rd
ucccaucuuuaagaguaaauuu

SEQ ID NO: 707229 - RNA, 16 nt, Haemophilus influenzae Rd
ucccauaccguauuuu

SEQ ID NO: 707230 - RNA, 23 nt, Haemophilus influenzae Rd
ucccauagcggauaaccaaaaua

SEQ ID NO: 707231 - RNA, 15 nt, Haemophilus influenzae Rd
uccaucuuuuacaua

SEQ ID NO: 707232 - RNA, 14 nt, Haemophilus influenzae Rd
uccaugacagaauu

SEQ ID NO: 707233 - RNA, 13 nt, Haemophilus influenzae Rd
uccauuccugcaa

SEQ ID NO: 707234 - RNA, 20 nt, Haemophilus influenzae Rd
uccauuccugcaagaaaaau

SEQ ID NO: 707235 - RNA, 15 nt, Haemophilus influenzae Rd
uccauucacuuucac

SEQ ID NO: 707236 - RNA, 15 nt, Haemophilus influenzae Rd
uccauugauauauuc

SEQ ID NO: 707237 - RNA, 23 nt, Haemophilus influenzae Rd
uccauugcauugccuaaauacau

SEQ ID NO: 707238 - RNA, 17 nt, Haemophilus influenzae Rd
uccauuacguucauaua

SEQ ID NO: 707239 - RNA, 20 nt, Haemophilus influenzae Rd
ucccaaaagcaaaugaggaa

SEQ ID NO: 707240 - RNA, 14 nt, Haemophilus influenzae Rd
ucccaaucuucguc

SEQ ID NO: 707241 - RNA, 13 nt, Haemophilus influenzae Rd
ucccaaggcucca

SEQ ID NO: 707242 - RNA, 16 nt, Haemophilus influenzae Rd
ucccaacuuuaugucc

SEQ ID NO: 707243 - RNA, 20 nt, Haemophilus influenzae Rd
ucccaagauuuuauacauuc

SEQ ID NO: 707244 - RNA, 13 nt, Haemophilus influenzae Rd
ucccaaaauauuu

SEQ ID NO: 707245 - RNA, 21 nt, Haemophilus influenzae Rd
ucccaaaauauuuucaaauaa

SEQ ID NO: 707246 - RNA, 23 nt, Haemophilus influenzae Rd
ucccaaaaugcuugaauaaauga

SEQ ID NO: 707247 - RNA, 16 nt, Haemophilus influenzae Rd
uccauuuuuuucuauu

SEQ ID NO: 707248 - RNA, 15 nt, Haemophilus influenzae Rd
uccauuuugaacaag

SEQ ID NO: 707249 - RNA, 20 nt, Haemophilus influenzae Rd
uccauuugcccacauagcuu

SEQ ID NO: 707250 - RNA, 16 nt, Haemophilus influenzae Rd
uccauuguuguuuauu

SEQ ID NO: 707251 - RNA, 22 nt, Haemophilus influenzae Rd
uccauugggaagcuggaaguaa

SEQ ID NO: 707252 - RNA, 16 nt, Haemophilus influenzae Rd
uccauugguggguuca

SEQ ID NO: 707253 - RNA, 23 nt, Haemophilus influenzae Rd
ucccaauggggguuagguaaaaa

SEQ ID NO: 707254 - RNA, 17 nt, Haemophilus influenzae Rd
uccaucaccuucaacau

SEQ ID NO: 707255 - RNA, 20 nt, Haemophilus influenzae Rd
uccaucaauucuucccaauc

SEQ ID NO: 707256 - RNA, 16 nt, Haemophilus influenzae Rd
uccauaugaccauuaa

SEQ ID NO: 707257 - RNA, 20 nt, Haemophilus influenzae Rd
uccauaugaccauuaaucac

SEQ ID NO: 707258 - RNA, 18 nt, Haemophilus influenzae Rd
uccauaucacauuuuauu

SEQ ID NO: 707259 - RNA, 16 nt, Haemophilus influenzae Rd
uccauaguucacuaaa

SEQ ID NO: 707260 - RNA, 18 nt, Haemophilus influenzae Rd
uccauaguucacuaaaaa

SEQ ID NO: 707261 - RNA, 17 nt, Haemophilus influenzae Rd
uccaucauuuuucgcaa

SEQ ID NO: 707262 - RNA, 23 nt, Haemophilus influenzae Rd
uccaucauuuuucgcaaaaucuu

SEQ ID NO: 707263 - RNA, 15 nt, Haemophilus influenzae Rd
uccauccagaaaauu

SEQ ID NO: 707264 - RNA, 17 nt, Haemophilus influenzae Rd
uccauaaaagaccucuc

SEQ ID NO: 707265 - RNA, 16 nt, Haemophilus influenzae Rd
uccauaaggaaauugc

SEQ ID NO: 707266 - RNA, 22 nt, Haemophilus influenzae Rd
uccauaauguucccuauaaaua

SEQ ID NO: 707267 - RNA, 15 nt, Haemophilus influenzae Rd
uccauacaguaaaaa

SEQ ID NO: 707268 - RNA, 17 nt, Haemophilus influenzae Rd
uccauaccaaaaugucg

SEQ ID NO: 707269 - RNA, 14 nt, Haemophilus influenzae Rd
uccaguaaagaauc

SEQ ID NO: 707270 - RNA, 18 nt, Haemophilus influenzae Rd
uccagucaucauagucag

SEQ ID NO: 707271 - RNA, 15 nt, Haemophilus influenzae Rd
uccaguucuccuucu

SEQ ID NO: 707272 - RNA, 18 nt, Haemophilus influenzae Rd
uccaguucuccuucucca

SEQ ID NO: 707273 - RNA, 20 nt, Haemophilus influenzae Rd
uccaguucuccuucuccauu

SEQ ID NO: 707274 - RNA, 16 nt, Haemophilus influenzae Rd
uccagcguaaccaaug

SEQ ID NO: 707275 - RNA, 20 nt, Haemophilus influenzae Rd
uccacgccuguggcaaaauc

SEQ ID NO: 707276 - RNA, 18 nt, Haemophilus influenzae Rd
uccacgguauuuucuuau

SEQ ID NO: 707277 - RNA, 19 nt, Haemophilus influenzae Rd
uccacgguauuuucuuauu

SEQ ID NO: 707278 - RNA, 15 nt, Haemophilus influenzae Rd
uccaccuugaauaau

SEQ ID NO: 707279 - RNA, 13 nt, Haemophilus influenzae Rd
uccacgagaaaag

SEQ ID NO: 707280 - RNA, 15 nt, Haemophilus influenzae Rd
uccacuaaaaaacua

SEQ ID NO: 707281 - RNA, 13 nt, Haemophilus influenzae Rd
uccacuaguucau

SEQ ID NO: 707282 - RNA, 16 nt, Haemophilus influenzae Rd
uccacuauaaaauacu

SEQ ID NO: 707283 - RNA, 18 nt, Haemophilus influenzae Rd
uccacuauaaaauacuau

SEQ ID NO: 707284 - RNA, 16 nt, Haemophilus influenzae Rd
uccacuucuuauggau

SEQ ID NO: 707285 - RNA, 18 nt, Haemophilus influenzae Rd
uccacuucuucuuuaaac

SEQ ID NO: 707286 - RNA, 23 nt, Haemophilus influenzae Rd
uccacuuuugguggauuauaaac

SEQ ID NO: 707287 - RNA, 13 nt, Haemophilus influenzae Rd
uccacuuuuucau

SEQ ID NO: 707288 - RNA, 14 nt, Haemophilus influenzae Rd
uccacuuuuucauc

SEQ ID NO: 707289 - RNA, 14 nt, Haemophilus influenzae Rd
uccacuuuuuucac

SEQ ID NO: 707290 - RNA, 16 nt, Haemophilus influenzae Rd
uccacaucacuuaauu

SEQ ID NO: 707291 - RNA, 21 nt, Haemophilus influenzae Rd
uccacauuuuuuguaauucgu

SEQ ID NO: 707292 - RNA, 19 nt, Haemophilus influenzae Rd
uccacacuuuaauaguaaa

SEQ ID NO: 707293 - RNA, 15 nt, Haemophilus influenzae Rd
uccacaauucuuaaa

SEQ ID NO: 707294 - RNA, 16 nt, Haemophilus influenzae Rd
uccaacucauuacaca

SEQ ID NO: 707295 - RNA, 21 nt, Haemophilus influenzae Rd
uccaagaggcucugaucacaa

SEQ ID NO: 707296 - RNA, 20 nt, Haemophilus influenzae Rd
uccaagcaaagaaauuuuaa

SEQ ID NO: 707297 - RNA, 14 nt, Haemophilus influenzae Rd
uccaagcaagcaaa

SEQ ID NO: 707298 - RNA, 15 nt, Haemophilus influenzae Rd
uccaagccauguuga

SEQ ID NO: 707299 - RNA, 14 nt, Haemophilus influenzae Rd
uccaauaaccaauc

SEQ ID NO: 707300 - RNA, 15 nt, Haemophilus influenzae Rd
uccaauaggaaacua

SEQ ID NO: 707301 - RNA, 14 nt, Haemophilus influenzae Rd
uccaagguuuuaau

SEQ ID NO: 707302 - RNA, 16 nt, Haemophilus influenzae Rd
uccaagguuuuaauuu

SEQ ID NO: 707303 - RNA, 17 nt, Haemophilus influenzae Rd
uccaagcguaaaaguau

SEQ ID NO: 707304 - RNA, 21 nt, Haemophilus influenzae Rd
uccaaugugaccaaauaaucg

SEQ ID NO: 707305 - RNA, 15 nt, Haemophilus influenzae Rd
uccaauguugcaaua

SEQ ID NO: 707306 - RNA, 22 nt, Haemophilus influenzae Rd
uccaaugcugaagucguuucau

SEQ ID NO: 707307 - RNA, 14 nt, Haemophilus influenzae Rd
uccaaugcacuugu

SEQ ID NO: 707308 - RNA, 23 nt, Haemophilus influenzae Rd
uccaaucaucagaauaauuaaca

SEQ ID NO: 707309 - RNA, 19 nt, Haemophilus influenzae Rd
uccaaucaucaucccaauc

SEQ ID NO: 707310 - RNA, 13 nt, Haemophilus influenzae Rd
uccacaaauaaua

SEQ ID NO: 707311 - RNA, 20 nt, Haemophilus influenzae Rd
uccacaaucaaucuuuaaaa

SEQ ID NO: 707312 - RNA, 22 nt, Haemophilus influenzae Rd
uccacaacuucggaagaaaaag

SEQ ID NO: 707313 - RNA, 16 nt, Haemophilus influenzae Rd
uccaauucuuuuaaau

SEQ ID NO: 707314 - RNA, 21 nt, Haemophilus influenzae Rd
uccacaaaaucugauacgaau

SEQ ID NO: 707315 - RNA, 20 nt, Haemophilus influenzae Rd
uaucuuccguuguuuuggau

SEQ ID NO: 707316 - RNA, 17 nt, Haemophilus influenzae Rd
ucagcgcauaauuaccu

SEQ ID NO: 707317 - RNA, 14 nt, Haemophilus influenzae Rd
uaucuuccacaaca

SEQ ID NO: 707318 - RNA, 17 nt, Haemophilus influenzae Rd
uaucuucaauuucuacc

SEQ ID NO: 707319 - RNA, 22 nt, Haemophilus influenzae Rd
ucagcgguuggcuuccagaaaa

SEQ ID NO: 707320 - RNA, 19 nt, Haemophilus influenzae Rd
ucagcgugaauauaagaaa

SEQ ID NO: 707321 - RNA, 16 nt, Haemophilus influenzae Rd
ucagcguugucaucag

SEQ ID NO: 707322 - RNA, 19 nt, Haemophilus influenzae Rd
ucagcguugucaucagaaa

SEQ ID NO: 707323 - RNA, 14 nt, Haemophilus influenzae Rd
ucagcggcuuucuu

SEQ ID NO: 707324 - RNA, 12 nt, Haemophilus influenzae Rd
ucagcuucaauu

SEQ ID NO: 707325 - RNA, 19 nt, Haemophilus influenzae Rd
ucagcuacuuguaagaaua

SEQ ID NO: 707326 - RNA, 22 nt, Haemophilus influenzae Rd
ucagcuacuuguaagaauaacc

SEQ ID NO: 707327 - RNA, 22 nt, Haemophilus influenzae Rd
ucagcuaauaaaguuugcaauu

SEQ ID NO: 707328 - RNA, 17 nt, Haemophilus influenzae Rd
ucagcuccuacauuaaa

SEQ ID NO: 707329 - RNA, 18 nt, Haemophilus influenzae Rd
ucagcugcgaugcauacu

SEQ ID NO: 707330 - RNA, 23 nt, Haemophilus influenzae Rd
ucagcugcucuuuaggaucacua

SEQ ID NO: 707331 - RNA, 15 nt, Haemophilus influenzae Rd
ucagcuguugcaaug

SEQ ID NO: 707332 - RNA, 15 nt, Haemophilus influenzae Rd
ucagcuuaaauacua

SEQ ID NO: 707333 - RNA, 17 nt, Haemophilus influenzae Rd
ucagguauuucuucaau

SEQ ID NO: 707334 - RNA, 22 nt, Haemophilus influenzae Rd
ucaggugcuauuuuauuuagaa

SEQ ID NO: 707335 - RNA, 19 nt, Haemophilus influenzae Rd
ucaggugcuuuagccacga

SEQ ID NO: 707336 - RNA, 15 nt, Haemophilus influenzae Rd
ucaggcuuucauuuu

SEQ ID NO: 707337 - RNA, 16 nt, Haemophilus influenzae Rd
ucaggcugugcauaau

SEQ ID NO: 707338 - RNA, 16 nt, Haemophilus influenzae Rd
ucagggauuaagaaaa

SEQ ID NO: 707339 - RNA, 12 nt, Haemophilus influenzae Rd
ucaguuugcuuu

SEQ ID NO: 707340 - RNA, 13 nt, Haemophilus influenzae Rd
ucaguuuucauuu

SEQ ID NO: 707341 - RNA, 15 nt, Haemophilus influenzae Rd
ucaguuuugcuuuuu

SEQ ID NO: 707342 - RNA, 21 nt, Haemophilus influenzae Rd
ucaguuuugcuuuuuuaauuu

SEQ ID NO: 707343 - RNA, 22 nt, Haemophilus influenzae Rd
ucauaaaaggcaaagcaaaauc

SEQ ID NO: 707344 - RNA, 11 nt, Haemophilus influenzae Rd
ucauaaaaauu

SEQ ID NO: 707345 - RNA, 12 nt, Haemophilus influenzae Rd
ucauaaaauuuc

SEQ ID NO: 707346 - RNA, 14 nt, Haemophilus influenzae Rd
ucauaaacuucuau

SEQ ID NO: 707347 - RNA, 19 nt, Haemophilus influenzae Rd
ucauaaauuccuuuuuaau

SEQ ID NO: 707348 - RNA, 15 nt, Haemophilus influenzae Rd
ucauaaauugugaug

SEQ ID NO: 707349 - RNA, 19 nt, Haemophilus influenzae Rd
ucauaaauuuccucagguu

SEQ ID NO: 707350 - RNA, 21 nt, Haemophilus influenzae Rd
ucauaaauuuccucagguuca

SEQ ID NO: 707351 - RNA, 15 nt, Haemophilus influenzae Rd
ucaguucaauuuaac

SEQ ID NO: 707352 - RNA, 16 nt, Haemophilus influenzae Rd
ucaguucaauuuaaca

SEQ ID NO: 707353 - RNA, 13 nt, Haemophilus influenzae Rd
ucaguuaugcaaa

SEQ ID NO: 707354 - RNA, 13 nt, Haemophilus influenzae Rd
ucaguuaaaccua

SEQ ID NO: 707355 - RNA, 21 nt, Haemophilus influenzae Rd
ucaguugaucgcaauguucac

SEQ ID NO: 707356 - RNA, 13 nt, Haemophilus influenzae Rd
ucaguuucaagca

SEQ ID NO: 707357 - RNA, 14 nt, Haemophilus influenzae Rd
ucaguuucaagcac

SEQ ID NO: 707358 - RNA, 15 nt, Haemophilus influenzae Rd
ucaguuucaagcacu

SEQ ID NO: 707359 - RNA, 12 nt, Haemophilus influenzae Rd
ucaguugcuucg

SEQ ID NO: 707360 - RNA, 20 nt, Haemophilus influenzae Rd
ucaguauuguuuuaugaaga

SEQ ID NO: 707361 - RNA, 21 nt, Haemophilus influenzae Rd
ucaguccgcauugaaaccuug

SEQ ID NO: 707362 - RNA, 15 nt, Haemophilus influenzae Rd
ucagucuauuauaaa

SEQ ID NO: 707363 - RNA, 18 nt, Haemophilus influenzae Rd
ucagucuauuauaaauuu

SEQ ID NO: 707364 - RNA, 15 nt, Haemophilus influenzae Rd
ucagucgguagaacg

SEQ ID NO: 707365 - RNA, 15 nt, Haemophilus influenzae Rd
ucagugccuaaauuu

SEQ ID NO: 707366 - RNA, 15 nt, Haemophilus influenzae Rd
ucaguguaauguuuu

SEQ ID NO: 707367 - RNA, 19 nt, Haemophilus influenzae Rd
ucaguggggaauaaaauaa

SEQ ID NO: 707368 - RNA, 23 nt, Haemophilus influenzae Rd
ucaguaacuacaacuucaucaau

SEQ ID NO: 707369 - RNA, 15 nt, Haemophilus influenzae Rd
ucaguaacuuuaaua

SEQ ID NO: 707370 - RNA, 16 nt, Haemophilus influenzae Rd
ucaguaagaaaccaac

SEQ ID NO: 707371 - RNA, 13 nt, Haemophilus influenzae Rd
ucaguaaacaagu

SEQ ID NO: 707372 - RNA, 20 nt, Haemophilus influenzae Rd
ucaguaaacaaguauaaaaa

SEQ ID NO: 707373 - RNA, 22 nt, Haemophilus influenzae Rd
ucagguugcgguaaaucuacuu

SEQ ID NO: 707374 - RNA, 15 nt, Haemophilus influenzae Rd
ucagguugguuuugu

SEQ ID NO: 707375 - RNA, 18 nt, Haemophilus influenzae Rd
ucagguuuaauaaucgaa

SEQ ID NO: 707376 - RNA, 15 nt, Haemophilus influenzae Rd
ucaguaucuggcuca

SEQ ID NO: 707377 - RNA, 18 nt, Haemophilus influenzae Rd
ucaguaccuuuaauuaaa

SEQ ID NO: 707378 - RNA, 14 nt, Haemophilus influenzae Rd
ucaguaccagucac

SEQ ID NO: 707379 - RNA, 15 nt, Haemophilus influenzae Rd
ucauacuaaaaaauu

SEQ ID NO: 707380 - RNA, 19 nt, Haemophilus influenzae Rd
ucauagaaaccaauaauuu

SEQ ID NO: 707381 - RNA, 22 nt, Haemophilus influenzae Rd
ucauagaaccgucuuuaaauag

SEQ ID NO: 707382 - RNA, 23 nt, Haemophilus influenzae Rd
ucauagaaccgucuuuaaauaga

SEQ ID NO: 707383 - RNA, 17 nt, Haemophilus influenzae Rd
ucauagagccaauuacc

SEQ ID NO: 707384 - RNA, 23 nt, Haemophilus influenzae Rd
ucauagaaggcuaguucuuccuu

SEQ ID NO: 707385 - RNA, 21 nt, Haemophilus influenzae Rd
ucauaagcauuuugauaauuu

SEQ ID NO: 707386 - RNA, 17 nt, Haemophilus influenzae Rd
ucauaagguacaacaga

SEQ ID NO: 707387 - RNA, 16 nt, Haemophilus influenzae Rd
ucauaaguaaaaccau

SEQ ID NO: 707388 - RNA, 13 nt, Haemophilus influenzae Rd
ucauaacuauaau

SEQ ID NO: 707389 - RNA, 13 nt, Haemophilus influenzae Rd
ucauaaucugaaa

SEQ ID NO: 707390 - RNA, 16 nt, Haemophilus influenzae Rd
ucauaaucugaaagug

SEQ ID NO: 707391 - RNA, 18 nt, Haemophilus influenzae Rd
ucauaauccacuaaaaac

SEQ ID NO: 707392 - RNA, 15 nt, Haemophilus influenzae Rd
ucauacagaaaccag

SEQ ID NO: 707393 - RNA, 18 nt, Haemophilus influenzae Rd
ucauaccaaggcauuuuu

SEQ ID NO: 707394 - RNA, 17 nt, Haemophilus influenzae Rd
ucauaauuuauucaaaa

SEQ ID NO: 707395 - RNA, 18 nt, Haemophilus influenzae Rd
ucauaauuuauucaaaau

SEQ ID NO: 707396 - RNA, 21 nt, Haemophilus influenzae Rd
ucauacaaucucuagauuuuu

SEQ ID NO: 707397 - RNA, 11 nt, Haemophilus influenzae Rd
ucauauuucug

SEQ ID NO: 707398 - RNA, 14 nt, Haemophilus influenzae Rd
ucauauuucugcaa

SEQ ID NO: 707399 - RNA, 19 nt, Haemophilus influenzae Rd
ucauauuucugcaaauaaa

SEQ ID NO: 707400 - RNA, 17 nt, Haemophilus influenzae Rd
ucauauuucuguauuau

SEQ ID NO: 707401 - RNA, 14 nt, Haemophilus influenzae Rd
ucauauuugaaguu

SEQ ID NO: 707402 - RNA, 13 nt, Haemophilus influenzae Rd
ucauauuguuuca

SEQ ID NO: 707403 - RNA, 18 nt, Haemophilus influenzae Rd
ucauauuguuucaacaua

SEQ ID NO: 707404 - RNA, 14 nt, Haemophilus influenzae Rd
ucauauugauuuac

SEQ ID NO: 707405 - RNA, 16 nt, Haemophilus influenzae Rd
ucauauugauuucucu

SEQ ID NO: 707406 - RNA, 13 nt, Haemophilus influenzae Rd
ucaucaaaaccau

SEQ ID NO: 707407 - RNA, 17 nt, Haemophilus influenzae Rd
ucaucaagauuuauucc

SEQ ID NO: 707408 - RNA, 22 nt, Haemophilus influenzae Rd
ucaucaagcaaacuuagauaac

SEQ ID NO: 707409 - RNA, 21 nt, Haemophilus influenzae Rd
ucaucaaugccauuuuuuaua

SEQ ID NO: 707410 - RNA, 22 nt, Haemophilus influenzae Rd
ucaucaauggcaucgcuggcua

SEQ ID NO: 707411 - RNA, 14 nt, Haemophilus influenzae Rd
ucaucaauaucugc

SEQ ID NO: 707412 - RNA, 11 nt, Haemophilus influenzae Rd
ucaucaaaaug

SEQ ID NO: 707413 - RNA, 20 nt, Haemophilus influenzae Rd
ucaucaaacacccaaucugg

SEQ ID NO: 707414 - RNA, 18 nt, Haemophilus influenzae Rd
ucauaucuuuaccuguuu

SEQ ID NO: 707415 - RNA, 15 nt, Haemophilus influenzae Rd
ucauaucuaacauag

SEQ ID NO: 707416 - RNA, 22 nt, Haemophilus influenzae Rd
ucauaucuauugagauuuaauu

SEQ ID NO: 707417 - RNA, 21 nt, Haemophilus influenzae Rd
ucauaucugucauauaaccac

SEQ ID NO: 707418 - RNA, 11 nt, Haemophilus influenzae Rd
ucauauuccca

SEQ ID NO: 707419 - RNA, 16 nt, Haemophilus influenzae Rd
ucauauucccaaggcu

SEQ ID NO: 707420 - RNA, 19 nt, Haemophilus influenzae Rd
ucauauucccaaggcucca

SEQ ID NO: 707421 - RNA, 20 nt, Haemophilus influenzae Rd
ucauaguuggauuauuuaga

SEQ ID NO: 707422 - RNA, 10 nt, Haemophilus influenzae Rd
ucauagcuga

SEQ ID NO: 707423 - RNA, 19 nt, Haemophilus influenzae Rd
ucauaguuuucugauuuaa

SEQ ID NO: 707424 - RNA, 13 nt, Haemophilus influenzae Rd
ucauauaaauaag

SEQ ID NO: 707425 - RNA, 16 nt, Haemophilus influenzae Rd
ucauauaaaucaaucc

SEQ ID NO: 707426 - RNA, 20 nt, Haemophilus influenzae Rd
ucauauagggcucaaauuuu

SEQ ID NO: 707427 - RNA, 14 nt, Haemophilus influenzae Rd
ucauauauaaauuu

SEQ ID NO: 707428 - RNA, 17 nt, Haemophilus influenzae Rd
ucauauauucaacuaaa

SEQ ID NO: 707429 - RNA, 14 nt, Haemophilus influenzae Rd
ucaucaauuuugac

SEQ ID NO: 707430 - RNA, 20 nt, Haemophilus influenzae Rd
ucaucacccaucaaaucuuu

SEQ ID NO: 707431 - RNA, 12 nt, Haemophilus influenzae Rd
ucaucacuucaa

SEQ ID NO: 707432 - RNA, 13 nt, Haemophilus influenzae Rd
ucaucagaaagug

SEQ ID NO: 707433 - RNA, 19 nt, Haemophilus influenzae Rd
ucaucauaauuuauucaaa

SEQ ID NO: 707434 - RNA, 15 nt, Haemophilus influenzae Rd
ucaucauacaaucca

SEQ ID NO: 707435 - RNA, 18 nt, Haemophilus influenzae Rd
ucaucauacaauccacca

SEQ ID NO: 707436 - RNA, 13 nt, Haemophilus influenzae Rd
ucaucauuaugaa

SEQ ID NO: 707437 - RNA, 17 nt, Haemophilus influenzae Rd
ucaucauuaugaaaaaa

SEQ ID NO: 707438 - RNA, 18 nt, Haemophilus influenzae Rd
ucaucauuaugaaaaaaa

SEQ ID NO: 707439 - RNA, 14 nt, Haemophilus influenzae Rd
ucauccaaucauca

SEQ ID NO: 707440 - RNA, 18 nt, Haemophilus influenzae Rd
ucauccaauguugcaaua

SEQ ID NO: 707441 - RNA, 16 nt, Haemophilus influenzae Rd
ucaucauuuuggcuuu

SEQ ID NO: 707442 - RNA, 17 nt, Haemophilus influenzae Rd
ucaucauuuuggcuuua

SEQ ID NO: 707443 - RNA, 16 nt, Haemophilus influenzae Rd
ucauccacuaaaccau

SEQ ID NO: 707444 - RNA, 14 nt, Haemophilus influenzae Rd
ucauccgcuucguu

SEQ ID NO: 707445 - RNA, 15 nt, Haemophilus influenzae Rd
ucaucccagauuuua

SEQ ID NO: 707446 - RNA, 20 nt, Haemophilus influenzae Rd
ucauccauuggauuaagaau

SEQ ID NO: 707447 - RNA, 16 nt, Haemophilus influenzae Rd
ucaucccaaucuucgu

SEQ ID NO: 707448 - RNA, 14 nt, Haemophilus influenzae Rd
ucaucgauaaauuc

SEQ ID NO: 707449 - RNA, 18 nt, Haemophilus influenzae Rd
ucaucgcguuuuuucuua

SEQ ID NO: 707450 - RNA, 14 nt, Haemophilus influenzae Rd
ucaucgcgcaaaau

SEQ ID NO: 707451 - RNA, 18 nt, Haemophilus influenzae Rd
ucaucgccgugauaauau

SEQ ID NO: 707452 - RNA, 18 nt, Haemophilus influenzae Rd
ucaucgccuguuaagcca

SEQ ID NO: 707453 - RNA, 22 nt, Haemophilus influenzae Rd
ucaucgauguaaaguguuacaa

SEQ ID NO: 707454 - RNA, 20 nt, Haemophilus influenzae Rd
ucaucguaauuaaacaaaau

SEQ ID NO: 707455 - RNA, 14 nt, Haemophilus influenzae Rd
ucaucgcucaucgu

SEQ ID NO: 707456 - RNA, 18 nt, Haemophilus influenzae Rd
ucaucgcuucuaaaucua

SEQ ID NO: 707457 - RNA, 17 nt, Haemophilus influenzae Rd
ucaucggacgaaucaca

SEQ ID NO: 707458 - RNA, 15 nt, Haemophilus influenzae Rd
ucaucuaguuuuaau

SEQ ID NO: 707459 - RNA, 12 nt, Haemophilus influenzae Rd
ucaucuaacaca

SEQ ID NO: 707460 - RNA, 18 nt, Haemophilus influenzae Rd
ucaucuaacacaauaacc

SEQ ID NO: 707461 - RNA, 16 nt, Haemophilus influenzae Rd
ucaucuaauaauaaga

SEQ ID NO: 707462 - RNA, 16 nt, Haemophilus influenzae Rd
ucaucugcauaacgau

SEQ ID NO: 707463 - RNA, 11 nt, Haemophilus influenzae Rd
ucaucugcugg

SEQ ID NO: 707464 - RNA, 21 nt, Haemophilus influenzae Rd
ucaucucgaccacaacagaga

SEQ ID NO: 707465 - RNA, 19 nt, Haemophilus influenzae Rd
ucaucucuaaccuaaaaua

SEQ ID NO: 707466 - RNA, 21 nt, Haemophilus influenzae Rd
ucaucucuaaccuaaaauaga

SEQ ID NO: 707467 - RNA, 23 nt, Haemophilus influenzae Rd
ucaucuucuuuugcccauucuaa

SEQ ID NO: 707468 - RNA, 16 nt, Haemophilus influenzae Rd
ucaucuugauccauau

SEQ ID NO: 707469 - RNA, 19 nt, Haemophilus influenzae Rd
ucaucuugauccauauauu

SEQ ID NO: 707470 - RNA, 21 nt, Haemophilus influenzae Rd
ucaucuuccgugacaucaucu

SEQ ID NO: 707471 - RNA, 15 nt, Haemophilus influenzae Rd
ucaucuuauuugauu

SEQ ID NO: 707472 - RNA, 19 nt, Haemophilus influenzae Rd
ucaugauguaauucugcuu

SEQ ID NO: 707473 - RNA, 24 nt, Haemophilus influenzae Rd
ucaugaguuguuuuuucaguuguu

SEQ ID NO: 707474 - RNA, 23 nt, Haemophilus influenzae Rd
ucaucuuuuuuaagauaaguggg

SEQ ID NO: 707475 - RNA, 16 nt, Haemophilus influenzae Rd
ucaucuuuuuauaaaa

SEQ ID NO: 707476 - RNA, 20 nt, Haemophilus influenzae Rd
ucaugccgcaaucaagcaaa

SEQ ID NO: 707477 - RNA, 13 nt, Haemophilus influenzae Rd
uccaacagcuugc

SEQ ID NO: 707478 - RNA, 17 nt, Haemophilus influenzae Rd
uccaaccgauaaggaaa

SEQ ID NO: 707479 - RNA, 20 nt, Haemophilus influenzae Rd
uccaacuaugaagacuaaac

SEQ ID NO: 707480 - RNA, 22 nt, Haemophilus influenzae Rd
uccaacgcacguaacaaaugca

SEQ ID NO: 707481 - RNA, 17 nt, Haemophilus influenzae Rd
uccaaccuaauaacggc

SEQ ID NO: 707482 - RNA, 14 nt, Haemophilus influenzae Rd
uccaacaauuucac

SEQ ID NO: 707483 - RNA, 15 nt, Haemophilus influenzae Rd
uccaacaauuucacu

SEQ ID NO: 707484 - RNA, 16 nt, Haemophilus influenzae Rd
uccaacaauuucacug

SEQ ID NO: 707485 - RNA, 15 nt, Haemophilus influenzae Rd
uccaaauucauuuuu

SEQ ID NO: 707486 - RNA, 21 nt, Haemophilus influenzae Rd
uccaaauucauuuuuuauuuu

SEQ ID NO: 707487 - RNA, 15 nt, Haemophilus influenzae Rd
uccaaauuccaucaa

SEQ ID NO: 707488 - RNA, 19 nt, Haemophilus influenzae Rd
uccaaauuccgcaauauuu

SEQ ID NO: 707489 - RNA, 16 nt, Haemophilus influenzae Rd
uccaaauugagaucuu

SEQ ID NO: 707490 - RNA, 17 nt, Haemophilus influenzae Rd
uccaaaugccuaacaca

SEQ ID NO: 707491 - RNA, 20 nt, Haemophilus influenzae Rd
uccaaaucauaccaauugca

SEQ ID NO: 707492 - RNA, 15 nt, Haemophilus influenzae Rd
uccaaauauaaaaua

SEQ ID NO: 707493 - RNA, 12 nt, Haemophilus influenzae Rd
uccaaaguauaa

SEQ ID NO: 707494 - RNA, 14 nt, Haemophilus influenzae Rd
ucauuuuuugcaaa

SEQ ID NO: 707495 - RNA, 11 nt, Haemophilus influenzae Rd
uccaaaaauau

SEQ ID NO: 707496 - RNA, 15 nt, Haemophilus influenzae Rd
ucauuuuuuuaaaua

SEQ ID NO: 707497 - RNA, 16 nt, Haemophilus influenzae Rd
uccaaaaaccaacgcc

SEQ ID NO: 707498 - RNA, 21 nt, Haemophilus influenzae Rd
uccaaaauuaaauugaaaaaa

SEQ ID NO: 707499 - RNA, 12 nt, Haemophilus influenzae Rd
uccaaacauuuu

SEQ ID NO: 707500 - RNA, 15 nt, Haemophilus influenzae Rd
uccaaacauuuuuau

SEQ ID NO: 707501 - RNA, 17 nt, Haemophilus influenzae Rd
uccaaacauuuuuauuu

SEQ ID NO: 707502 - RNA, 15 nt, Haemophilus influenzae Rd
uccaaacuaaaugcu

SEQ ID NO: 707503 - RNA, 23 nt, Haemophilus influenzae Rd
uccaaacgccacgcucgaggguu

SEQ ID NO: 707504 - RNA, 14 nt, Haemophilus influenzae Rd
uccaaagaaaucac

SEQ ID NO: 707505 - RNA, 21 nt, Haemophilus influenzae Rd
ucauugcucgacaaagauuuu

SEQ ID NO: 707506 - RNA, 18 nt, Haemophilus influenzae Rd
ucauugcugcuuuaauuu

SEQ ID NO: 707507 - RNA, 21 nt, Haemophilus influenzae Rd
ucauugcugcuuuaauuucau

SEQ ID NO: 707508 - RNA, 17 nt, Haemophilus influenzae Rd
ucauuggggaacggaag

SEQ ID NO: 707509 - RNA, 14 nt, Haemophilus influenzae Rd
ucauugugaucaga

SEQ ID NO: 707510 - RNA, 16 nt, Haemophilus influenzae Rd
ucauugugugcagaau

SEQ ID NO: 707511 - RNA, 13 nt, Haemophilus influenzae Rd
ucauuuaaaauau

SEQ ID NO: 707512 - RNA, 13 nt, Haemophilus influenzae Rd
ucauuuacagguu

SEQ ID NO: 707513 - RNA, 13 nt, Haemophilus influenzae Rd
ucauuuaaaacaa

SEQ ID NO: 707514 - RNA, 22 nt, Haemophilus influenzae Rd
ucauuuaaccguaauuucaaau

SEQ ID NO: 707515 - RNA, 14 nt, Haemophilus influenzae Rd
ucauuuaguuuaag

SEQ ID NO: 707516 - RNA, 14 nt, Haemophilus influenzae Rd
ucauuuauauaaaa

SEQ ID NO: 707517 - RNA, 18 nt, Haemophilus influenzae Rd
ucauuuauggaaauaaau

SEQ ID NO: 707518 - RNA, 16 nt, Haemophilus influenzae Rd
ucauuuauuaaaagua

SEQ ID NO: 707519 - RNA, 21 nt, Haemophilus influenzae Rd
ucauuuauuaaaaguaaacaa

SEQ ID NO: 707520 - RNA, 20 nt, Haemophilus influenzae Rd
ucauuucucgggcugaaaua

SEQ ID NO: 707521 - RNA, 22 nt, Haemophilus influenzae Rd
ucauuucucgggcugaaauacc

SEQ ID NO: 707522 - RNA, 20 nt, Haemophilus influenzae Rd
ucauuugccgccaaaaugag

SEQ ID NO: 707523 - RNA, 12 nt, Haemophilus influenzae Rd
ucauuugcucua

SEQ ID NO: 707524 - RNA, 19 nt, Haemophilus influenzae Rd
ucauuugcucuaaauguga

SEQ ID NO: 707525 - RNA, 18 nt, Haemophilus influenzae Rd
ucauuuggaucuaaaaaa

SEQ ID NO: 707526 - RNA, 15 nt, Haemophilus influenzae Rd
ucauuugaauuaaua

SEQ ID NO: 707527 - RNA, 22 nt, Haemophilus influenzae Rd
ucauuugagcggcuaugaauac

SEQ ID NO: 707528 - RNA, 23 nt, Haemophilus influenzae Rd
ucauuugcaaaucaagaugacga

SEQ ID NO: 707529 - RNA, 19 nt, Haemophilus influenzae Rd
ucauuuguuaagcucacuu

SEQ ID NO: 707530 - RNA, 22 nt, Haemophilus influenzae Rd
ucauuuguuagaaauacauuau

SEQ ID NO: 707531 - RNA, 18 nt, Haemophilus influenzae Rd
ucauuuugagauaaauuu

SEQ ID NO: 707532 - RNA, 14 nt, Haemophilus influenzae Rd
ucauuuuggcuuua

SEQ ID NO: 707533 - RNA, 19 nt, Haemophilus influenzae Rd
ucauuuuuauuuaaugggu

SEQ ID NO: 707534 - RNA, 20 nt, Haemophilus influenzae Rd
ucauuuuuacuuucuuucaa

SEQ ID NO: 707535 - RNA, 11 nt, Haemophilus influenzae Rd
ucauuuucgca

SEQ ID NO: 707536 - RNA, 20 nt, Haemophilus influenzae Rd
ucauuuguuuuccguauuuu

SEQ ID NO: 707537 - RNA, 15 nt, Haemophilus influenzae Rd
ucauuuuaaagaguu

SEQ ID NO: 707538 - RNA, 14 nt, Haemophilus influenzae Rd
ucauugccauuucu

SEQ ID NO: 707539 - RNA, 21 nt, Haemophilus influenzae Rd
ucauugcaagugcaguuucag

SEQ ID NO: 707540 - RNA, 12 nt, Haemophilus influenzae Rd
ucauucuauuuu

SEQ ID NO: 707541 - RNA, 19 nt, Haemophilus influenzae Rd
ucauucguauaaauauuuc

SEQ ID NO: 707542 - RNA, 17 nt, Haemophilus influenzae Rd
ucauucgcaucauagca

SEQ ID NO: 707543 - RNA, 21 nt, Haemophilus influenzae Rd
ucauuauugccuuucaucauu

SEQ ID NO: 707544 - RNA, 20 nt, Haemophilus influenzae Rd
ucauucaaugcaacaauacg

SEQ ID NO: 707545 - RNA, 14 nt, Haemophilus influenzae Rd
ucauucaaauaauu

SEQ ID NO: 707546 - RNA, 15 nt, Haemophilus influenzae Rd
ucauucaaauaauuu

SEQ ID NO: 707547 - RNA, 21 nt, Haemophilus influenzae Rd
ucauucaacaaaaaugccuuu

SEQ ID NO: 707548 - RNA, 16 nt, Haemophilus influenzae Rd
ucauuacuuuuuuaag

SEQ ID NO: 707549 - RNA, 14 nt, Haemophilus influenzae Rd
ucauuauauuccuu

SEQ ID NO: 707550 - RNA, 20 nt, Haemophilus influenzae Rd
ucauuauauuccuuauucaa

SEQ ID NO: 707551 - RNA, 21 nt, Haemophilus influenzae Rd
ucauuauauugugcauaguuu

SEQ ID NO: 707552 - RNA, 13 nt, Haemophilus influenzae Rd
ucauuauauuuaa

SEQ ID NO: 707553 - RNA, 12 nt, Haemophilus influenzae Rd
ucauuaugaaaa

SEQ ID NO: 707554 - RNA, 23 nt, Haemophilus influenzae Rd
ucauuauccaacauuaauaacgu

SEQ ID NO: 707555 - RNA, 14 nt, Haemophilus influenzae Rd
ucaugguuguaaua

SEQ ID NO: 707556 - RNA, 15 nt, Haemophilus influenzae Rd
ucauguguaggcaua

SEQ ID NO: 707557 - RNA, 22 nt, Haemophilus influenzae Rd
ucaugugggcuuuacaaugagu

SEQ ID NO: 707558 - RNA, 20 nt, Haemophilus influenzae Rd
ucauggcgaccauucucuaa

SEQ ID NO: 707559 - RNA, 14 nt, Haemophilus influenzae Rd
ucaugguaauuuaa

SEQ ID NO: 707560 - RNA, 17 nt, Haemophilus influenzae Rd
ucaugguaauuuaauua

SEQ ID NO: 707561 - RNA, 13 nt, Haemophilus influenzae Rd
ucauuaaaaucug

SEQ ID NO: 707562 - RNA, 22 nt, Haemophilus influenzae Rd
ucauuaaauaacucaagcaacc

SEQ ID NO: 707563 - RNA, 13 nt, Haemophilus influenzae Rd
ucauuaaauauaa

SEQ ID NO: 707564 - RNA, 16 nt, Haemophilus influenzae Rd
ucauuaaaaaauaauu

SEQ ID NO: 707565 - RNA, 20 nt, Haemophilus influenzae Rd
ucauuaaaaccaauuuuuuc

SEQ ID NO: 707566 - RNA, 21 nt, Haemophilus influenzae Rd
ucauuaaaaccaauuuuuuca

SEQ ID NO: 707567 - RNA, 22 nt, Haemophilus influenzae Rd
ucauuaaaaccaauuuuuucau

SEQ ID NO: 707568 - RNA, 23 nt, Haemophilus influenzae Rd
ucauuaaauuuaguuaauauauu

SEQ ID NO: 707569 - RNA, 17 nt, Haemophilus influenzae Rd
ucauuaagccugcuaca

SEQ ID NO: 707570 - RNA, 13 nt, Haemophilus influenzae Rd
ucauuaaggugca

SEQ ID NO: 707571 - RNA, 18 nt, Haemophilus influenzae Rd
ucauuacgugcaaauaaa

SEQ ID NO: 707572 - RNA, 22 nt, Haemophilus influenzae Rd
ucauuacgugcaaauaaauuug

SEQ ID NO: 707573 - RNA, 14 nt, Haemophilus influenzae Rd
ucauuaauuuuuuc

SEQ ID NO: 707574 - RNA, 18 nt, Haemophilus influenzae Rd
ucauuaauacagugcaga

SEQ ID NO: 707575 - RNA, 21 nt, Haemophilus influenzae Rd
ucauuaauuuuauuuuuugcg

SEQ ID NO: 707576 - RNA, 14 nt, Haemophilus influenzae Rd
ggaaucuggcuuau

SEQ ID NO: 707577 - RNA, 16 nt, Haemophilus influenzae Rd
ggaauuuuuuacugcu

SEQ ID NO: 707578 - RNA, 15 nt, Haemophilus influenzae Rd
ggaauagccgauuga

SEQ ID NO: 707579 - RNA, 15 nt, Haemophilus influenzae Rd
ggaaucgguagacac

SEQ ID NO: 707580 - RNA, 18 nt, Haemophilus influenzae Rd
ggaauaaauugaauaucu

SEQ ID NO: 707581 - RNA, 18 nt, Haemophilus influenzae Rd
ggaauaacacaccaacaa

SEQ ID NO: 707582 - RNA, 22 nt, Haemophilus influenzae Rd
ggaaguuaugggcugacauaaa

SEQ ID NO: 707583 - RNA, 15 nt, Haemophilus influenzae Rd
ggacuuacaucugug

SEQ ID NO: 707584 - RNA, 17 nt, Haemophilus influenzae Rd
ggagaaacauuuuuccc

SEQ ID NO: 707585 - RNA, 13 nt, Haemophilus influenzae Rd
ggagauaaauaaa

SEQ ID NO: 707586 - RNA, 22 nt, Haemophilus influenzae Rd
ggagauaauauuccaaaaaaua

SEQ ID NO: 707587 - RNA, 19 nt, Haemophilus influenzae Rd
ggacucgcuguaacaucaa

SEQ ID NO: 707588 - RNA, 18 nt, Haemophilus influenzae Rd
ggacugaguucugucauu

SEQ ID NO: 707589 - RNA, 23 nt, Haemophilus influenzae Rd
ggaggagccaaauuuaaaaaagc

SEQ ID NO: 707590 - RNA, 15 nt, Haemophilus influenzae Rd
ggauguucaaguaaa

SEQ ID NO: 707591 - RNA, 16 nt, Haemophilus influenzae Rd
ggauguucaaguaaau

SEQ ID NO: 707592 - RNA, 23 nt, Haemophilus influenzae Rd
ggauuaccacccaaaauuucagc

SEQ ID NO: 707593 - RNA, 19 nt, Haemophilus influenzae Rd
ggauuagcauaaaauuaac

SEQ ID NO: 707594 - RNA, 15 nt, Haemophilus influenzae Rd
ggauuaguaagugcu

SEQ ID NO: 707595 - RNA, 13 nt, Haemophilus influenzae Rd
ggauuacuuucau

SEQ ID NO: 707596 - RNA, 15 nt, Haemophilus influenzae Rd
ggauuagaaaugauc

SEQ ID NO: 707597 - RNA, 14 nt, Haemophilus influenzae Rd
ggauuauuaaaauu

SEQ ID NO: 707598 - RNA, 20 nt, Haemophilus influenzae Rd
ggauuggguuguuacguuuc

SEQ ID NO: 707599 - RNA, 14 nt, Haemophilus influenzae Rd
ggaucaagauuugc

SEQ ID NO: 707600 - RNA, 16 nt, Haemophilus influenzae Rd
ggcaacgccaauaaaa

SEQ ID NO: 707601 - RNA, 22 nt, Haemophilus influenzae Rd
ggcaacagugauacuucgggga

SEQ ID NO: 707602 - RNA, 16 nt, Haemophilus influenzae Rd
ggcaaaugggugcuug

SEQ ID NO: 707603 - RNA, 18 nt, Haemophilus influenzae Rd
ggauugguuggaaacgaa

SEQ ID NO: 707604 - RNA, 21 nt, Haemophilus influenzae Rd
ggauuuauuauuuaauacgaa

SEQ ID NO: 707605 - RNA, 16 nt, Haemophilus influenzae Rd
ggauuuuguaauaaaa

SEQ ID NO: 707606 - RNA, 22 nt, Haemophilus influenzae Rd
ggcaaaggcuucauuugcuucu

SEQ ID NO: 707607 - RNA, 20 nt, Haemophilus influenzae Rd
ggcaaaaccgcuauuacuua

SEQ ID NO: 707608 - RNA, 13 nt, Haemophilus influenzae Rd
ggcaaaaaaauca

SEQ ID NO: 707609 - RNA, 23 nt, Haemophilus influenzae Rd
ggcaagcaaacagcaauaaauaa

SEQ ID NO: 707610 - RNA, 17 nt, Haemophilus influenzae Rd
ggcaacucaguuuuuga

SEQ ID NO: 707611 - RNA, 22 nt, Haemophilus influenzae Rd
ggcaagaaauucacucaauuca

SEQ ID NO: 707612 - RNA, 18 nt, Haemophilus influenzae Rd
ggcaagucugcugaaaua

SEQ ID NO: 707613 - RNA, 20 nt, Haemophilus influenzae Rd
ggcaccgaauguggcagcaa

SEQ ID NO: 707614 - RNA, 14 nt, Haemophilus influenzae Rd
ggcaauuuuuuguc

SEQ ID NO: 707615 - RNA, 21 nt, Haemophilus influenzae Rd
ggcaauuuuagcuaauggcug

SEQ ID NO: 707616 - RNA, 23 nt, Haemophilus influenzae Rd
ggcauuuagagggauaaaaauca

SEQ ID NO: 707617 - RNA, 16 nt, Haemophilus influenzae Rd
ggcauuucaagcuggu

SEQ ID NO: 707618 - RNA, 13 nt, Haemophilus influenzae Rd
ggcauucauugga

SEQ ID NO: 707619 - RNA, 21 nt, Haemophilus influenzae Rd
ggcaucaucauuuuuugcuuc

SEQ ID NO: 707620 - RNA, 16 nt, Haemophilus influenzae Rd
ggcauccaaaguacac

SEQ ID NO: 707621 - RNA, 15 nt, Haemophilus influenzae Rd
ggcauaaagaaacag

SEQ ID NO: 707622 - RNA, 20 nt, Haemophilus influenzae Rd
ggcauaaagaaacaggacac

SEQ ID NO: 707623 - RNA, 22 nt, Haemophilus influenzae Rd
ggccacucauacguucaacaau

SEQ ID NO: 707624 - RNA, 19 nt, Haemophilus influenzae Rd
ggcggauuuauuauuuaau

SEQ ID NO: 707625 - RNA, 18 nt, Haemophilus influenzae Rd
ggcguaucauacuaaaaa

SEQ ID NO: 707626 - RNA, 22 nt, Haemophilus influenzae Rd
ggcguaaucguagaaaucaaaa

SEQ ID NO: 707627 - RNA, 18 nt, Haemophilus influenzae Rd
ggcguaaaccuuuuugcg

SEQ ID NO: 707628 - RNA, 15 nt, Haemophilus influenzae Rd
ggcuaugauuuuaaa

SEQ ID NO: 707629 - RNA, 18 nt, Haemophilus influenzae Rd
ggcuaacuucuuccacuu

SEQ ID NO: 707630 - RNA, 21 nt, Haemophilus influenzae Rd
ggcuaagguuuaacugauuag

SEQ ID NO: 707631 - RNA, 20 nt, Haemophilus influenzae Rd
ggcguuuuuuauaaacuucu

SEQ ID NO: 707632 - RNA, 15 nt, Haemophilus influenzae Rd
ggcguuuaggagaag

SEQ ID NO: 707633 - RNA, 17 nt, Haemophilus influenzae Rd
ggcgaugaucauaagau

SEQ ID NO: 707634 - RNA, 19 nt, Haemophilus influenzae Rd
ggcgagugcggcaaagguu

SEQ ID NO: 707635 - RNA, 12 nt, Haemophilus influenzae Rd
ggcgagauuaaa

SEQ ID NO: 707636 - RNA, 14 nt, Haemophilus influenzae Rd
ggcgacgauuuaau

SEQ ID NO: 707637 - RNA, 15 nt, Haemophilus influenzae Rd
ggcgaaccacauaau

SEQ ID NO: 707638 - RNA, 15 nt, Haemophilus influenzae Rd
ggcgaaggcaaauca

SEQ ID NO: 707639 - RNA, 17 nt, Haemophilus influenzae Rd
ggcugauuccaaacugg

SEQ ID NO: 707640 - RNA, 20 nt, Haemophilus influenzae Rd
ggcugaaauucuaaaaaaau

SEQ ID NO: 707641 - RNA, 19 nt, Haemophilus influenzae Rd
ggcugaaagcgaaaucgca

SEQ ID NO: 707642 - RNA, 15 nt, Haemophilus influenzae Rd
ggcucgcucuucagc

SEQ ID NO: 707643 - RNA, 12 nt, Haemophilus influenzae Rd
ggcuccgccacc

SEQ ID NO: 707644 - RNA, 22 nt, Haemophilus influenzae Rd
ggcuauuucagcuugaagugug

SEQ ID NO: 707645 - RNA, 21 nt, Haemophilus influenzae Rd
ggcucauugugaucagagccu

SEQ ID NO: 707646 - RNA, 21 nt, Haemophilus influenzae Rd
ggcuuuuuuaauuacucacua

SEQ ID NO: 707647 - RNA, 11 nt, Haemophilus influenzae Rd
ggcuuuuugcu

SEQ ID NO: 707648 - RNA, 20 nt, Haemophilus influenzae Rd
ggcuuuaaagguuuaaaccu

SEQ ID NO: 707649 - RNA, 18 nt, Haemophilus influenzae Rd
ggcuuguugaaauuccuc

SEQ ID NO: 707650 - RNA, 20 nt, Haemophilus influenzae Rd
gggaaauauugcucucccuu

SEQ ID NO: 707651 - RNA, 17 nt, Haemophilus influenzae Rd
gggaaagucgcaguauu

SEQ ID NO: 707652 - RNA, 12 nt, Haemophilus influenzae Rd
gggaaauccagc

SEQ ID NO: 707653 - RNA, 14 nt, Haemophilus influenzae Rd
gggcaccauuuaaa

SEQ ID NO: 707654 - RNA, 19 nt, Haemophilus influenzae Rd
gggauaaggcagaaaugaa

SEQ ID NO: 707655 - RNA, 16 nt, Haemophilus influenzae Rd
gggaugaaaucaaaau

SEQ ID NO: 707656 - RNA, 22 nt, Haemophilus influenzae Rd
gggcguauuuuacggauuuaua

SEQ ID NO: 707657 - RNA, 20 nt, Haemophilus influenzae Rd
gggcuuuuuuuuauucagua

SEQ ID NO: 707658 - RNA, 15 nt, Haemophilus influenzae Rd
gggcuuuagcccacc

SEQ ID NO: 707659 - RNA, 14 nt, Haemophilus influenzae Rd
gggcuuguuuuuuc

SEQ ID NO: 707660 - RNA, 15 nt, Haemophilus influenzae Rd
gggcgaaguaaaaag

SEQ ID NO: 707661 - RNA, 18 nt, Haemophilus influenzae Rd
gguaaaauucuauuaaaa

SEQ ID NO: 707662 - RNA, 19 nt, Haemophilus influenzae Rd
gguaaaaauuaucaucauu

SEQ ID NO: 707663 - RNA, 16 nt, Haemophilus influenzae Rd
gguaaaaauucuuuuu

SEQ ID NO: 707664 - RNA, 22 nt, Haemophilus influenzae Rd
gguaaaaauucuuuuuucuucc

SEQ ID NO: 707665 - RNA, 12 nt, Haemophilus influenzae Rd
gguaaaaauuuc

SEQ ID NO: 707666 - RNA, 15 nt, Haemophilus influenzae Rd
gguaaauaaaaauga

SEQ ID NO: 707667 - RNA, 13 nt, Haemophilus influenzae Rd
gguaacaacugcu

SEQ ID NO: 707668 - RNA, 23 nt, Haemophilus influenzae Rd
gguaacauaaugauuucuaaacu

SEQ ID NO: 707669 - RNA, 18 nt, Haemophilus influenzae Rd
ggguuucggauaauaauu

SEQ ID NO: 707670 - RNA, 13 nt, Haemophilus influenzae Rd
ggguaguuuauaa

SEQ ID NO: 707671 - RNA, 20 nt, Haemophilus influenzae Rd
ggggacgcaccuuuugaaaa

SEQ ID NO: 707672 - RNA, 13 nt, Haemophilus influenzae Rd
ggguagaaauccc

SEQ ID NO: 707673 - RNA, 12 nt, Haemophilus influenzae Rd
gguaucuaaauu

SEQ ID NO: 707674 - RNA, 19 nt, Haemophilus influenzae Rd
gguauaaaccuugcauuuc

SEQ ID NO: 707675 - RNA, 11 nt, Haemophilus influenzae Rd
gguauacuuua

SEQ ID NO: 707676 - RNA, 17 nt, Haemophilus influenzae Rd
gguagcaauaaccaaua

SEQ ID NO: 707677 - RNA, 20 nt, Haemophilus influenzae Rd
gguagacacaagggauuuaa

SEQ ID NO: 707678 - RNA, 21 nt, Haemophilus influenzae Rd
gguaauuuaaggcuuuuucug

SEQ ID NO: 707679 - RNA, 19 nt, Haemophilus influenzae Rd
gguaauuuaauuaaucauu

SEQ ID NO: 707680 - RNA, 18 nt, Haemophilus influenzae Rd
gguaauuauagagaaaua

SEQ ID NO: 707681 - RNA, 22 nt, Haemophilus influenzae Rd
gguaauugcccaauaaaaguaa

SEQ ID NO: 707682 - RNA, 18 nt, Haemophilus influenzae Rd
gguaauguuaucgacuuc

SEQ ID NO: 707683 - RNA, 14 nt, Haemophilus influenzae Rd
gguaauaaaucaaa

SEQ ID NO: 707684 - RNA, 20 nt, Haemophilus influenzae Rd
ggucuguugcaaauuuuuca

SEQ ID NO: 707685 - RNA, 10 nt, Haemophilus influenzae Rd
ggugaaauuu

SEQ ID NO: 707686 - RNA, 18 nt, Haemophilus influenzae Rd
ggucgauucugucgcaga

SEQ ID NO: 707687 - RNA, 15 nt, Haemophilus influenzae Rd
ggugucguagaaaua

SEQ ID NO: 707688 - RNA, 14 nt, Haemophilus influenzae Rd
ggugguggaauaaa

SEQ ID NO: 707689 - RNA, 16 nt, Haemophilus influenzae Rd
ggugcuacuugagcuu

SEQ ID NO: 707690 - RNA, 12 nt, Haemophilus influenzae Rd
ggugcuauuuua

SEQ ID NO: 707691 - RNA, 15 nt, Haemophilus influenzae Rd
ggugcuuuuaaauuu

SEQ ID NO: 707692 - RNA, 18 nt, Haemophilus influenzae Rd
guaagcgguaacgacaaa

SEQ ID NO: 707693 - RNA, 23 nt, Haemophilus influenzae Rd
guaagcauuaaaaauuuaaaagc

SEQ ID NO: 707694 - RNA, 20 nt, Haemophilus influenzae Rd
guaaggcgagauuaaagcgu

SEQ ID NO: 707695 - RNA, 14 nt, Haemophilus influenzae Rd
guaaguaaugaaaa

SEQ ID NO: 707696 - RNA, 13 nt, Haemophilus influenzae Rd
guaagguaauguu

SEQ ID NO: 707697 - RNA, 17 nt, Haemophilus influenzae Rd
guaauagccauuuugga

SEQ ID NO: 707698 - RNA, 16 nt, Haemophilus influenzae Rd
guaauagcuucuuuua

SEQ ID NO: 707699 - RNA, 13 nt, Haemophilus influenzae Rd
guaauauauucua

SEQ ID NO: 707700 - RNA, 13 nt, Haemophilus influenzae Rd
guaauauguaaua

SEQ ID NO: 707701 - RNA, 15 nt, Haemophilus influenzae Rd
guaauauguaauauu

SEQ ID NO: 707702 - RNA, 22 nt, Haemophilus influenzae Rd
guaauauuuucccucuuuaucu

SEQ ID NO: 707703 - RNA, 14 nt, Haemophilus influenzae Rd
guaauaaaaaauac

SEQ ID NO: 707704 - RNA, 13 nt, Haemophilus influenzae Rd
guaauaaauaagg

SEQ ID NO: 707705 - RNA, 13 nt, Haemophilus influenzae Rd
guaauaaaucaaa

SEQ ID NO: 707706 - RNA, 12 nt, Haemophilus influenzae Rd
guaauaaauccu

SEQ ID NO: 707707 - RNA, 20 nt, Haemophilus influenzae Rd
guaauaaauucaaaaaaugu

SEQ ID NO: 707708 - RNA, 18 nt, Haemophilus influenzae Rd
guaagucgugaucugcau

SEQ ID NO: 707709 - RNA, 22 nt, Haemophilus influenzae Rd
guaaguuaaaccaacaacugca

SEQ ID NO: 707710 - RNA, 11 nt, Haemophilus influenzae Rd
guaaccaaaga

SEQ ID NO: 707711 - RNA, 13 nt, Haemophilus influenzae Rd
guaacccaaagca

SEQ ID NO: 707712 - RNA, 18 nt, Haemophilus influenzae Rd
guaacuucugcugcacga

SEQ ID NO: 707713 - RNA, 13 nt, Haemophilus influenzae Rd
guaacugauuuug

SEQ ID NO: 707714 - RNA, 22 nt, Haemophilus influenzae Rd
guaacguugcucuuucaaguuu

SEQ ID NO: 707715 - RNA, 12 nt, Haemophilus influenzae Rd
guaacuaaaaaa

SEQ ID NO: 707716 - RNA, 18 nt, Haemophilus influenzae Rd
guaagcaauuuucugcag

SEQ ID NO: 707717 - RNA, 19 nt, Haemophilus influenzae Rd
guaagcaauuuucugcaga

SEQ ID NO: 707718 - RNA, 12 nt, Haemophilus influenzae Rd
guaagaaauaac

SEQ ID NO: 707719 - RNA, 19 nt, Haemophilus influenzae Rd
guaaacuuuccucaaguuu

SEQ ID NO: 707720 - RNA, 19 nt, Haemophilus influenzae Rd
guaaacugcuuucaaaagg

SEQ ID NO: 707721 - RNA, 13 nt, Haemophilus influenzae Rd
guaaagauugucc

SEQ ID NO: 707722 - RNA, 22 nt, Haemophilus influenzae Rd
guaaagauuguccuuuugccau

SEQ ID NO: 707723 - RNA, 16 nt, Haemophilus influenzae Rd
guaaagcaccauaaug

SEQ ID NO: 707724 - RNA, 22 nt, Haemophilus influenzae Rd
guaaacccacaacuuuuucauc

SEQ ID NO: 707725 - RNA, 13 nt, Haemophilus influenzae Rd
guaaacccuuuag

SEQ ID NO: 707726 - RNA, 22 nt, Haemophilus influenzae Rd
guaaaccaaauuucuugcuauc

SEQ ID NO: 707727 - RNA, 18 nt, Haemophilus influenzae Rd
guaaaccaagugaaauuc

SEQ ID NO: 707728 - RNA, 16 nt, Haemophilus influenzae Rd
guaaaagugcgguuga

SEQ ID NO: 707729 - RNA, 18 nt, Haemophilus influenzae Rd
gguuaaaauauuccuucg

SEQ ID NO: 707730 - RNA, 11 nt, Haemophilus influenzae Rd
gguuaaagaag

SEQ ID NO: 707731 - RNA, 16 nt, Haemophilus influenzae Rd
gguuaaagaagcaugu

SEQ ID NO: 707732 - RNA, 13 nt, Haemophilus influenzae Rd
gguuaaaauaaaa

SEQ ID NO: 707733 - RNA, 13 nt, Haemophilus influenzae Rd
gguuaaaaauagc

SEQ ID NO: 707734 - RNA, 22 nt, Haemophilus influenzae Rd
guaaaauaaugcaaaaacaagu

SEQ ID NO: 707735 - RNA, 13 nt, Haemophilus influenzae Rd
guaaaauauuaag

SEQ ID NO: 707736 - RNA, 14 nt, Haemophilus influenzae Rd
guaaacaauucuau

SEQ ID NO: 707737 - RNA, 21 nt, Haemophilus influenzae Rd
guaaacaauuuuccugcuuga

SEQ ID NO: 707738 - RNA, 17 nt, Haemophilus influenzae Rd
guaaaauucuauuaaaa

SEQ ID NO: 707739 - RNA, 20 nt, Haemophilus influenzae Rd
guaaaauucuauuaaaauau

SEQ ID NO: 707740 - RNA, 23 nt, Haemophilus influenzae Rd
guaaaauuuuuagugauuuuaaa

SEQ ID NO: 707741 - RNA, 16 nt, Haemophilus influenzae Rd
guaaaauuuuucucac

SEQ ID NO: 707742 - RNA, 12 nt, Haemophilus influenzae Rd
guaaauuuucag

SEQ ID NO: 707743 - RNA, 23 nt, Haemophilus influenzae Rd
guaaauuuucagcguuuucaacu

SEQ ID NO: 707744 - RNA, 19 nt, Haemophilus influenzae Rd
guaaauuuuuccacauuaa

SEQ ID NO: 707745 - RNA, 11 nt, Haemophilus influenzae Rd
guaacaacugc

SEQ ID NO: 707746 - RNA, 12 nt, Haemophilus influenzae Rd
guaacaacugcu

SEQ ID NO: 707747 - RNA, 14 nt, Haemophilus influenzae Rd
guaaauugguuuua

SEQ ID NO: 707748 - RNA, 21 nt, Haemophilus influenzae Rd
guaaauugguuuuauccugua

SEQ ID NO: 707749 - RNA, 13 nt, Haemophilus influenzae Rd
guaaauuuuaaaa

SEQ ID NO: 707750 - RNA, 22 nt, Haemophilus influenzae Rd
guaaauuuuaaccgcacuuuau

SEQ ID NO: 707751 - RNA, 21 nt, Haemophilus influenzae Rd
guaaauucucgguuguuucau

SEQ ID NO: 707752 - RNA, 19 nt, Haemophilus influenzae Rd
guaaauucuguuuagucuu

SEQ ID NO: 707753 - RNA, 14 nt, Haemophilus influenzae Rd
guaaauuaugccca

SEQ ID NO: 707754 - RNA, 22 nt, Haemophilus influenzae Rd
guaaagcgaguaagggcaaaaa

SEQ ID NO: 707755 - RNA, 20 nt, Haemophilus influenzae Rd
guaaauaauccagauaacaa

SEQ ID NO: 707756 - RNA, 12 nt, Haemophilus influenzae Rd
guaaauacuguu

SEQ ID NO: 707757 - RNA, 13 nt, Haemophilus influenzae Rd
guaaauaagccau

SEQ ID NO: 707758 - RNA, 21 nt, Haemophilus influenzae Rd
guaaauaugccuuauauuuca

SEQ ID NO: 707759 - RNA, 17 nt, Haemophilus influenzae Rd
guaaauaguuauuuauu

SEQ ID NO: 707760 - RNA, 16 nt, Haemophilus influenzae Rd
guaaaucugauucaga

SEQ ID NO: 707761 - RNA, 14 nt, Haemophilus influenzae Rd
guaaauauuuuuua

SEQ ID NO: 707762 - RNA, 16 nt, Haemophilus influenzae Rd
guaccauugugccaaa

SEQ ID NO: 707763 - RNA, 20 nt, Haemophilus influenzae Rd
guaccauugugccaaauuca

SEQ ID NO: 707764 - RNA, 14 nt, Haemophilus influenzae Rd
guaauuaaaaauaa

SEQ ID NO: 707765 - RNA, 22 nt, Haemophilus influenzae Rd
guaauguuuaaaguaagaauua

SEQ ID NO: 707766 - RNA, 17 nt, Haemophilus influenzae Rd
guaaucguagaaaucaa

SEQ ID NO: 707767 - RNA, 18 nt, Haemophilus influenzae Rd
guaaucuaauucuugccc

SEQ ID NO: 707768 - RNA, 17 nt, Haemophilus influenzae Rd
guaaugcuuuauuuaaa

SEQ ID NO: 707769 - RNA, 21 nt, Haemophilus influenzae Rd
guaaucgcucugcaagacuau

SEQ ID NO: 707770 - RNA, 17 nt, Haemophilus influenzae Rd
guacuguggauaauuca

SEQ ID NO: 707771 - RNA, 19 nt, Haemophilus influenzae Rd
guacuucacaguaaagauu

SEQ ID NO: 707772 - RNA, 17 nt, Haemophilus influenzae Rd
guacgucuuuuggcguu

SEQ ID NO: 707773 - RNA, 15 nt, Haemophilus influenzae Rd
guacuaauuguugua

SEQ ID NO: 707774 - RNA, 21 nt, Haemophilus influenzae Rd
guacuaauuguuguaaaauag

SEQ ID NO: 707775 - RNA, 15 nt, Haemophilus influenzae Rd
guagcgcacugccgc

SEQ ID NO: 707776 - RNA, 22 nt, Haemophilus influenzae Rd
guagccuuuaugacuauuuuuu

SEQ ID NO: 707777 - RNA, 18 nt, Haemophilus influenzae Rd
guagauaaaauauucaaa

SEQ ID NO: 707778 - RNA, 22 nt, Haemophilus influenzae Rd
guagauaaaauauucaaacagg

SEQ ID NO: 707779 - RNA, 20 nt, Haemophilus influenzae Rd
guagcugaaacuaaaagggu

SEQ ID NO: 707780 - RNA, 12 nt, Haemophilus influenzae Rd
guauaacaaaua

SEQ ID NO: 707781 - RNA, 17 nt, Haemophilus influenzae Rd
guauaaaccuugcauuu

SEQ ID NO: 707782 - RNA, 16 nt, Haemophilus influenzae Rd
guauaaagcauaauau

SEQ ID NO: 707783 - RNA, 17 nt, Haemophilus influenzae Rd
guaguuuucaauaucaa

SEQ ID NO: 707784 - RNA, 22 nt, Haemophilus influenzae Rd
guaguuuucuguauaccaacca

SEQ ID NO: 707785 - RNA, 13 nt, Haemophilus influenzae Rd
guaguuaaaccaa

SEQ ID NO: 707786 - RNA, 15 nt, Haemophilus influenzae Rd
guaguacaucauuug

SEQ ID NO: 707787 - RNA, 16 nt, Haemophilus influenzae Rd
guaguagcguaaauca

SEQ ID NO: 707788 - RNA, 16 nt, Haemophilus influenzae Rd
guaguaaauuuuccaa

SEQ ID NO: 707789 - RNA, 23 nt, Haemophilus influenzae Rd
gucaauguuauugccuaauaaaa

SEQ ID NO: 707790 - RNA, 17 nt, Haemophilus influenzae Rd
gucaagaucggaauauu

SEQ ID NO: 707791 - RNA, 12 nt, Haemophilus influenzae Rd
guauuuuuuaau

SEQ ID NO: 707792 - RNA, 19 nt, Haemophilus influenzae Rd
guauuuuucauaucuuccg

SEQ ID NO: 707793 - RNA, 12 nt, Haemophilus influenzae Rd
guauuuuuauuu

SEQ ID NO: 707794 - RNA, 18 nt, Haemophilus influenzae Rd
guauuuuuauuuauagca

SEQ ID NO: 707795 - RNA, 15 nt, Haemophilus influenzae Rd
gucaaaagaaagacu

SEQ ID NO: 707796 - RNA, 21 nt, Haemophilus influenzae Rd
guauuuuugucccaaaauauu

SEQ ID NO: 707797 - RNA, 12 nt, Haemophilus influenzae Rd
guauuuuuuagu

SEQ ID NO: 707798 - RNA, 17 nt, Haemophilus influenzae Rd
guauuuuuuaguuaaau

SEQ ID NO: 707799 - RNA, 14 nt, Haemophilus influenzae Rd
guauuuuuuuauuu

SEQ ID NO: 707800 - RNA, 17 nt, Haemophilus influenzae Rd
guauaauuccuaaaaua

SEQ ID NO: 707801 - RNA, 14 nt, Haemophilus influenzae Rd
gucagauuuauaaa

SEQ ID NO: 707802 - RNA, 22 nt, Haemophilus influenzae Rd
gucagauuuauaaauaggcuca

SEQ ID NO: 707803 - RNA, 23 nt, Haemophilus influenzae Rd
gucagcaaauuaucugauguuua

SEQ ID NO: 707804 - RNA, 20 nt, Haemophilus influenzae Rd
gucacuucuucaauacguuu

SEQ ID NO: 707805 - RNA, 16 nt, Haemophilus influenzae Rd
gucacgcuguaaacaa

SEQ ID NO: 707806 - RNA, 22 nt, Haemophilus influenzae Rd
gucacgcuguaaacaagauucu

SEQ ID NO: 707807 - RNA, 17 nt, Haemophilus influenzae Rd
gucaauuagcaaagaau

SEQ ID NO: 707808 - RNA, 19 nt, Haemophilus influenzae Rd
gucaauugcuaaaccugca

SEQ ID NO: 707809 - RNA, 16 nt, Haemophilus influenzae Rd
gucaauuucaaccgca

SEQ ID NO: 707810 - RNA, 21 nt, Haemophilus influenzae Rd
gucagcauaaacaaaauaaac

SEQ ID NO: 707811 - RNA, 19 nt, Haemophilus influenzae Rd
gucaguaaaccaagugaaa

SEQ ID NO: 707812 - RNA, 13 nt, Haemophilus influenzae Rd
gucaucuaauugu

SEQ ID NO: 707813 - RNA, 22 nt, Haemophilus influenzae Rd
gucaucuaguaccugauuugua

SEQ ID NO: 707814 - RNA, 13 nt, Haemophilus influenzae Rd
gucauuaaugcau

SEQ ID NO: 707815 - RNA, 13 nt, Haemophilus influenzae Rd
gucauuaaaaaau

SEQ ID NO: 707816 - RNA, 15 nt, Haemophilus influenzae Rd
gucauuaaaaaauaa

SEQ ID NO: 707817 - RNA, 15 nt, Haemophilus influenzae Rd
guccgccauuuuuaa

SEQ ID NO: 707818 - RNA, 20 nt, Haemophilus influenzae Rd
gucccgcauauaaaauaaag

SEQ ID NO: 707819 - RNA, 19 nt, Haemophilus influenzae Rd
guccugcagccgccaugga

SEQ ID NO: 707820 - RNA, 16 nt, Haemophilus influenzae Rd
gucauugccauuucug

SEQ ID NO: 707821 - RNA, 17 nt, Haemophilus influenzae Rd
gucauugccauuucugc

SEQ ID NO: 707822 - RNA, 14 nt, Haemophilus influenzae Rd
gucauuuaauucug

SEQ ID NO: 707823 - RNA, 21 nt, Haemophilus influenzae Rd
gucauucaaugcagaaauacu

SEQ ID NO: 707824 - RNA, 13 nt, Haemophilus influenzae Rd
guccaaaaucucu

SEQ ID NO: 707825 - RNA, 19 nt, Haemophilus influenzae Rd
gucauuuuuguuucaguuu

SEQ ID NO: 707826 - RNA, 11 nt, Haemophilus influenzae Rd
guccuugauuu

SEQ ID NO: 707827 - RNA, 18 nt, Haemophilus influenzae Rd
gucgagggucaaaagaaa

SEQ ID NO: 707828 - RNA, 15 nt, Haemophilus influenzae Rd
gucgauucaaauaac

SEQ ID NO: 707829 - RNA, 21 nt, Haemophilus influenzae Rd
gucgcacguuuacuuuuucca

SEQ ID NO: 707830 - RNA, 20 nt, Haemophilus influenzae Rd
gucgcaccaccuuuauuaaa

SEQ ID NO: 707831 - RNA, 20 nt, Haemophilus influenzae Rd
gucgcaucaacaacuaaaua

SEQ ID NO: 707832 - RNA, 19 nt, Haemophilus influenzae Rd
gugcagauuuuuuuauaaa

SEQ ID NO: 707833 - RNA, 17 nt, Haemophilus influenzae Rd
gugcagcccaaauaaag

SEQ ID NO: 707834 - RNA, 21 nt, Haemophilus influenzae Rd
gugcauguuuacuuaaaucuu

SEQ ID NO: 707835 - RNA, 20 nt, Haemophilus influenzae Rd
gugcaauaacaagcacaaga

SEQ ID NO: 707836 - RNA, 20 nt, Haemophilus influenzae Rd
gugcaaucagcaacauuauu

SEQ ID NO: 707837 - RNA, 13 nt, Haemophilus influenzae Rd
gugcaauuugaaa

SEQ ID NO: 707838 - RNA, 14 nt, Haemophilus influenzae Rd
gugauuuaccaaua

SEQ ID NO: 707839 - RNA, 13 nt, Haemophilus influenzae Rd
gugauuucaauuc

SEQ ID NO: 707840 - RNA, 16 nt, Haemophilus influenzae Rd
gugcaacgugugccag

SEQ ID NO: 707841 - RNA, 17 nt, Haemophilus influenzae Rd
gugcaacuaugguaaaa

SEQ ID NO: 707842 - RNA, 22 nt, Haemophilus influenzae Rd
gugauugugguauugauucaau

SEQ ID NO: 707843 - RNA, 19 nt, Haemophilus influenzae Rd
gucgcuucuaauucugcac

SEQ ID NO: 707844 - RNA, 20 nt, Haemophilus influenzae Rd
gucgcuucuaauucugcacg

SEQ ID NO: 707845 - RNA, 14 nt, Haemophilus influenzae Rd
gugaugaaacaauc

SEQ ID NO: 707846 - RNA, 18 nt, Haemophilus influenzae Rd
gugaugaguucugucacu

SEQ ID NO: 707847 - RNA, 14 nt, Haemophilus influenzae Rd
gugcucgauuuuua

SEQ ID NO: 707848 - RNA, 15 nt, Haemophilus influenzae Rd
gugcucgauuuuuaa

SEQ ID NO: 707849 - RNA, 19 nt, Haemophilus influenzae Rd
gugcuauagcuugcagauu

SEQ ID NO: 707850 - RNA, 17 nt, Haemophilus influenzae Rd
gugcuauacaaaauuuu

SEQ ID NO: 707851 - RNA, 22 nt, Haemophilus influenzae Rd
gugcuaaaauaaaaccuucugg

SEQ ID NO: 707852 - RNA, 18 nt, Haemophilus influenzae Rd
gugcuaaauuuuuuugca

SEQ ID NO: 707853 - RNA, 20 nt, Haemophilus influenzae Rd
gugcgguuaaaaaagaaaua

SEQ ID NO: 707854 - RNA, 18 nt, Haemophilus influenzae Rd
gugcgguuaaaaauucuu

SEQ ID NO: 707855 - RNA, 12 nt, Haemophilus influenzae Rd
gugcgguuaguu

SEQ ID NO: 707856 - RNA, 12 nt, Haemophilus influenzae Rd
gugcgguugaaa

SEQ ID NO: 707857 - RNA, 15 nt, Haemophilus influenzae Rd
gugcgguaaaauuuc

SEQ ID NO: 707858 - RNA, 14 nt, Haemophilus influenzae Rd
gugcggagaaaauu

SEQ ID NO: 707859 - RNA, 22 nt, Haemophilus influenzae Rd
gugcgcguaccaaauuccauuc

SEQ ID NO: 707860 - RNA, 18 nt, Haemophilus influenzae Rd
gugcggaaauauuuuaau

SEQ ID NO: 707861 - RNA, 13 nt, Haemophilus influenzae Rd
gugcggcaaaaaa

SEQ ID NO: 707862 - RNA, 23 nt, Haemophilus influenzae Rd
gugcgccauuuuuaaaacggcuc

SEQ ID NO: 707863 - RNA, 22 nt, Haemophilus influenzae Rd
guggaugaccaacaccauucca

SEQ ID NO: 707864 - RNA, 19 nt, Haemophilus influenzae Rd
gugcuuaacugaaaauuca

SEQ ID NO: 707865 - RNA, 23 nt, Haemophilus influenzae Rd
guggcaauaguuggguaaucaaa

SEQ ID NO: 707866 - RNA, 14 nt, Haemophilus influenzae Rd
guggauugauaauu

SEQ ID NO: 707867 - RNA, 18 nt, Haemophilus influenzae Rd
guggcuuuucugauaauu

SEQ ID NO: 707868 - RNA, 19 nt, Haemophilus influenzae Rd
guggcuuuucugauaauuu

SEQ ID NO: 707869 - RNA, 21 nt, Haemophilus influenzae Rd
gugguaaauaauuuucaguga

SEQ ID NO: 707870 - RNA, 21 nt, Haemophilus influenzae Rd
guggguaaaccaaacgagaaa

SEQ ID NO: 707871 - RNA, 19 nt, Haemophilus influenzae Rd
guggggaaaaauauuaaag

SEQ ID NO: 707872 - RNA, 14 nt, Haemophilus influenzae Rd
guggugcaaccugu

SEQ ID NO: 707873 - RNA, 16 nt, Haemophilus influenzae Rd
gugguggaauaaauaa

SEQ ID NO: 707874 - RNA, 15 nt, Haemophilus influenzae Rd
gugugauguauuuuc

SEQ ID NO: 707875 - RNA, 21 nt, Haemophilus influenzae Rd
gugugcacccgccgcaccuaa

SEQ ID NO: 707876 - RNA, 23 nt, Haemophilus influenzae Rd
guguuaaacgacgcauuccuucg

SEQ ID NO: 707877 - RNA, 14 nt, Haemophilus influenzae Rd
guguuucagcuucg

SEQ ID NO: 707878 - RNA, 18 nt, Haemophilus influenzae Rd
guuaaaauacgcucaaaa

SEQ ID NO: 707879 - RNA, 19 nt, Haemophilus influenzae Rd
guuaaagugcgguagaaau

SEQ ID NO: 707880 - RNA, 15 nt, Haemophilus influenzae Rd
guuaaaguuucuguu

SEQ ID NO: 707881 - RNA, 19 nt, Haemophilus influenzae Rd
guuaaacagcuuuccugua

SEQ ID NO: 707882 - RNA, 15 nt, Haemophilus influenzae Rd
guuaaaccaaauaau

SEQ ID NO: 707883 - RNA, 16 nt, Haemophilus influenzae Rd
guuaaacccuguuuua

SEQ ID NO: 707884 - RNA, 14 nt, Haemophilus influenzae Rd
guuaaaccuaaauc

SEQ ID NO: 707885 - RNA, 21 nt, Haemophilus influenzae Rd
guuaaacugccgccuucuucc

SEQ ID NO: 707886 - RNA, 14 nt, Haemophilus influenzae Rd
guuaauaaccaaga

SEQ ID NO: 707887 - RNA, 16 nt, Haemophilus influenzae Rd
guuaagucauuugagc

SEQ ID NO: 707888 - RNA, 18 nt, Haemophilus influenzae Rd
guuaaguucagaaagaga

SEQ ID NO: 707889 - RNA, 17 nt, Haemophilus influenzae Rd
guuaaguucaucauaaa

SEQ ID NO: 707890 - RNA, 12 nt, Haemophilus influenzae Rd
guuaaauaaugc

SEQ ID NO: 707891 - RNA, 13 nt, Haemophilus influenzae Rd
guuaaauaaugcc

SEQ ID NO: 707892 - RNA, 22 nt, Haemophilus influenzae Rd
guuaauaaaccuuuuucuaaca

SEQ ID NO: 707893 - RNA, 21 nt, Haemophilus influenzae Rd
guuaauaaugcuaauuucaaa

SEQ ID NO: 707894 - RNA, 14 nt, Haemophilus influenzae Rd
guuaauagcgucua

SEQ ID NO: 707895 - RNA, 18 nt, Haemophilus influenzae Rd
guuaauaggcaauguucc

SEQ ID NO: 707896 - RNA, 17 nt, Haemophilus influenzae Rd
guuaauauauucaauuc

SEQ ID NO: 707897 - RNA, 11 nt, Haemophilus influenzae Rd
guuaauuucug

SEQ ID NO: 707898 - RNA, 16 nt, Haemophilus influenzae Rd
guuaauuaauugcucu

SEQ ID NO: 707899 - RNA, 18 nt, Haemophilus influenzae Rd
guuaauuaccacaugcau

SEQ ID NO: 707900 - RNA, 17 nt, Haemophilus influenzae Rd
guuaauuaucaaaaaga

SEQ ID NO: 707901 - RNA, 13 nt, Haemophilus influenzae Rd
guuaauugauuua

SEQ ID NO: 707902 - RNA, 21 nt, Haemophilus influenzae Rd
guuaauugugcggauuuaucu

SEQ ID NO: 707903 - RNA, 14 nt, Haemophilus influenzae Rd
guuacgaacuucag

SEQ ID NO: 707904 - RNA, 16 nt, Haemophilus influenzae Rd
guuacagcugcauaaa

SEQ ID NO: 707905 - RNA, 13 nt, Haemophilus influenzae Rd
guuacaacguguu

SEQ ID NO: 707906 - RNA, 13 nt, Haemophilus influenzae Rd
guuacuaaaauaa

SEQ ID NO: 707907 - RNA, 13 nt, Haemophilus influenzae Rd
guuacggcuaaau

SEQ ID NO: 707908 - RNA, 16 nt, Haemophilus influenzae Rd
guuacuuaauuuugcu

SEQ ID NO: 707909 - RNA, 15 nt, Haemophilus influenzae Rd
guuccacgagaaaag

SEQ ID NO: 707910 - RNA, 18 nt, Haemophilus influenzae Rd
guuccaauaggaaacuac

SEQ ID NO: 707911 - RNA, 23 nt, Haemophilus influenzae Rd
guuccaauaggaaacuacuuucu

SEQ ID NO: 707912 - RNA, 15 nt, Haemophilus influenzae Rd
guuccccuaaaaaau

SEQ ID NO: 707913 - RNA, 17 nt, Haemophilus influenzae Rd
guuccguucuaaagauu

SEQ ID NO: 707914 - RNA, 13 nt, Haemophilus influenzae Rd
guucgcaaauaac

SEQ ID NO: 707915 - RNA, 12 nt, Haemophilus influenzae Rd
guucgcaaugaa

SEQ ID NO: 707916 - RNA, 18 nt, Haemophilus influenzae Rd
guucgauaacaauuuuug

SEQ ID NO: 707917 - RNA, 15 nt, Haemophilus influenzae Rd
guucagcgauuuuaa

SEQ ID NO: 707918 - RNA, 15 nt, Haemophilus influenzae Rd
guucagcaacaucau

SEQ ID NO: 707919 - RNA, 15 nt, Haemophilus influenzae Rd
guuacuuauuuagca

SEQ ID NO: 707920 - RNA, 14 nt, Haemophilus influenzae Rd
guuagaauguagcu

SEQ ID NO: 707921 - RNA, 13 nt, Haemophilus influenzae Rd
guuacuucuuuca

SEQ ID NO: 707922 - RNA, 15 nt, Haemophilus influenzae Rd
guucacguuuuucau

SEQ ID NO: 707923 - RNA, 14 nt, Haemophilus influenzae Rd
guucauauuugaag

SEQ ID NO: 707924 - RNA, 12 nt, Haemophilus influenzae Rd
guucauuuguug

SEQ ID NO: 707925 - RNA, 12 nt, Haemophilus influenzae Rd
guucauuauuaa

SEQ ID NO: 707926 - RNA, 12 nt, Haemophilus influenzae Rd
guucuuccccuc

SEQ ID NO: 707927 - RNA, 21 nt, Haemophilus influenzae Rd
guucuucugcggucaucucuu

SEQ ID NO: 707928 - RNA, 12 nt, Haemophilus influenzae Rd
guucuucuggga

SEQ ID NO: 707929 - RNA, 20 nt, Haemophilus influenzae Rd
guucuucugggauuggcuug

SEQ ID NO: 707930 - RNA, 16 nt, Haemophilus influenzae Rd
guucuugaugauaauc

SEQ ID NO: 707931 - RNA, 21 nt, Haemophilus influenzae Rd
guucuuguuuuaaaucuucua

SEQ ID NO: 707932 - RNA, 23 nt, Haemophilus influenzae Rd
guucuuguaagccaaauaaugca

SEQ ID NO: 707933 - RNA, 21 nt, Haemophilus influenzae Rd
guucuuccgucaauaucccaa

SEQ ID NO: 707934 - RNA, 17 nt, Haemophilus influenzae Rd
guucuacuuguucaaaa

SEQ ID NO: 707935 - RNA, 11 nt, Haemophilus influenzae Rd
guucuacuuuu

SEQ ID NO: 707936 - RNA, 17 nt, Haemophilus influenzae Rd
guucuacaccuucccaa

SEQ ID NO: 707937 - RNA, 13 nt, Haemophilus influenzae Rd
guucuaauugcug

SEQ ID NO: 707938 - RNA, 13 nt, Haemophilus influenzae Rd
guucuaaauaaac

SEQ ID NO: 707939 - RNA, 23 nt, Haemophilus influenzae Rd
guugaaacuguuuuggcauuuuc

SEQ ID NO: 707940 - RNA, 10 nt, Haemophilus influenzae Rd
guucuuucug

SEQ ID NO: 707941 - RNA, 13 nt, Haemophilus influenzae Rd
guucuuucuguca

SEQ ID NO: 707942 - RNA, 13 nt, Haemophilus influenzae Rd
guugaaaauaaau

SEQ ID NO: 707943 - RNA, 23 nt, Haemophilus influenzae Rd
guugaauuuucaaugguuuauaa

SEQ ID NO: 707944 - RNA, 14 nt, Haemophilus influenzae Rd
guugaaucgcacuu

SEQ ID NO: 707945 - RNA, 15 nt, Haemophilus influenzae Rd
guugaucagcaauca

SEQ ID NO: 707946 - RNA, 17 nt, Haemophilus influenzae Rd
guugaucgcaauguuca

SEQ ID NO: 707947 - RNA, 19 nt, Haemophilus influenzae Rd
guugauacggcaaacuaaa

SEQ ID NO: 707948 - RNA, 19 nt, Haemophilus influenzae Rd
guugauauucaauuuaucg

SEQ ID NO: 707949 - RNA, 19 nt, Haemophilus influenzae Rd
guugagcgagguaagcuga

SEQ ID NO: 707950 - RNA, 20 nt, Haemophilus influenzae Rd
guugagcauaacguauuuuc

SEQ ID NO: 707951 - RNA, 20 nt, Haemophilus influenzae Rd
guugcacccacuaaaauuug

SEQ ID NO: 707952 - RNA, 13 nt, Haemophilus influenzae Rd
guugcauaaaauc

SEQ ID NO: 707953 - RNA, 15 nt, Haemophilus influenzae Rd
guugcagauuuaccc

SEQ ID NO: 707954 - RNA, 23 nt, Haemophilus influenzae Rd
guugauuuuaaaauaucaaaguu

SEQ ID NO: 707955 - RNA, 14 nt, Haemophilus influenzae Rd
guugauuuuugacg

SEQ ID NO: 707956 - RNA, 20 nt, Haemophilus influenzae Rd
guugcgguaaaucuacuuua

SEQ ID NO: 707957 - RNA, 22 nt, Haemophilus influenzae Rd
guugcucagccaguuuucuagc

SEQ ID NO: 707958 - RNA, 23 nt, Haemophilus influenzae Rd
guugcucugcguucaagccuuug

SEQ ID NO: 707959 - RNA, 21 nt, Haemophilus influenzae Rd
guugcgauuuccacuuuuuca

SEQ ID NO: 707960 - RNA, 15 nt, Haemophilus influenzae Rd
guugccccaucauuu

SEQ ID NO: 707961 - RNA, 14 nt, Haemophilus influenzae Rd
guugccauaaaaaa

SEQ ID NO: 707962 - RNA, 15 nt, Haemophilus influenzae Rd
guugccauaaauuug

SEQ ID NO: 707963 - RNA, 18 nt, Haemophilus influenzae Rd
guugccauaaauuuggau

SEQ ID NO: 707964 - RNA, 18 nt, Haemophilus influenzae Rd
guugcauuagaaaucaac

SEQ ID NO: 707965 - RNA, 17 nt, Haemophilus influenzae Rd
guugccgccaauccagc

SEQ ID NO: 707966 - RNA, 22 nt, Haemophilus influenzae Rd
guugcccuagugcaaccacaca

SEQ ID NO: 707967 - RNA, 13 nt, Haemophilus influenzae Rd
guugcuucaauug

SEQ ID NO: 707968 - RNA, 21 nt, Haemophilus influenzae Rd
guugcugaauauccagugcca

SEQ ID NO: 707969 - RNA, 14 nt, Haemophilus influenzae Rd
guugcuuugccaau

SEQ ID NO: 707970 - RNA, 16 nt, Haemophilus influenzae Rd
guuggaagaauguuuu

SEQ ID NO: 707971 - RNA, 19 nt, Haemophilus influenzae Rd
guuggaucacaaacaauau

SEQ ID NO: 707972 - RNA, 23 nt, Haemophilus influenzae Rd
guugguaaagccaacuuuuucua

SEQ ID NO: 707973 - RNA, 21 nt, Haemophilus influenzae Rd
guuggcggaauuauguauuuu

SEQ ID NO: 707974 - RNA, 16 nt, Haemophilus influenzae Rd
guugggacugccacgg

SEQ ID NO: 707975 - RNA, 17 nt, Haemophilus influenzae Rd
guuggcuuccagaaaau

SEQ ID NO: 707976 - RNA, 16 nt, Haemophilus influenzae Rd
guuucgauacuuucuu

SEQ ID NO: 707977 - RNA, 18 nt, Haemophilus influenzae Rd
guuuaucguauucccaaa

SEQ ID NO: 707978 - RNA, 18 nt, Haemophilus influenzae Rd
guuuaucuaccacaucaa

SEQ ID NO: 707979 - RNA, 17 nt, Haemophilus influenzae Rd
guuucgccagcaccacg

SEQ ID NO: 707980 - RNA, 16 nt, Haemophilus influenzae Rd
guuucgcauaaaaauu

SEQ ID NO: 707981 - RNA, 19 nt, Haemophilus influenzae Rd
guuucuacucguagaguuu

SEQ ID NO: 707982 - RNA, 16 nt, Haemophilus influenzae Rd
guuugagcaaaucaaa

SEQ ID NO: 707983 - RNA, 14 nt, Haemophilus influenzae Rd
guuugaaggcaaaa

SEQ ID NO: 707984 - RNA, 21 nt, Haemophilus influenzae Rd
guuugacagcaauauauaaau

SEQ ID NO: 707985 - RNA, 20 nt, Haemophilus influenzae Rd
guuucuuuuaucgagaaaau

SEQ ID NO: 707986 - RNA, 22 nt, Haemophilus influenzae Rd
guuugaaaagaaauauauuauu

SEQ ID NO: 707987 - RNA, 23 nt, Haemophilus influenzae Rd
guuuaaccacguauuuuuuaaua

SEQ ID NO: 707988 - RNA, 13 nt, Haemophilus influenzae Rd
guuuaauuucauc

SEQ ID NO: 707989 - RNA, 22 nt, Haemophilus influenzae Rd
guuuaaagagaucacuguaaau

SEQ ID NO: 707990 - RNA, 12 nt, Haemophilus influenzae Rd
guuuaaauuuua

SEQ ID NO: 707991 - RNA, 15 nt, Haemophilus influenzae Rd
guuuaaauuuuaaaa

SEQ ID NO: 707992 - RNA, 19 nt, Haemophilus influenzae Rd
guuuacccacuugguaaac

SEQ ID NO: 707993 - RNA, 12 nt, Haemophilus influenzae Rd
guuuaucaucug

SEQ ID NO: 707994 - RNA, 16 nt, Haemophilus influenzae Rd
guuuaguaaaauaaaa

SEQ ID NO: 707995 - RNA, 12 nt, Haemophilus influenzae Rd
guuguucuggug

SEQ ID NO: 707996 - RNA, 22 nt, Haemophilus influenzae Rd
guuguuggcauauucgcaccuu

SEQ ID NO: 707997 - RNA, 13 nt, Haemophilus influenzae Rd
guuguuuuuuaau

SEQ ID NO: 707998 - RNA, 18 nt, Haemophilus influenzae Rd
guuuaaaagcccuucuau

SEQ ID NO: 707999 - RNA, 23 nt, Haemophilus influenzae Rd
uaaaaucgccugacauuuuugcc

SEQ ID NO: 708000 - RNA, 14 nt, Haemophilus influenzae Rd
uaaaauauuuaauu

SEQ ID NO: 708001 - RNA, 20 nt, Haemophilus influenzae Rd
uaaaaucuauuugaaaucuu

SEQ ID NO: 708002 - RNA, 24 nt, Haemophilus influenzae Rd
uaaaaugcaaacaagaugucaaau

SEQ ID NO: 708003 - RNA, 16 nt, Haemophilus influenzae Rd
uaaaauguuuauauuu

SEQ ID NO: 708004 - RNA, 15 nt, Haemophilus influenzae Rd
uaaaauuaagcaaua

SEQ ID NO: 708005 - RNA, 15 nt, Haemophilus influenzae Rd
uaaaauuaauaaaua

SEQ ID NO: 708006 - RNA, 14 nt, Haemophilus influenzae Rd
uaaaauuaaucaua

SEQ ID NO: 708007 - RNA, 18 nt, Haemophilus influenzae Rd
uaaaauuaaugugcuaua

SEQ ID NO: 708008 - RNA, 19 nt, Haemophilus influenzae Rd
uaaaauuacaaaaccaauc

SEQ ID NO: 708009 - RNA, 12 nt, Haemophilus influenzae Rd
uaaaauggcuuu

SEQ ID NO: 708010 - RNA, 24 nt, Haemophilus influenzae Rd
uaaaauggugcuuuuuacaacauu

SEQ ID NO: 708011 - RNA, 19 nt, Haemophilus influenzae Rd
uaaaaugguuuaaauaacc

SEQ ID NO: 708012 - RNA, 12 nt, Haemophilus influenzae Rd
uaaaauguaaaa

SEQ ID NO: 708013 - RNA, 18 nt, Haemophilus influenzae Rd
uaaaauguaaaaauugga

SEQ ID NO: 708014 - RNA, 18 nt, Haemophilus influenzae Rd
uaaaauguaauagccauu

SEQ ID NO: 708015 - RNA, 21 nt, Haemophilus influenzae Rd
uaaaauggcgguuuuuuaauu

SEQ ID NO: 708016 - RNA, 19 nt, Haemophilus influenzae Rd
uaaaauggaaauuugagau

SEQ ID NO: 708017 - RNA, 18 nt, Haemophilus influenzae Rd
uaaaauggauaaaccgua

SEQ ID NO: 708018 - RNA, 16 nt, Haemophilus influenzae Rd
uaaaaggcuuucuaac

SEQ ID NO: 708019 - RNA, 19 nt, Haemophilus influenzae Rd
uaaaaggcuuucuguguua

SEQ ID NO: 708020 - RNA, 14 nt, Haemophilus influenzae Rd
uaaaaggcaaagca

SEQ ID NO: 708021 - RNA, 18 nt, Haemophilus influenzae Rd
uaaaaggcaaagcaaaau

SEQ ID NO: 708022 - RNA, 19 nt, Haemophilus influenzae Rd
uaaaauaauaucacaacca

SEQ ID NO: 708023 - RNA, 13 nt, Haemophilus influenzae Rd
uaaaauaauaucc

SEQ ID NO: 708024 - RNA, 15 nt, Haemophilus influenzae Rd
uaaaauaaauuuugg

SEQ ID NO: 708025 - RNA, 14 nt, Haemophilus influenzae Rd
uaaaauaacaaaaa

SEQ ID NO: 708026 - RNA, 18 nt, Haemophilus influenzae Rd
uaaaauauccacauaacc

SEQ ID NO: 708027 - RNA, 19 nt, Haemophilus influenzae Rd
uaaaauauccacauaacca

SEQ ID NO: 708028 - RNA, 21 nt, Haemophilus influenzae Rd
uaaaauauccacauaaccaaa

SEQ ID NO: 708029 - RNA, 12 nt, Haemophilus influenzae Rd
uaaaauaucuug

SEQ ID NO: 708030 - RNA, 17 nt, Haemophilus influenzae Rd
uaaaauaguuuucacaa

SEQ ID NO: 708031 - RNA, 17 nt, Haemophilus influenzae Rd
uaaaauaguuuuuauua

SEQ ID NO: 708032 - RNA, 15 nt, Haemophilus influenzae Rd
uaaaauauaacauuu

SEQ ID NO: 708033 - RNA, 16 nt, Haemophilus influenzae Rd
uaaaauauauaaucuu

SEQ ID NO: 708034 - RNA, 18 nt, Haemophilus influenzae Rd
uaaaauauauuaauuauu

SEQ ID NO: 708035 - RNA, 23 nt, Haemophilus influenzae Rd
uaaacaagauucugaaagauauu

SEQ ID NO: 708036 - RNA, 19 nt, Haemophilus influenzae Rd
uaaacaagcucuagaaaau

SEQ ID NO: 708037 - RNA, 16 nt, Haemophilus influenzae Rd
uaaacaauauaaccag

SEQ ID NO: 708038 - RNA, 19 nt, Haemophilus influenzae Rd
uaaacaauauauucggaaa

SEQ ID NO: 708039 - RNA, 21 nt, Haemophilus influenzae Rd
uaaacaauauauucggaaaaa

SEQ ID NO: 708040 - RNA, 23 nt, Haemophilus influenzae Rd
uaaacaaagaaucuuaaauucau

SEQ ID NO: 708041 - RNA, 13 nt, Haemophilus influenzae Rd
uaaacaaaccuaa

SEQ ID NO: 708042 - RNA, 18 nt, Haemophilus influenzae Rd
uaaacaaaccuaaaccuu

SEQ ID NO: 708043 - RNA, 14 nt, Haemophilus influenzae Rd
uaaacaaaaauaca

SEQ ID NO: 708044 - RNA, 23 nt, Haemophilus influenzae Rd
uaaacaaaauaccccaauuaagu

SEQ ID NO: 708045 - RNA, 13 nt, Haemophilus influenzae Rd
uaaacaaaaucuu

SEQ ID NO: 708046 - RNA, 15 nt, Haemophilus influenzae Rd
uaaacaaccaacuaa

SEQ ID NO: 708047 - RNA, 14 nt, Haemophilus influenzae Rd
uaaacacacucuua

SEQ ID NO: 708048 - RNA, 13 nt, Haemophilus influenzae Rd
uaaacacauaaua

SEQ ID NO: 708049 - RNA, 12 nt, Haemophilus influenzae Rd
uaaacaauuuca

SEQ ID NO: 708050 - RNA, 14 nt, Haemophilus influenzae Rd
uaaacaauuucauu

SEQ ID NO: 708051 - RNA, 21 nt, Haemophilus influenzae Rd
uaaacaauuucauuacguguu

SEQ ID NO: 708052 - RNA, 15 nt, Haemophilus influenzae Rd
uaaacagaauuuacg

SEQ ID NO: 708053 - RNA, 15 nt, Haemophilus influenzae Rd
uaaacagaaauauug

SEQ ID NO: 708054 - RNA, 16 nt, Haemophilus influenzae Rd
uaaacagaaauauugu

SEQ ID NO: 708055 - RNA, 19 nt, Haemophilus influenzae Rd
uaaacacugcgcagauuaa

SEQ ID NO: 708056 - RNA, 20 nt, Haemophilus influenzae Rd
uaaacacugcgcagauuaau

SEQ ID NO: 708057 - RNA, 20 nt, Haemophilus influenzae Rd
uaaacacuuaaauaguuaau

SEQ ID NO: 708058 - RNA, 17 nt, Haemophilus influenzae Rd
uaaacagcaaaagugcu

SEQ ID NO: 708059 - RNA, 19 nt, Haemophilus influenzae Rd
uaaacagcaaaagugcuua

SEQ ID NO: 708060 - RNA, 18 nt, Haemophilus influenzae Rd
uaaaauuuauuacaaaca

SEQ ID NO: 708061 - RNA, 18 nt, Haemophilus influenzae Rd
uaaaauuuauuuuaaaau

SEQ ID NO: 708062 - RNA, 23 nt, Haemophilus influenzae Rd
uaaaauuuauuuuaaaaucaucu

SEQ ID NO: 708063 - RNA, 20 nt, Haemophilus influenzae Rd
uaaaauuucuuuuguuuuaa

SEQ ID NO: 708064 - RNA, 16 nt, Haemophilus influenzae Rd
uaaaauuucuucuaca

SEQ ID NO: 708065 - RNA, 17 nt, Haemophilus influenzae Rd
uaaaauuuuuaccauau

SEQ ID NO: 708066 - RNA, 24 nt, Haemophilus influenzae Rd
uaaaauuuuuaucuuuaaagaaua

SEQ ID NO: 708067 - RNA, 19 nt, Haemophilus influenzae Rd
uaaaauugccccuucaccu

SEQ ID NO: 708068 - RNA, 22 nt, Haemophilus influenzae Rd
uaaaauugcuuuguuaauucac

SEQ ID NO: 708069 - RNA, 17 nt, Haemophilus influenzae Rd
uaaaauucuauuaaaau

SEQ ID NO: 708070 - RNA, 18 nt, Haemophilus influenzae Rd
uaaaauucuauuaaaaua

SEQ ID NO: 708071 - RNA, 19 nt, Haemophilus influenzae Rd
uaaaauucuauuaaaauau

SEQ ID NO: 708072 - RNA, 21 nt, Haemophilus influenzae Rd
uaaaauucgacgauaaccauc

SEQ ID NO: 708073 - RNA, 23 nt, Haemophilus influenzae Rd
uaaaauucgacgauaaccaucug

SEQ ID NO: 708074 - RNA, 12 nt, Haemophilus influenzae Rd
uaaaauuauaau

SEQ ID NO: 708075 - RNA, 16 nt, Haemophilus influenzae Rd
uaaaauuauaauauuu

SEQ ID NO: 708076 - RNA, 21 nt, Haemophilus influenzae Rd
uaaaauuaccgcacuuuuuau

SEQ ID NO: 708077 - RNA, 23 nt, Haemophilus influenzae Rd
uaaaauuaccgcacuuuuuauuu

SEQ ID NO: 708078 - RNA, 22 nt, Haemophilus influenzae Rd
uaaaauucaaagauuauuuaau

SEQ ID NO: 708079 - RNA, 23 nt, Haemophilus influenzae Rd
uaaaacuauuuuuaauuuugaag

SEQ ID NO: 708080 - RNA, 23 nt, Haemophilus influenzae Rd
uaaaacuaauuugcacacuuaaa

SEQ ID NO: 708081 - RNA, 14 nt, Haemophilus influenzae Rd
uaaaacuauaaaaa

SEQ ID NO: 708082 - RNA, 15 nt, Haemophilus influenzae Rd
uaaaacuauaaaaau

SEQ ID NO: 708083 - RNA, 18 nt, Haemophilus influenzae Rd
uaaaacgcgcauuaaacu

SEQ ID NO: 708084 - RNA, 19 nt, Haemophilus influenzae Rd
uaaaagauaaacaaaccua

SEQ ID NO: 708085 - RNA, 18 nt, Haemophilus influenzae Rd
uaaaagauacacucacuu

SEQ ID NO: 708086 - RNA, 22 nt, Haemophilus influenzae Rd
uaaaagcuuccauaauacucac

SEQ ID NO: 708087 - RNA, 22 nt, Haemophilus influenzae Rd
uaaaagauaaaacagagaaaaa

SEQ ID NO: 708088 - RNA, 18 nt, Haemophilus influenzae Rd
uaaaagagagcuucucuu

SEQ ID NO: 708089 - RNA, 17 nt, Haemophilus influenzae Rd
uaaaaccacaauaaaau

SEQ ID NO: 708090 - RNA, 20 nt, Haemophilus influenzae Rd
uaaaaccauccgaaauuaau

SEQ ID NO: 708091 - RNA, 23 nt, Haemophilus influenzae Rd
uaaaaccaaaagauucaacaaua

SEQ ID NO: 708092 - RNA, 13 nt, Haemophilus influenzae Rd
uaaaacaacagua

SEQ ID NO: 708093 - RNA, 15 nt, Haemophilus influenzae Rd
uaaaaccaagaaagc

SEQ ID NO: 708094 - RNA, 12 nt, Haemophilus influenzae Rd
uaaaacaaaguc

SEQ ID NO: 708095 - RNA, 15 nt, Haemophilus influenzae Rd
uaaaacaaagucaau

SEQ ID NO: 708096 - RNA, 14 nt, Haemophilus influenzae Rd
uaaaaauuucucuc

SEQ ID NO: 708097 - RNA, 12 nt, Haemophilus influenzae Rd
uaaaaauuucag

SEQ ID NO: 708098 - RNA, 21 nt, Haemophilus influenzae Rd
uaaaaauuguugauuccucug

SEQ ID NO: 708099 - RNA, 13 nt, Haemophilus influenzae Rd
uaaaaauuuaaaa

SEQ ID NO: 708100 - RNA, 19 nt, Haemophilus influenzae Rd
uaaaaauuuaaaagcaccu

SEQ ID NO: 708101 - RNA, 19 nt, Haemophilus influenzae Rd
uaaaaauuuaaauauaauu

SEQ ID NO: 708102 - RNA, 22 nt, Haemophilus influenzae Rd
uaaaaauucuuuuuucuuccua

SEQ ID NO: 708103 - RNA, 13 nt, Haemophilus influenzae Rd
uaaaaauuggaaa

SEQ ID NO: 708104 - RNA, 13 nt, Haemophilus influenzae Rd
uaaaaaugcuguu

SEQ ID NO: 708105 - RNA, 11 nt, Haemophilus influenzae Rd
uaaaaaugcuu

SEQ ID NO: 708106 - RNA, 22 nt, Haemophilus influenzae Rd
uaaaaauaaauagauacaagaa

SEQ ID NO: 708107 - RNA, 12 nt, Haemophilus influenzae Rd
uaaaaauuaaug

SEQ ID NO: 708108 - RNA, 11 nt, Haemophilus influenzae Rd
uaaaaauucac

SEQ ID NO: 708109 - RNA, 20 nt, Haemophilus influenzae Rd
uaaaaauucaccgcacuuuu

SEQ ID NO: 708110 - RNA, 19 nt, Haemophilus influenzae Rd
uaaaaaugcacguuaauua

SEQ ID NO: 708111 - RNA, 11 nt, Haemophilus influenzae Rd
uaaaaaugcug

SEQ ID NO: 708112 - RNA, 17 nt, Haemophilus influenzae Rd
uaaaaauguuauaaaua

SEQ ID NO: 708113 - RNA, 13 nt, Haemophilus influenzae Rd
uaaaaauuaaccg

SEQ ID NO: 708114 - RNA, 16 nt, Haemophilus influenzae Rd
uaaaaauuaaccgcac

SEQ ID NO: 708115 - RNA, 15 nt, Haemophilus influenzae Rd
uaaaaauuaaggaaa

SEQ ID NO: 708116 - RNA, 21 nt, Haemophilus influenzae Rd
uaaaaauuaaggaaagcccca

SEQ ID NO: 708117 - RNA, 12 nt, Haemophilus influenzae Rd
uaaaaaccuaaa

SEQ ID NO: 708118 - RNA, 15 nt, Haemophilus influenzae Rd
uaaaaagacaaaacg

SEQ ID NO: 708119 - RNA, 15 nt, Haemophilus influenzae Rd
uaaaaagaacuacau

SEQ ID NO: 708120 - RNA, 17 nt, Haemophilus influenzae Rd
uaaaaagaaauaaaaga

SEQ ID NO: 708121 - RNA, 22 nt, Haemophilus influenzae Rd
uaaaaagaaauaaaagauaaac

SEQ ID NO: 708122 - RNA, 13 nt, Haemophilus influenzae Rd
uaaaaacugugcg

SEQ ID NO: 708123 - RNA, 22 nt, Haemophilus influenzae Rd
guuugauuuauacgugaaccaa

SEQ ID NO: 708124 - RNA, 21 nt, Haemophilus influenzae Rd
uaaaaaccagauaaaaacugu

SEQ ID NO: 708125 - RNA, 23 nt, Haemophilus influenzae Rd
guuugauccacaaauaauaaucu

SEQ ID NO: 708126 - RNA, 15 nt, Haemophilus influenzae Rd
guuugauaaauaucu

SEQ ID NO: 708127 - RNA, 20 nt, Haemophilus influenzae Rd
guuugaggaucacacaaaau

SEQ ID NO: 708128 - RNA, 21 nt, Haemophilus influenzae Rd
uaaaaagauaacuuagaaaau

SEQ ID NO: 708129 - RNA, 22 nt, Haemophilus influenzae Rd
uaaaaagauaacuuagaaaaua

SEQ ID NO: 708130 - RNA, 17 nt, Haemophilus influenzae Rd
uaaaaagcccaaaugca

SEQ ID NO: 708131 - RNA, 15 nt, Haemophilus influenzae Rd
uaaaaaggaaauaau

SEQ ID NO: 708132 - RNA, 19 nt, Haemophilus influenzae Rd
uaaaaaggaaauaauuucc

SEQ ID NO: 708133 - RNA, 21 nt, Haemophilus influenzae Rd
uaaaaaggaaauaauuuccuu

SEQ ID NO: 708134 - RNA, 13 nt, Haemophilus influenzae Rd
uaaaaauaaaaaa

SEQ ID NO: 708135 - RNA, 16 nt, Haemophilus influenzae Rd
uaaaaauaaaaacauu

SEQ ID NO: 708136 - RNA, 14 nt, Haemophilus influenzae Rd
uaaaaauaaacauu

SEQ ID NO: 708137 - RNA, 23 nt, Haemophilus influenzae Rd
uaaaaauaacccuuacuuuauac

SEQ ID NO: 708138 - RNA, 16 nt, Haemophilus influenzae Rd
uaaaaauaaccuauaa

SEQ ID NO: 708139 - RNA, 14 nt, Haemophilus influenzae Rd
uaaaaauaaucacu

SEQ ID NO: 708140 - RNA, 16 nt, Haemophilus influenzae Rd
uaaaaauaauuagaua

SEQ ID NO: 708141 - RNA, 14 nt, Haemophilus influenzae Rd
uaaaaauagccuca

SEQ ID NO: 708142 - RNA, 17 nt, Haemophilus influenzae Rd
uaaaaauaauuuuacuu

SEQ ID NO: 708143 - RNA, 15 nt, Haemophilus influenzae Rd
uaaacucgaaggaaa

SEQ ID NO: 708144 - RNA, 18 nt, Haemophilus influenzae Rd
uaaacucaaugaauuaaa

SEQ ID NO: 708145 - RNA, 13 nt, Haemophilus influenzae Rd
uaaacucagaaua

SEQ ID NO: 708146 - RNA, 23 nt, Haemophilus influenzae Rd
uaaacugccgccuucuuccacgu

SEQ ID NO: 708147 - RNA, 14 nt, Haemophilus influenzae Rd
uaaacuggaugaaa

SEQ ID NO: 708148 - RNA, 17 nt, Haemophilus influenzae Rd
uaaacuggaugaaauca

SEQ ID NO: 708149 - RNA, 18 nt, Haemophilus influenzae Rd
uaaacggaguuuuccauu

SEQ ID NO: 708150 - RNA, 15 nt, Haemophilus influenzae Rd
uaaacggaacucuug

SEQ ID NO: 708151 - RNA, 19 nt, Haemophilus influenzae Rd
uaaacuacccaaauuuaua

SEQ ID NO: 708152 - RNA, 22 nt, Haemophilus influenzae Rd
uaaacgcaucaacuuuaucauu

SEQ ID NO: 708153 - RNA, 16 nt, Haemophilus influenzae Rd
uaaaccgcaucaaaau

SEQ ID NO: 708154 - RNA, 19 nt, Haemophilus influenzae Rd
uaaaccgcaucaaaauuau

SEQ ID NO: 708155 - RNA, 16 nt, Haemophilus influenzae Rd
uaaacccgaaauauaa

SEQ ID NO: 708156 - RNA, 22 nt, Haemophilus influenzae Rd
uaaacccuuuagcauaaaacag

SEQ ID NO: 708157 - RNA, 20 nt, Haemophilus influenzae Rd
uaaacccuguuuuaagguuu

SEQ ID NO: 708158 - RNA, 18 nt, Haemophilus influenzae Rd
uaaaccauuuaauaaaac

SEQ ID NO: 708159 - RNA, 20 nt, Haemophilus influenzae Rd
uaaacauuaggaauaucuuu

SEQ ID NO: 708160 - RNA, 23 nt, Haemophilus influenzae Rd
uaaacagccauggcuuuuuccug

SEQ ID NO: 708161 - RNA, 14 nt, Haemophilus influenzae Rd
uaaacagcuuuccu

SEQ ID NO: 708162 - RNA, 14 nt, Haemophilus influenzae Rd
uaaacaucuugcau

SEQ ID NO: 708163 - RNA, 19 nt, Haemophilus influenzae Rd
uaaacauauugaugauuaa

SEQ ID NO: 708164 - RNA, 17 nt, Haemophilus influenzae Rd
uaaacauccgaauaaau

SEQ ID NO: 708165 - RNA, 21 nt, Haemophilus influenzae Rd
uaaacauccgaauaaaugcau

SEQ ID NO: 708166 - RNA, 22 nt, Haemophilus influenzae Rd
uaaacagucugcgccuaaaaua

SEQ ID NO: 708167 - RNA, 17 nt, Haemophilus influenzae Rd
uaaacauacaucuaauu

SEQ ID NO: 708168 - RNA, 14 nt, Haemophilus influenzae Rd
uaaagauuguccuu

SEQ ID NO: 708169 - RNA, 18 nt, Haemophilus influenzae Rd
uaaagcuacaucaacaaa

SEQ ID NO: 708170 - RNA, 15 nt, Haemophilus influenzae Rd
uaaagcucguauaau

SEQ ID NO: 708171 - RNA, 18 nt, Haemophilus influenzae Rd
uaaagcucuaauugaaau

SEQ ID NO: 708172 - RNA, 17 nt, Haemophilus influenzae Rd
uaaaggcacaaaaaauu

SEQ ID NO: 708173 - RNA, 19 nt, Haemophilus influenzae Rd
uaaaggcacaaaaaauucu

SEQ ID NO: 708174 - RNA, 15 nt, Haemophilus influenzae Rd
uaaaggauuaaauaa

SEQ ID NO: 708175 - RNA, 18 nt, Haemophilus influenzae Rd
uaaagcuugaaaaaaccg

SEQ ID NO: 708176 - RNA, 20 nt, Haemophilus influenzae Rd
uaaagaucauucacaucuug

SEQ ID NO: 708177 - RNA, 23 nt, Haemophilus influenzae Rd
uaaagauggacguguuguggcau

SEQ ID NO: 708178 - RNA, 21 nt, Haemophilus influenzae Rd
uaaagaugguugucgaaaaaa

SEQ ID NO: 708179 - RNA, 16 nt, Haemophilus influenzae Rd
uaaagaagaaaaucuu

SEQ ID NO: 708180 - RNA, 18 nt, Haemophilus influenzae Rd
uaaagaguaccacuuuca

SEQ ID NO: 708181 - RNA, 23 nt, Haemophilus influenzae Rd
uaaagagugaccagucauugauu

SEQ ID NO: 708182 - RNA, 18 nt, Haemophilus influenzae Rd
uaaagaguuauaaaccca

SEQ ID NO: 708183 - RNA, 15 nt, Haemophilus influenzae Rd
uaaacuguugccaua

SEQ ID NO: 708184 - RNA, 21 nt, Haemophilus influenzae Rd
uaaagaaaauacauaauuaaa

SEQ ID NO: 708185 - RNA, 18 nt, Haemophilus influenzae Rd
uaaagaaacguaaacaaa

SEQ ID NO: 708186 - RNA, 19 nt, Haemophilus influenzae Rd
uaaagaaacguaaacaaaa

SEQ ID NO: 708187 - RNA, 17 nt, Haemophilus influenzae Rd
uaaagaaauaagcaauu

SEQ ID NO: 708188 - RNA, 17 nt, Haemophilus influenzae Rd
uaaagaaauaaauuuau

SEQ ID NO: 708189 - RNA, 19 nt, Haemophilus influenzae Rd
uaaagaaaucauugcugca

SEQ ID NO: 708190 - RNA, 20 nt, Haemophilus influenzae Rd
uaaagaaauuucauauuucu

SEQ ID NO: 708191 - RNA, 23 nt, Haemophilus influenzae Rd
uaaagaacuauuauuccaaauau

SEQ ID NO: 708192 - RNA, 13 nt, Haemophilus influenzae Rd
uaaauccucagca

SEQ ID NO: 708193 - RNA, 19 nt, Haemophilus influenzae Rd
uaaauccugcuucuuuauc

SEQ ID NO: 708194 - RNA, 24 nt, Haemophilus influenzae Rd
uaaaucccaagguugcucaaucca

SEQ ID NO: 708195 - RNA, 19 nt, Haemophilus influenzae Rd
uaaaugcacauuuuuacca

SEQ ID NO: 708196 - RNA, 21 nt, Haemophilus influenzae Rd
uaaaugauguaggcaaaaaca

SEQ ID NO: 708197 - RNA, 23 nt, Haemophilus influenzae Rd
uaaaugauuaucuuguacuaacg

SEQ ID NO: 708198 - RNA, 13 nt, Haemophilus influenzae Rd
uaaaucuaaaaua

SEQ ID NO: 708199 - RNA, 19 nt, Haemophilus influenzae Rd
uaaaucuaagcgaccugaa

SEQ ID NO: 708200 - RNA, 13 nt, Haemophilus influenzae Rd
uaaaucuacuuua

SEQ ID NO: 708201 - RNA, 14 nt, Haemophilus influenzae Rd
uaaaucuacuuuau

SEQ ID NO: 708202 - RNA, 15 nt, Haemophilus influenzae Rd
uaaaucguauaagcc

SEQ ID NO: 708203 - RNA, 18 nt, Haemophilus influenzae Rd
uaaaucggcuuuaucauc

SEQ ID NO: 708204 - RNA, 20 nt, Haemophilus influenzae Rd
uaaaucggcuuuaucaucuu

SEQ ID NO: 708205 - RNA, 15 nt, Haemophilus influenzae Rd
uaaauauuuaaaaag

SEQ ID NO: 708206 - RNA, 17 nt, Haemophilus influenzae Rd
uaaauauuuaaaaagaa

SEQ ID NO: 708207 - RNA, 20 nt, Haemophilus influenzae Rd
uaaauauuuaaaaagaauau

SEQ ID NO: 708208 - RNA, 16 nt, Haemophilus influenzae Rd
uaaauauuuaaagugc

SEQ ID NO: 708209 - RNA, 19 nt, Haemophilus influenzae Rd
uaaauauugauuacccauu

SEQ ID NO: 708210 - RNA, 12 nt, Haemophilus influenzae Rd
uaaauauucaau

SEQ ID NO: 708211 - RNA, 18 nt, Haemophilus influenzae Rd
uaaauauucaauuacaua

SEQ ID NO: 708212 - RNA, 15 nt, Haemophilus influenzae Rd
uaaauauuauuaaaa

SEQ ID NO: 708213 - RNA, 12 nt, Haemophilus influenzae Rd
uaaauauaaacu

SEQ ID NO: 708214 - RNA, 18 nt, Haemophilus influenzae Rd
uaaaucagcgaauuaaag

SEQ ID NO: 708215 - RNA, 18 nt, Haemophilus influenzae Rd
uaaaucagcgaguuugau

SEQ ID NO: 708216 - RNA, 20 nt, Haemophilus influenzae Rd
uaaauauuguauuuaaguaa

SEQ ID NO: 708217 - RNA, 19 nt, Haemophilus influenzae Rd
uaaauauuuaggcuauuuu

SEQ ID NO: 708218 - RNA, 17 nt, Haemophilus influenzae Rd
uaaauauuuauacacuu

SEQ ID NO: 708219 - RNA, 13 nt, Haemophilus influenzae Rd
uaaauauuucacu

SEQ ID NO: 708220 - RNA, 17 nt, Haemophilus influenzae Rd
uaaaucacuuucauuaa

SEQ ID NO: 708221 - RNA, 19 nt, Haemophilus influenzae Rd
uaaaucacuuucauuaaaa

SEQ ID NO: 708222 - RNA, 15 nt, Haemophilus influenzae Rd
uaaaucauaagcaau

SEQ ID NO: 708223 - RNA, 20 nt, Haemophilus influenzae Rd
uaaaucaugaauaauuuugu

SEQ ID NO: 708224 - RNA, 20 nt, Haemophilus influenzae Rd
uaaaucaucccuguauaaag

SEQ ID NO: 708225 - RNA, 22 nt, Haemophilus influenzae Rd
uaaaucaugggcgauaaaaauu

SEQ ID NO: 708226 - RNA, 15 nt, Haemophilus influenzae Rd
uaaagugcagauuuu

SEQ ID NO: 708227 - RNA, 21 nt, Haemophilus influenzae Rd
uaaagugcgguaaaauucuau

SEQ ID NO: 708228 - RNA, 23 nt, Haemophilus influenzae Rd
uaaagugcggucugaaaaucaaa

SEQ ID NO: 708229 - RNA, 17 nt, Haemophilus influenzae Rd
uaaagugcgguuaauuu

SEQ ID NO: 708230 - RNA, 22 nt, Haemophilus influenzae Rd
uaaagugguuuuagccauuugu

SEQ ID NO: 708231 - RNA, 17 nt, Haemophilus influenzae Rd
uaaaguuacuuugcauu

SEQ ID NO: 708232 - RNA, 18 nt, Haemophilus influenzae Rd
uaaaguuacacaaugcca

SEQ ID NO: 708233 - RNA, 20 nt, Haemophilus influenzae Rd
uaaaguguggauuuuguaau

SEQ ID NO: 708234 - RNA, 13 nt, Haemophilus influenzae Rd
uaaaguuaucaaa

SEQ ID NO: 708235 - RNA, 21 nt, Haemophilus influenzae Rd
uaaauaacaucgcuaaaucuu

SEQ ID NO: 708236 - RNA, 21 nt, Haemophilus influenzae Rd
uaaauaacgcucauaagcauu

SEQ ID NO: 708237 - RNA, 21 nt, Haemophilus influenzae Rd
uaaauaacuaccuaauaaagc

SEQ ID NO: 708238 - RNA, 19 nt, Haemophilus influenzae Rd
uaaagucuaauaugauuaa

SEQ ID NO: 708239 - RNA, 14 nt, Haemophilus influenzae Rd
uaaaguccauaaua

SEQ ID NO: 708240 - RNA, 19 nt, Haemophilus influenzae Rd
uaaagucgguuuuuucaua

SEQ ID NO: 708241 - RNA, 13 nt, Haemophilus influenzae Rd
uaaaguauucaua

SEQ ID NO: 708242 - RNA, 17 nt, Haemophilus influenzae Rd
uaaaguauucauauaau

SEQ ID NO: 708243 - RNA, 12 nt, Haemophilus influenzae Rd
uaaaguauacuu

SEQ ID NO: 708244 - RNA, 15 nt, Haemophilus influenzae Rd
uaaagggaagugaua

SEQ ID NO: 708245 - RNA, 21 nt, Haemophilus influenzae Rd
uaaauaguuaauugauuuaaa

SEQ ID NO: 708246 - RNA, 22 nt, Haemophilus influenzae Rd
uaaauaguuaauugauuuaaaa

SEQ ID NO: 708247 - RNA, 24 nt, Haemophilus influenzae Rd
uaaauagguauagccuucgcuauu

SEQ ID NO: 708248 - RNA, 19 nt, Haemophilus influenzae Rd
uaaauagguaucacuuaaa

SEQ ID NO: 708249 - RNA, 21 nt, Haemophilus influenzae Rd
uaaauaggaaacucuuacuuu

SEQ ID NO: 708250 - RNA, 20 nt, Haemophilus influenzae Rd
uaaauaauccagauaacaaa

SEQ ID NO: 708251 - RNA, 12 nt, Haemophilus influenzae Rd
uaaauaauagua

SEQ ID NO: 708252 - RNA, 13 nt, Haemophilus influenzae Rd
uaaauacagcuca

SEQ ID NO: 708253 - RNA, 20 nt, Haemophilus influenzae Rd
uaaauacagcucaaaaugcu

SEQ ID NO: 708254 - RNA, 15 nt, Haemophilus influenzae Rd
uaaauaacucaagca

SEQ ID NO: 708255 - RNA, 13 nt, Haemophilus influenzae Rd
uaaauaaggaauu

SEQ ID NO: 708256 - RNA, 17 nt, Haemophilus influenzae Rd
uaacauacccaugccuu

SEQ ID NO: 708257 - RNA, 19 nt, Haemophilus influenzae Rd
uaacauaaugauuucuaaa

SEQ ID NO: 708258 - RNA, 20 nt, Haemophilus influenzae Rd
uaacauaaugauuucuaaac

SEQ ID NO: 708259 - RNA, 15 nt, Haemophilus influenzae Rd
uaacauaauuguguu

SEQ ID NO: 708260 - RNA, 13 nt, Haemophilus influenzae Rd
uaacauaauuuau

SEQ ID NO: 708261 - RNA, 17 nt, Haemophilus influenzae Rd
uaacauagaaaucacua

SEQ ID NO: 708262 - RNA, 18 nt, Haemophilus influenzae Rd
uaacauagaaaucacuaa

SEQ ID NO: 708263 - RNA, 17 nt, Haemophilus influenzae Rd
uaacauaugacagauag

SEQ ID NO: 708264 - RNA, 18 nt, Haemophilus influenzae Rd
uaacauaugauuauuuaa

SEQ ID NO: 708265 - RNA, 13 nt, Haemophilus influenzae Rd
uaacacuuuuuca

SEQ ID NO: 708266 - RNA, 17 nt, Haemophilus influenzae Rd
uaacagcuagaauaaag

SEQ ID NO: 708267 - RNA, 13 nt, Haemophilus influenzae Rd
uaacagcucugua

SEQ ID NO: 708268 - RNA, 16 nt, Haemophilus influenzae Rd
uaacagcucuguaaaa

SEQ ID NO: 708269 - RNA, 17 nt, Haemophilus influenzae Rd
uaacagggcauaaauca

SEQ ID NO: 708270 - RNA, 22 nt, Haemophilus influenzae Rd
uaacaggaauuugcucaauaau

SEQ ID NO: 708271 - RNA, 13 nt, Haemophilus influenzae Rd
uaaccaacauaaa

SEQ ID NO: 708272 - RNA, 17 nt, Haemophilus influenzae Rd
uaaccaacauaaacauu

SEQ ID NO: 708273 - RNA, 19 nt, Haemophilus influenzae Rd
uaaccaaaauauuucauuu

SEQ ID NO: 708274 - RNA, 22 nt, Haemophilus influenzae Rd
uaaccaaauagaugaaauuuau

SEQ ID NO: 708275 - RNA, 22 nt, Haemophilus influenzae Rd
uaacaucaucaucgcaucugua

SEQ ID NO: 708276 - RNA, 17 nt, Haemophilus influenzae Rd
uaacaucaugaaaugca

SEQ ID NO: 708277 - RNA, 24 nt, Haemophilus influenzae Rd
uaaccacgcuggaauuuucacauu

SEQ ID NO: 708278 - RNA, 19 nt, Haemophilus influenzae Rd
uaaccacuugucauuaaaa

SEQ ID NO: 708279 - RNA, 20 nt, Haemophilus influenzae Rd
uaaccacuugucauuaaaaa

SEQ ID NO: 708280 - RNA, 17 nt, Haemophilus influenzae Rd
uaaccacguaauucuug

SEQ ID NO: 708281 - RNA, 16 nt, Haemophilus influenzae Rd
uaaccacuaaaaaagc

SEQ ID NO: 708282 - RNA, 16 nt, Haemophilus influenzae Rd
uaaccacuacguguag

SEQ ID NO: 708283 - RNA, 18 nt, Haemophilus influenzae Rd
uaaccacuccaaauaaua

SEQ ID NO: 708284 - RNA, 19 nt, Haemophilus influenzae Rd
uaaccacuccaaauaauac

SEQ ID NO: 708285 - RNA, 22 nt, Haemophilus influenzae Rd
uaaccacauauagugaaaaaau

SEQ ID NO: 708286 - RNA, 19 nt, Haemophilus influenzae Rd
uaaccaacguggcuuuucu

SEQ ID NO: 708287 - RNA, 17 nt, Haemophilus influenzae Rd
uaaccaauauaauuuac

SEQ ID NO: 708288 - RNA, 24 nt, Haemophilus influenzae Rd
uaaccaauggcaaucacaaaucca

SEQ ID NO: 708289 - RNA, 18 nt, Haemophilus influenzae Rd
uaaaugucuucuguuugg

SEQ ID NO: 708290 - RNA, 18 nt, Haemophilus influenzae Rd
uaaaugugacauuguaaa

SEQ ID NO: 708291 - RNA, 20 nt, Haemophilus influenzae Rd
uaaaugcaucauuaauacac

SEQ ID NO: 708292 - RNA, 21 nt, Haemophilus influenzae Rd
uaaaugcaucauuaauacaca

SEQ ID NO: 708293 - RNA, 19 nt, Haemophilus influenzae Rd
uaaauuuugcuuuaaauca

SEQ ID NO: 708294 - RNA, 16 nt, Haemophilus influenzae Rd
uaaaugugauuuccau

SEQ ID NO: 708295 - RNA, 11 nt, Haemophilus influenzae Rd
uaaaugugguc

SEQ ID NO: 708296 - RNA, 16 nt, Haemophilus influenzae Rd
uaaauguguuaaauaa

SEQ ID NO: 708297 - RNA, 12 nt, Haemophilus influenzae Rd
uaacaacaaaag

SEQ ID NO: 708298 - RNA, 15 nt, Haemophilus influenzae Rd
uaacaacaaagucaa

SEQ ID NO: 708299 - RNA, 18 nt, Haemophilus influenzae Rd
uaaauuuuuuaauucagu

SEQ ID NO: 708300 - RNA, 21 nt, Haemophilus influenzae Rd
uaacaaaagugcgguaaaaau

SEQ ID NO: 708301 - RNA, 16 nt, Haemophilus influenzae Rd
uaaauuuuuccacauu

SEQ ID NO: 708302 - RNA, 14 nt, Haemophilus influenzae Rd
uaaauuuuuaauaa

SEQ ID NO: 708303 - RNA, 22 nt, Haemophilus influenzae Rd
uaaauuuuuaauaaaguaaaau

SEQ ID NO: 708304 - RNA, 12 nt, Haemophilus influenzae Rd
uaaauuuuuagu

SEQ ID NO: 708305 - RNA, 14 nt, Haemophilus influenzae Rd
uaaauuuuuaguuu

SEQ ID NO: 708306 - RNA, 16 nt, Haemophilus influenzae Rd
uaaauuuuuaguuugu

SEQ ID NO: 708307 - RNA, 16 nt, Haemophilus influenzae Rd
uaaauuuuuggcugcu

SEQ ID NO: 708308 - RNA, 19 nt, Haemophilus influenzae Rd
uaaauuuuuggcugcugca

SEQ ID NO: 708309 - RNA, 21 nt, Haemophilus influenzae Rd
uaaauuuuucgccuaauucaa

SEQ ID NO: 708310 - RNA, 12 nt, Haemophilus influenzae Rd
uaacaaaaacaa

SEQ ID NO: 708311 - RNA, 21 nt, Haemophilus influenzae Rd
uaacacucauuguaaagccca

SEQ ID NO: 708312 - RNA, 15 nt, Haemophilus influenzae Rd
uaacacgaaaccaac

SEQ ID NO: 708313 - RNA, 21 nt, Haemophilus influenzae Rd
uaacacgaaaccaacgaaaau

SEQ ID NO: 708314 - RNA, 17 nt, Haemophilus influenzae Rd
uaacacgaccauugaau

SEQ ID NO: 708315 - RNA, 15 nt, Haemophilus influenzae Rd
uaacaaguaauuuau

SEQ ID NO: 708316 - RNA, 16 nt, Haemophilus influenzae Rd
uaacaaguaauuuauc

SEQ ID NO: 708317 - RNA, 21 nt, Haemophilus influenzae Rd
uaacaaguaauuuaucgccau

SEQ ID NO: 708318 - RNA, 17 nt, Haemophilus influenzae Rd
uaacuaaaccauuuaau

SEQ ID NO: 708319 - RNA, 15 nt, Haemophilus influenzae Rd
uaacuaaaaaaguuu

SEQ ID NO: 708320 - RNA, 15 nt, Haemophilus influenzae Rd
uaacgguuuucgauu

SEQ ID NO: 708321 - RNA, 22 nt, Haemophilus influenzae Rd
uaacguaaccauuguuuaauuc

SEQ ID NO: 708322 - RNA, 17 nt, Haemophilus influenzae Rd
uaacguagcgauaaaau

SEQ ID NO: 708323 - RNA, 19 nt, Haemophilus influenzae Rd
uaacgccauucguucccaa

SEQ ID NO: 708324 - RNA, 20 nt, Haemophilus influenzae Rd
uaacgggcuuaaacuuuuuu

SEQ ID NO: 708325 - RNA, 20 nt, Haemophilus influenzae Rd
uaacccauuacuaaaucccu

SEQ ID NO: 708326 - RNA, 20 nt, Haemophilus influenzae Rd
uaacccccuuaauucuaagg

SEQ ID NO: 708327 - RNA, 14 nt, Haemophilus influenzae Rd
uaacccaccaaauu

SEQ ID NO: 708328 - RNA, 18 nt, Haemophilus influenzae Rd
uaaccauuguuuaauucg

SEQ ID NO: 708329 - RNA, 20 nt, Haemophilus influenzae Rd
uaaccuuacugccuuuuucu

SEQ ID NO: 708330 - RNA, 21 nt, Haemophilus influenzae Rd
uaaccuucaaugguuuuacug

SEQ ID NO: 708331 - RNA, 17 nt, Haemophilus influenzae Rd
uaaccugcggauuucac

SEQ ID NO: 708332 - RNA, 19 nt, Haemophilus influenzae Rd
uaaccugauuaaucaaaaa

SEQ ID NO: 708333 - RNA, 16 nt, Haemophilus influenzae Rd
uaacgcaucaccacaa

SEQ ID NO: 708334 - RNA, 15 nt, Haemophilus influenzae Rd
uaacgccaagguuau

SEQ ID NO: 708335 - RNA, 19 nt, Haemophilus influenzae Rd
uaacuguaucuacuuuauu

SEQ ID NO: 708336 - RNA, 19 nt, Haemophilus influenzae Rd
uaacuggcuguguaaaaca

SEQ ID NO: 708337 - RNA, 15 nt, Haemophilus influenzae Rd
uaacugcuuuuuucc

SEQ ID NO: 708338 - RNA, 18 nt, Haemophilus influenzae Rd
uaacugcuuuuuuccagc

SEQ ID NO: 708339 - RNA, 18 nt, Haemophilus influenzae Rd
uaacucugguucaaaaug

SEQ ID NO: 708340 - RNA, 17 nt, Haemophilus influenzae Rd
uaacugaagcaaucgca

SEQ ID NO: 708341 - RNA, 14 nt, Haemophilus influenzae Rd
uaacugaaaauuca

SEQ ID NO: 708342 - RNA, 20 nt, Haemophilus influenzae Rd
uaacucuuuagaaaguuuug

SEQ ID NO: 708343 - RNA, 14 nt, Haemophilus influenzae Rd
uaacugaucgccau

SEQ ID NO: 708344 - RNA, 20 nt, Haemophilus influenzae Rd
uaacugcaaguccgccuuga

SEQ ID NO: 708345 - RNA, 20 nt, Haemophilus influenzae Rd
uaacucaucaacaaaaugcu

SEQ ID NO: 708346 - RNA, 22 nt, Haemophilus influenzae Rd
uaacucgcgcaccgucauuuuc

SEQ ID NO: 708347 - RNA, 14 nt, Haemophilus influenzae Rd
uaacucaaaauacu

SEQ ID NO: 708348 - RNA, 16 nt, Haemophilus influenzae Rd
uaacucaaaauacuca

SEQ ID NO: 708349 - RNA, 17 nt, Haemophilus influenzae Rd
uaacucaacaccgcaaa

SEQ ID NO: 708350 - RNA, 23 nt, Haemophilus influenzae Rd
uaacucaacaccgcaaaaauacu

SEQ ID NO: 708351 - RNA, 22 nt, Haemophilus influenzae Rd
uaacuauuggcaucaaaacguu

SEQ ID NO: 708352 - RNA, 23 nt, Haemophilus influenzae Rd
uaacuauuggcaucaaaacguuc

SEQ ID NO: 708353 - RNA, 17 nt, Haemophilus influenzae Rd
uaacuaggcaucaaaau

SEQ ID NO: 708354 - RNA, 13 nt, Haemophilus influenzae Rd
uaacuaaggugca

SEQ ID NO: 708355 - RNA, 13 nt, Haemophilus influenzae Rd
uaacuacaacaca

SEQ ID NO: 708356 - RNA, 16 nt, Haemophilus influenzae Rd
uaacuuuuaauucuug

SEQ ID NO: 708357 - RNA, 17 nt, Haemophilus influenzae Rd
uaacuuuuaauucuugu

SEQ ID NO: 708358 - RNA, 17 nt, Haemophilus influenzae Rd
uaacuuuccuacuauag

SEQ ID NO: 708359 - RNA, 14 nt, Haemophilus influenzae Rd
uaagaaaauaauau

SEQ ID NO: 708360 - RNA, 13 nt, Haemophilus influenzae Rd
uaagaaaauagaa

SEQ ID NO: 708361 - RNA, 13 nt, Haemophilus influenzae Rd
uaacuuuuuuauu

SEQ ID NO: 708362 - RNA, 20 nt, Haemophilus influenzae Rd
uaagaaaucucuuucaauuu

SEQ ID NO: 708363 - RNA, 22 nt, Haemophilus influenzae Rd
uaagaaagaaacugaaguauaa

SEQ ID NO: 708364 - RNA, 14 nt, Haemophilus influenzae Rd
uaagaaaaucaaag

SEQ ID NO: 708365 - RNA, 19 nt, Haemophilus influenzae Rd
uaagaaauccacaaucaau

SEQ ID NO: 708366 - RNA, 19 nt, Haemophilus influenzae Rd
uaagaaauuuucuuuucua

SEQ ID NO: 708367 - RNA, 13 nt, Haemophilus influenzae Rd
uaacuugauuuug

SEQ ID NO: 708368 - RNA, 15 nt, Haemophilus influenzae Rd
uaacuuuaaguaauc

SEQ ID NO: 708369 - RNA, 18 nt, Haemophilus influenzae Rd
uaacuugcgauaauauca

SEQ ID NO: 708370 - RNA, 19 nt, Haemophilus influenzae Rd
uaacuugcgauaauaucag

SEQ ID NO: 708371 - RNA, 17 nt, Haemophilus influenzae Rd
uaacuugcgauacaaac

SEQ ID NO: 708372 - RNA, 15 nt, Haemophilus influenzae Rd
uaacuucuuccacuu

SEQ ID NO: 708373 - RNA, 13 nt, Haemophilus influenzae Rd
uaacuuagaaaau

SEQ ID NO: 708374 - RNA, 14 nt, Haemophilus influenzae Rd
uaacuuagaaaaua

SEQ ID NO: 708375 - RNA, 15 nt, Haemophilus influenzae Rd
uaacuuagaaaauau

SEQ ID NO: 708376 - RNA, 16 nt, Haemophilus influenzae Rd
uaacuuagaaaauauc

SEQ ID NO: 708377 - RNA, 19 nt, Haemophilus influenzae Rd
uaacugugugauuuauuua

SEQ ID NO: 708378 - RNA, 16 nt, Haemophilus influenzae Rd
uaacuuaguaaggcac

SEQ ID NO: 708379 - RNA, 17 nt, Haemophilus influenzae Rd
uaacuuaugaauaauaa

SEQ ID NO: 708380 - RNA, 17 nt, Haemophilus influenzae Rd
uaacuucaaccacuuca

SEQ ID NO: 708381 - RNA, 21 nt, Haemophilus influenzae Rd
uaagaauuaccgcacuuuaaa

SEQ ID NO: 708382 - RNA, 21 nt, Haemophilus influenzae Rd
uaagaaguuaucauuugaauu

SEQ ID NO: 708383 - RNA, 15 nt, Haemophilus influenzae Rd
uaagacuuucaagca

SEQ ID NO: 708384 - RNA, 20 nt, Haemophilus influenzae Rd
uaagacaccugcaagugcgg

SEQ ID NO: 708385 - RNA, 16 nt, Haemophilus influenzae Rd
uaagagaggagaaaua

SEQ ID NO: 708386 - RNA, 22 nt, Haemophilus influenzae Rd
uaagagaggagaaauaaucucu

SEQ ID NO: 708387 - RNA, 21 nt, Haemophilus influenzae Rd
uaagagcauauucguagaugu

SEQ ID NO: 708388 - RNA, 21 nt, Haemophilus influenzae Rd
uaagauaaguggggaaaaaua

SEQ ID NO: 708389 - RNA, 20 nt, Haemophilus influenzae Rd
uaagauaaauuuaaaggacu

SEQ ID NO: 708390 - RNA, 17 nt, Haemophilus influenzae Rd
uaagauaauaaaugcua

SEQ ID NO: 708391 - RNA, 20 nt, Haemophilus influenzae Rd
uaagauaaacgcauagaaau

SEQ ID NO: 708392 - RNA, 15 nt, Haemophilus influenzae Rd
uaagaugauaaauuc

SEQ ID NO: 708393 - RNA, 22 nt, Haemophilus influenzae Rd
uaagaucuucuacuguuaauuu

SEQ ID NO: 708394 - RNA, 15 nt, Haemophilus influenzae Rd
uaagauguuguaaaa

SEQ ID NO: 708395 - RNA, 22 nt, Haemophilus influenzae Rd
uaagauguuguaaaaucucuau

SEQ ID NO: 708396 - RNA, 16 nt, Haemophilus influenzae Rd
uaagauggcuauuuaa

SEQ ID NO: 708397 - RNA, 23 nt, Haemophilus influenzae Rd
uaagauuacccacuaaguauuaa

SEQ ID NO: 708398 - RNA, 17 nt, Haemophilus influenzae Rd
uaagcaauaauuucauu

SEQ ID NO: 708399 - RNA, 18 nt, Haemophilus influenzae Rd
uaagcaauagauucuaag

SEQ ID NO: 708400 - RNA, 14 nt, Haemophilus influenzae Rd
uaagcaaagaaauu

SEQ ID NO: 708401 - RNA, 22 nt, Haemophilus influenzae Rd
uaagcaaaaacacguuuugcac

SEQ ID NO: 708402 - RNA, 23 nt, Haemophilus influenzae Rd
uaagauuuuugauaaaaaagaaa

SEQ ID NO: 708403 - RNA, 12 nt, Haemophilus influenzae Rd
uaagauuuuugg

SEQ ID NO: 708404 - RNA, 17 nt, Haemophilus influenzae Rd
uaagauuuuuggcugca

SEQ ID NO: 708405 - RNA, 14 nt, Haemophilus influenzae Rd
uaagcauaaaagug

SEQ ID NO: 708406 - RNA, 21 nt, Haemophilus influenzae Rd
uaagcauccaucgacauacaa

SEQ ID NO: 708407 - RNA, 14 nt, Haemophilus influenzae Rd
uaagcaaucuugcc

SEQ ID NO: 708408 - RNA, 13 nt, Haemophilus influenzae Rd
uaagcaauuuauu

SEQ ID NO: 708409 - RNA, 19 nt, Haemophilus influenzae Rd
uaagcaccuucaauauagg

SEQ ID NO: 708410 - RNA, 15 nt, Haemophilus influenzae Rd
uaagcauuaaaaauu

SEQ ID NO: 708411 - RNA, 13 nt, Haemophilus influenzae Rd
uaagccaaauaau

SEQ ID NO: 708412 - RNA, 22 nt, Haemophilus influenzae Rd
uaagccacucuaaguuuaagug

SEQ ID NO: 708413 - RNA, 18 nt, Haemophilus influenzae Rd
uaagcccugcguuauauu

SEQ ID NO: 708414 - RNA, 21 nt, Haemophilus influenzae Rd
uaagcccccacgcgacuaaag

SEQ ID NO: 708415 - RNA, 14 nt, Haemophilus influenzae Rd
uaagcccaacuuaa

SEQ ID NO: 708416 - RNA, 15 nt, Haemophilus influenzae Rd
uaagccauuggaaaa

SEQ ID NO: 708417 - RNA, 14 nt, Haemophilus influenzae Rd
uaagccauugugau

SEQ ID NO: 708418 - RNA, 17 nt, Haemophilus influenzae Rd
uaagcugugguaaaaau

SEQ ID NO: 708419 - RNA, 18 nt, Haemophilus influenzae Rd
uaagcugugguaaaaaua

SEQ ID NO: 708420 - RNA, 15 nt, Haemophilus influenzae Rd
uaagcucucuacuaa

SEQ ID NO: 708421 - RNA, 20 nt, Haemophilus influenzae Rd
uaagcuaucgucaaauuuaa

SEQ ID NO: 708422 - RNA, 21 nt, Haemophilus influenzae Rd
uaagcuaucgucaaauuuaaa

SEQ ID NO: 708423 - RNA, 19 nt, Haemophilus influenzae Rd
uaagcuauuguuauagaaa

SEQ ID NO: 708424 - RNA, 16 nt, Haemophilus influenzae Rd
uaagcuuuugaguuuu

SEQ ID NO: 708425 - RNA, 19 nt, Haemophilus influenzae Rd
uaagcuuuuuuuaaucaca

SEQ ID NO: 708426 - RNA, 15 nt, Haemophilus influenzae Rd
uaaggaaauugcagg

SEQ ID NO: 708427 - RNA, 22 nt, Haemophilus influenzae Rd
uaagcuuaauauguucuuuguu

SEQ ID NO: 708428 - RNA, 12 nt, Haemophilus influenzae Rd
uaagcuuuucua

SEQ ID NO: 708429 - RNA, 16 nt, Haemophilus influenzae Rd
uaagcuuuucuagcaa

SEQ ID NO: 708430 - RNA, 18 nt, Haemophilus influenzae Rd
uaagcguucguuaucauu

SEQ ID NO: 708431 - RNA, 17 nt, Haemophilus influenzae Rd
uaagcuaaguacaaaag

SEQ ID NO: 708432 - RNA, 15 nt, Haemophilus influenzae Rd
uaagccuugcauaau

SEQ ID NO: 708433 - RNA, 14 nt, Haemophilus influenzae Rd
uaagccuuuucaua

SEQ ID NO: 708434 - RNA, 20 nt, Haemophilus influenzae Rd
uaagccgccugauguuugag

SEQ ID NO: 708435 - RNA, 15 nt, Haemophilus influenzae Rd
uaagccgcaccaaua

SEQ ID NO: 708436 - RNA, 16 nt, Haemophilus influenzae Rd
uaagccgcaccaauaa

SEQ ID NO: 708437 - RNA, 21 nt, Haemophilus influenzae Rd
uaagccuguuaugcuuuauuc

SEQ ID NO: 708438 - RNA, 18 nt, Haemophilus influenzae Rd
uaagccgcuauuucacuc

SEQ ID NO: 708439 - RNA, 22 nt, Haemophilus influenzae Rd
uaagccguguucuagugcaaca

SEQ ID NO: 708440 - RNA, 14 nt, Haemophilus influenzae Rd
uaaucuuaaauaau

SEQ ID NO: 708441 - RNA, 15 nt, Haemophilus influenzae Rd
uaaucugauaaauuu

SEQ ID NO: 708442 - RNA, 18 nt, Haemophilus influenzae Rd
uaaucugauaaauuuugu

SEQ ID NO: 708443 - RNA, 15 nt, Haemophilus influenzae Rd
uaaucugauuauucu

SEQ ID NO: 708444 - RNA, 18 nt, Haemophilus influenzae Rd
uaaucugauugagaaaau

SEQ ID NO: 708445 - RNA, 15 nt, Haemophilus influenzae Rd
uaaucucccaaagaa

SEQ ID NO: 708446 - RNA, 15 nt, Haemophilus influenzae Rd
uaaucguccaaagaa

SEQ ID NO: 708447 - RNA, 18 nt, Haemophilus influenzae Rd
uaaucguuaccaagaaac

SEQ ID NO: 708448 - RNA, 23 nt, Haemophilus influenzae Rd
uaaucguuuaggaauuuaugguu

SEQ ID NO: 708449 - RNA, 17 nt, Haemophilus influenzae Rd
uaaucuaaaaaaccuug

SEQ ID NO: 708450 - RNA, 21 nt, Haemophilus influenzae Rd
uaaucuaaacuuguuaaauaa

SEQ ID NO: 708451 - RNA, 12 nt, Haemophilus influenzae Rd
uaaucuaauucu

SEQ ID NO: 708452 - RNA, 13 nt, Haemophilus influenzae Rd
uaaucuacaaaac

SEQ ID NO: 708453 - RNA, 23 nt, Haemophilus influenzae Rd
uaaucuacaaaacauaauaaaau

SEQ ID NO: 708454 - RNA, 16 nt, Haemophilus influenzae Rd
uaaucuauuucuuuga

SEQ ID NO: 708455 - RNA, 20 nt, Haemophilus influenzae Rd
uaaucgaucuuuuuuuuguu

SEQ ID NO: 708456 - RNA, 14 nt, Haemophilus influenzae Rd
uaauccauuuugaa

SEQ ID NO: 708457 - RNA, 15 nt, Haemophilus influenzae Rd
uaaucgccccaaaag

SEQ ID NO: 708458 - RNA, 17 nt, Haemophilus influenzae Rd
uaaucgcccuauuaaaa

SEQ ID NO: 708459 - RNA, 17 nt, Haemophilus influenzae Rd
uaaucgcauuguuuuau

SEQ ID NO: 708460 - RNA, 15 nt, Haemophilus influenzae Rd
uaaucgccaaaauca

SEQ ID NO: 708461 - RNA, 20 nt, Haemophilus influenzae Rd
uaaucgccaaaaucaucaca

SEQ ID NO: 708462 - RNA, 21 nt, Haemophilus influenzae Rd
uaaucguagaaaucaaaaaug

SEQ ID NO: 708463 - RNA, 15 nt, Haemophilus influenzae Rd
uaaucggcacaagac

SEQ ID NO: 708464 - RNA, 19 nt, Haemophilus influenzae Rd
uaauagaauuuugcaagcc

SEQ ID NO: 708465 - RNA, 15 nt, Haemophilus influenzae Rd
uaauagacugaaaaa

SEQ ID NO: 708466 - RNA, 17 nt, Haemophilus influenzae Rd
uaauagacugaaaaaag

SEQ ID NO: 708467 - RNA, 19 nt, Haemophilus influenzae Rd
uaauaugccaaauaaaauu

SEQ ID NO: 708468 - RNA, 15 nt, Haemophilus influenzae Rd
uaauauguaauauuu

SEQ ID NO: 708469 - RNA, 13 nt, Haemophilus influenzae Rd
uaauauuaaagaa

SEQ ID NO: 708470 - RNA, 16 nt, Haemophilus influenzae Rd
uaauauuaaagaaaau

SEQ ID NO: 708471 - RNA, 16 nt, Haemophilus influenzae Rd
uaauauuucuucauuu

SEQ ID NO: 708472 - RNA, 18 nt, Haemophilus influenzae Rd
uaauauuaucgaauagau

SEQ ID NO: 708473 - RNA, 23 nt, Haemophilus influenzae Rd
uaauauuuuuacuccuauuagua

SEQ ID NO: 708474 - RNA, 14 nt, Haemophilus influenzae Rd
uaauauuuuugcca

SEQ ID NO: 708475 - RNA, 17 nt, Haemophilus influenzae Rd
uaauauuucuuuuugau

SEQ ID NO: 708476 - RNA, 12 nt, Haemophilus influenzae Rd
uaaucaaaaaug

SEQ ID NO: 708477 - RNA, 15 nt, Haemophilus influenzae Rd
uaaucaaauaaaaua

SEQ ID NO: 708478 - RNA, 22 nt, Haemophilus influenzae Rd
uaaucaaauaaaauauuuuuua

SEQ ID NO: 708479 - RNA, 17 nt, Haemophilus influenzae Rd
uaaucaaacuuuuagaa

SEQ ID NO: 708480 - RNA, 16 nt, Haemophilus influenzae Rd
uaaucaaaucuuugau

SEQ ID NO: 708481 - RNA, 19 nt, Haemophilus influenzae Rd
uaaucacaaagcuuagucc

SEQ ID NO: 708482 - RNA, 14 nt, Haemophilus influenzae Rd
uaaucacaaauauu

SEQ ID NO: 708483 - RNA, 16 nt, Haemophilus influenzae Rd
uaaucacaacaaacca

SEQ ID NO: 708484 - RNA, 13 nt, Haemophilus influenzae Rd
uaaucaauuugau

SEQ ID NO: 708485 - RNA, 17 nt, Haemophilus influenzae Rd
uaaucaauuaaagaaau

SEQ ID NO: 708486 - RNA, 12 nt, Haemophilus influenzae Rd
uaaucaauaaga

SEQ ID NO: 708487 - RNA, 17 nt, Haemophilus influenzae Rd
uaaucagugauuauauu

SEQ ID NO: 708488 - RNA, 14 nt, Haemophilus influenzae Rd
uaaucauaaaaaaa

SEQ ID NO: 708489 - RNA, 16 nt, Haemophilus influenzae Rd
uaaucauaucuaacau

SEQ ID NO: 708490 - RNA, 19 nt, Haemophilus influenzae Rd
uaaucauaucuaacauagg

SEQ ID NO: 708491 - RNA, 20 nt, Haemophilus influenzae Rd
uaauugcuaccauuuaucuu

SEQ ID NO: 708492 - RNA, 14 nt, Haemophilus influenzae Rd
uaauuggaaauaau

SEQ ID NO: 708493 - RNA, 18 nt, Haemophilus influenzae Rd
uaauuggaaauaauauuc

SEQ ID NO: 708494 - RNA, 20 nt, Haemophilus influenzae Rd
uaauuggaaauaauauucaa

SEQ ID NO: 708495 - RNA, 21 nt, Haemophilus influenzae Rd
uaauugggucguuagcucagu

SEQ ID NO: 708496 - RNA, 14 nt, Haemophilus influenzae Rd
uaauuggacaagaa

SEQ ID NO: 708497 - RNA, 17 nt, Haemophilus influenzae Rd
uaauuggacaagaaaua

SEQ ID NO: 708498 - RNA, 21 nt, Haemophilus influenzae Rd
uaauuggacaagaaauaauaa

SEQ ID NO: 708499 - RNA, 19 nt, Haemophilus influenzae Rd
uaauugcccaauaaaagua

SEQ ID NO: 708500 - RNA, 16 nt, Haemophilus influenzae Rd
uaauugauuuaaaaau

SEQ ID NO: 708501 - RNA, 18 nt, Haemophilus influenzae Rd
uaauugauuuucagaaag

SEQ ID NO: 708502 - RNA, 20 nt, Haemophilus influenzae Rd
uaauugcaauguauucuguu

SEQ ID NO: 708503 - RNA, 18 nt, Haemophilus influenzae Rd
uaauugauucgauaaauu

SEQ ID NO: 708504 - RNA, 15 nt, Haemophilus influenzae Rd
uaauugaguguggug

SEQ ID NO: 708505 - RNA, 19 nt, Haemophilus influenzae Rd
uaauugauggcgugaaaua

SEQ ID NO: 708506 - RNA, 22 nt, Haemophilus influenzae Rd
uaauugaagcaauugaaacuaa

SEQ ID NO: 708507 - RNA, 12 nt, Haemophilus influenzae Rd
uaauucuuuuug

SEQ ID NO: 708508 - RNA, 12 nt, Haemophilus influenzae Rd
uaauucuugcca

SEQ ID NO: 708509 - RNA, 14 nt, Haemophilus influenzae Rd
uaauucuugucuuu

SEQ ID NO: 708510 - RNA, 14 nt, Haemophilus influenzae Rd
uaauuaggacaaua

SEQ ID NO: 708511 - RNA, 20 nt, Haemophilus influenzae Rd
uaauuaggacaauauuuacu

SEQ ID NO: 708512 - RNA, 19 nt, Haemophilus influenzae Rd
uaauuagccgugauaacgc

SEQ ID NO: 708513 - RNA, 14 nt, Haemophilus influenzae Rd
uaauuagaauaaca

SEQ ID NO: 708514 - RNA, 18 nt, Haemophilus influenzae Rd
uaauuaguuauacuuaau

SEQ ID NO: 708515 - RNA, 14 nt, Haemophilus influenzae Rd
uaauuaguuugauu

SEQ ID NO: 708516 - RNA, 15 nt, Haemophilus influenzae Rd
uaauuauaaaauagc

SEQ ID NO: 708517 - RNA, 17 nt, Haemophilus influenzae Rd
uaauuauagaaaagaca

SEQ ID NO: 708518 - RNA, 21 nt, Haemophilus influenzae Rd
uaauuauagaaaagacaauaa

SEQ ID NO: 708519 - RNA, 14 nt, Haemophilus influenzae Rd
uaauucaucaaaau

SEQ ID NO: 708520 - RNA, 15 nt, Haemophilus influenzae Rd
uaauucaucaaaauu

SEQ ID NO: 708521 - RNA, 16 nt, Haemophilus influenzae Rd
uaauucauauuggaaa

SEQ ID NO: 708522 - RNA, 17 nt, Haemophilus influenzae Rd
uaauucauuagaaaguu

SEQ ID NO: 708523 - RNA, 12 nt, Haemophilus influenzae Rd
uaauucuuccaa

SEQ ID NO: 708524 - RNA, 19 nt, Haemophilus influenzae Rd
uaauucuucgaugcuuuuu

SEQ ID NO: 708525 - RNA, 22 nt, Haemophilus influenzae Rd
uaauucuucgaugcuuuuucau

SEQ ID NO: 708526 - RNA, 14 nt, Haemophilus influenzae Rd
uaauuccuaaaaua

SEQ ID NO: 708527 - RNA, 21 nt, Haemophilus influenzae Rd
uaauuccgacuaaaaccaaga

SEQ ID NO: 708528 - RNA, 14 nt, Haemophilus influenzae Rd
uaauguguucuguu

SEQ ID NO: 708529 - RNA, 14 nt, Haemophilus influenzae Rd
uaauguuaaaucua

SEQ ID NO: 708530 - RNA, 17 nt, Haemophilus influenzae Rd
uaauguuaauuuuaaau

SEQ ID NO: 708531 - RNA, 18 nt, Haemophilus influenzae Rd
uaauguuauuaaauauag

SEQ ID NO: 708532 - RNA, 20 nt, Haemophilus influenzae Rd
uaauguucccuauaaauaaa

SEQ ID NO: 708533 - RNA, 22 nt, Haemophilus influenzae Rd
uaaugucuuuaggauuguugau

SEQ ID NO: 708534 - RNA, 21 nt, Haemophilus influenzae Rd
uaauguggugcuguuuggcaa

SEQ ID NO: 708535 - RNA, 23 nt, Haemophilus influenzae Rd
uaauguggugcuguuuggcaaug

SEQ ID NO: 708536 - RNA, 21 nt, Haemophilus influenzae Rd
uaauuaagagaggagaaauaa

SEQ ID NO: 708537 - RNA, 15 nt, Haemophilus influenzae Rd
uaauuaagauaauuu

SEQ ID NO: 708538 - RNA, 13 nt, Haemophilus influenzae Rd
uaauuacuuuuau

SEQ ID NO: 708539 - RNA, 17 nt, Haemophilus influenzae Rd
uaauuacuuuuauaucu

SEQ ID NO: 708540 - RNA, 12 nt, Haemophilus influenzae Rd
uaauuaaauuaa

SEQ ID NO: 708541 - RNA, 14 nt, Haemophilus influenzae Rd
uaauuaacugaaaa

SEQ ID NO: 708542 - RNA, 23 nt, Haemophilus influenzae Rd
uaauuaaguuugagcaaaucaaa

SEQ ID NO: 708543 - RNA, 14 nt, Haemophilus influenzae Rd
uaauuaauaaaaaa

SEQ ID NO: 708544 - RNA, 18 nt, Haemophilus influenzae Rd
uaauuaacgcucaaaaau

SEQ ID NO: 708545 - RNA, 23 nt, Haemophilus influenzae Rd
uaauuaacgcucaaaaauuucag

SEQ ID NO: 708546 - RNA, 20 nt, Haemophilus influenzae Rd
uaauuaacgggcuuaaacuu

SEQ ID NO: 708547 - RNA, 15 nt, Haemophilus influenzae Rd
uaauuaaagucagau

SEQ ID NO: 708548 - RNA, 16 nt, Haemophilus influenzae Rd
uaauuaaauaaacauu

SEQ ID NO: 708549 - RNA, 19 nt, Haemophilus influenzae Rd
uaauuaacaaauaauuauu

SEQ ID NO: 708550 - RNA, 18 nt, Haemophilus influenzae Rd
uaauuaaagccacauaau

SEQ ID NO: 708551 - RNA, 14 nt, Haemophilus influenzae Rd
uaauggcaauuucc

SEQ ID NO: 708552 - RNA, 20 nt, Haemophilus influenzae Rd
uaaugcuuuaaauuguuuaa

SEQ ID NO: 708553 - RNA, 22 nt, Haemophilus influenzae Rd
uaaugcuuuaaauuguuuaaug

SEQ ID NO: 708554 - RNA, 13 nt, Haemophilus influenzae Rd
uaaugcuuuaauu

SEQ ID NO: 708555 - RNA, 15 nt, Haemophilus influenzae Rd
uaaugcuuuauuuaa

SEQ ID NO: 708556 - RNA, 17 nt, Haemophilus influenzae Rd
uaaugcuuuauuuaaau

SEQ ID NO: 708557 - RNA, 21 nt, Haemophilus influenzae Rd
uaaugcuuuauuuaaauuaaa

SEQ ID NO: 708558 - RNA, 19 nt, Haemophilus influenzae Rd
uaauguagagcucaauuau

SEQ ID NO: 708559 - RNA, 21 nt, Haemophilus influenzae Rd
uaauguagagcucaauuauuu

SEQ ID NO: 708560 - RNA, 15 nt, Haemophilus influenzae Rd
uaauguaaacaaaaa

SEQ ID NO: 708561 - RNA, 23 nt, Haemophilus influenzae Rd
uaaucuuuaaaauguaaaaaauc

SEQ ID NO: 708562 - RNA, 18 nt, Haemophilus influenzae Rd
uaaucuuuaaauuuugcu

SEQ ID NO: 708563 - RNA, 15 nt, Haemophilus influenzae Rd
uaaucuugugcugug

SEQ ID NO: 708564 - RNA, 14 nt, Haemophilus influenzae Rd
uaaucuucccauuu

SEQ ID NO: 708565 - RNA, 11 nt, Haemophilus influenzae Rd
uaaucuucuuc

SEQ ID NO: 708566 - RNA, 16 nt, Haemophilus influenzae Rd
uaaugcuucuaauccc

SEQ ID NO: 708567 - RNA, 19 nt, Haemophilus influenzae Rd
uaaugcuucuaaucccauu

SEQ ID NO: 708568 - RNA, 13 nt, Haemophilus influenzae Rd
uaaugcuguuuaa

SEQ ID NO: 708569 - RNA, 20 nt, Haemophilus influenzae Rd
uaaucuuucacugcauuuuc

SEQ ID NO: 708570 - RNA, 18 nt, Haemophilus influenzae Rd
uaaugcugaguaccaaaa

SEQ ID NO: 708571 - RNA, 22 nt, Haemophilus influenzae Rd
uaaugcugaguaccaaaaggug

SEQ ID NO: 708572 - RNA, 21 nt, Haemophilus influenzae Rd
uaaggcuaacucugguucaaa

SEQ ID NO: 708573 - RNA, 23 nt, Haemophilus influenzae Rd
uaaggcguaaaacuauuaucuac

SEQ ID NO: 708574 - RNA, 22 nt, Haemophilus influenzae Rd
uaaggcgagaucuugauaauag

SEQ ID NO: 708575 - RNA, 15 nt, Haemophilus influenzae Rd
uaaggguaucacaaa

SEQ ID NO: 708576 - RNA, 16 nt, Haemophilus influenzae Rd
uaagggacuucaggag

SEQ ID NO: 708577 - RNA, 16 nt, Haemophilus influenzae Rd
uaaggcuuuaccuuuu

SEQ ID NO: 708578 - RNA, 16 nt, Haemophilus influenzae Rd
uaaggcuuuucuuuua

SEQ ID NO: 708579 - RNA, 13 nt, Haemophilus influenzae Rd
uaaggacuaaacu

SEQ ID NO: 708580 - RNA, 15 nt, Haemophilus influenzae Rd
uaaggaccaagcaau

SEQ ID NO: 708581 - RNA, 21 nt, Haemophilus influenzae Rd
uaaggacgaaggauaaauuga

SEQ ID NO: 708582 - RNA, 16 nt, Haemophilus influenzae Rd
uaaggaucuuguaaag

SEQ ID NO: 708583 - RNA, 21 nt, Haemophilus influenzae Rd
uaaggauuuauuuaacaauga

SEQ ID NO: 708584 - RNA, 18 nt, Haemophilus influenzae Rd
uaaggauuucuuaugaaa

SEQ ID NO: 708585 - RNA, 14 nt, Haemophilus influenzae Rd
uaaguaaauauuuu

SEQ ID NO: 708586 - RNA, 23 nt, Haemophilus influenzae Rd
uaagguuuggacaccuuuuuccu

SEQ ID NO: 708587 - RNA, 15 nt, Haemophilus influenzae Rd
uaaguaaaaccauua

SEQ ID NO: 708588 - RNA, 19 nt, Haemophilus influenzae Rd
uaagguuaugccaaugcua

SEQ ID NO: 708589 - RNA, 17 nt, Haemophilus influenzae Rd
uaagguuuauagaugaa

SEQ ID NO: 708590 - RNA, 16 nt, Haemophilus influenzae Rd
uaagguuaaauucacu

SEQ ID NO: 708591 - RNA, 22 nt, Haemophilus influenzae Rd
uaaggugcagaaaacucgacuu

SEQ ID NO: 708592 - RNA, 21 nt, Haemophilus influenzae Rd
uaaggugcagauuaauuauau

SEQ ID NO: 708593 - RNA, 17 nt, Haemophilus influenzae Rd
uaaggguauacuuuauu

SEQ ID NO: 708594 - RNA, 19 nt, Haemophilus influenzae Rd
uaagguaauauguaauauu

SEQ ID NO: 708595 - RNA, 16 nt, Haemophilus influenzae Rd
uaaguaagucaagcua

SEQ ID NO: 708596 - RNA, 22 nt, Haemophilus influenzae Rd
uaaguaagucaagcuaaucucu

SEQ ID NO: 708597 - RNA, 19 nt, Haemophilus influenzae Rd
uaaguaaggguaucacaaa

SEQ ID NO: 708598 - RNA, 14 nt, Haemophilus influenzae Rd
uaaguaauacauuu

SEQ ID NO: 708599 - RNA, 18 nt, Haemophilus influenzae Rd
uaaguagcguaaaccuug

SEQ ID NO: 708600 - RNA, 13 nt, Haemophilus influenzae Rd
uaaguaguuacca

SEQ ID NO: 708601 - RNA, 17 nt, Haemophilus influenzae Rd
uaaguauaacuuaaauc

SEQ ID NO: 708602 - RNA, 17 nt, Haemophilus influenzae Rd
uaaguacgauaaacacu

SEQ ID NO: 708603 - RNA, 17 nt, Haemophilus influenzae Rd
uaagugcgguaaaaaaa

SEQ ID NO: 708604 - RNA, 21 nt, Haemophilus influenzae Rd
uaagugcgguccguuuucaau

SEQ ID NO: 708605 - RNA, 13 nt, Haemophilus influenzae Rd
uaaguguuuacua

SEQ ID NO: 708606 - RNA, 21 nt, Haemophilus influenzae Rd
uaaguggggaaaaauauuaaa

SEQ ID NO: 708607 - RNA, 12 nt, Haemophilus influenzae Rd
uaagucuucuuu

SEQ ID NO: 708608 - RNA, 19 nt, Haemophilus influenzae Rd
uaagugauaaguauaacuu

SEQ ID NO: 708609 - RNA, 18 nt, Haemophilus influenzae Rd
uaagucagcauaaacaaa

SEQ ID NO: 708610 - RNA, 20 nt, Haemophilus influenzae Rd
uaagucaggaauaaaagauu

SEQ ID NO: 708611 - RNA, 15 nt, Haemophilus influenzae Rd
uaaguauagcuuuuu

SEQ ID NO: 708612 - RNA, 19 nt, Haemophilus influenzae Rd
uaaguaugccauaaaauag

SEQ ID NO: 708613 - RNA, 19 nt, Haemophilus influenzae Rd
uaagucuauuacuaaaauu

SEQ ID NO: 708614 - RNA, 21 nt, Haemophilus influenzae Rd
uaagucuauuacuaaaauucu

SEQ ID NO: 708615 - RNA, 17 nt, Haemophilus influenzae Rd
uaagucgugaucugcau

SEQ ID NO: 708616 - RNA, 22 nt, Haemophilus influenzae Rd
uaaguuaccgcuucuuccuguu

SEQ ID NO: 708617 - RNA, 12 nt, Haemophilus influenzae Rd
uaaguuaaaagu

SEQ ID NO: 708618 - RNA, 15 nt, Haemophilus influenzae Rd
uaaguuaaaccaaca

SEQ ID NO: 708619 - RNA, 23 nt, Haemophilus influenzae Rd
uaaguucagaaagagacucuguu

SEQ ID NO: 708620 - RNA, 18 nt, Haemophilus influenzae Rd
uaaguucaaauuucuuca

SEQ ID NO: 708621 - RNA, 20 nt, Haemophilus influenzae Rd
uaaguucaacaccuaaauga

SEQ ID NO: 708622 - RNA, 21 nt, Haemophilus influenzae Rd
uaaguuauuuauauaauuuaa

SEQ ID NO: 708623 - RNA, 22 nt, Haemophilus influenzae Rd
uaaguuauuuauauaauuuaac

SEQ ID NO: 708624 - RNA, 13 nt, Haemophilus influenzae Rd
uaaguucuaaaau

SEQ ID NO: 708625 - RNA, 19 nt, Haemophilus influenzae Rd
uaaguugggcuuauuuguu

SEQ ID NO: 708626 - RNA, 16 nt, Haemophilus influenzae Rd
uaaguuggcugaaagc

SEQ ID NO: 708627 - RNA, 13 nt, Haemophilus influenzae Rd
uaauaaaaaauaa

SEQ ID NO: 708628 - RNA, 13 nt, Haemophilus influenzae Rd
uaauaaaaaauac

SEQ ID NO: 708629 - RNA, 17 nt, Haemophilus influenzae Rd
uaauaaaacaaauguaa

SEQ ID NO: 708630 - RNA, 21 nt, Haemophilus influenzae Rd
uaauaaaacaaauguaaaaca

SEQ ID NO: 708631 - RNA, 14 nt, Haemophilus influenzae Rd
uaauaaaaauuaaa

SEQ ID NO: 708632 - RNA, 22 nt, Haemophilus influenzae Rd
uaauaaaaccucagaagaaauu

SEQ ID NO: 708633 - RNA, 20 nt, Haemophilus influenzae Rd
uaauaaaaucacgaauugau

SEQ ID NO: 708634 - RNA, 23 nt, Haemophilus influenzae Rd
uaauaaacggaguuuuccauuug

SEQ ID NO: 708635 - RNA, 19 nt, Haemophilus influenzae Rd
uaauaaacggauugcauau

SEQ ID NO: 708636 - RNA, 17 nt, Haemophilus influenzae Rd
uaauaaaccuuuuucua

SEQ ID NO: 708637 - RNA, 23 nt, Haemophilus influenzae Rd
uaauaaaccuuuuucuaacacaa

SEQ ID NO: 708638 - RNA, 14 nt, Haemophilus influenzae Rd
uaauaaaccaacau

SEQ ID NO: 708639 - RNA, 20 nt, Haemophilus influenzae Rd
uaauaaaccaacauacauua

SEQ ID NO: 708640 - RNA, 13 nt, Haemophilus influenzae Rd
uaauaaaccaaua

SEQ ID NO: 708641 - RNA, 14 nt, Haemophilus influenzae Rd
uaauaaaccaauaa

SEQ ID NO: 708642 - RNA, 21 nt, Haemophilus influenzae Rd
uaauaaaccaauaagauagaa

SEQ ID NO: 708643 - RNA, 23 nt, Haemophilus influenzae Rd
uaauaaaccaauaagauagaaau

SEQ ID NO: 708644 - RNA, 16 nt, Haemophilus influenzae Rd
uaauaaaauguuuaua

SEQ ID NO: 708645 - RNA, 12 nt, Haemophilus influenzae Rd
uaauaaaauuua

SEQ ID NO: 708646 - RNA, 13 nt, Haemophilus influenzae Rd
uaauaaaauuuau

SEQ ID NO: 708647 - RNA, 14 nt, Haemophilus influenzae Rd
uaauaaacauacau

SEQ ID NO: 708648 - RNA, 11 nt, Haemophilus influenzae Rd
uaauaaagcgu

SEQ ID NO: 708649 - RNA, 20 nt, Haemophilus influenzae Rd
uaauaaagcuacuaaaaauu

SEQ ID NO: 708650 - RNA, 20 nt, Haemophilus influenzae Rd
uaauaaagcuccuugaauau

SEQ ID NO: 708651 - RNA, 15 nt, Haemophilus influenzae Rd
uaauaaaguaaaaua

SEQ ID NO: 708652 - RNA, 12 nt, Haemophilus influenzae Rd
uaauaaauauaa

SEQ ID NO: 708653 - RNA, 14 nt, Haemophilus influenzae Rd
uaauaaauauaauu

SEQ ID NO: 708654 - RNA, 17 nt, Haemophilus influenzae Rd
uaauaaauauuauuaaa

SEQ ID NO: 708655 - RNA, 12 nt, Haemophilus influenzae Rd
uaauaaaucaag

SEQ ID NO: 708656 - RNA, 12 nt, Haemophilus influenzae Rd
uaauaaauauua

SEQ ID NO: 708657 - RNA, 24 nt, Haemophilus influenzae Rd
uaauaaauccuucaggauaaaaca

SEQ ID NO: 708658 - RNA, 23 nt, Haemophilus influenzae Rd
uaauaaauuagccccaaauuacu

SEQ ID NO: 708659 - RNA, 19 nt, Haemophilus influenzae Rd
uaauaacaagcgaaaaacg

SEQ ID NO: 708660 - RNA, 13 nt, Haemophilus influenzae Rd
uaauaacauuccg

SEQ ID NO: 708661 - RNA, 19 nt, Haemophilus influenzae Rd
uaauaacauagaaaucacu

SEQ ID NO: 708662 - RNA, 19 nt, Haemophilus influenzae Rd
uaauaagccauuuucugca

SEQ ID NO: 708663 - RNA, 20 nt, Haemophilus influenzae Rd
uaauaagccauuuucugcau

SEQ ID NO: 708664 - RNA, 18 nt, Haemophilus influenzae Rd
uaauaagccuugcauaau

SEQ ID NO: 708665 - RNA, 20 nt, Haemophilus influenzae Rd
uaauaacguguaaauugcuu

SEQ ID NO: 708666 - RNA, 19 nt, Haemophilus influenzae Rd
uaauaacugaauaauuucc

SEQ ID NO: 708667 - RNA, 13 nt, Haemophilus influenzae Rd
uaauaauaaaaag

SEQ ID NO: 708668 - RNA, 20 nt, Haemophilus influenzae Rd
uaauaaggcuugcacaauaa

SEQ ID NO: 708669 - RNA, 22 nt, Haemophilus influenzae Rd
uaauaaggcuugcacaauaauc

SEQ ID NO: 708670 - RNA, 23 nt, Haemophilus influenzae Rd
uaauaagcuaucgucaaauuuaa

SEQ ID NO: 708671 - RNA, 14 nt, Haemophilus influenzae Rd
uaauaaucaaaucu

SEQ ID NO: 708672 - RNA, 15 nt, Haemophilus influenzae Rd
uaauaaucaaaucuu

SEQ ID NO: 708673 - RNA, 21 nt, Haemophilus influenzae Rd
uaauaaucaauuaaugggcua

SEQ ID NO: 708674 - RNA, 13 nt, Haemophilus influenzae Rd
uaauaaucacaac

SEQ ID NO: 708675 - RNA, 17 nt, Haemophilus influenzae Rd
uaauaaucacaacaaac

SEQ ID NO: 708676 - RNA, 21 nt, Haemophilus influenzae Rd
uaauaauccucuuuaaaauua

SEQ ID NO: 708677 - RNA, 13 nt, Haemophilus influenzae Rd
uaauaaucgaaaa

SEQ ID NO: 708678 - RNA, 15 nt, Haemophilus influenzae Rd
uaauaaucgaaaaag

SEQ ID NO: 708679 - RNA, 16 nt, Haemophilus influenzae Rd
uaauaaucgcaaugcc

SEQ ID NO: 708680 - RNA, 15 nt, Haemophilus influenzae Rd
uaauaaucuaaucca

SEQ ID NO: 708681 - RNA, 17 nt, Haemophilus influenzae Rd
uaauacgcggucagaaa

SEQ ID NO: 708682 - RNA, 14 nt, Haemophilus influenzae Rd
uaauaccaaaauug

SEQ ID NO: 708683 - RNA, 15 nt, Haemophilus influenzae Rd
uaauaccaauaauaa

SEQ ID NO: 708684 - RNA, 16 nt, Haemophilus influenzae Rd
uaauaccaauaauaau

SEQ ID NO: 708685 - RNA, 19 nt, Haemophilus influenzae Rd
uaauaccaauaauaauauc

SEQ ID NO: 708686 - RNA, 13 nt, Haemophilus influenzae Rd
uaauacugauacc

SEQ ID NO: 708687 - RNA, 14 nt, Haemophilus influenzae Rd
uaauacuugaccaa

SEQ ID NO: 708688 - RNA, 14 nt, Haemophilus influenzae Rd
uaauacuugcgaua

SEQ ID NO: 708689 - RNA, 21 nt, Haemophilus influenzae Rd
uaauacuuggugcaauaaaau

SEQ ID NO: 708690 - RNA, 14 nt, Haemophilus influenzae Rd
uaauagaaaacauu

SEQ ID NO: 708691 - RNA, 15 nt, Haemophilus influenzae Rd
uaauagaaaacauug

SEQ ID NO: 708692 - RNA, 13 nt, Haemophilus influenzae Rd
uaauagaaacuaa

SEQ ID NO: 708693 - RNA, 20 nt, Haemophilus influenzae Rd
uaauacuuucuuuucaauuu

SEQ ID NO: 708694 - RNA, 16 nt, Haemophilus influenzae Rd
uaauagaaaaaugcca

SEQ ID NO: 708695 - RNA, 13 nt, Haemophilus influenzae Rd
uaauacaaucugu

SEQ ID NO: 708696 - RNA, 22 nt, Haemophilus influenzae Rd
uaauacaccaauaauuaaacag

SEQ ID NO: 708697 - RNA, 22 nt, Haemophilus influenzae Rd
uaauacacgaggaacuaacgcc

SEQ ID NO: 708698 - RNA, 17 nt, Haemophilus influenzae Rd
uaauacagugcagaaaa

SEQ ID NO: 708699 - RNA, 21 nt, Haemophilus influenzae Rd
uaauacagugcagaaaauugc

SEQ ID NO: 708700 - RNA, 16 nt, Haemophilus influenzae Rd
uaauacacuuuuacuu

SEQ ID NO: 708701 - RNA, 17 nt, Haemophilus influenzae Rd
uaauacagaaauaugaa

SEQ ID NO: 708702 - RNA, 16 nt, Haemophilus influenzae Rd
uaauaaucuucuuccc

SEQ ID NO: 708703 - RNA, 21 nt, Haemophilus influenzae Rd
uaauaaugccugcauuaauaa

SEQ ID NO: 708704 - RNA, 13 nt, Haemophilus influenzae Rd
uaauaauguauuu

SEQ ID NO: 708705 - RNA, 15 nt, Haemophilus influenzae Rd
uaauaauucauuauu

SEQ ID NO: 708706 - RNA, 23 nt, Haemophilus influenzae Rd
uaauaauuguaguuagaccaucu

SEQ ID NO: 708707 - RNA, 15 nt, Haemophilus influenzae Rd
uaauaauuuaaauuu

SEQ ID NO: 708708 - RNA, 17 nt, Haemophilus influenzae Rd
uaauaauuuaaauuuau

SEQ ID NO: 708709 - RNA, 12 nt, Haemophilus influenzae Rd
uaauaauuuaaa

SEQ ID NO: 708710 - RNA, 22 nt, Haemophilus influenzae Rd
uacaaauagcuguaagauaaac

SEQ ID NO: 708711 - RNA, 15 nt, Haemophilus influenzae Rd
uacaaauacugaccu

SEQ ID NO: 708712 - RNA, 18 nt, Haemophilus influenzae Rd
uacaaauaacacagaaac

SEQ ID NO: 708713 - RNA, 22 nt, Haemophilus influenzae Rd
uacaaauaacacagaaaccaau

SEQ ID NO: 708714 - RNA, 20 nt, Haemophilus influenzae Rd
uaauugugggaaaguuggcc

SEQ ID NO: 708715 - RNA, 22 nt, Haemophilus influenzae Rd
uaauugugggaaaguuggccaa

SEQ ID NO: 708716 - RNA, 16 nt, Haemophilus influenzae Rd
uaauuguuguaaaaua

SEQ ID NO: 708717 - RNA, 16 nt, Haemophilus influenzae Rd
uaauugugcuaaauaa

SEQ ID NO: 708718 - RNA, 20 nt, Haemophilus influenzae Rd
uaauugugcuaaauaauuac

SEQ ID NO: 708719 - RNA, 15 nt, Haemophilus influenzae Rd
uacaaauuuagauaa

SEQ ID NO: 708720 - RNA, 17 nt, Haemophilus influenzae Rd
uacaaaucguaauuaaa

SEQ ID NO: 708721 - RNA, 19 nt, Haemophilus influenzae Rd
uacaaaucguaauuaaaau

SEQ ID NO: 708722 - RNA, 15 nt, Haemophilus influenzae Rd
uacaacaaaggguaa

SEQ ID NO: 708723 - RNA, 18 nt, Haemophilus influenzae Rd
uacaacaaaggguaaaua

SEQ ID NO: 708724 - RNA, 21 nt, Haemophilus influenzae Rd
uacaacaaauugugucacaua

SEQ ID NO: 708725 - RNA, 17 nt, Haemophilus influenzae Rd
uacaacgugaaguaaau

SEQ ID NO: 708726 - RNA, 18 nt, Haemophilus influenzae Rd
uacaacgugaaguaaaua

SEQ ID NO: 708727 - RNA, 17 nt, Haemophilus influenzae Rd
uacaacuaaucccacuu

SEQ ID NO: 708728 - RNA, 21 nt, Haemophilus influenzae Rd
uacaacuaaucccacuuguug

SEQ ID NO: 708729 - RNA, 18 nt, Haemophilus influenzae Rd
uacaauccuaacuuuucu

SEQ ID NO: 708730 - RNA, 22 nt, Haemophilus influenzae Rd
uacaauccuaacuuuucuucaa

SEQ ID NO: 708731 - RNA, 23 nt, Haemophilus influenzae Rd
uacaauccuaacuuuucuucaau

SEQ ID NO: 708732 - RNA, 17 nt, Haemophilus influenzae Rd
uacaaucauagaaaucc

SEQ ID NO: 708733 - RNA, 20 nt, Haemophilus influenzae Rd
uacaaucacgaucugcaaca

SEQ ID NO: 708734 - RNA, 19 nt, Haemophilus influenzae Rd
uacaauauuuauuucuaua

SEQ ID NO: 708735 - RNA, 20 nt, Haemophilus influenzae Rd
uacaauauuuauuucuauag

SEQ ID NO: 708736 - RNA, 14 nt, Haemophilus influenzae Rd
uacagauaaaucag

SEQ ID NO: 708737 - RNA, 20 nt, Haemophilus influenzae Rd
uacagccugcgauugcacca

SEQ ID NO: 708738 - RNA, 13 nt, Haemophilus influenzae Rd
uacagcaaauccu

SEQ ID NO: 708739 - RNA, 19 nt, Haemophilus influenzae Rd
uacagcaaaccaaggaauu

SEQ ID NO: 708740 - RNA, 20 nt, Haemophilus influenzae Rd
uacagaaucauuuucaccaa

SEQ ID NO: 708741 - RNA, 16 nt, Haemophilus influenzae Rd
uacagaccauugagcu

SEQ ID NO: 708742 - RNA, 13 nt, Haemophilus influenzae Rd
uacagaacaaaau

SEQ ID NO: 708743 - RNA, 15 nt, Haemophilus influenzae Rd
uacagaacaaaauaa

SEQ ID NO: 708744 - RNA, 18 nt, Haemophilus influenzae Rd
uacagaaauaugaaauuu

SEQ ID NO: 708745 - RNA, 13 nt, Haemophilus influenzae Rd
uacagaaauauua

SEQ ID NO: 708746 - RNA, 18 nt, Haemophilus influenzae Rd
uacagaaauauuauuaag

SEQ ID NO: 708747 - RNA, 17 nt, Haemophilus influenzae Rd
uacaauuuucuuuucaa

SEQ ID NO: 708748 - RNA, 21 nt, Haemophilus influenzae Rd
uacaauuuuuuucaagcaaca

SEQ ID NO: 708749 - RNA, 13 nt, Haemophilus influenzae Rd
uacacaaaaucca

SEQ ID NO: 708750 - RNA, 14 nt, Haemophilus influenzae Rd
uacacaaaauccau

SEQ ID NO: 708751 - RNA, 18 nt, Haemophilus influenzae Rd
uacacuuuaaauuuuccu

SEQ ID NO: 708752 - RNA, 12 nt, Haemophilus influenzae Rd
uacacuuucacg

SEQ ID NO: 708753 - RNA, 16 nt, Haemophilus influenzae Rd
uacacaccaucaacuu

SEQ ID NO: 708754 - RNA, 12 nt, Haemophilus influenzae Rd
uacauugcuuaa

SEQ ID NO: 708755 - RNA, 21 nt, Haemophilus influenzae Rd
uacauuugccccaacaacaua

SEQ ID NO: 708756 - RNA, 16 nt, Haemophilus influenzae Rd
uacauuucuaaaauaa

SEQ ID NO: 708757 - RNA, 19 nt, Haemophilus influenzae Rd
uacauuucuaaaauaauau

SEQ ID NO: 708758 - RNA, 18 nt, Haemophilus influenzae Rd
uacauuuacaucuaaaau

SEQ ID NO: 708759 - RNA, 18 nt, Haemophilus influenzae Rd
uaccaaaaaauucguaaa

SEQ ID NO: 708760 - RNA, 18 nt, Haemophilus influenzae Rd
uacauuuuguuucuaaau

SEQ ID NO: 708761 - RNA, 16 nt, Haemophilus influenzae Rd
uacauuaauuuuuccg

SEQ ID NO: 708762 - RNA, 13 nt, Haemophilus influenzae Rd
uacauuaaaagau

SEQ ID NO: 708763 - RNA, 14 nt, Haemophilus influenzae Rd
uacauuaaaagaua

SEQ ID NO: 708764 - RNA, 21 nt, Haemophilus influenzae Rd
uacauuaagugcguguauaua

SEQ ID NO: 708765 - RNA, 14 nt, Haemophilus influenzae Rd
uacauuauuaaaag

SEQ ID NO: 708766 - RNA, 23 nt, Haemophilus influenzae Rd
uacauucaagccuucuaaaauaa

SEQ ID NO: 708767 - RNA, 11 nt, Haemophilus influenzae Rd
uacauuauuga

SEQ ID NO: 708768 - RNA, 22 nt, Haemophilus influenzae Rd
uacauucagugguaaucauuaa

SEQ ID NO: 708769 - RNA, 17 nt, Haemophilus influenzae Rd
uacauugcuauggcaau

SEQ ID NO: 708770 - RNA, 22 nt, Haemophilus influenzae Rd
uacauugaagcgggcgaugaaa

SEQ ID NO: 708771 - RNA, 15 nt, Haemophilus influenzae Rd
uacauucccaaauaa

SEQ ID NO: 708772 - RNA, 18 nt, Haemophilus influenzae Rd
uacauucuuccgcaauuu

SEQ ID NO: 708773 - RNA, 16 nt, Haemophilus influenzae Rd
uaccaaaauuuaaaau

SEQ ID NO: 708774 - RNA, 23 nt, Haemophilus influenzae Rd
uaccaaauuccauucacuuucac

SEQ ID NO: 708775 - RNA, 20 nt, Haemophilus influenzae Rd
uaccaaaaggucuuaauagc

SEQ ID NO: 708776 - RNA, 15 nt, Haemophilus influenzae Rd
uaccaauaaucaaua

SEQ ID NO: 708777 - RNA, 18 nt, Haemophilus influenzae Rd
uaccaauauucuuuaaaa

SEQ ID NO: 708778 - RNA, 14 nt, Haemophilus influenzae Rd
uaccaauacgauaa

SEQ ID NO: 708779 - RNA, 19 nt, Haemophilus influenzae Rd
uaccaauacgauaauuaaa

SEQ ID NO: 708780 - RNA, 19 nt, Haemophilus influenzae Rd
uaccaauucaaaaaccaaa

SEQ ID NO: 708781 - RNA, 18 nt, Haemophilus influenzae Rd
uacagggcuuuauuuuug

SEQ ID NO: 708782 - RNA, 15 nt, Haemophilus influenzae Rd
uacaucacgaacuuc

SEQ ID NO: 708783 - RNA, 18 nt, Haemophilus influenzae Rd
uacauauuucaccgcaga

SEQ ID NO: 708784 - RNA, 21 nt, Haemophilus influenzae Rd
uacaucaggaggaauaaugaa

SEQ ID NO: 708785 - RNA, 17 nt, Haemophilus influenzae Rd
uacaucagguuuaauaa

SEQ ID NO: 708786 - RNA, 19 nt, Haemophilus influenzae Rd
uacaucaguaccuuuaauu

SEQ ID NO: 708787 - RNA, 21 nt, Haemophilus influenzae Rd
uacaucaguaccuuuaauuaa

SEQ ID NO: 708788 - RNA, 14 nt, Haemophilus influenzae Rd
uacaucauuccgcc

SEQ ID NO: 708789 - RNA, 14 nt, Haemophilus influenzae Rd
uacaucgaaaacau

SEQ ID NO: 708790 - RNA, 23 nt, Haemophilus influenzae Rd
uacaucccauauacuugccaaaa

SEQ ID NO: 708791 - RNA, 16 nt, Haemophilus influenzae Rd
uacaucuaaaauguca

SEQ ID NO: 708792 - RNA, 13 nt, Haemophilus influenzae Rd
uacaucuaaugcc

SEQ ID NO: 708793 - RNA, 19 nt, Haemophilus influenzae Rd
uacaucuucaaaaacauaa

SEQ ID NO: 708794 - RNA, 11 nt, Haemophilus influenzae Rd
uacaucuucac

SEQ ID NO: 708795 - RNA, 22 nt, Haemophilus influenzae Rd
uaccgucuaaacggaaauauug

SEQ ID NO: 708796 - RNA, 21 nt, Haemophilus influenzae Rd
uaccgucagccaaauuuuucu

SEQ ID NO: 708797 - RNA, 21 nt, Haemophilus influenzae Rd
uaccgauaauauguuuugcca

SEQ ID NO: 708798 - RNA, 14 nt, Haemophilus influenzae Rd
uaccgacugagcua

SEQ ID NO: 708799 - RNA, 13 nt, Haemophilus influenzae Rd
uaccugaugaaau

SEQ ID NO: 708800 - RNA, 13 nt, Haemophilus influenzae Rd
uaccuaaaauaaa

SEQ ID NO: 708801 - RNA, 16 nt, Haemophilus influenzae Rd
uaccuaaaauaaauuu

SEQ ID NO: 708802 - RNA, 18 nt, Haemophilus influenzae Rd
uaccauucuuucaauaau

SEQ ID NO: 708803 - RNA, 21 nt, Haemophilus influenzae Rd
uaccauugcguucacucacuu

SEQ ID NO: 708804 - RNA, 15 nt, Haemophilus influenzae Rd
uaccauuuaucucuu

SEQ ID NO: 708805 - RNA, 13 nt, Haemophilus influenzae Rd
uaccauuuaucuu

SEQ ID NO: 708806 - RNA, 16 nt, Haemophilus influenzae Rd
uaccaugcugauuauu

SEQ ID NO: 708807 - RNA, 14 nt, Haemophilus influenzae Rd
uaccacauaaaugu

SEQ ID NO: 708808 - RNA, 20 nt, Haemophilus influenzae Rd
uaccacaugcauuuuucuua

SEQ ID NO: 708809 - RNA, 21 nt, Haemophilus influenzae Rd
uacgcuuuaacgagaauauuc

SEQ ID NO: 708810 - RNA, 23 nt, Haemophilus influenzae Rd
uacgcgcaauuucagcacccaca

SEQ ID NO: 708811 - RNA, 17 nt, Haemophilus influenzae Rd
uacgcugcaucuuguuu

SEQ ID NO: 708812 - RNA, 20 nt, Haemophilus influenzae Rd
uacgguuauuuuuuucuaac

SEQ ID NO: 708813 - RNA, 16 nt, Haemophilus influenzae Rd
uacguguuaauaacca

SEQ ID NO: 708814 - RNA, 16 nt, Haemophilus influenzae Rd
uacguguuugguuuug

SEQ ID NO: 708815 - RNA, 19 nt, Haemophilus influenzae Rd
uacguguuugguuuuggug

SEQ ID NO: 708816 - RNA, 16 nt, Haemophilus influenzae Rd
uacguaauauuuaccg

SEQ ID NO: 708817 - RNA, 15 nt, Haemophilus influenzae Rd
uacgugcaaauaaau

SEQ ID NO: 708818 - RNA, 19 nt, Haemophilus influenzae Rd
uacguuguuguucuaacau

SEQ ID NO: 708819 - RNA, 21 nt, Haemophilus influenzae Rd
uacguuguuguucuaacauuu

SEQ ID NO: 708820 - RNA, 17 nt, Haemophilus influenzae Rd
uacguucauauaaauuu

SEQ ID NO: 708821 - RNA, 22 nt, Haemophilus influenzae Rd
uacguugaguauagucauucaa

SEQ ID NO: 708822 - RNA, 13 nt, Haemophilus influenzae Rd
uacuaaauuagua

SEQ ID NO: 708823 - RNA, 17 nt, Haemophilus influenzae Rd
uacuaauucaagcaaau

SEQ ID NO: 708824 - RNA, 19 nt, Haemophilus influenzae Rd
uacuaauucaagcaaauau

SEQ ID NO: 708825 - RNA, 17 nt, Haemophilus influenzae Rd
uacuaacguuucuaaua

SEQ ID NO: 708826 - RNA, 14 nt, Haemophilus influenzae Rd
uacuaacucaaaau

SEQ ID NO: 708827 - RNA, 16 nt, Haemophilus influenzae Rd
uacuaacucaaaauac

SEQ ID NO: 708828 - RNA, 16 nt, Haemophilus influenzae Rd
uacuacuggcauuuuu

SEQ ID NO: 708829 - RNA, 17 nt, Haemophilus influenzae Rd
uacuacguguucaucau

SEQ ID NO: 708830 - RNA, 19 nt, Haemophilus influenzae Rd
uacuacguguucaucaucg

SEQ ID NO: 708831 - RNA, 14 nt, Haemophilus influenzae Rd
uacuaauuuuagua

SEQ ID NO: 708832 - RNA, 21 nt, Haemophilus influenzae Rd
uacuacagcccaauuauuggc

SEQ ID NO: 708833 - RNA, 19 nt, Haemophilus influenzae Rd
uacgccuccauuaguuguu

SEQ ID NO: 708834 - RNA, 14 nt, Haemophilus influenzae Rd
uacgccuaaugcau

SEQ ID NO: 708835 - RNA, 20 nt, Haemophilus influenzae Rd
uacgcccauugaaaauacag

SEQ ID NO: 708836 - RNA, 15 nt, Haemophilus influenzae Rd
uaccugugaaaacac

SEQ ID NO: 708837 - RNA, 15 nt, Haemophilus influenzae Rd
uaccugugcauugcu

SEQ ID NO: 708838 - RNA, 16 nt, Haemophilus influenzae Rd
uaccugguugcauaaa

SEQ ID NO: 708839 - RNA, 16 nt, Haemophilus influenzae Rd
uaccuguaauccuuuu

SEQ ID NO: 708840 - RNA, 21 nt, Haemophilus influenzae Rd
uaccuuagccaaaucaucuag

SEQ ID NO: 708841 - RNA, 21 nt, Haemophilus influenzae Rd
uaccuguuucguacauuguuu

SEQ ID NO: 708842 - RNA, 16 nt, Haemophilus influenzae Rd
uaccuuaacauuuucu

SEQ ID NO: 708843 - RNA, 17 nt, Haemophilus influenzae Rd
uaccuuaauuaaucuuu

SEQ ID NO: 708844 - RNA, 17 nt, Haemophilus influenzae Rd
uacgauuuaauguauaa

SEQ ID NO: 708845 - RNA, 21 nt, Haemophilus influenzae Rd
uacgauuuuccgaaaaaacaa

SEQ ID NO: 708846 - RNA, 19 nt, Haemophilus influenzae Rd
uacgagcacaguauuuaua

SEQ ID NO: 708847 - RNA, 17 nt, Haemophilus influenzae Rd
uacgagcaccaaauauc

SEQ ID NO: 708848 - RNA, 11 nt, Haemophilus influenzae Rd
uaguuucuaau

SEQ ID NO: 708849 - RNA, 11 nt, Haemophilus influenzae Rd
uaguucaauuu

SEQ ID NO: 708850 - RNA, 16 nt, Haemophilus influenzae Rd
uaguuagaagugaaau

SEQ ID NO: 708851 - RNA, 18 nt, Haemophilus influenzae Rd
uaguuauuuauuccuuca

SEQ ID NO: 708852 - RNA, 22 nt, Haemophilus influenzae Rd
uaguuauuuauuccuucaaucg

SEQ ID NO: 708853 - RNA, 17 nt, Haemophilus influenzae Rd
uaguuauuuauuuaaga

SEQ ID NO: 708854 - RNA, 18 nt, Haemophilus influenzae Rd
uaguuauuuauuuaagau

SEQ ID NO: 708855 - RNA, 16 nt, Haemophilus influenzae Rd
uaguuuuuuauuucua

SEQ ID NO: 708856 - RNA, 10 nt, Haemophilus influenzae Rd
uauaaaaaaa

SEQ ID NO: 708857 - RNA, 16 nt, Haemophilus influenzae Rd
uaguuuuugcauagcc

SEQ ID NO: 708858 - RNA, 17 nt, Haemophilus influenzae Rd
uaguuuuucgcugcagc

SEQ ID NO: 708859 - RNA, 19 nt, Haemophilus influenzae Rd
uauaaaaaaacuaaaaaca

SEQ ID NO: 708860 - RNA, 18 nt, Haemophilus influenzae Rd
uauaaaaaaaucugcacu

SEQ ID NO: 708861 - RNA, 21 nt, Haemophilus influenzae Rd
uaguuuggcugaaauucuaaa

SEQ ID NO: 708862 - RNA, 13 nt, Haemophilus influenzae Rd
uaguuucuucuuu

SEQ ID NO: 708863 - RNA, 19 nt, Haemophilus influenzae Rd
uaguuuuauaguuuuuagu

SEQ ID NO: 708864 - RNA, 21 nt, Haemophilus influenzae Rd
uauaaaugccgccuuuuaaua

SEQ ID NO: 708865 - RNA, 17 nt, Haemophilus influenzae Rd
uauaaauccguaaaaua

SEQ ID NO: 708866 - RNA, 17 nt, Haemophilus influenzae Rd
uauaaaugacauauaau

SEQ ID NO: 708867 - RNA, 23 nt, Haemophilus influenzae Rd
uauaaaugacauauaauauuaau

SEQ ID NO: 708868 - RNA, 21 nt, Haemophilus influenzae Rd
uauaaaucuauuccuuucuuu

SEQ ID NO: 708869 - RNA, 12 nt, Haemophilus influenzae Rd
uauaaauaauuu

SEQ ID NO: 708870 - RNA, 19 nt, Haemophilus influenzae Rd
uauaaaccaguuaaauccu

SEQ ID NO: 708871 - RNA, 21 nt, Haemophilus influenzae Rd
uauaaaccuugcauuucauuu

SEQ ID NO: 708872 - RNA, 15 nt, Haemophilus influenzae Rd
uauaaacaauucccc

SEQ ID NO: 708873 - RNA, 20 nt, Haemophilus influenzae Rd
uauaaacccaucauaaauau

SEQ ID NO: 708874 - RNA, 22 nt, Haemophilus influenzae Rd
uauaaacggagcgauguuuucc

SEQ ID NO: 708875 - RNA, 19 nt, Haemophilus influenzae Rd
uagucgcuggaacuucuaa

SEQ ID NO: 708876 - RNA, 14 nt, Haemophilus influenzae Rd
uagucuaacuuuuu

SEQ ID NO: 708877 - RNA, 17 nt, Haemophilus influenzae Rd
uagucuaacuuuuucaa

SEQ ID NO: 708878 - RNA, 19 nt, Haemophilus influenzae Rd
uagucuacaagaaaccaaa

SEQ ID NO: 708879 - RNA, 23 nt, Haemophilus influenzae Rd
uagguauuaucgccaucacgcca

SEQ ID NO: 708880 - RNA, 20 nt, Haemophilus influenzae Rd
uagguaguuuucaauaucaa

SEQ ID NO: 708881 - RNA, 15 nt, Haemophilus influenzae Rd
uagguaaauuugguu

SEQ ID NO: 708882 - RNA, 18 nt, Haemophilus influenzae Rd
uagguaacauaaugauuu

SEQ ID NO: 708883 - RNA, 18 nt, Haemophilus influenzae Rd
uagguacguuuuguuuua

SEQ ID NO: 708884 - RNA, 22 nt, Haemophilus influenzae Rd
uagucucuuuauuuuuucauca

SEQ ID NO: 708885 - RNA, 18 nt, Haemophilus influenzae Rd
uagucuuuuuaauuuaaa

SEQ ID NO: 708886 - RNA, 20 nt, Haemophilus influenzae Rd
uagucuucccaagauuuuau

SEQ ID NO: 708887 - RNA, 13 nt, Haemophilus influenzae Rd
uagugaaaagaaa

SEQ ID NO: 708888 - RNA, 12 nt, Haemophilus influenzae Rd
uaguuaaugcag

SEQ ID NO: 708889 - RNA, 18 nt, Haemophilus influenzae Rd
uaguuaauugauuuaaaa

SEQ ID NO: 708890 - RNA, 21 nt, Haemophilus influenzae Rd
uaguuacguuuaguaaaauaa

SEQ ID NO: 708891 - RNA, 17 nt, Haemophilus influenzae Rd
uaguuagcuaaaaaaac

SEQ ID NO: 708892 - RNA, 18 nt, Haemophilus influenzae Rd
uaguuagcuaaaaaaacu

SEQ ID NO: 708893 - RNA, 21 nt, Haemophilus influenzae Rd
uaguuagcuaaaaaaacuaga

SEQ ID NO: 708894 - RNA, 12 nt, Haemophilus influenzae Rd
uaguuaaauaau

SEQ ID NO: 708895 - RNA, 18 nt, Haemophilus influenzae Rd
uaguuaaagaaaauauuu

SEQ ID NO: 708896 - RNA, 19 nt, Haemophilus influenzae Rd
uaguuaaagaaaauauuua

SEQ ID NO: 708897 - RNA, 21 nt, Haemophilus influenzae Rd
uaguuaaagaaaauauuuaac

SEQ ID NO: 708898 - RNA, 20 nt, Haemophilus influenzae Rd
uaguuaaaccaaauuuugau

SEQ ID NO: 708899 - RNA, 22 nt, Haemophilus influenzae Rd
uaguggugguggaauaaauaac

SEQ ID NO: 708900 - RNA, 23 nt, Haemophilus influenzae Rd
uaguggugguggaauaaauaaca

SEQ ID NO: 708901 - RNA, 16 nt, Haemophilus influenzae Rd
uagugaaugaugccau

SEQ ID NO: 708902 - RNA, 17 nt, Haemophilus influenzae Rd
uaguggcaauaacuaca

SEQ ID NO: 708903 - RNA, 20 nt, Haemophilus influenzae Rd
uaguggagagcuuagauaca

SEQ ID NO: 708904 - RNA, 15 nt, Haemophilus influenzae Rd
uauagauaaauauca

SEQ ID NO: 708905 - RNA, 18 nt, Haemophilus influenzae Rd
uauagauaaauaucaaaa

SEQ ID NO: 708906 - RNA, 12 nt, Haemophilus influenzae Rd
uauagaaaucau

SEQ ID NO: 708907 - RNA, 20 nt, Haemophilus influenzae Rd
uauacuuuuuugauacuaac

SEQ ID NO: 708908 - RNA, 20 nt, Haemophilus influenzae Rd
uauagacuugggggcagcga

SEQ ID NO: 708909 - RNA, 15 nt, Haemophilus influenzae Rd
uauagagaaauaauc

SEQ ID NO: 708910 - RNA, 13 nt, Haemophilus influenzae Rd
uauagaauuauuu

SEQ ID NO: 708911 - RNA, 15 nt, Haemophilus influenzae Rd
uauaccuaucuuauu

SEQ ID NO: 708912 - RNA, 21 nt, Haemophilus influenzae Rd
uauacgaucacgauuuuucuc

SEQ ID NO: 708913 - RNA, 22 nt, Haemophilus influenzae Rd
uauacgaucacgauuuuucucu

SEQ ID NO: 708914 - RNA, 20 nt, Haemophilus influenzae Rd
uauacgccaggcucuguaau

SEQ ID NO: 708915 - RNA, 15 nt, Haemophilus influenzae Rd
uauacaucucauaaa

SEQ ID NO: 708916 - RNA, 17 nt, Haemophilus influenzae Rd
uauacaucucauaaagu

SEQ ID NO: 708917 - RNA, 14 nt, Haemophilus influenzae Rd
uauacauuaacaau

SEQ ID NO: 708918 - RNA, 19 nt, Haemophilus influenzae Rd
uauaccauucuuucaauaa

SEQ ID NO: 708919 - RNA, 20 nt, Haemophilus influenzae Rd
uauaccauucuuucaauaau

SEQ ID NO: 708920 - RNA, 22 nt, Haemophilus influenzae Rd
uauaccauucuuucaauaauuu

SEQ ID NO: 708921 - RNA, 13 nt, Haemophilus influenzae Rd
uauaccauuugau

SEQ ID NO: 708922 - RNA, 16 nt, Haemophilus influenzae Rd
uauacuuaauuucuca

SEQ ID NO: 708923 - RNA, 13 nt, Haemophilus influenzae Rd
uauacuuacucaa

SEQ ID NO: 708924 - RNA, 18 nt, Haemophilus influenzae Rd
uauacugccuuuaaagaa

SEQ ID NO: 708925 - RNA, 21 nt, Haemophilus influenzae Rd
uauacuaauuuuaguauucuu

SEQ ID NO: 708926 - RNA, 15 nt, Haemophilus influenzae Rd
uauaauaaauucaau

SEQ ID NO: 708927 - RNA, 18 nt, Haemophilus influenzae Rd
uauaaauuguuuuuccca

SEQ ID NO: 708928 - RNA, 22 nt, Haemophilus influenzae Rd
uauaaauuaccuuguuuugcaa

SEQ ID NO: 708929 - RNA, 19 nt, Haemophilus influenzae Rd
uauaaauuagcuuaauaaa

SEQ ID NO: 708930 - RNA, 16 nt, Haemophilus influenzae Rd
uauaauuccuaaaaua

SEQ ID NO: 708931 - RNA, 19 nt, Haemophilus influenzae Rd
uauaauuccuaaaauacaa

SEQ ID NO: 708932 - RNA, 16 nt, Haemophilus influenzae Rd
uauaauuaauaaaaaa

SEQ ID NO: 708933 - RNA, 17 nt, Haemophilus influenzae Rd
uauaauuaauaaaaaau

SEQ ID NO: 708934 - RNA, 19 nt, Haemophilus influenzae Rd
uauaauauuuucuuuuauc

SEQ ID NO: 708935 - RNA, 14 nt, Haemophilus influenzae Rd
uauaauauuuuggc

SEQ ID NO: 708936 - RNA, 17 nt, Haemophilus influenzae Rd
uauaaugucaucuagua

SEQ ID NO: 708937 - RNA, 14 nt, Haemophilus influenzae Rd
uauaauuaaacauu

SEQ ID NO: 708938 - RNA, 19 nt, Haemophilus influenzae Rd
uauaauuaaacauuuccaa

SEQ ID NO: 708939 - RNA, 14 nt, Haemophilus influenzae Rd
uauaauuaauaaaa

SEQ ID NO: 708940 - RNA, 16 nt, Haemophilus influenzae Rd
uauacagcacuaaaag

SEQ ID NO: 708941 - RNA, 13 nt, Haemophilus influenzae Rd
uauacaguucacg

SEQ ID NO: 708942 - RNA, 21 nt, Haemophilus influenzae Rd
uauacaauucuuguuuaauau

SEQ ID NO: 708943 - RNA, 13 nt, Haemophilus influenzae Rd
uauaauuuacugu

SEQ ID NO: 708944 - RNA, 15 nt, Haemophilus influenzae Rd
uauaauuuaacauaa

SEQ ID NO: 708945 - RNA, 13 nt, Haemophilus influenzae Rd
uauacaacaaaaa

SEQ ID NO: 708946 - RNA, 12 nt, Haemophilus influenzae Rd
uauaauuuugau

SEQ ID NO: 708947 - RNA, 19 nt, Haemophilus influenzae Rd
uauaauuuccuauacuaau

SEQ ID NO: 708948 - RNA, 21 nt, Haemophilus influenzae Rd
uauaugaguuucagagauuua

SEQ ID NO: 708949 - RNA, 21 nt, Haemophilus influenzae Rd
uauauuaaaaaaaucuuuauc

SEQ ID NO: 708950 - RNA, 14 nt, Haemophilus influenzae Rd
uauaugaaaaauaa

SEQ ID NO: 708951 - RNA, 23 nt, Haemophilus influenzae Rd
uauauuaacuugcuauuuucuaa

SEQ ID NO: 708952 - RNA, 19 nt, Haemophilus influenzae Rd
uauauuaauuauuuuagau

SEQ ID NO: 708953 - RNA, 18 nt, Haemophilus influenzae Rd
uauauucauuuaaaacaa

SEQ ID NO: 708954 - RNA, 16 nt, Haemophilus influenzae Rd
uauauuccuuauucaa

SEQ ID NO: 708955 - RNA, 16 nt, Haemophilus influenzae Rd
uauauucguuaaauaa

SEQ ID NO: 708956 - RNA, 11 nt, Haemophilus influenzae Rd
uauauucugua

SEQ ID NO: 708957 - RNA, 23 nt, Haemophilus influenzae Rd
uauauagccuguuguucucacua

SEQ ID NO: 708958 - RNA, 20 nt, Haemophilus influenzae Rd
uauaggguaaauaaaaauga

SEQ ID NO: 708959 - RNA, 17 nt, Haemophilus influenzae Rd
uauaucgaauuaaagaa

SEQ ID NO: 708960 - RNA, 17 nt, Haemophilus influenzae Rd
uauauaugauaaaaaua

SEQ ID NO: 708961 - RNA, 14 nt, Haemophilus influenzae Rd
uauauaucauggca

SEQ ID NO: 708962 - RNA, 23 nt, Haemophilus influenzae Rd
uauauaucauggcacaaaauaau

SEQ ID NO: 708963 - RNA, 18 nt, Haemophilus influenzae Rd
uauaucgccauccacuac

SEQ ID NO: 708964 - RNA, 23 nt, Haemophilus influenzae Rd
uauaggauaagcugcuuaauuaa

SEQ ID NO: 708965 - RNA, 14 nt, Haemophilus influenzae Rd
uauaggaauaucau

SEQ ID NO: 708966 - RNA, 16 nt, Haemophilus influenzae Rd
uauagcuuuaguuuua

SEQ ID NO: 708967 - RNA, 23 nt, Haemophilus influenzae Rd
uauagcuuuaguuuuagggaaga

SEQ ID NO: 708968 - RNA, 13 nt, Haemophilus influenzae Rd
uauaggauuuuaa

SEQ ID NO: 708969 - RNA, 19 nt, Haemophilus influenzae Rd
uaucauaaacaauuucauu

SEQ ID NO: 708970 - RNA, 14 nt, Haemophilus influenzae Rd
uaucauacuaaaaa

SEQ ID NO: 708971 - RNA, 17 nt, Haemophilus influenzae Rd
uaucauacuaaaaaauu

SEQ ID NO: 708972 - RNA, 15 nt, Haemophilus influenzae Rd
uaucaggcuuaacuu

SEQ ID NO: 708973 - RNA, 17 nt, Haemophilus influenzae Rd
uaucacauuuuauugaa

SEQ ID NO: 708974 - RNA, 17 nt, Haemophilus influenzae Rd
uaucaauuucauuugca

SEQ ID NO: 708975 - RNA, 18 nt, Haemophilus influenzae Rd
uaucacagauuuuuaaau

SEQ ID NO: 708976 - RNA, 21 nt, Haemophilus influenzae Rd
uaucacagauuuuuuauuaau

SEQ ID NO: 708977 - RNA, 13 nt, Haemophilus influenzae Rd
uaucaauuccuuc

SEQ ID NO: 708978 - RNA, 15 nt, Haemophilus influenzae Rd
uaucacaaagcacua

SEQ ID NO: 708979 - RNA, 14 nt, Haemophilus influenzae Rd
uaucaauuuggcuc

SEQ ID NO: 708980 - RNA, 21 nt, Haemophilus influenzae Rd
uaucaauuuggcucacaagac

SEQ ID NO: 708981 - RNA, 18 nt, Haemophilus influenzae Rd
uaucacaaauuuccauau

SEQ ID NO: 708982 - RNA, 16 nt, Haemophilus influenzae Rd
uaucacaaguuaaaac

SEQ ID NO: 708983 - RNA, 17 nt, Haemophilus influenzae Rd
uaucaaugaauauaaaa

SEQ ID NO: 708984 - RNA, 18 nt, Haemophilus influenzae Rd
uaucaaugaauauaaaau

SEQ ID NO: 708985 - RNA, 13 nt, Haemophilus influenzae Rd
uaucaaugccauc

SEQ ID NO: 708986 - RNA, 17 nt, Haemophilus influenzae Rd
uaucaauguuugugcgu

SEQ ID NO: 708987 - RNA, 22 nt, Haemophilus influenzae Rd
uauauugcauaaucauaucuaa

SEQ ID NO: 708988 - RNA, 19 nt, Haemophilus influenzae Rd
uauauuguugcacauuaau

SEQ ID NO: 708989 - RNA, 21 nt, Haemophilus influenzae Rd
uaucaagcugugcaaaacuag

SEQ ID NO: 708990 - RNA, 21 nt, Haemophilus influenzae Rd
uaucaagcacaaucaggcgau

SEQ ID NO: 708991 - RNA, 21 nt, Haemophilus influenzae Rd
uaucgacaaauuaauaagaaa

SEQ ID NO: 708992 - RNA, 13 nt, Haemophilus influenzae Rd
uauccgcauugcc

SEQ ID NO: 708993 - RNA, 14 nt, Haemophilus influenzae Rd
uauccgagagaaag

SEQ ID NO: 708994 - RNA, 23 nt, Haemophilus influenzae Rd
uauccgagcucuuucauuaaauu

SEQ ID NO: 708995 - RNA, 21 nt, Haemophilus influenzae Rd
uauccagugccauuuggucua

SEQ ID NO: 708996 - RNA, 14 nt, Haemophilus influenzae Rd
uaucccauugugca

SEQ ID NO: 708997 - RNA, 21 nt, Haemophilus influenzae Rd
uaucaucgcguuuauuuuuau

SEQ ID NO: 708998 - RNA, 15 nt, Haemophilus influenzae Rd
uaucaucauuuuuau

SEQ ID NO: 708999 - RNA, 13 nt, Haemophilus influenzae Rd
uaucaucuagauu

SEQ ID NO: 709000 - RNA, 19 nt, Haemophilus influenzae Rd
uaucaucuguaaaccauuc

SEQ ID NO: 709001 - RNA, 17 nt, Haemophilus influenzae Rd
uaucaucaauaucugca

SEQ ID NO: 709002 - RNA, 14 nt, Haemophilus influenzae Rd
uaucaucaagauuu

SEQ ID NO: 709003 - RNA, 20 nt, Haemophilus influenzae Rd
uaucauuaaaacaaagggcu

SEQ ID NO: 709004 - RNA, 13 nt, Haemophilus influenzae Rd
uaucauuaaucuu

SEQ ID NO: 709005 - RNA, 20 nt, Haemophilus influenzae Rd
uaucauuacccgucacugca

SEQ ID NO: 709006 - RNA, 18 nt, Haemophilus influenzae Rd
uaucgagaaaauuaaaaa

SEQ ID NO: 709007 - RNA, 20 nt, Haemophilus influenzae Rd
uaucgaggacaaucugcugu

SEQ ID NO: 709008 - RNA, 22 nt, Haemophilus influenzae Rd
uaucuaaauuacauuuuuucua

SEQ ID NO: 709009 - RNA, 13 nt, Haemophilus influenzae Rd
uaucuaaaucucu

SEQ ID NO: 709010 - RNA, 17 nt, Haemophilus influenzae Rd
uaucuaaauauauuuuu

SEQ ID NO: 709011 - RNA, 16 nt, Haemophilus influenzae Rd
uaucgcacuuuuuuca

SEQ ID NO: 709012 - RNA, 12 nt, Haemophilus influenzae Rd
uaucgcaaucaa

SEQ ID NO: 709013 - RNA, 13 nt, Haemophilus influenzae Rd
uaucgcaaucacg

SEQ ID NO: 709014 - RNA, 18 nt, Haemophilus influenzae Rd
uaucuaacucuuggcuaa

SEQ ID NO: 709015 - RNA, 20 nt, Haemophilus influenzae Rd
uaucuaagaaaauagaagcc

SEQ ID NO: 709016 - RNA, 15 nt, Haemophilus influenzae Rd
uaucuaagauaaauu

SEQ ID NO: 709017 - RNA, 17 nt, Haemophilus influenzae Rd
uaucuaagauaaauuua

SEQ ID NO: 709018 - RNA, 14 nt, Haemophilus influenzae Rd
uaucuaauagauuu

SEQ ID NO: 709019 - RNA, 19 nt, Haemophilus influenzae Rd
uaucuacaaucaaaaaauc

SEQ ID NO: 709020 - RNA, 14 nt, Haemophilus influenzae Rd
uaucuauaaaaaga

SEQ ID NO: 709021 - RNA, 15 nt, Haemophilus influenzae Rd
uaucuagaaaacuca

SEQ ID NO: 709022 - RNA, 18 nt, Haemophilus influenzae Rd
uaucuacuagccaaucau

SEQ ID NO: 709023 - RNA, 21 nt, Haemophilus influenzae Rd
uaucuaccacaucaaauuuau

SEQ ID NO: 709024 - RNA, 21 nt, Haemophilus influenzae Rd
uaucugauuuaaucauuacuu

SEQ ID NO: 709025 - RNA, 14 nt, Haemophilus influenzae Rd
uaucuuauauuuuu

SEQ ID NO: 709026 - RNA, 14 nt, Haemophilus influenzae Rd
uaucuauaucuuua

SEQ ID NO: 709027 - RNA, 17 nt, Haemophilus influenzae Rd
uaucuaugauuucauuu

SEQ ID NO: 709028 - RNA, 13 nt, Haemophilus influenzae Rd
uaucugaaaauau

SEQ ID NO: 709029 - RNA, 13 nt, Haemophilus influenzae Rd
uaucucuuacagu

SEQ ID NO: 709030 - RNA, 19 nt, Haemophilus influenzae Rd
uaucugauguagcuugaau

SEQ ID NO: 709031 - RNA, 17 nt, Haemophilus influenzae Rd
uaucugacacuaaccaa

SEQ ID NO: 709032 - RNA, 15 nt, Haemophilus influenzae Rd
uagccauaaauaaau

SEQ ID NO: 709033 - RNA, 19 nt, Haemophilus influenzae Rd
uagccucagguauuucuuc

SEQ ID NO: 709034 - RNA, 18 nt, Haemophilus influenzae Rd
uagccuagugcuaaaaua

SEQ ID NO: 709035 - RNA, 23 nt, Haemophilus influenzae Rd
uagccuaagauuuuaucuaacuc

SEQ ID NO: 709036 - RNA, 16 nt, Haemophilus influenzae Rd
uagccguccauuucaa

SEQ ID NO: 709037 - RNA, 20 nt, Haemophilus influenzae Rd
uagccguccauuucaaucac

SEQ ID NO: 709038 - RNA, 21 nt, Haemophilus influenzae Rd
uagccguccauuucaaucacu

SEQ ID NO: 709039 - RNA, 14 nt, Haemophilus influenzae Rd
uagccuuauuuugu

SEQ ID NO: 709040 - RNA, 17 nt, Haemophilus influenzae Rd
uagccuuauuuugucuu

SEQ ID NO: 709041 - RNA, 12 nt, Haemophilus influenzae Rd
uagccuucugcc

SEQ ID NO: 709042 - RNA, 14 nt, Haemophilus influenzae Rd
uagccuguucuucc

SEQ ID NO: 709043 - RNA, 15 nt, Haemophilus influenzae Rd
uagccuguucuucca

SEQ ID NO: 709044 - RNA, 16 nt, Haemophilus influenzae Rd
uagccuguucuuccac

SEQ ID NO: 709045 - RNA, 18 nt, Haemophilus influenzae Rd
uagcauaaguuaauucac

SEQ ID NO: 709046 - RNA, 17 nt, Haemophilus influenzae Rd
uagcauaauaaaaaaac

SEQ ID NO: 709047 - RNA, 16 nt, Haemophilus influenzae Rd
uagcaucaaaauaaau

SEQ ID NO: 709048 - RNA, 18 nt, Haemophilus influenzae Rd
uagccaaaacgaauagaa

SEQ ID NO: 709049 - RNA, 23 nt, Haemophilus influenzae Rd
uagcaauaauggcgguaaaaaag

SEQ ID NO: 709050 - RNA, 12 nt, Haemophilus influenzae Rd
uagcaaucaauu

SEQ ID NO: 709051 - RNA, 16 nt, Haemophilus influenzae Rd
uagcaaucaauuccuu

SEQ ID NO: 709052 - RNA, 21 nt, Haemophilus influenzae Rd
uagcaaucuuuggcaaaaaau

SEQ ID NO: 709053 - RNA, 23 nt, Haemophilus influenzae Rd
uagauauuguucuacugguuuuu

SEQ ID NO: 709054 - RNA, 13 nt, Haemophilus influenzae Rd
uagauauuucuca

SEQ ID NO: 709055 - RNA, 13 nt, Haemophilus influenzae Rd
uagauauaaaaac

SEQ ID NO: 709056 - RNA, 15 nt, Haemophilus influenzae Rd
uagauccgcaauaua

SEQ ID NO: 709057 - RNA, 17 nt, Haemophilus influenzae Rd
uagcugauuuuuuaaag

SEQ ID NO: 709058 - RNA, 12 nt, Haemophilus influenzae Rd
uagcugcaggga

SEQ ID NO: 709059 - RNA, 22 nt, Haemophilus influenzae Rd
uagcugaaaaauaaaaaauauu

SEQ ID NO: 709060 - RNA, 23 nt, Haemophilus influenzae Rd
uagcugaaaaauaaaaaauauug

SEQ ID NO: 709061 - RNA, 21 nt, Haemophilus influenzae Rd
uagcugaaaucccuuagaaaa

SEQ ID NO: 709062 - RNA, 22 nt, Haemophilus influenzae Rd
uagcugacacgguaguaaauaa

SEQ ID NO: 709063 - RNA, 16 nt, Haemophilus influenzae Rd
uagcucucuuuuuaug

SEQ ID NO: 709064 - RNA, 16 nt, Haemophilus influenzae Rd
uagcuugaauugcucc

SEQ ID NO: 709065 - RNA, 23 nt, Haemophilus influenzae Rd
uagcuuuacguaccgcaccuuua

SEQ ID NO: 709066 - RNA, 13 nt, Haemophilus influenzae Rd
uagcuuuuuaauu

SEQ ID NO: 709067 - RNA, 16 nt, Haemophilus influenzae Rd
uagcuaacaaauuuaa

SEQ ID NO: 709068 - RNA, 17 nt, Haemophilus influenzae Rd
uagcuaacaaauuuaau

SEQ ID NO: 709069 - RNA, 21 nt, Haemophilus influenzae Rd
uagcuaacaaauuuaauauuu

SEQ ID NO: 709070 - RNA, 18 nt, Haemophilus influenzae Rd
uagcucaauagauuuaau

SEQ ID NO: 709071 - RNA, 21 nt, Haemophilus influenzae Rd
uagcucaacgcuuuucguuuc

SEQ ID NO: 709072 - RNA, 18 nt, Haemophilus influenzae Rd
uagcgauccuaaaaaacc

SEQ ID NO: 709073 - RNA, 15 nt, Haemophilus influenzae Rd
uaggauaaauaaacu

SEQ ID NO: 709074 - RNA, 23 nt, Haemophilus influenzae Rd
uaggaauaucuuugacuaaauca

SEQ ID NO: 709075 - RNA, 17 nt, Haemophilus influenzae Rd
uaggaucuauauuuccc

SEQ ID NO: 709076 - RNA, 17 nt, Haemophilus influenzae Rd
uagguaaacuuuggaau

SEQ ID NO: 709077 - RNA, 20 nt, Haemophilus influenzae Rd
uaggggggaccauuuuucca

SEQ ID NO: 709078 - RNA, 23 nt, Haemophilus influenzae Rd
uagacuuaauuucacauuaugau

SEQ ID NO: 709079 - RNA, 21 nt, Haemophilus influenzae Rd
uagacucguuuuuuauuuugu

SEQ ID NO: 709080 - RNA, 16 nt, Haemophilus influenzae Rd
uagacauuaguaucuu

SEQ ID NO: 709081 - RNA, 21 nt, Haemophilus influenzae Rd
uagacauuaguaucuuccauu

SEQ ID NO: 709082 - RNA, 21 nt, Haemophilus influenzae Rd
uagacauagaaaguuuaacuu

SEQ ID NO: 709083 - RNA, 20 nt, Haemophilus influenzae Rd
uagacacaagggauuuaaaa

SEQ ID NO: 709084 - RNA, 22 nt, Haemophilus influenzae Rd
uagacacaagggauuuaaaauc

SEQ ID NO: 709085 - RNA, 23 nt, Haemophilus influenzae Rd
uagacacaagggauuuaaaaucc

SEQ ID NO: 709086 - RNA, 15 nt, Haemophilus influenzae Rd
uagacaauauugaaa

SEQ ID NO: 709087 - RNA, 16 nt, Haemophilus influenzae Rd
uagacaauauugaaau

SEQ ID NO: 709088 - RNA, 18 nt, Haemophilus influenzae Rd
uagacaauauugaaauaa

SEQ ID NO: 709089 - RNA, 15 nt, Haemophilus influenzae Rd
uagacaauaaaacac

SEQ ID NO: 709090 - RNA, 17 nt, Haemophilus influenzae Rd
uagaccgcuauuuuuaa

SEQ ID NO: 709091 - RNA, 15 nt, Haemophilus influenzae Rd
uagacauuguuugau

SEQ ID NO: 709092 - RNA, 23 nt, Haemophilus influenzae Rd
uagagcgauggcaguuuggaaag

SEQ ID NO: 709093 - RNA, 15 nt, Haemophilus influenzae Rd
uagagggauaaaaau

SEQ ID NO: 709094 - RNA, 23 nt, Haemophilus influenzae Rd
uagaggcugaagccauuuuaugc

SEQ ID NO: 709095 - RNA, 12 nt, Haemophilus influenzae Rd
uagagcuugccu

SEQ ID NO: 709096 - RNA, 13 nt, Haemophilus influenzae Rd
uagagauaauaaa

SEQ ID NO: 709097 - RNA, 17 nt, Haemophilus influenzae Rd
uagagauuguaugaaaa

SEQ ID NO: 709098 - RNA, 12 nt, Haemophilus influenzae Rd
uagagcaagcaa

SEQ ID NO: 709099 - RNA, 19 nt, Haemophilus influenzae Rd
uagauaagccauuaacauu

SEQ ID NO: 709100 - RNA, 13 nt, Haemophilus influenzae Rd
uagauaacuucuu

SEQ ID NO: 709101 - RNA, 13 nt, Haemophilus influenzae Rd
uagauaagaaaau

SEQ ID NO: 709102 - RNA, 16 nt, Haemophilus influenzae Rd
uagauaauaaaaaaac

SEQ ID NO: 709103 - RNA, 23 nt, Haemophilus influenzae Rd
uagauaauacagaaauaugaaau

SEQ ID NO: 709104 - RNA, 19 nt, Haemophilus influenzae Rd
uagauaaugguuacagaaa

SEQ ID NO: 709105 - RNA, 14 nt, Haemophilus influenzae Rd
uagauaaaguauaa

SEQ ID NO: 709106 - RNA, 16 nt, Haemophilus influenzae Rd
uagauaaaaauuucag

SEQ ID NO: 709107 - RNA, 15 nt, Haemophilus influenzae Rd
uagauaaaauuaauc

SEQ ID NO: 709108 - RNA, 18 nt, Haemophilus influenzae Rd
uagauaaauuucaauuaa

SEQ ID NO: 709109 - RNA, 14 nt, Haemophilus influenzae Rd
uagauaacaacuaa

SEQ ID NO: 709110 - RNA, 18 nt, Haemophilus influenzae Rd
uagauaacaacuaaaaau

SEQ ID NO: 709111 - RNA, 17 nt, Haemophilus influenzae Rd
uagauaacguucauauu

SEQ ID NO: 709112 - RNA, 21 nt, Haemophilus influenzae Rd
uagauaacguucauauuguuu

SEQ ID NO: 709113 - RNA, 15 nt, Haemophilus influenzae Rd
uagauacauaaaaaa

SEQ ID NO: 709114 - RNA, 16 nt, Haemophilus influenzae Rd
uagauacaagaaagaa

SEQ ID NO: 709115 - RNA, 21 nt, Haemophilus influenzae Rd
uagauagaagauuuaaaacaa

SEQ ID NO: 709116 - RNA, 23 nt, Haemophilus influenzae Rd
uagauagaagauuuaaaacaaga

SEQ ID NO: 709117 - RNA, 16 nt, Haemophilus influenzae Rd
uagagucauuuacagg

SEQ ID NO: 709118 - RNA, 20 nt, Haemophilus influenzae Rd
uagaguacgcccauugaaaa

SEQ ID NO: 709119 - RNA, 13 nt, Haemophilus influenzae Rd
uagagugcagauu

SEQ ID NO: 709120 - RNA, 13 nt, Haemophilus influenzae Rd
uagaaauuuuggc

SEQ ID NO: 709121 - RNA, 11 nt, Haemophilus influenzae Rd
uagaaaugauc

SEQ ID NO: 709122 - RNA, 13 nt, Haemophilus influenzae Rd
uagaaaucacaau

SEQ ID NO: 709123 - RNA, 19 nt, Haemophilus influenzae Rd
uagaaaucacaauaaaagc

SEQ ID NO: 709124 - RNA, 17 nt, Haemophilus influenzae Rd
uagaaaucacuaaauuu

SEQ ID NO: 709125 - RNA, 18 nt, Haemophilus influenzae Rd
uagaaaucccuugaccac

SEQ ID NO: 709126 - RNA, 14 nt, Haemophilus influenzae Rd
uagaaauuaauaau

SEQ ID NO: 709127 - RNA, 15 nt, Haemophilus influenzae Rd
uagaaaguaaacaau

SEQ ID NO: 709128 - RNA, 16 nt, Haemophilus influenzae Rd
uagaaaguaaacaauu

SEQ ID NO: 709129 - RNA, 18 nt, Haemophilus influenzae Rd
uagaaaggcaauauuuua

SEQ ID NO: 709130 - RNA, 22 nt, Haemophilus influenzae Rd
uagaaagcugagaaauuaagua

SEQ ID NO: 709131 - RNA, 14 nt, Haemophilus influenzae Rd
uagaaacuaaacuu

SEQ ID NO: 709132 - RNA, 18 nt, Haemophilus influenzae Rd
uagaaauacauuauuaaa

SEQ ID NO: 709133 - RNA, 18 nt, Haemophilus influenzae Rd
uagaaaguggcuuaauuu

SEQ ID NO: 709134 - RNA, 18 nt, Haemophilus influenzae Rd
uacuaugaggauuuucau

SEQ ID NO: 709135 - RNA, 14 nt, Haemophilus influenzae Rd
uagaaacagaagua

SEQ ID NO: 709136 - RNA, 13 nt, Haemophilus influenzae Rd
uacuauacacauc

SEQ ID NO: 709137 - RNA, 14 nt, Haemophilus influenzae Rd
uacuacuuuggauu

SEQ ID NO: 709138 - RNA, 19 nt, Haemophilus influenzae Rd
uacuacuuuggauuggauu

SEQ ID NO: 709139 - RNA, 21 nt, Haemophilus influenzae Rd
uagaauauuuugcauguuauu

SEQ ID NO: 709140 - RNA, 16 nt, Haemophilus influenzae Rd
uagaauuaaauuugcu

SEQ ID NO: 709141 - RNA, 16 nt, Haemophilus influenzae Rd
uagaauuauuuaaacu

SEQ ID NO: 709142 - RNA, 23 nt, Haemophilus influenzae Rd
uagaaugggcauugacuaaggcc

SEQ ID NO: 709143 - RNA, 16 nt, Haemophilus influenzae Rd
uagaauggugacgaga

SEQ ID NO: 709144 - RNA, 16 nt, Haemophilus influenzae Rd
uagaauguaaauuauu

SEQ ID NO: 709145 - RNA, 21 nt, Haemophilus influenzae Rd
uagaaugcaacaaguacgauu

SEQ ID NO: 709146 - RNA, 20 nt, Haemophilus influenzae Rd
uagaauuuauaguuuaaacu

SEQ ID NO: 709147 - RNA, 22 nt, Haemophilus influenzae Rd
uagaauuuuaccgcacuuuauu

SEQ ID NO: 709148 - RNA, 13 nt, Haemophilus influenzae Rd
uagaagcguucau

SEQ ID NO: 709149 - RNA, 19 nt, Haemophilus influenzae Rd
uagaaggcuaguucuuccu

SEQ ID NO: 709150 - RNA, 20 nt, Haemophilus influenzae Rd
uagaaggcuaguucuuccuu

SEQ ID NO: 709151 - RNA, 23 nt, Haemophilus influenzae Rd
uagaaggcuaguucuuccuuggu

SEQ ID NO: 709152 - RNA, 15 nt, Haemophilus influenzae Rd
uagaauaaauuaaaa

SEQ ID NO: 709153 - RNA, 16 nt, Haemophilus influenzae Rd
uagaauaaauuaaaaa

SEQ ID NO: 709154 - RNA, 14 nt, Haemophilus influenzae Rd
uagaauaacaacaa

SEQ ID NO: 709155 - RNA, 14 nt, Haemophilus influenzae Rd
uagaaccaggcgaa

SEQ ID NO: 709156 - RNA, 20 nt, Haemophilus influenzae Rd
uagaacgguggacuguuaau

SEQ ID NO: 709157 - RNA, 17 nt, Haemophilus influenzae Rd
uagaacuguuauuugca

SEQ ID NO: 709158 - RNA, 20 nt, Haemophilus influenzae Rd
uagaacuuagccuuuuuguu

SEQ ID NO: 709159 - RNA, 19 nt, Haemophilus influenzae Rd
uagaagauuuaaaacaaga

SEQ ID NO: 709160 - RNA, 15 nt, Haemophilus influenzae Rd
gccaccuuuuaccaa

SEQ ID NO: 709161 - RNA, 16 nt, Haemophilus influenzae Rd
gccaccuuuuguagaa

SEQ ID NO: 709162 - RNA, 17 nt, Haemophilus influenzae Rd
gccacauaauaagaaag

SEQ ID NO: 709163 - RNA, 16 nt, Haemophilus influenzae Rd
gcauagccguucuuau

SEQ ID NO: 709164 - RNA, 18 nt, Haemophilus influenzae Rd
gcauagccguucuuaucu

SEQ ID NO: 709165 - RNA, 16 nt, Haemophilus influenzae Rd
gccacucuaaguuuaa

SEQ ID NO: 709166 - RNA, 22 nt, Haemophilus influenzae Rd
gccagaaguuguuuuucuuccg

SEQ ID NO: 709167 - RNA, 21 nt, Haemophilus influenzae Rd
gccauaaaucgccuucacaua

SEQ ID NO: 709168 - RNA, 15 nt, Haemophilus influenzae Rd
gccauaaaauagccc

SEQ ID NO: 709169 - RNA, 15 nt, Haemophilus influenzae Rd
gccaguuucuuggga

SEQ ID NO: 709170 - RNA, 21 nt, Haemophilus influenzae Rd
gccaguaagaucuucuacugu

SEQ ID NO: 709171 - RNA, 23 nt, Haemophilus influenzae Rd
gccagugauuuuugcaacuucag

SEQ ID NO: 709172 - RNA, 16 nt, Haemophilus influenzae Rd
gccauagaaaauagaa

SEQ ID NO: 709173 - RNA, 18 nt, Haemophilus influenzae Rd
gccauauaagcaaagaaa

SEQ ID NO: 709174 - RNA, 22 nt, Haemophilus influenzae Rd
gccaucgcugaaauuaauaaga

SEQ ID NO: 709175 - RNA, 15 nt, Haemophilus influenzae Rd
gcccccccagcgacc

SEQ ID NO: 709176 - RNA, 16 nt, Haemophilus influenzae Rd
gccccagcaagaagca

SEQ ID NO: 709177 - RNA, 14 nt, Haemophilus influenzae Rd
gccccaaaagcugc

SEQ ID NO: 709178 - RNA, 15 nt, Haemophilus influenzae Rd
gcccauuccacccau

SEQ ID NO: 709179 - RNA, 20 nt, Haemophilus influenzae Rd
gcccacuuuuccuaaaguuu

SEQ ID NO: 709180 - RNA, 11 nt, Haemophilus influenzae Rd
gcccagcaauu

SEQ ID NO: 709181 - RNA, 22 nt, Haemophilus influenzae Rd
gcccugaaagucgauucaaaua

SEQ ID NO: 709182 - RNA, 16 nt, Haemophilus influenzae Rd
gcccgcuacaaauaag

SEQ ID NO: 709183 - RNA, 14 nt, Haemophilus influenzae Rd
gccuaauuggaaaa

SEQ ID NO: 709184 - RNA, 17 nt, Haemophilus influenzae Rd
gccuaauuggaaaagua

SEQ ID NO: 709185 - RNA, 17 nt, Haemophilus influenzae Rd
gccuaagccaaauccaa

SEQ ID NO: 709186 - RNA, 20 nt, Haemophilus influenzae Rd
gccuaacccccuuaauucua

SEQ ID NO: 709187 - RNA, 15 nt, Haemophilus influenzae Rd
gccuaauaaaaaaua

SEQ ID NO: 709188 - RNA, 23 nt, Haemophilus influenzae Rd
gccuauuagacuuaauuucacau

SEQ ID NO: 709189 - RNA, 17 nt, Haemophilus influenzae Rd
gccuauuuuuagaaaau

SEQ ID NO: 709190 - RNA, 13 nt, Haemophilus influenzae Rd
gccuaguauuuuu

SEQ ID NO: 709191 - RNA, 15 nt, Haemophilus influenzae Rd
gccuagugcuaaaau

SEQ ID NO: 709192 - RNA, 17 nt, Haemophilus influenzae Rd
gccucgauauuuauaag

SEQ ID NO: 709193 - RNA, 12 nt, Haemophilus influenzae Rd
gccugcugcagu

SEQ ID NO: 709194 - RNA, 16 nt, Haemophilus influenzae Rd
gccugcuaauggcuga

SEQ ID NO: 709195 - RNA, 15 nt, Haemophilus influenzae Rd
gccugcuacagaagc

SEQ ID NO: 709196 - RNA, 17 nt, Haemophilus influenzae Rd
gccugcuacagaagcug

SEQ ID NO: 709197 - RNA, 13 nt, Haemophilus influenzae Rd
gccuguggcaaaa

SEQ ID NO: 709198 - RNA, 18 nt, Haemophilus influenzae Rd
gccuguggaaacuaauuu

SEQ ID NO: 709199 - RNA, 16 nt, Haemophilus influenzae Rd
gccugcccaaguugug

SEQ ID NO: 709200 - RNA, 14 nt, Haemophilus influenzae Rd
gccugcauuaauaa

SEQ ID NO: 709201 - RNA, 12 nt, Haemophilus influenzae Rd
gccugcaaagcc

SEQ ID NO: 709202 - RNA, 19 nt, Haemophilus influenzae Rd
gccugauuucgcuuugcuu

SEQ ID NO: 709203 - RNA, 15 nt, Haemophilus influenzae Rd
gccucugcagggaaa

SEQ ID NO: 709204 - RNA, 22 nt, Haemophilus influenzae Rd
gccucugcagggaaaaauuuua

SEQ ID NO: 709205 - RNA, 22 nt, Haemophilus influenzae Rd
gccucuucuuuugcaaaaauga

SEQ ID NO: 709206 - RNA, 13 nt, Haemophilus influenzae Rd
gccucuuuaucua

SEQ ID NO: 709207 - RNA, 21 nt, Haemophilus influenzae Rd
gccucuuggauuuucuuagcu

SEQ ID NO: 709208 - RNA, 18 nt, Haemophilus influenzae Rd
gccugaaaaagcuaaaaa

SEQ ID NO: 709209 - RNA, 20 nt, Haemophilus influenzae Rd
gccugaaaaagcuaaaaaaa

SEQ ID NO: 709210 - RNA, 22 nt, Haemophilus influenzae Rd
gccugaaaaagcuaaaaaaaca

SEQ ID NO: 709211 - RNA, 11 nt, Haemophilus influenzae Rd
gccugaagccu

SEQ ID NO: 709212 - RNA, 23 nt, Haemophilus influenzae Rd
gccgcaucaacuugauugauaaa

SEQ ID NO: 709213 - RNA, 20 nt, Haemophilus influenzae Rd
gccgcacuuuugaucugcac

SEQ ID NO: 709214 - RNA, 22 nt, Haemophilus influenzae Rd
gccgcuuguugauuaauacgcu

SEQ ID NO: 709215 - RNA, 23 nt, Haemophilus influenzae Rd
gccuucgcgagauaaaauuuuua

SEQ ID NO: 709216 - RNA, 22 nt, Haemophilus influenzae Rd
gccuucgcuauuuuucgcuacg

SEQ ID NO: 709217 - RNA, 17 nt, Haemophilus influenzae Rd
gccuucauuugcccaua

SEQ ID NO: 709218 - RNA, 23 nt, Haemophilus influenzae Rd
gccuucacaaacccauuuauaac

SEQ ID NO: 709219 - RNA, 21 nt, Haemophilus influenzae Rd
gccuucaaugggcauccaaag

SEQ ID NO: 709220 - RNA, 21 nt, Haemophilus influenzae Rd
gccuguuucacgaucauaaau

SEQ ID NO: 709221 - RNA, 13 nt, Haemophilus influenzae Rd
gccuguucuucca

SEQ ID NO: 709222 - RNA, 14 nt, Haemophilus influenzae Rd
gccuguucuuccac

SEQ ID NO: 709223 - RNA, 19 nt, Haemophilus influenzae Rd
gccuguucuuccaccgcuu

SEQ ID NO: 709224 - RNA, 23 nt, Haemophilus influenzae Rd
gccuuguaauugauuuucagaaa

SEQ ID NO: 709225 - RNA, 19 nt, Haemophilus influenzae Rd
gccuugugcauaaacaaau

SEQ ID NO: 709226 - RNA, 15 nt, Haemophilus influenzae Rd
gccuugggcuaacau

SEQ ID NO: 709227 - RNA, 19 nt, Haemophilus influenzae Rd
gccuugcuuuuaauaaugu

SEQ ID NO: 709228 - RNA, 12 nt, Haemophilus influenzae Rd
gccuucuucacu

SEQ ID NO: 709229 - RNA, 20 nt, Haemophilus influenzae Rd
gccuucuucacuacuugaac

SEQ ID NO: 709230 - RNA, 17 nt, Haemophilus influenzae Rd
gccuucuaaaauaagaa

SEQ ID NO: 709231 - RNA, 20 nt, Haemophilus influenzae Rd
gccuucuaaaauaagaaugu

SEQ ID NO: 709232 - RNA, 14 nt, Haemophilus influenzae Rd
gccuugcaaauuuu

SEQ ID NO: 709233 - RNA, 14 nt, Haemophilus influenzae Rd
gccuugagauguuu

SEQ ID NO: 709234 - RNA, 15 nt, Haemophilus influenzae Rd
gccuugagauguuuc

SEQ ID NO: 709235 - RNA, 23 nt, Haemophilus influenzae Rd
gcgacaaguuugauccacaaaua

SEQ ID NO: 709236 - RNA, 17 nt, Haemophilus influenzae Rd
gcgaauuuuuauuuucu

SEQ ID NO: 709237 - RNA, 19 nt, Haemophilus influenzae Rd
gcgacagaaaccgcauauu

SEQ ID NO: 709238 - RNA, 15 nt, Haemophilus influenzae Rd
gcgaccauucucuaa

SEQ ID NO: 709239 - RNA, 12 nt, Haemophilus influenzae Rd
gccuuuuaaaau

SEQ ID NO: 709240 - RNA, 18 nt, Haemophilus influenzae Rd
gccuuuuaauaaacccuc

SEQ ID NO: 709241 - RNA, 14 nt, Haemophilus influenzae Rd
gccuuuuaguucgu

SEQ ID NO: 709242 - RNA, 17 nt, Haemophilus influenzae Rd
gccuuuccguucauaaa

SEQ ID NO: 709243 - RNA, 23 nt, Haemophilus influenzae Rd
gccuuuuugcuuaccaaccgaau

SEQ ID NO: 709244 - RNA, 19 nt, Haemophilus influenzae Rd
gcgaaauaucgcccuuauu

SEQ ID NO: 709245 - RNA, 23 nt, Haemophilus influenzae Rd
gcgaaccugauaaguagaaaaau

SEQ ID NO: 709246 - RNA, 15 nt, Haemophilus influenzae Rd
gcgaaccuucacuua

SEQ ID NO: 709247 - RNA, 19 nt, Haemophilus influenzae Rd
gcgauuuuuauauaaauaa

SEQ ID NO: 709248 - RNA, 14 nt, Haemophilus influenzae Rd
gcgauuuuugcacg

SEQ ID NO: 709249 - RNA, 17 nt, Haemophilus influenzae Rd
gcgauuuccaagcuggc

SEQ ID NO: 709250 - RNA, 17 nt, Haemophilus influenzae Rd
gcgauuacugucaaucc

SEQ ID NO: 709251 - RNA, 19 nt, Haemophilus influenzae Rd
gcgauggcaguuuggaaag

SEQ ID NO: 709252 - RNA, 18 nt, Haemophilus influenzae Rd
gcgcagcaauuaauaaua

SEQ ID NO: 709253 - RNA, 20 nt, Haemophilus influenzae Rd
gcgaucauuacuuuaaagcc

SEQ ID NO: 709254 - RNA, 14 nt, Haemophilus influenzae Rd
gcgcuaaaucauaa

SEQ ID NO: 709255 - RNA, 16 nt, Haemophilus influenzae Rd
gcgccacuuccccaag

SEQ ID NO: 709256 - RNA, 18 nt, Haemophilus influenzae Rd
gcguuagccgauuuaccu

SEQ ID NO: 709257 - RNA, 16 nt, Haemophilus influenzae Rd
gcgugguucaaaacca

SEQ ID NO: 709258 - RNA, 23 nt, Haemophilus influenzae Rd
gcguuauccaucaagaaaguuuu

SEQ ID NO: 709259 - RNA, 19 nt, Haemophilus influenzae Rd
gcguuuuuuaauucuucga

SEQ ID NO: 709260 - RNA, 11 nt, Haemophilus influenzae Rd
gcuaaaaaaac

SEQ ID NO: 709261 - RNA, 13 nt, Haemophilus influenzae Rd
gcguuuuucuuaa

SEQ ID NO: 709262 - RNA, 23 nt, Haemophilus influenzae Rd
gcguaucauacuaaaaaauuaaa

SEQ ID NO: 709263 - RNA, 13 nt, Haemophilus influenzae Rd
gcgugaaauauug

SEQ ID NO: 709264 - RNA, 18 nt, Haemophilus influenzae Rd
gcuaccuacuaaugaacg

SEQ ID NO: 709265 - RNA, 15 nt, Haemophilus influenzae Rd
gcuaccuucaaccac

SEQ ID NO: 709266 - RNA, 21 nt, Haemophilus influenzae Rd
gcuacgaaccgagcggucaga

SEQ ID NO: 709267 - RNA, 14 nt, Haemophilus influenzae Rd
gcuaccgaaagaua

SEQ ID NO: 709268 - RNA, 23 nt, Haemophilus influenzae Rd
gcuacguuagagaauaaguaguu

SEQ ID NO: 709269 - RNA, 17 nt, Haemophilus influenzae Rd
gcuacuauacacaucag

SEQ ID NO: 709270 - RNA, 19 nt, Haemophilus influenzae Rd
gcuacaauauuuauuucua

SEQ ID NO: 709271 - RNA, 14 nt, Haemophilus influenzae Rd
gcuaauuuuuaaaa

SEQ ID NO: 709272 - RNA, 20 nt, Haemophilus influenzae Rd
gcuaauuuuuaaaauagaau

SEQ ID NO: 709273 - RNA, 20 nt, Haemophilus influenzae Rd
gcuaaugguuggaagaaaag

SEQ ID NO: 709274 - RNA, 21 nt, Haemophilus influenzae Rd
gcuaauucguuaauaaaucca

SEQ ID NO: 709275 - RNA, 16 nt, Haemophilus influenzae Rd
gcuaauucuacaccag

SEQ ID NO: 709276 - RNA, 12 nt, Haemophilus influenzae Rd
gcuaauucuucu

SEQ ID NO: 709277 - RNA, 20 nt, Haemophilus influenzae Rd
gcuaauuuaagaaaaacgcc

SEQ ID NO: 709278 - RNA, 11 nt, Haemophilus influenzae Rd
gcuacagugag

SEQ ID NO: 709279 - RNA, 17 nt, Haemophilus influenzae Rd
gcuacauauucaaaagg

SEQ ID NO: 709280 - RNA, 14 nt, Haemophilus influenzae Rd
gcuacaucaacaaa

SEQ ID NO: 709281 - RNA, 15 nt, Haemophilus influenzae Rd
gcuacacccacuuca

SEQ ID NO: 709282 - RNA, 23 nt, Haemophilus influenzae Rd
gcuacacccacuucaccuuggca

SEQ ID NO: 709283 - RNA, 14 nt, Haemophilus influenzae Rd
gcuaccauuuaucu

SEQ ID NO: 709284 - RNA, 19 nt, Haemophilus influenzae Rd
gcuaccacguuuucaacag

SEQ ID NO: 709285 - RNA, 22 nt, Haemophilus influenzae Rd
gcuacauuugccccaacaacau

SEQ ID NO: 709286 - RNA, 15 nt, Haemophilus influenzae Rd
gcuaauaauaaaaag

SEQ ID NO: 709287 - RNA, 17 nt, Haemophilus influenzae Rd
gcuaauaaucuauuucu

SEQ ID NO: 709288 - RNA, 16 nt, Haemophilus influenzae Rd
gcuaauaaaaauccuu

SEQ ID NO: 709289 - RNA, 14 nt, Haemophilus influenzae Rd
gcuaauccaaauca

SEQ ID NO: 709290 - RNA, 17 nt, Haemophilus influenzae Rd
gcuaauccaauuucaca

SEQ ID NO: 709291 - RNA, 15 nt, Haemophilus influenzae Rd
gcuaaggcaaaaaaa

SEQ ID NO: 709292 - RNA, 22 nt, Haemophilus influenzae Rd
gcuaagacaccugcaagugcgg

SEQ ID NO: 709293 - RNA, 13 nt, Haemophilus influenzae Rd
gcuaagccaauaa

SEQ ID NO: 709294 - RNA, 16 nt, Haemophilus influenzae Rd
gcuaaguacaaaagag

SEQ ID NO: 709295 - RNA, 16 nt, Haemophilus influenzae Rd
gcuaacucaucaacaa

SEQ ID NO: 709296 - RNA, 19 nt, Haemophilus influenzae Rd
gcuaacggcguaccuucaa

SEQ ID NO: 709297 - RNA, 16 nt, Haemophilus influenzae Rd
gcuaacggcaaauaac

SEQ ID NO: 709298 - RNA, 12 nt, Haemophilus influenzae Rd
gcuaaauuuauu

SEQ ID NO: 709299 - RNA, 13 nt, Haemophilus influenzae Rd
gcuaacacugcca

SEQ ID NO: 709300 - RNA, 20 nt, Haemophilus influenzae Rd
gcuaacauugcaucagccac

SEQ ID NO: 709301 - RNA, 24 nt, Haemophilus influenzae Rd
gcuaaaucauaagcaauaauuuca

SEQ ID NO: 709302 - RNA, 14 nt, Haemophilus influenzae Rd
gcuaacaaaauuaa

SEQ ID NO: 709303 - RNA, 14 nt, Haemophilus influenzae Rd
gcuaacaaauaaug

SEQ ID NO: 709304 - RNA, 15 nt, Haemophilus influenzae Rd
gcuaacaaauaaugc

SEQ ID NO: 709305 - RNA, 20 nt, Haemophilus influenzae Rd
gcuaacaaauaaugccucau

SEQ ID NO: 709306 - RNA, 22 nt, Haemophilus influenzae Rd
gcuaaaucuguuucauuuguua

SEQ ID NO: 709307 - RNA, 22 nt, Haemophilus influenzae Rd
gcuaaaguucucaaaaaguuaa

SEQ ID NO: 709308 - RNA, 22 nt, Haemophilus influenzae Rd
gcuaaacuuuucgcaaaauauc

SEQ ID NO: 709309 - RNA, 15 nt, Haemophilus influenzae Rd
gcuaaaaagaaauaa

SEQ ID NO: 709310 - RNA, 19 nt, Haemophilus influenzae Rd
gcuaaaaagaaauaaaaga

SEQ ID NO: 709311 - RNA, 13 nt, Haemophilus influenzae Rd
gcuaaaacagaag

SEQ ID NO: 709312 - RNA, 14 nt, Haemophilus influenzae Rd
gcuaaaaucuugca

SEQ ID NO: 709313 - RNA, 13 nt, Haemophilus influenzae Rd
gcuaaaauuaaag

SEQ ID NO: 709314 - RNA, 14 nt, Haemophilus influenzae Rd
gcucggaauguuuu

SEQ ID NO: 709315 - RNA, 15 nt, Haemophilus influenzae Rd
gcucgcuggaaucaa

SEQ ID NO: 709316 - RNA, 21 nt, Haemophilus influenzae Rd
gcucgcuccccuucauaagcc

SEQ ID NO: 709317 - RNA, 18 nt, Haemophilus influenzae Rd
gcucgcucuucagcuucu

SEQ ID NO: 709318 - RNA, 13 nt, Haemophilus influenzae Rd
gcucgccaauaaa

SEQ ID NO: 709319 - RNA, 18 nt, Haemophilus influenzae Rd
gcucgccaauaaaauguu

SEQ ID NO: 709320 - RNA, 17 nt, Haemophilus influenzae Rd
gcuccuacauuaaaaga

SEQ ID NO: 709321 - RNA, 22 nt, Haemophilus influenzae Rd
gcuccgccaccuacgccugcga

SEQ ID NO: 709322 - RNA, 22 nt, Haemophilus influenzae Rd
gcuccaguuguaaagauugacc

SEQ ID NO: 709323 - RNA, 18 nt, Haemophilus influenzae Rd
gcucaauguuaaguucau

SEQ ID NO: 709324 - RNA, 14 nt, Haemophilus influenzae Rd
gcguaccaaauucc

SEQ ID NO: 709325 - RNA, 14 nt, Haemophilus influenzae Rd
gcguacaacgugaa

SEQ ID NO: 709326 - RNA, 17 nt, Haemophilus influenzae Rd
gcguaaugccaucacca

SEQ ID NO: 709327 - RNA, 17 nt, Haemophilus influenzae Rd
gcgguuaaaauaaaaga

SEQ ID NO: 709328 - RNA, 15 nt, Haemophilus influenzae Rd
gcgguuaauuuucac

SEQ ID NO: 709329 - RNA, 15 nt, Haemophilus influenzae Rd
gcgguucuucuuuua

SEQ ID NO: 709330 - RNA, 23 nt, Haemophilus influenzae Rd
gcgguucuucuuuuaauaauaga

SEQ ID NO: 709331 - RNA, 11 nt, Haemophilus influenzae Rd
gcgguugaaau

SEQ ID NO: 709332 - RNA, 16 nt, Haemophilus influenzae Rd
gcguaaccaaagaaag

SEQ ID NO: 709333 - RNA, 18 nt, Haemophilus influenzae Rd
gcguaacccaaagcacaa

SEQ ID NO: 709334 - RNA, 18 nt, Haemophilus influenzae Rd
gcguaaagggaagugaua

SEQ ID NO: 709335 - RNA, 11 nt, Haemophilus influenzae Rd
gcguaaaucag

SEQ ID NO: 709336 - RNA, 13 nt, Haemophilus influenzae Rd
gcguaaaaaugcu

SEQ ID NO: 709337 - RNA, 22 nt, Haemophilus influenzae Rd
gcguaaaaaugcuguuucuaau

SEQ ID NO: 709338 - RNA, 22 nt, Haemophilus influenzae Rd
gcguaaacauuuuguaucuaaa

SEQ ID NO: 709339 - RNA, 20 nt, Haemophilus influenzae Rd
gcguaaaccuacacccacug

SEQ ID NO: 709340 - RNA, 23 nt, Haemophilus influenzae Rd
gcggcuucaucuaagguuucgau

SEQ ID NO: 709341 - RNA, 21 nt, Haemophilus influenzae Rd
gcggcggaauucaucaagcuc

SEQ ID NO: 709342 - RNA, 13 nt, Haemophilus influenzae Rd
gcaacggcagcgg

SEQ ID NO: 709343 - RNA, 15 nt, Haemophilus influenzae Rd
gcaacgcauuagcau

SEQ ID NO: 709344 - RNA, 13 nt, Haemophilus influenzae Rd
gcaacccacuucu

SEQ ID NO: 709345 - RNA, 16 nt, Haemophilus influenzae Rd
gcaacgacaaucacug

SEQ ID NO: 709346 - RNA, 18 nt, Haemophilus influenzae Rd
gcaaccuguggcaggugg

SEQ ID NO: 709347 - RNA, 15 nt, Haemophilus influenzae Rd
gcaaccaaugcaaca

SEQ ID NO: 709348 - RNA, 19 nt, Haemophilus influenzae Rd
gcaacaucaauaacaagcu

SEQ ID NO: 709349 - RNA, 15 nt, Haemophilus influenzae Rd
gcaacauauuuucua

SEQ ID NO: 709350 - RNA, 14 nt, Haemophilus influenzae Rd
gcaacagugauacu

SEQ ID NO: 709351 - RNA, 17 nt, Haemophilus influenzae Rd
gcaaaagacgaagaaac

SEQ ID NO: 709352 - RNA, 14 nt, Haemophilus influenzae Rd
gcaaaagccaauaa

SEQ ID NO: 709353 - RNA, 21 nt, Haemophilus influenzae Rd
gcaacaaagugcggcaaaaaa

SEQ ID NO: 709354 - RNA, 15 nt, Haemophilus influenzae Rd
gcaaaacugaaagaa

SEQ ID NO: 709355 - RNA, 19 nt, Haemophilus influenzae Rd
gcaaaacgugcugcagcuu

SEQ ID NO: 709356 - RNA, 13 nt, Haemophilus influenzae Rd
gcaaaagcaauaa

SEQ ID NO: 709357 - RNA, 15 nt, Haemophilus influenzae Rd
gcaacacuugcugcc

SEQ ID NO: 709358 - RNA, 21 nt, Haemophilus influenzae Rd
gcaacaauaacugccacauca

SEQ ID NO: 709359 - RNA, 16 nt, Haemophilus influenzae Rd
gcaacaccaccagcgu

SEQ ID NO: 709360 - RNA, 17 nt, Haemophilus influenzae Rd
gcaagauagcaaaauau

SEQ ID NO: 709361 - RNA, 19 nt, Haemophilus influenzae Rd
gcaagcugugcaagcauuu

SEQ ID NO: 709362 - RNA, 17 nt, Haemophilus influenzae Rd
gcaagcuggcuuggguu

SEQ ID NO: 709363 - RNA, 22 nt, Haemophilus influenzae Rd
gcaacuaaauuagcucuagucc

SEQ ID NO: 709364 - RNA, 17 nt, Haemophilus influenzae Rd
gcaacuaaauucaauuu

SEQ ID NO: 709365 - RNA, 20 nt, Haemophilus influenzae Rd
gcaaguugggauuuaucuuc

SEQ ID NO: 709366 - RNA, 17 nt, Haemophilus influenzae Rd
gcaauaaccaauaacga

SEQ ID NO: 709367 - RNA, 13 nt, Haemophilus influenzae Rd
gcaauaaccacgc

SEQ ID NO: 709368 - RNA, 22 nt, Haemophilus influenzae Rd
gcaauaagugcgguaaaaaaau

SEQ ID NO: 709369 - RNA, 18 nt, Haemophilus influenzae Rd
gcaaguuugcgaucauca

SEQ ID NO: 709370 - RNA, 18 nt, Haemophilus influenzae Rd
gcaauaaaaaaacaccuu

SEQ ID NO: 709371 - RNA, 20 nt, Haemophilus influenzae Rd
gcaauccacuacugcaucug

SEQ ID NO: 709372 - RNA, 11 nt, Haemophilus influenzae Rd
gcaaucauaau

SEQ ID NO: 709373 - RNA, 17 nt, Haemophilus influenzae Rd
gcacauuaauuugugag

SEQ ID NO: 709374 - RNA, 19 nt, Haemophilus influenzae Rd
gcaccaucguuaaaccaaa

SEQ ID NO: 709375 - RNA, 14 nt, Haemophilus influenzae Rd
gcacaguauuuaua

SEQ ID NO: 709376 - RNA, 13 nt, Haemophilus influenzae Rd
gcacaaaauaaug

SEQ ID NO: 709377 - RNA, 19 nt, Haemophilus influenzae Rd
gcaaugcaaaaguaaauaa

SEQ ID NO: 709378 - RNA, 18 nt, Haemophilus influenzae Rd
gcaaucguaagauccaaa

SEQ ID NO: 709379 - RNA, 22 nt, Haemophilus influenzae Rd
gcacaaagacagcuauuaaaaa

SEQ ID NO: 709380 - RNA, 18 nt, Haemophilus influenzae Rd
gcacaacaugcccuuucu

SEQ ID NO: 709381 - RNA, 16 nt, Haemophilus influenzae Rd
gcaccccaaaagcugg

SEQ ID NO: 709382 - RNA, 18 nt, Haemophilus influenzae Rd
gcacccaucacauuuuca

SEQ ID NO: 709383 - RNA, 20 nt, Haemophilus influenzae Rd
gcacccacuucgauauuuuc

SEQ ID NO: 709384 - RNA, 14 nt, Haemophilus influenzae Rd
gcacuugcaucuaa

SEQ ID NO: 709385 - RNA, 22 nt, Haemophilus influenzae Rd
gcacuugccacaacugaagcuu

SEQ ID NO: 709386 - RNA, 12 nt, Haemophilus influenzae Rd
gcacuucuucag

SEQ ID NO: 709387 - RNA, 19 nt, Haemophilus influenzae Rd
gcacuuuccaucauugcuc

SEQ ID NO: 709388 - RNA, 14 nt, Haemophilus influenzae Rd
gcacuuugauuuug

SEQ ID NO: 709389 - RNA, 20 nt, Haemophilus influenzae Rd
gcacuuuuggauaaaguauu

SEQ ID NO: 709390 - RNA, 21 nt, Haemophilus influenzae Rd
gcacuuuuggauaaaguauuc

SEQ ID NO: 709391 - RNA, 16 nt, Haemophilus influenzae Rd
gcacuuuugugauuaa

SEQ ID NO: 709392 - RNA, 13 nt, Haemophilus influenzae Rd
gcacuuuuuaaua

SEQ ID NO: 709393 - RNA, 21 nt, Haemophilus influenzae Rd
gcacuuuuuaauaaaauguuu

SEQ ID NO: 709394 - RNA, 21 nt, Haemophilus influenzae Rd
gcacuuuuuagucaaaaguau

SEQ ID NO: 709395 - RNA, 17 nt, Haemophilus influenzae Rd
gcacuuuuuauauuuuu

SEQ ID NO: 709396 - RNA, 16 nt, Haemophilus influenzae Rd
gcacuuuuuauuagau

SEQ ID NO: 709397 - RNA, 20 nt, Haemophilus influenzae Rd
gcacuuguggcggguuucuu

SEQ ID NO: 709398 - RNA, 16 nt, Haemophilus influenzae Rd
gcacuuggcgaacauu

SEQ ID NO: 709399 - RNA, 18 nt, Haemophilus influenzae Rd
gcacuugggcugcaugaa

SEQ ID NO: 709400 - RNA, 19 nt, Haemophilus influenzae Rd
gcacuuggguaaauauaaa

SEQ ID NO: 709401 - RNA, 14 nt, Haemophilus influenzae Rd
gcacuuuauuagaa

SEQ ID NO: 709402 - RNA, 18 nt, Haemophilus influenzae Rd
gcacuuuauuagaaauau

SEQ ID NO: 709403 - RNA, 13 nt, Haemophilus influenzae Rd
gcacuuuauucaa

SEQ ID NO: 709404 - RNA, 18 nt, Haemophilus influenzae Rd
gcacuuuaccauuacaua

SEQ ID NO: 709405 - RNA, 14 nt, Haemophilus influenzae Rd
gcacuuuagaaaau

SEQ ID NO: 709406 - RNA, 15 nt, Haemophilus influenzae Rd
gcacuuuaaauauuu

SEQ ID NO: 709407 - RNA, 15 nt, Haemophilus influenzae Rd
gcacuuguugauuga

SEQ ID NO: 709408 - RNA, 21 nt, Haemophilus influenzae Rd
gcacuuuaaucugugccuuaa

SEQ ID NO: 709409 - RNA, 23 nt, Haemophilus influenzae Rd
gcacuuuuauauguaaaauuuuu

SEQ ID NO: 709410 - RNA, 17 nt, Haemophilus influenzae Rd
gcacuuucuucuuuuag

SEQ ID NO: 709411 - RNA, 13 nt, Haemophilus influenzae Rd
gcacuuuggguug

SEQ ID NO: 709412 - RNA, 18 nt, Haemophilus influenzae Rd
gcacuuuuugaaagacug

SEQ ID NO: 709413 - RNA, 15 nt, Haemophilus influenzae Rd
gcagaaaaauguuca

SEQ ID NO: 709414 - RNA, 19 nt, Haemophilus influenzae Rd
gcagaacgguaagccgcua

SEQ ID NO: 709415 - RNA, 14 nt, Haemophilus influenzae Rd
gcagagaagaaaua

SEQ ID NO: 709416 - RNA, 15 nt, Haemophilus influenzae Rd
gcagacaaguuuaau

SEQ ID NO: 709417 - RNA, 22 nt, Haemophilus influenzae Rd
gcagaaugaaucguuuguucug

SEQ ID NO: 709418 - RNA, 18 nt, Haemophilus influenzae Rd
gcagccuuguucugcagc

SEQ ID NO: 709419 - RNA, 17 nt, Haemophilus influenzae Rd
gcagauccuuucacaaa

SEQ ID NO: 709420 - RNA, 13 nt, Haemophilus influenzae Rd
gcaggcuuaacac

SEQ ID NO: 709421 - RNA, 23 nt, Haemophilus influenzae Rd
gcagguacacggccguaaugaau

SEQ ID NO: 709422 - RNA, 16 nt, Haemophilus influenzae Rd
gcauaaacuaaaauau

SEQ ID NO: 709423 - RNA, 15 nt, Haemophilus influenzae Rd
gcaguaauaaauccu

SEQ ID NO: 709424 - RNA, 23 nt, Haemophilus influenzae Rd
gcagugaucccagcauaaauaaa

SEQ ID NO: 709425 - RNA, 16 nt, Haemophilus influenzae Rd
gcagugguaaauuuua

SEQ ID NO: 709426 - RNA, 18 nt, Haemophilus influenzae Rd
gauguucuaaaucaucag

SEQ ID NO: 709427 - RNA, 18 nt, Haemophilus influenzae Rd
gauguugcaaccuucagc

SEQ ID NO: 709428 - RNA, 15 nt, Haemophilus influenzae Rd
gauuacaucuaaugc

SEQ ID NO: 709429 - RNA, 19 nt, Haemophilus influenzae Rd
gauuagagccaucacguuc

SEQ ID NO: 709430 - RNA, 22 nt, Haemophilus influenzae Rd
gauuaccacccaaaauuucagc

SEQ ID NO: 709431 - RNA, 17 nt, Haemophilus influenzae Rd
gauuaaucuuuuuucuu

SEQ ID NO: 709432 - RNA, 23 nt, Haemophilus influenzae Rd
gauuaaucuuuuuucuugcuaaa

SEQ ID NO: 709433 - RNA, 19 nt, Haemophilus influenzae Rd
gauuaaugcuauaaaucca

SEQ ID NO: 709434 - RNA, 13 nt, Haemophilus influenzae Rd
gauuaauuaaauu

SEQ ID NO: 709435 - RNA, 14 nt, Haemophilus influenzae Rd
gauuaauucaacag

SEQ ID NO: 709436 - RNA, 15 nt, Haemophilus influenzae Rd
gauuaauugcuacca

SEQ ID NO: 709437 - RNA, 17 nt, Haemophilus influenzae Rd
gauuaauugcuaccauu

SEQ ID NO: 709438 - RNA, 14 nt, Haemophilus influenzae Rd
gauuaauuuuccua

SEQ ID NO: 709439 - RNA, 14 nt, Haemophilus influenzae Rd
gauuacaaaaacac

SEQ ID NO: 709440 - RNA, 17 nt, Haemophilus influenzae Rd
gaugucuggcugaguaa

SEQ ID NO: 709441 - RNA, 19 nt, Haemophilus influenzae Rd
gauuccuaaucuuaugaau

SEQ ID NO: 709442 - RNA, 14 nt, Haemophilus influenzae Rd
gauuccuacaccac

SEQ ID NO: 709443 - RNA, 14 nt, Haemophilus influenzae Rd
gauuccucugcagg

SEQ ID NO: 709444 - RNA, 17 nt, Haemophilus influenzae Rd
gauuccucugcaggcau

SEQ ID NO: 709445 - RNA, 23 nt, Haemophilus influenzae Rd
gauuccucugcaggcauuuucaa

SEQ ID NO: 709446 - RNA, 19 nt, Haemophilus influenzae Rd
gauuccaccacucgggcaa

SEQ ID NO: 709447 - RNA, 14 nt, Haemophilus influenzae Rd
gauucauuaaguuu

SEQ ID NO: 709448 - RNA, 19 nt, Haemophilus influenzae Rd
gauucauuaaguuuucuac

SEQ ID NO: 709449 - RNA, 14 nt, Haemophilus influenzae Rd
gauucauuguuucu

SEQ ID NO: 709450 - RNA, 18 nt, Haemophilus influenzae Rd
gauucaaacgcguuaaau

SEQ ID NO: 709451 - RNA, 12 nt, Haemophilus influenzae Rd
gauucaaauaac

SEQ ID NO: 709452 - RNA, 13 nt, Haemophilus influenzae Rd
gauucaaaucuaa

SEQ ID NO: 709453 - RNA, 19 nt, Haemophilus influenzae Rd
gauucaaugcuuccuucaa

SEQ ID NO: 709454 - RNA, 13 nt, Haemophilus influenzae Rd
gauucuaaauauu

SEQ ID NO: 709455 - RNA, 20 nt, Haemophilus influenzae Rd
gauucguuguaccaaucaaa

SEQ ID NO: 709456 - RNA, 15 nt, Haemophilus influenzae Rd
gauugcaagugagcu

SEQ ID NO: 709457 - RNA, 14 nt, Haemophilus influenzae Rd
gauugcaccaaauu

SEQ ID NO: 709458 - RNA, 17 nt, Haemophilus influenzae Rd
gauugauggaucauaag

SEQ ID NO: 709459 - RNA, 20 nt, Haemophilus influenzae Rd
gauuuagguuucaauuuacc

SEQ ID NO: 709460 - RNA, 15 nt, Haemophilus influenzae Rd
gauuuaggcauugcu

SEQ ID NO: 709461 - RNA, 14 nt, Haemophilus influenzae Rd
gauuuaucuucccc

SEQ ID NO: 709462 - RNA, 20 nt, Haemophilus influenzae Rd
gauuuaauuuauuuucuaau

SEQ ID NO: 709463 - RNA, 15 nt, Haemophilus influenzae Rd
gauuuacagaacaaa

SEQ ID NO: 709464 - RNA, 16 nt, Haemophilus influenzae Rd
gauuuacccaacaaau

SEQ ID NO: 709465 - RNA, 13 nt, Haemophilus influenzae Rd
gauuuacuuuaau

SEQ ID NO: 709466 - RNA, 12 nt, Haemophilus influenzae Rd
gauuuucuucau

SEQ ID NO: 709467 - RNA, 18 nt, Haemophilus influenzae Rd
gauuuugccguucaaaac

SEQ ID NO: 709468 - RNA, 18 nt, Haemophilus influenzae Rd
gauuuuaaagaauguuug

SEQ ID NO: 709469 - RNA, 14 nt, Haemophilus influenzae Rd
gauuuuccaaaauu

SEQ ID NO: 709470 - RNA, 15 nt, Haemophilus influenzae Rd
gauuuuaaaguaaau

SEQ ID NO: 709471 - RNA, 19 nt, Haemophilus influenzae Rd
gauuuuuuuauaaaaaaac

SEQ ID NO: 709472 - RNA, 15 nt, Haemophilus influenzae Rd
gauuuuuuucagaaa

SEQ ID NO: 709473 - RNA, 18 nt, Haemophilus influenzae Rd
gauuuuuuucagaaauga

SEQ ID NO: 709474 - RNA, 19 nt, Haemophilus influenzae Rd
gauuuuugacgagauuuuu

SEQ ID NO: 709475 - RNA, 13 nt, Haemophilus influenzae Rd
gauuuuugauaaa

SEQ ID NO: 709476 - RNA, 18 nt, Haemophilus influenzae Rd
gauuucauuggcgguuuu

SEQ ID NO: 709477 - RNA, 19 nt, Haemophilus influenzae Rd
gauuuggcguucguguuca

SEQ ID NO: 709478 - RNA, 17 nt, Haemophilus influenzae Rd
gauuucuacacuuaaau

SEQ ID NO: 709479 - RNA, 18 nt, Haemophilus influenzae Rd
gauuucuguuaaaucuac

SEQ ID NO: 709480 - RNA, 20 nt, Haemophilus influenzae Rd
gaucccagcauaaauaaaua

SEQ ID NO: 709481 - RNA, 15 nt, Haemophilus influenzae Rd
gaucuauaagaaaau

SEQ ID NO: 709482 - RNA, 15 nt, Haemophilus influenzae Rd
gaucuauuugauuua

SEQ ID NO: 709483 - RNA, 22 nt, Haemophilus influenzae Rd
gaucuacaucaguaccuuuaau

SEQ ID NO: 709484 - RNA, 18 nt, Haemophilus influenzae Rd
gaucuacaccgaauaaua

SEQ ID NO: 709485 - RNA, 15 nt, Haemophilus influenzae Rd
gaucuaauacaguuu

SEQ ID NO: 709486 - RNA, 13 nt, Haemophilus influenzae Rd
gaucuaauccauu

SEQ ID NO: 709487 - RNA, 14 nt, Haemophilus influenzae Rd
gaucuaauuugcca

SEQ ID NO: 709488 - RNA, 13 nt, Haemophilus influenzae Rd
gaucugcacccca

SEQ ID NO: 709489 - RNA, 16 nt, Haemophilus influenzae Rd
gaucuuuuaaacgugu

SEQ ID NO: 709490 - RNA, 17 nt, Haemophilus influenzae Rd
gaucuuuuuuuuguuuu

SEQ ID NO: 709491 - RNA, 15 nt, Haemophilus influenzae Rd
gaucuuguaaagauu

SEQ ID NO: 709492 - RNA, 18 nt, Haemophilus influenzae Rd
gaucuugauccccauaca

SEQ ID NO: 709493 - RNA, 21 nt, Haemophilus influenzae Rd
gaugaaccauaaacaauauaa

SEQ ID NO: 709494 - RNA, 18 nt, Haemophilus influenzae Rd
gaucuucggauuuuucaa

SEQ ID NO: 709495 - RNA, 20 nt, Haemophilus influenzae Rd
gaucuucaaucaucauuuau

SEQ ID NO: 709496 - RNA, 23 nt, Haemophilus influenzae Rd
gaucugcugguacgagcacagua

SEQ ID NO: 709497 - RNA, 17 nt, Haemophilus influenzae Rd
gaugcccaagugcgauc

SEQ ID NO: 709498 - RNA, 18 nt, Haemophilus influenzae Rd
gaugccccugcaauugug

SEQ ID NO: 709499 - RNA, 20 nt, Haemophilus influenzae Rd
gaugcucugcauaaaagccu

SEQ ID NO: 709500 - RNA, 22 nt, Haemophilus influenzae Rd
gaugaagcuaagaaaauccaag

SEQ ID NO: 709501 - RNA, 14 nt, Haemophilus influenzae Rd
gaugaagaaaauuu

SEQ ID NO: 709502 - RNA, 17 nt, Haemophilus influenzae Rd
gaugaagaaaauuucug

SEQ ID NO: 709503 - RNA, 17 nt, Haemophilus influenzae Rd
gaugacgaaaugaaauu

SEQ ID NO: 709504 - RNA, 21 nt, Haemophilus influenzae Rd
gaugaggcguuuuucuuaaau

SEQ ID NO: 709505 - RNA, 17 nt, Haemophilus influenzae Rd
gaugcaacgcauuagca

SEQ ID NO: 709506 - RNA, 13 nt, Haemophilus influenzae Rd
gaugcaccaauac

SEQ ID NO: 709507 - RNA, 16 nt, Haemophilus influenzae Rd
gaugcaccaauaccaa

SEQ ID NO: 709508 - RNA, 17 nt, Haemophilus influenzae Rd
gaugauaaucuucccau

SEQ ID NO: 709509 - RNA, 19 nt, Haemophilus influenzae Rd
gaugaugggaugaaaucaa

SEQ ID NO: 709510 - RNA, 13 nt, Haemophilus influenzae Rd
gaugauuuuaaaa

SEQ ID NO: 709511 - RNA, 21 nt, Haemophilus influenzae Rd
gaugauuuuuacaaguuaaag

SEQ ID NO: 709512 - RNA, 14 nt, Haemophilus influenzae Rd
gaugauuugcauaa

SEQ ID NO: 709513 - RNA, 23 nt, Haemophilus influenzae Rd
gaugauuugcauaaaaccagcau

SEQ ID NO: 709514 - RNA, 14 nt, Haemophilus influenzae Rd
gaugauuaacuauu

SEQ ID NO: 709515 - RNA, 16 nt, Haemophilus influenzae Rd
gaugauuccaaaguuu

SEQ ID NO: 709516 - RNA, 20 nt, Haemophilus influenzae Rd
gaucacccauuaaauaaaaa

SEQ ID NO: 709517 - RNA, 20 nt, Haemophilus influenzae Rd
gaucaaaucaaauuuuccuu

SEQ ID NO: 709518 - RNA, 21 nt, Haemophilus influenzae Rd
gauauagcuagaaagcaaugu

SEQ ID NO: 709519 - RNA, 16 nt, Haemophilus influenzae Rd
gauauauuaacuugcu

SEQ ID NO: 709520 - RNA, 17 nt, Haemophilus influenzae Rd
gauauaucagugcuugc

SEQ ID NO: 709521 - RNA, 16 nt, Haemophilus influenzae Rd
gauauuauuauuaaau

SEQ ID NO: 709522 - RNA, 18 nt, Haemophilus influenzae Rd
gauauauugguuugcuua

SEQ ID NO: 709523 - RNA, 21 nt, Haemophilus influenzae Rd
gauauauugguuugcuuaaaa

SEQ ID NO: 709524 - RNA, 20 nt, Haemophilus influenzae Rd
gaucaaaaauauccacuucc

SEQ ID NO: 709525 - RNA, 18 nt, Haemophilus influenzae Rd
gaucacuaauugcauuaa

SEQ ID NO: 709526 - RNA, 22 nt, Haemophilus influenzae Rd
gaucagaaguuaaaacuugaau

SEQ ID NO: 709527 - RNA, 23 nt, Haemophilus influenzae Rd
gaucagagccucuuggauuuucu

SEQ ID NO: 709528 - RNA, 21 nt, Haemophilus influenzae Rd
gaucacuucugcauaacuuaa

SEQ ID NO: 709529 - RNA, 22 nt, Haemophilus influenzae Rd
gaucauagaaccgucuuuaaau

SEQ ID NO: 709530 - RNA, 17 nt, Haemophilus influenzae Rd
gaucaucacgacaucaa

SEQ ID NO: 709531 - RNA, 22 nt, Haemophilus influenzae Rd
gauccaguuggcgugcuuccau

SEQ ID NO: 709532 - RNA, 16 nt, Haemophilus influenzae Rd
gauccauacaguaaaa

SEQ ID NO: 709533 - RNA, 20 nt, Haemophilus influenzae Rd
gauccauacaguaaaaauag

SEQ ID NO: 709534 - RNA, 15 nt, Haemophilus influenzae Rd
gauccauuaauaacu

SEQ ID NO: 709535 - RNA, 22 nt, Haemophilus influenzae Rd
gauccauuaauaacugaauaau

SEQ ID NO: 709536 - RNA, 16 nt, Haemophilus influenzae Rd
gauagcccgccuaaua

SEQ ID NO: 709537 - RNA, 18 nt, Haemophilus influenzae Rd
gauagccucuucuuuuga

SEQ ID NO: 709538 - RNA, 20 nt, Haemophilus influenzae Rd
gauagcugugguaaauaauu

SEQ ID NO: 709539 - RNA, 14 nt, Haemophilus influenzae Rd
gauagguaauaaua

SEQ ID NO: 709540 - RNA, 17 nt, Haemophilus influenzae Rd
gauaguaaaaaaucaag

SEQ ID NO: 709541 - RNA, 19 nt, Haemophilus influenzae Rd
gauaguaaaaaaucaagcc

SEQ ID NO: 709542 - RNA, 19 nt, Haemophilus influenzae Rd
gauaguagagucauuuaca

SEQ ID NO: 709543 - RNA, 14 nt, Haemophilus influenzae Rd
gauagcuuuuguug

SEQ ID NO: 709544 - RNA, 22 nt, Haemophilus influenzae Rd
gauagugccaaucaagauaacu

SEQ ID NO: 709545 - RNA, 21 nt, Haemophilus influenzae Rd
gauagugcccgcuacaaauaa

SEQ ID NO: 709546 - RNA, 20 nt, Haemophilus influenzae Rd
gauagugaguugauuuaaau

SEQ ID NO: 709547 - RNA, 21 nt, Haemophilus influenzae Rd
gauagugaguugauuuaaauu

SEQ ID NO: 709548 - RNA, 22 nt, Haemophilus influenzae Rd
gauauaaaagugcgguaaaaau

SEQ ID NO: 709549 - RNA, 20 nt, Haemophilus influenzae Rd
gauauaacuugauguuuuug

SEQ ID NO: 709550 - RNA, 22 nt, Haemophilus influenzae Rd
gauauaacguaaucaaauccac

SEQ ID NO: 709551 - RNA, 21 nt, Haemophilus influenzae Rd
gauauaaguucuaaauaaacu

SEQ ID NO: 709552 - RNA, 18 nt, Haemophilus influenzae Rd
gauacuaacucaaaauac

SEQ ID NO: 709553 - RNA, 22 nt, Haemophilus influenzae Rd
gauaaguaaugaaaauugcaaa

SEQ ID NO: 709554 - RNA, 15 nt, Haemophilus influenzae Rd
gauaaguagaaaaau

SEQ ID NO: 709555 - RNA, 19 nt, Haemophilus influenzae Rd
gauaaguggggaaaaauau

SEQ ID NO: 709556 - RNA, 22 nt, Haemophilus influenzae Rd
gauaaguggggaaaaauauuaa

SEQ ID NO: 709557 - RNA, 17 nt, Haemophilus influenzae Rd
gauaaguucauaaaagg

SEQ ID NO: 709558 - RNA, 21 nt, Haemophilus influenzae Rd
gauaaguugggauaagcuuuu

SEQ ID NO: 709559 - RNA, 17 nt, Haemophilus influenzae Rd
gauaccgauaaaaccua

SEQ ID NO: 709560 - RNA, 16 nt, Haemophilus influenzae Rd
gauaaggcagaaauga

SEQ ID NO: 709561 - RNA, 19 nt, Haemophilus influenzae Rd
gauaagggcguagauauug

SEQ ID NO: 709562 - RNA, 22 nt, Haemophilus influenzae Rd
gauaaggcuuauuuuuaaacaa

SEQ ID NO: 709563 - RNA, 14 nt, Haemophilus influenzae Rd
gauaaggaaaauac

SEQ ID NO: 709564 - RNA, 18 nt, Haemophilus influenzae Rd
gauaagcauuuuaucaca

SEQ ID NO: 709565 - RNA, 18 nt, Haemophilus influenzae Rd
gaggcuaauaauaaaaag

SEQ ID NO: 709566 - RNA, 21 nt, Haemophilus influenzae Rd
gaggcugauagucgaaaucau

SEQ ID NO: 709567 - RNA, 14 nt, Haemophilus influenzae Rd
gaggcuaugauuuu

SEQ ID NO: 709568 - RNA, 21 nt, Haemophilus influenzae Rd
gaggcuaugauuuuaaagcca

SEQ ID NO: 709569 - RNA, 13 nt, Haemophilus influenzae Rd
gagguagaaaauc

SEQ ID NO: 709570 - RNA, 19 nt, Haemophilus influenzae Rd
gaggguucgaaucccucuc

SEQ ID NO: 709571 - RNA, 17 nt, Haemophilus influenzae Rd
gagggucaaaagaaaga

SEQ ID NO: 709572 - RNA, 18 nt, Haemophilus influenzae Rd
gagggucaaaagaaagac

SEQ ID NO: 709573 - RNA, 19 nt, Haemophilus influenzae Rd
gaguaaucuaauucuugcc

SEQ ID NO: 709574 - RNA, 11 nt, Haemophilus influenzae Rd
gaguaaaauac

SEQ ID NO: 709575 - RNA, 17 nt, Haemophilus influenzae Rd
gagguuuauaacaaaga

SEQ ID NO: 709576 - RNA, 22 nt, Haemophilus influenzae Rd
gaggugagaaguuuaagaaaag

SEQ ID NO: 709577 - RNA, 17 nt, Haemophilus influenzae Rd
gauaaaucgccccacua

SEQ ID NO: 709578 - RNA, 17 nt, Haemophilus influenzae Rd
gauaaauguguuaaaua

SEQ ID NO: 709579 - RNA, 18 nt, Haemophilus influenzae Rd
gauaaauguguuaaauaa

SEQ ID NO: 709580 - RNA, 17 nt, Haemophilus influenzae Rd
gauaaauuauauuuuua

SEQ ID NO: 709581 - RNA, 19 nt, Haemophilus influenzae Rd
gauaaauuauucugcaaca

SEQ ID NO: 709582 - RNA, 19 nt, Haemophilus influenzae Rd
gauaaacauaaccugaauu

SEQ ID NO: 709583 - RNA, 21 nt, Haemophilus influenzae Rd
gauaaacacugcgcagauuaa

SEQ ID NO: 709584 - RNA, 16 nt, Haemophilus influenzae Rd
gauaacuuagaaaaua

SEQ ID NO: 709585 - RNA, 23 nt, Haemophilus influenzae Rd
gauaagaaguuaucauuugaauu

SEQ ID NO: 709586 - RNA, 15 nt, Haemophilus influenzae Rd
gauaagauuugcuuu

SEQ ID NO: 709587 - RNA, 14 nt, Haemophilus influenzae Rd
gauaaccaaaauau

SEQ ID NO: 709588 - RNA, 17 nt, Haemophilus influenzae Rd
gauaacaauuuuugcau

SEQ ID NO: 709589 - RNA, 23 nt, Haemophilus influenzae Rd
gauaaauuucaauuaaaucaaaa

SEQ ID NO: 709590 - RNA, 13 nt, Haemophilus influenzae Rd
gauaaauuucuaa

SEQ ID NO: 709591 - RNA, 20 nt, Haemophilus influenzae Rd
gauaacaacucacaauaaua

SEQ ID NO: 709592 - RNA, 16 nt, Haemophilus influenzae Rd
gauaacaaacccugaa

SEQ ID NO: 709593 - RNA, 18 nt, Haemophilus influenzae Rd
gauaacaaacccugaauu

SEQ ID NO: 709594 - RNA, 11 nt, Haemophilus influenzae Rd
gauaacaaauu

SEQ ID NO: 709595 - RNA, 14 nt, Haemophilus influenzae Rd
gauaacaaauugcu

SEQ ID NO: 709596 - RNA, 15 nt, Haemophilus influenzae Rd
gagucgcacccgccu

SEQ ID NO: 709597 - RNA, 14 nt, Haemophilus influenzae Rd
gagucgaugccaag

SEQ ID NO: 709598 - RNA, 19 nt, Haemophilus influenzae Rd
gaguagcugaauaucagaa

SEQ ID NO: 709599 - RNA, 16 nt, Haemophilus influenzae Rd
gaguuguuuaaaauua

SEQ ID NO: 709600 - RNA, 14 nt, Haemophilus influenzae Rd
gaguuugaauaauu

SEQ ID NO: 709601 - RNA, 17 nt, Haemophilus influenzae Rd
gaguugcauaagcaaaa

SEQ ID NO: 709602 - RNA, 17 nt, Haemophilus influenzae Rd
gaguugauuuuaaaaua

SEQ ID NO: 709603 - RNA, 20 nt, Haemophilus influenzae Rd
gagugagauaaauaaauuca

SEQ ID NO: 709604 - RNA, 17 nt, Haemophilus influenzae Rd
gagaucacuguaaauaa

SEQ ID NO: 709605 - RNA, 15 nt, Haemophilus influenzae Rd
gagauauaaggcaca

SEQ ID NO: 709606 - RNA, 18 nt, Haemophilus influenzae Rd
gagauauaauacguaaau

SEQ ID NO: 709607 - RNA, 18 nt, Haemophilus influenzae Rd
gagauaauaaauauaauu

SEQ ID NO: 709608 - RNA, 13 nt, Haemophilus influenzae Rd
gagauaaaauuuu

SEQ ID NO: 709609 - RNA, 16 nt, Haemophilus influenzae Rd
gagauaagcauuuuau

SEQ ID NO: 709610 - RNA, 15 nt, Haemophilus influenzae Rd
gagcaccaaauuaaa

SEQ ID NO: 709611 - RNA, 12 nt, Haemophilus influenzae Rd
gagcaaaucaaa

SEQ ID NO: 709612 - RNA, 23 nt, Haemophilus influenzae Rd
gagcaaaucaaaaccuuucugua

SEQ ID NO: 709613 - RNA, 23 nt, Haemophilus influenzae Rd
gagcaaauuacccaaaugaugaa

SEQ ID NO: 709614 - RNA, 20 nt, Haemophilus influenzae Rd
gagcaaauuuaaauaauaaa

SEQ ID NO: 709615 - RNA, 19 nt, Haemophilus influenzae Rd
gagauuuaauccguuaauu

SEQ ID NO: 709616 - RNA, 13 nt, Haemophilus influenzae Rd
gagcaaucuuuuu

SEQ ID NO: 709617 - RNA, 20 nt, Haemophilus influenzae Rd
gagcaauauaaucuuuuaca

SEQ ID NO: 709618 - RNA, 21 nt, Haemophilus influenzae Rd
gagcaggggauugaaaauccc

SEQ ID NO: 709619 - RNA, 13 nt, Haemophilus influenzae Rd
gagccaagaauga

SEQ ID NO: 709620 - RNA, 12 nt, Haemophilus influenzae Rd
gagccaauuuuc

SEQ ID NO: 709621 - RNA, 17 nt, Haemophilus influenzae Rd
gagcaucgguauuaaug

SEQ ID NO: 709622 - RNA, 21 nt, Haemophilus influenzae Rd
gagcaucgguauuaaugacac

SEQ ID NO: 709623 - RNA, 21 nt, Haemophilus influenzae Rd
gagcaucuacccaauaaacau

SEQ ID NO: 709624 - RNA, 15 nt, Haemophilus influenzae Rd
gagcauauuuuccau

SEQ ID NO: 709625 - RNA, 22 nt, Haemophilus influenzae Rd
gagcauauuuuccaucaccuuc

SEQ ID NO: 709626 - RNA, 19 nt, Haemophilus influenzae Rd
gagcauaaggaccaagcaa

SEQ ID NO: 709627 - RNA, 17 nt, Haemophilus influenzae Rd
gagcauaacguauuuuc

SEQ ID NO: 709628 - RNA, 16 nt, Haemophilus influenzae Rd
gagcauaaacuaaaau

SEQ ID NO: 709629 - RNA, 14 nt, Haemophilus influenzae Rd
gagcuaaauccaga

SEQ ID NO: 709630 - RNA, 12 nt, Haemophilus influenzae Rd
gagcugcugcaa

SEQ ID NO: 709631 - RNA, 15 nt, Haemophilus influenzae Rd
gagcucuaguaauuc

SEQ ID NO: 709632 - RNA, 22 nt, Haemophilus influenzae Rd
gagcuaacuaauucggaagaau

SEQ ID NO: 709633 - RNA, 21 nt, Haemophilus influenzae Rd
gagcucaauuauuuauacuaa

SEQ ID NO: 709634 - RNA, 15 nt, Haemophilus influenzae Rd
gagccuucaaaauuu

SEQ ID NO: 709635 - RNA, 16 nt, Haemophilus influenzae Rd
gagccuccacaagcaa

SEQ ID NO: 709636 - RNA, 22 nt, Haemophilus influenzae Rd
gagccuugggaauaugaaaaag

SEQ ID NO: 709637 - RNA, 13 nt, Haemophilus influenzae Rd
gagccuuuuucua

SEQ ID NO: 709638 - RNA, 20 nt, Haemophilus influenzae Rd
gagcgauagaaauaaagaua

SEQ ID NO: 709639 - RNA, 15 nt, Haemophilus influenzae Rd
gagcgagguaagcug

SEQ ID NO: 709640 - RNA, 15 nt, Haemophilus influenzae Rd
gagcgagaccacuuu

SEQ ID NO: 709641 - RNA, 23 nt, Haemophilus influenzae Rd
gagcugucuaauuuuuuauucaa

SEQ ID NO: 709642 - RNA, 16 nt, Haemophilus influenzae Rd
gagcuugagcugcugc

SEQ ID NO: 709643 - RNA, 19 nt, Haemophilus influenzae Rd
gaggaauggucgagugguu

SEQ ID NO: 709644 - RNA, 22 nt, Haemophilus influenzae Rd
gaggagaaauaaucucuuuaua

SEQ ID NO: 709645 - RNA, 21 nt, Haemophilus influenzae Rd
gaggaaguuaauggguuaaaa

SEQ ID NO: 709646 - RNA, 14 nt, Haemophilus influenzae Rd
gaggcgauaagcaa

SEQ ID NO: 709647 - RNA, 22 nt, Haemophilus influenzae Rd
gaggauuugccucuucuuuugc

SEQ ID NO: 709648 - RNA, 17 nt, Haemophilus influenzae Rd
gaggauuuuauggcugc

SEQ ID NO: 709649 - RNA, 15 nt, Haemophilus influenzae Rd
gaggauuagaaauga

SEQ ID NO: 709650 - RNA, 16 nt, Haemophilus influenzae Rd
gaggagguagaaaauc

SEQ ID NO: 709651 - RNA, 15 nt, Haemophilus influenzae Rd
gacgugcuaauucug

SEQ ID NO: 709652 - RNA, 22 nt, Haemophilus influenzae Rd
gacuaaguucgguauucaaucg

SEQ ID NO: 709653 - RNA, 16 nt, Haemophilus influenzae Rd
gacuaaauaaaucaca

SEQ ID NO: 709654 - RNA, 17 nt, Haemophilus influenzae Rd
gacuaaaucaaaaauaa

SEQ ID NO: 709655 - RNA, 16 nt, Haemophilus influenzae Rd
gacuaaacuuuuaauu

SEQ ID NO: 709656 - RNA, 14 nt, Haemophilus influenzae Rd
gacguuuauuuuua

SEQ ID NO: 709657 - RNA, 21 nt, Haemophilus influenzae Rd
gacuaaacaaauaaaaagugg

SEQ ID NO: 709658 - RNA, 22 nt, Haemophilus influenzae Rd
gacuaaacaaauaaaaaguggg

SEQ ID NO: 709659 - RNA, 17 nt, Haemophilus influenzae Rd
gacggcuucagaaaaua

SEQ ID NO: 709660 - RNA, 23 nt, Haemophilus influenzae Rd
gacggugcauuugcauaaagcau

SEQ ID NO: 709661 - RNA, 17 nt, Haemophilus influenzae Rd
gacggugcgauggggac

SEQ ID NO: 709662 - RNA, 20 nt, Haemophilus influenzae Rd
gacguacaauuucaaauaaa

SEQ ID NO: 709663 - RNA, 21 nt, Haemophilus influenzae Rd
gacguaauuuacguaaugcuu

SEQ ID NO: 709664 - RNA, 15 nt, Haemophilus influenzae Rd
gacguaauuugugcg

SEQ ID NO: 709665 - RNA, 12 nt, Haemophilus influenzae Rd
gacuauuacaau

SEQ ID NO: 709666 - RNA, 22 nt, Haemophilus influenzae Rd
gacuaauuuuuuaauuuuuucu

SEQ ID NO: 709667 - RNA, 14 nt, Haemophilus influenzae Rd
gacugcuacuuuug

SEQ ID NO: 709668 - RNA, 15 nt, Haemophilus influenzae Rd
gacugaguucuguca

SEQ ID NO: 709669 - RNA, 21 nt, Haemophilus influenzae Rd
gacuggcuugugaaauaaaau

SEQ ID NO: 709670 - RNA, 18 nt, Haemophilus influenzae Rd
gacuuaauaauauauuca

SEQ ID NO: 709671 - RNA, 16 nt, Haemophilus influenzae Rd
gagaaaguaauggaag

SEQ ID NO: 709672 - RNA, 20 nt, Haemophilus influenzae Rd
gagaaaaaucgucaaaauca

SEQ ID NO: 709673 - RNA, 22 nt, Haemophilus influenzae Rd
gagaaaaaucuuuaccaaaaaa

SEQ ID NO: 709674 - RNA, 23 nt, Haemophilus influenzae Rd
gagaaagaauauaaauaaaacaa

SEQ ID NO: 709675 - RNA, 16 nt, Haemophilus influenzae Rd
gagaaaauucuccgca

SEQ ID NO: 709676 - RNA, 20 nt, Haemophilus influenzae Rd
gacuuuuuucuuaaauauau

SEQ ID NO: 709677 - RNA, 23 nt, Haemophilus influenzae Rd
gacuuuaccauugcguucacuca

SEQ ID NO: 709678 - RNA, 21 nt, Haemophilus influenzae Rd
gacuuguuucauaaaaaaugc

SEQ ID NO: 709679 - RNA, 19 nt, Haemophilus influenzae Rd
gacuuucaagcaagccaca

SEQ ID NO: 709680 - RNA, 23 nt, Haemophilus influenzae Rd
gacuuuaucgaggacaaucugcu

SEQ ID NO: 709681 - RNA, 16 nt, Haemophilus influenzae Rd
gacuuuauauugacaa

SEQ ID NO: 709682 - RNA, 12 nt, Haemophilus influenzae Rd
gagaacugaaag

SEQ ID NO: 709683 - RNA, 17 nt, Haemophilus influenzae Rd
gagaaguuuaagaaaag

SEQ ID NO: 709684 - RNA, 19 nt, Haemophilus influenzae Rd
gagaagcugaauaaaagag

SEQ ID NO: 709685 - RNA, 14 nt, Haemophilus influenzae Rd
gagaauuuuuucuu

SEQ ID NO: 709686 - RNA, 17 nt, Haemophilus influenzae Rd
gagaaucuuuaucuucu

SEQ ID NO: 709687 - RNA, 13 nt, Haemophilus influenzae Rd
gagagaagaaacg

SEQ ID NO: 709688 - RNA, 19 nt, Haemophilus influenzae Rd
gaccguauugucugcaacg

SEQ ID NO: 709689 - RNA, 18 nt, Haemophilus influenzae Rd
gaccgcuuguuuauuauu

SEQ ID NO: 709690 - RNA, 19 nt, Haemophilus influenzae Rd
gaccgcccucuugcacaau

SEQ ID NO: 709691 - RNA, 15 nt, Haemophilus influenzae Rd
gaccuguacuugcuu

SEQ ID NO: 709692 - RNA, 16 nt, Haemophilus influenzae Rd
gaccugcagaaaggcg

SEQ ID NO: 709693 - RNA, 15 nt, Haemophilus influenzae Rd
gaccugcagagaaga

SEQ ID NO: 709694 - RNA, 16 nt, Haemophilus influenzae Rd
gaccugaagaugauau

SEQ ID NO: 709695 - RNA, 19 nt, Haemophilus influenzae Rd
gaccguuuaacgcagccgc

SEQ ID NO: 709696 - RNA, 14 nt, Haemophilus influenzae Rd
gaccuaaucccaua

SEQ ID NO: 709697 - RNA, 14 nt, Haemophilus influenzae Rd
gaccguuuuuucuu

SEQ ID NO: 709698 - RNA, 22 nt, Haemophilus influenzae Rd
gaccguguuuuucaucaaugca

SEQ ID NO: 709699 - RNA, 17 nt, Haemophilus influenzae Rd
gaccgauuucuaccauu

SEQ ID NO: 709700 - RNA, 18 nt, Haemophilus influenzae Rd
gaccgcacuuuaaaagug

SEQ ID NO: 709701 - RNA, 22 nt, Haemophilus influenzae Rd
gaccgcacuuuuuauauuuuuu

SEQ ID NO: 709702 - RNA, 15 nt, Haemophilus influenzae Rd
gaccauuaaucacac

SEQ ID NO: 709703 - RNA, 21 nt, Haemophilus influenzae Rd
gaccauuacagcaagcaucgc

SEQ ID NO: 709704 - RNA, 18 nt, Haemophilus influenzae Rd
gaccuucugcaucaguau

SEQ ID NO: 709705 - RNA, 11 nt, Haemophilus influenzae Rd
gacgaaaaauu

SEQ ID NO: 709706 - RNA, 23 nt, Haemophilus influenzae Rd
gacgaaaugaaauuaauaagccc

SEQ ID NO: 709707 - RNA, 22 nt, Haemophilus influenzae Rd
gacgaacgugggaauuuuccca

SEQ ID NO: 709708 - RNA, 16 nt, Haemophilus influenzae Rd
gacgcaccuuuugaaa

SEQ ID NO: 709709 - RNA, 23 nt, Haemophilus influenzae Rd
gacgcacuguugugaaguuuuuu

SEQ ID NO: 709710 - RNA, 23 nt, Haemophilus influenzae Rd
gacgauuuaauagcacagaaaag

SEQ ID NO: 709711 - RNA, 18 nt, Haemophilus influenzae Rd
gacgagcuuuccaaacaa

SEQ ID NO: 709712 - RNA, 14 nt, Haemophilus influenzae Rd
gacgauaaccaucu

SEQ ID NO: 709713 - RNA, 18 nt, Haemophilus influenzae Rd
gacgcuugggcuuuuuca

SEQ ID NO: 709714 - RNA, 13 nt, Haemophilus influenzae Rd
gacggauuacaau

SEQ ID NO: 709715 - RNA, 16 nt, Haemophilus influenzae Rd
gacgcccgcagaacuu

SEQ ID NO: 709716 - RNA, 23 nt, Haemophilus influenzae Rd
gacgcauuacgccuucagaaaga

SEQ ID NO: 709717 - RNA, 16 nt, Haemophilus influenzae Rd
gacaccuuuaaaaauu

SEQ ID NO: 709718 - RNA, 19 nt, Haemophilus influenzae Rd
gacaccuuuaaaaauuaca

SEQ ID NO: 709719 - RNA, 19 nt, Haemophilus influenzae Rd
gacacgguaguaaauaaca

SEQ ID NO: 709720 - RNA, 19 nt, Haemophilus influenzae Rd
gacacaagggauuuaaaau

SEQ ID NO: 709721 - RNA, 21 nt, Haemophilus influenzae Rd
gacagaggggauaaaauaaac

SEQ ID NO: 709722 - RNA, 12 nt, Haemophilus influenzae Rd
gacagacuauuu

SEQ ID NO: 709723 - RNA, 17 nt, Haemophilus influenzae Rd
gacagacuauuucugua

SEQ ID NO: 709724 - RNA, 15 nt, Haemophilus influenzae Rd
gacaauaauaagcac

SEQ ID NO: 709725 - RNA, 14 nt, Haemophilus influenzae Rd
gacaauauugaaau

SEQ ID NO: 709726 - RNA, 16 nt, Haemophilus influenzae Rd
gacaacgcucacuuaa

SEQ ID NO: 709727 - RNA, 17 nt, Haemophilus influenzae Rd
gacaacgcucacuuaau

SEQ ID NO: 709728 - RNA, 15 nt, Haemophilus influenzae Rd
gaauuuuuucuucaa

SEQ ID NO: 709729 - RNA, 12 nt, Haemophilus influenzae Rd
gaauuuuugcug

SEQ ID NO: 709730 - RNA, 15 nt, Haemophilus influenzae Rd
gaauuuuuuucaaca

SEQ ID NO: 709731 - RNA, 13 nt, Haemophilus influenzae Rd
gaauuuucaucaa

SEQ ID NO: 709732 - RNA, 18 nt, Haemophilus influenzae Rd
gaauuuucccauuuaacc

SEQ ID NO: 709733 - RNA, 19 nt, Haemophilus influenzae Rd
gaauuuugcaagccaauag

SEQ ID NO: 709734 - RNA, 20 nt, Haemophilus influenzae Rd
gaauuuuuauuuucuuaauu

SEQ ID NO: 709735 - RNA, 17 nt, Haemophilus influenzae Rd
gaauuuuacuucuucag

SEQ ID NO: 709736 - RNA, 18 nt, Haemophilus influenzae Rd
gaauuuuacuucuucagg

SEQ ID NO: 709737 - RNA, 14 nt, Haemophilus influenzae Rd
cuuugguaaaagaa

SEQ ID NO: 709738 - RNA, 18 nt, Haemophilus influenzae Rd
gacaaauuaauaagaaaa

SEQ ID NO: 709739 - RNA, 18 nt, Haemophilus influenzae Rd
gacaaauuuguugcauuu

SEQ ID NO: 709740 - RNA, 11 nt, Haemophilus influenzae Rd
gacaacacuug

SEQ ID NO: 709741 - RNA, 20 nt, Haemophilus influenzae Rd
gacaaaucugccugauuuuu

SEQ ID NO: 709742 - RNA, 23 nt, Haemophilus influenzae Rd
gacaaagucgguuuuuaauucag

SEQ ID NO: 709743 - RNA, 22 nt, Haemophilus influenzae Rd
gacaaagggucguuaagaaaga

SEQ ID NO: 709744 - RNA, 19 nt, Haemophilus influenzae Rd
gacaaacaacguaaaagua

SEQ ID NO: 709745 - RNA, 17 nt, Haemophilus influenzae Rd
gaccagagccaaauaca

SEQ ID NO: 709746 - RNA, 17 nt, Haemophilus influenzae Rd
gaccacaugaauuucua

SEQ ID NO: 709747 - RNA, 16 nt, Haemophilus influenzae Rd
gaccaaagcuguaaaa

SEQ ID NO: 709748 - RNA, 22 nt, Haemophilus influenzae Rd
gaccaaauacaauuuuuuucaa

SEQ ID NO: 709749 - RNA, 20 nt, Haemophilus influenzae Rd
gaccaacggauuaaaagucc

SEQ ID NO: 709750 - RNA, 20 nt, Haemophilus influenzae Rd
gacaucuuaaauuauagaua

SEQ ID NO: 709751 - RNA, 13 nt, Haemophilus influenzae Rd
gacaucaaucaaa

SEQ ID NO: 709752 - RNA, 21 nt, Haemophilus influenzae Rd
gacaucaaucaaauucaacac

SEQ ID NO: 709753 - RNA, 21 nt, Haemophilus influenzae Rd
gacauucgcacccgcuuguuu

SEQ ID NO: 709754 - RNA, 16 nt, Haemophilus influenzae Rd
gacauucgcauauuuu

SEQ ID NO: 709755 - RNA, 20 nt, Haemophilus influenzae Rd
gacauuauuuuuacaaauag

SEQ ID NO: 709756 - RNA, 17 nt, Haemophilus influenzae Rd
gacauuccuauucuaaa

SEQ ID NO: 709757 - RNA, 17 nt, Haemophilus influenzae Rd
gacauacaaaguaaagu

SEQ ID NO: 709758 - RNA, 12 nt, Haemophilus influenzae Rd
gacaucaagcac

SEQ ID NO: 709759 - RNA, 21 nt, Haemophilus influenzae Rd
gacauauuuucuaaaaaacgu

SEQ ID NO: 709760 - RNA, 17 nt, Haemophilus influenzae Rd
gacauaacgagaacgag

SEQ ID NO: 709761 - RNA, 13 nt, Haemophilus influenzae Rd
gacauaacauugu

SEQ ID NO: 709762 - RNA, 14 nt, Haemophilus influenzae Rd
gacauaacauuguu

SEQ ID NO: 709763 - RNA, 15 nt, Haemophilus influenzae Rd
gacauaaaaacauag

SEQ ID NO: 709764 - RNA, 15 nt, Haemophilus influenzae Rd
gacaguuucgccugc

SEQ ID NO: 709765 - RNA, 21 nt, Haemophilus influenzae Rd
gacaguuuguaauccugcauu

SEQ ID NO: 709766 - RNA, 13 nt, Haemophilus influenzae Rd
gacaguauauucg

SEQ ID NO: 709767 - RNA, 18 nt, Haemophilus influenzae Rd
gacagucugcuaauguua

SEQ ID NO: 709768 - RNA, 14 nt, Haemophilus influenzae Rd
cguugcaacgcugc

SEQ ID NO: 709769 - RNA, 17 nt, Haemophilus influenzae Rd
cguucuaagaauuuuuu

SEQ ID NO: 709770 - RNA, 17 nt, Haemophilus influenzae Rd
cguugaacuuaauuaaa

SEQ ID NO: 709771 - RNA, 16 nt, Haemophilus influenzae Rd
cguugagccaauuuuc

SEQ ID NO: 709772 - RNA, 21 nt, Haemophilus influenzae Rd
cguuaucaucuguaaaccauu

SEQ ID NO: 709773 - RNA, 14 nt, Haemophilus influenzae Rd
cguuaucauuggcu

SEQ ID NO: 709774 - RNA, 17 nt, Haemophilus influenzae Rd
cguuaucgacuuuuuca

SEQ ID NO: 709775 - RNA, 15 nt, Haemophilus influenzae Rd
cguuaguuuguauuu

SEQ ID NO: 709776 - RNA, 18 nt, Haemophilus influenzae Rd
cguuauaacguuuaaaaa

SEQ ID NO: 709777 - RNA, 19 nt, Haemophilus influenzae Rd
cgucaugggauaaacauuu

SEQ ID NO: 709778 - RNA, 10 nt, Haemophilus influenzae Rd
cguccacaag

SEQ ID NO: 709779 - RNA, 12 nt, Haemophilus influenzae Rd
cguccaagguuu

SEQ ID NO: 709780 - RNA, 19 nt, Haemophilus influenzae Rd
cguccaaaggcuucuuuuc

SEQ ID NO: 709781 - RNA, 19 nt, Haemophilus influenzae Rd
cguucaugguuguaauaau

SEQ ID NO: 709782 - RNA, 21 nt, Haemophilus influenzae Rd
cguucauauuguuucaacaua

SEQ ID NO: 709783 - RNA, 11 nt, Haemophilus influenzae Rd
cguucaucuua

SEQ ID NO: 709784 - RNA, 15 nt, Haemophilus influenzae Rd
cguucgauaacaauu

SEQ ID NO: 709785 - RNA, 22 nt, Haemophilus influenzae Rd
cuaaacuaagcucauccauaaa

SEQ ID NO: 709786 - RNA, 15 nt, Haemophilus influenzae Rd
cuaaacuacaacagc

SEQ ID NO: 709787 - RNA, 16 nt, Haemophilus influenzae Rd
cuaaacucggaauuuu

SEQ ID NO: 709788 - RNA, 21 nt, Haemophilus influenzae Rd
cuaaacucggaauuuuuuuca

SEQ ID NO: 709789 - RNA, 23 nt, Haemophilus influenzae Rd
cuaaacucggaauuuuuuucaac

SEQ ID NO: 709790 - RNA, 13 nt, Haemophilus influenzae Rd
cuaaagcggaugg

SEQ ID NO: 709791 - RNA, 18 nt, Haemophilus influenzae Rd
cuaaacuuguuaaauaaa

SEQ ID NO: 709792 - RNA, 14 nt, Haemophilus influenzae Rd
cuaaacuuauauua

SEQ ID NO: 709793 - RNA, 21 nt, Haemophilus influenzae Rd
cuaaagugcgguaauuuuuag

SEQ ID NO: 709794 - RNA, 17 nt, Haemophilus influenzae Rd
cuaaagugcgguuaauu

SEQ ID NO: 709795 - RNA, 13 nt, Haemophilus influenzae Rd
cuaaaggcaaggu

SEQ ID NO: 709796 - RNA, 20 nt, Haemophilus influenzae Rd
cuaaaggcacaaaaaauucu

SEQ ID NO: 709797 - RNA, 22 nt, Haemophilus influenzae Rd
cuaaaggcacaaaaaauucuuu

SEQ ID NO: 709798 - RNA, 19 nt, Haemophilus influenzae Rd
cuaaauaaggcguaaaacu

SEQ ID NO: 709799 - RNA, 15 nt, Haemophilus influenzae Rd
cuaaauaauuuccuu

SEQ ID NO: 709800 - RNA, 20 nt, Haemophilus influenzae Rd
cuaaauaauuuccuuuccuu

SEQ ID NO: 709801 - RNA, 21 nt, Haemophilus influenzae Rd
cuaaauaaacuacuucuaaag

SEQ ID NO: 709802 - RNA, 14 nt, Haemophilus influenzae Rd
cuaaauaaagauua

SEQ ID NO: 709803 - RNA, 13 nt, Haemophilus influenzae Rd
cuaaauacuugcu

SEQ ID NO: 709804 - RNA, 15 nt, Haemophilus influenzae Rd
cuaaauacuugcuua

SEQ ID NO: 709805 - RNA, 23 nt, Haemophilus influenzae Rd
cuaaauacuugcuuaugcaaagu

SEQ ID NO: 709806 - RNA, 13 nt, Haemophilus influenzae Rd
cuaaauaaaucac

SEQ ID NO: 709807 - RNA, 19 nt, Haemophilus influenzae Rd
cuaaauaagcuaauuuuuc

SEQ ID NO: 709808 - RNA, 21 nt, Haemophilus influenzae Rd
cuaaauaagcuaauuuuucag

SEQ ID NO: 709809 - RNA, 16 nt, Haemophilus influenzae Rd
cuaaauacauuuuuau

SEQ ID NO: 709810 - RNA, 19 nt, Haemophilus influenzae Rd
cuaaaguuggcacuucaau

SEQ ID NO: 709811 - RNA, 16 nt, Haemophilus influenzae Rd
cuaaaguuucuuuuac

SEQ ID NO: 709812 - RNA, 21 nt, Haemophilus influenzae Rd
cuaaaauggugcuuuuuacaa

SEQ ID NO: 709813 - RNA, 22 nt, Haemophilus influenzae Rd
cuaaaaguuggcuuacagcaaa

SEQ ID NO: 709814 - RNA, 14 nt, Haemophilus influenzae Rd
cguuuuucuuaaau

SEQ ID NO: 709815 - RNA, 20 nt, Haemophilus influenzae Rd
cuaaaagugcggcuucauuu

SEQ ID NO: 709816 - RNA, 20 nt, Haemophilus influenzae Rd
cuaaaauaaccuuaaaucaa

SEQ ID NO: 709817 - RNA, 18 nt, Haemophilus influenzae Rd
cuaaaauaauuuuuugaa

SEQ ID NO: 709818 - RNA, 13 nt, Haemophilus influenzae Rd
cuaaaaguuugau

SEQ ID NO: 709819 - RNA, 17 nt, Haemophilus influenzae Rd
cuaaaauaaauuuuggu

SEQ ID NO: 709820 - RNA, 15 nt, Haemophilus influenzae Rd
cuaaaauuuguacca

SEQ ID NO: 709821 - RNA, 22 nt, Haemophilus influenzae Rd
cuaaaauucgacgauaaccauc

SEQ ID NO: 709822 - RNA, 17 nt, Haemophilus influenzae Rd
cuaaaauucuaagguuc

SEQ ID NO: 709823 - RNA, 23 nt, Haemophilus influenzae Rd
cuaaaauugcagggauauugccu

SEQ ID NO: 709824 - RNA, 12 nt, Haemophilus influenzae Rd
cuaaacaaauaa

SEQ ID NO: 709825 - RNA, 15 nt, Haemophilus influenzae Rd
cuaaacaaauaaaaa

SEQ ID NO: 709826 - RNA, 16 nt, Haemophilus influenzae Rd
cuaaacagaauuuacg

SEQ ID NO: 709827 - RNA, 16 nt, Haemophilus influenzae Rd
cuaaacauccgaauaa

SEQ ID NO: 709828 - RNA, 12 nt, Haemophilus influenzae Rd
cuaaacacauaa

SEQ ID NO: 709829 - RNA, 17 nt, Haemophilus influenzae Rd
cuaaacacauaauauuu

SEQ ID NO: 709830 - RNA, 15 nt, Haemophilus influenzae Rd
cuaaacgcucaaaua

SEQ ID NO: 709831 - RNA, 18 nt, Haemophilus influenzae Rd
cuaaacgcucaaauaaau

SEQ ID NO: 709832 - RNA, 15 nt, Haemophilus influenzae Rd
cuaaacguaacuaaa

SEQ ID NO: 709833 - RNA, 19 nt, Haemophilus influenzae Rd
cuaaacguaacuaaaaaag

SEQ ID NO: 709834 - RNA, 13 nt, Haemophilus influenzae Rd
cguuuucuacuuc

SEQ ID NO: 709835 - RNA, 13 nt, Haemophilus influenzae Rd
cguuugacagcaa

SEQ ID NO: 709836 - RNA, 18 nt, Haemophilus influenzae Rd
cguuugaggacuuaaauu

SEQ ID NO: 709837 - RNA, 14 nt, Haemophilus influenzae Rd
cguuugauauacca

SEQ ID NO: 709838 - RNA, 15 nt, Haemophilus influenzae Rd
cguuugauuguaaaa

SEQ ID NO: 709839 - RNA, 19 nt, Haemophilus influenzae Rd
cguugcuaccacuugauca

SEQ ID NO: 709840 - RNA, 14 nt, Haemophilus influenzae Rd
cguuucauaugcca

SEQ ID NO: 709841 - RNA, 15 nt, Haemophilus influenzae Rd
cguuucaucacuuca

SEQ ID NO: 709842 - RNA, 18 nt, Haemophilus influenzae Rd
cguuucaucgagaaauac

SEQ ID NO: 709843 - RNA, 20 nt, Haemophilus influenzae Rd
cguuucuacucguagaguuu

SEQ ID NO: 709844 - RNA, 14 nt, Haemophilus influenzae Rd
cguuuaucaucugc

SEQ ID NO: 709845 - RNA, 22 nt, Haemophilus influenzae Rd
cguuucaaaaauagccuucauc

SEQ ID NO: 709846 - RNA, 14 nt, Haemophilus influenzae Rd
cuaccaucuaaagu

SEQ ID NO: 709847 - RNA, 19 nt, Haemophilus influenzae Rd
cuaccacguuuucaacagu

SEQ ID NO: 709848 - RNA, 17 nt, Haemophilus influenzae Rd
cuaccaauucaaaaacc

SEQ ID NO: 709849 - RNA, 15 nt, Haemophilus influenzae Rd
cuaccacgauaaauc

SEQ ID NO: 709850 - RNA, 12 nt, Haemophilus influenzae Rd
cuacauuuuuag

SEQ ID NO: 709851 - RNA, 22 nt, Haemophilus influenzae Rd
cuacauggauuugcaauccagu

SEQ ID NO: 709852 - RNA, 21 nt, Haemophilus influenzae Rd
cuacauuugccccaacaacau

SEQ ID NO: 709853 - RNA, 12 nt, Haemophilus influenzae Rd
cuacagcaaauc

SEQ ID NO: 709854 - RNA, 20 nt, Haemophilus influenzae Rd
cuacagaagugcguucauau

SEQ ID NO: 709855 - RNA, 22 nt, Haemophilus influenzae Rd
cuacagaaagaaugucaucuaa

SEQ ID NO: 709856 - RNA, 17 nt, Haemophilus influenzae Rd
cuacagcuggagaguga

SEQ ID NO: 709857 - RNA, 19 nt, Haemophilus influenzae Rd
cuacagcuuguuucaucau

SEQ ID NO: 709858 - RNA, 20 nt, Haemophilus influenzae Rd
cuacaggcuuccaacaaaau

SEQ ID NO: 709859 - RNA, 15 nt, Haemophilus influenzae Rd
cuacaucgccuugca

SEQ ID NO: 709860 - RNA, 22 nt, Haemophilus influenzae Rd
cuacauaaaacgaacaauuucu

SEQ ID NO: 709861 - RNA, 15 nt, Haemophilus influenzae Rd
cuacacggagauauu

SEQ ID NO: 709862 - RNA, 14 nt, Haemophilus influenzae Rd
cuacaccuucuuua

SEQ ID NO: 709863 - RNA, 22 nt, Haemophilus influenzae Rd
cuacaauuucauuaauuuuauu

SEQ ID NO: 709864 - RNA, 13 nt, Haemophilus influenzae Rd
cuacaacuuuuua

SEQ ID NO: 709865 - RNA, 21 nt, Haemophilus influenzae Rd
cuacaacuuuuuauuuucugc

SEQ ID NO: 709866 - RNA, 15 nt, Haemophilus influenzae Rd
cuacaacuucaucaa

SEQ ID NO: 709867 - RNA, 22 nt, Haemophilus influenzae Rd
cuacaacagcgaaauauuucac

SEQ ID NO: 709868 - RNA, 20 nt, Haemophilus influenzae Rd
cuacaacaaaggguaaauaa

SEQ ID NO: 709869 - RNA, 19 nt, Haemophilus influenzae Rd
cuacaaggguaucuaaauu

SEQ ID NO: 709870 - RNA, 20 nt, Haemophilus influenzae Rd
cuacaaggguaucuaaauuu

SEQ ID NO: 709871 - RNA, 18 nt, Haemophilus influenzae Rd
cuacaaguacuacuggca

SEQ ID NO: 709872 - RNA, 23 nt, Haemophilus influenzae Rd
cuacaaguacuacuggcauuuuu

SEQ ID NO: 709873 - RNA, 15 nt, Haemophilus influenzae Rd
cuaauuuuuuuccaa

SEQ ID NO: 709874 - RNA, 13 nt, Haemophilus influenzae Rd
cuaauuuuuuuuc

SEQ ID NO: 709875 - RNA, 14 nt, Haemophilus influenzae Rd
cuaauuuuuuuucu

SEQ ID NO: 709876 - RNA, 16 nt, Haemophilus influenzae Rd
cuacaaaacauaauaa

SEQ ID NO: 709877 - RNA, 15 nt, Haemophilus influenzae Rd
cuacaaacaaauuuu

SEQ ID NO: 709878 - RNA, 17 nt, Haemophilus influenzae Rd
cuaauuuuaguuguuug

SEQ ID NO: 709879 - RNA, 13 nt, Haemophilus influenzae Rd
cuaauuuucacau

SEQ ID NO: 709880 - RNA, 13 nt, Haemophilus influenzae Rd
cuaauuuugccau

SEQ ID NO: 709881 - RNA, 17 nt, Haemophilus influenzae Rd
cuaauuuuguaagcauu

SEQ ID NO: 709882 - RNA, 16 nt, Haemophilus influenzae Rd
cuaauuuuugcaaugg

SEQ ID NO: 709883 - RNA, 19 nt, Haemophilus influenzae Rd
cuaauuuuuguuguuuaua

SEQ ID NO: 709884 - RNA, 22 nt, Haemophilus influenzae Rd
cuaauuuuuguuguuuauauuc

SEQ ID NO: 709885 - RNA, 14 nt, Haemophilus influenzae Rd
cuaauuuuuuaauu

SEQ ID NO: 709886 - RNA, 22 nt, Haemophilus influenzae Rd
cuaauuuuuuaauuaguuugau

SEQ ID NO: 709887 - RNA, 21 nt, Haemophilus influenzae Rd
cuaauuuuuuaauuuuuucug

SEQ ID NO: 709888 - RNA, 14 nt, Haemophilus influenzae Rd
cuaauuuuguugug

SEQ ID NO: 709889 - RNA, 11 nt, Haemophilus influenzae Rd
cuaauuuuuaa

SEQ ID NO: 709890 - RNA, 19 nt, Haemophilus influenzae Rd
cuaauuuuuaaaauagaau

SEQ ID NO: 709891 - RNA, 13 nt, Haemophilus influenzae Rd
cuaauuucauuuu

SEQ ID NO: 709892 - RNA, 21 nt, Haemophilus influenzae Rd
cuaauuucacaccauuuuuaa

SEQ ID NO: 709893 - RNA, 17 nt, Haemophilus influenzae Rd
cuaauuuauuucaucaa

SEQ ID NO: 709894 - RNA, 17 nt, Haemophilus influenzae Rd
cuaauuuauccaauacu

SEQ ID NO: 709895 - RNA, 13 nt, Haemophilus influenzae Rd
cuaauuguucagc

SEQ ID NO: 709896 - RNA, 22 nt, Haemophilus influenzae Rd
cuaauuguucagcaauuucucu

SEQ ID NO: 709897 - RNA, 23 nt, Haemophilus influenzae Rd
cuaauuguucuucuguuaauaaa

SEQ ID NO: 709898 - RNA, 19 nt, Haemophilus influenzae Rd
cuaauugugcauuguuacc

SEQ ID NO: 709899 - RNA, 19 nt, Haemophilus influenzae Rd
cuaauuguuuuaaaaugga

SEQ ID NO: 709900 - RNA, 23 nt, Haemophilus influenzae Rd
cuaauugauggcgugaaauauug

SEQ ID NO: 709901 - RNA, 17 nt, Haemophilus influenzae Rd
cuaauugauucaaaucu

SEQ ID NO: 709902 - RNA, 19 nt, Haemophilus influenzae Rd
cuaauugcauuaaaagucu

SEQ ID NO: 709903 - RNA, 12 nt, Haemophilus influenzae Rd
cuaauuggaaaa

SEQ ID NO: 709904 - RNA, 19 nt, Haemophilus influenzae Rd
cuaauuggggugcagauuu

SEQ ID NO: 709905 - RNA, 23 nt, Haemophilus influenzae Rd
cuaauuggggugcagauuuuuuu

SEQ ID NO: 709906 - RNA, 20 nt, Haemophilus influenzae Rd
cuaauugggucguuagcuca

SEQ ID NO: 709907 - RNA, 16 nt, Haemophilus influenzae Rd
cuaauuggucguucca

SEQ ID NO: 709908 - RNA, 12 nt, Haemophilus influenzae Rd
cuaacuaaaaaa

SEQ ID NO: 709909 - RNA, 22 nt, Haemophilus influenzae Rd
cuaacuaaaauaguugaaauuu

SEQ ID NO: 709910 - RNA, 18 nt, Haemophilus influenzae Rd
cuaacuaaggugcagauu

SEQ ID NO: 709911 - RNA, 23 nt, Haemophilus influenzae Rd
cuaacuaaggugcagauuuuuuu

SEQ ID NO: 709912 - RNA, 14 nt, Haemophilus influenzae Rd
cuaacucaaaauac

SEQ ID NO: 709913 - RNA, 13 nt, Haemophilus influenzae Rd
cuaacucacauug

SEQ ID NO: 709914 - RNA, 18 nt, Haemophilus influenzae Rd
cuaacucacauugccauu

SEQ ID NO: 709915 - RNA, 17 nt, Haemophilus influenzae Rd
cuaacugaucuaaaugu

SEQ ID NO: 709916 - RNA, 22 nt, Haemophilus influenzae Rd
cuaacugaucuaaauguugaua

SEQ ID NO: 709917 - RNA, 15 nt, Haemophilus influenzae Rd
cuaacucuuggcuaa

SEQ ID NO: 709918 - RNA, 15 nt, Haemophilus influenzae Rd
cuaagauacccauuu

SEQ ID NO: 709919 - RNA, 15 nt, Haemophilus influenzae Rd
cuaacguuuauauug

SEQ ID NO: 709920 - RNA, 15 nt, Haemophilus influenzae Rd
cuaaaucuaauuuug

SEQ ID NO: 709921 - RNA, 21 nt, Haemophilus influenzae Rd
cuaaaucuacguggauuuguu

SEQ ID NO: 709922 - RNA, 14 nt, Haemophilus influenzae Rd
cuaaaucggcuuua

SEQ ID NO: 709923 - RNA, 22 nt, Haemophilus influenzae Rd
cuaaaucauauuucuucgauuu

SEQ ID NO: 709924 - RNA, 19 nt, Haemophilus influenzae Rd
cuaaauccuuacgcugaau

SEQ ID NO: 709925 - RNA, 15 nt, Haemophilus influenzae Rd
cuaaauauuuuucaa

SEQ ID NO: 709926 - RNA, 15 nt, Haemophilus influenzae Rd
cuaaaucaaaaauaa

SEQ ID NO: 709927 - RNA, 19 nt, Haemophilus influenzae Rd
cuaaaucaccuaaaucuuu

SEQ ID NO: 709928 - RNA, 18 nt, Haemophilus influenzae Rd
cuaaauagcuaacaauau

SEQ ID NO: 709929 - RNA, 15 nt, Haemophilus influenzae Rd
cuaagguauaaauaa

SEQ ID NO: 709930 - RNA, 19 nt, Haemophilus influenzae Rd
cuaagauuuuaucuaacuc

SEQ ID NO: 709931 - RNA, 14 nt, Haemophilus influenzae Rd
cuaaggcaaaaaaa

SEQ ID NO: 709932 - RNA, 21 nt, Haemophilus influenzae Rd
cuaagcacaaagaaaaacuaa

SEQ ID NO: 709933 - RNA, 16 nt, Haemophilus influenzae Rd
cuaauaaaccaauaag

SEQ ID NO: 709934 - RNA, 18 nt, Haemophilus influenzae Rd
cuaauaaauagaaauuac

SEQ ID NO: 709935 - RNA, 13 nt, Haemophilus influenzae Rd
cuaauaaaaaaua

SEQ ID NO: 709936 - RNA, 15 nt, Haemophilus influenzae Rd
cuaagguuuaacuga

SEQ ID NO: 709937 - RNA, 18 nt, Haemophilus influenzae Rd
cuaagguugguaugguuu

SEQ ID NO: 709938 - RNA, 23 nt, Haemophilus influenzae Rd
cuaauaagccgccugauguuuga

SEQ ID NO: 709939 - RNA, 20 nt, Haemophilus influenzae Rd
cuaauaagugagaaaguuaa

SEQ ID NO: 709940 - RNA, 13 nt, Haemophilus influenzae Rd
cuaauaagaagcu

SEQ ID NO: 709941 - RNA, 18 nt, Haemophilus influenzae Rd
cuaauaagaagcugcuuu

SEQ ID NO: 709942 - RNA, 23 nt, Haemophilus influenzae Rd
cuaaucauuaacaaauucucggc

SEQ ID NO: 709943 - RNA, 17 nt, Haemophilus influenzae Rd
cuaauccagauugguau

SEQ ID NO: 709944 - RNA, 23 nt, Haemophilus influenzae Rd
cuaauccagauugguauuccgcu

SEQ ID NO: 709945 - RNA, 16 nt, Haemophilus influenzae Rd
cuaaucaauccagaac

SEQ ID NO: 709946 - RNA, 15 nt, Haemophilus influenzae Rd
cuaaucuuaaaaaau

SEQ ID NO: 709947 - RNA, 14 nt, Haemophilus influenzae Rd
cuaaucuuaugaau

SEQ ID NO: 709948 - RNA, 22 nt, Haemophilus influenzae Rd
cuaauucacgcauuuaaauaaa

SEQ ID NO: 709949 - RNA, 17 nt, Haemophilus influenzae Rd
cuaauuccccacucacg

SEQ ID NO: 709950 - RNA, 15 nt, Haemophilus influenzae Rd
cuaauucaucuucuu

SEQ ID NO: 709951 - RNA, 21 nt, Haemophilus influenzae Rd
cuaauucauuacauaauacuu

SEQ ID NO: 709952 - RNA, 13 nt, Haemophilus influenzae Rd
cuaauuaaaagga

SEQ ID NO: 709953 - RNA, 13 nt, Haemophilus influenzae Rd
cuaauuaaacuaa

SEQ ID NO: 709954 - RNA, 15 nt, Haemophilus influenzae Rd
cuaauugaaauagac

SEQ ID NO: 709955 - RNA, 14 nt, Haemophilus influenzae Rd
cuaauucugcacga

SEQ ID NO: 709956 - RNA, 23 nt, Haemophilus influenzae Rd
cuaauucugcacgacgugcuuca

SEQ ID NO: 709957 - RNA, 16 nt, Haemophilus influenzae Rd
cuaauucugcuaaauc

SEQ ID NO: 709958 - RNA, 17 nt, Haemophilus influenzae Rd
cuaauucugcuaaaucu

SEQ ID NO: 709959 - RNA, 21 nt, Haemophilus influenzae Rd
cuaauucuguaauuucacuuc

SEQ ID NO: 709960 - RNA, 16 nt, Haemophilus influenzae Rd
cuaauucggcuucagu

SEQ ID NO: 709961 - RNA, 18 nt, Haemophilus influenzae Rd
cuaauuccauugcauugc

SEQ ID NO: 709962 - RNA, 13 nt, Haemophilus influenzae Rd
cuaauguuaauuu

SEQ ID NO: 709963 - RNA, 16 nt, Haemophilus influenzae Rd
cuaauguuaauuuuaa

SEQ ID NO: 709964 - RNA, 20 nt, Haemophilus influenzae Rd
cuaauggauauagaaaucau

SEQ ID NO: 709965 - RNA, 14 nt, Haemophilus influenzae Rd
cuaaugcuuuaauu

SEQ ID NO: 709966 - RNA, 16 nt, Haemophilus influenzae Rd
cuaaugcuuuaauuug

SEQ ID NO: 709967 - RNA, 13 nt, Haemophilus influenzae Rd
cuaaugcuuuaau

SEQ ID NO: 709968 - RNA, 14 nt, Haemophilus influenzae Rd
cuaaugcaauuuca

SEQ ID NO: 709969 - RNA, 15 nt, Haemophilus influenzae Rd
cuaaugaugcuucag

SEQ ID NO: 709970 - RNA, 21 nt, Haemophilus influenzae Rd
cuaaugcccacguccacuuca

SEQ ID NO: 709971 - RNA, 23 nt, Haemophilus influenzae Rd
cuaaugccgcaaaaccuaacaua

SEQ ID NO: 709972 - RNA, 21 nt, Haemophilus influenzae Rd
cuaaugccgcaaauacuucac

SEQ ID NO: 709973 - RNA, 19 nt, Haemophilus influenzae Rd
cuaccgcacuuagauuuga

SEQ ID NO: 709974 - RNA, 12 nt, Haemophilus influenzae Rd
cuacccaaauuu

SEQ ID NO: 709975 - RNA, 19 nt, Haemophilus influenzae Rd
cuacucgagcauaaacuaa

SEQ ID NO: 709976 - RNA, 16 nt, Haemophilus influenzae Rd
cuacuuuuuauuuuug

SEQ ID NO: 709977 - RNA, 20 nt, Haemophilus influenzae Rd
cuacuuuugacgcagcaucu

SEQ ID NO: 709978 - RNA, 12 nt, Haemophilus influenzae Rd
cuacuuuugugc

SEQ ID NO: 709979 - RNA, 14 nt, Haemophilus influenzae Rd
cuacuuuuuuugcg

SEQ ID NO: 709980 - RNA, 16 nt, Haemophilus influenzae Rd
cuacuugaguugcggc

SEQ ID NO: 709981 - RNA, 11 nt, Haemophilus influenzae Rd
cuacuucuucc

SEQ ID NO: 709982 - RNA, 16 nt, Haemophilus influenzae Rd
cuacuuguaagaauaa

SEQ ID NO: 709983 - RNA, 16 nt, Haemophilus influenzae Rd
cuacuuuaaagaauau

SEQ ID NO: 709984 - RNA, 22 nt, Haemophilus influenzae Rd
cuacuuuggauuggauuuugaa

SEQ ID NO: 709985 - RNA, 15 nt, Haemophilus influenzae Rd
cuagcuuaacaacaa

SEQ ID NO: 709986 - RNA, 20 nt, Haemophilus influenzae Rd
cuagcucucguuguucuuua

SEQ ID NO: 709987 - RNA, 15 nt, Haemophilus influenzae Rd
cuaggcuuucaccaa

SEQ ID NO: 709988 - RNA, 18 nt, Haemophilus influenzae Rd
cuaggcuauauuuuuaug

SEQ ID NO: 709989 - RNA, 16 nt, Haemophilus influenzae Rd
cuagauuuuuuacuca

SEQ ID NO: 709990 - RNA, 19 nt, Haemophilus influenzae Rd
cuagauuuuuuacucaaag

SEQ ID NO: 709991 - RNA, 22 nt, Haemophilus influenzae Rd
cuagauuuuuuacucaaagaaa

SEQ ID NO: 709992 - RNA, 20 nt, Haemophilus influenzae Rd
cuagauuucuauccauuucu

SEQ ID NO: 709993 - RNA, 16 nt, Haemophilus influenzae Rd
cuagcgggauaagauu

SEQ ID NO: 709994 - RNA, 22 nt, Haemophilus influenzae Rd
cuaguauagauaugugaauaaa

SEQ ID NO: 709995 - RNA, 21 nt, Haemophilus influenzae Rd
cuagucauauugauuucucug

SEQ ID NO: 709996 - RNA, 16 nt, Haemophilus influenzae Rd
cuagucuuguaacuau

SEQ ID NO: 709997 - RNA, 18 nt, Haemophilus influenzae Rd
cuagucguucuugaugau

SEQ ID NO: 709998 - RNA, 15 nt, Haemophilus influenzae Rd
cuagugcaaccacac

SEQ ID NO: 709999 - RNA, 15 nt, Haemophilus influenzae Rd
cuagugcuaaaauaa

SEQ ID NO: 710000 - RNA, 16 nt, Haemophilus influenzae Rd
cuagugcuaaaauaaa

SEQ ID NO: 710001 - RNA, 17 nt, Haemophilus influenzae Rd
cuaguacuuguaacuug

SEQ ID NO: 710002 - RNA, 15 nt, Haemophilus influenzae Rd
cuaucacaaaacaac

SEQ ID NO: 710003 - RNA, 13 nt, Haemophilus influenzae Rd
cuaucaaaaucaa

SEQ ID NO: 710004 - RNA, 16 nt, Haemophilus influenzae Rd
cuaucaggcuuaacuu

SEQ ID NO: 710005 - RNA, 14 nt, Haemophilus influenzae Rd
cuauccaacucauu

SEQ ID NO: 710006 - RNA, 18 nt, Haemophilus influenzae Rd
cuaucauccgcuuguaau

SEQ ID NO: 710007 - RNA, 23 nt, Haemophilus influenzae Rd
cuauaguagaauguaaauuauuu

SEQ ID NO: 710008 - RNA, 12 nt, Haemophilus influenzae Rd
cuaguucaucau

SEQ ID NO: 710009 - RNA, 20 nt, Haemophilus influenzae Rd
cuaguuuuuucccuaaugcu

SEQ ID NO: 710010 - RNA, 12 nt, Haemophilus influenzae Rd
cuaugcccaagc

SEQ ID NO: 710011 - RNA, 14 nt, Haemophilus influenzae Rd
cuaugauuuuaaag

SEQ ID NO: 710012 - RNA, 15 nt, Haemophilus influenzae Rd
cuaugauuucauuuu

SEQ ID NO: 710013 - RNA, 14 nt, Haemophilus influenzae Rd
cuaugccuucuuca

SEQ ID NO: 710014 - RNA, 17 nt, Haemophilus influenzae Rd
cuaucggugaagacauc

SEQ ID NO: 710015 - RNA, 19 nt, Haemophilus influenzae Rd
cuaucgucauuaauacagu

SEQ ID NO: 710016 - RNA, 20 nt, Haemophilus influenzae Rd
cuaucuacuacgcuaacacu

SEQ ID NO: 710017 - RNA, 21 nt, Haemophilus influenzae Rd
cuaugauuauagauuuagucc

SEQ ID NO: 710018 - RNA, 15 nt, Haemophilus influenzae Rd
cuaucuaaaauauaa

SEQ ID NO: 710019 - RNA, 21 nt, Haemophilus influenzae Rd
cuaucuaugauuucauuuucu

SEQ ID NO: 710020 - RNA, 17 nt, Haemophilus influenzae Rd
cuauucauaccgauaac

SEQ ID NO: 710021 - RNA, 17 nt, Haemophilus influenzae Rd
cuauucucacaucauca

SEQ ID NO: 710022 - RNA, 12 nt, Haemophilus influenzae Rd
cuauucuucaau

SEQ ID NO: 710023 - RNA, 15 nt, Haemophilus influenzae Rd
cuauucuucaauaga

SEQ ID NO: 710024 - RNA, 20 nt, Haemophilus influenzae Rd
cuauuccuuucuuuauuuca

SEQ ID NO: 710025 - RNA, 14 nt, Haemophilus influenzae Rd
cuauguuauuaaaa

SEQ ID NO: 710026 - RNA, 16 nt, Haemophilus influenzae Rd
cuauguuauuaaaauu

SEQ ID NO: 710027 - RNA, 19 nt, Haemophilus influenzae Rd
cuauguuauuaaaauuaau

SEQ ID NO: 710028 - RNA, 21 nt, Haemophilus influenzae Rd
cuauuagcuaugccuuuuuau

SEQ ID NO: 710029 - RNA, 12 nt, Haemophilus influenzae Rd
cuauuaaaaaaa

SEQ ID NO: 710030 - RNA, 17 nt, Haemophilus influenzae Rd
cuauuaaaaaaagcaau

SEQ ID NO: 710031 - RNA, 12 nt, Haemophilus influenzae Rd
cuauuaaaaaau

SEQ ID NO: 710032 - RNA, 13 nt, Haemophilus influenzae Rd
cuauuaaaaaauc

SEQ ID NO: 710033 - RNA, 22 nt, Haemophilus influenzae Rd
cucaacaacaucuuguuuuaau

SEQ ID NO: 710034 - RNA, 18 nt, Haemophilus influenzae Rd
cucaacaccuaauaucaa

SEQ ID NO: 710035 - RNA, 21 nt, Haemophilus influenzae Rd
cucaagaauauauuuuaucaa

SEQ ID NO: 710036 - RNA, 17 nt, Haemophilus influenzae Rd
cucaaaaaguuaaauaa

SEQ ID NO: 710037 - RNA, 18 nt, Haemophilus influenzae Rd
cucaaaaaguuaaauaag

SEQ ID NO: 710038 - RNA, 20 nt, Haemophilus influenzae Rd
cucaaaaaguuaaauaagcu

SEQ ID NO: 710039 - RNA, 19 nt, Haemophilus influenzae Rd
cucaaaugugaaaacuacu

SEQ ID NO: 710040 - RNA, 19 nt, Haemophilus influenzae Rd
cucaaaugaggaauacucu

SEQ ID NO: 710041 - RNA, 16 nt, Haemophilus influenzae Rd
cucaaaucuacuaaaa

SEQ ID NO: 710042 - RNA, 12 nt, Haemophilus influenzae Rd
cucaaaaucaag

SEQ ID NO: 710043 - RNA, 13 nt, Haemophilus influenzae Rd
cucaaaaucaagu

SEQ ID NO: 710044 - RNA, 19 nt, Haemophilus influenzae Rd
cucaaaaucaaguuaaaaa

SEQ ID NO: 710045 - RNA, 21 nt, Haemophilus influenzae Rd
cucaaaaucaaguuaaaaaau

SEQ ID NO: 710046 - RNA, 22 nt, Haemophilus influenzae Rd
cucaaaauccgccgcacuuaau

SEQ ID NO: 710047 - RNA, 17 nt, Haemophilus influenzae Rd
cucaaaaacggauuuau

SEQ ID NO: 710048 - RNA, 14 nt, Haemophilus influenzae Rd
cucacggcaauaau

SEQ ID NO: 710049 - RNA, 13 nt, Haemophilus influenzae Rd
cucacgggcagaa

SEQ ID NO: 710050 - RNA, 13 nt, Haemophilus influenzae Rd
cucacgaguuaag

SEQ ID NO: 710051 - RNA, 14 nt, Haemophilus influenzae Rd
cucacauaaagugc

SEQ ID NO: 710052 - RNA, 23 nt, Haemophilus influenzae Rd
cucacaauugauguaaaagauaa

SEQ ID NO: 710053 - RNA, 20 nt, Haemophilus influenzae Rd
cucacaaaguguuuuauuua

SEQ ID NO: 710054 - RNA, 13 nt, Haemophilus influenzae Rd
cucacaacaaaga

SEQ ID NO: 710055 - RNA, 11 nt, Haemophilus influenzae Rd
cucacaagacg

SEQ ID NO: 710056 - RNA, 20 nt, Haemophilus influenzae Rd
cucacaagucuguaauuuua

SEQ ID NO: 710057 - RNA, 16 nt, Haemophilus influenzae Rd
cucauccacuaaacca

SEQ ID NO: 710058 - RNA, 13 nt, Haemophilus influenzae Rd
cucaucauauaac

SEQ ID NO: 710059 - RNA, 15 nt, Haemophilus influenzae Rd
cucaucuuuuuuaag

SEQ ID NO: 710060 - RNA, 14 nt, Haemophilus influenzae Rd
cuccaacuucaugu

SEQ ID NO: 710061 - RNA, 20 nt, Haemophilus influenzae Rd
cuccaagaauauuucacacc

SEQ ID NO: 710062 - RNA, 15 nt, Haemophilus influenzae Rd
cucauugaacuguuu

SEQ ID NO: 710063 - RNA, 21 nt, Haemophilus influenzae Rd
cucauuuaaccguaauuucaa

SEQ ID NO: 710064 - RNA, 19 nt, Haemophilus influenzae Rd
cucaguuuuugaggaaagu

SEQ ID NO: 710065 - RNA, 17 nt, Haemophilus influenzae Rd
cucagucgguagagcag

SEQ ID NO: 710066 - RNA, 22 nt, Haemophilus influenzae Rd
cucagucgguagagcaggggau

SEQ ID NO: 710067 - RNA, 19 nt, Haemophilus influenzae Rd
cucauaccaaggcauuuuu

SEQ ID NO: 710068 - RNA, 21 nt, Haemophilus influenzae Rd
cucauaccaaggcauuuuuuc

SEQ ID NO: 710069 - RNA, 13 nt, Haemophilus influenzae Rd
cucauacaaaaag

SEQ ID NO: 710070 - RNA, 17 nt, Haemophilus influenzae Rd
cucauaagcauuuugau

SEQ ID NO: 710071 - RNA, 14 nt, Haemophilus influenzae Rd
cucagggaaaugua

SEQ ID NO: 710072 - RNA, 21 nt, Haemophilus influenzae Rd
cucagcgugaauauaagaaau

SEQ ID NO: 710073 - RNA, 14 nt, Haemophilus influenzae Rd
cuccccguccaaag

SEQ ID NO: 710074 - RNA, 15 nt, Haemophilus influenzae Rd
cucgaggcaccauuu

SEQ ID NO: 710075 - RNA, 14 nt, Haemophilus influenzae Rd
cucgaucauuuuua

SEQ ID NO: 710076 - RNA, 20 nt, Haemophilus influenzae Rd
cucgagcauaaacuaaaaua

SEQ ID NO: 710077 - RNA, 21 nt, Haemophilus influenzae Rd
cucgagcauaaacuaaaauau

SEQ ID NO: 710078 - RNA, 14 nt, Haemophilus influenzae Rd
cucgaugagaaaug

SEQ ID NO: 710079 - RNA, 13 nt, Haemophilus influenzae Rd
cucgaaaguuacc

SEQ ID NO: 710080 - RNA, 22 nt, Haemophilus influenzae Rd
cucgaacaauaugauuacgguu

SEQ ID NO: 710081 - RNA, 14 nt, Haemophilus influenzae Rd
cucgaauucguuuu

SEQ ID NO: 710082 - RNA, 23 nt, Haemophilus influenzae Rd
cucgaauucguuuuucaaacuga

SEQ ID NO: 710083 - RNA, 20 nt, Haemophilus influenzae Rd
cucuagcucucguuguucuu

SEQ ID NO: 710084 - RNA, 12 nt, Haemophilus influenzae Rd
cucuaauuccac

SEQ ID NO: 710085 - RNA, 18 nt, Haemophilus influenzae Rd
cucguuauuauuaaguga

SEQ ID NO: 710086 - RNA, 18 nt, Haemophilus influenzae Rd
cucguugccauaaaaaau

SEQ ID NO: 710087 - RNA, 21 nt, Haemophilus influenzae Rd
cucguccaaauucauuuuuua

SEQ ID NO: 710088 - RNA, 22 nt, Haemophilus influenzae Rd
cucgguaaaaaucauuaaauaa

SEQ ID NO: 710089 - RNA, 16 nt, Haemophilus influenzae Rd
cucucacgugaaucac

SEQ ID NO: 710090 - RNA, 20 nt, Haemophilus influenzae Rd
cucucaaagugcgguuaaau

SEQ ID NO: 710091 - RNA, 14 nt, Haemophilus influenzae Rd
cucucaaaaaucaa

SEQ ID NO: 710092 - RNA, 15 nt, Haemophilus influenzae Rd
cucucaaaaaucaac

SEQ ID NO: 710093 - RNA, 13 nt, Haemophilus influenzae Rd
cucucauuuuuua

SEQ ID NO: 710094 - RNA, 22 nt, Haemophilus influenzae Rd
cucucgggugcgccauuuuuaa

SEQ ID NO: 710095 - RNA, 17 nt, Haemophilus influenzae Rd
cucucgcugaauuauug

SEQ ID NO: 710096 - RNA, 22 nt, Haemophilus influenzae Rd
cucucgccaauagguugcaaau

SEQ ID NO: 710097 - RNA, 22 nt, Haemophilus influenzae Rd
cucucucaccgccauuguuugu

SEQ ID NO: 710098 - RNA, 14 nt, Haemophilus influenzae Rd
cucugccauacuga

SEQ ID NO: 710099 - RNA, 17 nt, Haemophilus influenzae Rd
cucugcagggaaaaauu

SEQ ID NO: 710100 - RNA, 20 nt, Haemophilus influenzae Rd
cucugcagggaaaaauuuua

SEQ ID NO: 710101 - RNA, 21 nt, Haemophilus influenzae Rd
cucugcuagucguucuugaug

SEQ ID NO: 710102 - RNA, 19 nt, Haemophilus influenzae Rd
cucuggcucgcucuucagc

SEQ ID NO: 710103 - RNA, 18 nt, Haemophilus influenzae Rd
cucuucagcuucuucauc

SEQ ID NO: 710104 - RNA, 23 nt, Haemophilus influenzae Rd
cucuucagcuucuucaucgcuca

SEQ ID NO: 710105 - RNA, 15 nt, Haemophilus influenzae Rd
cucuucaucaaaaug

SEQ ID NO: 710106 - RNA, 13 nt, Haemophilus influenzae Rd
cucuguuaaaaua

SEQ ID NO: 710107 - RNA, 22 nt, Haemophilus influenzae Rd
cucuuauuuguguggaaaaaug

SEQ ID NO: 710108 - RNA, 18 nt, Haemophilus influenzae Rd
cucuuaaccuaccggaaa

SEQ ID NO: 710109 - RNA, 18 nt, Haemophilus influenzae Rd
cucuuacaguaccuauau

SEQ ID NO: 710110 - RNA, 16 nt, Haemophilus influenzae Rd
cucuugcuucuaauac

SEQ ID NO: 710111 - RNA, 22 nt, Haemophilus influenzae Rd
cucuuuauagccuauaauuaaa

SEQ ID NO: 710112 - RNA, 15 nt, Haemophilus influenzae Rd
cucuuuacuguucaa

SEQ ID NO: 710113 - RNA, 14 nt, Haemophilus influenzae Rd
cucuuucaaauaau

SEQ ID NO: 710114 - RNA, 12 nt, Haemophilus influenzae Rd
cucuuucaaguu

SEQ ID NO: 710115 - RNA, 12 nt, Haemophilus influenzae Rd
cucuuucaauuu

SEQ ID NO: 710116 - RNA, 13 nt, Haemophilus influenzae Rd
cucuuucaccauu

SEQ ID NO: 710117 - RNA, 16 nt, Haemophilus influenzae Rd
cucuucuaaaaauuac

SEQ ID NO: 710118 - RNA, 17 nt, Haemophilus influenzae Rd
cucuucuuguucaaaua

SEQ ID NO: 710119 - RNA, 17 nt, Haemophilus influenzae Rd
cugaaaccacuaaaaac

SEQ ID NO: 710120 - RNA, 19 nt, Haemophilus influenzae Rd
cugaaaaugggcgggcaaa

SEQ ID NO: 710121 - RNA, 18 nt, Haemophilus influenzae Rd
cugaaaguauuaaauuuu

SEQ ID NO: 710122 - RNA, 17 nt, Haemophilus influenzae Rd
cugaaagucgauucaaa

SEQ ID NO: 710123 - RNA, 18 nt, Haemophilus influenzae Rd
cugaaagucgauucaaau

SEQ ID NO: 710124 - RNA, 20 nt, Haemophilus influenzae Rd
cugaaagucgauucaaauaa

SEQ ID NO: 710125 - RNA, 14 nt, Haemophilus influenzae Rd
cugaaauaccuucu

SEQ ID NO: 710126 - RNA, 23 nt, Haemophilus influenzae Rd
cugaaagacccaccgcaaaagcc

SEQ ID NO: 710127 - RNA, 16 nt, Haemophilus influenzae Rd
cucuuucuuaaaauac

SEQ ID NO: 710128 - RNA, 15 nt, Haemophilus influenzae Rd
cugaaaaauaaaaaa

SEQ ID NO: 710129 - RNA, 18 nt, Haemophilus influenzae Rd
cugaaaaauaaaaaauau

SEQ ID NO: 710130 - RNA, 20 nt, Haemophilus influenzae Rd
cugaaaaauaaaaaauauug

SEQ ID NO: 710131 - RNA, 18 nt, Haemophilus influenzae Rd
cugaaaaagcuaaaaaaa

SEQ ID NO: 710132 - RNA, 19 nt, Haemophilus influenzae Rd
cugaaaaagcuaaaaaaac

SEQ ID NO: 710133 - RNA, 16 nt, Haemophilus influenzae Rd
cucuuuuuucauugca

SEQ ID NO: 710134 - RNA, 16 nt, Haemophilus influenzae Rd
cucuuuuuuagauaaa

SEQ ID NO: 710135 - RNA, 18 nt, Haemophilus influenzae Rd
cugaagccauuuuaugcg

SEQ ID NO: 710136 - RNA, 14 nt, Haemophilus influenzae Rd
cugaagcccacccu

SEQ ID NO: 710137 - RNA, 15 nt, Haemophilus influenzae Rd
cugaagcaacaauca

SEQ ID NO: 710138 - RNA, 20 nt, Haemophilus influenzae Rd
cugaacuaaaauaaccuuaa

SEQ ID NO: 710139 - RNA, 20 nt, Haemophilus influenzae Rd
cugaaauuuuuaucuaaauu

SEQ ID NO: 710140 - RNA, 14 nt, Haemophilus influenzae Rd
cugaaauucuaaaa

SEQ ID NO: 710141 - RNA, 16 nt, Haemophilus influenzae Rd
cugaaauucuaaaaaa

SEQ ID NO: 710142 - RNA, 17 nt, Haemophilus influenzae Rd
cugaaauucuaaaaaaa

SEQ ID NO: 710143 - RNA, 19 nt, Haemophilus influenzae Rd
cugaaauucuaaaaaaauc

SEQ ID NO: 710144 - RNA, 20 nt, Haemophilus influenzae Rd
cugaaauucuaaaaaaauca

SEQ ID NO: 710145 - RNA, 18 nt, Haemophilus influenzae Rd
cugaaaugauuauaauua

SEQ ID NO: 710146 - RNA, 21 nt, Haemophilus influenzae Rd
cugaacaugucuuguggguuu

SEQ ID NO: 710147 - RNA, 21 nt, Haemophilus influenzae Rd
cugaacacucuaucuaaaaua

SEQ ID NO: 710148 - RNA, 12 nt, Haemophilus influenzae Rd
cugaaugcguuc

SEQ ID NO: 710149 - RNA, 21 nt, Haemophilus influenzae Rd
cugaaugaucgaguaaaaaua

SEQ ID NO: 710150 - RNA, 22 nt, Haemophilus influenzae Rd
cugaaugaucgaguaaaaauaa

SEQ ID NO: 710151 - RNA, 16 nt, Haemophilus influenzae Rd
cugaauccgaaauuaa

SEQ ID NO: 710152 - RNA, 14 nt, Haemophilus influenzae Rd
cugaauuuaauuca

SEQ ID NO: 710153 - RNA, 19 nt, Haemophilus influenzae Rd
cugaauuucauucaaaaau

SEQ ID NO: 710154 - RNA, 21 nt, Haemophilus influenzae Rd
cugaauuucauucaaaaauaa

SEQ ID NO: 710155 - RNA, 14 nt, Haemophilus influenzae Rd
cugaauuuaaacuu

SEQ ID NO: 710156 - RNA, 17 nt, Haemophilus influenzae Rd
cugaauuggacggcaaa

SEQ ID NO: 710157 - RNA, 22 nt, Haemophilus influenzae Rd
cugaauuggacggcaaaaauau

SEQ ID NO: 710158 - RNA, 23 nt, Haemophilus influenzae Rd
cugaauuggacggcaaaaauauc

SEQ ID NO: 710159 - RNA, 15 nt, Haemophilus influenzae Rd
cugaauuauugucuu

SEQ ID NO: 710160 - RNA, 21 nt, Haemophilus influenzae Rd
cugaaugugaucaugguugua

SEQ ID NO: 710161 - RNA, 15 nt, Haemophilus influenzae Rd
cugaauaauuuccaa

SEQ ID NO: 710162 - RNA, 21 nt, Haemophilus influenzae Rd
cugaauaauuuccaacacauu

SEQ ID NO: 710163 - RNA, 23 nt, Haemophilus influenzae Rd
cugaagguuuucuuuguuucccu

SEQ ID NO: 710164 - RNA, 13 nt, Haemophilus influenzae Rd
cugaaguauaagc

SEQ ID NO: 710165 - RNA, 14 nt, Haemophilus influenzae Rd
cugaccauuuuguu

SEQ ID NO: 710166 - RNA, 19 nt, Haemophilus influenzae Rd
cugaccaccagaaaguuuu

SEQ ID NO: 710167 - RNA, 15 nt, Haemophilus influenzae Rd
cugaccacuuucaau

SEQ ID NO: 710168 - RNA, 15 nt, Haemophilus influenzae Rd
cugacacuuccccug

SEQ ID NO: 710169 - RNA, 22 nt, Haemophilus influenzae Rd
cugacagaagacgauuuuagag

SEQ ID NO: 710170 - RNA, 22 nt, Haemophilus influenzae Rd
cugacauuucgggcaaaagaaa

SEQ ID NO: 710171 - RNA, 13 nt, Haemophilus influenzae Rd
cugacaucaagca

SEQ ID NO: 710172 - RNA, 14 nt, Haemophilus influenzae Rd
cugacauuacauaa

SEQ ID NO: 710173 - RNA, 17 nt, Haemophilus influenzae Rd
cugacaguuuaucucuu

SEQ ID NO: 710174 - RNA, 21 nt, Haemophilus influenzae Rd
cugacuaaucguccaauuuca

SEQ ID NO: 710175 - RNA, 17 nt, Haemophilus influenzae Rd
cugacguacaauuucaa

SEQ ID NO: 710176 - RNA, 15 nt, Haemophilus influenzae Rd
cugacuagauaaacg

SEQ ID NO: 710177 - RNA, 18 nt, Haemophilus influenzae Rd
cugacuugucuauacaaa

SEQ ID NO: 710178 - RNA, 13 nt, Haemophilus influenzae Rd
cugagauuuuguc

SEQ ID NO: 710179 - RNA, 13 nt, Haemophilus influenzae Rd
cugaugaauuuag

SEQ ID NO: 710180 - RNA, 20 nt, Haemophilus influenzae Rd
cugaugaauuuaguacuucc

SEQ ID NO: 710181 - RNA, 14 nt, Haemophilus influenzae Rd
cugaugauggccau

SEQ ID NO: 710182 - RNA, 20 nt, Haemophilus influenzae Rd
cugaugauggccaugacaag

SEQ ID NO: 710183 - RNA, 14 nt, Haemophilus influenzae Rd
cugauuuuaaauau

SEQ ID NO: 710184 - RNA, 18 nt, Haemophilus influenzae Rd
cugauuuuuuuauaauua

SEQ ID NO: 710185 - RNA, 13 nt, Haemophilus influenzae Rd
cugauuuuuuaaa

SEQ ID NO: 710186 - RNA, 12 nt, Haemophilus influenzae Rd
cugauuuuucac

SEQ ID NO: 710187 - RNA, 16 nt, Haemophilus influenzae Rd
cugauuuuucuuuuuc

SEQ ID NO: 710188 - RNA, 21 nt, Haemophilus influenzae Rd
cugauuuuucuuuuucaguuu

SEQ ID NO: 710189 - RNA, 12 nt, Haemophilus influenzae Rd
cugauuuugcua

SEQ ID NO: 710190 - RNA, 18 nt, Haemophilus influenzae Rd
cugcacccuaauucauua

SEQ ID NO: 710191 - RNA, 19 nt, Haemophilus influenzae Rd
cugcacccuaauucauuaa

SEQ ID NO: 710192 - RNA, 14 nt, Haemophilus influenzae Rd
cugcaccuuaauua

SEQ ID NO: 710193 - RNA, 15 nt, Haemophilus influenzae Rd
cugcagcaggaagaa

SEQ ID NO: 710194 - RNA, 18 nt, Haemophilus influenzae Rd
cugcaaaugguguuuuau

SEQ ID NO: 710195 - RNA, 20 nt, Haemophilus influenzae Rd
cugcaacaaauaaaucauag

SEQ ID NO: 710196 - RNA, 19 nt, Haemophilus influenzae Rd
cugcacaaucaaaccaaua

SEQ ID NO: 710197 - RNA, 21 nt, Haemophilus influenzae Rd
cugcacaaucaaaccaauaaa

SEQ ID NO: 710198 - RNA, 18 nt, Haemophilus influenzae Rd
cugcaccaaucaaauaaa

SEQ ID NO: 710199 - RNA, 23 nt, Haemophilus influenzae Rd
cugccacaagauuacguguaguu

SEQ ID NO: 710200 - RNA, 12 nt, Haemophilus influenzae Rd
cugcccaaauaa

SEQ ID NO: 710201 - RNA, 14 nt, Haemophilus influenzae Rd
cugcccaaguugug

SEQ ID NO: 710202 - RNA, 13 nt, Haemophilus influenzae Rd
cugcaucaauaau

SEQ ID NO: 710203 - RNA, 21 nt, Haemophilus influenzae Rd
cugcaucaauaauucauuaga

SEQ ID NO: 710204 - RNA, 15 nt, Haemophilus influenzae Rd
cugcaucacaaacac

SEQ ID NO: 710205 - RNA, 14 nt, Haemophilus influenzae Rd
cugcaggaaaaaua

SEQ ID NO: 710206 - RNA, 20 nt, Haemophilus influenzae Rd
cugcagcuugcgccauugaa

SEQ ID NO: 710207 - RNA, 14 nt, Haemophilus influenzae Rd
cugcagcugcugcu

SEQ ID NO: 710208 - RNA, 17 nt, Haemophilus influenzae Rd
cugcagcugcugcuuua

SEQ ID NO: 710209 - RNA, 20 nt, Haemophilus influenzae Rd
cugcagccauaauauuuaaa

SEQ ID NO: 710210 - RNA, 19 nt, Haemophilus influenzae Rd
cugcaucgcuaagacaccu

SEQ ID NO: 710211 - RNA, 20 nt, Haemophilus influenzae Rd
cugcauuauaaccaaaguuu

SEQ ID NO: 710212 - RNA, 20 nt, Haemophilus influenzae Rd
cugcauuacugcggcuaguc

SEQ ID NO: 710213 - RNA, 15 nt, Haemophilus influenzae Rd
cugcuguaacguuaa

SEQ ID NO: 710214 - RNA, 15 nt, Haemophilus influenzae Rd
cugcuggcucuacgc

SEQ ID NO: 710215 - RNA, 19 nt, Haemophilus influenzae Rd
cugcugacgguucaguuuc

SEQ ID NO: 710216 - RNA, 20 nt, Haemophilus influenzae Rd
cugcugcaguuacugccucu

SEQ ID NO: 710217 - RNA, 22 nt, Haemophilus influenzae Rd
cugcugcaguuacugccucugc

SEQ ID NO: 710218 - RNA, 19 nt, Haemophilus influenzae Rd
cugcugcaagauuugcugc

SEQ ID NO: 710219 - RNA, 20 nt, Haemophilus influenzae Rd
cugcucugcaccauccauca

SEQ ID NO: 710220 - RNA, 21 nt, Haemophilus influenzae Rd
cugcucugcaccauccaucaa

SEQ ID NO: 710221 - RNA, 22 nt, Haemophilus influenzae Rd
cugcggauuauagaauuuaguc

SEQ ID NO: 710222 - RNA, 23 nt, Haemophilus influenzae Rd
cugcgccuaauuggaaaaguaag

SEQ ID NO: 710223 - RNA, 15 nt, Haemophilus influenzae Rd
cugcgcacuuuugga

SEQ ID NO: 710224 - RNA, 12 nt, Haemophilus influenzae Rd
cugcgccaauau

SEQ ID NO: 710225 - RNA, 15 nt, Haemophilus influenzae Rd
cugcgauuucuuuug

SEQ ID NO: 710226 - RNA, 21 nt, Haemophilus influenzae Rd
cugcgaccacguuugccuuuu

SEQ ID NO: 710227 - RNA, 18 nt, Haemophilus influenzae Rd
cugcgauacguuucauau

SEQ ID NO: 710228 - RNA, 19 nt, Haemophilus influenzae Rd
cugcgauacguuucauauc

SEQ ID NO: 710229 - RNA, 17 nt, Haemophilus influenzae Rd
cugcgacuuucccugca

SEQ ID NO: 710230 - RNA, 18 nt, Haemophilus influenzae Rd
cugccuuuuucuucuuuc

SEQ ID NO: 710231 - RNA, 23 nt, Haemophilus influenzae Rd
cugccuuuuucuucuuucauuug

SEQ ID NO: 710232 - RNA, 15 nt, Haemophilus influenzae Rd
cuggaucuucagcau

SEQ ID NO: 710233 - RNA, 20 nt, Haemophilus influenzae Rd
cuggaucuucagcauuuacc

SEQ ID NO: 710234 - RNA, 18 nt, Haemophilus influenzae Rd
cuggauuagagccaucaa

SEQ ID NO: 710235 - RNA, 13 nt, Haemophilus influenzae Rd
cuggauuaucugu

SEQ ID NO: 710236 - RNA, 18 nt, Haemophilus influenzae Rd
cuggauguuguaaaauau

SEQ ID NO: 710237 - RNA, 19 nt, Haemophilus influenzae Rd
cuggauuaaauaaccaacu

SEQ ID NO: 710238 - RNA, 12 nt, Haemophilus influenzae Rd
cugcuguuuuac

SEQ ID NO: 710239 - RNA, 14 nt, Haemophilus influenzae Rd
cugcuucauaaaaa

SEQ ID NO: 710240 - RNA, 15 nt, Haemophilus influenzae Rd
cuggcuugccaauuc

SEQ ID NO: 710241 - RNA, 16 nt, Haemophilus influenzae Rd
cuggcucuacgcaagc

SEQ ID NO: 710242 - RNA, 13 nt, Haemophilus influenzae Rd
cuggcucugcuga

SEQ ID NO: 710243 - RNA, 17 nt, Haemophilus influenzae Rd
cuggcucaauguuaagu

SEQ ID NO: 710244 - RNA, 18 nt, Haemophilus influenzae Rd
cuggcucaauguuaaguu

SEQ ID NO: 710245 - RNA, 17 nt, Haemophilus influenzae Rd
cuggcucgcucuucagc

SEQ ID NO: 710246 - RNA, 21 nt, Haemophilus influenzae Rd
cuggcuaacaaauaaugccuc

SEQ ID NO: 710247 - RNA, 23 nt, Haemophilus influenzae Rd
cuggcuaacaaauaaugccucau

SEQ ID NO: 710248 - RNA, 16 nt, Haemophilus influenzae Rd
cuggcguuuuuuauaa

SEQ ID NO: 710249 - RNA, 21 nt, Haemophilus influenzae Rd
cugggcaaaaucaucaaacac

SEQ ID NO: 710250 - RNA, 13 nt, Haemophilus influenzae Rd
cuggguaaaauaa

SEQ ID NO: 710251 - RNA, 14 nt, Haemophilus influenzae Rd
cuggguaaaauaau

SEQ ID NO: 710252 - RNA, 20 nt, Haemophilus influenzae Rd
cuggguaaaauaaugcaaaa

SEQ ID NO: 710253 - RNA, 17 nt, Haemophilus influenzae Rd
cuggugggaauaauuuu

SEQ ID NO: 710254 - RNA, 23 nt, Haemophilus influenzae Rd
cuggugcuacuugagcuucagcu

SEQ ID NO: 710255 - RNA, 17 nt, Haemophilus influenzae Rd
cuggguuucggauaaua

SEQ ID NO: 710256 - RNA, 22 nt, Haemophilus influenzae Rd
cuggguuucggauaauaauuuu

SEQ ID NO: 710257 - RNA, 12 nt, Haemophilus influenzae Rd
cugguuccauua

SEQ ID NO: 710258 - RNA, 24 nt, Haemophilus influenzae Rd
cugguuccauuacguucauauaaa

SEQ ID NO: 710259 - RNA, 22 nt, Haemophilus influenzae Rd
cugguuuaucgucugcacgaau

SEQ ID NO: 710260 - RNA, 23 nt, Haemophilus influenzae Rd
cuguaacguuaaaugaacguuuu

SEQ ID NO: 710261 - RNA, 17 nt, Haemophilus influenzae Rd
cuguacuagauaacuag

SEQ ID NO: 710262 - RNA, 12 nt, Haemophilus influenzae Rd
cuguaaugauca

SEQ ID NO: 710263 - RNA, 18 nt, Haemophilus influenzae Rd
cuguagaaauuaauaaug

SEQ ID NO: 710264 - RNA, 17 nt, Haemophilus influenzae Rd
cugucauuuauggaaau

SEQ ID NO: 710265 - RNA, 23 nt, Haemophilus influenzae Rd
cugucauauaaccacguaauucu

SEQ ID NO: 710266 - RNA, 16 nt, Haemophilus influenzae Rd
cugucauauucauuuu

SEQ ID NO: 710267 - RNA, 16 nt, Haemophilus influenzae Rd
cugugagucuugcuuu

SEQ ID NO: 710268 - RNA, 17 nt, Haemophilus influenzae Rd
cugugagucuugcuuuu

SEQ ID NO: 710269 - RNA, 23 nt, Haemophilus influenzae Rd
cugugauauauaucacagauuuu

SEQ ID NO: 710270 - RNA, 14 nt, Haemophilus influenzae Rd
cugucuuccacaac

SEQ ID NO: 710271 - RNA, 23 nt, Haemophilus influenzae Rd
cuguguuagaaagccuuuuaaaa

SEQ ID NO: 710272 - RNA, 13 nt, Haemophilus influenzae Rd
cuguggcuaauuc

SEQ ID NO: 710273 - RNA, 14 nt, Haemophilus influenzae Rd
cuguguaaaacauu

SEQ ID NO: 710274 - RNA, 15 nt, Haemophilus influenzae Rd
cuguguaaaacauug

SEQ ID NO: 710275 - RNA, 20 nt, Haemophilus influenzae Rd
cuucuuugauauaaauuguu

SEQ ID NO: 710276 - RNA, 22 nt, Haemophilus influenzae Rd
cuucuuugauauaaauuguuuu

SEQ ID NO: 710277 - RNA, 13 nt, Haemophilus influenzae Rd
cuucuuuguuucc

SEQ ID NO: 710278 - RNA, 21 nt, Haemophilus influenzae Rd
cuucuuuuauagacuucaagu

SEQ ID NO: 710279 - RNA, 17 nt, Haemophilus influenzae Rd
cuugaauugauaaaggc

SEQ ID NO: 710280 - RNA, 22 nt, Haemophilus influenzae Rd
cuugaauugcauuuucuuccaa

SEQ ID NO: 710281 - RNA, 21 nt, Haemophilus influenzae Rd
cuugaauggcuaucugcuuuu

SEQ ID NO: 710282 - RNA, 21 nt, Haemophilus influenzae Rd
cuugaauaucagcuacuuccc

SEQ ID NO: 710283 - RNA, 21 nt, Haemophilus influenzae Rd
cuugaauaugauguggcuuuu

SEQ ID NO: 710284 - RNA, 20 nt, Haemophilus influenzae Rd
cuugaaguuugauuccguuu

SEQ ID NO: 710285 - RNA, 15 nt, Haemophilus influenzae Rd
cuugaccuuucaaua

SEQ ID NO: 710286 - RNA, 17 nt, Haemophilus influenzae Rd
cuugaccgauuaauuca

SEQ ID NO: 710287 - RNA, 19 nt, Haemophilus influenzae Rd
cuugaccagagccaaauac

SEQ ID NO: 710288 - RNA, 15 nt, Haemophilus influenzae Rd
cuugacguuguucuu

SEQ ID NO: 710289 - RNA, 21 nt, Haemophilus influenzae Rd
cuugacguuguucuucuguua

SEQ ID NO: 710290 - RNA, 12 nt, Haemophilus influenzae Rd
cuugaucuacag

SEQ ID NO: 710291 - RNA, 13 nt, Haemophilus influenzae Rd
cuugaucuacaga

SEQ ID NO: 710292 - RNA, 17 nt, Haemophilus influenzae Rd
cuugaucuacagaagug

SEQ ID NO: 710293 - RNA, 23 nt, Haemophilus influenzae Rd
cuugauccccauacaaguauuuu

SEQ ID NO: 710294 - RNA, 17 nt, Haemophilus influenzae Rd
cuugcccaauauaacaa

SEQ ID NO: 710295 - RNA, 17 nt, Haemophilus influenzae Rd
cuugcccaucuugccaa

SEQ ID NO: 710296 - RNA, 16 nt, Haemophilus influenzae Rd
cuugcauuuacauaaa

SEQ ID NO: 710297 - RNA, 15 nt, Haemophilus influenzae Rd
cuugcauuucauuug

SEQ ID NO: 710298 - RNA, 14 nt, Haemophilus influenzae Rd
cuugccaaacauua

SEQ ID NO: 710299 - RNA, 17 nt, Haemophilus influenzae Rd
cuugcauucacaaaagu

SEQ ID NO: 710300 - RNA, 21 nt, Haemophilus influenzae Rd
cuugccacagguaaagaacca

SEQ ID NO: 710301 - RNA, 13 nt, Haemophilus influenzae Rd
cuugcaaauuuuc

SEQ ID NO: 710302 - RNA, 17 nt, Haemophilus influenzae Rd
cuugcaaauuuucagcu

SEQ ID NO: 710303 - RNA, 16 nt, Haemophilus influenzae Rd
cuugcauaauuccuuu

SEQ ID NO: 710304 - RNA, 19 nt, Haemophilus influenzae Rd
cuugcauaauuccuuuuuc

SEQ ID NO: 710305 - RNA, 20 nt, Haemophilus influenzae Rd
cuugcauaauuccuuuuucu

SEQ ID NO: 710306 - RNA, 18 nt, Haemophilus influenzae Rd
cuugcgauaucuucuaau

SEQ ID NO: 710307 - RNA, 17 nt, Haemophilus influenzae Rd
cuugccgcacuuuuuau

SEQ ID NO: 710308 - RNA, 22 nt, Haemophilus influenzae Rd
cuuggcaacccacuucugcacc

SEQ ID NO: 710309 - RNA, 22 nt, Haemophilus influenzae Rd
cuugcuuaugcaaaguauuuuu

SEQ ID NO: 710310 - RNA, 20 nt, Haemophilus influenzae Rd
cuuggaguucuugaauacaa

SEQ ID NO: 710311 - RNA, 15 nt, Haemophilus influenzae Rd
cuuggcgaguaaauu

SEQ ID NO: 710312 - RNA, 18 nt, Haemophilus influenzae Rd
cuuggcgaguaaauuuag

SEQ ID NO: 710313 - RNA, 16 nt, Haemophilus influenzae Rd
cuuggcauuucaagcu

SEQ ID NO: 710314 - RNA, 13 nt, Haemophilus influenzae Rd
cuuggcauuuuug

SEQ ID NO: 710315 - RNA, 13 nt, Haemophilus influenzae Rd
cuuggcauagaaa

SEQ ID NO: 710316 - RNA, 22 nt, Haemophilus influenzae Rd
cuuguaguucaggaauuaaauc

SEQ ID NO: 710317 - RNA, 13 nt, Haemophilus influenzae Rd
cuugguuuaaauu

SEQ ID NO: 710318 - RNA, 15 nt, Haemophilus influenzae Rd
cuugguucgcuucau

SEQ ID NO: 710319 - RNA, 12 nt, Haemophilus influenzae Rd
cuugguuaaucc

SEQ ID NO: 710320 - RNA, 23 nt, Haemophilus influenzae Rd
cuuguagaucggcaaugguucga

SEQ ID NO: 710321 - RNA, 20 nt, Haemophilus influenzae Rd
cuuggucacugguucaaguc

SEQ ID NO: 710322 - RNA, 16 nt, Haemophilus influenzae Rd
cuugguaguuuuucac

SEQ ID NO: 710323 - RNA, 12 nt, Haemophilus influenzae Rd
cuugggcggcuu

SEQ ID NO: 710324 - RNA, 17 nt, Haemophilus influenzae Rd
cuugguaagaaagauag

SEQ ID NO: 710325 - RNA, 21 nt, Haemophilus influenzae Rd
cuuggcuaacuucuuccacuu

SEQ ID NO: 710326 - RNA, 17 nt, Haemophilus influenzae Rd
cuugggauauuccaagg

SEQ ID NO: 710327 - RNA, 17 nt, Haemophilus influenzae Rd
cuugucgcggcaaucca

SEQ ID NO: 710328 - RNA, 18 nt, Haemophilus influenzae Rd
cuugucgcggcaauccac

SEQ ID NO: 710329 - RNA, 23 nt, Haemophilus influenzae Rd
cuuuaagaguaaauuuaacaauc

SEQ ID NO: 710330 - RNA, 14 nt, Haemophilus influenzae Rd
cuuuaauugauuaa

SEQ ID NO: 710331 - RNA, 14 nt, Haemophilus influenzae Rd
cuuuaauuuguuuu

SEQ ID NO: 710332 - RNA, 18 nt, Haemophilus influenzae Rd
cuuuaauuuguuuuucga

SEQ ID NO: 710333 - RNA, 19 nt, Haemophilus influenzae Rd
cuuuaauuuuaucuaauca

SEQ ID NO: 710334 - RNA, 15 nt, Haemophilus influenzae Rd
cuuuaauuucuucaa

SEQ ID NO: 710335 - RNA, 15 nt, Haemophilus influenzae Rd
cuuuacauuuaaacu

SEQ ID NO: 710336 - RNA, 24 nt, Haemophilus influenzae Rd
cuuuacauuuccuuuacauuuaaa

SEQ ID NO: 710337 - RNA, 20 nt, Haemophilus influenzae Rd
cuuuacauuuggcaaaauaa

SEQ ID NO: 710338 - RNA, 13 nt, Haemophilus influenzae Rd
cuuuacggauaau

SEQ ID NO: 710339 - RNA, 19 nt, Haemophilus influenzae Rd
cuuuacggauaauuucccu

SEQ ID NO: 710340 - RNA, 20 nt, Haemophilus influenzae Rd
cuuuacggauaauuucccua

SEQ ID NO: 710341 - RNA, 14 nt, Haemophilus influenzae Rd
cuuuacuaaagugg

SEQ ID NO: 710342 - RNA, 14 nt, Haemophilus influenzae Rd
cuuuacguaaagua

SEQ ID NO: 710343 - RNA, 20 nt, Haemophilus influenzae Rd
cuuuacguaaaguaaaugcu

SEQ ID NO: 710344 - RNA, 17 nt, Haemophilus influenzae Rd
cuuuacuguucaaauaa

SEQ ID NO: 710345 - RNA, 18 nt, Haemophilus influenzae Rd
cuuuacuguucaaauaag

SEQ ID NO: 710346 - RNA, 15 nt, Haemophilus influenzae Rd
cuuuagauugcucaa

SEQ ID NO: 710347 - RNA, 22 nt, Haemophilus influenzae Rd
cuuuagcauaaaacaguauuuu

SEQ ID NO: 710348 - RNA, 13 nt, Haemophilus influenzae Rd
cuuuagcccacca

SEQ ID NO: 710349 - RNA, 14 nt, Haemophilus influenzae Rd
cuuucaaauaauug

SEQ ID NO: 710350 - RNA, 18 nt, Haemophilus influenzae Rd
cuuucaauaauuuuucuu

SEQ ID NO: 710351 - RNA, 12 nt, Haemophilus influenzae Rd
cuuuauuuuguu

SEQ ID NO: 710352 - RNA, 20 nt, Haemophilus influenzae Rd
cuuuauuuuuucaucauuuc

SEQ ID NO: 710353 - RNA, 23 nt, Haemophilus influenzae Rd
cuuucaaaaaucaaauuaauuua

SEQ ID NO: 710354 - RNA, 19 nt, Haemophilus influenzae Rd
cuuuauuugauuguugcuu

SEQ ID NO: 710355 - RNA, 20 nt, Haemophilus influenzae Rd
cuuuauuugucagauuuacc

SEQ ID NO: 710356 - RNA, 18 nt, Haemophilus influenzae Rd
cuuucagcuuccauccac

SEQ ID NO: 710357 - RNA, 13 nt, Haemophilus influenzae Rd
cuuucaauuuucu

SEQ ID NO: 710358 - RNA, 15 nt, Haemophilus influenzae Rd
cuuucaaugcagaaa

SEQ ID NO: 710359 - RNA, 19 nt, Haemophilus influenzae Rd
cuuucaaugcagaaauaaa

SEQ ID NO: 710360 - RNA, 15 nt, Haemophilus influenzae Rd
cuuuaugaauuacca

SEQ ID NO: 710361 - RNA, 15 nt, Haemophilus influenzae Rd
cuuuaugacuauuuu

SEQ ID NO: 710362 - RNA, 18 nt, Haemophilus influenzae Rd
cuuuaugacuauuuuuuu

SEQ ID NO: 710363 - RNA, 19 nt, Haemophilus influenzae Rd
cuuuaucuauugauucuaa

SEQ ID NO: 710364 - RNA, 16 nt, Haemophilus influenzae Rd
cuuuaucuaaaguuac

SEQ ID NO: 710365 - RNA, 21 nt, Haemophilus influenzae Rd
cuuuauuuaauucacgaaugu

SEQ ID NO: 710366 - RNA, 20 nt, Haemophilus influenzae Rd
cuuuaguguauaacaaauag

SEQ ID NO: 710367 - RNA, 21 nt, Haemophilus influenzae Rd
cuuuaucgaggacaaucugcu

SEQ ID NO: 710368 - RNA, 23 nt, Haemophilus influenzae Rd
cuuuaucgaggacaaucugcugu

SEQ ID NO: 710369 - RNA, 22 nt, Haemophilus influenzae Rd
cuuuaguuuuagggaagauuaa

SEQ ID NO: 710370 - RNA, 19 nt, Haemophilus influenzae Rd
cuuugaauugguguuuaaa

SEQ ID NO: 710371 - RNA, 18 nt, Haemophilus influenzae Rd
cuuugagguaaaagugcg

SEQ ID NO: 710372 - RNA, 15 nt, Haemophilus influenzae Rd
cuuugacuaaaucau

SEQ ID NO: 710373 - RNA, 16 nt, Haemophilus influenzae Rd
cuuugacuaaaucaug

SEQ ID NO: 710374 - RNA, 23 nt, Haemophilus influenzae Rd
cuuugagaaagaauauaaauaaa

SEQ ID NO: 710375 - RNA, 16 nt, Haemophilus influenzae Rd
cuuucuucguuaaagu

SEQ ID NO: 710376 - RNA, 23 nt, Haemophilus influenzae Rd
cuuucuuauuggacugcauauuc

SEQ ID NO: 710377 - RNA, 16 nt, Haemophilus influenzae Rd
cuuucuaacuuuuaau

SEQ ID NO: 710378 - RNA, 14 nt, Haemophilus influenzae Rd
cuuucauuuuccaa

SEQ ID NO: 710379 - RNA, 23 nt, Haemophilus influenzae Rd
cuuuccaccccagaauuaagauc

SEQ ID NO: 710380 - RNA, 21 nt, Haemophilus influenzae Rd
cuuucgguacgaucacugcca

SEQ ID NO: 710381 - RNA, 14 nt, Haemophilus influenzae Rd
cuuugcagugcauu

SEQ ID NO: 710382 - RNA, 22 nt, Haemophilus influenzae Rd
cuuugauucgcuuggaguucuu

SEQ ID NO: 710383 - RNA, 21 nt, Haemophilus influenzae Rd
cuuugccuugaugcucugcau

SEQ ID NO: 710384 - RNA, 14 nt, Haemophilus influenzae Rd
cuuugcgaguuuca

SEQ ID NO: 710385 - RNA, 16 nt, Haemophilus influenzae Rd
cuuugccuguuugugc

SEQ ID NO: 710386 - RNA, 22 nt, Haemophilus influenzae Rd
cuuugccaauuccuuguacuuc

SEQ ID NO: 710387 - RNA, 19 nt, Haemophilus influenzae Rd
cuuugccacaggauaaaaa

SEQ ID NO: 710388 - RNA, 21 nt, Haemophilus influenzae Rd
cuuugcugacaauuucuaaaa

SEQ ID NO: 710389 - RNA, 17 nt, Haemophilus influenzae Rd
cuuugggaaugccauua

SEQ ID NO: 710390 - RNA, 16 nt, Haemophilus influenzae Rd
cuuuggcaaaaaauac

SEQ ID NO: 710391 - RNA, 19 nt, Haemophilus influenzae Rd
cuuuggauugguguuuaaa

SEQ ID NO: 710392 - RNA, 17 nt, Haemophilus influenzae Rd
cuuagacucguuuuuua

SEQ ID NO: 710393 - RNA, 14 nt, Haemophilus influenzae Rd
cuuagccuuuuugu

SEQ ID NO: 710394 - RNA, 13 nt, Haemophilus influenzae Rd
cuuagcuucaucu

SEQ ID NO: 710395 - RNA, 14 nt, Haemophilus influenzae Rd
cuuagcuuuuuucu

SEQ ID NO: 710396 - RNA, 15 nt, Haemophilus influenzae Rd
cuuaguaauauagca

SEQ ID NO: 710397 - RNA, 23 nt, Haemophilus influenzae Rd
cuuaggguaauuuuuucgguuuu

SEQ ID NO: 710398 - RNA, 17 nt, Haemophilus influenzae Rd
cuuagggucgcaacuaa

SEQ ID NO: 710399 - RNA, 20 nt, Haemophilus influenzae Rd
cuuaguuccaccacccuucu

SEQ ID NO: 710400 - RNA, 14 nt, Haemophilus influenzae Rd
cuuaguuaaauaua

SEQ ID NO: 710401 - RNA, 13 nt, Haemophilus influenzae Rd
cuuagugaaaaga

SEQ ID NO: 710402 - RNA, 15 nt, Haemophilus influenzae Rd
cuuagugaaaagaaa

SEQ ID NO: 710403 - RNA, 12 nt, Haemophilus influenzae Rd
cuuaguccuuuu

SEQ ID NO: 710404 - RNA, 22 nt, Haemophilus influenzae Rd
cuuagucggcgacgauuuaaua

SEQ ID NO: 710405 - RNA, 19 nt, Haemophilus influenzae Rd
cuuaccaaccgaauauaug

SEQ ID NO: 710406 - RNA, 14 nt, Haemophilus influenzae Rd
cuuacuucuacuuc

SEQ ID NO: 710407 - RNA, 18 nt, Haemophilus influenzae Rd
cuuacuucuacuucuugu

SEQ ID NO: 710408 - RNA, 15 nt, Haemophilus influenzae Rd
cuuaaugcaaaaucu

SEQ ID NO: 710409 - RNA, 17 nt, Haemophilus influenzae Rd
cuuaaugcaaaaucuuu

SEQ ID NO: 710410 - RNA, 16 nt, Haemophilus influenzae Rd
cuuaaugaacuuucua

SEQ ID NO: 710411 - RNA, 17 nt, Haemophilus influenzae Rd
cuuacauugcuuaacau

SEQ ID NO: 710412 - RNA, 18 nt, Haemophilus influenzae Rd
cuuacauugcuuaacauu

SEQ ID NO: 710413 - RNA, 22 nt, Haemophilus influenzae Rd
cuuaauggcuugcucuguauuu

SEQ ID NO: 710414 - RNA, 20 nt, Haemophilus influenzae Rd
cuuaaauuagcguaaacauu

SEQ ID NO: 710415 - RNA, 21 nt, Haemophilus influenzae Rd
cuuaaauuagcguaaacauuu

SEQ ID NO: 710416 - RNA, 23 nt, Haemophilus influenzae Rd
cuuaaauuagcguaaacauuuug

SEQ ID NO: 710417 - RNA, 13 nt, Haemophilus influenzae Rd
cuuaacaaagccu

SEQ ID NO: 710418 - RNA, 15 nt, Haemophilus influenzae Rd
cuuaaauuuuuauaa

SEQ ID NO: 710419 - RNA, 17 nt, Haemophilus influenzae Rd
cuuaacauuaauaaacc

SEQ ID NO: 710420 - RNA, 12 nt, Haemophilus influenzae Rd
cuuaacauuuuc

SEQ ID NO: 710421 - RNA, 13 nt, Haemophilus influenzae Rd
cuuaaccaucaca

SEQ ID NO: 710422 - RNA, 16 nt, Haemophilus influenzae Rd
cuguuccgccacaagu

SEQ ID NO: 710423 - RNA, 16 nt, Haemophilus influenzae Rd
cuuaaaugaucuaaug

SEQ ID NO: 710424 - RNA, 18 nt, Haemophilus influenzae Rd
cuuaaaugaucuaauggg

SEQ ID NO: 710425 - RNA, 20 nt, Haemophilus influenzae Rd
cuuaagucagcauaaacaaa

SEQ ID NO: 710426 - RNA, 20 nt, Haemophilus influenzae Rd
cuuaagugcgguauuuuuau

SEQ ID NO: 710427 - RNA, 19 nt, Haemophilus influenzae Rd
cuuaauaauggauuaauuc

SEQ ID NO: 710428 - RNA, 20 nt, Haemophilus influenzae Rd
cuuaauaauggauuaauucg

SEQ ID NO: 710429 - RNA, 15 nt, Haemophilus influenzae Rd
cuuaauacgacggca

SEQ ID NO: 710430 - RNA, 18 nt, Haemophilus influenzae Rd
cuuaaucggcacaagacu

SEQ ID NO: 710431 - RNA, 23 nt, Haemophilus influenzae Rd
cuuauucgguguucugcaucaau

SEQ ID NO: 710432 - RNA, 20 nt, Haemophilus influenzae Rd
cuuauucauuaaggcuuuuc

SEQ ID NO: 710433 - RNA, 21 nt, Haemophilus influenzae Rd
cuuauucauuaaggcuuuucu

SEQ ID NO: 710434 - RNA, 16 nt, Haemophilus influenzae Rd
cuuauugaagaaagag

SEQ ID NO: 710435 - RNA, 14 nt, Haemophilus influenzae Rd
cuuaugaaacagcu

SEQ ID NO: 710436 - RNA, 15 nt, Haemophilus influenzae Rd
cuuaguuuuaauucu

SEQ ID NO: 710437 - RNA, 21 nt, Haemophilus influenzae Rd
cuucaaacgccguucaaaauc

SEQ ID NO: 710438 - RNA, 13 nt, Haemophilus influenzae Rd
cuucaaaaacaua

SEQ ID NO: 710439 - RNA, 13 nt, Haemophilus influenzae Rd
cuucaaaaucacc

SEQ ID NO: 710440 - RNA, 19 nt, Haemophilus influenzae Rd
cuuauuguacucaauaagg

SEQ ID NO: 710441 - RNA, 12 nt, Haemophilus influenzae Rd
cuuauuucaaua

SEQ ID NO: 710442 - RNA, 13 nt, Haemophilus influenzae Rd
cuuauuuuuuaau

SEQ ID NO: 710443 - RNA, 17 nt, Haemophilus influenzae Rd
cuuauuuuguguuugaa

SEQ ID NO: 710444 - RNA, 14 nt, Haemophilus influenzae Rd
cuuauuuuuaaaca

SEQ ID NO: 710445 - RNA, 21 nt, Haemophilus influenzae Rd
cuuauuuuuauuaucaaaaaa

SEQ ID NO: 710446 - RNA, 14 nt, Haemophilus influenzae Rd
cuuauuuguuuuau

SEQ ID NO: 710447 - RNA, 16 nt, Haemophilus influenzae Rd
cuuauuuguuuuauag

SEQ ID NO: 710448 - RNA, 19 nt, Haemophilus influenzae Rd
cuuauuuuaaauaaaaaau

SEQ ID NO: 710449 - RNA, 22 nt, Haemophilus influenzae Rd
cuuauuuuacuucaacaacgau

SEQ ID NO: 710450 - RNA, 16 nt, Haemophilus influenzae Rd
cuucaacuaacuggcu

SEQ ID NO: 710451 - RNA, 17 nt, Haemophilus influenzae Rd
cuucaaccacuucaaau

SEQ ID NO: 710452 - RNA, 16 nt, Haemophilus influenzae Rd
cuucaaccacccauac

SEQ ID NO: 710453 - RNA, 13 nt, Haemophilus influenzae Rd
cuucaacauuuuu

SEQ ID NO: 710454 - RNA, 21 nt, Haemophilus influenzae Rd
cuucaacauaaguacauucaa

SEQ ID NO: 710455 - RNA, 16 nt, Haemophilus influenzae Rd
cuucaaucaucauuua

SEQ ID NO: 710456 - RNA, 19 nt, Haemophilus influenzae Rd
cuucaaucaucauuuauua

SEQ ID NO: 710457 - RNA, 21 nt, Haemophilus influenzae Rd
cuucaauagauaaaucaaaac

SEQ ID NO: 710458 - RNA, 14 nt, Haemophilus influenzae Rd
cuucaauuaccuua

SEQ ID NO: 710459 - RNA, 21 nt, Haemophilus influenzae Rd
cuucgaaaauaacuucaucca

SEQ ID NO: 710460 - RNA, 16 nt, Haemophilus influenzae Rd
cuucgaccaacggauu

SEQ ID NO: 710461 - RNA, 16 nt, Haemophilus influenzae Rd
cuucgauauuuuccgu

SEQ ID NO: 710462 - RNA, 22 nt, Haemophilus influenzae Rd
cuucuaaaggcuaaauaaccua

SEQ ID NO: 710463 - RNA, 12 nt, Haemophilus influenzae Rd
cuucuaaaagau

SEQ ID NO: 710464 - RNA, 18 nt, Haemophilus influenzae Rd
cuucuaaaauacguuuuu

SEQ ID NO: 710465 - RNA, 14 nt, Haemophilus influenzae Rd
cuucuacaccuucu

SEQ ID NO: 710466 - RNA, 16 nt, Haemophilus influenzae Rd
cuucuaauuuuugcaa

SEQ ID NO: 710467 - RNA, 21 nt, Haemophilus influenzae Rd
cuucuaauuugccaucacuca

SEQ ID NO: 710468 - RNA, 14 nt, Haemophilus influenzae Rd
cuucuaauucugca

SEQ ID NO: 710469 - RNA, 13 nt, Haemophilus influenzae Rd
cuucuaauucuuc

SEQ ID NO: 710470 - RNA, 16 nt, Haemophilus influenzae Rd
cuucuaauucuuccca

SEQ ID NO: 710471 - RNA, 17 nt, Haemophilus influenzae Rd
cuucuaauuguuugcgu

SEQ ID NO: 710472 - RNA, 20 nt, Haemophilus influenzae Rd
cuucuaugccaaucacaaug

SEQ ID NO: 710473 - RNA, 22 nt, Haemophilus influenzae Rd
cuucuaugccaaucacaaugag

SEQ ID NO: 710474 - RNA, 20 nt, Haemophilus influenzae Rd
cuucuauguuugcaucaauc

SEQ ID NO: 710475 - RNA, 14 nt, Haemophilus influenzae Rd
cuucuacuugaguu

SEQ ID NO: 710476 - RNA, 20 nt, Haemophilus influenzae Rd
cuucguuaaaguugcugaau

SEQ ID NO: 710477 - RNA, 20 nt, Haemophilus influenzae Rd
cuucguuuucugcuucagau

SEQ ID NO: 710478 - RNA, 22 nt, Haemophilus influenzae Rd
cuucgugaauacgaucugcauc

SEQ ID NO: 710479 - RNA, 15 nt, Haemophilus influenzae Rd
cuucgucaucaucaa

SEQ ID NO: 710480 - RNA, 13 nt, Haemophilus influenzae Rd
cuuccacuuuuug

SEQ ID NO: 710481 - RNA, 22 nt, Haemophilus influenzae Rd
cuuccaccgcuuugcuugccca

SEQ ID NO: 710482 - RNA, 11 nt, Haemophilus influenzae Rd
cuucaugauuu

SEQ ID NO: 710483 - RNA, 14 nt, Haemophilus influenzae Rd
cuucaugauuuucc

SEQ ID NO: 710484 - RNA, 20 nt, Haemophilus influenzae Rd
cuucaucuuuaaacaucgcu

SEQ ID NO: 710485 - RNA, 15 nt, Haemophilus influenzae Rd
cuuccaauaauucuu

SEQ ID NO: 710486 - RNA, 17 nt, Haemophilus influenzae Rd
cuuccaauaauucuuua

SEQ ID NO: 710487 - RNA, 19 nt, Haemophilus influenzae Rd
cuuccaaagaaucaucuuc

SEQ ID NO: 710488 - RNA, 23 nt, Haemophilus influenzae Rd
cuuccaaagaaucaucuucaucu

SEQ ID NO: 710489 - RNA, 13 nt, Haemophilus influenzae Rd
cuucaucgcucau

SEQ ID NO: 710490 - RNA, 14 nt, Haemophilus influenzae Rd
cuucaucuauauua

SEQ ID NO: 710491 - RNA, 13 nt, Haemophilus influenzae Rd
cuucacugugcca

SEQ ID NO: 710492 - RNA, 14 nt, Haemophilus influenzae Rd
cuucagaaaauaaa

SEQ ID NO: 710493 - RNA, 11 nt, Haemophilus influenzae Rd
cuucagaaaga

SEQ ID NO: 710494 - RNA, 16 nt, Haemophilus influenzae Rd
cuucagaaagauuaca

SEQ ID NO: 710495 - RNA, 24 nt, Haemophilus influenzae Rd
cuucagaaccugucgcaaugaaga

SEQ ID NO: 710496 - RNA, 22 nt, Haemophilus influenzae Rd
cuucagaacugcuuucuuccaa

SEQ ID NO: 710497 - RNA, 22 nt, Haemophilus influenzae Rd
cuuccguugcauuuaacuuaau

SEQ ID NO: 710498 - RNA, 16 nt, Haemophilus influenzae Rd
cuucccccaaaaaguu

SEQ ID NO: 710499 - RNA, 16 nt, Haemophilus influenzae Rd
cgcaccuucagccacu

SEQ ID NO: 710500 - RNA, 22 nt, Haemophilus influenzae Rd
cgauuaaucgaaguaugaaaac

SEQ ID NO: 710501 - RNA, 19 nt, Haemophilus influenzae Rd
cgauuaauaccaauaauaa

SEQ ID NO: 710502 - RNA, 14 nt, Haemophilus influenzae Rd
cgauuacaaaaaca

SEQ ID NO: 710503 - RNA, 14 nt, Haemophilus influenzae Rd
cgauuaguuuauca

SEQ ID NO: 710504 - RNA, 22 nt, Haemophilus influenzae Rd
cgauuauuuggcaaaugauaac

SEQ ID NO: 710505 - RNA, 14 nt, Haemophilus influenzae Rd
cgcaaacaucauca

SEQ ID NO: 710506 - RNA, 15 nt, Haemophilus influenzae Rd
cgcaaauacuucacc

SEQ ID NO: 710507 - RNA, 13 nt, Haemophilus influenzae Rd
cgcaaguucuuca

SEQ ID NO: 710508 - RNA, 20 nt, Haemophilus influenzae Rd
cgcaauauaggcuauauuuu

SEQ ID NO: 710509 - RNA, 16 nt, Haemophilus influenzae Rd
cgcaauauagucaaau

SEQ ID NO: 710510 - RNA, 12 nt, Haemophilus influenzae Rd
cgcacaccaccu

SEQ ID NO: 710511 - RNA, 21 nt, Haemophilus influenzae Rd
cgcacaccaccugaugcuuua

SEQ ID NO: 710512 - RNA, 17 nt, Haemophilus influenzae Rd
cgcaacuaaauucaauu

SEQ ID NO: 710513 - RNA, 18 nt, Haemophilus influenzae Rd
cgcaacuaauaaaccaau

SEQ ID NO: 710514 - RNA, 21 nt, Haemophilus influenzae Rd
cgcagccuuguucugcagcaa

SEQ ID NO: 710515 - RNA, 14 nt, Haemophilus influenzae Rd
cgcagccacuugcg

SEQ ID NO: 710516 - RNA, 21 nt, Haemophilus influenzae Rd
cgcagcaucugccacuucuug

SEQ ID NO: 710517 - RNA, 13 nt, Haemophilus influenzae Rd
cgcacuuuauuau

SEQ ID NO: 710518 - RNA, 21 nt, Haemophilus influenzae Rd
cgcacuuucagagaaaacuca

SEQ ID NO: 710519 - RNA, 17 nt, Haemophilus influenzae Rd
cgcacuuugauuuugcu

SEQ ID NO: 710520 - RNA, 10 nt, Haemophilus influenzae Rd
cgcacuuugg

SEQ ID NO: 710521 - RNA, 13 nt, Haemophilus influenzae Rd
cgcacuuuuuaau

SEQ ID NO: 710522 - RNA, 17 nt, Haemophilus influenzae Rd
cgcacuuuuuauuuuuc

SEQ ID NO: 710523 - RNA, 19 nt, Haemophilus influenzae Rd
cgcacuuuuuauuuuuccu

SEQ ID NO: 710524 - RNA, 16 nt, Haemophilus influenzae Rd
cgcacuuuuuuuauau

SEQ ID NO: 710525 - RNA, 20 nt, Haemophilus influenzae Rd
cgcacuuuuuuucuuauuuc

SEQ ID NO: 710526 - RNA, 18 nt, Haemophilus influenzae Rd
cgcacuuuucaacaaaaa

SEQ ID NO: 710527 - RNA, 16 nt, Haemophilus influenzae Rd
cgaugaugcaggaaag

SEQ ID NO: 710528 - RNA, 14 nt, Haemophilus influenzae Rd
cgaucugcacuuua

SEQ ID NO: 710529 - RNA, 20 nt, Haemophilus influenzae Rd
cgaucuauauucguuaaaua

SEQ ID NO: 710530 - RNA, 19 nt, Haemophilus influenzae Rd
cgaucuauaagaaaauuau

SEQ ID NO: 710531 - RNA, 17 nt, Haemophilus influenzae Rd
cgaugaaagcuauuucg

SEQ ID NO: 710532 - RNA, 20 nt, Haemophilus influenzae Rd
cgaucuggguuuacaucuug

SEQ ID NO: 710533 - RNA, 14 nt, Haemophilus influenzae Rd
ccuucauauaauaa

SEQ ID NO: 710534 - RNA, 10 nt, Haemophilus influenzae Rd
cgauaaacau

SEQ ID NO: 710535 - RNA, 11 nt, Haemophilus influenzae Rd
cgauaaacauu

SEQ ID NO: 710536 - RNA, 19 nt, Haemophilus influenzae Rd
cgauacggcaaauuaaauc

SEQ ID NO: 710537 - RNA, 22 nt, Haemophilus influenzae Rd
cgauaaauauuacuuaacauca

SEQ ID NO: 710538 - RNA, 16 nt, Haemophilus influenzae Rd
cgauaacaauuuuugc

SEQ ID NO: 710539 - RNA, 22 nt, Haemophilus influenzae Rd
cgauaacaauuuuugcauuuuc

SEQ ID NO: 710540 - RNA, 12 nt, Haemophilus influenzae Rd
cgauaacacccu

SEQ ID NO: 710541 - RNA, 14 nt, Haemophilus influenzae Rd
cgauagaaauaaag

SEQ ID NO: 710542 - RNA, 22 nt, Haemophilus influenzae Rd
cgauaguggcaccgaauguggc

SEQ ID NO: 710543 - RNA, 20 nt, Haemophilus influenzae Rd
cgauauauuguaguaauaaa

SEQ ID NO: 710544 - RNA, 14 nt, Haemophilus influenzae Rd
cgaucaucauuaaa

SEQ ID NO: 710545 - RNA, 19 nt, Haemophilus influenzae Rd
cgaucagggccaguugaaa

SEQ ID NO: 710546 - RNA, 17 nt, Haemophilus influenzae Rd
cgauccucccuaaugau

SEQ ID NO: 710547 - RNA, 23 nt, Haemophilus influenzae Rd
cgauccguaaucgugccugccac

SEQ ID NO: 710548 - RNA, 13 nt, Haemophilus influenzae Rd
cgauccuaaaaaa

SEQ ID NO: 710549 - RNA, 14 nt, Haemophilus influenzae Rd
cgauccuaaaaaac

SEQ ID NO: 710550 - RNA, 16 nt, Haemophilus influenzae Rd
cgauccaaaauucugu

SEQ ID NO: 710551 - RNA, 14 nt, Haemophilus influenzae Rd
cgccagcagugcca

SEQ ID NO: 710552 - RNA, 16 nt, Haemophilus influenzae Rd
cgccaccuuuuguaga

SEQ ID NO: 710553 - RNA, 17 nt, Haemophilus influenzae Rd
cgccacguagauacaua

SEQ ID NO: 710554 - RNA, 18 nt, Haemophilus influenzae Rd
cgccacguagauacauaa

SEQ ID NO: 710555 - RNA, 23 nt, Haemophilus influenzae Rd
cgccacguagauacauaacgcca

SEQ ID NO: 710556 - RNA, 17 nt, Haemophilus influenzae Rd
cgccacccacuaaugcg

SEQ ID NO: 710557 - RNA, 19 nt, Haemophilus influenzae Rd
cgccaaugcuuuuaauuua

SEQ ID NO: 710558 - RNA, 14 nt, Haemophilus influenzae Rd
cgcauaaaaauucc

SEQ ID NO: 710559 - RNA, 16 nt, Haemophilus influenzae Rd
cgccauucuuuauucg

SEQ ID NO: 710560 - RNA, 17 nt, Haemophilus influenzae Rd
cgccauuggauacauaa

SEQ ID NO: 710561 - RNA, 12 nt, Haemophilus influenzae Rd
cgccauuuuuaa

SEQ ID NO: 710562 - RNA, 14 nt, Haemophilus influenzae Rd
cgccuaguccgcca

SEQ ID NO: 710563 - RNA, 14 nt, Haemophilus influenzae Rd
cgccuagcacuuca

SEQ ID NO: 710564 - RNA, 22 nt, Haemophilus influenzae Rd
cgccuaaacacauaauauuuuu

SEQ ID NO: 710565 - RNA, 15 nt, Haemophilus influenzae Rd
cgccuaaugcauuga

SEQ ID NO: 710566 - RNA, 16 nt, Haemophilus influenzae Rd
cgccuaauucaucuuc

SEQ ID NO: 710567 - RNA, 16 nt, Haemophilus influenzae Rd
cgccuaauucuugcca

SEQ ID NO: 710568 - RNA, 23 nt, Haemophilus influenzae Rd
cgccuaauugugaguguaaugcg

SEQ ID NO: 710569 - RNA, 15 nt, Haemophilus influenzae Rd
cgccucaucuuuuuu

SEQ ID NO: 710570 - RNA, 18 nt, Haemophilus influenzae Rd
cgccugaucguacacuuc

SEQ ID NO: 710571 - RNA, 20 nt, Haemophilus influenzae Rd
cgcgaauaucuggauguugu

SEQ ID NO: 710572 - RNA, 17 nt, Haemophilus influenzae Rd
cgccuuaaucauugcaa

SEQ ID NO: 710573 - RNA, 20 nt, Haemophilus influenzae Rd
cgccuuagccuguucuucca

SEQ ID NO: 710574 - RNA, 15 nt, Haemophilus influenzae Rd
cgccugguucguuug

SEQ ID NO: 710575 - RNA, 20 nt, Haemophilus influenzae Rd
cgccugcuaauggcugaucu

SEQ ID NO: 710576 - RNA, 15 nt, Haemophilus influenzae Rd
cgcgacuaaaucuua

SEQ ID NO: 710577 - RNA, 14 nt, Haemophilus influenzae Rd
cgcgcacauacuuc

SEQ ID NO: 710578 - RNA, 14 nt, Haemophilus influenzae Rd
cgcccucgccuugc

SEQ ID NO: 710579 - RNA, 23 nt, Haemophilus influenzae Rd
cgcccuacgccuaauucaucuuc

SEQ ID NO: 710580 - RNA, 22 nt, Haemophilus influenzae Rd
cgcccuuucgggcguuauuuuu

SEQ ID NO: 710581 - RNA, 14 nt, Haemophilus influenzae Rd
cggucaauuuuuuc

SEQ ID NO: 710582 - RNA, 14 nt, Haemophilus influenzae Rd
cggucauccaaugu

SEQ ID NO: 710583 - RNA, 18 nt, Haemophilus influenzae Rd
cggugcaauuugaaaaga

SEQ ID NO: 710584 - RNA, 13 nt, Haemophilus influenzae Rd
cggugacuuuuug

SEQ ID NO: 710585 - RNA, 18 nt, Haemophilus influenzae Rd
cgguggauuuguugugaa

SEQ ID NO: 710586 - RNA, 15 nt, Haemophilus influenzae Rd
cgguuaaaaaucaua

SEQ ID NO: 710587 - RNA, 23 nt, Haemophilus influenzae Rd
cgguuaaaaaucauaguguuuuu

SEQ ID NO: 710588 - RNA, 16 nt, Haemophilus influenzae Rd
cgguuaaaauugcccc

SEQ ID NO: 710589 - RNA, 19 nt, Haemophilus influenzae Rd
cgguuaauuuuuuguucau

SEQ ID NO: 710590 - RNA, 13 nt, Haemophilus influenzae Rd
cguaacgcccaaa

SEQ ID NO: 710591 - RNA, 15 nt, Haemophilus influenzae Rd
cguaaccgcccagca

SEQ ID NO: 710592 - RNA, 12 nt, Haemophilus influenzae Rd
cgguuuuauuau

SEQ ID NO: 710593 - RNA, 13 nt, Haemophilus influenzae Rd
cgguuauuuuuuu

SEQ ID NO: 710594 - RNA, 15 nt, Haemophilus influenzae Rd
cgguuauuuuuuucu

SEQ ID NO: 710595 - RNA, 16 nt, Haemophilus influenzae Rd
cguagaguuuuuucac

SEQ ID NO: 710596 - RNA, 19 nt, Haemophilus influenzae Rd
cguagauacauaacgccaa

SEQ ID NO: 710597 - RNA, 17 nt, Haemophilus influenzae Rd
cguagaaaacaauaaaa

SEQ ID NO: 710598 - RNA, 22 nt, Haemophilus influenzae Rd
cguagaaagaugggugguauca

SEQ ID NO: 710599 - RNA, 15 nt, Haemophilus influenzae Rd
cguagaaaucaaaaa

SEQ ID NO: 710600 - RNA, 22 nt, Haemophilus influenzae Rd
cguagaaaucaaaaaugcuuuu

SEQ ID NO: 710601 - RNA, 15 nt, Haemophilus influenzae Rd
cguaguacaucauuu

SEQ ID NO: 710602 - RNA, 15 nt, Haemophilus influenzae Rd
cguauagcgugcuuu

SEQ ID NO: 710603 - RNA, 16 nt, Haemophilus influenzae Rd
cguauaauauuuucuu

SEQ ID NO: 710604 - RNA, 18 nt, Haemophilus influenzae Rd
cguaucaacuaaaucauc

SEQ ID NO: 710605 - RNA, 24 nt, Haemophilus influenzae Rd
cguaucaacuaaaucaucuaccac

SEQ ID NO: 710606 - RNA, 22 nt, Haemophilus influenzae Rd
cguaucaacuagugcuguugca

SEQ ID NO: 710607 - RNA, 18 nt, Haemophilus influenzae Rd
cguauuaucggaagauga

SEQ ID NO: 710608 - RNA, 13 nt, Haemophilus influenzae Rd
cgucaaaaucauu

SEQ ID NO: 710609 - RNA, 18 nt, Haemophilus influenzae Rd
cgucaaaauuaugcugau

SEQ ID NO: 710610 - RNA, 19 nt, Haemophilus influenzae Rd
cguauuuuuuaguuaaaua

SEQ ID NO: 710611 - RNA, 15 nt, Haemophilus influenzae Rd
cguauuuuuuauuac

SEQ ID NO: 710612 - RNA, 14 nt, Haemophilus influenzae Rd
cguauugaauaauu

SEQ ID NO: 710613 - RNA, 18 nt, Haemophilus influenzae Rd
cguauugcauaaaagcac

SEQ ID NO: 710614 - RNA, 17 nt, Haemophilus influenzae Rd
cgucaugccgcaaucaa

SEQ ID NO: 710615 - RNA, 18 nt, Haemophilus influenzae Rd
cgucaaucaucccuucuu

SEQ ID NO: 710616 - RNA, 14 nt, Haemophilus influenzae Rd
cgucaauugcuaaa

SEQ ID NO: 710617 - RNA, 17 nt, Haemophilus influenzae Rd
cgucaauugcuaaaccu

SEQ ID NO: 710618 - RNA, 14 nt, Haemophilus influenzae Rd
cggcuauuucagcu

SEQ ID NO: 710619 - RNA, 17 nt, Haemophilus influenzae Rd
cggcguagaaugcaaac

SEQ ID NO: 710620 - RNA, 16 nt, Haemophilus influenzae Rd
cggcuuguuguugcuc

SEQ ID NO: 710621 - RNA, 15 nt, Haemophilus influenzae Rd
cggcuuagauaauaa

SEQ ID NO: 710622 - RNA, 14 nt, Haemophilus influenzae Rd
cgggcuuuaucaua

SEQ ID NO: 710623 - RNA, 18 nt, Haemophilus influenzae Rd
cgggcgaaaccuuuuucu

SEQ ID NO: 710624 - RNA, 19 nt, Haemophilus influenzae Rd
cgggaauacacgaugcucu

SEQ ID NO: 710625 - RNA, 15 nt, Haemophilus influenzae Rd
cgcugcucugugcca

SEQ ID NO: 710626 - RNA, 16 nt, Haemophilus influenzae Rd
cgcuggaacuucuaaa

SEQ ID NO: 710627 - RNA, 15 nt, Haemophilus influenzae Rd
cgcucugcaccuuca

SEQ ID NO: 710628 - RNA, 13 nt, Haemophilus influenzae Rd
cgcugaauuauug

SEQ ID NO: 710629 - RNA, 19 nt, Haemophilus influenzae Rd
cgcugaauuauugucuuuu

SEQ ID NO: 710630 - RNA, 21 nt, Haemophilus influenzae Rd
cgcugauaaacgccuuuuaaa

SEQ ID NO: 710631 - RNA, 17 nt, Haemophilus influenzae Rd
cgcuuucaauuuucugu

SEQ ID NO: 710632 - RNA, 14 nt, Haemophilus influenzae Rd
cgcuuuaucuucuu

SEQ ID NO: 710633 - RNA, 17 nt, Haemophilus influenzae Rd
cgcuuuaacgagaauau

SEQ ID NO: 710634 - RNA, 12 nt, Haemophilus influenzae Rd
cgcuuuaauaau

SEQ ID NO: 710635 - RNA, 19 nt, Haemophilus influenzae Rd
cgcuugcaccaaugcgagu

SEQ ID NO: 710636 - RNA, 18 nt, Haemophilus influenzae Rd
cgcuuuucccucuuuuuc

SEQ ID NO: 710637 - RNA, 15 nt, Haemophilus influenzae Rd
cgcuuuugcauugag

SEQ ID NO: 710638 - RNA, 12 nt, Haemophilus influenzae Rd
cgcuuucauaaa

SEQ ID NO: 710639 - RNA, 12 nt, Haemophilus influenzae Rd
cgcuuuuuccuc

SEQ ID NO: 710640 - RNA, 14 nt, Haemophilus influenzae Rd
cgcuuuuuccucag

SEQ ID NO: 710641 - RNA, 20 nt, Haemophilus influenzae Rd
cgcuuuuuccucagcaaaag

SEQ ID NO: 710642 - RNA, 14 nt, Haemophilus influenzae Rd
cggaaaccagcuuu

SEQ ID NO: 710643 - RNA, 15 nt, Haemophilus influenzae Rd
cggaaaccagcuuuc

SEQ ID NO: 710644 - RNA, 11 nt, Haemophilus influenzae Rd
cggaaaauaau

SEQ ID NO: 710645 - RNA, 14 nt, Haemophilus influenzae Rd
cgcuguuacuucuu

SEQ ID NO: 710646 - RNA, 15 nt, Haemophilus influenzae Rd
cgcuguuacuucuuu

SEQ ID NO: 710647 - RNA, 16 nt, Haemophilus influenzae Rd
cgcuggcggcaggcuu

SEQ ID NO: 710648 - RNA, 19 nt, Haemophilus influenzae Rd
cgcugggauuuugucacca

SEQ ID NO: 710649 - RNA, 14 nt, Haemophilus influenzae Rd
cgcgugaugaaaca

SEQ ID NO: 710650 - RNA, 15 nt, Haemophilus influenzae Rd
cgcuaacauaucaau

SEQ ID NO: 710651 - RNA, 12 nt, Haemophilus influenzae Rd
cgcuaaaucaua

SEQ ID NO: 710652 - RNA, 22 nt, Haemophilus influenzae Rd
cgcuaucuuuugguaaauacug

SEQ ID NO: 710653 - RNA, 19 nt, Haemophilus influenzae Rd
cgcucaggaaaacguucau

SEQ ID NO: 710654 - RNA, 23 nt, Haemophilus influenzae Rd
cggcaguacucgaaaaggcaaac

SEQ ID NO: 710655 - RNA, 23 nt, Haemophilus influenzae Rd
cggcaaagguuuuauuuugaaca

SEQ ID NO: 710656 - RNA, 15 nt, Haemophilus influenzae Rd
cggauuaauuucucg

SEQ ID NO: 710657 - RNA, 13 nt, Haemophilus influenzae Rd
cggauugcagaac

SEQ ID NO: 710658 - RNA, 15 nt, Haemophilus influenzae Rd
cggauuauagaauuu

SEQ ID NO: 710659 - RNA, 16 nt, Haemophilus influenzae Rd
cggauuaaaaguccgc

SEQ ID NO: 710660 - RNA, 13 nt, Haemophilus influenzae Rd
cggauuaacacau

SEQ ID NO: 710661 - RNA, 12 nt, Haemophilus influenzae Rd
cggauuuauuau

SEQ ID NO: 710662 - RNA, 15 nt, Haemophilus influenzae Rd
cggauuuguuaagua

SEQ ID NO: 710663 - RNA, 23 nt, Haemophilus influenzae Rd
cggaaaugaaaccaaauccuuuu

SEQ ID NO: 710664 - RNA, 12 nt, Haemophilus influenzae Rd
cggaaauauuuu

SEQ ID NO: 710665 - RNA, 20 nt, Haemophilus influenzae Rd
cggaaauauuuuaauagaau

SEQ ID NO: 710666 - RNA, 23 nt, Haemophilus influenzae Rd
cggauaaccaaaauauuucauuu

SEQ ID NO: 710667 - RNA, 18 nt, Haemophilus influenzae Rd
ccaccgguacagaugcca

SEQ ID NO: 710668 - RNA, 15 nt, Haemophilus influenzae Rd
ccaccugaugcuuua

SEQ ID NO: 710669 - RNA, 19 nt, Haemophilus influenzae Rd
cauuuuuugcaaacgcaag

SEQ ID NO: 710670 - RNA, 22 nt, Haemophilus influenzae Rd
cauuuuuuggaguuguuuaaaa

SEQ ID NO: 710671 - RNA, 17 nt, Haemophilus influenzae Rd
cauuuuuuuaaauauuu

SEQ ID NO: 710672 - RNA, 15 nt, Haemophilus influenzae Rd
cauuuuuuuauucua

SEQ ID NO: 710673 - RNA, 16 nt, Haemophilus influenzae Rd
cauuuuuuuauucuau

SEQ ID NO: 710674 - RNA, 14 nt, Haemophilus influenzae Rd
ccaccgauaaacac

SEQ ID NO: 710675 - RNA, 15 nt, Haemophilus influenzae Rd
ccacuacguguagaa

SEQ ID NO: 710676 - RNA, 19 nt, Haemophilus influenzae Rd
ccacuacugcaucugcauu

SEQ ID NO: 710677 - RNA, 16 nt, Haemophilus influenzae Rd
ccacguuuucaacagu

SEQ ID NO: 710678 - RNA, 16 nt, Haemophilus influenzae Rd
ccacuaaaaacaagug

SEQ ID NO: 710679 - RNA, 24 nt, Haemophilus influenzae Rd
ccacuaaaacacguuugccagaaa

SEQ ID NO: 710680 - RNA, 15 nt, Haemophilus influenzae Rd
ccacuaaaccauuuu

SEQ ID NO: 710681 - RNA, 19 nt, Haemophilus influenzae Rd
ccacuaacucacauugcca

SEQ ID NO: 710682 - RNA, 21 nt, Haemophilus influenzae Rd
ccacucauacguucaacaauc

SEQ ID NO: 710683 - RNA, 15 nt, Haemophilus influenzae Rd
ccacuccccaaaaac

SEQ ID NO: 710684 - RNA, 13 nt, Haemophilus influenzae Rd
ccacuucugaauc

SEQ ID NO: 710685 - RNA, 13 nt, Haemophilus influenzae Rd
ccacuucugcacc

SEQ ID NO: 710686 - RNA, 20 nt, Haemophilus influenzae Rd
ccacuucuucuuuaaacacc

SEQ ID NO: 710687 - RNA, 17 nt, Haemophilus influenzae Rd
ccagaaauagaguuaag

SEQ ID NO: 710688 - RNA, 18 nt, Haemophilus influenzae Rd
ccagaaaguuuuaccccu

SEQ ID NO: 710689 - RNA, 20 nt, Haemophilus influenzae Rd
ccagaaauuggcuuguugcu

SEQ ID NO: 710690 - RNA, 21 nt, Haemophilus influenzae Rd
ccagaaauuggcuuguugcug

SEQ ID NO: 710691 - RNA, 19 nt, Haemophilus influenzae Rd
ccagaacauauaacccaua

SEQ ID NO: 710692 - RNA, 21 nt, Haemophilus influenzae Rd
ccacugauuuuucuuuuucag

SEQ ID NO: 710693 - RNA, 14 nt, Haemophilus influenzae Rd
ccacuggugcugaa

SEQ ID NO: 710694 - RNA, 18 nt, Haemophilus influenzae Rd
ccacugugcauuaaauca

SEQ ID NO: 710695 - RNA, 23 nt, Haemophilus influenzae Rd
ccacuguugugaaguuuuuuaag

SEQ ID NO: 710696 - RNA, 16 nt, Haemophilus influenzae Rd
ccagcaccacguucau

SEQ ID NO: 710697 - RNA, 16 nt, Haemophilus influenzae Rd
ccagauugguucauau

SEQ ID NO: 710698 - RNA, 20 nt, Haemophilus influenzae Rd
ccagauuuuuagacggucaa

SEQ ID NO: 710699 - RNA, 16 nt, Haemophilus influenzae Rd
ccagauuuuuuuuaua

SEQ ID NO: 710700 - RNA, 12 nt, Haemophilus influenzae Rd
ccagcaaaagca

SEQ ID NO: 710701 - RNA, 19 nt, Haemophilus influenzae Rd
ccagcagugacguuuauuu

SEQ ID NO: 710702 - RNA, 14 nt, Haemophilus influenzae Rd
ccagcagugccaac

SEQ ID NO: 710703 - RNA, 19 nt, Haemophilus influenzae Rd
ccagcuggaaauuccacuu

SEQ ID NO: 710704 - RNA, 16 nt, Haemophilus influenzae Rd
ccagcuaaagaaagca

SEQ ID NO: 710705 - RNA, 19 nt, Haemophilus influenzae Rd
ccaucacguaaguaaguca

SEQ ID NO: 710706 - RNA, 21 nt, Haemophilus influenzae Rd
ccaucacguaauacaaaauau

SEQ ID NO: 710707 - RNA, 13 nt, Haemophilus influenzae Rd
ccaucacguucaa

SEQ ID NO: 710708 - RNA, 20 nt, Haemophilus influenzae Rd
ccaucacuuuuaauucuuua

SEQ ID NO: 710709 - RNA, 15 nt, Haemophilus influenzae Rd
ccauacauucagugg

SEQ ID NO: 710710 - RNA, 21 nt, Haemophilus influenzae Rd
ccauaauuucagcaucagaaa

SEQ ID NO: 710711 - RNA, 17 nt, Haemophilus influenzae Rd
ccauacaaguauuuucc

SEQ ID NO: 710712 - RNA, 14 nt, Haemophilus influenzae Rd
ccaucuucuucugg

SEQ ID NO: 710713 - RNA, 18 nt, Haemophilus influenzae Rd
ccaucuuuaauuccaacu

SEQ ID NO: 710714 - RNA, 13 nt, Haemophilus influenzae Rd
ccaucaucuuauc

SEQ ID NO: 710715 - RNA, 20 nt, Haemophilus influenzae Rd
ccaucauagauaaaguauaa

SEQ ID NO: 710716 - RNA, 14 nt, Haemophilus influenzae Rd
ccaucauaaauaug

SEQ ID NO: 710717 - RNA, 23 nt, Haemophilus influenzae Rd
ccauaaaucggcguauuuuacaa

SEQ ID NO: 710718 - RNA, 17 nt, Haemophilus influenzae Rd
ccauaacgcuaucuuuu

SEQ ID NO: 710719 - RNA, 20 nt, Haemophilus influenzae Rd
ccauaacggcaagcaaacag

SEQ ID NO: 710720 - RNA, 18 nt, Haemophilus influenzae Rd
ccaguuggguuaaauaua

SEQ ID NO: 710721 - RNA, 15 nt, Haemophilus influenzae Rd
ccagucgauugugac

SEQ ID NO: 710722 - RNA, 13 nt, Haemophilus influenzae Rd
ccagugaauuucu

SEQ ID NO: 710723 - RNA, 18 nt, Haemophilus influenzae Rd
ccagugaccaagcgauua

SEQ ID NO: 710724 - RNA, 17 nt, Haemophilus influenzae Rd
ccagucauuuuuuacau

SEQ ID NO: 710725 - RNA, 14 nt, Haemophilus influenzae Rd
ccagucaauaaacu

SEQ ID NO: 710726 - RNA, 17 nt, Haemophilus influenzae Rd
cccagcauaaauaaaua

SEQ ID NO: 710727 - RNA, 19 nt, Haemophilus influenzae Rd
cccaaaagcugccaucuga

SEQ ID NO: 710728 - RNA, 16 nt, Haemophilus influenzae Rd
cccaaaacaguaauga

SEQ ID NO: 710729 - RNA, 22 nt, Haemophilus influenzae Rd
cccaaaauauuuucaaauaagu

SEQ ID NO: 710730 - RNA, 14 nt, Haemophilus influenzae Rd
ccauuuuuuuugca

SEQ ID NO: 710731 - RNA, 21 nt, Haemophilus influenzae Rd
ccauuuuuuggaguuguuuaa

SEQ ID NO: 710732 - RNA, 21 nt, Haemophilus influenzae Rd
ccauuuugcucaaaacgaguu

SEQ ID NO: 710733 - RNA, 22 nt, Haemophilus influenzae Rd
ccauuuugcucaaaacgaguua

SEQ ID NO: 710734 - RNA, 21 nt, Haemophilus influenzae Rd
ccauuuuuaaauggucuucau

SEQ ID NO: 710735 - RNA, 20 nt, Haemophilus influenzae Rd
ccauuuucucugcgauuucu

SEQ ID NO: 710736 - RNA, 16 nt, Haemophilus influenzae Rd
ccauuuucuuguucuc

SEQ ID NO: 710737 - RNA, 19 nt, Haemophilus influenzae Rd
ccauuuucuuguucuccau

SEQ ID NO: 710738 - RNA, 14 nt, Haemophilus influenzae Rd
ccauuuugaacaag

SEQ ID NO: 710739 - RNA, 18 nt, Haemophilus influenzae Rd
ccauuuugaggaauaaau

SEQ ID NO: 710740 - RNA, 20 nt, Haemophilus influenzae Rd
ccauuuugauugcuacagca

SEQ ID NO: 710741 - RNA, 19 nt, Haemophilus influenzae Rd
ccauuuuucagcaagcauu

SEQ ID NO: 710742 - RNA, 15 nt, Haemophilus influenzae Rd
ccauuuuuccagcaa

SEQ ID NO: 710743 - RNA, 23 nt, Haemophilus influenzae Rd
ccauuuuugagguguuuaugcuu

SEQ ID NO: 710744 - RNA, 19 nt, Haemophilus influenzae Rd
ccauuucuugaccuuucaa

SEQ ID NO: 710745 - RNA, 11 nt, Haemophilus influenzae Rd
ccauuucuaaa

SEQ ID NO: 710746 - RNA, 19 nt, Haemophilus influenzae Rd
ccauuucuuuuugcaggga

SEQ ID NO: 710747 - RNA, 15 nt, Haemophilus influenzae Rd
ccauuugaauuuuac

SEQ ID NO: 710748 - RNA, 20 nt, Haemophilus influenzae Rd
ccauuuguuuagauuuuacu

SEQ ID NO: 710749 - RNA, 19 nt, Haemophilus influenzae Rd
ccauuuuaaucauaaaaaa

SEQ ID NO: 710750 - RNA, 19 nt, Haemophilus influenzae Rd
ccauuuucgcaucaaucac

SEQ ID NO: 710751 - RNA, 16 nt, Haemophilus influenzae Rd
ccauugcaauuucagc

SEQ ID NO: 710752 - RNA, 14 nt, Haemophilus influenzae Rd
ccauugaugaaaug

SEQ ID NO: 710753 - RNA, 17 nt, Haemophilus influenzae Rd
ccauugagcauuuuuua

SEQ ID NO: 710754 - RNA, 18 nt, Haemophilus influenzae Rd
ccauugaaaggguugcag

SEQ ID NO: 710755 - RNA, 13 nt, Haemophilus influenzae Rd
ccauuucaccacu

SEQ ID NO: 710756 - RNA, 21 nt, Haemophilus influenzae Rd
ccauuuaaaaguaaaaauaaa

SEQ ID NO: 710757 - RNA, 23 nt, Haemophilus influenzae Rd
ccauuguuuguuuuauuuauucu

SEQ ID NO: 710758 - RNA, 20 nt, Haemophilus influenzae Rd
ccauuuacggcuuagauaau

SEQ ID NO: 710759 - RNA, 12 nt, Haemophilus influenzae Rd
ccauuucaauca

SEQ ID NO: 710760 - RNA, 16 nt, Haemophilus influenzae Rd
ccauuguuaaauguua

SEQ ID NO: 710761 - RNA, 22 nt, Haemophilus influenzae Rd
ccauugugccaaauucaguauc

SEQ ID NO: 710762 - RNA, 12 nt, Haemophilus influenzae Rd
ccauuguuuaau

SEQ ID NO: 710763 - RNA, 21 nt, Haemophilus influenzae Rd
cccaacagaaaucauuucaau

SEQ ID NO: 710764 - RNA, 17 nt, Haemophilus influenzae Rd
cccaacagauuuaauac

SEQ ID NO: 710765 - RNA, 20 nt, Haemophilus influenzae Rd
cccaacauuucacuaaauaa

SEQ ID NO: 710766 - RNA, 21 nt, Haemophilus influenzae Rd
cccaacaaauuuaaaugauga

SEQ ID NO: 710767 - RNA, 14 nt, Haemophilus influenzae Rd
cccaaauuuauaau

SEQ ID NO: 710768 - RNA, 11 nt, Haemophilus influenzae Rd
cccaacaaauu

SEQ ID NO: 710769 - RNA, 14 nt, Haemophilus influenzae Rd
cccaaaauuucagc

SEQ ID NO: 710770 - RNA, 13 nt, Haemophilus influenzae Rd
ccccccuaccgga

SEQ ID NO: 710771 - RNA, 14 nt, Haemophilus influenzae Rd
cccauuuguagaaa

SEQ ID NO: 710772 - RNA, 21 nt, Haemophilus influenzae Rd
cccauuaaugguauugugauu

SEQ ID NO: 710773 - RNA, 19 nt, Haemophilus influenzae Rd
ccccaauuaagucaaaaau

SEQ ID NO: 710774 - RNA, 11 nt, Haemophilus influenzae Rd
ccccaauauuu

SEQ ID NO: 710775 - RNA, 22 nt, Haemophilus influenzae Rd
ccccaaguuugcacuucuucag

SEQ ID NO: 710776 - RNA, 15 nt, Haemophilus influenzae Rd
ccccaauaaaaagau

SEQ ID NO: 710777 - RNA, 12 nt, Haemophilus influenzae Rd
cccgaagccaga

SEQ ID NO: 710778 - RNA, 19 nt, Haemophilus influenzae Rd
ccccuuguucuucauagaa

SEQ ID NO: 710779 - RNA, 13 nt, Haemophilus influenzae Rd
cccgguaaaucua

SEQ ID NO: 710780 - RNA, 14 nt, Haemophilus influenzae Rd
cccucaagauagcg

SEQ ID NO: 710781 - RNA, 15 nt, Haemophilus influenzae Rd
cccucaaaauuauga

SEQ ID NO: 710782 - RNA, 15 nt, Haemophilus influenzae Rd
cccuauuaaaacagc

SEQ ID NO: 710783 - RNA, 19 nt, Haemophilus influenzae Rd
cccuauacuccacuauaaa

SEQ ID NO: 710784 - RNA, 15 nt, Haemophilus influenzae Rd
cccuacgccuaauuc

SEQ ID NO: 710785 - RNA, 22 nt, Haemophilus influenzae Rd
cccuacgccuaauucaucuucu

SEQ ID NO: 710786 - RNA, 14 nt, Haemophilus influenzae Rd
cccguucaauuuga

SEQ ID NO: 710787 - RNA, 13 nt, Haemophilus influenzae Rd
cccgcucuuucca

SEQ ID NO: 710788 - RNA, 15 nt, Haemophilus influenzae Rd
cccgcuucuuucgca

SEQ ID NO: 710789 - RNA, 23 nt, Haemophilus influenzae Rd
ccgaaugacgcguuaauuuuuaa

SEQ ID NO: 710790 - RNA, 15 nt, Haemophilus influenzae Rd
ccgacaacacuugcu

SEQ ID NO: 710791 - RNA, 18 nt, Haemophilus influenzae Rd
cccuuuuaguuuccccug

SEQ ID NO: 710792 - RNA, 13 nt, Haemophilus influenzae Rd
cccuuuucaaaca

SEQ ID NO: 710793 - RNA, 22 nt, Haemophilus influenzae Rd
cccuuuuuacauuauugaagca

SEQ ID NO: 710794 - RNA, 13 nt, Haemophilus influenzae Rd
cccuuuuguuauu

SEQ ID NO: 710795 - RNA, 20 nt, Haemophilus influenzae Rd
ccgaaauaaccuagaacaaa

SEQ ID NO: 710796 - RNA, 17 nt, Haemophilus influenzae Rd
cccuuguuacaccuugg

SEQ ID NO: 710797 - RNA, 15 nt, Haemophilus influenzae Rd
cccuuguucuucaua

SEQ ID NO: 710798 - RNA, 21 nt, Haemophilus influenzae Rd
cccuuuaaauuacauucccaa

SEQ ID NO: 710799 - RNA, 16 nt, Haemophilus influenzae Rd
ccgauaaguccaucac

SEQ ID NO: 710800 - RNA, 22 nt, Haemophilus influenzae Rd
ccgauagcuuuuguugcuugaa

SEQ ID NO: 710801 - RNA, 21 nt, Haemophilus influenzae Rd
ccgcauugcccgcuucuucga

SEQ ID NO: 710802 - RNA, 22 nt, Haemophilus influenzae Rd
ccgcauuguaaaccaaauuucu

SEQ ID NO: 710803 - RNA, 20 nt, Haemophilus influenzae Rd
ccgccaagugcgguugaaaa

SEQ ID NO: 710804 - RNA, 12 nt, Haemophilus influenzae Rd
ccgcaucuuugg

SEQ ID NO: 710805 - RNA, 14 nt, Haemophilus influenzae Rd
ccgcacuuuuuucu

SEQ ID NO: 710806 - RNA, 22 nt, Haemophilus influenzae Rd
ccgcacuuuuuuguauaaaaau

SEQ ID NO: 710807 - RNA, 15 nt, Haemophilus influenzae Rd
ccgcacuuuuuuuau

SEQ ID NO: 710808 - RNA, 17 nt, Haemophilus influenzae Rd
ccgcacuuuuauuauuu

SEQ ID NO: 710809 - RNA, 23 nt, Haemophilus influenzae Rd
ccgcacuuuucaacaaaaaacac

SEQ ID NO: 710810 - RNA, 14 nt, Haemophilus influenzae Rd
ccgcacuuuuuagc

SEQ ID NO: 710811 - RNA, 20 nt, Haemophilus influenzae Rd
ccgcacuuuuuauauuuuuu

SEQ ID NO: 710812 - RNA, 20 nt, Haemophilus influenzae Rd
ccgcacuuuuuaucuaaaaa

SEQ ID NO: 710813 - RNA, 13 nt, Haemophilus influenzae Rd
ccgcacuuuuucu

SEQ ID NO: 710814 - RNA, 12 nt, Haemophilus influenzae Rd
ccgcacuuuuug

SEQ ID NO: 710815 - RNA, 13 nt, Haemophilus influenzae Rd
ccgcaauuucugc

SEQ ID NO: 710816 - RNA, 15 nt, Haemophilus influenzae Rd
ccgcaauuucugcca

SEQ ID NO: 710817 - RNA, 13 nt, Haemophilus influenzae Rd
ccgcaaucaagca

SEQ ID NO: 710818 - RNA, 15 nt, Haemophilus influenzae Rd
ccgcaaucacaaaau

SEQ ID NO: 710819 - RNA, 22 nt, Haemophilus influenzae Rd
ccgccacgauggcaauucgccc

SEQ ID NO: 710820 - RNA, 14 nt, Haemophilus influenzae Rd
ccgccgauaguuaa

SEQ ID NO: 710821 - RNA, 20 nt, Haemophilus influenzae Rd
ccgcuucuuucgcagccacu

SEQ ID NO: 710822 - RNA, 23 nt, Haemophilus influenzae Rd
ccgccuuaaucauugcaagugca

SEQ ID NO: 710823 - RNA, 23 nt, Haemophilus influenzae Rd
ccgcgcuuagcaauguuuucgcc

SEQ ID NO: 710824 - RNA, 18 nt, Haemophilus influenzae Rd
ccgcuggaaacaaaccac

SEQ ID NO: 710825 - RNA, 15 nt, Haemophilus influenzae Rd
ccgcucgccaauaaa

SEQ ID NO: 710826 - RNA, 22 nt, Haemophilus influenzae Rd
ccgcugcaacaaauaaaucaua

SEQ ID NO: 710827 - RNA, 18 nt, Haemophilus influenzae Rd
ccuaaacccgcaauuaau

SEQ ID NO: 710828 - RNA, 23 nt, Haemophilus influenzae Rd
ccuaaauuaugcuccauugcaau

SEQ ID NO: 710829 - RNA, 15 nt, Haemophilus influenzae Rd
ccuaaaucuucuuua

SEQ ID NO: 710830 - RNA, 18 nt, Haemophilus influenzae Rd
ccuaaaucuucuuuacca

SEQ ID NO: 710831 - RNA, 16 nt, Haemophilus influenzae Rd
ccuaagcacaaagaaa

SEQ ID NO: 710832 - RNA, 16 nt, Haemophilus influenzae Rd
ccuaagccaaauccaa

SEQ ID NO: 710833 - RNA, 17 nt, Haemophilus influenzae Rd
ccuaauuggaaaaguaa

SEQ ID NO: 710834 - RNA, 14 nt, Haemophilus influenzae Rd
ccuaauuucauaaa

SEQ ID NO: 710835 - RNA, 19 nt, Haemophilus influenzae Rd
ccuaaaaauuuuaggugcu

SEQ ID NO: 710836 - RNA, 19 nt, Haemophilus influenzae Rd
ccuaaaaaugccccagcaa

SEQ ID NO: 710837 - RNA, 22 nt, Haemophilus influenzae Rd
ccuaaaauagagcaaauauaaa

SEQ ID NO: 710838 - RNA, 11 nt, Haemophilus influenzae Rd
ccguuuuucac

SEQ ID NO: 710839 - RNA, 13 nt, Haemophilus influenzae Rd
ccguguuuuucac

SEQ ID NO: 710840 - RNA, 19 nt, Haemophilus influenzae Rd
ccguguuuuucaucaaugc

SEQ ID NO: 710841 - RNA, 18 nt, Haemophilus influenzae Rd
ccguguucuagugcaaca

SEQ ID NO: 710842 - RNA, 23 nt, Haemophilus influenzae Rd
ccgucgcgauagccucuucuuuu

SEQ ID NO: 710843 - RNA, 16 nt, Haemophilus influenzae Rd
ccgugauaacaacuca

SEQ ID NO: 710844 - RNA, 15 nt, Haemophilus influenzae Rd
ccuauuuacguaaaa

SEQ ID NO: 710845 - RNA, 14 nt, Haemophilus influenzae Rd
ccuauuacuuucca

SEQ ID NO: 710846 - RNA, 23 nt, Haemophilus influenzae Rd
ccucaaguuuguggaguaauucu

SEQ ID NO: 710847 - RNA, 16 nt, Haemophilus influenzae Rd
ccucagaagaaauuaa

SEQ ID NO: 710848 - RNA, 13 nt, Haemophilus influenzae Rd
ccuauagcccaac

SEQ ID NO: 710849 - RNA, 13 nt, Haemophilus influenzae Rd
ccuaugaauaagc

SEQ ID NO: 710850 - RNA, 18 nt, Haemophilus influenzae Rd
ccuaugauuauagauuua

SEQ ID NO: 710851 - RNA, 22 nt, Haemophilus influenzae Rd
ccuagugcaaccacacaagcac

SEQ ID NO: 710852 - RNA, 14 nt, Haemophilus influenzae Rd
ccuaguauuuuugu

SEQ ID NO: 710853 - RNA, 16 nt, Haemophilus influenzae Rd
ccuauaauuaaaguua

SEQ ID NO: 710854 - RNA, 19 nt, Haemophilus influenzae Rd
ccuauaauuaaaguuacuu

SEQ ID NO: 710855 - RNA, 11 nt, Haemophilus influenzae Rd
ccuauaauagc

SEQ ID NO: 710856 - RNA, 18 nt, Haemophilus influenzae Rd
ccuauacuccacuauaaa

SEQ ID NO: 710857 - RNA, 13 nt, Haemophilus influenzae Rd
ccuacagauacag

SEQ ID NO: 710858 - RNA, 16 nt, Haemophilus influenzae Rd
ccuacagauacagaag

SEQ ID NO: 710859 - RNA, 18 nt, Haemophilus influenzae Rd
ccuacuauaggaauauca

SEQ ID NO: 710860 - RNA, 15 nt, Haemophilus influenzae Rd
ccuacuuuuuauuuu

SEQ ID NO: 710861 - RNA, 20 nt, Haemophilus influenzae Rd
ccuacuuuuuauuuuugauu

SEQ ID NO: 710862 - RNA, 15 nt, Haemophilus influenzae Rd
ccuagaacaaaaggc

SEQ ID NO: 710863 - RNA, 17 nt, Haemophilus influenzae Rd
ccuagcagcaauagaua

SEQ ID NO: 710864 - RNA, 16 nt, Haemophilus influenzae Rd
ccgucauuuauaaaau

SEQ ID NO: 710865 - RNA, 21 nt, Haemophilus influenzae Rd
ccguccaaucuaauucuuccg

SEQ ID NO: 710866 - RNA, 19 nt, Haemophilus influenzae Rd
ccguaaugcuuuauuuaaa

SEQ ID NO: 710867 - RNA, 16 nt, Haemophilus influenzae Rd
ccguauugaauaauua

SEQ ID NO: 710868 - RNA, 19 nt, Haemophilus influenzae Rd
ccguaucaacuaaaucauc

SEQ ID NO: 710869 - RNA, 11 nt, Haemophilus influenzae Rd
ccguauuuuca

SEQ ID NO: 710870 - RNA, 15 nt, Haemophilus influenzae Rd
ccgguugugcaguau

SEQ ID NO: 710871 - RNA, 17 nt, Haemophilus influenzae Rd
ccucagguucaaacauc

SEQ ID NO: 710872 - RNA, 15 nt, Haemophilus influenzae Rd
ccucagguauuucuu

SEQ ID NO: 710873 - RNA, 22 nt, Haemophilus influenzae Rd
ccucagauaaucuacaaaacau

SEQ ID NO: 710874 - RNA, 15 nt, Haemophilus influenzae Rd
ccucagcaauuucuu

SEQ ID NO: 710875 - RNA, 22 nt, Haemophilus influenzae Rd
ccucagcaauuucuucagcuug

SEQ ID NO: 710876 - RNA, 14 nt, Haemophilus influenzae Rd
ccucuaaauaaaaa

SEQ ID NO: 710877 - RNA, 16 nt, Haemophilus influenzae Rd
ccucuucauuguggaa

SEQ ID NO: 710878 - RNA, 21 nt, Haemophilus influenzae Rd
ccucugcagggaaaaauuuua

SEQ ID NO: 710879 - RNA, 15 nt, Haemophilus influenzae Rd
ccucuacggcaauug

SEQ ID NO: 710880 - RNA, 18 nt, Haemophilus influenzae Rd
ccugauaaguagaaaaau

SEQ ID NO: 710881 - RNA, 14 nt, Haemophilus influenzae Rd
ccugcaaauaagau

SEQ ID NO: 710882 - RNA, 16 nt, Haemophilus influenzae Rd
ccugcagccauaauau

SEQ ID NO: 710883 - RNA, 20 nt, Haemophilus influenzae Rd
ccugcagccauaauauuuaa

SEQ ID NO: 710884 - RNA, 13 nt, Haemophilus influenzae Rd
ccugaugcagaag

SEQ ID NO: 710885 - RNA, 20 nt, Haemophilus influenzae Rd
ccugaugcuuuaacaccaau

SEQ ID NO: 710886 - RNA, 17 nt, Haemophilus influenzae Rd
ccugaugcgauccaaaa

SEQ ID NO: 710887 - RNA, 15 nt, Haemophilus influenzae Rd
ccugauuauugugau

SEQ ID NO: 710888 - RNA, 16 nt, Haemophilus influenzae Rd
ccugauuaaucaaaaa

SEQ ID NO: 710889 - RNA, 17 nt, Haemophilus influenzae Rd
ccugauuaaucaaaaau

SEQ ID NO: 710890 - RNA, 22 nt, Haemophilus influenzae Rd
ccugauucauugcauuuuuaua

SEQ ID NO: 710891 - RNA, 15 nt, Haemophilus influenzae Rd
ccugaucauaaguau

SEQ ID NO: 710892 - RNA, 22 nt, Haemophilus influenzae Rd
ccuguuggaauuucaaaaucca

SEQ ID NO: 710893 - RNA, 14 nt, Haemophilus influenzae Rd
ccuguuucacaagu

SEQ ID NO: 710894 - RNA, 22 nt, Haemophilus influenzae Rd
ccuuaauacugcugaauaaacc

SEQ ID NO: 710895 - RNA, 22 nt, Haemophilus influenzae Rd
ccuuaaccaucuuuuuuugcaa

SEQ ID NO: 710896 - RNA, 17 nt, Haemophilus influenzae Rd
ccuucacaaacccauuu

SEQ ID NO: 710897 - RNA, 19 nt, Haemophilus influenzae Rd
ccuucacuuggcgaaaauc

SEQ ID NO: 710898 - RNA, 14 nt, Haemophilus influenzae Rd
ccuucaggauaaaa

SEQ ID NO: 710899 - RNA, 13 nt, Haemophilus influenzae Rd
ccuucaagccuug

SEQ ID NO: 710900 - RNA, 16 nt, Haemophilus influenzae Rd
ccuucaacauuuuuug

SEQ ID NO: 710901 - RNA, 21 nt, Haemophilus influenzae Rd
ccuucaaccacccauacuuua

SEQ ID NO: 710902 - RNA, 12 nt, Haemophilus influenzae Rd
ccuuauuuuuug

SEQ ID NO: 710903 - RNA, 18 nt, Haemophilus influenzae Rd
ccuuagccaaaucaucua

SEQ ID NO: 710904 - RNA, 16 nt, Haemophilus influenzae Rd
ccuuacugccuuuuuc

SEQ ID NO: 710905 - RNA, 23 nt, Haemophilus influenzae Rd
ccuuacugccuuuuucuucuuuc

SEQ ID NO: 710906 - RNA, 16 nt, Haemophilus influenzae Rd
ccuuaccuuccacuuu

SEQ ID NO: 710907 - RNA, 13 nt, Haemophilus influenzae Rd
ccuuauuuuaaau

SEQ ID NO: 710908 - RNA, 14 nt, Haemophilus influenzae Rd
ccuuauuuuguguu

SEQ ID NO: 710909 - RNA, 15 nt, Haemophilus influenzae Rd
ccuuauacaaaacua

SEQ ID NO: 710910 - RNA, 22 nt, Haemophilus influenzae Rd
ccuuauauucagacugaauuug

SEQ ID NO: 710911 - RNA, 18 nt, Haemophilus influenzae Rd
cagcuuaucaaucaagaa

SEQ ID NO: 710912 - RNA, 19 nt, Haemophilus influenzae Rd
cagcuuaucaaucaagaau

SEQ ID NO: 710913 - RNA, 14 nt, Haemophilus influenzae Rd
cagcuuaagcuggc

SEQ ID NO: 710914 - RNA, 18 nt, Haemophilus influenzae Rd
cagcuguuuaucaauaga

SEQ ID NO: 710915 - RNA, 17 nt, Haemophilus influenzae Rd
cagcuucacgguuauac

SEQ ID NO: 710916 - RNA, 16 nt, Haemophilus influenzae Rd
cagcuggaguucguua

SEQ ID NO: 710917 - RNA, 15 nt, Haemophilus influenzae Rd
cagcuggaaauucca

SEQ ID NO: 710918 - RNA, 19 nt, Haemophilus influenzae Rd
cagcuacuucccaaauuuu

SEQ ID NO: 710919 - RNA, 12 nt, Haemophilus influenzae Rd
cagcuagaauaa

SEQ ID NO: 710920 - RNA, 17 nt, Haemophilus influenzae Rd
cagcuaguccugcagcc

SEQ ID NO: 710921 - RNA, 20 nt, Haemophilus influenzae Rd
caggaagcucgguaaaaauc

SEQ ID NO: 710922 - RNA, 21 nt, Haemophilus influenzae Rd
caggaagcucgguaaaaauca

SEQ ID NO: 710923 - RNA, 12 nt, Haemophilus influenzae Rd
caggaauuugcu

SEQ ID NO: 710924 - RNA, 18 nt, Haemophilus influenzae Rd
caggaauuugcucaauaa

SEQ ID NO: 710925 - RNA, 19 nt, Haemophilus influenzae Rd
caggaaucgugacaauaac

SEQ ID NO: 710926 - RNA, 22 nt, Haemophilus influenzae Rd
caggagaaaguuguacuauuuu

SEQ ID NO: 710927 - RNA, 19 nt, Haemophilus influenzae Rd
caggagaaucagaguuaaa

SEQ ID NO: 710928 - RNA, 21 nt, Haemophilus influenzae Rd
caggaggagccaaauuuaaaa

SEQ ID NO: 710929 - RNA, 22 nt, Haemophilus influenzae Rd
cagggaacgguucgccugauuu

SEQ ID NO: 710930 - RNA, 14 nt, Haemophilus influenzae Rd
cagggcgaaguaaa

SEQ ID NO: 710931 - RNA, 20 nt, Haemophilus influenzae Rd
cagggcgaaguaaaaaguca

SEQ ID NO: 710932 - RNA, 18 nt, Haemophilus influenzae Rd
cagggccaguugaaagaa

SEQ ID NO: 710933 - RNA, 20 nt, Haemophilus influenzae Rd
caggcuaucaucaucauuuu

SEQ ID NO: 710934 - RNA, 21 nt, Haemophilus influenzae Rd
caguauaaaccgcauuacuuu

SEQ ID NO: 710935 - RNA, 22 nt, Haemophilus influenzae Rd
caguauaaaccgcauuacuuuu

SEQ ID NO: 710936 - RNA, 16 nt, Haemophilus influenzae Rd
caguagaaucaaggcu

SEQ ID NO: 710937 - RNA, 18 nt, Haemophilus influenzae Rd
caguagaaucaaggcuuu

SEQ ID NO: 710938 - RNA, 13 nt, Haemophilus influenzae Rd
caguauuuuuucg

SEQ ID NO: 710939 - RNA, 14 nt, Haemophilus influenzae Rd
cagucaaaaaugug

SEQ ID NO: 710940 - RNA, 20 nt, Haemophilus influenzae Rd
caguauccgccaaugcuuuu

SEQ ID NO: 710941 - RNA, 14 nt, Haemophilus influenzae Rd
caguaucaaauaca

SEQ ID NO: 710942 - RNA, 20 nt, Haemophilus influenzae Rd
caguauagugcgcauauacu

SEQ ID NO: 710943 - RNA, 20 nt, Haemophilus influenzae Rd
caguaacuacaacuucauca

SEQ ID NO: 710944 - RNA, 14 nt, Haemophilus influenzae Rd
caguaacuucugcu

SEQ ID NO: 710945 - RNA, 18 nt, Haemophilus influenzae Rd
caguaacuuucuucaaua

SEQ ID NO: 710946 - RNA, 17 nt, Haemophilus influenzae Rd
caggguuauuugcaaua

SEQ ID NO: 710947 - RNA, 21 nt, Haemophilus influenzae Rd
caggguuauuugcaauaaaau

SEQ ID NO: 710948 - RNA, 17 nt, Haemophilus influenzae Rd
cagggugucguagaaau

SEQ ID NO: 710949 - RNA, 18 nt, Haemophilus influenzae Rd
caggugggaaauaauuuu

SEQ ID NO: 710950 - RNA, 14 nt, Haemophilus influenzae Rd
caggugucacagca

SEQ ID NO: 710951 - RNA, 23 nt, Haemophilus influenzae Rd
caggugucaucacucguugguau

SEQ ID NO: 710952 - RNA, 22 nt, Haemophilus influenzae Rd
cagguguguuuuucaaaaaaug

SEQ ID NO: 710953 - RNA, 13 nt, Haemophilus influenzae Rd
caguaaacaagua

SEQ ID NO: 710954 - RNA, 22 nt, Haemophilus influenzae Rd
caguaaacaaguauaaaaaauc

SEQ ID NO: 710955 - RNA, 12 nt, Haemophilus influenzae Rd
cagguuuuucuu

SEQ ID NO: 710956 - RNA, 17 nt, Haemophilus influenzae Rd
cagguuuuuuauuucuc

SEQ ID NO: 710957 - RNA, 17 nt, Haemophilus influenzae Rd
cagguugcugauaaaga

SEQ ID NO: 710958 - RNA, 19 nt, Haemophilus influenzae Rd
cagguugcugauaaagaua

SEQ ID NO: 710959 - RNA, 15 nt, Haemophilus influenzae Rd
cagugcauuaaugcc

SEQ ID NO: 710960 - RNA, 18 nt, Haemophilus influenzae Rd
cagugcuuucauagauga

SEQ ID NO: 710961 - RNA, 14 nt, Haemophilus influenzae Rd
cagucuuuuaacac

SEQ ID NO: 710962 - RNA, 13 nt, Haemophilus influenzae Rd
cagugaaaccaaa

SEQ ID NO: 710963 - RNA, 18 nt, Haemophilus influenzae Rd
cagucgauuacaaaaaca

SEQ ID NO: 710964 - RNA, 22 nt, Haemophilus influenzae Rd
cagucaucuaauugauucaaau

SEQ ID NO: 710965 - RNA, 19 nt, Haemophilus influenzae Rd
cagucugcgccuaaaauau

SEQ ID NO: 710966 - RNA, 21 nt, Haemophilus influenzae Rd
cagucuguuuggcuaauaauu

SEQ ID NO: 710967 - RNA, 14 nt, Haemophilus influenzae Rd
cagucuuacgccaa

SEQ ID NO: 710968 - RNA, 21 nt, Haemophilus influenzae Rd
cagucgcuuuuuuaucuaaac

SEQ ID NO: 710969 - RNA, 15 nt, Haemophilus influenzae Rd
caguuggguuaaaua

SEQ ID NO: 710970 - RNA, 13 nt, Haemophilus influenzae Rd
caguuguaaagau

SEQ ID NO: 710971 - RNA, 20 nt, Haemophilus influenzae Rd
caguugcuaaaucaccuaaa

SEQ ID NO: 710972 - RNA, 13 nt, Haemophilus influenzae Rd
caguucuccuucu

SEQ ID NO: 710973 - RNA, 22 nt, Haemophilus influenzae Rd
caguucuccuucuccauuugcc

SEQ ID NO: 710974 - RNA, 24 nt, Haemophilus influenzae Rd
cauaaccauucccauuccaguaau

SEQ ID NO: 710975 - RNA, 21 nt, Haemophilus influenzae Rd
cauaacccacuguuaaagugc

SEQ ID NO: 710976 - RNA, 16 nt, Haemophilus influenzae Rd
cauaacccgccuuugu

SEQ ID NO: 710977 - RNA, 15 nt, Haemophilus influenzae Rd
cauaaccaaagggca

SEQ ID NO: 710978 - RNA, 17 nt, Haemophilus influenzae Rd
cauaacauuguuuuaau

SEQ ID NO: 710979 - RNA, 15 nt, Haemophilus influenzae Rd
cauaacaaaauggcu

SEQ ID NO: 710980 - RNA, 20 nt, Haemophilus influenzae Rd
cauaacaaaauggcuuuuuu

SEQ ID NO: 710981 - RNA, 15 nt, Haemophilus influenzae Rd
cauaaaugcuacuug

SEQ ID NO: 710982 - RNA, 17 nt, Haemophilus influenzae Rd
cauaaaucuuuaaaugc

SEQ ID NO: 710983 - RNA, 15 nt, Haemophilus influenzae Rd
cauaaaugacagaaa

SEQ ID NO: 710984 - RNA, 20 nt, Haemophilus influenzae Rd
cauaaauuuggauaguuuau

SEQ ID NO: 710985 - RNA, 22 nt, Haemophilus influenzae Rd
cauaaauuuggauaguuuauua

SEQ ID NO: 710986 - RNA, 23 nt, Haemophilus influenzae Rd
cauaaauucucgccauaauaaaa

SEQ ID NO: 710987 - RNA, 23 nt, Haemophilus influenzae Rd
cauaaauaggaaaggcauuuuuu

SEQ ID NO: 710988 - RNA, 18 nt, Haemophilus influenzae Rd
cauaaaucgccuucacau

SEQ ID NO: 710989 - RNA, 19 nt, Haemophilus influenzae Rd
cauaaaccgccaaaaauua

SEQ ID NO: 710990 - RNA, 15 nt, Haemophilus influenzae Rd
cauaaacgcaccaca

SEQ ID NO: 710991 - RNA, 22 nt, Haemophilus influenzae Rd
cauaaaacacaucgcuugcauu

SEQ ID NO: 710992 - RNA, 18 nt, Haemophilus influenzae Rd
cauaaaacaguauuuucc

SEQ ID NO: 710993 - RNA, 21 nt, Haemophilus influenzae Rd
cauaaaacaguauuuuccuua

SEQ ID NO: 710994 - RNA, 11 nt, Haemophilus influenzae Rd
cauaaaaccag

SEQ ID NO: 710995 - RNA, 17 nt, Haemophilus influenzae Rd
cauaaacaaaauaaacu

SEQ ID NO: 710996 - RNA, 12 nt, Haemophilus influenzae Rd
cauaaacaaauu

SEQ ID NO: 710997 - RNA, 15 nt, Haemophilus influenzae Rd
cauaaacaauuucau

SEQ ID NO: 710998 - RNA, 17 nt, Haemophilus influenzae Rd
cauaaacaauuucauua

SEQ ID NO: 710999 - RNA, 14 nt, Haemophilus influenzae Rd
cauaaacuaaaaua

SEQ ID NO: 711000 - RNA, 15 nt, Haemophilus influenzae Rd
cauaaacuaaaauau

SEQ ID NO: 711001 - RNA, 15 nt, Haemophilus influenzae Rd
cauaaagaauaauuu

SEQ ID NO: 711002 - RNA, 19 nt, Haemophilus influenzae Rd
cauaaagaauaauuuucaa

SEQ ID NO: 711003 - RNA, 22 nt, Haemophilus influenzae Rd
cauaaagacgcuguuucuuuuc

SEQ ID NO: 711004 - RNA, 13 nt, Haemophilus influenzae Rd
cauaaaaauucca

SEQ ID NO: 711005 - RNA, 12 nt, Haemophilus influenzae Rd
cauaaaaaaauc

SEQ ID NO: 711006 - RNA, 15 nt, Haemophilus influenzae Rd
cauaaucgccaaaau

SEQ ID NO: 711007 - RNA, 15 nt, Haemophilus influenzae Rd
cauaacguauuuucu

SEQ ID NO: 711008 - RNA, 21 nt, Haemophilus influenzae Rd
cauaacguuuacgauacauag

SEQ ID NO: 711009 - RNA, 17 nt, Haemophilus influenzae Rd
cauaacgcuaucuuuug

SEQ ID NO: 711010 - RNA, 15 nt, Haemophilus influenzae Rd
cauaacggcaagcaa

SEQ ID NO: 711011 - RNA, 13 nt, Haemophilus influenzae Rd
cauaacuauaauu

SEQ ID NO: 711012 - RNA, 18 nt, Haemophilus influenzae Rd
cauaacuaucacuaauau

SEQ ID NO: 711013 - RNA, 23 nt, Haemophilus influenzae Rd
cauaacugaucggauuucuuuau

SEQ ID NO: 711014 - RNA, 12 nt, Haemophilus influenzae Rd
cauaccaauugc

SEQ ID NO: 711015 - RNA, 12 nt, Haemophilus influenzae Rd
cauaccccaaac

SEQ ID NO: 711016 - RNA, 14 nt, Haemophilus influenzae Rd
cauacaguaaaaau

SEQ ID NO: 711017 - RNA, 15 nt, Haemophilus influenzae Rd
cauacaguaaaaaua

SEQ ID NO: 711018 - RNA, 23 nt, Haemophilus influenzae Rd
cauacguaauacuuuugcuucac

SEQ ID NO: 711019 - RNA, 12 nt, Haemophilus influenzae Rd
cauacuaaauac

SEQ ID NO: 711020 - RNA, 22 nt, Haemophilus influenzae Rd
cauaccuaaaaaugccccagca

SEQ ID NO: 711021 - RNA, 23 nt, Haemophilus influenzae Rd
cauaccuaaaaaugccccagcaa

SEQ ID NO: 711022 - RNA, 22 nt, Haemophilus influenzae Rd
cauacggauauuaguaauauau

SEQ ID NO: 711023 - RNA, 23 nt, Haemophilus influenzae Rd
cauauaaccacguaauucuugac

SEQ ID NO: 711024 - RNA, 13 nt, Haemophilus influenzae Rd
cauauaacccaua

SEQ ID NO: 711025 - RNA, 16 nt, Haemophilus influenzae Rd
cauacuuuguugaaug

SEQ ID NO: 711026 - RNA, 18 nt, Haemophilus influenzae Rd
cauacuuuguugaaugcc

SEQ ID NO: 711027 - RNA, 20 nt, Haemophilus influenzae Rd
cauauaaaguggaugaccaa

SEQ ID NO: 711028 - RNA, 22 nt, Haemophilus influenzae Rd
cauagaaacaacgcguacuuuu

SEQ ID NO: 711029 - RNA, 13 nt, Haemophilus influenzae Rd
cauauaacaacaa

SEQ ID NO: 711030 - RNA, 20 nt, Haemophilus influenzae Rd
cauauagugaaaaaauaacc

SEQ ID NO: 711031 - RNA, 22 nt, Haemophilus influenzae Rd
cauauaucucuaaaaaauaacc

SEQ ID NO: 711032 - RNA, 17 nt, Haemophilus influenzae Rd
cauauauucaacuaaag

SEQ ID NO: 711033 - RNA, 23 nt, Haemophilus influenzae Rd
cauauauucaacuaaaggcacaa

SEQ ID NO: 711034 - RNA, 17 nt, Haemophilus influenzae Rd
cauaucaauuucauuug

SEQ ID NO: 711035 - RNA, 15 nt, Haemophilus influenzae Rd
cauaucaauuugcca

SEQ ID NO: 711036 - RNA, 22 nt, Haemophilus influenzae Rd
cauaucaauuugccauuuacag

SEQ ID NO: 711037 - RNA, 15 nt, Haemophilus influenzae Rd
cauaucacauuuuau

SEQ ID NO: 711038 - RNA, 21 nt, Haemophilus influenzae Rd
cauaucaaaaaguugaauuuu

SEQ ID NO: 711039 - RNA, 22 nt, Haemophilus influenzae Rd
cauauuaaugcggugcuuuaag

SEQ ID NO: 711040 - RNA, 16 nt, Haemophilus influenzae Rd
cauauuagaaucaaug

SEQ ID NO: 711041 - RNA, 13 nt, Haemophilus influenzae Rd
cauauuaguuagu

SEQ ID NO: 711042 - RNA, 19 nt, Haemophilus influenzae Rd
cauauuaguuaguuuuuua

SEQ ID NO: 711043 - RNA, 17 nt, Haemophilus influenzae Rd
cauauuaucaauaauua

SEQ ID NO: 711044 - RNA, 22 nt, Haemophilus influenzae Rd
cauauuacccguaccuuuaaau

SEQ ID NO: 711045 - RNA, 18 nt, Haemophilus influenzae Rd
cauaucucacaauaauuu

SEQ ID NO: 711046 - RNA, 13 nt, Haemophilus influenzae Rd
cauaucugaaaau

SEQ ID NO: 711047 - RNA, 14 nt, Haemophilus influenzae Rd
cauaucugcugcug

SEQ ID NO: 711048 - RNA, 15 nt, Haemophilus influenzae Rd
cauaucuaaagcauu

SEQ ID NO: 711049 - RNA, 14 nt, Haemophilus influenzae Rd
cauaugauuauuua

SEQ ID NO: 711050 - RNA, 19 nt, Haemophilus influenzae Rd
caucaacgguuuucauugc

SEQ ID NO: 711051 - RNA, 23 nt, Haemophilus influenzae Rd
caucaacuaauuuauuaaaaaua

SEQ ID NO: 711052 - RNA, 20 nt, Haemophilus influenzae Rd
caucaacugcaacaauuuca

SEQ ID NO: 711053 - RNA, 19 nt, Haemophilus influenzae Rd
caucaccgauaauaugcau

SEQ ID NO: 711054 - RNA, 15 nt, Haemophilus influenzae Rd
caucacccaucaaau

SEQ ID NO: 711055 - RNA, 22 nt, Haemophilus influenzae Rd
caucaaguguuacugcaacgcu

SEQ ID NO: 711056 - RNA, 15 nt, Haemophilus influenzae Rd
caucaauaaaaagcu

SEQ ID NO: 711057 - RNA, 17 nt, Haemophilus influenzae Rd
caucaaaaccauuuuuc

SEQ ID NO: 711058 - RNA, 14 nt, Haemophilus influenzae Rd
caucaaaauaaaua

SEQ ID NO: 711059 - RNA, 19 nt, Haemophilus influenzae Rd
caucaaaagaucauuuuuu

SEQ ID NO: 711060 - RNA, 22 nt, Haemophilus influenzae Rd
caucaaaagaucauuuuuuuaa

SEQ ID NO: 711061 - RNA, 12 nt, Haemophilus influenzae Rd
caucaaaauuga

SEQ ID NO: 711062 - RNA, 20 nt, Haemophilus influenzae Rd
caucaaaccugcuucaucca

SEQ ID NO: 711063 - RNA, 21 nt, Haemophilus influenzae Rd
caucaaaccugcuucauccac

SEQ ID NO: 711064 - RNA, 12 nt, Haemophilus influenzae Rd
cauauuuuaaau

SEQ ID NO: 711065 - RNA, 17 nt, Haemophilus influenzae Rd
cauauuuuaaauaauua

SEQ ID NO: 711066 - RNA, 11 nt, Haemophilus influenzae Rd
cauauuuucca

SEQ ID NO: 711067 - RNA, 19 nt, Haemophilus influenzae Rd
cauauuuucccaguaaaua

SEQ ID NO: 711068 - RNA, 14 nt, Haemophilus influenzae Rd
cauauuuucuaaaa

SEQ ID NO: 711069 - RNA, 17 nt, Haemophilus influenzae Rd
cauauuaucugcuggau

SEQ ID NO: 711070 - RNA, 14 nt, Haemophilus influenzae Rd
cauauuuuguucua

SEQ ID NO: 711071 - RNA, 18 nt, Haemophilus influenzae Rd
caucaugagguuugccau

SEQ ID NO: 711072 - RNA, 13 nt, Haemophilus influenzae Rd
caucaucugcugg

SEQ ID NO: 711073 - RNA, 21 nt, Haemophilus influenzae Rd
caucaucugcugguuuuagcg

SEQ ID NO: 711074 - RNA, 23 nt, Haemophilus influenzae Rd
caucaucuggcauaucugcugcu

SEQ ID NO: 711075 - RNA, 14 nt, Haemophilus influenzae Rd
caucauuggggaac

SEQ ID NO: 711076 - RNA, 12 nt, Haemophilus influenzae Rd
caucauuuuuau

SEQ ID NO: 711077 - RNA, 21 nt, Haemophilus influenzae Rd
caucauuuuagguucaauaau

SEQ ID NO: 711078 - RNA, 16 nt, Haemophilus influenzae Rd
caucaucagacauauc

SEQ ID NO: 711079 - RNA, 19 nt, Haemophilus influenzae Rd
caucaucccaaucuucguc

SEQ ID NO: 711080 - RNA, 23 nt, Haemophilus influenzae Rd
caucacgcauaauuuuacguagu

SEQ ID NO: 711081 - RNA, 15 nt, Haemophilus influenzae Rd
caucacgaacuucag

SEQ ID NO: 711082 - RNA, 11 nt, Haemophilus influenzae Rd
caucaccuuca

SEQ ID NO: 711083 - RNA, 19 nt, Haemophilus influenzae Rd
caucaccuucaacauaagu

SEQ ID NO: 711084 - RNA, 13 nt, Haemophilus influenzae Rd
caucaccugcuuu

SEQ ID NO: 711085 - RNA, 18 nt, Haemophilus influenzae Rd
caucagccgcuuuuugau

SEQ ID NO: 711086 - RNA, 18 nt, Haemophilus influenzae Rd
caucgcguuuauuuuuau

SEQ ID NO: 711087 - RNA, 16 nt, Haemophilus influenzae Rd
caucgcguuuuuucuu

SEQ ID NO: 711088 - RNA, 16 nt, Haemophilus influenzae Rd
caucgcgccaacgaaa

SEQ ID NO: 711089 - RNA, 16 nt, Haemophilus influenzae Rd
caucgcgcaaaauaau

SEQ ID NO: 711090 - RNA, 12 nt, Haemophilus influenzae Rd
caucgagaaaua

SEQ ID NO: 711091 - RNA, 19 nt, Haemophilus influenzae Rd
caucgaggccucuugcuuc

SEQ ID NO: 711092 - RNA, 17 nt, Haemophilus influenzae Rd
caucgcccaauuuggca

SEQ ID NO: 711093 - RNA, 17 nt, Haemophilus influenzae Rd
caucgaguuuuaucuuc

SEQ ID NO: 711094 - RNA, 20 nt, Haemophilus influenzae Rd
cauccgcuuguaauuucauu

SEQ ID NO: 711095 - RNA, 16 nt, Haemophilus influenzae Rd
cauccacuaaaccauu

SEQ ID NO: 711096 - RNA, 14 nt, Haemophilus influenzae Rd
cauccacuucaucc

SEQ ID NO: 711097 - RNA, 15 nt, Haemophilus influenzae Rd
cauccacuucaucca

SEQ ID NO: 711098 - RNA, 16 nt, Haemophilus influenzae Rd
cauccacuucauccau

SEQ ID NO: 711099 - RNA, 15 nt, Haemophilus influenzae Rd
caucuagcuuaacaa

SEQ ID NO: 711100 - RNA, 14 nt, Haemophilus influenzae Rd
caucuaguuuuaau

SEQ ID NO: 711101 - RNA, 17 nt, Haemophilus influenzae Rd
caucucuuguuuuucca

SEQ ID NO: 711102 - RNA, 20 nt, Haemophilus influenzae Rd
caucugaacguaagaucaga

SEQ ID NO: 711103 - RNA, 13 nt, Haemophilus influenzae Rd
caucugauuuugu

SEQ ID NO: 711104 - RNA, 13 nt, Haemophilus influenzae Rd
caucugaauuuaa

SEQ ID NO: 711105 - RNA, 16 nt, Haemophilus influenzae Rd
caucugaauuuaaacu

SEQ ID NO: 711106 - RNA, 14 nt, Haemophilus influenzae Rd
caucugguuuugug

SEQ ID NO: 711107 - RNA, 14 nt, Haemophilus influenzae Rd
caucuguaaaccau

SEQ ID NO: 711108 - RNA, 19 nt, Haemophilus influenzae Rd
caucuguaaaccauuccac

SEQ ID NO: 711109 - RNA, 13 nt, Haemophilus influenzae Rd
caucuguaaaccu

SEQ ID NO: 711110 - RNA, 19 nt, Haemophilus influenzae Rd
caucuguugugaaugcaau

SEQ ID NO: 711111 - RNA, 22 nt, Haemophilus influenzae Rd
caucuguugugaaugcaauauu

SEQ ID NO: 711112 - RNA, 20 nt, Haemophilus influenzae Rd
caucuggcauaucugcugcu

SEQ ID NO: 711113 - RNA, 12 nt, Haemophilus influenzae Rd
caucuucacaaa

SEQ ID NO: 711114 - RNA, 19 nt, Haemophilus influenzae Rd
caucuucagcauuuaaaau

SEQ ID NO: 711115 - RNA, 13 nt, Haemophilus influenzae Rd
caucuucaguacg

SEQ ID NO: 711116 - RNA, 13 nt, Haemophilus influenzae Rd
caucuucaucaau

SEQ ID NO: 711117 - RNA, 17 nt, Haemophilus influenzae Rd
caucuucaucugcauca

SEQ ID NO: 711118 - RNA, 13 nt, Haemophilus influenzae Rd
caucuucauuaaa

SEQ ID NO: 711119 - RNA, 20 nt, Haemophilus influenzae Rd
caucuuaaauuauagauaaa

SEQ ID NO: 711120 - RNA, 21 nt, Haemophilus influenzae Rd
caucuuauuugauuaaguaua

SEQ ID NO: 711121 - RNA, 14 nt, Haemophilus influenzae Rd
caucuuuaaacauc

SEQ ID NO: 711122 - RNA, 12 nt, Haemophilus influenzae Rd
caucuuuaauuc

SEQ ID NO: 711123 - RNA, 17 nt, Haemophilus influenzae Rd
caucuuuauaacauaau

SEQ ID NO: 711124 - RNA, 13 nt, Haemophilus influenzae Rd
caucuucuacggu

SEQ ID NO: 711125 - RNA, 17 nt, Haemophilus influenzae Rd
caucuucuauucucugu

SEQ ID NO: 711126 - RNA, 15 nt, Haemophilus influenzae Rd
caucuucuggguuca

SEQ ID NO: 711127 - RNA, 21 nt, Haemophilus influenzae Rd
caucuugccaaugccaaauuu

SEQ ID NO: 711128 - RNA, 15 nt, Haemophilus influenzae Rd
caugggauaaacauu

SEQ ID NO: 711129 - RNA, 16 nt, Haemophilus influenzae Rd
caugggauaaacauuu

SEQ ID NO: 711130 - RNA, 16 nt, Haemophilus influenzae Rd
caugggcgauaaaaau

SEQ ID NO: 711131 - RNA, 13 nt, Haemophilus influenzae Rd
cauggcuuuuucc

SEQ ID NO: 711132 - RNA, 16 nt, Haemophilus influenzae Rd
cauggcacaaaauaau

SEQ ID NO: 711133 - RNA, 15 nt, Haemophilus influenzae Rd
cauggaacguuuuuu

SEQ ID NO: 711134 - RNA, 21 nt, Haemophilus influenzae Rd
caugcaaaauauucuauuuau

SEQ ID NO: 711135 - RNA, 20 nt, Haemophilus influenzae Rd
caugauuuuccaaaauuucu

SEQ ID NO: 711136 - RNA, 18 nt, Haemophilus influenzae Rd
caucuuuuggguuaaaua

SEQ ID NO: 711137 - RNA, 15 nt, Haemophilus influenzae Rd
caugccuguucuaau

SEQ ID NO: 711138 - RNA, 15 nt, Haemophilus influenzae Rd
cauuaauuuuuucac

SEQ ID NO: 711139 - RNA, 17 nt, Haemophilus influenzae Rd
cauuaauuuuuucacaa

SEQ ID NO: 711140 - RNA, 23 nt, Haemophilus influenzae Rd
cauuaauggguaaucaauauuua

SEQ ID NO: 711141 - RNA, 20 nt, Haemophilus influenzae Rd
cauuaauuggcgcaacauca

SEQ ID NO: 711142 - RNA, 17 nt, Haemophilus influenzae Rd
cauuacaaguauaaaga

SEQ ID NO: 711143 - RNA, 19 nt, Haemophilus influenzae Rd
cauuaauuuuauuuuuugc

SEQ ID NO: 711144 - RNA, 18 nt, Haemophilus influenzae Rd
cauuacuuagauauauua

SEQ ID NO: 711145 - RNA, 22 nt, Haemophilus influenzae Rd
cauuacuuagauauauuauuua

SEQ ID NO: 711146 - RNA, 20 nt, Haemophilus influenzae Rd
cauuacuucuaaacuuaauu

SEQ ID NO: 711147 - RNA, 13 nt, Haemophilus influenzae Rd
cauuacauaauac

SEQ ID NO: 711148 - RNA, 22 nt, Haemophilus influenzae Rd
cauuaaggcuuuucuuuuauac

SEQ ID NO: 711149 - RNA, 17 nt, Haemophilus influenzae Rd
cauuaaacgaucuauuc

SEQ ID NO: 711150 - RNA, 17 nt, Haemophilus influenzae Rd
cauuaaccccauuacca

SEQ ID NO: 711151 - RNA, 23 nt, Haemophilus influenzae Rd
cauuaaucuuauacaacaaaaag

SEQ ID NO: 711152 - RNA, 15 nt, Haemophilus influenzae Rd
cauuaaugcauugau

SEQ ID NO: 711153 - RNA, 15 nt, Haemophilus influenzae Rd
cauuaauaucuuuaa

SEQ ID NO: 711154 - RNA, 19 nt, Haemophilus influenzae Rd
cauuaauaggaauaacaca

SEQ ID NO: 711155 - RNA, 15 nt, Haemophilus influenzae Rd
cauuaaucaccauau

SEQ ID NO: 711156 - RNA, 19 nt, Haemophilus influenzae Rd
cauuaauacacaaaaucca

SEQ ID NO: 711157 - RNA, 19 nt, Haemophilus influenzae Rd
cauuaauaacguguaaauu

SEQ ID NO: 711158 - RNA, 14 nt, Haemophilus influenzae Rd
cauuaauaaucuaa

SEQ ID NO: 711159 - RNA, 21 nt, Haemophilus influenzae Rd
cauuaauaaucuaauccaaau

SEQ ID NO: 711160 - RNA, 19 nt, Haemophilus influenzae Rd
cauuaaguuuuuagcaguu

SEQ ID NO: 711161 - RNA, 16 nt, Haemophilus influenzae Rd
cauuaagugcaucaac

SEQ ID NO: 711162 - RNA, 13 nt, Haemophilus influenzae Rd
caugugcagcccu

SEQ ID NO: 711163 - RNA, 20 nt, Haemophilus influenzae Rd
cauguuuacuuaaaucuuua

SEQ ID NO: 711164 - RNA, 18 nt, Haemophilus influenzae Rd
cauuaaacucacuaaauu

SEQ ID NO: 711165 - RNA, 13 nt, Haemophilus influenzae Rd
cauuaaaauucac

SEQ ID NO: 711166 - RNA, 12 nt, Haemophilus influenzae Rd
cauuaaauaaaa

SEQ ID NO: 711167 - RNA, 13 nt, Haemophilus influenzae Rd
cauuaaauaaaaa

SEQ ID NO: 711168 - RNA, 19 nt, Haemophilus influenzae Rd
cauuaaauaacucaagcaa

SEQ ID NO: 711169 - RNA, 19 nt, Haemophilus influenzae Rd
cauuaaauaccgcuugaau

SEQ ID NO: 711170 - RNA, 10 nt, Haemophilus influenzae Rd
cauuaaauau

SEQ ID NO: 711171 - RNA, 21 nt, Haemophilus influenzae Rd
cauuaaaagucuguuuaaaaa

SEQ ID NO: 711172 - RNA, 13 nt, Haemophilus influenzae Rd
cauuaaaaggacu

SEQ ID NO: 711173 - RNA, 19 nt, Haemophilus influenzae Rd
cauuaaaaauuuaaaagca

SEQ ID NO: 711174 - RNA, 15 nt, Haemophilus influenzae Rd
cauuaaaaaauaauu

SEQ ID NO: 711175 - RNA, 12 nt, Haemophilus influenzae Rd
cauuaaaaaaua

SEQ ID NO: 711176 - RNA, 18 nt, Haemophilus influenzae Rd
cauuuaagccuacuugac

SEQ ID NO: 711177 - RNA, 13 nt, Haemophilus influenzae Rd
cauuuaauacuga

SEQ ID NO: 711178 - RNA, 15 nt, Haemophilus influenzae Rd
cauuuaaauaaaaua

SEQ ID NO: 711179 - RNA, 17 nt, Haemophilus influenzae Rd
cauuuaaauaaaauaac

SEQ ID NO: 711180 - RNA, 22 nt, Haemophilus influenzae Rd
cauuuaaauaaaauaacaaaaa

SEQ ID NO: 711181 - RNA, 11 nt, Haemophilus influenzae Rd
cauuuaaauau

SEQ ID NO: 711182 - RNA, 22 nt, Haemophilus influenzae Rd
cauuuaacaauggcaacaaaua

SEQ ID NO: 711183 - RNA, 21 nt, Haemophilus influenzae Rd
cauuuaaccguaauuucaaau

SEQ ID NO: 711184 - RNA, 22 nt, Haemophilus influenzae Rd
cauuuaaccguaauuucaaauc

SEQ ID NO: 711185 - RNA, 23 nt, Haemophilus influenzae Rd
cauuuaacuaacugcucuugcgc

SEQ ID NO: 711186 - RNA, 19 nt, Haemophilus influenzae Rd
cauuuaacuuaaucuccaa

SEQ ID NO: 711187 - RNA, 17 nt, Haemophilus influenzae Rd
cauuuaacuugcaauca

SEQ ID NO: 711188 - RNA, 22 nt, Haemophilus influenzae Rd
cauuuaauccugucaucuguaa

SEQ ID NO: 711189 - RNA, 23 nt, Haemophilus influenzae Rd
cauuuaauccugucaucuguaaa

SEQ ID NO: 711190 - RNA, 21 nt, Haemophilus influenzae Rd
cauuuacagguuugacauuca

SEQ ID NO: 711191 - RNA, 16 nt, Haemophilus influenzae Rd
cauuucuuauguuuug

SEQ ID NO: 711192 - RNA, 20 nt, Haemophilus influenzae Rd
cauuugaagauuaaauguau

SEQ ID NO: 711193 - RNA, 15 nt, Haemophilus influenzae Rd
cauuugaauuaauaa

SEQ ID NO: 711194 - RNA, 14 nt, Haemophilus influenzae Rd
cauuucuucugaua

SEQ ID NO: 711195 - RNA, 12 nt, Haemophilus influenzae Rd
cauuugauucac

SEQ ID NO: 711196 - RNA, 18 nt, Haemophilus influenzae Rd
cauuugagaugaaaaaaa

SEQ ID NO: 711197 - RNA, 19 nt, Haemophilus influenzae Rd
cauuugaauuuuacuucuu

SEQ ID NO: 711198 - RNA, 17 nt, Haemophilus influenzae Rd
cauuugacgauuaauac

SEQ ID NO: 711199 - RNA, 22 nt, Haemophilus influenzae Rd
cauuuguuggcggaauuaugua

SEQ ID NO: 711200 - RNA, 23 nt, Haemophilus influenzae Rd
cauuuguuaagcucacuugcaua

SEQ ID NO: 711201 - RNA, 21 nt, Haemophilus influenzae Rd
cauuuguuagaaauacauuau

SEQ ID NO: 711202 - RNA, 20 nt, Haemophilus influenzae Rd
cauuuguuuuccguauuuuc

SEQ ID NO: 711203 - RNA, 22 nt, Haemophilus influenzae Rd
cauuuuaaaaggcuuucuaaca

SEQ ID NO: 711204 - RNA, 13 nt, Haemophilus influenzae Rd
cauuugcacccgc

SEQ ID NO: 711205 - RNA, 19 nt, Haemophilus influenzae Rd
cauuugcacccgcuuuaau

SEQ ID NO: 711206 - RNA, 16 nt, Haemophilus influenzae Rd
cauuugcauaaagcau

SEQ ID NO: 711207 - RNA, 14 nt, Haemophilus influenzae Rd
cauuugcauauuuu

SEQ ID NO: 711208 - RNA, 12 nt, Haemophilus influenzae Rd
cauuugcaucau

SEQ ID NO: 711209 - RNA, 15 nt, Haemophilus influenzae Rd
cauuugcaucauuua

SEQ ID NO: 711210 - RNA, 14 nt, Haemophilus influenzae Rd
cauuugcucaauac

SEQ ID NO: 711211 - RNA, 15 nt, Haemophilus influenzae Rd
cauuugcgccaauaa

SEQ ID NO: 711212 - RNA, 16 nt, Haemophilus influenzae Rd
cauuugcgccaauaau

SEQ ID NO: 711213 - RNA, 19 nt, Haemophilus influenzae Rd
cauuugguuagaucagaaa

SEQ ID NO: 711214 - RNA, 14 nt, Haemophilus influenzae Rd
cauuuggcaaaaua

SEQ ID NO: 711215 - RNA, 17 nt, Haemophilus influenzae Rd
cauuugcguauuaugga

SEQ ID NO: 711216 - RNA, 23 nt, Haemophilus influenzae Rd
cauuugcuucgccuucagcaauu

SEQ ID NO: 711217 - RNA, 20 nt, Haemophilus influenzae Rd
cauuugcuucuaauuuuaaa

SEQ ID NO: 711218 - RNA, 18 nt, Haemophilus influenzae Rd
cauuugcuuuaacccauu

SEQ ID NO: 711219 - RNA, 15 nt, Haemophilus influenzae Rd
cauuuggaaauguuu

SEQ ID NO: 711220 - RNA, 15 nt, Haemophilus influenzae Rd
cauuuuaucacaagu

SEQ ID NO: 711221 - RNA, 16 nt, Haemophilus influenzae Rd
cauuuuaaauuauuuu

SEQ ID NO: 711222 - RNA, 16 nt, Haemophilus influenzae Rd
cauuuucucugcgauu

SEQ ID NO: 711223 - RNA, 18 nt, Haemophilus influenzae Rd
cauuuucugcucuucauc

SEQ ID NO: 711224 - RNA, 12 nt, Haemophilus influenzae Rd
cauuuucuucca

SEQ ID NO: 711225 - RNA, 15 nt, Haemophilus influenzae Rd
cauuuucuugaacug

SEQ ID NO: 711226 - RNA, 15 nt, Haemophilus influenzae Rd
cauuuucgcaucaau

SEQ ID NO: 711227 - RNA, 16 nt, Haemophilus influenzae Rd
cauuuucacugauaua

SEQ ID NO: 711228 - RNA, 20 nt, Haemophilus influenzae Rd
cauuuucaccaauuuaucug

SEQ ID NO: 711229 - RNA, 15 nt, Haemophilus influenzae Rd
cauuuucaagccacc

SEQ ID NO: 711230 - RNA, 22 nt, Haemophilus influenzae Rd
cauuuucaaauuguccuuugcc

SEQ ID NO: 711231 - RNA, 19 nt, Haemophilus influenzae Rd
cauuuuccauuggugaaau

SEQ ID NO: 711232 - RNA, 14 nt, Haemophilus influenzae Rd
cauuuuuauuagua

SEQ ID NO: 711233 - RNA, 16 nt, Haemophilus influenzae Rd
cauuuuuaauuuuuag

SEQ ID NO: 711234 - RNA, 18 nt, Haemophilus influenzae Rd
cauuuuuaauuuuuagaa

SEQ ID NO: 711235 - RNA, 14 nt, Haemophilus influenzae Rd
cauuuuucauuuuc

SEQ ID NO: 711236 - RNA, 23 nt, Haemophilus influenzae Rd
cauuuuucagcaagcauuuugaa

SEQ ID NO: 711237 - RNA, 23 nt, Haemophilus influenzae Rd
cauuuuucauaaugcgaucuuuu

SEQ ID NO: 711238 - RNA, 18 nt, Haemophilus influenzae Rd
cauuuuuuauaaugucau

SEQ ID NO: 711239 - RNA, 15 nt, Haemophilus influenzae Rd
cauuuuuuauuaaaa

SEQ ID NO: 711240 - RNA, 17 nt, Haemophilus influenzae Rd
cauuuuuuauuaaaaaa

SEQ ID NO: 711241 - RNA, 15 nt, Haemophilus influenzae Rd
cauuuuuuauuuuuu

SEQ ID NO: 711242 - RNA, 21 nt, Haemophilus influenzae Rd
cauuuuuuauuuuuucuaaaa

SEQ ID NO: 711243 - RNA, 18 nt, Haemophilus influenzae Rd
cauuuuuuauaaauggcu

SEQ ID NO: 711244 - RNA, 17 nt, Haemophilus influenzae Rd
cauuuuuguuucaguuu

SEQ ID NO: 711245 - RNA, 12 nt, Haemophilus influenzae Rd
cauuuuggaaug

SEQ ID NO: 711246 - RNA, 21 nt, Haemophilus influenzae Rd
cauuuuggaaugguugcaaag

SEQ ID NO: 711247 - RNA, 14 nt, Haemophilus influenzae Rd
cauuuucuuuuuca

SEQ ID NO: 711248 - RNA, 16 nt, Haemophilus influenzae Rd
cauuuugaacaagguu

SEQ ID NO: 711249 - RNA, 20 nt, Haemophilus influenzae Rd
cauuuugaaugguuguucug

SEQ ID NO: 711250 - RNA, 21 nt, Haemophilus influenzae Rd
cauuuugauggaaggcuaccu

SEQ ID NO: 711251 - RNA, 21 nt, Haemophilus influenzae Rd
cauuuuuaauggauuccauca

SEQ ID NO: 711252 - RNA, 11 nt, Haemophilus influenzae Rd
cauuuuuaaau

SEQ ID NO: 711253 - RNA, 13 nt, Haemophilus influenzae Rd
cauuuuuaaaugg

SEQ ID NO: 711254 - RNA, 19 nt, Haemophilus influenzae Rd
cauuuugucagauuuauaa

SEQ ID NO: 711255 - RNA, 19 nt, Haemophilus influenzae Rd
cauugcuuaacauuaauaa

SEQ ID NO: 711256 - RNA, 20 nt, Haemophilus influenzae Rd
cauugccuaaauacaucacu

SEQ ID NO: 711257 - RNA, 22 nt, Haemophilus influenzae Rd
cauugauugcgagucaaauuuu

SEQ ID NO: 711258 - RNA, 19 nt, Haemophilus influenzae Rd
cauugauugcuaaauaaau

SEQ ID NO: 711259 - RNA, 17 nt, Haemophilus influenzae Rd
cauugauugcuuuaacu

SEQ ID NO: 711260 - RNA, 19 nt, Haemophilus influenzae Rd
cauugcaauuucagcugcg

SEQ ID NO: 711261 - RNA, 15 nt, Haemophilus influenzae Rd
cauugcaagugcagu

SEQ ID NO: 711262 - RNA, 22 nt, Haemophilus influenzae Rd
cauugauuuguuacuaaaauaa

SEQ ID NO: 711263 - RNA, 23 nt, Haemophilus influenzae Rd
cauugauuuguuacuaaaauaau

SEQ ID NO: 711264 - RNA, 16 nt, Haemophilus influenzae Rd
cauuguuaccuaauuc

SEQ ID NO: 711265 - RNA, 20 nt, Haemophilus influenzae Rd
cauuguuaaauaaauccuua

SEQ ID NO: 711266 - RNA, 13 nt, Haemophilus influenzae Rd
cauuguuaaaugu

SEQ ID NO: 711267 - RNA, 15 nt, Haemophilus influenzae Rd
cauuguuaaauguua

SEQ ID NO: 711268 - RNA, 14 nt, Haemophilus influenzae Rd
cauuuaaacaccaa

SEQ ID NO: 711269 - RNA, 16 nt, Haemophilus influenzae Rd
cauuuaaacaccaauu

SEQ ID NO: 711270 - RNA, 14 nt, Haemophilus influenzae Rd
cauuuaaaacaaaa

SEQ ID NO: 711271 - RNA, 15 nt, Haemophilus influenzae Rd
cauuuaaaauauaua

SEQ ID NO: 711272 - RNA, 19 nt, Haemophilus influenzae Rd
cauuguuucaaucacuuua

SEQ ID NO: 711273 - RNA, 20 nt, Haemophilus influenzae Rd
cauuguuucaaucacuuuau

SEQ ID NO: 711274 - RNA, 22 nt, Haemophilus influenzae Rd
cauuguuucaaucacuuuaucu

SEQ ID NO: 711275 - RNA, 17 nt, Haemophilus influenzae Rd
cauuguuugauccuuua

SEQ ID NO: 711276 - RNA, 18 nt, Haemophilus influenzae Rd
cauugucuuuuacguuau

SEQ ID NO: 711277 - RNA, 20 nt, Haemophilus influenzae Rd
cauugugacggugaauuuau

SEQ ID NO: 711278 - RNA, 21 nt, Haemophilus influenzae Rd
cauugugaucggacuuuuuuc

SEQ ID NO: 711279 - RNA, 19 nt, Haemophilus influenzae Rd
cauugugauguucuaaauc

SEQ ID NO: 711280 - RNA, 13 nt, Haemophilus influenzae Rd
cauugugcaauua

SEQ ID NO: 711281 - RNA, 20 nt, Haemophilus influenzae Rd
cauugugccaaauucaguau

SEQ ID NO: 711282 - RNA, 21 nt, Haemophilus influenzae Rd
cauuguggaaacgugcaauua

SEQ ID NO: 711283 - RNA, 18 nt, Haemophilus influenzae Rd
cauugugggcuuuaagcu

SEQ ID NO: 711284 - RNA, 14 nt, Haemophilus influenzae Rd
cauuggaaugcuaa

SEQ ID NO: 711285 - RNA, 14 nt, Haemophilus influenzae Rd
cauuggaaaaugcu

SEQ ID NO: 711286 - RNA, 16 nt, Haemophilus influenzae Rd
cauuauccaacauuaa

SEQ ID NO: 711287 - RNA, 19 nt, Haemophilus influenzae Rd
cauuauccaacauuaauaa

SEQ ID NO: 711288 - RNA, 18 nt, Haemophilus influenzae Rd
cauuaggaauaucuuuga

SEQ ID NO: 711289 - RNA, 18 nt, Haemophilus influenzae Rd
cauuaugccuacuuuuua

SEQ ID NO: 711290 - RNA, 17 nt, Haemophilus influenzae Rd
cauucguauaaauauuu

SEQ ID NO: 711291 - RNA, 21 nt, Haemophilus influenzae Rd
cauucucuaacgcauucaaau

SEQ ID NO: 711292 - RNA, 21 nt, Haemophilus influenzae Rd
cauucugaaugaucgaguaaa

SEQ ID NO: 711293 - RNA, 15 nt, Haemophilus influenzae Rd
cauucuaauggcuuc

SEQ ID NO: 711294 - RNA, 15 nt, Haemophilus influenzae Rd
cauucguucccaaau

SEQ ID NO: 711295 - RNA, 15 nt, Haemophilus influenzae Rd
cauugaguuuuucug

SEQ ID NO: 711296 - RNA, 14 nt, Haemophilus influenzae Rd
cauugacuucugua

SEQ ID NO: 711297 - RNA, 13 nt, Haemophilus influenzae Rd
cauugagcauuuu

SEQ ID NO: 711298 - RNA, 13 nt, Haemophilus influenzae Rd
cauucuuaaauca

SEQ ID NO: 711299 - RNA, 21 nt, Haemophilus influenzae Rd
cauugaauccaacguauuuau

SEQ ID NO: 711300 - RNA, 14 nt, Haemophilus influenzae Rd
cauugaauuaaaaa

SEQ ID NO: 711301 - RNA, 15 nt, Haemophilus influenzae Rd
cauugaauuuuucua

SEQ ID NO: 711302 - RNA, 20 nt, Haemophilus influenzae Rd
cauugaauuuuucuaaggua

SEQ ID NO: 711303 - RNA, 19 nt, Haemophilus influenzae Rd
cagcacuacugcgugacaa

SEQ ID NO: 711304 - RNA, 15 nt, Haemophilus influenzae Rd
cagcacuaaaagcau

SEQ ID NO: 711305 - RNA, 14 nt, Haemophilus influenzae Rd
cagcagaaaauaac

SEQ ID NO: 711306 - RNA, 18 nt, Haemophilus influenzae Rd
cagcacuugcaucuaaaa

SEQ ID NO: 711307 - RNA, 14 nt, Haemophilus influenzae Rd
cagcagcaccuaaa

SEQ ID NO: 711308 - RNA, 17 nt, Haemophilus influenzae Rd
cagcagggauuuuaagu

SEQ ID NO: 711309 - RNA, 13 nt, Haemophilus influenzae Rd
cagcauaaagaga

SEQ ID NO: 711310 - RNA, 20 nt, Haemophilus influenzae Rd
cagcauaaagagaauauuuc

SEQ ID NO: 711311 - RNA, 15 nt, Haemophilus influenzae Rd
cagcauaaauaaaua

SEQ ID NO: 711312 - RNA, 19 nt, Haemophilus influenzae Rd
cagcagcuucuucuuccug

SEQ ID NO: 711313 - RNA, 15 nt, Haemophilus influenzae Rd
cagcauggaagaaag

SEQ ID NO: 711314 - RNA, 21 nt, Haemophilus influenzae Rd
cagcauauugaaauuggaauc

SEQ ID NO: 711315 - RNA, 13 nt, Haemophilus influenzae Rd
cagcauuuaaaga

SEQ ID NO: 711316 - RNA, 14 nt, Haemophilus influenzae Rd
cagccagguuuugu

SEQ ID NO: 711317 - RNA, 15 nt, Haemophilus influenzae Rd
cagccaucgcugaaa

SEQ ID NO: 711318 - RNA, 19 nt, Haemophilus influenzae Rd
cagccauccccaaaacagu

SEQ ID NO: 711319 - RNA, 12 nt, Haemophilus influenzae Rd
cagcccaaauaa

SEQ ID NO: 711320 - RNA, 13 nt, Haemophilus influenzae Rd
cagcccaaauaaa

SEQ ID NO: 711321 - RNA, 15 nt, Haemophilus influenzae Rd
cagcccaaauaaaga

SEQ ID NO: 711322 - RNA, 20 nt, Haemophilus influenzae Rd
cagccugaaaaagcuaaaaa

SEQ ID NO: 711323 - RNA, 15 nt, Haemophilus influenzae Rd
cagccuuguucugca

SEQ ID NO: 711324 - RNA, 21 nt, Haemophilus influenzae Rd
cagcgagcagugguaaauuuu

SEQ ID NO: 711325 - RNA, 15 nt, Haemophilus influenzae Rd
cagcgaccaccaaug

SEQ ID NO: 711326 - RNA, 16 nt, Haemophilus influenzae Rd
cagcgaacauuuuugg

SEQ ID NO: 711327 - RNA, 16 nt, Haemophilus influenzae Rd
cagcgcaccacacaau

SEQ ID NO: 711328 - RNA, 16 nt, Haemophilus influenzae Rd
cacugccacugcgccc

SEQ ID NO: 711329 - RNA, 22 nt, Haemophilus influenzae Rd
cacugcauuuucuuuuucaaga

SEQ ID NO: 711330 - RNA, 13 nt, Haemophilus influenzae Rd
caaugucuuuuuc

SEQ ID NO: 711331 - RNA, 20 nt, Haemophilus influenzae Rd
caauguuauugccuaauaaa

SEQ ID NO: 711332 - RNA, 14 nt, Haemophilus influenzae Rd
caauguuccaccac

SEQ ID NO: 711333 - RNA, 17 nt, Haemophilus influenzae Rd
caauguuaaguucauca

SEQ ID NO: 711334 - RNA, 18 nt, Haemophilus influenzae Rd
caauguuaaguucaucau

SEQ ID NO: 711335 - RNA, 20 nt, Haemophilus influenzae Rd
caauguucgauuuuacuuuu

SEQ ID NO: 711336 - RNA, 13 nt, Haemophilus influenzae Rd
caauguugcaaua

SEQ ID NO: 711337 - RNA, 17 nt, Haemophilus influenzae Rd
cacugauuuuuuuauaa

SEQ ID NO: 711338 - RNA, 13 nt, Haemophilus influenzae Rd
cacugauuucacg

SEQ ID NO: 711339 - RNA, 14 nt, Haemophilus influenzae Rd
cacugauuauauug

SEQ ID NO: 711340 - RNA, 20 nt, Haemophilus influenzae Rd
caauguuuuaaguucaacac

SEQ ID NO: 711341 - RNA, 17 nt, Haemophilus influenzae Rd
cacuuaauguuaauaau

SEQ ID NO: 711342 - RNA, 18 nt, Haemophilus influenzae Rd
cacuuaauguuaauaauu

SEQ ID NO: 711343 - RNA, 21 nt, Haemophilus influenzae Rd
cacuuacgccagcuaaagaaa

SEQ ID NO: 711344 - RNA, 19 nt, Haemophilus influenzae Rd
cacuuaacgaaccaucagc

SEQ ID NO: 711345 - RNA, 22 nt, Haemophilus influenzae Rd
cacuuaaauuacgaccuuuacu

SEQ ID NO: 711346 - RNA, 14 nt, Haemophilus influenzae Rd
cacuuaaauaguua

SEQ ID NO: 711347 - RNA, 22 nt, Haemophilus influenzae Rd
cacuguugugaaguuuuuuaag

SEQ ID NO: 711348 - RNA, 14 nt, Haemophilus influenzae Rd
cacuguuauauaaa

SEQ ID NO: 711349 - RNA, 18 nt, Haemophilus influenzae Rd
cacugugcauuaaaucaa

SEQ ID NO: 711350 - RNA, 18 nt, Haemophilus influenzae Rd
cacugugccaacuucuac

SEQ ID NO: 711351 - RNA, 13 nt, Haemophilus influenzae Rd
cacuguaaauaau

SEQ ID NO: 711352 - RNA, 23 nt, Haemophilus influenzae Rd
cacuucauaaauccaauccaacu

SEQ ID NO: 711353 - RNA, 15 nt, Haemophilus influenzae Rd
cacuucagaauucau

SEQ ID NO: 711354 - RNA, 11 nt, Haemophilus influenzae Rd
cacuucauaaa

SEQ ID NO: 711355 - RNA, 18 nt, Haemophilus influenzae Rd
cacuucaauuucaccgcc

SEQ ID NO: 711356 - RNA, 22 nt, Haemophilus influenzae Rd
cacuucacacaccaacacgcca

SEQ ID NO: 711357 - RNA, 15 nt, Haemophilus influenzae Rd
cacuuaucuuaaaaa

SEQ ID NO: 711358 - RNA, 20 nt, Haemophilus influenzae Rd
cacuucgccacguaacgaau

SEQ ID NO: 711359 - RNA, 20 nt, Haemophilus influenzae Rd
cacuucugcauaacuuaaau

SEQ ID NO: 711360 - RNA, 23 nt, Haemophilus influenzae Rd
cacuucugccagauguuggaaau

SEQ ID NO: 711361 - RNA, 14 nt, Haemophilus influenzae Rd
cacuucuucuuuaa

SEQ ID NO: 711362 - RNA, 16 nt, Haemophilus influenzae Rd
cacuucuucaaagauu

SEQ ID NO: 711363 - RNA, 20 nt, Haemophilus influenzae Rd
cacuuuuaccuuuaagcauu

SEQ ID NO: 711364 - RNA, 13 nt, Haemophilus influenzae Rd
cacuuuuauauuu

SEQ ID NO: 711365 - RNA, 22 nt, Haemophilus influenzae Rd
cacuuuuaucuauaaaaagaac

SEQ ID NO: 711366 - RNA, 13 nt, Haemophilus influenzae Rd
cacuuugauuuug

SEQ ID NO: 711367 - RNA, 13 nt, Haemophilus influenzae Rd
cacuuugcacuuu

SEQ ID NO: 711368 - RNA, 22 nt, Haemophilus influenzae Rd
cacuuucuuauuggacugcaua

SEQ ID NO: 711369 - RNA, 23 nt, Haemophilus influenzae Rd
cacuuuuuguuuguaauaaauuu

SEQ ID NO: 711370 - RNA, 19 nt, Haemophilus influenzae Rd
cacuuuuuauuuuuccuuu

SEQ ID NO: 711371 - RNA, 17 nt, Haemophilus influenzae Rd
cacuuuuuuguuuucag

SEQ ID NO: 711372 - RNA, 13 nt, Haemophilus influenzae Rd
cacuuuuuuucuu

SEQ ID NO: 711373 - RNA, 14 nt, Haemophilus influenzae Rd
cacuuucacauaaa

SEQ ID NO: 711374 - RNA, 15 nt, Haemophilus influenzae Rd
cacuuuccaucauug

SEQ ID NO: 711375 - RNA, 14 nt, Haemophilus influenzae Rd
cacuuuaaaaauaa

SEQ ID NO: 711376 - RNA, 12 nt, Haemophilus influenzae Rd
cacuuguugauu

SEQ ID NO: 711377 - RNA, 14 nt, Haemophilus influenzae Rd
cacuuguuuuuagu

SEQ ID NO: 711378 - RNA, 15 nt, Haemophilus influenzae Rd
cacuuguuuuuucaa

SEQ ID NO: 711379 - RNA, 20 nt, Haemophilus influenzae Rd
cacuuuaaagaaauaaauuu

SEQ ID NO: 711380 - RNA, 22 nt, Haemophilus influenzae Rd
cacuuuaaauauuuaaaaagaa

SEQ ID NO: 711381 - RNA, 16 nt, Haemophilus influenzae Rd
cacuuuaaauuuuccu

SEQ ID NO: 711382 - RNA, 22 nt, Haemophilus influenzae Rd
cacuuuaaucgaaaucacaccu

SEQ ID NO: 711383 - RNA, 13 nt, Haemophilus influenzae Rd
cacuuuagaaaau

SEQ ID NO: 711384 - RNA, 18 nt, Haemophilus influenzae Rd
cacuuuaucuagacaaaa

SEQ ID NO: 711385 - RNA, 17 nt, Haemophilus influenzae Rd
cacuugcauauccgcug

SEQ ID NO: 711386 - RNA, 23 nt, Haemophilus influenzae Rd
cacuugcauauccgcugcaaauu

SEQ ID NO: 711387 - RNA, 22 nt, Haemophilus influenzae Rd
cacuugcaucuaaaaauaauuu

SEQ ID NO: 711388 - RNA, 21 nt, Haemophilus influenzae Rd
cacuuggcgaaaaucaucaua

SEQ ID NO: 711389 - RNA, 20 nt, Haemophilus influenzae Rd
cacuuggcgugguucaaaac

SEQ ID NO: 711390 - RNA, 21 nt, Haemophilus influenzae Rd
cacuugggcugcaugaagaac

SEQ ID NO: 711391 - RNA, 20 nt, Haemophilus influenzae Rd
cacuugugcaucaaagcguu

SEQ ID NO: 711392 - RNA, 18 nt, Haemophilus influenzae Rd
cagaacaagcauuuuuca

SEQ ID NO: 711393 - RNA, 21 nt, Haemophilus influenzae Rd
cagaaauuggcuuguugcugu

SEQ ID NO: 711394 - RNA, 11 nt, Haemophilus influenzae Rd
cagaacaaaau

SEQ ID NO: 711395 - RNA, 18 nt, Haemophilus influenzae Rd
cagaaaugaccuucacuu

SEQ ID NO: 711396 - RNA, 22 nt, Haemophilus influenzae Rd
cagaaauaccgauaauauguuu

SEQ ID NO: 711397 - RNA, 23 nt, Haemophilus influenzae Rd
cagaaauauguuuuaccaccgcu

SEQ ID NO: 711398 - RNA, 12 nt, Haemophilus influenzae Rd
cagaaauacuuu

SEQ ID NO: 711399 - RNA, 14 nt, Haemophilus influenzae Rd
cagaaauauugucu

SEQ ID NO: 711400 - RNA, 19 nt, Haemophilus influenzae Rd
cagaaagcagguuuuucuu

SEQ ID NO: 711401 - RNA, 16 nt, Haemophilus influenzae Rd
cagaaagacuaauagc

SEQ ID NO: 711402 - RNA, 12 nt, Haemophilus influenzae Rd
cagaaaauugca

SEQ ID NO: 711403 - RNA, 14 nt, Haemophilus influenzae Rd
cagaaccuaaugca

SEQ ID NO: 711404 - RNA, 22 nt, Haemophilus influenzae Rd
cagaacauugugacauuggauu

SEQ ID NO: 711405 - RNA, 20 nt, Haemophilus influenzae Rd
cagaaccugucgcaaugaag

SEQ ID NO: 711406 - RNA, 19 nt, Haemophilus influenzae Rd
cagaacguugaucauugaa

SEQ ID NO: 711407 - RNA, 20 nt, Haemophilus influenzae Rd
cagaacguugaucauugaag

SEQ ID NO: 711408 - RNA, 19 nt, Haemophilus influenzae Rd
cagaagaaguaaaaagaaa

SEQ ID NO: 711409 - RNA, 15 nt, Haemophilus influenzae Rd
cagaaguaaaccgug

SEQ ID NO: 711410 - RNA, 16 nt, Haemophilus influenzae Rd
cagaaguuguuuuucu

SEQ ID NO: 711411 - RNA, 17 nt, Haemophilus influenzae Rd
cagaaguuguuuuucuu

SEQ ID NO: 711412 - RNA, 18 nt, Haemophilus influenzae Rd
cagaaguuguuuuucuuc

SEQ ID NO: 711413 - RNA, 21 nt, Haemophilus influenzae Rd
cagaagugcguucauauuuga

SEQ ID NO: 711414 - RNA, 18 nt, Haemophilus influenzae Rd
cagaaguuaaaacuugaa

SEQ ID NO: 711415 - RNA, 15 nt, Haemophilus influenzae Rd
cagaaugaaucguuu

SEQ ID NO: 711416 - RNA, 20 nt, Haemophilus influenzae Rd
cagaaugaaucguuuguucu

SEQ ID NO: 711417 - RNA, 17 nt, Haemophilus influenzae Rd
cagaaucauuuucacca

SEQ ID NO: 711418 - RNA, 14 nt, Haemophilus influenzae Rd
cagaauaccacucc

SEQ ID NO: 711419 - RNA, 18 nt, Haemophilus influenzae Rd
cagaauaauuaacaaaua

SEQ ID NO: 711420 - RNA, 15 nt, Haemophilus influenzae Rd
cagaauuucaucugu

SEQ ID NO: 711421 - RNA, 22 nt, Haemophilus influenzae Rd
cagaauuucaucuguuggaaug

SEQ ID NO: 711422 - RNA, 17 nt, Haemophilus influenzae Rd
cagaauuuacgaaaacu

SEQ ID NO: 711423 - RNA, 15 nt, Haemophilus influenzae Rd
cagaauuuggaucuu

SEQ ID NO: 711424 - RNA, 18 nt, Haemophilus influenzae Rd
cagaauuucgucaaaaau

SEQ ID NO: 711425 - RNA, 21 nt, Haemophilus influenzae Rd
cagacaguagcauucccacgg

SEQ ID NO: 711426 - RNA, 18 nt, Haemophilus influenzae Rd
cagagauuuagauaauaa

SEQ ID NO: 711427 - RNA, 20 nt, Haemophilus influenzae Rd
cagagcaccaaauuaaaaau

SEQ ID NO: 711428 - RNA, 15 nt, Haemophilus influenzae Rd
cagagccaaauacaa

SEQ ID NO: 711429 - RNA, 15 nt, Haemophilus influenzae Rd
cagacuugaacuggc

SEQ ID NO: 711430 - RNA, 14 nt, Haemophilus influenzae Rd
cagagaaaaaaaua

SEQ ID NO: 711431 - RNA, 15 nt, Haemophilus influenzae Rd
cagagaaaaaaauag

SEQ ID NO: 711432 - RNA, 14 nt, Haemophilus influenzae Rd
cagagaagaaauac

SEQ ID NO: 711433 - RNA, 16 nt, Haemophilus influenzae Rd
cagagaagaaauacaa

SEQ ID NO: 711434 - RNA, 19 nt, Haemophilus influenzae Rd
cagacgcugcccaaauaac

SEQ ID NO: 711435 - RNA, 15 nt, Haemophilus influenzae Rd
cagacuagcaucaaa

SEQ ID NO: 711436 - RNA, 20 nt, Haemophilus influenzae Rd
cagacuagcaucaaaauaaa

SEQ ID NO: 711437 - RNA, 14 nt, Haemophilus influenzae Rd
cagacuagugaaau

SEQ ID NO: 711438 - RNA, 12 nt, Haemophilus influenzae Rd
cagacuauuucu

SEQ ID NO: 711439 - RNA, 19 nt, Haemophilus influenzae Rd
cagacuauuucuguauuuu

SEQ ID NO: 711440 - RNA, 14 nt, Haemophilus influenzae Rd
cagagccuuuuucu

SEQ ID NO: 711441 - RNA, 15 nt, Haemophilus influenzae Rd
cagauaaaaacugug

SEQ ID NO: 711442 - RNA, 19 nt, Haemophilus influenzae Rd
cagagugcgaucaccauaa

SEQ ID NO: 711443 - RNA, 15 nt, Haemophilus influenzae Rd
cagaggcugaacuuu

SEQ ID NO: 711444 - RNA, 17 nt, Haemophilus influenzae Rd
cagaggggauaaaauaa

SEQ ID NO: 711445 - RNA, 19 nt, Haemophilus influenzae Rd
cagaggggauaaaauaaac

SEQ ID NO: 711446 - RNA, 19 nt, Haemophilus influenzae Rd
cagauacauuuaaugauga

SEQ ID NO: 711447 - RNA, 18 nt, Haemophilus influenzae Rd
cagauuauguucauuuuc

SEQ ID NO: 711448 - RNA, 19 nt, Haemophilus influenzae Rd
cagauuaaaaauucaauga

SEQ ID NO: 711449 - RNA, 21 nt, Haemophilus influenzae Rd
cagcaaaaugcgugcugugau

SEQ ID NO: 711450 - RNA, 22 nt, Haemophilus influenzae Rd
cagcaaaagugcuuaaaugcaa

SEQ ID NO: 711451 - RNA, 12 nt, Haemophilus influenzae Rd
cagcaaaagaaa

SEQ ID NO: 711452 - RNA, 14 nt, Haemophilus influenzae Rd
cagcaaaagaaaua

SEQ ID NO: 711453 - RNA, 15 nt, Haemophilus influenzae Rd
cagcaaaagaaauaa

SEQ ID NO: 711454 - RNA, 22 nt, Haemophilus influenzae Rd
cagauuuuuuauuaauuauaaa

SEQ ID NO: 711455 - RNA, 20 nt, Haemophilus influenzae Rd
cagauuuuuacuucaucaaa

SEQ ID NO: 711456 - RNA, 12 nt, Haemophilus influenzae Rd
cagcaaaaaaau

SEQ ID NO: 711457 - RNA, 16 nt, Haemophilus influenzae Rd
cagcaaaaaaauuucu

SEQ ID NO: 711458 - RNA, 16 nt, Haemophilus influenzae Rd
cagauuuuauaucaag

SEQ ID NO: 711459 - RNA, 17 nt, Haemophilus influenzae Rd
cagauuuuuaaaucaau

SEQ ID NO: 711460 - RNA, 23 nt, Haemophilus influenzae Rd
cagauuuuuaaaucaauuaacua

SEQ ID NO: 711461 - RNA, 21 nt, Haemophilus influenzae Rd
cagauuuugguuguuuaaaga

SEQ ID NO: 711462 - RNA, 21 nt, Haemophilus influenzae Rd
cagauuuaauaccauacauaa

SEQ ID NO: 711463 - RNA, 23 nt, Haemophilus influenzae Rd
cagauugcugacaaauuuguuga

SEQ ID NO: 711464 - RNA, 21 nt, Haemophilus influenzae Rd
cagaugccauuaaaacgaaag

SEQ ID NO: 711465 - RNA, 21 nt, Haemophilus influenzae Rd
cagcaaucguucgcacaaacu

SEQ ID NO: 711466 - RNA, 14 nt, Haemophilus influenzae Rd
cagcaauuucucug

SEQ ID NO: 711467 - RNA, 14 nt, Haemophilus influenzae Rd
cagcaauuucuuca

SEQ ID NO: 711468 - RNA, 23 nt, Haemophilus influenzae Rd
cagcacacuaauaagaauacaaa

SEQ ID NO: 711469 - RNA, 17 nt, Haemophilus influenzae Rd
cagcaauuaaaaaguca

SEQ ID NO: 711470 - RNA, 14 nt, Haemophilus influenzae Rd
cagcaauuaauaau

SEQ ID NO: 711471 - RNA, 12 nt, Haemophilus influenzae Rd
cagcaaccuaaa

SEQ ID NO: 711472 - RNA, 16 nt, Haemophilus influenzae Rd
cagcaagaaacucaag

SEQ ID NO: 711473 - RNA, 17 nt, Haemophilus influenzae Rd
cagcaagauaagcugcg

SEQ ID NO: 711474 - RNA, 14 nt, Haemophilus influenzae Rd
cagcaagaucaaua

SEQ ID NO: 711475 - RNA, 14 nt, Haemophilus influenzae Rd
cagcaauaaauaau

SEQ ID NO: 711476 - RNA, 15 nt, Haemophilus influenzae Rd
cagcaauaaauaaua

SEQ ID NO: 711477 - RNA, 20 nt, Haemophilus influenzae Rd
caaaagcuacaccgauuucu

SEQ ID NO: 711478 - RNA, 19 nt, Haemophilus influenzae Rd
caaaagcuggauuaaauaa

SEQ ID NO: 711479 - RNA, 23 nt, Haemophilus influenzae Rd
caaaagcuggauuaaauaaccaa

SEQ ID NO: 711480 - RNA, 14 nt, Haemophilus influenzae Rd
caaaagguaaaaau

SEQ ID NO: 711481 - RNA, 22 nt, Haemophilus influenzae Rd
caaaagguaaaaauucuuuuuu

SEQ ID NO: 711482 - RNA, 16 nt, Haemophilus influenzae Rd
caaaaggcaagcuagg

SEQ ID NO: 711483 - RNA, 23 nt, Haemophilus influenzae Rd
caaacuuuuagaaugcagauuaa

SEQ ID NO: 711484 - RNA, 20 nt, Haemophilus influenzae Rd
caaagaauuaaaauaugauu

SEQ ID NO: 711485 - RNA, 16 nt, Haemophilus influenzae Rd
caaagaaucuuaaauu

SEQ ID NO: 711486 - RNA, 22 nt, Haemophilus influenzae Rd
caaagaaucuuaaauucauaau

SEQ ID NO: 711487 - RNA, 16 nt, Haemophilus influenzae Rd
caaagaauuuuuucac

SEQ ID NO: 711488 - RNA, 13 nt, Haemophilus influenzae Rd
caaagaauuugcc

SEQ ID NO: 711489 - RNA, 16 nt, Haemophilus influenzae Rd
caaagauuuuaaaauu

SEQ ID NO: 711490 - RNA, 23 nt, Haemophilus influenzae Rd
caaagcacuaugguguuacuuaa

SEQ ID NO: 711491 - RNA, 20 nt, Haemophilus influenzae Rd
caaagcauuuagagcaagca

SEQ ID NO: 711492 - RNA, 17 nt, Haemophilus influenzae Rd
caaagccugcuacauuu

SEQ ID NO: 711493 - RNA, 18 nt, Haemophilus influenzae Rd
caaaguagucuauuuacu

SEQ ID NO: 711494 - RNA, 20 nt, Haemophilus influenzae Rd
caaaguagucuauuuacuug

SEQ ID NO: 711495 - RNA, 17 nt, Haemophilus influenzae Rd
caaaguaacuuuaauua

SEQ ID NO: 711496 - RNA, 22 nt, Haemophilus influenzae Rd
caaagguuuuauuuugaacaau

SEQ ID NO: 711497 - RNA, 17 nt, Haemophilus influenzae Rd
caaagguaauugccaau

SEQ ID NO: 711498 - RNA, 15 nt, Haemophilus influenzae Rd
caaagguugaaugcg

SEQ ID NO: 711499 - RNA, 17 nt, Haemophilus influenzae Rd
caaagucaauacacauu

SEQ ID NO: 711500 - RNA, 13 nt, Haemophilus influenzae Rd
caaagucuuuacc

SEQ ID NO: 711501 - RNA, 18 nt, Haemophilus influenzae Rd
caaaguuaccauuuauuc

SEQ ID NO: 711502 - RNA, 17 nt, Haemophilus influenzae Rd
caaaguggagaaacauu

SEQ ID NO: 711503 - RNA, 18 nt, Haemophilus influenzae Rd
caaagugcggcaaaaaau

SEQ ID NO: 711504 - RNA, 19 nt, Haemophilus influenzae Rd
caaagugcgguaagaaaau

SEQ ID NO: 711505 - RNA, 18 nt, Haemophilus influenzae Rd
caaauaaacaaacuuuca

SEQ ID NO: 711506 - RNA, 12 nt, Haemophilus influenzae Rd
caaauaaaauau

SEQ ID NO: 711507 - RNA, 15 nt, Haemophilus influenzae Rd
caaauaauccuagag

SEQ ID NO: 711508 - RNA, 17 nt, Haemophilus influenzae Rd
caaauaaagaagaaaau

SEQ ID NO: 711509 - RNA, 19 nt, Haemophilus influenzae Rd
caaauagaugaaauuuauu

SEQ ID NO: 711510 - RNA, 22 nt, Haemophilus influenzae Rd
caaauaggcacauaaguaaaau

SEQ ID NO: 711511 - RNA, 13 nt, Haemophilus influenzae Rd
caaauaauuauua

SEQ ID NO: 711512 - RNA, 19 nt, Haemophilus influenzae Rd
caaauaauuauuauccuau

SEQ ID NO: 711513 - RNA, 23 nt, Haemophilus influenzae Rd
caaauacaaguggcgguaaaaau

SEQ ID NO: 711514 - RNA, 16 nt, Haemophilus influenzae Rd
caaauacaauuuuuuu

SEQ ID NO: 711515 - RNA, 16 nt, Haemophilus influenzae Rd
caaaugaucauuuugg

SEQ ID NO: 711516 - RNA, 17 nt, Haemophilus influenzae Rd
caaaugaugaaacaagc

SEQ ID NO: 711517 - RNA, 13 nt, Haemophilus influenzae Rd
caaauuaaccgca

SEQ ID NO: 711518 - RNA, 17 nt, Haemophilus influenzae Rd
caaauuaauaagaaaau

SEQ ID NO: 711519 - RNA, 14 nt, Haemophilus influenzae Rd
caaauucuaauucu

SEQ ID NO: 711520 - RNA, 13 nt, Haemophilus influenzae Rd
caaauucuacacc

SEQ ID NO: 711521 - RNA, 16 nt, Haemophilus influenzae Rd
caaauucuacauggcg

SEQ ID NO: 711522 - RNA, 14 nt, Haemophilus influenzae Rd
caaauugagaucuu

SEQ ID NO: 711523 - RNA, 18 nt, Haemophilus influenzae Rd
caaauuauucuacauaau

SEQ ID NO: 711524 - RNA, 21 nt, Haemophilus influenzae Rd
caaaucacacguucauuacgu

SEQ ID NO: 711525 - RNA, 18 nt, Haemophilus influenzae Rd
caaaucauaccaauugca

SEQ ID NO: 711526 - RNA, 22 nt, Haemophilus influenzae Rd
caaaucauaccaauugcaacuu

SEQ ID NO: 711527 - RNA, 13 nt, Haemophilus influenzae Rd
caaauauaaaaua

SEQ ID NO: 711528 - RNA, 17 nt, Haemophilus influenzae Rd
caaauauaaaauaaaau

SEQ ID NO: 711529 - RNA, 21 nt, Haemophilus influenzae Rd
caaauauaaauaguuaaagcc

SEQ ID NO: 711530 - RNA, 22 nt, Haemophilus influenzae Rd
caaauauaaauaguuaaagccu

SEQ ID NO: 711531 - RNA, 19 nt, Haemophilus influenzae Rd
caaaucguuugucguaaua

SEQ ID NO: 711532 - RNA, 13 nt, Haemophilus influenzae Rd
caaaucuaacauu

SEQ ID NO: 711533 - RNA, 17 nt, Haemophilus influenzae Rd
caacaccagucaauaaa

SEQ ID NO: 711534 - RNA, 15 nt, Haemophilus influenzae Rd
caacagcugcacaag

SEQ ID NO: 711535 - RNA, 21 nt, Haemophilus influenzae Rd
caacagcugcacaagcaccac

SEQ ID NO: 711536 - RNA, 13 nt, Haemophilus influenzae Rd
caacagcuucucc

SEQ ID NO: 711537 - RNA, 17 nt, Haemophilus influenzae Rd
caacacuuuauuacuuu

SEQ ID NO: 711538 - RNA, 19 nt, Haemophilus influenzae Rd
caacacuugcuguuuuucc

SEQ ID NO: 711539 - RNA, 18 nt, Haemophilus influenzae Rd
caacaauacguugaacuu

SEQ ID NO: 711540 - RNA, 19 nt, Haemophilus influenzae Rd
caacaaugcuauaaaaccu

SEQ ID NO: 711541 - RNA, 21 nt, Haemophilus influenzae Rd
caacaauuaaugucauccauc

SEQ ID NO: 711542 - RNA, 21 nt, Haemophilus influenzae Rd
caacacaacaucagcuucaau

SEQ ID NO: 711543 - RNA, 16 nt, Haemophilus influenzae Rd
caacaauuucugcaua

SEQ ID NO: 711544 - RNA, 20 nt, Haemophilus influenzae Rd
caacaauuucacugaaagua

SEQ ID NO: 711545 - RNA, 20 nt, Haemophilus influenzae Rd
caaauuggguucgcaaauaa

SEQ ID NO: 711546 - RNA, 21 nt, Haemophilus influenzae Rd
caaauuggguucgcaaauaac

SEQ ID NO: 711547 - RNA, 22 nt, Haemophilus influenzae Rd
caaauuggguucgcaaauaacg

SEQ ID NO: 711548 - RNA, 23 nt, Haemophilus influenzae Rd
caaauuggguucgcaaauaacga

SEQ ID NO: 711549 - RNA, 17 nt, Haemophilus influenzae Rd
caaauuguacuuuuuga

SEQ ID NO: 711550 - RNA, 23 nt, Haemophilus influenzae Rd
caaauuggagcgggaaacgaggc

SEQ ID NO: 711551 - RNA, 24 nt, Haemophilus influenzae Rd
caaauugugucacauaaucaggcu

SEQ ID NO: 711552 - RNA, 11 nt, Haemophilus influenzae Rd
caaauuuaucg

SEQ ID NO: 711553 - RNA, 23 nt, Haemophilus influenzae Rd
caaauuucuguugaaaucaaaug

SEQ ID NO: 711554 - RNA, 14 nt, Haemophilus influenzae Rd
caaauuucuucacu

SEQ ID NO: 711555 - RNA, 16 nt, Haemophilus influenzae Rd
caaauuuaaauaauaa

SEQ ID NO: 711556 - RNA, 17 nt, Haemophilus influenzae Rd
caaauuuaaauaauaaa

SEQ ID NO: 711557 - RNA, 15 nt, Haemophilus influenzae Rd
caaauuuaaaugaug

SEQ ID NO: 711558 - RNA, 14 nt, Haemophilus influenzae Rd
caaauuuaggauuu

SEQ ID NO: 711559 - RNA, 15 nt, Haemophilus influenzae Rd
caacauuaauaacgu

SEQ ID NO: 711560 - RNA, 11 nt, Haemophilus influenzae Rd
caaccaaacaa

SEQ ID NO: 711561 - RNA, 14 nt, Haemophilus influenzae Rd
caaccacuucaaau

SEQ ID NO: 711562 - RNA, 17 nt, Haemophilus influenzae Rd
caaccacccauacuuua

SEQ ID NO: 711563 - RNA, 23 nt, Haemophilus influenzae Rd
caaccacccauacuuuaacuucu

SEQ ID NO: 711564 - RNA, 16 nt, Haemophilus influenzae Rd
caaccagcagaaaaua

SEQ ID NO: 711565 - RNA, 17 nt, Haemophilus influenzae Rd
caaccagcagaaaauaa

SEQ ID NO: 711566 - RNA, 16 nt, Haemophilus influenzae Rd
caaccagcgcaccaca

SEQ ID NO: 711567 - RNA, 16 nt, Haemophilus influenzae Rd
caaccgcacuuaauaa

SEQ ID NO: 711568 - RNA, 17 nt, Haemophilus influenzae Rd
caaccgcacuuaauaaa

SEQ ID NO: 711569 - RNA, 21 nt, Haemophilus influenzae Rd
caaccgccugcauagaaugca

SEQ ID NO: 711570 - RNA, 13 nt, Haemophilus influenzae Rd
caaccgaauauau

SEQ ID NO: 711571 - RNA, 13 nt, Haemophilus influenzae Rd
caacccauuuucc

SEQ ID NO: 711572 - RNA, 15 nt, Haemophilus influenzae Rd
caacccaauuuaccu

SEQ ID NO: 711573 - RNA, 17 nt, Haemophilus influenzae Rd
caaccaucuuuaauucc

SEQ ID NO: 711574 - RNA, 19 nt, Haemophilus influenzae Rd
caaccauaacaagaaucau

SEQ ID NO: 711575 - RNA, 19 nt, Haemophilus influenzae Rd
caacuguuuauagcgucuu

SEQ ID NO: 711576 - RNA, 23 nt, Haemophilus influenzae Rd
caacuguuuauagcgucuuuuug

SEQ ID NO: 711577 - RNA, 15 nt, Haemophilus influenzae Rd
caacuuaaguugggc

SEQ ID NO: 711578 - RNA, 14 nt, Haemophilus influenzae Rd
caacugcuucuguu

SEQ ID NO: 711579 - RNA, 17 nt, Haemophilus influenzae Rd
caacugcaacaauuuca

SEQ ID NO: 711580 - RNA, 22 nt, Haemophilus influenzae Rd
caacugaauucucaauugcaga

SEQ ID NO: 711581 - RNA, 12 nt, Haemophilus influenzae Rd
caacuaaauaag

SEQ ID NO: 711582 - RNA, 13 nt, Haemophilus influenzae Rd
caacuaacacgcg

SEQ ID NO: 711583 - RNA, 20 nt, Haemophilus influenzae Rd
caacuaacacgcgcugcucu

SEQ ID NO: 711584 - RNA, 24 nt, Haemophilus influenzae Rd
caacuaauaaaccaauaagauaga

SEQ ID NO: 711585 - RNA, 21 nt, Haemophilus influenzae Rd
caacuaauagcgugaaaagcu

SEQ ID NO: 711586 - RNA, 18 nt, Haemophilus influenzae Rd
caacuaauuuauuaaaaa

SEQ ID NO: 711587 - RNA, 21 nt, Haemophilus influenzae Rd
caacuaauuuauuaaaaauaa

SEQ ID NO: 711588 - RNA, 13 nt, Haemophilus influenzae Rd
caacgcuuaauga

SEQ ID NO: 711589 - RNA, 15 nt, Haemophilus influenzae Rd
caacggauuaaaagu

SEQ ID NO: 711590 - RNA, 14 nt, Haemophilus influenzae Rd
caaccguggcaacc

SEQ ID NO: 711591 - RNA, 16 nt, Haemophilus influenzae Rd
caaucucuuuacuguu

SEQ ID NO: 711592 - RNA, 21 nt, Haemophilus influenzae Rd
caaucucuuuacuguucaaau

SEQ ID NO: 711593 - RNA, 19 nt, Haemophilus influenzae Rd
caaucuccguugggauuuu

SEQ ID NO: 711594 - RNA, 23 nt, Haemophilus influenzae Rd
caaucucuagauuuuuuacucaa

SEQ ID NO: 711595 - RNA, 15 nt, Haemophilus influenzae Rd
caaucuggauuggau

SEQ ID NO: 711596 - RNA, 11 nt, Haemophilus influenzae Rd
caaucuaauuc

SEQ ID NO: 711597 - RNA, 20 nt, Haemophilus influenzae Rd
caaucgacuuuguccaaaaa

SEQ ID NO: 711598 - RNA, 15 nt, Haemophilus influenzae Rd
caaucgguuucacaa

SEQ ID NO: 711599 - RNA, 17 nt, Haemophilus influenzae Rd
caaucguaagauccaaa

SEQ ID NO: 711600 - RNA, 16 nt, Haemophilus influenzae Rd
caauccgcuuguuaau

SEQ ID NO: 711601 - RNA, 16 nt, Haemophilus influenzae Rd
caauccuaacuuuucu

SEQ ID NO: 711602 - RNA, 21 nt, Haemophilus influenzae Rd
caauccuaacuuuucuucaau

SEQ ID NO: 711603 - RNA, 17 nt, Haemophilus influenzae Rd
caauccauuuuuaaaug

SEQ ID NO: 711604 - RNA, 10 nt, Haemophilus influenzae Rd
caauccauaa

SEQ ID NO: 711605 - RNA, 22 nt, Haemophilus influenzae Rd
caauccauuucgucgcuuuucc

SEQ ID NO: 711606 - RNA, 20 nt, Haemophilus influenzae Rd
caauccagcguaaccaaugg

SEQ ID NO: 711607 - RNA, 19 nt, Haemophilus influenzae Rd
caauccaacguuuuaaucc

SEQ ID NO: 711608 - RNA, 16 nt, Haemophilus influenzae Rd
caaucaaauucaacac

SEQ ID NO: 711609 - RNA, 15 nt, Haemophilus influenzae Rd
caaucaaaaaugaaa

SEQ ID NO: 711610 - RNA, 13 nt, Haemophilus influenzae Rd
caaucauaaaauu

SEQ ID NO: 711611 - RNA, 14 nt, Haemophilus influenzae Rd
caaucaguuuuacg

SEQ ID NO: 711612 - RNA, 20 nt, Haemophilus influenzae Rd
caaucauacuaaauacauuu

SEQ ID NO: 711613 - RNA, 16 nt, Haemophilus influenzae Rd
caaucauaucaucaac

SEQ ID NO: 711614 - RNA, 13 nt, Haemophilus influenzae Rd
caaucaucagaau

SEQ ID NO: 711615 - RNA, 21 nt, Haemophilus influenzae Rd
caaucaucccuucuuuuauag

SEQ ID NO: 711616 - RNA, 15 nt, Haemophilus influenzae Rd
caauauugucuauuu

SEQ ID NO: 711617 - RNA, 18 nt, Haemophilus influenzae Rd
caauauugucuauuuuau

SEQ ID NO: 711618 - RNA, 12 nt, Haemophilus influenzae Rd
caauauugaaaa

SEQ ID NO: 711619 - RNA, 14 nt, Haemophilus influenzae Rd
caauauugaaaagu

SEQ ID NO: 711620 - RNA, 18 nt, Haemophilus influenzae Rd
caauauuuacucuuuuuu

SEQ ID NO: 711621 - RNA, 21 nt, Haemophilus influenzae Rd
caauauuuaaauacacuucua

SEQ ID NO: 711622 - RNA, 23 nt, Haemophilus influenzae Rd
caauauuuaauaugccaaauaaa

SEQ ID NO: 711623 - RNA, 22 nt, Haemophilus influenzae Rd
caauauuuauuucuauagauuu

SEQ ID NO: 711624 - RNA, 13 nt, Haemophilus influenzae Rd
caauauuuccucu

SEQ ID NO: 711625 - RNA, 18 nt, Haemophilus influenzae Rd
caauauuuccucuaaaua

SEQ ID NO: 711626 - RNA, 16 nt, Haemophilus influenzae Rd
caauauuaucgugauu

SEQ ID NO: 711627 - RNA, 21 nt, Haemophilus influenzae Rd
caauauuaugugcuugggcaa

SEQ ID NO: 711628 - RNA, 18 nt, Haemophilus influenzae Rd
caaugaguguuauugaug

SEQ ID NO: 711629 - RNA, 16 nt, Haemophilus influenzae Rd
caaugauaccuuguua

SEQ ID NO: 711630 - RNA, 23 nt, Haemophilus influenzae Rd
caaugagccaacucgaacaugaa

SEQ ID NO: 711631 - RNA, 17 nt, Haemophilus influenzae Rd
caaugccaaucuaaaca

SEQ ID NO: 711632 - RNA, 14 nt, Haemophilus influenzae Rd
caaugcagaaauac

SEQ ID NO: 711633 - RNA, 16 nt, Haemophilus influenzae Rd
caaugcaaaaguaaau

SEQ ID NO: 711634 - RNA, 19 nt, Haemophilus influenzae Rd
caaugcaaaaguaaauaau

SEQ ID NO: 711635 - RNA, 15 nt, Haemophilus influenzae Rd
caaugcaaauuaacg

SEQ ID NO: 711636 - RNA, 19 nt, Haemophilus influenzae Rd
caaugcaaauuaacgguuu

SEQ ID NO: 711637 - RNA, 14 nt, Haemophilus influenzae Rd
caaugcaagcggca

SEQ ID NO: 711638 - RNA, 21 nt, Haemophilus influenzae Rd
caaugcaauuggcaauauuaa

SEQ ID NO: 711639 - RNA, 21 nt, Haemophilus influenzae Rd
caaucuucacaaauaauauga

SEQ ID NO: 711640 - RNA, 19 nt, Haemophilus influenzae Rd
caaucuuguuggaucuucc

SEQ ID NO: 711641 - RNA, 20 nt, Haemophilus influenzae Rd
caaucuuguuggaucuucca

SEQ ID NO: 711642 - RNA, 13 nt, Haemophilus influenzae Rd
caaucuuguuuua

SEQ ID NO: 711643 - RNA, 13 nt, Haemophilus influenzae Rd
caaucuuuuucuu

SEQ ID NO: 711644 - RNA, 18 nt, Haemophilus influenzae Rd
caaucuuuuuguuaauaa

SEQ ID NO: 711645 - RNA, 22 nt, Haemophilus influenzae Rd
caaucuuuggcaaaaaauacau

SEQ ID NO: 711646 - RNA, 12 nt, Haemophilus influenzae Rd
caaugacugaua

SEQ ID NO: 711647 - RNA, 21 nt, Haemophilus influenzae Rd
caaugaacuuaugugcaccuu

SEQ ID NO: 711648 - RNA, 15 nt, Haemophilus influenzae Rd
caaugaaauuauugc

SEQ ID NO: 711649 - RNA, 12 nt, Haemophilus influenzae Rd
caaugaaauuuu

SEQ ID NO: 711650 - RNA, 15 nt, Haemophilus influenzae Rd
caauggcaaucacaa

SEQ ID NO: 711651 - RNA, 18 nt, Haemophilus influenzae Rd
caauggcaaucacaguuu

SEQ ID NO: 711652 - RNA, 19 nt, Haemophilus influenzae Rd
caauggcuuuuaauccaag

SEQ ID NO: 711653 - RNA, 23 nt, Haemophilus influenzae Rd
caauggcuuuuaauccaagugca

SEQ ID NO: 711654 - RNA, 23 nt, Haemophilus influenzae Rd
caauggcugaaaaauucaaagaa

SEQ ID NO: 711655 - RNA, 22 nt, Haemophilus influenzae Rd
caauggcugagguuccccuaaa

SEQ ID NO: 711656 - RNA, 22 nt, Haemophilus influenzae Rd
caaugucagaaaagauuuuuug

SEQ ID NO: 711657 - RNA, 21 nt, Haemophilus influenzae Rd
caauggggguuagguaaaaau

SEQ ID NO: 711658 - RNA, 22 nt, Haemophilus influenzae Rd
caauggggguuagguaaaaauc

SEQ ID NO: 711659 - RNA, 17 nt, Haemophilus influenzae Rd
caaugguucgagaaacu

SEQ ID NO: 711660 - RNA, 14 nt, Haemophilus influenzae Rd
caaugguuggacaa

SEQ ID NO: 711661 - RNA, 15 nt, Haemophilus influenzae Rd
caaugguuuauaaca

SEQ ID NO: 711662 - RNA, 16 nt, Haemophilus influenzae Rd
caaugguuuuacugug

SEQ ID NO: 711663 - RNA, 18 nt, Haemophilus influenzae Rd
caaugcucacuucgcuua

SEQ ID NO: 711664 - RNA, 18 nt, Haemophilus influenzae Rd
caaugcucucuuuuaauc

SEQ ID NO: 711665 - RNA, 16 nt, Haemophilus influenzae Rd
caauggaaauaccaug

SEQ ID NO: 711666 - RNA, 14 nt, Haemophilus influenzae Rd
caaugcuuuaauca

SEQ ID NO: 711667 - RNA, 14 nt, Haemophilus influenzae Rd
caaugcuauaaaac

SEQ ID NO: 711668 - RNA, 17 nt, Haemophilus influenzae Rd
caaugcuuccuucaaac

SEQ ID NO: 711669 - RNA, 16 nt, Haemophilus influenzae Rd
caaugccauuuuuuau

SEQ ID NO: 711670 - RNA, 23 nt, Haemophilus influenzae Rd
caaugccaucguggaauggagga

SEQ ID NO: 711671 - RNA, 23 nt, Haemophilus influenzae Rd
caauagguugaagaacguaaauu

SEQ ID NO: 711672 - RNA, 15 nt, Haemophilus influenzae Rd
caauagguugcaaau

SEQ ID NO: 711673 - RNA, 17 nt, Haemophilus influenzae Rd
caauagucguuuaacca

SEQ ID NO: 711674 - RNA, 20 nt, Haemophilus influenzae Rd
caauaggaagcauuucuaaa

SEQ ID NO: 711675 - RNA, 21 nt, Haemophilus influenzae Rd
caauaggaagcauuucuaaag

SEQ ID NO: 711676 - RNA, 23 nt, Haemophilus influenzae Rd
caauaucccaacuuuauguccau

SEQ ID NO: 711677 - RNA, 23 nt, Haemophilus influenzae Rd
caauauaacucaacaccgcaaaa

SEQ ID NO: 711678 - RNA, 22 nt, Haemophilus influenzae Rd
caauaucuauuggaauggcaaa

SEQ ID NO: 711679 - RNA, 15 nt, Haemophilus influenzae Rd
caauaucuaagaaaa

SEQ ID NO: 711680 - RNA, 20 nt, Haemophilus influenzae Rd
caauaucuagcacagcaauu

SEQ ID NO: 711681 - RNA, 20 nt, Haemophilus influenzae Rd
caauaauuucuuguuuaaau

SEQ ID NO: 711682 - RNA, 15 nt, Haemophilus influenzae Rd
caauaauuuucaaua

SEQ ID NO: 711683 - RNA, 14 nt, Haemophilus influenzae Rd
caauacgauauuug

SEQ ID NO: 711684 - RNA, 21 nt, Haemophilus influenzae Rd
caauaaucacaguaccuacau

SEQ ID NO: 711685 - RNA, 16 nt, Haemophilus influenzae Rd
caauaaucaauacucc

SEQ ID NO: 711686 - RNA, 15 nt, Haemophilus influenzae Rd
caauaauucuuuaau

SEQ ID NO: 711687 - RNA, 23 nt, Haemophilus influenzae Rd
caauaauucuuuaaucguuacca

SEQ ID NO: 711688 - RNA, 18 nt, Haemophilus influenzae Rd
caauaauugaugcuaaau

SEQ ID NO: 711689 - RNA, 13 nt, Haemophilus influenzae Rd
caauaauuucaau

SEQ ID NO: 711690 - RNA, 12 nt, Haemophilus influenzae Rd
caauaauuuuac

SEQ ID NO: 711691 - RNA, 15 nt, Haemophilus influenzae Rd
caauacucuuaacaa

SEQ ID NO: 711692 - RNA, 18 nt, Haemophilus influenzae Rd
caauacucuuaacaaaac

SEQ ID NO: 711693 - RNA, 17 nt, Haemophilus influenzae Rd
caauacuccaacccaga

SEQ ID NO: 711694 - RNA, 22 nt, Haemophilus influenzae Rd
caauacgauucguuucaguacg

SEQ ID NO: 711695 - RNA, 11 nt, Haemophilus influenzae Rd
caauacuuagc

SEQ ID NO: 711696 - RNA, 16 nt, Haemophilus influenzae Rd
caauacuguuuggcaa

SEQ ID NO: 711697 - RNA, 20 nt, Haemophilus influenzae Rd
caauacuguuuggcaaauag

SEQ ID NO: 711698 - RNA, 14 nt, Haemophilus influenzae Rd
caauagccaauaau

SEQ ID NO: 711699 - RNA, 16 nt, Haemophilus influenzae Rd
caauagccuguaaauu

SEQ ID NO: 711700 - RNA, 22 nt, Haemophilus influenzae Rd
caauagcgaccaacaguuaagc

SEQ ID NO: 711701 - RNA, 19 nt, Haemophilus influenzae Rd
caauaauaggcgaaucaaa

SEQ ID NO: 711702 - RNA, 13 nt, Haemophilus influenzae Rd
caauaauaucugc

SEQ ID NO: 711703 - RNA, 22 nt, Haemophilus influenzae Rd
caauaauagccauauuaucugc

SEQ ID NO: 711704 - RNA, 21 nt, Haemophilus influenzae Rd
caauaagugcgguaaaaaaau

SEQ ID NO: 711705 - RNA, 14 nt, Haemophilus influenzae Rd
caauaaccaauaac

SEQ ID NO: 711706 - RNA, 16 nt, Haemophilus influenzae Rd
caauaaauucaccacu

SEQ ID NO: 711707 - RNA, 15 nt, Haemophilus influenzae Rd
caauaaauucguaca

SEQ ID NO: 711708 - RNA, 21 nt, Haemophilus influenzae Rd
caauaaauucguacaaaugaa

SEQ ID NO: 711709 - RNA, 16 nt, Haemophilus influenzae Rd
caauaacaacuggaau

SEQ ID NO: 711710 - RNA, 19 nt, Haemophilus influenzae Rd
caauaacaagcacaagauu

SEQ ID NO: 711711 - RNA, 13 nt, Haemophilus influenzae Rd
caauaaagggaaa

SEQ ID NO: 711712 - RNA, 19 nt, Haemophilus influenzae Rd
caauaaaguugagaauuuu

SEQ ID NO: 711713 - RNA, 13 nt, Haemophilus influenzae Rd
caauaaaauuugc

SEQ ID NO: 711714 - RNA, 12 nt, Haemophilus influenzae Rd
caauaaaaguaa

SEQ ID NO: 711715 - RNA, 18 nt, Haemophilus influenzae Rd
caauaaaauaauauauua

SEQ ID NO: 711716 - RNA, 13 nt, Haemophilus influenzae Rd
caauaaaaagaua

SEQ ID NO: 711717 - RNA, 13 nt, Haemophilus influenzae Rd
caauaaaaauaau

SEQ ID NO: 711718 - RNA, 21 nt, Haemophilus influenzae Rd
caauaaaaauaauguuuuuau

SEQ ID NO: 711719 - RNA, 14 nt, Haemophilus influenzae Rd
caaguuuucacuuc

SEQ ID NO: 711720 - RNA, 19 nt, Haemophilus influenzae Rd
caaguuucuaaaaucacuu

SEQ ID NO: 711721 - RNA, 11 nt, Haemophilus influenzae Rd
caaguuuuuua

SEQ ID NO: 711722 - RNA, 15 nt, Haemophilus influenzae Rd
caaguuuaauacaau

SEQ ID NO: 711723 - RNA, 13 nt, Haemophilus influenzae Rd
caaguauuuuccu

SEQ ID NO: 711724 - RNA, 20 nt, Haemophilus influenzae Rd
caaguauuuuccuucugcca

SEQ ID NO: 711725 - RNA, 19 nt, Haemophilus influenzae Rd
caaguauuuuguggaauau

SEQ ID NO: 711726 - RNA, 20 nt, Haemophilus influenzae Rd
caagucagcucaagcaacau

SEQ ID NO: 711727 - RNA, 18 nt, Haemophilus influenzae Rd
caagguugcccacaaaau

SEQ ID NO: 711728 - RNA, 15 nt, Haemophilus influenzae Rd
caagguuauauaaca

SEQ ID NO: 711729 - RNA, 18 nt, Haemophilus influenzae Rd
caaguaucaauguaauga

SEQ ID NO: 711730 - RNA, 16 nt, Haemophilus influenzae Rd
caaguauaaaaaagug

SEQ ID NO: 711731 - RNA, 17 nt, Haemophilus influenzae Rd
caaggguuccugcauca

SEQ ID NO: 711732 - RNA, 17 nt, Haemophilus influenzae Rd
caaggucgugcucuacc

SEQ ID NO: 711733 - RNA, 20 nt, Haemophilus influenzae Rd
caaggcgaaucgaaagauuc

SEQ ID NO: 711734 - RNA, 14 nt, Haemophilus influenzae Rd
caaggggaaaauau

SEQ ID NO: 711735 - RNA, 20 nt, Haemophilus influenzae Rd
caaggaaucgaaauuaaaau

SEQ ID NO: 711736 - RNA, 16 nt, Haemophilus influenzae Rd
caagcuaagauugaca

SEQ ID NO: 711737 - RNA, 19 nt, Haemophilus influenzae Rd
caaggagcuuuauuauugg

SEQ ID NO: 711738 - RNA, 18 nt, Haemophilus influenzae Rd
caaggacuaggcucugua

SEQ ID NO: 711739 - RNA, 23 nt, Haemophilus influenzae Rd
caagcggcugacauuacauaaau

SEQ ID NO: 711740 - RNA, 22 nt, Haemophilus influenzae Rd
caagcacauuaaucauuucaau

SEQ ID NO: 711741 - RNA, 18 nt, Haemophilus influenzae Rd
caagcaccagucaagguu

SEQ ID NO: 711742 - RNA, 21 nt, Haemophilus influenzae Rd
caagcacugaggcuaauaaua

SEQ ID NO: 711743 - RNA, 18 nt, Haemophilus influenzae Rd
caagcacuuuauuuaauu

SEQ ID NO: 711744 - RNA, 21 nt, Haemophilus influenzae Rd
caagcagccauccccaaaaca

SEQ ID NO: 711745 - RNA, 19 nt, Haemophilus influenzae Rd
caacuucggaagaaaaaga

SEQ ID NO: 711746 - RNA, 13 nt, Haemophilus influenzae Rd
caacuucagcagc

SEQ ID NO: 711747 - RNA, 13 nt, Haemophilus influenzae Rd
caacuucaucaau

SEQ ID NO: 711748 - RNA, 13 nt, Haemophilus influenzae Rd
caagccaauuauu

SEQ ID NO: 711749 - RNA, 15 nt, Haemophilus influenzae Rd
caagccaauuauuua

SEQ ID NO: 711750 - RNA, 14 nt, Haemophilus influenzae Rd
caagcauuaaauau

SEQ ID NO: 711751 - RNA, 13 nt, Haemophilus influenzae Rd
caagcauucucaa

SEQ ID NO: 711752 - RNA, 15 nt, Haemophilus influenzae Rd
caagcauuucaagcu

SEQ ID NO: 711753 - RNA, 14 nt, Haemophilus influenzae Rd
caagccccugaagc

SEQ ID NO: 711754 - RNA, 14 nt, Haemophilus influenzae Rd
caagccauguugau

SEQ ID NO: 711755 - RNA, 15 nt, Haemophilus influenzae Rd
auuuuuuaacuugau

SEQ ID NO: 711756 - RNA, 13 nt, Haemophilus influenzae Rd
auuuuuuacucaa

SEQ ID NO: 711757 - RNA, 12 nt, Haemophilus influenzae Rd
auuuuuuacauu

SEQ ID NO: 711758 - RNA, 19 nt, Haemophilus influenzae Rd
auuuuuggauuuaacccag

SEQ ID NO: 711759 - RNA, 21 nt, Haemophilus influenzae Rd
auuuuuguggcgugagauccu

SEQ ID NO: 711760 - RNA, 14 nt, Haemophilus influenzae Rd
auuuuugauaaaaa

SEQ ID NO: 711761 - RNA, 17 nt, Haemophilus influenzae Rd
auuuuugauugcaccua

SEQ ID NO: 711762 - RNA, 17 nt, Haemophilus influenzae Rd
auuuuugcaaaaaguac

SEQ ID NO: 711763 - RNA, 17 nt, Haemophilus influenzae Rd
auuuuugaauuucacug

SEQ ID NO: 711764 - RNA, 20 nt, Haemophilus influenzae Rd
auuuuucuuuuucaguuuuu

SEQ ID NO: 711765 - RNA, 21 nt, Haemophilus influenzae Rd
auuuuucuuuuucaguuuuua

SEQ ID NO: 711766 - RNA, 23 nt, Haemophilus influenzae Rd
auuuuucuucgcgagaauuacca

SEQ ID NO: 711767 - RNA, 21 nt, Haemophilus influenzae Rd
auuuuuccgcugccuugauuu

SEQ ID NO: 711768 - RNA, 23 nt, Haemophilus influenzae Rd
auuuuuccccacuuaucuuaaaa

SEQ ID NO: 711769 - RNA, 15 nt, Haemophilus influenzae Rd
auuuuucggauuaag

SEQ ID NO: 711770 - RNA, 19 nt, Haemophilus influenzae Rd
auuuuucucaccaccagau

SEQ ID NO: 711771 - RNA, 17 nt, Haemophilus influenzae Rd
auuuuucuaaaaucaca

SEQ ID NO: 711772 - RNA, 18 nt, Haemophilus influenzae Rd
auuuuucaucuuuuuaua

SEQ ID NO: 711773 - RNA, 19 nt, Haemophilus influenzae Rd
auuuuucaucuuuuuauaa

SEQ ID NO: 711774 - RNA, 13 nt, Haemophilus influenzae Rd
auuuuucagguaa

SEQ ID NO: 711775 - RNA, 17 nt, Haemophilus influenzae Rd
auuuuucauaaauauca

SEQ ID NO: 711776 - RNA, 23 nt, Haemophilus influenzae Rd
auuuuuaaaagcaccgcauugua

SEQ ID NO: 711777 - RNA, 13 nt, Haemophilus influenzae Rd
auuuuuaaaucaa

SEQ ID NO: 711778 - RNA, 14 nt, Haemophilus influenzae Rd
auuuuuaaaucaau

SEQ ID NO: 711779 - RNA, 14 nt, Haemophilus influenzae Rd
auuuuuaaagaaau

SEQ ID NO: 711780 - RNA, 12 nt, Haemophilus influenzae Rd
auuuuuaaaguu

SEQ ID NO: 711781 - RNA, 18 nt, Haemophilus influenzae Rd
auuuuuaaacaauauauu

SEQ ID NO: 711782 - RNA, 23 nt, Haemophilus influenzae Rd
auuuuuucucucgccaauagguu

SEQ ID NO: 711783 - RNA, 15 nt, Haemophilus influenzae Rd
auuuuuucuuaaauu

SEQ ID NO: 711784 - RNA, 17 nt, Haemophilus influenzae Rd
auuuuuucugaauaaau

SEQ ID NO: 711785 - RNA, 19 nt, Haemophilus influenzae Rd
auuuuuucgaucuaaucca

SEQ ID NO: 711786 - RNA, 18 nt, Haemophilus influenzae Rd
auuuuuucgguuuuuccg

SEQ ID NO: 711787 - RNA, 18 nt, Haemophilus influenzae Rd
auuuuuuauuuauauaaa

SEQ ID NO: 711788 - RNA, 14 nt, Haemophilus influenzae Rd
auuuuuuauuuuua

SEQ ID NO: 711789 - RNA, 16 nt, Haemophilus influenzae Rd
auuuuuuauuuuuucu

SEQ ID NO: 711790 - RNA, 14 nt, Haemophilus influenzae Rd
auuuuuuauuaaaa

SEQ ID NO: 711791 - RNA, 21 nt, Haemophilus influenzae Rd
auuuuuuauaugccaagauuu

SEQ ID NO: 711792 - RNA, 12 nt, Haemophilus influenzae Rd
auuuuuuaucaa

SEQ ID NO: 711793 - RNA, 17 nt, Haemophilus influenzae Rd
auuuuuuaucaaauaac

SEQ ID NO: 711794 - RNA, 15 nt, Haemophilus influenzae Rd
auuuuuuaugguaaa

SEQ ID NO: 711795 - RNA, 19 nt, Haemophilus influenzae Rd
auuuuuuaugguaaauauu

SEQ ID NO: 711796 - RNA, 16 nt, Haemophilus influenzae Rd
auuuuuucaauuuaaa

SEQ ID NO: 711797 - RNA, 14 nt, Haemophilus influenzae Rd
auuuuuucacaauc

SEQ ID NO: 711798 - RNA, 22 nt, Haemophilus influenzae Rd
auuuuuucacaccgucuaaaaa

SEQ ID NO: 711799 - RNA, 17 nt, Haemophilus influenzae Rd
auuuuuuuaaauauuuu

SEQ ID NO: 711800 - RNA, 17 nt, Haemophilus influenzae Rd
auuuuuuuaugauuaaa

SEQ ID NO: 711801 - RNA, 15 nt, Haemophilus influenzae Rd
auuuuuuuagagcuu

SEQ ID NO: 711802 - RNA, 14 nt, Haemophilus influenzae Rd
auuuuuuucaauga

SEQ ID NO: 711803 - RNA, 20 nt, Haemophilus influenzae Rd
auuuuuuggaguuguuuaaa

SEQ ID NO: 711804 - RNA, 19 nt, Haemophilus influenzae Rd
auuuuuuguucauuuuaaa

SEQ ID NO: 711805 - RNA, 24 nt, Haemophilus influenzae Rd
auuuuuuguugagcaauccaauca

SEQ ID NO: 711806 - RNA, 23 nt, Haemophilus influenzae Rd
caaaaaagcccaaguaauacacc

SEQ ID NO: 711807 - RNA, 19 nt, Haemophilus influenzae Rd
caaaaaagcguugaaaaua

SEQ ID NO: 711808 - RNA, 15 nt, Haemophilus influenzae Rd
caaaaaacaccuaaa

SEQ ID NO: 711809 - RNA, 22 nt, Haemophilus influenzae Rd
caaaaaacuuugguuuguuaaa

SEQ ID NO: 711810 - RNA, 23 nt, Haemophilus influenzae Rd
auuuuuuuucuaauaauccucuu

SEQ ID NO: 711811 - RNA, 19 nt, Haemophilus influenzae Rd
auuuuuuucucuguuuuau

SEQ ID NO: 711812 - RNA, 12 nt, Haemophilus influenzae Rd
auuuuuuuuaaa

SEQ ID NO: 711813 - RNA, 18 nt, Haemophilus influenzae Rd
auuuuuuuuauaucuucu

SEQ ID NO: 711814 - RNA, 23 nt, Haemophilus influenzae Rd
auuuuuuuuauccaaaauuaaau

SEQ ID NO: 711815 - RNA, 18 nt, Haemophilus influenzae Rd
auuuuuuugcuuuucccu

SEQ ID NO: 711816 - RNA, 18 nt, Haemophilus influenzae Rd
auuuuuuucuauuuaaag

SEQ ID NO: 711817 - RNA, 14 nt, Haemophilus influenzae Rd
caaaaccauucagu

SEQ ID NO: 711818 - RNA, 15 nt, Haemophilus influenzae Rd
caaaaccuaacauaa

SEQ ID NO: 711819 - RNA, 20 nt, Haemophilus influenzae Rd
caaaaccuaacauaaugccu

SEQ ID NO: 711820 - RNA, 17 nt, Haemophilus influenzae Rd
caaaacgcacuucaaau

SEQ ID NO: 711821 - RNA, 20 nt, Haemophilus influenzae Rd
caaaacgcacuucaaaugaa

SEQ ID NO: 711822 - RNA, 21 nt, Haemophilus influenzae Rd
caaaaccaaucauaaaauuuc

SEQ ID NO: 711823 - RNA, 17 nt, Haemophilus influenzae Rd
caaaaccaaucauugga

SEQ ID NO: 711824 - RNA, 22 nt, Haemophilus influenzae Rd
caaaacagggcgacaauuuauc

SEQ ID NO: 711825 - RNA, 14 nt, Haemophilus influenzae Rd
caaaacauaauaaa

SEQ ID NO: 711826 - RNA, 15 nt, Haemophilus influenzae Rd
caaaacaguaaugaa

SEQ ID NO: 711827 - RNA, 18 nt, Haemophilus influenzae Rd
caaaacaguaaugaaaga

SEQ ID NO: 711828 - RNA, 23 nt, Haemophilus influenzae Rd
caaaacaauggcugaaaaauuca

SEQ ID NO: 711829 - RNA, 23 nt, Haemophilus influenzae Rd
caaaaauuucagaauuaguaaag

SEQ ID NO: 711830 - RNA, 21 nt, Haemophilus influenzae Rd
caaaagaaaagaugaaugaac

SEQ ID NO: 711831 - RNA, 14 nt, Haemophilus influenzae Rd
caaaagaaagacuu

SEQ ID NO: 711832 - RNA, 15 nt, Haemophilus influenzae Rd
caaaacguucuacuu

SEQ ID NO: 711833 - RNA, 15 nt, Haemophilus influenzae Rd
caaaacgugcugcag

SEQ ID NO: 711834 - RNA, 17 nt, Haemophilus influenzae Rd
caaaacuaucaaaauca

SEQ ID NO: 711835 - RNA, 21 nt, Haemophilus influenzae Rd
caaaacuaucaaaaucaaagu

SEQ ID NO: 711836 - RNA, 21 nt, Haemophilus influenzae Rd
caaaagaaugacguaauuugu

SEQ ID NO: 711837 - RNA, 19 nt, Haemophilus influenzae Rd
caaaagagcgguugaaaau

SEQ ID NO: 711838 - RNA, 16 nt, Haemophilus influenzae Rd
caaaagccaauaagag

SEQ ID NO: 711839 - RNA, 20 nt, Haemophilus influenzae Rd
caaaagcaagaucuaaaaac

SEQ ID NO: 711840 - RNA, 14 nt, Haemophilus influenzae Rd
caaaagcaauaaug

SEQ ID NO: 711841 - RNA, 23 nt, Haemophilus influenzae Rd
caaaagaucaggaucaaaaauau

SEQ ID NO: 711842 - RNA, 16 nt, Haemophilus influenzae Rd
caaaaauauaaacuga

SEQ ID NO: 711843 - RNA, 11 nt, Haemophilus influenzae Rd
caaaaaucaac

SEQ ID NO: 711844 - RNA, 16 nt, Haemophilus influenzae Rd
caaaaauacguuguuu

SEQ ID NO: 711845 - RNA, 21 nt, Haemophilus influenzae Rd
caaaaauacguuguuuuucua

SEQ ID NO: 711846 - RNA, 18 nt, Haemophilus influenzae Rd
caaaaauagccuucauca

SEQ ID NO: 711847 - RNA, 12 nt, Haemophilus influenzae Rd
caaaaauuaaua

SEQ ID NO: 711848 - RNA, 15 nt, Haemophilus influenzae Rd
caaaaauacagccac

SEQ ID NO: 711849 - RNA, 18 nt, Haemophilus influenzae Rd
caaaaauacagccacuau

SEQ ID NO: 711850 - RNA, 19 nt, Haemophilus influenzae Rd
caaaaauacagccacuauu

SEQ ID NO: 711851 - RNA, 17 nt, Haemophilus influenzae Rd
caaaaauaaagcccugu

SEQ ID NO: 711852 - RNA, 21 nt, Haemophilus influenzae Rd
caaaaagcuuaauggcuugcu

SEQ ID NO: 711853 - RNA, 20 nt, Haemophilus influenzae Rd
caaaaagugcgguuaaaauu

SEQ ID NO: 711854 - RNA, 22 nt, Haemophilus influenzae Rd
caaaaagugcgguuaaaauuca

SEQ ID NO: 711855 - RNA, 13 nt, Haemophilus influenzae Rd
caaaaaauucuuu

SEQ ID NO: 711856 - RNA, 14 nt, Haemophilus influenzae Rd
caaaaaauacauug

SEQ ID NO: 711857 - RNA, 21 nt, Haemophilus influenzae Rd
caaaaaagugcgguaaaaauu

SEQ ID NO: 711858 - RNA, 13 nt, Haemophilus influenzae Rd
caaaaaccaaacu

SEQ ID NO: 711859 - RNA, 15 nt, Haemophilus influenzae Rd
caaaaacuucucuua

SEQ ID NO: 711860 - RNA, 15 nt, Haemophilus influenzae Rd
caaaaacuaaauauu

SEQ ID NO: 711861 - RNA, 18 nt, Haemophilus influenzae Rd
auuucucaccaaauuguu

SEQ ID NO: 711862 - RNA, 20 nt, Haemophilus influenzae Rd
auuucuaaaggcaauuccca

SEQ ID NO: 711863 - RNA, 13 nt, Haemophilus influenzae Rd
auuucuaaauaaa

SEQ ID NO: 711864 - RNA, 22 nt, Haemophilus influenzae Rd
auuucuaaaauaauaucacaac

SEQ ID NO: 711865 - RNA, 23 nt, Haemophilus influenzae Rd
auuucuaaaauaauaucacaacc

SEQ ID NO: 711866 - RNA, 11 nt, Haemophilus influenzae Rd
auuucaucgcg

SEQ ID NO: 711867 - RNA, 18 nt, Haemophilus influenzae Rd
auuucaucgcgcaaaaua

SEQ ID NO: 711868 - RNA, 18 nt, Haemophilus influenzae Rd
auuucaucgcguuuuuuc

SEQ ID NO: 711869 - RNA, 17 nt, Haemophilus influenzae Rd
auuucaucuacaccaaa

SEQ ID NO: 711870 - RNA, 16 nt, Haemophilus influenzae Rd
auuucaucuuuuaaau

SEQ ID NO: 711871 - RNA, 16 nt, Haemophilus influenzae Rd
auuucaucuguuggaa

SEQ ID NO: 711872 - RNA, 15 nt, Haemophilus influenzae Rd
auuucaucuucagua

SEQ ID NO: 711873 - RNA, 16 nt, Haemophilus influenzae Rd
auuucguuguuuuaau

SEQ ID NO: 711874 - RNA, 17 nt, Haemophilus influenzae Rd
auuucguuguuuuaaua

SEQ ID NO: 711875 - RNA, 19 nt, Haemophilus influenzae Rd
auuucguuuaauggacgga

SEQ ID NO: 711876 - RNA, 11 nt, Haemophilus influenzae Rd
auuucuucacu

SEQ ID NO: 711877 - RNA, 20 nt, Haemophilus influenzae Rd
auuucuucagcuuguuuaau

SEQ ID NO: 711878 - RNA, 12 nt, Haemophilus influenzae Rd
auuucuucaaag

SEQ ID NO: 711879 - RNA, 14 nt, Haemophilus influenzae Rd
auuucuucaacuaa

SEQ ID NO: 711880 - RNA, 14 nt, Haemophilus influenzae Rd
auuucuuaugaaaa

SEQ ID NO: 711881 - RNA, 17 nt, Haemophilus influenzae Rd
auuucuucuacaccuuc

SEQ ID NO: 711882 - RNA, 19 nt, Haemophilus influenzae Rd
auuucuucuaguuuuccuu

SEQ ID NO: 711883 - RNA, 17 nt, Haemophilus influenzae Rd
auuucuucgauuuuucu

SEQ ID NO: 711884 - RNA, 18 nt, Haemophilus influenzae Rd
auuucuucauuuuaaauu

SEQ ID NO: 711885 - RNA, 14 nt, Haemophilus influenzae Rd
auuugaguuauuuu

SEQ ID NO: 711886 - RNA, 13 nt, Haemophilus influenzae Rd
auuugagucucaa

SEQ ID NO: 711887 - RNA, 21 nt, Haemophilus influenzae Rd
auuugagucucaaauuuuuca

SEQ ID NO: 711888 - RNA, 19 nt, Haemophilus influenzae Rd
auuugaagaauuuguuguu

SEQ ID NO: 711889 - RNA, 15 nt, Haemophilus influenzae Rd
auuugaagauuaaau

SEQ ID NO: 711890 - RNA, 18 nt, Haemophilus influenzae Rd
auuugaagauuaaaugua

SEQ ID NO: 711891 - RNA, 22 nt, Haemophilus influenzae Rd
auuugaaacaauaaaacuuuau

SEQ ID NO: 711892 - RNA, 19 nt, Haemophilus influenzae Rd
auuucuuuuuuaucaaaaa

SEQ ID NO: 711893 - RNA, 17 nt, Haemophilus influenzae Rd
auuucuugaccuuucaa

SEQ ID NO: 711894 - RNA, 15 nt, Haemophilus influenzae Rd
auuuggaucuaaaaa

SEQ ID NO: 711895 - RNA, 21 nt, Haemophilus influenzae Rd
auuuggaucuaaaaaaucaau

SEQ ID NO: 711896 - RNA, 22 nt, Haemophilus influenzae Rd
auuuggaucuaaaaaaucaauc

SEQ ID NO: 711897 - RNA, 18 nt, Haemophilus influenzae Rd
auuugcucgcucgccaag

SEQ ID NO: 711898 - RNA, 15 nt, Haemophilus influenzae Rd
auuugcgucuuaaau

SEQ ID NO: 711899 - RNA, 21 nt, Haemophilus influenzae Rd
auuugcgggguuuuguuuuau

SEQ ID NO: 711900 - RNA, 20 nt, Haemophilus influenzae Rd
auuugggagagaggaaucua

SEQ ID NO: 711901 - RNA, 17 nt, Haemophilus influenzae Rd
auuuggcugauauauua

SEQ ID NO: 711902 - RNA, 16 nt, Haemophilus influenzae Rd
auuuggcucacaagac

SEQ ID NO: 711903 - RNA, 15 nt, Haemophilus influenzae Rd
auuuggcauagaaaa

SEQ ID NO: 711904 - RNA, 13 nt, Haemophilus influenzae Rd
auuuggcauuuug

SEQ ID NO: 711905 - RNA, 15 nt, Haemophilus influenzae Rd
auuuggcauuuugua

SEQ ID NO: 711906 - RNA, 15 nt, Haemophilus influenzae Rd
auuuggggcguggau

SEQ ID NO: 711907 - RNA, 20 nt, Haemophilus influenzae Rd
auuugauuucagaacaugac

SEQ ID NO: 711908 - RNA, 17 nt, Haemophilus influenzae Rd
auuugccccaauauuuu

SEQ ID NO: 711909 - RNA, 20 nt, Haemophilus influenzae Rd
auuugccccaauauuuuuca

SEQ ID NO: 711910 - RNA, 17 nt, Haemophilus influenzae Rd
auuugcgaugauaaagu

SEQ ID NO: 711911 - RNA, 15 nt, Haemophilus influenzae Rd
auuugaugcucagaa

SEQ ID NO: 711912 - RNA, 19 nt, Haemophilus influenzae Rd
auuugauuaucuagcacaa

SEQ ID NO: 711913 - RNA, 20 nt, Haemophilus influenzae Rd
auuugaucuucccagaaugg

SEQ ID NO: 711914 - RNA, 20 nt, Haemophilus influenzae Rd
auuuguuaagugaucuugau

SEQ ID NO: 711915 - RNA, 20 nt, Haemophilus influenzae Rd
auuuguuagaaauacauuau

SEQ ID NO: 711916 - RNA, 23 nt, Haemophilus influenzae Rd
auuuguuagaaauacauuauuaa

SEQ ID NO: 711917 - RNA, 16 nt, Haemophilus influenzae Rd
auuuguuacuaaaaua

SEQ ID NO: 711918 - RNA, 18 nt, Haemophilus influenzae Rd
auuuguuacuaaaauaau

SEQ ID NO: 711919 - RNA, 13 nt, Haemophilus influenzae Rd
auuuguucaagau

SEQ ID NO: 711920 - RNA, 15 nt, Haemophilus influenzae Rd
auuuuaaacagcaaa

SEQ ID NO: 711921 - RNA, 12 nt, Haemophilus influenzae Rd
auuuuaaaauuu

SEQ ID NO: 711922 - RNA, 12 nt, Haemophilus influenzae Rd
auuugugaugaa

SEQ ID NO: 711923 - RNA, 18 nt, Haemophilus influenzae Rd
auuuggucuaacauuuca

SEQ ID NO: 711924 - RNA, 13 nt, Haemophilus influenzae Rd
auuuucucuugca

SEQ ID NO: 711925 - RNA, 18 nt, Haemophilus influenzae Rd
auuuucuuauugaagaaa

SEQ ID NO: 711926 - RNA, 20 nt, Haemophilus influenzae Rd
auuuucugugagucuugcuu

SEQ ID NO: 711927 - RNA, 16 nt, Haemophilus influenzae Rd
auuuuccuucuauauc

SEQ ID NO: 711928 - RNA, 21 nt, Haemophilus influenzae Rd
auuuuccuucuauaucagaaa

SEQ ID NO: 711929 - RNA, 17 nt, Haemophilus influenzae Rd
auuuuccucgacauaaa

SEQ ID NO: 711930 - RNA, 18 nt, Haemophilus influenzae Rd
auuuuccucgacauaaaa

SEQ ID NO: 711931 - RNA, 17 nt, Haemophilus influenzae Rd
auuuuccucuuuuaugu

SEQ ID NO: 711932 - RNA, 19 nt, Haemophilus influenzae Rd
auuuuccucuuuuauguuu

SEQ ID NO: 711933 - RNA, 19 nt, Haemophilus influenzae Rd
auuuucaucguuaauuaau

SEQ ID NO: 711934 - RNA, 20 nt, Haemophilus influenzae Rd
auuuuguuacucgcaucaau

SEQ ID NO: 711935 - RNA, 22 nt, Haemophilus influenzae Rd
auuuuguuagcggauaaaauaa

SEQ ID NO: 711936 - RNA, 16 nt, Haemophilus influenzae Rd
auuuuguguuugaaaa

SEQ ID NO: 711937 - RNA, 20 nt, Haemophilus influenzae Rd
auuuuguuaaaaguuagauu

SEQ ID NO: 711938 - RNA, 17 nt, Haemophilus influenzae Rd
auuuuguuucuaaauua

SEQ ID NO: 711939 - RNA, 14 nt, Haemophilus influenzae Rd
auuuugucaccaaa

SEQ ID NO: 711940 - RNA, 20 nt, Haemophilus influenzae Rd
auuuugucaccaaauacauu

SEQ ID NO: 711941 - RNA, 16 nt, Haemophilus influenzae Rd
auuuugucagauuuau

SEQ ID NO: 711942 - RNA, 20 nt, Haemophilus influenzae Rd
auuuuguauauugugacaaa

SEQ ID NO: 711943 - RNA, 23 nt, Haemophilus influenzae Rd
auuuuguggcaaucguucuaaaa

SEQ ID NO: 711944 - RNA, 20 nt, Haemophilus influenzae Rd
auuuugagauaaauuuuuag

SEQ ID NO: 711945 - RNA, 13 nt, Haemophilus influenzae Rd
auuuugagauaga

SEQ ID NO: 711946 - RNA, 17 nt, Haemophilus influenzae Rd
auuuugacuuucgagua

SEQ ID NO: 711947 - RNA, 14 nt, Haemophilus influenzae Rd
auuuugagccauuu

SEQ ID NO: 711948 - RNA, 17 nt, Haemophilus influenzae Rd
auuuugaggaauaaauu

SEQ ID NO: 711949 - RNA, 14 nt, Haemophilus influenzae Rd
auuuugaugaaagu

SEQ ID NO: 711950 - RNA, 15 nt, Haemophilus influenzae Rd
auuuugaugaaaguu

SEQ ID NO: 711951 - RNA, 19 nt, Haemophilus influenzae Rd
auuuugaugaaaguugaau

SEQ ID NO: 711952 - RNA, 10 nt, Haemophilus influenzae Rd
auuuugauug

SEQ ID NO: 711953 - RNA, 17 nt, Haemophilus influenzae Rd
auuuugcaacuguuuau

SEQ ID NO: 711954 - RNA, 21 nt, Haemophilus influenzae Rd
auuuugcaagguuuccaagaa

SEQ ID NO: 711955 - RNA, 17 nt, Haemophilus influenzae Rd
auuuucagcguuuucaa

SEQ ID NO: 711956 - RNA, 20 nt, Haemophilus influenzae Rd
auuuucagaaaguguuuuac

SEQ ID NO: 711957 - RNA, 18 nt, Haemophilus influenzae Rd
auuuucagcaaaaugcgu

SEQ ID NO: 711958 - RNA, 12 nt, Haemophilus influenzae Rd
auuuucaucaau

SEQ ID NO: 711959 - RNA, 13 nt, Haemophilus influenzae Rd
auuuucaucaauu

SEQ ID NO: 711960 - RNA, 20 nt, Haemophilus influenzae Rd
auuuucaggugcuauuuuau

SEQ ID NO: 711961 - RNA, 18 nt, Haemophilus influenzae Rd
auuuucaauggcaucaau

SEQ ID NO: 711962 - RNA, 19 nt, Haemophilus influenzae Rd
auuuucaauggcaucaaua

SEQ ID NO: 711963 - RNA, 17 nt, Haemophilus influenzae Rd
auuuucaaugguuuaua

SEQ ID NO: 711964 - RNA, 20 nt, Haemophilus influenzae Rd
auuuucaauagccaauaaua

SEQ ID NO: 711965 - RNA, 16 nt, Haemophilus influenzae Rd
auuuucaaucccuucu

SEQ ID NO: 711966 - RNA, 22 nt, Haemophilus influenzae Rd
auuuucaaucccuucugcucca

SEQ ID NO: 711967 - RNA, 21 nt, Haemophilus influenzae Rd
auuuuaucuugcugcuuugag

SEQ ID NO: 711968 - RNA, 23 nt, Haemophilus influenzae Rd
auuuuagauuggauggagagaau

SEQ ID NO: 711969 - RNA, 15 nt, Haemophilus influenzae Rd
auuuuaugaaaucuu

SEQ ID NO: 711970 - RNA, 19 nt, Haemophilus influenzae Rd
auuuuauggcugcugcaau

SEQ ID NO: 711971 - RNA, 19 nt, Haemophilus influenzae Rd
auuuuacuugugcauuugg

SEQ ID NO: 711972 - RNA, 15 nt, Haemophilus influenzae Rd
auuuuacuuguuuau

SEQ ID NO: 711973 - RNA, 18 nt, Haemophilus influenzae Rd
auuuuacuuuuucuaaua

SEQ ID NO: 711974 - RNA, 21 nt, Haemophilus influenzae Rd
auuuuagaggcuaugauuuua

SEQ ID NO: 711975 - RNA, 23 nt, Haemophilus influenzae Rd
auuuuagaggcuaugauuuuaaa

SEQ ID NO: 711976 - RNA, 16 nt, Haemophilus influenzae Rd
auuuuagaauccaaaa

SEQ ID NO: 711977 - RNA, 18 nt, Haemophilus influenzae Rd
auuuuagaauccaaaauu

SEQ ID NO: 711978 - RNA, 19 nt, Haemophilus influenzae Rd
auuuuagaauccaaaauua

SEQ ID NO: 711979 - RNA, 20 nt, Haemophilus influenzae Rd
auuuuagaaaaaucgaagaa

SEQ ID NO: 711980 - RNA, 21 nt, Haemophilus influenzae Rd
auuuuagaaaaaucgaagaaa

SEQ ID NO: 711981 - RNA, 21 nt, Haemophilus influenzae Rd
auuuuacguaguacaucauuu

SEQ ID NO: 711982 - RNA, 20 nt, Haemophilus influenzae Rd
auuuuacguauguauuuuca

SEQ ID NO: 711983 - RNA, 18 nt, Haemophilus influenzae Rd
auuuuacguuggucugca

SEQ ID NO: 711984 - RNA, 17 nt, Haemophilus influenzae Rd
auuuuacguuucauuuu

SEQ ID NO: 711985 - RNA, 20 nt, Haemophilus influenzae Rd
auuuuacguuucauuuuugc

SEQ ID NO: 711986 - RNA, 15 nt, Haemophilus influenzae Rd
auuuuacguuuuaaa

SEQ ID NO: 711987 - RNA, 17 nt, Haemophilus influenzae Rd
auuuuacguuuuaaauu

SEQ ID NO: 711988 - RNA, 18 nt, Haemophilus influenzae Rd
auuuuaauaaagauaaau

SEQ ID NO: 711989 - RNA, 13 nt, Haemophilus influenzae Rd
auuuuaaaaucau

SEQ ID NO: 711990 - RNA, 14 nt, Haemophilus influenzae Rd
auuuuaaauaaaaa

SEQ ID NO: 711991 - RNA, 19 nt, Haemophilus influenzae Rd
auuuuaaauaaaaaauaaa

SEQ ID NO: 711992 - RNA, 15 nt, Haemophilus influenzae Rd
auuuuaaauaaaaua

SEQ ID NO: 711993 - RNA, 20 nt, Haemophilus influenzae Rd
auuuuaaauaaaauauuuaa

SEQ ID NO: 711994 - RNA, 17 nt, Haemophilus influenzae Rd
auuuuaaauaaauaaua

SEQ ID NO: 711995 - RNA, 16 nt, Haemophilus influenzae Rd
auuuuaaauaauuaaa

SEQ ID NO: 711996 - RNA, 20 nt, Haemophilus influenzae Rd
auuuuaaauaauuaaaaaua

SEQ ID NO: 711997 - RNA, 13 nt, Haemophilus influenzae Rd
auucuuaaaucau

SEQ ID NO: 711998 - RNA, 16 nt, Haemophilus influenzae Rd
auucuuaaaucauaaa

SEQ ID NO: 711999 - RNA, 16 nt, Haemophilus influenzae Rd
auucuuaaaugggaaa

SEQ ID NO: 712000 - RNA, 15 nt, Haemophilus influenzae Rd
auucuggcaauauuu

SEQ ID NO: 712001 - RNA, 17 nt, Haemophilus influenzae Rd
auucuggcaauauuuca

SEQ ID NO: 712002 - RNA, 16 nt, Haemophilus influenzae Rd
auucucgguuguuuca

SEQ ID NO: 712003 - RNA, 16 nt, Haemophilus influenzae Rd
auucuccuuaauuuca

SEQ ID NO: 712004 - RNA, 21 nt, Haemophilus influenzae Rd
auucuccuugguuuucuugcc

SEQ ID NO: 712005 - RNA, 15 nt, Haemophilus influenzae Rd
auucuccguaaaaau

SEQ ID NO: 712006 - RNA, 13 nt, Haemophilus influenzae Rd
auucugcuuguuc

SEQ ID NO: 712007 - RNA, 18 nt, Haemophilus influenzae Rd
auucugcucugcaccauc

SEQ ID NO: 712008 - RNA, 23 nt, Haemophilus influenzae Rd
auucagcgagagaauauuuagau

SEQ ID NO: 712009 - RNA, 13 nt, Haemophilus influenzae Rd
auucagcacuuuc

SEQ ID NO: 712010 - RNA, 23 nt, Haemophilus influenzae Rd
auucagcacuuucgcuuaaaaau

SEQ ID NO: 712011 - RNA, 16 nt, Haemophilus influenzae Rd
auucagcaaaaucacu

SEQ ID NO: 712012 - RNA, 19 nt, Haemophilus influenzae Rd
auucagggauuaagaaaau

SEQ ID NO: 712013 - RNA, 13 nt, Haemophilus influenzae Rd
auucuauuuuaaa

SEQ ID NO: 712014 - RNA, 19 nt, Haemophilus influenzae Rd
auucuccgcauuuuuuuau

SEQ ID NO: 712015 - RNA, 22 nt, Haemophilus influenzae Rd
auucaggugggaaauaauuuuc

SEQ ID NO: 712016 - RNA, 21 nt, Haemophilus influenzae Rd
auucuagcuguaacagcuaga

SEQ ID NO: 712017 - RNA, 22 nt, Haemophilus influenzae Rd
auucuauaauccgcagaauuua

SEQ ID NO: 712018 - RNA, 22 nt, Haemophilus influenzae Rd
auugacuaagauucgcacguuu

SEQ ID NO: 712019 - RNA, 19 nt, Haemophilus influenzae Rd
auugacggugcauuugcau

SEQ ID NO: 712020 - RNA, 15 nt, Haemophilus influenzae Rd
auugacguaaaaguu

SEQ ID NO: 712021 - RNA, 21 nt, Haemophilus influenzae Rd
auugaccgccacgagcucgca

SEQ ID NO: 712022 - RNA, 12 nt, Haemophilus influenzae Rd
auugaaucaauu

SEQ ID NO: 712023 - RNA, 13 nt, Haemophilus influenzae Rd
auugagcauuuuu

SEQ ID NO: 712024 - RNA, 22 nt, Haemophilus influenzae Rd
auugagcauuuuuuauuaaaaa

SEQ ID NO: 712025 - RNA, 17 nt, Haemophilus influenzae Rd
auugacuuguuuuaaaa

SEQ ID NO: 712026 - RNA, 20 nt, Haemophilus influenzae Rd
auugacuuguuuuaaaacua

SEQ ID NO: 712027 - RNA, 18 nt, Haemophilus influenzae Rd
auugacuugcacaauuac

SEQ ID NO: 712028 - RNA, 20 nt, Haemophilus influenzae Rd
auugaaaauuaaacgauaaa

SEQ ID NO: 712029 - RNA, 21 nt, Haemophilus influenzae Rd
auugaaaccugaguaaauaaa

SEQ ID NO: 712030 - RNA, 23 nt, Haemophilus influenzae Rd
auucuuuuuucuuccuaugaaua

SEQ ID NO: 712031 - RNA, 20 nt, Haemophilus influenzae Rd
auucuucaaguguuuuugcu

SEQ ID NO: 712032 - RNA, 18 nt, Haemophilus influenzae Rd
auucuucaauaacaacug

SEQ ID NO: 712033 - RNA, 23 nt, Haemophilus influenzae Rd
auucuucaauaacaacuggaauu

SEQ ID NO: 712034 - RNA, 17 nt, Haemophilus influenzae Rd
auucuucagaacugcuu

SEQ ID NO: 712035 - RNA, 18 nt, Haemophilus influenzae Rd
auucuuagcuuuagcaau

SEQ ID NO: 712036 - RNA, 14 nt, Haemophilus influenzae Rd
auugccgaagccau

SEQ ID NO: 712037 - RNA, 13 nt, Haemophilus influenzae Rd
auugccuaauaaa

SEQ ID NO: 712038 - RNA, 16 nt, Haemophilus influenzae Rd
auugccuaauaaaaaa

SEQ ID NO: 712039 - RNA, 20 nt, Haemophilus influenzae Rd
auugccuaauagaaaaaugc

SEQ ID NO: 712040 - RNA, 21 nt, Haemophilus influenzae Rd
auugccuaaauacaucacuaa

SEQ ID NO: 712041 - RNA, 13 nt, Haemophilus influenzae Rd
auugcacuucacc

SEQ ID NO: 712042 - RNA, 15 nt, Haemophilus influenzae Rd
auugcacuaauaaau

SEQ ID NO: 712043 - RNA, 21 nt, Haemophilus influenzae Rd
auugcaccaucguuaaaccaa

SEQ ID NO: 712044 - RNA, 13 nt, Haemophilus influenzae Rd
auugaggaaaguu

SEQ ID NO: 712045 - RNA, 18 nt, Haemophilus influenzae Rd
auugagcgauagaaauaa

SEQ ID NO: 712046 - RNA, 15 nt, Haemophilus influenzae Rd
auugagcgauugaac

SEQ ID NO: 712047 - RNA, 19 nt, Haemophilus influenzae Rd
auugauuucucugacguaa

SEQ ID NO: 712048 - RNA, 20 nt, Haemophilus influenzae Rd
auugauuucauauauugugu

SEQ ID NO: 712049 - RNA, 14 nt, Haemophilus influenzae Rd
auugauuuccaguu

SEQ ID NO: 712050 - RNA, 17 nt, Haemophilus influenzae Rd
auugauuuccaguuacu

SEQ ID NO: 712051 - RNA, 18 nt, Haemophilus influenzae Rd
auugauuuccaguuacuu

SEQ ID NO: 712052 - RNA, 13 nt, Haemophilus influenzae Rd
auugaguuuaguc

SEQ ID NO: 712053 - RNA, 17 nt, Haemophilus influenzae Rd
auugaguucucguugca

SEQ ID NO: 712054 - RNA, 15 nt, Haemophilus influenzae Rd
auugcaccaaauuuc

SEQ ID NO: 712055 - RNA, 23 nt, Haemophilus influenzae Rd
auugcaagugcaguuucaguauc

SEQ ID NO: 712056 - RNA, 14 nt, Haemophilus influenzae Rd
auugcaauaaccac

SEQ ID NO: 712057 - RNA, 17 nt, Haemophilus influenzae Rd
auugcaauaaucacagu

SEQ ID NO: 712058 - RNA, 23 nt, Haemophilus influenzae Rd
auugauuuguuacuaaaauaauu

SEQ ID NO: 712059 - RNA, 19 nt, Haemophilus influenzae Rd
auugauuuuaaagaauguu

SEQ ID NO: 712060 - RNA, 17 nt, Haemophilus influenzae Rd
auugauuuucuuucugc

SEQ ID NO: 712061 - RNA, 22 nt, Haemophilus influenzae Rd
auugcaaaaaugcaaaguaacu

SEQ ID NO: 712062 - RNA, 16 nt, Haemophilus influenzae Rd
auuggauugaaucaau

SEQ ID NO: 712063 - RNA, 13 nt, Haemophilus influenzae Rd
auuggggaacgga

SEQ ID NO: 712064 - RNA, 18 nt, Haemophilus influenzae Rd
auuggggcgaccauuaca

SEQ ID NO: 712065 - RNA, 14 nt, Haemophilus influenzae Rd
auugggauuauuuu

SEQ ID NO: 712066 - RNA, 20 nt, Haemophilus influenzae Rd
auugggauuauuuuuguggc

SEQ ID NO: 712067 - RNA, 18 nt, Haemophilus influenzae Rd
auugcuuguuucauacaa

SEQ ID NO: 712068 - RNA, 18 nt, Haemophilus influenzae Rd
auugcuugcauucacaaa

SEQ ID NO: 712069 - RNA, 15 nt, Haemophilus influenzae Rd
auugcuuaacauuaa

SEQ ID NO: 712070 - RNA, 19 nt, Haemophilus influenzae Rd
auuggacugcauauucaua

SEQ ID NO: 712071 - RNA, 10 nt, Haemophilus influenzae Rd
auuggauaaa

SEQ ID NO: 712072 - RNA, 21 nt, Haemophilus influenzae Rd
auuggauaaauuauucugcaa

SEQ ID NO: 712073 - RNA, 19 nt, Haemophilus influenzae Rd
auugccuucauauaauaaa

SEQ ID NO: 712074 - RNA, 13 nt, Haemophilus influenzae Rd
auugcuaaauuua

SEQ ID NO: 712075 - RNA, 13 nt, Haemophilus influenzae Rd
auugcuacagcaa

SEQ ID NO: 712076 - RNA, 14 nt, Haemophilus influenzae Rd
auugcuagccaaua

SEQ ID NO: 712077 - RNA, 21 nt, Haemophilus influenzae Rd
auugcucgacaaagauuuucu

SEQ ID NO: 712078 - RNA, 15 nt, Haemophilus influenzae Rd
auugcucugcuuuau

SEQ ID NO: 712079 - RNA, 19 nt, Haemophilus influenzae Rd
auugcucgugcaggauaaa

SEQ ID NO: 712080 - RNA, 16 nt, Haemophilus influenzae Rd
auugcucguuauuauu

SEQ ID NO: 712081 - RNA, 19 nt, Haemophilus influenzae Rd
auugcugugcgaccugaag

SEQ ID NO: 712082 - RNA, 18 nt, Haemophilus influenzae Rd
auugcuguugguuuucca

SEQ ID NO: 712083 - RNA, 23 nt, Haemophilus influenzae Rd
auuuaaccacuugucauuaaaaa

SEQ ID NO: 712084 - RNA, 16 nt, Haemophilus influenzae Rd
auuuaacacuuuuucu

SEQ ID NO: 712085 - RNA, 19 nt, Haemophilus influenzae Rd
auuuaacauaacuuuccau

SEQ ID NO: 712086 - RNA, 16 nt, Haemophilus influenzae Rd
auuuaacauaauuuau

SEQ ID NO: 712087 - RNA, 15 nt, Haemophilus influenzae Rd
auuuaacaucaugaa

SEQ ID NO: 712088 - RNA, 12 nt, Haemophilus influenzae Rd
auuuaacaaguu

SEQ ID NO: 712089 - RNA, 18 nt, Haemophilus influenzae Rd
auuuaacaaguuuagauu

SEQ ID NO: 712090 - RNA, 12 nt, Haemophilus influenzae Rd
auuuaacaauaa

SEQ ID NO: 712091 - RNA, 17 nt, Haemophilus influenzae Rd
auuuaacaaugaaauua

SEQ ID NO: 712092 - RNA, 16 nt, Haemophilus influenzae Rd
auuuaaauuaaaaaga

SEQ ID NO: 712093 - RNA, 23 nt, Haemophilus influenzae Rd
auuuaaauuaaaaagacuaaacu

SEQ ID NO: 712094 - RNA, 13 nt, Haemophilus influenzae Rd
auuuaaauuauua

SEQ ID NO: 712095 - RNA, 14 nt, Haemophilus influenzae Rd
auuuaaauauaauu

SEQ ID NO: 712096 - RNA, 17 nt, Haemophilus influenzae Rd
auuuaaaggacuaaauu

SEQ ID NO: 712097 - RNA, 20 nt, Haemophilus influenzae Rd
auuuaaaggcggauuuauua

SEQ ID NO: 712098 - RNA, 12 nt, Haemophilus influenzae Rd
auuguuuuaaaa

SEQ ID NO: 712099 - RNA, 24 nt, Haemophilus influenzae Rd
auuuaaauaaaacacaguuauuuu

SEQ ID NO: 712100 - RNA, 14 nt, Haemophilus influenzae Rd
auuuaaauaaaaua

SEQ ID NO: 712101 - RNA, 20 nt, Haemophilus influenzae Rd
auuuaaauaaggaucuugua

SEQ ID NO: 712102 - RNA, 22 nt, Haemophilus influenzae Rd
auuuaaauacacuucuaaaaua

SEQ ID NO: 712103 - RNA, 21 nt, Haemophilus influenzae Rd
auuuaaauagauccgcaauau

SEQ ID NO: 712104 - RNA, 17 nt, Haemophilus influenzae Rd
auuuaaacggauuaaca

SEQ ID NO: 712105 - RNA, 23 nt, Haemophilus influenzae Rd
auuguuuguuuuauuuauucugc

SEQ ID NO: 712106 - RNA, 22 nt, Haemophilus influenzae Rd
auuguuugcuaauguaguugga

SEQ ID NO: 712107 - RNA, 16 nt, Haemophilus influenzae Rd
auuguuguaaaauagu

SEQ ID NO: 712108 - RNA, 18 nt, Haemophilus influenzae Rd
auuguugcaccaauaauu

SEQ ID NO: 712109 - RNA, 14 nt, Haemophilus influenzae Rd
auuguuauagaaaa

SEQ ID NO: 712110 - RNA, 18 nt, Haemophilus influenzae Rd
auuguuaucuaaauaauu

SEQ ID NO: 712111 - RNA, 15 nt, Haemophilus influenzae Rd
auuguuaucuguaga

SEQ ID NO: 712112 - RNA, 14 nt, Haemophilus influenzae Rd
auuguuauugugau

SEQ ID NO: 712113 - RNA, 22 nt, Haemophilus influenzae Rd
auuguuccaauaggaaacuacu

SEQ ID NO: 712114 - RNA, 19 nt, Haemophilus influenzae Rd
auuguguguuuuaaaccac

SEQ ID NO: 712115 - RNA, 20 nt, Haemophilus influenzae Rd
auuguguugcccuagugcaa

SEQ ID NO: 712116 - RNA, 18 nt, Haemophilus influenzae Rd
auuguuaaaacgccauuc

SEQ ID NO: 712117 - RNA, 17 nt, Haemophilus influenzae Rd
auuguuaauuaucaaaa

SEQ ID NO: 712118 - RNA, 17 nt, Haemophilus influenzae Rd
auuguuaaauaaauccu

SEQ ID NO: 712119 - RNA, 18 nt, Haemophilus influenzae Rd
auuguuaaauaaauccuu

SEQ ID NO: 712120 - RNA, 20 nt, Haemophilus influenzae Rd
auuguccacagcaaaagaaa

SEQ ID NO: 712121 - RNA, 20 nt, Haemophilus influenzae Rd
auuguccuucauugauggaa

SEQ ID NO: 712122 - RNA, 23 nt, Haemophilus influenzae Rd
auugugauggggauuuuuuuguu

SEQ ID NO: 712123 - RNA, 18 nt, Haemophilus influenzae Rd
auugugcauaguuugugc

SEQ ID NO: 712124 - RNA, 18 nt, Haemophilus influenzae Rd
auugugagauaugaaaua

SEQ ID NO: 712125 - RNA, 23 nt, Haemophilus influenzae Rd
auugugaguucaacgacaauuaa

SEQ ID NO: 712126 - RNA, 15 nt, Haemophilus influenzae Rd
auugugauaauuaag

SEQ ID NO: 712127 - RNA, 22 nt, Haemophilus influenzae Rd
auugugccguauuuuuuacagu

SEQ ID NO: 712128 - RNA, 11 nt, Haemophilus influenzae Rd
auugugccaaa

SEQ ID NO: 712129 - RNA, 17 nt, Haemophilus influenzae Rd
auugugggcuuuaagcu

SEQ ID NO: 712130 - RNA, 21 nt, Haemophilus influenzae Rd
auugugggcuuuaagcuuuuc

SEQ ID NO: 712131 - RNA, 19 nt, Haemophilus influenzae Rd
auugugguauugauucaau

SEQ ID NO: 712132 - RNA, 16 nt, Haemophilus influenzae Rd
auugugucacauaauc

SEQ ID NO: 712133 - RNA, 17 nt, Haemophilus influenzae Rd
auugugucacuagauuu

SEQ ID NO: 712134 - RNA, 15 nt, Haemophilus influenzae Rd
auuguacuuuuugac

SEQ ID NO: 712135 - RNA, 22 nt, Haemophilus influenzae Rd
auuguacuucuuacguuuaaau

SEQ ID NO: 712136 - RNA, 23 nt, Haemophilus influenzae Rd
auuguacuucuuacguuuaaauu

SEQ ID NO: 712137 - RNA, 14 nt, Haemophilus influenzae Rd
auuguaauuuugug

SEQ ID NO: 712138 - RNA, 18 nt, Haemophilus influenzae Rd
auuguaguaauaaaaagc

SEQ ID NO: 712139 - RNA, 18 nt, Haemophilus influenzae Rd
auuggguuaauagcgaaa

SEQ ID NO: 712140 - RNA, 12 nt, Haemophilus influenzae Rd
auuggguuauaa

SEQ ID NO: 712141 - RNA, 19 nt, Haemophilus influenzae Rd
auugguaaaauuucuucua

SEQ ID NO: 712142 - RNA, 20 nt, Haemophilus influenzae Rd
auugguuggaaacgaauuua

SEQ ID NO: 712143 - RNA, 20 nt, Haemophilus influenzae Rd
auugguuuugugcuugcuuu

SEQ ID NO: 712144 - RNA, 17 nt, Haemophilus influenzae Rd
auuguaacuauaugaua

SEQ ID NO: 712145 - RNA, 17 nt, Haemophilus influenzae Rd
auuguaaaccaaauuuc

SEQ ID NO: 712146 - RNA, 17 nt, Haemophilus influenzae Rd
auuuaguccuuaaacaa

SEQ ID NO: 712147 - RNA, 19 nt, Haemophilus influenzae Rd
auuuaguccuuaauuuuau

SEQ ID NO: 712148 - RNA, 17 nt, Haemophilus influenzae Rd
auuuaguccuuuagaaa

SEQ ID NO: 712149 - RNA, 16 nt, Haemophilus influenzae Rd
auuuagauuacuuuua

SEQ ID NO: 712150 - RNA, 20 nt, Haemophilus influenzae Rd
auuuagaauuuuuauuuuua

SEQ ID NO: 712151 - RNA, 17 nt, Haemophilus influenzae Rd
auuuagagggauaaaaa

SEQ ID NO: 712152 - RNA, 19 nt, Haemophilus influenzae Rd
auuuagagggauaaaaauc

SEQ ID NO: 712153 - RNA, 11 nt, Haemophilus influenzae Rd
auuuagauaaa

SEQ ID NO: 712154 - RNA, 16 nt, Haemophilus influenzae Rd
auuuaauaagauuuuu

SEQ ID NO: 712155 - RNA, 21 nt, Haemophilus influenzae Rd
auuuaauaauaucaaucacuu

SEQ ID NO: 712156 - RNA, 13 nt, Haemophilus influenzae Rd
auuuaauaaugaa

SEQ ID NO: 712157 - RNA, 19 nt, Haemophilus influenzae Rd
auuuaauaccauacauaaa

SEQ ID NO: 712158 - RNA, 12 nt, Haemophilus influenzae Rd
auuuaauagcac

SEQ ID NO: 712159 - RNA, 23 nt, Haemophilus influenzae Rd
auuuaauaucuucuaauaaaaua

SEQ ID NO: 712160 - RNA, 15 nt, Haemophilus influenzae Rd
auuuagaaaguauaa

SEQ ID NO: 712161 - RNA, 14 nt, Haemophilus influenzae Rd
auuuaauauuucuu

SEQ ID NO: 712162 - RNA, 16 nt, Haemophilus influenzae Rd
auuuaauauuucuuca

SEQ ID NO: 712163 - RNA, 23 nt, Haemophilus influenzae Rd
auuuaauccugucaucuguaaac

SEQ ID NO: 712164 - RNA, 18 nt, Haemophilus influenzae Rd
auuuaucgccauagaaaa

SEQ ID NO: 712165 - RNA, 19 nt, Haemophilus influenzae Rd
auuuauccaauacugucgu

SEQ ID NO: 712166 - RNA, 20 nt, Haemophilus influenzae Rd
auuuauccguuuggagauaa

SEQ ID NO: 712167 - RNA, 19 nt, Haemophilus influenzae Rd
auuuaucgggaauaauauc

SEQ ID NO: 712168 - RNA, 13 nt, Haemophilus influenzae Rd
auuuaucuaaaag

SEQ ID NO: 712169 - RNA, 18 nt, Haemophilus influenzae Rd
auuuaucuaaaaguaauc

SEQ ID NO: 712170 - RNA, 13 nt, Haemophilus influenzae Rd
auuuauccaugac

SEQ ID NO: 712171 - RNA, 20 nt, Haemophilus influenzae Rd
auuuauccccaauuaaggau

SEQ ID NO: 712172 - RNA, 14 nt, Haemophilus influenzae Rd
auuuagugauuucu

SEQ ID NO: 712173 - RNA, 16 nt, Haemophilus influenzae Rd
auuuaguugaagaaau

SEQ ID NO: 712174 - RNA, 19 nt, Haemophilus influenzae Rd
auuuaguuggguauucacu

SEQ ID NO: 712175 - RNA, 20 nt, Haemophilus influenzae Rd
auuuaguuggguauucacuu

SEQ ID NO: 712176 - RNA, 21 nt, Haemophilus influenzae Rd
auuuaguuggguauucacuua

SEQ ID NO: 712177 - RNA, 22 nt, Haemophilus influenzae Rd
auuuauaaugcaaccaaacaaa

SEQ ID NO: 712178 - RNA, 21 nt, Haemophilus influenzae Rd
auuuauacacuuuuaacuuaa

SEQ ID NO: 712179 - RNA, 18 nt, Haemophilus influenzae Rd
auuuauacgcauaauaaa

SEQ ID NO: 712180 - RNA, 13 nt, Haemophilus influenzae Rd
auuuauacuuaau

SEQ ID NO: 712181 - RNA, 19 nt, Haemophilus influenzae Rd
auuucaucaggcauugcgc

SEQ ID NO: 712182 - RNA, 17 nt, Haemophilus influenzae Rd
auuucagcuuaaauacu

SEQ ID NO: 712183 - RNA, 14 nt, Haemophilus influenzae Rd
auuucagcaucaga

SEQ ID NO: 712184 - RNA, 19 nt, Haemophilus influenzae Rd
auuucagcaucagaaauac

SEQ ID NO: 712185 - RNA, 13 nt, Haemophilus influenzae Rd
auuucaaaaucac

SEQ ID NO: 712186 - RNA, 15 nt, Haemophilus influenzae Rd
auuucaaaaucacau

SEQ ID NO: 712187 - RNA, 15 nt, Haemophilus influenzae Rd
auuucaauauugucu

SEQ ID NO: 712188 - RNA, 13 nt, Haemophilus influenzae Rd
auuucaauauaag

SEQ ID NO: 712189 - RNA, 17 nt, Haemophilus influenzae Rd
auuucaacgaauaauuu

SEQ ID NO: 712190 - RNA, 16 nt, Haemophilus influenzae Rd
auuucaauaaauucac

SEQ ID NO: 712191 - RNA, 17 nt, Haemophilus influenzae Rd
auuuauuuugguauuuu

SEQ ID NO: 712192 - RNA, 18 nt, Haemophilus influenzae Rd
auuuauuuugguauuuuu

SEQ ID NO: 712193 - RNA, 22 nt, Haemophilus influenzae Rd
auuuauuuugguauuuuugugg

SEQ ID NO: 712194 - RNA, 16 nt, Haemophilus influenzae Rd
auuuauuugcuaaaau

SEQ ID NO: 712195 - RNA, 23 nt, Haemophilus influenzae Rd
auuuauuugcuaaaauuaccgcu

SEQ ID NO: 712196 - RNA, 15 nt, Haemophilus influenzae Rd
auuuauuucaauaua

SEQ ID NO: 712197 - RNA, 19 nt, Haemophilus influenzae Rd
auuuauuucaauauaauca

SEQ ID NO: 712198 - RNA, 15 nt, Haemophilus influenzae Rd
auuuauuugaaacaa

SEQ ID NO: 712199 - RNA, 16 nt, Haemophilus influenzae Rd
auuuauuuauuuuaau

SEQ ID NO: 712200 - RNA, 17 nt, Haemophilus influenzae Rd
auuuauuuccauaaaug

SEQ ID NO: 712201 - RNA, 23 nt, Haemophilus influenzae Rd
auuuauuguagccuaguauuuuu

SEQ ID NO: 712202 - RNA, 20 nt, Haemophilus influenzae Rd
auuuauuuaacaaugaaauu

SEQ ID NO: 712203 - RNA, 16 nt, Haemophilus influenzae Rd
auuuauuuacaucggu

SEQ ID NO: 712204 - RNA, 13 nt, Haemophilus influenzae Rd
auuuauucaaaau

SEQ ID NO: 712205 - RNA, 20 nt, Haemophilus influenzae Rd
auuuauuccugcuuuuuuca

SEQ ID NO: 712206 - RNA, 21 nt, Haemophilus influenzae Rd
auuuauuccuucaaucgcauc

SEQ ID NO: 712207 - RNA, 16 nt, Haemophilus influenzae Rd
auuuauucaaaauaaa

SEQ ID NO: 712208 - RNA, 20 nt, Haemophilus influenzae Rd
auuuauucaaaauaaaacca

SEQ ID NO: 712209 - RNA, 16 nt, Haemophilus influenzae Rd
auuuauucagcuuuaa

SEQ ID NO: 712210 - RNA, 16 nt, Haemophilus influenzae Rd
auuuauuccaucaaua

SEQ ID NO: 712211 - RNA, 18 nt, Haemophilus influenzae Rd
auuuauuccaucaauacc

SEQ ID NO: 712212 - RNA, 19 nt, Haemophilus influenzae Rd
auuuauucccccauuaaaa

SEQ ID NO: 712213 - RNA, 22 nt, Haemophilus influenzae Rd
auuuauucccccauuaaaagaa

SEQ ID NO: 712214 - RNA, 23 nt, Haemophilus influenzae Rd
auuuauucccccauuaaaagaag

SEQ ID NO: 712215 - RNA, 13 nt, Haemophilus influenzae Rd
auuuauuauauaa

SEQ ID NO: 712216 - RNA, 14 nt, Haemophilus influenzae Rd
auuuauuaagauau

SEQ ID NO: 712217 - RNA, 12 nt, Haemophilus influenzae Rd
auuuauuaaaaa

SEQ ID NO: 712218 - RNA, 18 nt, Haemophilus influenzae Rd
auuacgugcaaauaaauu

SEQ ID NO: 712219 - RNA, 15 nt, Haemophilus influenzae Rd
auuacguguuugguu

SEQ ID NO: 712220 - RNA, 16 nt, Haemophilus influenzae Rd
auuacguguuugguuu

SEQ ID NO: 712221 - RNA, 19 nt, Haemophilus influenzae Rd
auuacguucauauaaauuu

SEQ ID NO: 712222 - RNA, 21 nt, Haemophilus influenzae Rd
auuacucacuauaacuuuuca

SEQ ID NO: 712223 - RNA, 17 nt, Haemophilus influenzae Rd
auuacguagaaaacaau

SEQ ID NO: 712224 - RNA, 19 nt, Haemophilus influenzae Rd
auuacguagaaaacaauaa

SEQ ID NO: 712225 - RNA, 20 nt, Haemophilus influenzae Rd
auuacguagaaaacaauaaa

SEQ ID NO: 712226 - RNA, 22 nt, Haemophilus influenzae Rd
auuacgcuuuacuacaucaggu

SEQ ID NO: 712227 - RNA, 12 nt, Haemophilus influenzae Rd
auuacgcugucc

SEQ ID NO: 712228 - RNA, 23 nt, Haemophilus influenzae Rd
auuacgcaacgcuuguuugacug

SEQ ID NO: 712229 - RNA, 21 nt, Haemophilus influenzae Rd
auuacgauaguaaaaaaucaa

SEQ ID NO: 712230 - RNA, 16 nt, Haemophilus influenzae Rd
auuaccaggaaauauu

SEQ ID NO: 712231 - RNA, 19 nt, Haemophilus influenzae Rd
auuaccacugcauuuucuc

SEQ ID NO: 712232 - RNA, 17 nt, Haemophilus influenzae Rd
auuaccacgaguauauu

SEQ ID NO: 712233 - RNA, 20 nt, Haemophilus influenzae Rd
auuaccacaucauuauugcc

SEQ ID NO: 712234 - RNA, 15 nt, Haemophilus influenzae Rd
auuaccacaugcauu

SEQ ID NO: 712235 - RNA, 15 nt, Haemophilus influenzae Rd
auuacauucccaaau

SEQ ID NO: 712236 - RNA, 15 nt, Haemophilus influenzae Rd
auuaccauuugauau

SEQ ID NO: 712237 - RNA, 18 nt, Haemophilus influenzae Rd
auuaccccaauuccuugu

SEQ ID NO: 712238 - RNA, 16 nt, Haemophilus influenzae Rd
auuaccgcguaaaaau

SEQ ID NO: 712239 - RNA, 17 nt, Haemophilus influenzae Rd
auuaccgcguaaaaauu

SEQ ID NO: 712240 - RNA, 19 nt, Haemophilus influenzae Rd
auuacccguaccuuuaaau

SEQ ID NO: 712241 - RNA, 18 nt, Haemophilus influenzae Rd
auuacgacauucuuuaga

SEQ ID NO: 712242 - RNA, 17 nt, Haemophilus influenzae Rd
auuaccuuguuuugcaa

SEQ ID NO: 712243 - RNA, 17 nt, Haemophilus influenzae Rd
auuaccugccaaaccau

SEQ ID NO: 712244 - RNA, 17 nt, Haemophilus influenzae Rd
auuaccugugaaaacac

SEQ ID NO: 712245 - RNA, 15 nt, Haemophilus influenzae Rd
auuaccguguuuuuc

SEQ ID NO: 712246 - RNA, 16 nt, Haemophilus influenzae Rd
auuaccguguuuuuca

SEQ ID NO: 712247 - RNA, 22 nt, Haemophilus influenzae Rd
auuaccgcacuuuagguuuuau

SEQ ID NO: 712248 - RNA, 17 nt, Haemophilus influenzae Rd
auuaccgcacuuuuuau

SEQ ID NO: 712249 - RNA, 13 nt, Haemophilus influenzae Rd
auuaccuaaccaa

SEQ ID NO: 712250 - RNA, 14 nt, Haemophilus influenzae Rd
auuacaaguauaaa

SEQ ID NO: 712251 - RNA, 16 nt, Haemophilus influenzae Rd
auuaauuuuuuauaaa

SEQ ID NO: 712252 - RNA, 19 nt, Haemophilus influenzae Rd
auuaauuuuuuauaaaauu

SEQ ID NO: 712253 - RNA, 13 nt, Haemophilus influenzae Rd
auuacaaaaacac

SEQ ID NO: 712254 - RNA, 16 nt, Haemophilus influenzae Rd
auuacacagaugccau

SEQ ID NO: 712255 - RNA, 18 nt, Haemophilus influenzae Rd
auuacaauuuaagaucuu

SEQ ID NO: 712256 - RNA, 15 nt, Haemophilus influenzae Rd
auuacacaaaauauu

SEQ ID NO: 712257 - RNA, 21 nt, Haemophilus influenzae Rd
auuacacgagcaauggcaauu

SEQ ID NO: 712258 - RNA, 18 nt, Haemophilus influenzae Rd
auuacagaaucauuuuca

SEQ ID NO: 712259 - RNA, 17 nt, Haemophilus influenzae Rd
auuacagagccuagucc

SEQ ID NO: 712260 - RNA, 23 nt, Haemophilus influenzae Rd
auuacagugcgguuauuuaguuu

SEQ ID NO: 712261 - RNA, 15 nt, Haemophilus influenzae Rd
auuacauaaaaccaa

SEQ ID NO: 712262 - RNA, 16 nt, Haemophilus influenzae Rd
auuacauaaaaccaau

SEQ ID NO: 712263 - RNA, 19 nt, Haemophilus influenzae Rd
auuacaucuaaugccgcaa

SEQ ID NO: 712264 - RNA, 14 nt, Haemophilus influenzae Rd
auuacaucauuccg

SEQ ID NO: 712265 - RNA, 15 nt, Haemophilus influenzae Rd
auuacauccacuuuu

SEQ ID NO: 712266 - RNA, 12 nt, Haemophilus influenzae Rd
auuaauuugcug

SEQ ID NO: 712267 - RNA, 14 nt, Haemophilus influenzae Rd
auuaauuugcugaa

SEQ ID NO: 712268 - RNA, 17 nt, Haemophilus influenzae Rd
auuaauuugcugaaaua

SEQ ID NO: 712269 - RNA, 13 nt, Haemophilus influenzae Rd
auuaauuuuccua

SEQ ID NO: 712270 - RNA, 14 nt, Haemophilus influenzae Rd
auuacaaaaccaau

SEQ ID NO: 712271 - RNA, 15 nt, Haemophilus influenzae Rd
auuacaaaaccaauc

SEQ ID NO: 712272 - RNA, 18 nt, Haemophilus influenzae Rd
auuacaaaaccaaucaua

SEQ ID NO: 712273 - RNA, 21 nt, Haemophilus influenzae Rd
auuaauuggcgcaacaucaaa

SEQ ID NO: 712274 - RNA, 14 nt, Haemophilus influenzae Rd
auuaauuuaauucu

SEQ ID NO: 712275 - RNA, 17 nt, Haemophilus influenzae Rd
auuaauguuauuaaaua

SEQ ID NO: 712276 - RNA, 20 nt, Haemophilus influenzae Rd
auuaauuaacgcucaaaaau

SEQ ID NO: 712277 - RNA, 21 nt, Haemophilus influenzae Rd
auuaauuaacgcucaaaaauu

SEQ ID NO: 712278 - RNA, 20 nt, Haemophilus influenzae Rd
auuaauggguaaucaauauu

SEQ ID NO: 712279 - RNA, 23 nt, Haemophilus influenzae Rd
auuaauggguaaucaauauuuau

SEQ ID NO: 712280 - RNA, 19 nt, Haemophilus influenzae Rd
auuaauggcucgauuaaac

SEQ ID NO: 712281 - RNA, 18 nt, Haemophilus influenzae Rd
auuaauguaguaaauccc

SEQ ID NO: 712282 - RNA, 20 nt, Haemophilus influenzae Rd
auuaauuaccugccaaacca

SEQ ID NO: 712283 - RNA, 22 nt, Haemophilus influenzae Rd
auuaauuaccugccaaaccauc

SEQ ID NO: 712284 - RNA, 21 nt, Haemophilus influenzae Rd
auuaauuacuuuuauaucuau

SEQ ID NO: 712285 - RNA, 17 nt, Haemophilus influenzae Rd
auuaauugcuaccauuu

SEQ ID NO: 712286 - RNA, 21 nt, Haemophilus influenzae Rd
auuagucuacaagaaaccaaa

SEQ ID NO: 712287 - RNA, 20 nt, Haemophilus influenzae Rd
auuaguaucuuccauuaauu

SEQ ID NO: 712288 - RNA, 17 nt, Haemophilus influenzae Rd
auuagugaaugaugcca

SEQ ID NO: 712289 - RNA, 20 nt, Haemophilus influenzae Rd
auuagugaaugaugccauuu

SEQ ID NO: 712290 - RNA, 14 nt, Haemophilus influenzae Rd
auuaguggauguaa

SEQ ID NO: 712291 - RNA, 15 nt, Haemophilus influenzae Rd
auuagugugauuuua

SEQ ID NO: 712292 - RNA, 16 nt, Haemophilus influenzae Rd
auuagugugauuuuag

SEQ ID NO: 712293 - RNA, 19 nt, Haemophilus influenzae Rd
auuagugugauuuuagaaa

SEQ ID NO: 712294 - RNA, 17 nt, Haemophilus influenzae Rd
auuaguuagcuaaaaaa

SEQ ID NO: 712295 - RNA, 12 nt, Haemophilus influenzae Rd
auuaguuuuuua

SEQ ID NO: 712296 - RNA, 14 nt, Haemophilus influenzae Rd
auuaguuguuuuag

SEQ ID NO: 712297 - RNA, 16 nt, Haemophilus influenzae Rd
auuaguuguuuuaguu

SEQ ID NO: 712298 - RNA, 20 nt, Haemophilus influenzae Rd
auuaguuguuuuaguucuag

SEQ ID NO: 712299 - RNA, 20 nt, Haemophilus influenzae Rd
auuaguaagugcuuugagug

SEQ ID NO: 712300 - RNA, 21 nt, Haemophilus influenzae Rd
auuaguaauauauucuacgua

SEQ ID NO: 712301 - RNA, 18 nt, Haemophilus influenzae Rd
auuaguaguuagaauuuu

SEQ ID NO: 712302 - RNA, 24 nt, Haemophilus influenzae Rd
auuaguauaaacaucagugauuuu

SEQ ID NO: 712303 - RNA, 18 nt, Haemophilus influenzae Rd
auuagggauagcaucaca

SEQ ID NO: 712304 - RNA, 19 nt, Haemophilus influenzae Rd
auuaggcgacgcugcaaaa

SEQ ID NO: 712305 - RNA, 15 nt, Haemophilus influenzae Rd
auuaggaauaucuuu

SEQ ID NO: 712306 - RNA, 14 nt, Haemophilus influenzae Rd
auuauagagaaaua

SEQ ID NO: 712307 - RNA, 21 nt, Haemophilus influenzae Rd
auuauacaucggcgcaccaau

SEQ ID NO: 712308 - RNA, 20 nt, Haemophilus influenzae Rd
auuauauuccuuauucaaau

SEQ ID NO: 712309 - RNA, 19 nt, Haemophilus influenzae Rd
auuauauuguugcacauua

SEQ ID NO: 712310 - RNA, 16 nt, Haemophilus influenzae Rd
auuauauuuaauacuu

SEQ ID NO: 712311 - RNA, 21 nt, Haemophilus influenzae Rd
auuauauuuuccuguuaauuc

SEQ ID NO: 712312 - RNA, 22 nt, Haemophilus influenzae Rd
auuauauuuuccuguuaauucu

SEQ ID NO: 712313 - RNA, 13 nt, Haemophilus influenzae Rd
auuauauuuucua

SEQ ID NO: 712314 - RNA, 16 nt, Haemophilus influenzae Rd
auuauagaaaagacaa

SEQ ID NO: 712315 - RNA, 14 nt, Haemophilus influenzae Rd
auuacuuuuaucca

SEQ ID NO: 712316 - RNA, 19 nt, Haemophilus influenzae Rd
auuacuuuuuuaaguagua

SEQ ID NO: 712317 - RNA, 22 nt, Haemophilus influenzae Rd
auuacuuggggcuaauuuuuaa

SEQ ID NO: 712318 - RNA, 21 nt, Haemophilus influenzae Rd
auuacuuuccauaauagaaac

SEQ ID NO: 712319 - RNA, 11 nt, Haemophilus influenzae Rd
auuagaaauga

SEQ ID NO: 712320 - RNA, 12 nt, Haemophilus influenzae Rd
auuagaaaugau

SEQ ID NO: 712321 - RNA, 13 nt, Haemophilus influenzae Rd
auuagaaucaaug

SEQ ID NO: 712322 - RNA, 17 nt, Haemophilus influenzae Rd
auuagaaucaauggcuu

SEQ ID NO: 712323 - RNA, 23 nt, Haemophilus influenzae Rd
auuacucuuaauuuuugauuuaa

SEQ ID NO: 712324 - RNA, 18 nt, Haemophilus influenzae Rd
auuacugucgaaccaagu

SEQ ID NO: 712325 - RNA, 22 nt, Haemophilus influenzae Rd
auuacugucgaaccaaguugga

SEQ ID NO: 712326 - RNA, 12 nt, Haemophilus influenzae Rd
auuacuuaaagu

SEQ ID NO: 712327 - RNA, 19 nt, Haemophilus influenzae Rd
auuacuuacuacuuuggau

SEQ ID NO: 712328 - RNA, 17 nt, Haemophilus influenzae Rd
auuacuuagauauauua

SEQ ID NO: 712329 - RNA, 13 nt, Haemophilus influenzae Rd
auuacuugaaauu

SEQ ID NO: 712330 - RNA, 17 nt, Haemophilus influenzae Rd
auuagaugauuuuaaag

SEQ ID NO: 712331 - RNA, 20 nt, Haemophilus influenzae Rd
auuagcaaagaauuaaaaua

SEQ ID NO: 712332 - RNA, 15 nt, Haemophilus influenzae Rd
auuagcauaaaauua

SEQ ID NO: 712333 - RNA, 16 nt, Haemophilus influenzae Rd
auuagcguaaacauuu

SEQ ID NO: 712334 - RNA, 21 nt, Haemophilus influenzae Rd
auuagcgaaaauuuugccaau

SEQ ID NO: 712335 - RNA, 14 nt, Haemophilus influenzae Rd
auuagcuaaauacu

SEQ ID NO: 712336 - RNA, 13 nt, Haemophilus influenzae Rd
auuagacuuaauu

SEQ ID NO: 712337 - RNA, 20 nt, Haemophilus influenzae Rd
auuagacuuaauuucacauu

SEQ ID NO: 712338 - RNA, 16 nt, Haemophilus influenzae Rd
auuagagccaucaauu

SEQ ID NO: 712339 - RNA, 23 nt, Haemophilus influenzae Rd
auuagagccaucacguucaaaaa

SEQ ID NO: 712340 - RNA, 16 nt, Haemophilus influenzae Rd
auuagaucauaaaaaa

SEQ ID NO: 712341 - RNA, 20 nt, Haemophilus influenzae Rd
auuagaugacuggcaaaaau

SEQ ID NO: 712342 - RNA, 13 nt, Haemophilus influenzae Rd
auuagauuuauuu

SEQ ID NO: 712343 - RNA, 19 nt, Haemophilus influenzae Rd
auucaccgcacuuuucuuu

SEQ ID NO: 712344 - RNA, 21 nt, Haemophilus influenzae Rd
auucaccgcacuuuuuacuuu

SEQ ID NO: 712345 - RNA, 18 nt, Haemophilus influenzae Rd
auucaccgccuacaugau

SEQ ID NO: 712346 - RNA, 21 nt, Haemophilus influenzae Rd
auucaccccuucuguugccau

SEQ ID NO: 712347 - RNA, 18 nt, Haemophilus influenzae Rd
auucacauucuuuuaaau

SEQ ID NO: 712348 - RNA, 21 nt, Haemophilus influenzae Rd
auucacauucuuuuaaauaca

SEQ ID NO: 712349 - RNA, 15 nt, Haemophilus influenzae Rd
auucaauuacuauua

SEQ ID NO: 712350 - RNA, 17 nt, Haemophilus influenzae Rd
auucaaugcuuccuuca

SEQ ID NO: 712351 - RNA, 14 nt, Haemophilus influenzae Rd
auucaaugcaacaa

SEQ ID NO: 712352 - RNA, 14 nt, Haemophilus influenzae Rd
auucaaugcagaaa

SEQ ID NO: 712353 - RNA, 19 nt, Haemophilus influenzae Rd
auucaaugcagaaauacuu

SEQ ID NO: 712354 - RNA, 16 nt, Haemophilus influenzae Rd
auucaauuuuccccuc

SEQ ID NO: 712355 - RNA, 15 nt, Haemophilus influenzae Rd
auucagcaagaaacu

SEQ ID NO: 712356 - RNA, 14 nt, Haemophilus influenzae Rd
auucacuuucacau

SEQ ID NO: 712357 - RNA, 17 nt, Haemophilus influenzae Rd
auucacuuucacauaaa

SEQ ID NO: 712358 - RNA, 22 nt, Haemophilus influenzae Rd
auucacuuucacauaaauuaca

SEQ ID NO: 712359 - RNA, 17 nt, Haemophilus influenzae Rd
auucacuucuaaaacca

SEQ ID NO: 712360 - RNA, 14 nt, Haemophilus influenzae Rd
auucacuaacaaau

SEQ ID NO: 712361 - RNA, 17 nt, Haemophilus influenzae Rd
auucacgcucguuaaau

SEQ ID NO: 712362 - RNA, 23 nt, Haemophilus influenzae Rd
auucacgguguuuuuuaauaaaa

SEQ ID NO: 712363 - RNA, 22 nt, Haemophilus influenzae Rd
auucacgguguuuuuuuucuuu

SEQ ID NO: 712364 - RNA, 13 nt, Haemophilus influenzae Rd
auucacucaauuc

SEQ ID NO: 712365 - RNA, 20 nt, Haemophilus influenzae Rd
auucacgcauuuaaauaaaa

SEQ ID NO: 712366 - RNA, 21 nt, Haemophilus influenzae Rd
auucacgaucacuuguuuugu

SEQ ID NO: 712367 - RNA, 19 nt, Haemophilus influenzae Rd
auucaagccuucuaaaaua

SEQ ID NO: 712368 - RNA, 16 nt, Haemophilus influenzae Rd
auucaacuaaaggcac

SEQ ID NO: 712369 - RNA, 22 nt, Haemophilus influenzae Rd
auucaacuaaaggcacaaaaaa

SEQ ID NO: 712370 - RNA, 18 nt, Haemophilus influenzae Rd
auucaauagguuauaagu

SEQ ID NO: 712371 - RNA, 22 nt, Haemophilus influenzae Rd
auucaauagguuauaaguuuuu

SEQ ID NO: 712372 - RNA, 19 nt, Haemophilus influenzae Rd
auucaauacuuauauuauu

SEQ ID NO: 712373 - RNA, 19 nt, Haemophilus influenzae Rd
auucaauaauauauuuaau

SEQ ID NO: 712374 - RNA, 19 nt, Haemophilus influenzae Rd
auucaacacgccuaacaua

SEQ ID NO: 712375 - RNA, 11 nt, Haemophilus influenzae Rd
auucaaauaac

SEQ ID NO: 712376 - RNA, 18 nt, Haemophilus influenzae Rd
auucaacaauaauuuuua

SEQ ID NO: 712377 - RNA, 14 nt, Haemophilus influenzae Rd
auucaaaacauuaa

SEQ ID NO: 712378 - RNA, 22 nt, Haemophilus influenzae Rd
auucaaacguuaaaucacuuuc

SEQ ID NO: 712379 - RNA, 22 nt, Haemophilus influenzae Rd
auucaaacaggcuuauuaaaaa

SEQ ID NO: 712380 - RNA, 20 nt, Haemophilus influenzae Rd
auucaaacagguguguuuuu

SEQ ID NO: 712381 - RNA, 22 nt, Haemophilus influenzae Rd
auucaaacagguguguuuuuca

SEQ ID NO: 712382 - RNA, 20 nt, Haemophilus influenzae Rd
auucaaacgcguuaaaucac

SEQ ID NO: 712383 - RNA, 11 nt, Haemophilus influenzae Rd
auucaaaauuu

SEQ ID NO: 712384 - RNA, 16 nt, Haemophilus influenzae Rd
auuauuugauuuuuau

SEQ ID NO: 712385 - RNA, 18 nt, Haemophilus influenzae Rd
auuauuugcauauaaaaa

SEQ ID NO: 712386 - RNA, 21 nt, Haemophilus influenzae Rd
auuauuucguuguuuuaauaa

SEQ ID NO: 712387 - RNA, 22 nt, Haemophilus influenzae Rd
auuauuucguuguuuuaauaaa

SEQ ID NO: 712388 - RNA, 13 nt, Haemophilus influenzae Rd
auuauuucucuau

SEQ ID NO: 712389 - RNA, 19 nt, Haemophilus influenzae Rd
auuauuucaguaacuuuaa

SEQ ID NO: 712390 - RNA, 22 nt, Haemophilus influenzae Rd
auuauuucaguaacuuuaauaa

SEQ ID NO: 712391 - RNA, 14 nt, Haemophilus influenzae Rd
auuauuuuaaauaa

SEQ ID NO: 712392 - RNA, 16 nt, Haemophilus influenzae Rd
auuauuuuaaauaaau

SEQ ID NO: 712393 - RNA, 15 nt, Haemophilus influenzae Rd
auuauuggcuauuga

SEQ ID NO: 712394 - RNA, 19 nt, Haemophilus influenzae Rd
auuauugcacuaauaaaua

SEQ ID NO: 712395 - RNA, 17 nt, Haemophilus influenzae Rd
auuauugcauuuuuaac

SEQ ID NO: 712396 - RNA, 20 nt, Haemophilus influenzae Rd
auuauuguuuucugaacuaa

SEQ ID NO: 712397 - RNA, 21 nt, Haemophilus influenzae Rd
auuauugugauaauuaagguc

SEQ ID NO: 712398 - RNA, 22 nt, Haemophilus influenzae Rd
auuauuuaggggccuuuuuuau

SEQ ID NO: 712399 - RNA, 14 nt, Haemophilus influenzae Rd
auuauuuagauaua

SEQ ID NO: 712400 - RNA, 18 nt, Haemophilus influenzae Rd
auuauuuagauauaaaaa

SEQ ID NO: 712401 - RNA, 17 nt, Haemophilus influenzae Rd
auuauuuauuuaauuuc

SEQ ID NO: 712402 - RNA, 13 nt, Haemophilus influenzae Rd
auuauuuaaacuu

SEQ ID NO: 712403 - RNA, 23 nt, Haemophilus influenzae Rd
auuauuuaagccagaacauauaa

SEQ ID NO: 712404 - RNA, 15 nt, Haemophilus influenzae Rd
auuauuuaauacgaa

SEQ ID NO: 712405 - RNA, 16 nt, Haemophilus influenzae Rd
auuauuuaauuuuuua

SEQ ID NO: 712406 - RNA, 17 nt, Haemophilus influenzae Rd
auuauuuaauuuuuuau

SEQ ID NO: 712407 - RNA, 18 nt, Haemophilus influenzae Rd
auuauuccaaauaucuuc

SEQ ID NO: 712408 - RNA, 22 nt, Haemophilus influenzae Rd
auuauucucuauuaauuuuaaa

SEQ ID NO: 712409 - RNA, 19 nt, Haemophilus influenzae Rd
auuauugaagcacugaaau

SEQ ID NO: 712410 - RNA, 20 nt, Haemophilus influenzae Rd
auuauugaagcacugaaaua

SEQ ID NO: 712411 - RNA, 11 nt, Haemophilus influenzae Rd
auuauucuuuu

SEQ ID NO: 712412 - RNA, 21 nt, Haemophilus influenzae Rd
auuauucuuuucaacauucac

SEQ ID NO: 712413 - RNA, 16 nt, Haemophilus influenzae Rd
auuaugguuuugcugu

SEQ ID NO: 712414 - RNA, 14 nt, Haemophilus influenzae Rd
auuauguauuacca

SEQ ID NO: 712415 - RNA, 17 nt, Haemophilus influenzae Rd
auuauguauuaccauuu

SEQ ID NO: 712416 - RNA, 17 nt, Haemophilus influenzae Rd
auuauggaauggcauaa

SEQ ID NO: 712417 - RNA, 14 nt, Haemophilus influenzae Rd
auuaugcccaauua

SEQ ID NO: 712418 - RNA, 18 nt, Haemophilus influenzae Rd
auuauuaaauaaacgcuc

SEQ ID NO: 712419 - RNA, 16 nt, Haemophilus influenzae Rd
auuauuaaauccaaaa

SEQ ID NO: 712420 - RNA, 21 nt, Haemophilus influenzae Rd
auuauuaaguaauacauuuuc

SEQ ID NO: 712421 - RNA, 22 nt, Haemophilus influenzae Rd
auuauuaaguaauacauuuuca

SEQ ID NO: 712422 - RNA, 21 nt, Haemophilus influenzae Rd
auuauuaagucuauuacuaaa

SEQ ID NO: 712423 - RNA, 18 nt, Haemophilus influenzae Rd
auuauuaaccguuuuuau

SEQ ID NO: 712424 - RNA, 12 nt, Haemophilus influenzae Rd
auuauuagcaua

SEQ ID NO: 712425 - RNA, 19 nt, Haemophilus influenzae Rd
auuauuagcauaauaaaaa

SEQ ID NO: 712426 - RNA, 16 nt, Haemophilus influenzae Rd
auuaucaauguuugug

SEQ ID NO: 712427 - RNA, 15 nt, Haemophilus influenzae Rd
auuaucaauaauuaa

SEQ ID NO: 712428 - RNA, 20 nt, Haemophilus influenzae Rd
auuaucaaagaauuuuuuca

SEQ ID NO: 712429 - RNA, 20 nt, Haemophilus influenzae Rd
auuaucaaaagaaaagauga

SEQ ID NO: 712430 - RNA, 20 nt, Haemophilus influenzae Rd
auuaucaagcugauuuauca

SEQ ID NO: 712431 - RNA, 16 nt, Haemophilus influenzae Rd
auuaucaacaguaaau

SEQ ID NO: 712432 - RNA, 22 nt, Haemophilus influenzae Rd
auuaucaacaguaaauuuuucc

SEQ ID NO: 712433 - RNA, 23 nt, Haemophilus influenzae Rd
auuaucaacaguaaauuuuucca

SEQ ID NO: 712434 - RNA, 16 nt, Haemophilus influenzae Rd
auuaucauuaaauaua

SEQ ID NO: 712435 - RNA, 22 nt, Haemophilus influenzae Rd
auuaucauuaaauauaaugaau

SEQ ID NO: 712436 - RNA, 18 nt, Haemophilus influenzae Rd
auuaucgaauagauuuuu

SEQ ID NO: 712437 - RNA, 16 nt, Haemophilus influenzae Rd
auuauccguaaauuca

SEQ ID NO: 712438 - RNA, 22 nt, Haemophilus influenzae Rd
auuauccguaaauucaaauacu

SEQ ID NO: 712439 - RNA, 14 nt, Haemophilus influenzae Rd
auuauccuauagua

SEQ ID NO: 712440 - RNA, 15 nt, Haemophilus influenzae Rd
auuauccaacauuaa

SEQ ID NO: 712441 - RNA, 15 nt, Haemophilus influenzae Rd
auuauccacuaaaaa

SEQ ID NO: 712442 - RNA, 16 nt, Haemophilus influenzae Rd
auuauccacuaaaaaa

SEQ ID NO: 712443 - RNA, 18 nt, Haemophilus influenzae Rd
auuauccacuaaaaaacu

SEQ ID NO: 712444 - RNA, 15 nt, Haemophilus influenzae Rd
auuaucucgaauauc

SEQ ID NO: 712445 - RNA, 21 nt, Haemophilus influenzae Rd
auuaucuccaagaauauuuca

SEQ ID NO: 712446 - RNA, 17 nt, Haemophilus influenzae Rd
auuaucugaggauuaaa

SEQ ID NO: 712447 - RNA, 22 nt, Haemophilus influenzae Rd
auuaucugaggauuaaagggcu

SEQ ID NO: 712448 - RNA, 18 nt, Haemophilus influenzae Rd
auuaucuguaacaaguaa

SEQ ID NO: 712449 - RNA, 23 nt, Haemophilus influenzae Rd
auuaucuguaacaaguaauuuau

SEQ ID NO: 712450 - RNA, 21 nt, Haemophilus influenzae Rd
auuaucuguaauugagcauaa

SEQ ID NO: 712451 - RNA, 15 nt, Haemophilus influenzae Rd
auuaucuaaauuaca

SEQ ID NO: 712452 - RNA, 23 nt, Haemophilus influenzae Rd
auuaucuaaaccguuuagcaaac

SEQ ID NO: 712453 - RNA, 19 nt, Haemophilus influenzae Rd
auuaucgucuaucuaagau

SEQ ID NO: 712454 - RNA, 14 nt, Haemophilus influenzae Rd
auuaucguuuacuu

SEQ ID NO: 712455 - RNA, 19 nt, Haemophilus influenzae Rd
auuaucguuuacuuaaaau

SEQ ID NO: 712456 - RNA, 13 nt, Haemophilus influenzae Rd
auuaugaaauuug

SEQ ID NO: 712457 - RNA, 23 nt, Haemophilus influenzae Rd
auuaugaccuuuuuuuagaauua

SEQ ID NO: 712458 - RNA, 17 nt, Haemophilus influenzae Rd
auuaucuuuauuuguca

SEQ ID NO: 712459 - RNA, 20 nt, Haemophilus influenzae Rd
auguuugugcguuuuuuaau

SEQ ID NO: 712460 - RNA, 18 nt, Haemophilus influenzae Rd
auguuuuccccuuuuuaa

SEQ ID NO: 712461 - RNA, 12 nt, Haemophilus influenzae Rd
auguuuucagcu

SEQ ID NO: 712462 - RNA, 23 nt, Haemophilus influenzae Rd
auguuuugguuuucuuuuuuuca

SEQ ID NO: 712463 - RNA, 19 nt, Haemophilus influenzae Rd
auguuugaggaucacacaa

SEQ ID NO: 712464 - RNA, 18 nt, Haemophilus influenzae Rd
auguuugaucgguuuuau

SEQ ID NO: 712465 - RNA, 13 nt, Haemophilus influenzae Rd
auguuuggauaau

SEQ ID NO: 712466 - RNA, 19 nt, Haemophilus influenzae Rd
auguuucucucuauucauc

SEQ ID NO: 712467 - RNA, 22 nt, Haemophilus influenzae Rd
auguuucucucuauucaucuaa

SEQ ID NO: 712468 - RNA, 16 nt, Haemophilus influenzae Rd
auguuugaaggcaaaa

SEQ ID NO: 712469 - RNA, 19 nt, Haemophilus influenzae Rd
auguuugaaggcaaaauug

SEQ ID NO: 712470 - RNA, 17 nt, Haemophilus influenzae Rd
auguuuacuuaaaucuu

SEQ ID NO: 712471 - RNA, 22 nt, Haemophilus influenzae Rd
auguuuacuuaaaucuuuaccu

SEQ ID NO: 712472 - RNA, 21 nt, Haemophilus influenzae Rd
auguuuaagccaucacugcca

SEQ ID NO: 712473 - RNA, 22 nt, Haemophilus influenzae Rd
auguuuaccgcaaaauuauuug

SEQ ID NO: 712474 - RNA, 15 nt, Haemophilus influenzae Rd
auguucagccacuuc

SEQ ID NO: 712475 - RNA, 23 nt, Haemophilus influenzae Rd
auguucagccacuucuucaaaga

SEQ ID NO: 712476 - RNA, 15 nt, Haemophilus influenzae Rd
auguucauuuucuug

SEQ ID NO: 712477 - RNA, 14 nt, Haemophilus influenzae Rd
auguuguaaaauau

SEQ ID NO: 712478 - RNA, 11 nt, Haemophilus influenzae Rd
auuaaagugac

SEQ ID NO: 712479 - RNA, 19 nt, Haemophilus influenzae Rd
auuaaagucccaaaagcaa

SEQ ID NO: 712480 - RNA, 18 nt, Haemophilus influenzae Rd
auuaaagucuaauaugau

SEQ ID NO: 712481 - RNA, 19 nt, Haemophilus influenzae Rd
auuaaaguuacuuugcauu

SEQ ID NO: 712482 - RNA, 20 nt, Haemophilus influenzae Rd
auuaaauauaaugaauuaug

SEQ ID NO: 712483 - RNA, 17 nt, Haemophilus influenzae Rd
auuaaaucaaaaauuaa

SEQ ID NO: 712484 - RNA, 15 nt, Haemophilus influenzae Rd
auuaaaucaaauuua

SEQ ID NO: 712485 - RNA, 19 nt, Haemophilus influenzae Rd
auuaaauagcgaacaugcg

SEQ ID NO: 712486 - RNA, 20 nt, Haemophilus influenzae Rd
auuaaauagcgaucugcacu

SEQ ID NO: 712487 - RNA, 15 nt, Haemophilus influenzae Rd
auuaaagaaaauaca

SEQ ID NO: 712488 - RNA, 11 nt, Haemophilus influenzae Rd
auuaaacugau

SEQ ID NO: 712489 - RNA, 20 nt, Haemophilus influenzae Rd
auuaaacuggaugaaaucau

SEQ ID NO: 712490 - RNA, 22 nt, Haemophilus influenzae Rd
auuaaacggcucacauccauuc

SEQ ID NO: 712491 - RNA, 18 nt, Haemophilus influenzae Rd
auuaaacagccaaacaaa

SEQ ID NO: 712492 - RNA, 12 nt, Haemophilus influenzae Rd
auuaaacaaaaa

SEQ ID NO: 712493 - RNA, 16 nt, Haemophilus influenzae Rd
auuaaacaaaaaccau

SEQ ID NO: 712494 - RNA, 14 nt, Haemophilus influenzae Rd
auuaaacgcaacau

SEQ ID NO: 712495 - RNA, 13 nt, Haemophilus influenzae Rd
auguuuuucauuc

SEQ ID NO: 712496 - RNA, 15 nt, Haemophilus influenzae Rd
auguuuuuuagauuu

SEQ ID NO: 712497 - RNA, 15 nt, Haemophilus influenzae Rd
auguuuuuuccauuu

SEQ ID NO: 712498 - RNA, 13 nt, Haemophilus influenzae Rd
auuaaaaaaagca

SEQ ID NO: 712499 - RNA, 14 nt, Haemophilus influenzae Rd
auuaaaaaaagcaa

SEQ ID NO: 712500 - RNA, 17 nt, Haemophilus influenzae Rd
auuaaaaaaauaguuaa

SEQ ID NO: 712501 - RNA, 13 nt, Haemophilus influenzae Rd
auuaaaaacuaaa

SEQ ID NO: 712502 - RNA, 13 nt, Haemophilus influenzae Rd
auuaaaaaagcaa

SEQ ID NO: 712503 - RNA, 22 nt, Haemophilus influenzae Rd
auuaaaaaagcaagauacuuuu

SEQ ID NO: 712504 - RNA, 13 nt, Haemophilus influenzae Rd
auuaaaaaauaau

SEQ ID NO: 712505 - RNA, 15 nt, Haemophilus influenzae Rd
auuaaaaauuuaaaa

SEQ ID NO: 712506 - RNA, 12 nt, Haemophilus influenzae Rd
auuaaaaauaaa

SEQ ID NO: 712507 - RNA, 14 nt, Haemophilus influenzae Rd
auuaaaaucugugc

SEQ ID NO: 712508 - RNA, 13 nt, Haemophilus influenzae Rd
auuaaaaugguuu

SEQ ID NO: 712509 - RNA, 17 nt, Haemophilus influenzae Rd
auuaaaaucacauaaaa

SEQ ID NO: 712510 - RNA, 21 nt, Haemophilus influenzae Rd
auuaaaaucacauaaaaaaug

SEQ ID NO: 712511 - RNA, 22 nt, Haemophilus influenzae Rd
auuaaaaucacauaaaaaauga

SEQ ID NO: 712512 - RNA, 16 nt, Haemophilus influenzae Rd
auuaaaaggacuaaac

SEQ ID NO: 712513 - RNA, 21 nt, Haemophilus influenzae Rd
auuaaaacuugacguuguucu

SEQ ID NO: 712514 - RNA, 18 nt, Haemophilus influenzae Rd
auuaaaagaagcgaauau

SEQ ID NO: 712515 - RNA, 23 nt, Haemophilus influenzae Rd
auuaaaagguggaauuuuaguuu

SEQ ID NO: 712516 - RNA, 13 nt, Haemophilus influenzae Rd
auuaaaaguagaa

SEQ ID NO: 712517 - RNA, 22 nt, Haemophilus influenzae Rd
auuaaaagugcggugauuuuuu

SEQ ID NO: 712518 - RNA, 17 nt, Haemophilus influenzae Rd
auuaaaagugcgguuaa

SEQ ID NO: 712519 - RNA, 21 nt, Haemophilus influenzae Rd
auuaaaacccgaaccgauuuu

SEQ ID NO: 712520 - RNA, 17 nt, Haemophilus influenzae Rd
auuaaccgcacuuuaaa

SEQ ID NO: 712521 - RNA, 19 nt, Haemophilus influenzae Rd
auuaaccgcacuuuaaaua

SEQ ID NO: 712522 - RNA, 19 nt, Haemophilus influenzae Rd
auuaacuauuuuuuauuua

SEQ ID NO: 712523 - RNA, 15 nt, Haemophilus influenzae Rd
auuaacuaaaccauu

SEQ ID NO: 712524 - RNA, 18 nt, Haemophilus influenzae Rd
auuaacgggcuuaaacuu

SEQ ID NO: 712525 - RNA, 15 nt, Haemophilus influenzae Rd
auuaacgguuuucga

SEQ ID NO: 712526 - RNA, 23 nt, Haemophilus influenzae Rd
auuaagcacaggcguaauuaagg

SEQ ID NO: 712527 - RNA, 13 nt, Haemophilus influenzae Rd
auuaagcagcgaa

SEQ ID NO: 712528 - RNA, 12 nt, Haemophilus influenzae Rd
auuaagcaauag

SEQ ID NO: 712529 - RNA, 14 nt, Haemophilus influenzae Rd
auuaagaaguuauu

SEQ ID NO: 712530 - RNA, 20 nt, Haemophilus influenzae Rd
auuaacuuaucuaaaaagau

SEQ ID NO: 712531 - RNA, 15 nt, Haemophilus influenzae Rd
auuaagaaaauaaua

SEQ ID NO: 712532 - RNA, 17 nt, Haemophilus influenzae Rd
auuaagaaagguugguu

SEQ ID NO: 712533 - RNA, 18 nt, Haemophilus influenzae Rd
auuaacagcaaacuuaaa

SEQ ID NO: 712534 - RNA, 14 nt, Haemophilus influenzae Rd
auuaacagaauuug

SEQ ID NO: 712535 - RNA, 13 nt, Haemophilus influenzae Rd
auuaaccaacaua

SEQ ID NO: 712536 - RNA, 15 nt, Haemophilus influenzae Rd
auuaaccaacauaaa

SEQ ID NO: 712537 - RNA, 18 nt, Haemophilus influenzae Rd
auuaacaaauaauuauua

SEQ ID NO: 712538 - RNA, 23 nt, Haemophilus influenzae Rd
auuaacaauaaugugagaauaac

SEQ ID NO: 712539 - RNA, 21 nt, Haemophilus influenzae Rd
auuaacaaugcggagaaaagc

SEQ ID NO: 712540 - RNA, 23 nt, Haemophilus influenzae Rd
auuaacaauauucgcuucuuuua

SEQ ID NO: 712541 - RNA, 20 nt, Haemophilus influenzae Rd
auuaaauucaucagaaagug

SEQ ID NO: 712542 - RNA, 14 nt, Haemophilus influenzae Rd
auuaaauguauuuu

SEQ ID NO: 712543 - RNA, 23 nt, Haemophilus influenzae Rd
auuaaauuaccaugauccacaua

SEQ ID NO: 712544 - RNA, 17 nt, Haemophilus influenzae Rd
auuaaauucauuuaaaa

SEQ ID NO: 712545 - RNA, 16 nt, Haemophilus influenzae Rd
auuaaauugaaaaaau

SEQ ID NO: 712546 - RNA, 20 nt, Haemophilus influenzae Rd
auuaaguuugagcaaaucaa

SEQ ID NO: 712547 - RNA, 21 nt, Haemophilus influenzae Rd
auuaaguuugagcaaaucaaa

SEQ ID NO: 712548 - RNA, 13 nt, Haemophilus influenzae Rd
auuaaguuuucua

SEQ ID NO: 712549 - RNA, 14 nt, Haemophilus influenzae Rd
auuaaguauaaauc

SEQ ID NO: 712550 - RNA, 17 nt, Haemophilus influenzae Rd
auuaaguauaacuaauu

SEQ ID NO: 712551 - RNA, 21 nt, Haemophilus influenzae Rd
auuaagugcgguccguuuuca

SEQ ID NO: 712552 - RNA, 21 nt, Haemophilus influenzae Rd
auuaaggugcagauuaaauau

SEQ ID NO: 712553 - RNA, 20 nt, Haemophilus influenzae Rd
auuaagguuagaauguagcu

SEQ ID NO: 712554 - RNA, 15 nt, Haemophilus influenzae Rd
auuaagguuggaaua

SEQ ID NO: 712555 - RNA, 13 nt, Haemophilus influenzae Rd
auuaaguaaauau

SEQ ID NO: 712556 - RNA, 22 nt, Haemophilus influenzae Rd
auuaagcucaacugccacuaau

SEQ ID NO: 712557 - RNA, 15 nt, Haemophilus influenzae Rd
auuaagcgugcuuug

SEQ ID NO: 712558 - RNA, 15 nt, Haemophilus influenzae Rd
auuaaggcuuuucuu

SEQ ID NO: 712559 - RNA, 19 nt, Haemophilus influenzae Rd
auuaauaacgcaagcacca

SEQ ID NO: 712560 - RNA, 21 nt, Haemophilus influenzae Rd
auuaauaacguguaaauugcu

SEQ ID NO: 712561 - RNA, 20 nt, Haemophilus influenzae Rd
auuaauaagaaaaucaaaga

SEQ ID NO: 712562 - RNA, 15 nt, Haemophilus influenzae Rd
auuaauaagaaagaa

SEQ ID NO: 712563 - RNA, 15 nt, Haemophilus influenzae Rd
auuaauaagccauuu

SEQ ID NO: 712564 - RNA, 13 nt, Haemophilus influenzae Rd
auuaauaaaaaau

SEQ ID NO: 712565 - RNA, 19 nt, Haemophilus influenzae Rd
auuaauaaaccaacauaca

SEQ ID NO: 712566 - RNA, 13 nt, Haemophilus influenzae Rd
auuaauaaauauu

SEQ ID NO: 712567 - RNA, 14 nt, Haemophilus influenzae Rd
auuaauaaauauua

SEQ ID NO: 712568 - RNA, 17 nt, Haemophilus influenzae Rd
auuaauaccaauaauaa

SEQ ID NO: 712569 - RNA, 17 nt, Haemophilus influenzae Rd
auuaauacgcucuugua

SEQ ID NO: 712570 - RNA, 20 nt, Haemophilus influenzae Rd
auuaauacgucaauugcuaa

SEQ ID NO: 712571 - RNA, 15 nt, Haemophilus influenzae Rd
auuaauagauaagaa

SEQ ID NO: 712572 - RNA, 22 nt, Haemophilus influenzae Rd
auuaauauaaaggauuuuauca

SEQ ID NO: 712573 - RNA, 21 nt, Haemophilus influenzae Rd
auuaauauaccccaaacuaua

SEQ ID NO: 712574 - RNA, 13 nt, Haemophilus influenzae Rd
auuaaucaauuug

SEQ ID NO: 712575 - RNA, 20 nt, Haemophilus influenzae Rd
auuaaucaccauaucaauuu

SEQ ID NO: 712576 - RNA, 16 nt, Haemophilus influenzae Rd
auuaaucauaaaaaug

SEQ ID NO: 712577 - RNA, 22 nt, Haemophilus influenzae Rd
auuaaugcggugcuuuaaguaa

SEQ ID NO: 712578 - RNA, 16 nt, Haemophilus influenzae Rd
auuaaugcuaaaccaa

SEQ ID NO: 712579 - RNA, 20 nt, Haemophilus influenzae Rd
auuaaugcauugauugcuaa

SEQ ID NO: 712580 - RNA, 12 nt, Haemophilus influenzae Rd
auuaaugccaau

SEQ ID NO: 712581 - RNA, 21 nt, Haemophilus influenzae Rd
auuaaucggcaauguuuuaag

SEQ ID NO: 712582 - RNA, 15 nt, Haemophilus influenzae Rd
auuaaucgaaguaug

SEQ ID NO: 712583 - RNA, 16 nt, Haemophilus influenzae Rd
auuaaucgaucaauuu

SEQ ID NO: 712584 - RNA, 17 nt, Haemophilus influenzae Rd
auuaaugacaccuuuaa

SEQ ID NO: 712585 - RNA, 17 nt, Haemophilus influenzae Rd
auuaaucuuuuuucuug

SEQ ID NO: 712586 - RNA, 14 nt, Haemophilus influenzae Rd
auuaaucugauaaa

SEQ ID NO: 712587 - RNA, 17 nt, Haemophilus influenzae Rd
auuaaucugcaccuuaa

SEQ ID NO: 712588 - RNA, 16 nt, Haemophilus influenzae Rd
auuaaucugcauucua

SEQ ID NO: 712589 - RNA, 22 nt, Haemophilus influenzae Rd
auuaaucugcauucuaaaaguu

SEQ ID NO: 712590 - RNA, 23 nt, Haemophilus influenzae Rd
auuaaucugcauucuaaaaguuu

SEQ ID NO: 712591 - RNA, 15 nt, Haemophilus influenzae Rd
augguuaauuuuucg

SEQ ID NO: 712592 - RNA, 23 nt, Haemophilus influenzae Rd
augguuaauuuuucgucaaucau

SEQ ID NO: 712593 - RNA, 13 nt, Haemophilus influenzae Rd
augguauaaaaaa

SEQ ID NO: 712594 - RNA, 14 nt, Haemophilus influenzae Rd
augguauaaaaaau

SEQ ID NO: 712595 - RNA, 21 nt, Haemophilus influenzae Rd
augguaauagaguaccaaaau

SEQ ID NO: 712596 - RNA, 22 nt, Haemophilus influenzae Rd
augguaauagaguaccaaaauu

SEQ ID NO: 712597 - RNA, 18 nt, Haemophilus influenzae Rd
auggcugacuagauaaac

SEQ ID NO: 712598 - RNA, 23 nt, Haemophilus influenzae Rd
auggcugaucuugguagaaaauu

SEQ ID NO: 712599 - RNA, 15 nt, Haemophilus influenzae Rd
augggaugaaaucaa

SEQ ID NO: 712600 - RNA, 15 nt, Haemophilus influenzae Rd
auggcuaaauacaac

SEQ ID NO: 712601 - RNA, 16 nt, Haemophilus influenzae Rd
auggcuauuuaagccu

SEQ ID NO: 712602 - RNA, 14 nt, Haemophilus influenzae Rd
auggcugaaaaauu

SEQ ID NO: 712603 - RNA, 21 nt, Haemophilus influenzae Rd
auggcugaaaaauucaaagaa

SEQ ID NO: 712604 - RNA, 16 nt, Haemophilus influenzae Rd
auggcucuaaauuaau

SEQ ID NO: 712605 - RNA, 17 nt, Haemophilus influenzae Rd
auggcucuaaauuaauu

SEQ ID NO: 712606 - RNA, 19 nt, Haemophilus influenzae Rd
auggcuaucugcuuuucuu

SEQ ID NO: 712607 - RNA, 23 nt, Haemophilus influenzae Rd
augccuugugcauaaacaaauug

SEQ ID NO: 712608 - RNA, 17 nt, Haemophilus influenzae Rd
augcgaucuuuuguuac

SEQ ID NO: 712609 - RNA, 14 nt, Haemophilus influenzae Rd
auggcaucaauauu

SEQ ID NO: 712610 - RNA, 15 nt, Haemophilus influenzae Rd
auggcauuuauaaac

SEQ ID NO: 712611 - RNA, 19 nt, Haemophilus influenzae Rd
augguuuuccaaaaaccaa

SEQ ID NO: 712612 - RNA, 23 nt, Haemophilus influenzae Rd
augguuuaaauaaccaauauuug

SEQ ID NO: 712613 - RNA, 15 nt, Haemophilus influenzae Rd
auguaaacaaaaaua

SEQ ID NO: 712614 - RNA, 13 nt, Haemophilus influenzae Rd
auguaaaaauaac

SEQ ID NO: 712615 - RNA, 16 nt, Haemophilus influenzae Rd
auguaaaaauaaccua

SEQ ID NO: 712616 - RNA, 14 nt, Haemophilus influenzae Rd
auguaaaaaauaau

SEQ ID NO: 712617 - RNA, 15 nt, Haemophilus influenzae Rd
auguaaaaaauccuc

SEQ ID NO: 712618 - RNA, 22 nt, Haemophilus influenzae Rd
auguaaguagcguaaaccuugu

SEQ ID NO: 712619 - RNA, 21 nt, Haemophilus influenzae Rd
auguaauccaacgaagaaaca

SEQ ID NO: 712620 - RNA, 16 nt, Haemophilus influenzae Rd
auguaauagccauuuu

SEQ ID NO: 712621 - RNA, 22 nt, Haemophilus influenzae Rd
auguaauagccauuuuggaaug

SEQ ID NO: 712622 - RNA, 21 nt, Haemophilus influenzae Rd
auguaauauaaguuauuuaua

SEQ ID NO: 712623 - RNA, 15 nt, Haemophilus influenzae Rd
auguagcuugaauau

SEQ ID NO: 712624 - RNA, 16 nt, Haemophilus influenzae Rd
auguagcuugaauauu

SEQ ID NO: 712625 - RNA, 14 nt, Haemophilus influenzae Rd
auguaggcucuuuc

SEQ ID NO: 712626 - RNA, 20 nt, Haemophilus influenzae Rd
auguaguuucuucuuucaau

SEQ ID NO: 712627 - RNA, 21 nt, Haemophilus influenzae Rd
auguccauaacugucaaaauu

SEQ ID NO: 712628 - RNA, 17 nt, Haemophilus influenzae Rd
augugcaaucagcaaca

SEQ ID NO: 712629 - RNA, 20 nt, Haemophilus influenzae Rd
augugcaaucagcaacauua

SEQ ID NO: 712630 - RNA, 11 nt, Haemophilus influenzae Rd
augugcaccuu

SEQ ID NO: 712631 - RNA, 17 nt, Haemophilus influenzae Rd
augugcaccuucaacau

SEQ ID NO: 712632 - RNA, 19 nt, Haemophilus influenzae Rd
auguuaaguucaucauaaa

SEQ ID NO: 712633 - RNA, 13 nt, Haemophilus influenzae Rd
auguguuuaggcg

SEQ ID NO: 712634 - RNA, 16 nt, Haemophilus influenzae Rd
augucgaaauuuuucg

SEQ ID NO: 712635 - RNA, 12 nt, Haemophilus influenzae Rd
augucuuuuucu

SEQ ID NO: 712636 - RNA, 14 nt, Haemophilus influenzae Rd
augucuuuuucuua

SEQ ID NO: 712637 - RNA, 17 nt, Haemophilus influenzae Rd
augugaaaacuacuuuc

SEQ ID NO: 712638 - RNA, 22 nt, Haemophilus influenzae Rd
augugacagacgcugcccaaau

SEQ ID NO: 712639 - RNA, 15 nt, Haemophilus influenzae Rd
augugacauuguaaa

SEQ ID NO: 712640 - RNA, 15 nt, Haemophilus influenzae Rd
augugaccaaauaau

SEQ ID NO: 712641 - RNA, 16 nt, Haemophilus influenzae Rd
augugaccaaauaauc

SEQ ID NO: 712642 - RNA, 14 nt, Haemophilus influenzae Rd
aucuucuuuugccc

SEQ ID NO: 712643 - RNA, 12 nt, Haemophilus influenzae Rd
aucuucuuuacg

SEQ ID NO: 712644 - RNA, 20 nt, Haemophilus influenzae Rd
aucuucuuuacgugugcgau

SEQ ID NO: 712645 - RNA, 22 nt, Haemophilus influenzae Rd
aucuucugaucaauuuaaucaa

SEQ ID NO: 712646 - RNA, 22 nt, Haemophilus influenzae Rd
aucuucugcagaaaaauguuca

SEQ ID NO: 712647 - RNA, 21 nt, Haemophilus influenzae Rd
aucuggguuuacaucuugcgu

SEQ ID NO: 712648 - RNA, 22 nt, Haemophilus influenzae Rd
aucugcuaauagaacuguuauu

SEQ ID NO: 712649 - RNA, 18 nt, Haemophilus influenzae Rd
aucuuucacugcauuuuc

SEQ ID NO: 712650 - RNA, 19 nt, Haemophilus influenzae Rd
aucuuucacugcauuuucu

SEQ ID NO: 712651 - RNA, 18 nt, Haemophilus influenzae Rd
aucuuuaaguguuguucc

SEQ ID NO: 712652 - RNA, 18 nt, Haemophilus influenzae Rd
aucuuuaaucguguucac

SEQ ID NO: 712653 - RNA, 18 nt, Haemophilus influenzae Rd
aucuuuaauuaaaauauu

SEQ ID NO: 712654 - RNA, 14 nt, Haemophilus influenzae Rd
aucuuuacaacugg

SEQ ID NO: 712655 - RNA, 16 nt, Haemophilus influenzae Rd
aucuuuaccaaaaaau

SEQ ID NO: 712656 - RNA, 18 nt, Haemophilus influenzae Rd
aucuucuuugcgauuacu

SEQ ID NO: 712657 - RNA, 13 nt, Haemophilus influenzae Rd
aucuugacauaau

SEQ ID NO: 712658 - RNA, 12 nt, Haemophilus influenzae Rd
aucuuguuuuaa

SEQ ID NO: 712659 - RNA, 12 nt, Haemophilus influenzae Rd
aucuuguuuuac

SEQ ID NO: 712660 - RNA, 14 nt, Haemophilus influenzae Rd
aucuuuaaacaucg

SEQ ID NO: 712661 - RNA, 16 nt, Haemophilus influenzae Rd
augaaaguaacaaugu

SEQ ID NO: 712662 - RNA, 21 nt, Haemophilus influenzae Rd
augaaaguaacaauguagaaa

SEQ ID NO: 712663 - RNA, 16 nt, Haemophilus influenzae Rd
augaaaguugaauauu

SEQ ID NO: 712664 - RNA, 21 nt, Haemophilus influenzae Rd
augaaaguugaauauuuuguu

SEQ ID NO: 712665 - RNA, 17 nt, Haemophilus influenzae Rd
augaaaucauuacacag

SEQ ID NO: 712666 - RNA, 14 nt, Haemophilus influenzae Rd
augaaauauuuuua

SEQ ID NO: 712667 - RNA, 15 nt, Haemophilus influenzae Rd
augaacuuuuuuaua

SEQ ID NO: 712668 - RNA, 17 nt, Haemophilus influenzae Rd
augaagaacaaggggaa

SEQ ID NO: 712669 - RNA, 20 nt, Haemophilus influenzae Rd
augaacuuaugugcaccuuc

SEQ ID NO: 712670 - RNA, 22 nt, Haemophilus influenzae Rd
augaaaucgcaguuucuuuguu

SEQ ID NO: 712671 - RNA, 14 nt, Haemophilus influenzae Rd
augaacuguaauuu

SEQ ID NO: 712672 - RNA, 16 nt, Haemophilus influenzae Rd
augaagacuaaacaga

SEQ ID NO: 712673 - RNA, 11 nt, Haemophilus influenzae Rd
augaagaugaa

SEQ ID NO: 712674 - RNA, 20 nt, Haemophilus influenzae Rd
augaaagaagaaaaaggcag

SEQ ID NO: 712675 - RNA, 21 nt, Haemophilus influenzae Rd
augaaacgcgaguaaaauaaa

SEQ ID NO: 712676 - RNA, 19 nt, Haemophilus influenzae Rd
augaaacgagauuuauuuu

SEQ ID NO: 712677 - RNA, 13 nt, Haemophilus influenzae Rd
augaaaauuaucu

SEQ ID NO: 712678 - RNA, 14 nt, Haemophilus influenzae Rd
augaaaauuaucug

SEQ ID NO: 712679 - RNA, 22 nt, Haemophilus influenzae Rd
augaaaauuaucugcucucauu

SEQ ID NO: 712680 - RNA, 19 nt, Haemophilus influenzae Rd
augaaaauucucuucaacu

SEQ ID NO: 712681 - RNA, 15 nt, Haemophilus influenzae Rd
aucuuuuggguuaaa

SEQ ID NO: 712682 - RNA, 19 nt, Haemophilus influenzae Rd
augaaacagcuaaaaauga

SEQ ID NO: 712683 - RNA, 22 nt, Haemophilus influenzae Rd
augaaacagcuaaaaaugaauu

SEQ ID NO: 712684 - RNA, 14 nt, Haemophilus influenzae Rd
aucuuuuauucugc

SEQ ID NO: 712685 - RNA, 13 nt, Haemophilus influenzae Rd
aucuuuugccacg

SEQ ID NO: 712686 - RNA, 13 nt, Haemophilus influenzae Rd
aucuuucuucgau

SEQ ID NO: 712687 - RNA, 13 nt, Haemophilus influenzae Rd
aucuuuuaacacg

SEQ ID NO: 712688 - RNA, 15 nt, Haemophilus influenzae Rd
aucuuuuaacacgaa

SEQ ID NO: 712689 - RNA, 19 nt, Haemophilus influenzae Rd
aucuuuuaauaagauaaua

SEQ ID NO: 712690 - RNA, 14 nt, Haemophilus influenzae Rd
aucuuuuaauucuc

SEQ ID NO: 712691 - RNA, 17 nt, Haemophilus influenzae Rd
augagacuuaaccaaau

SEQ ID NO: 712692 - RNA, 19 nt, Haemophilus influenzae Rd
augagacuuaaccaaauag

SEQ ID NO: 712693 - RNA, 13 nt, Haemophilus influenzae Rd
augagaauuaauu

SEQ ID NO: 712694 - RNA, 15 nt, Haemophilus influenzae Rd
augagguguuauuug

SEQ ID NO: 712695 - RNA, 11 nt, Haemophilus influenzae Rd
augagcaaaua

SEQ ID NO: 712696 - RNA, 19 nt, Haemophilus influenzae Rd
augaguaaaccgauuaauu

SEQ ID NO: 712697 - RNA, 14 nt, Haemophilus influenzae Rd
augaguagauuuuu

SEQ ID NO: 712698 - RNA, 15 nt, Haemophilus influenzae Rd
augaguagauuuuua

SEQ ID NO: 712699 - RNA, 23 nt, Haemophilus influenzae Rd
augaguagauuuuuauucaauaa

SEQ ID NO: 712700 - RNA, 12 nt, Haemophilus influenzae Rd
augacuuucacu

SEQ ID NO: 712701 - RNA, 21 nt, Haemophilus influenzae Rd
augacuuucacuacagguugc

SEQ ID NO: 712702 - RNA, 19 nt, Haemophilus influenzae Rd
augacuggcuugugaaaua

SEQ ID NO: 712703 - RNA, 21 nt, Haemophilus influenzae Rd
augacuggcuugugaaauaaa

SEQ ID NO: 712704 - RNA, 18 nt, Haemophilus influenzae Rd
augacgaacgugggaauu

SEQ ID NO: 712705 - RNA, 20 nt, Haemophilus influenzae Rd
augacgagugagauaaauaa

SEQ ID NO: 712706 - RNA, 16 nt, Haemophilus influenzae Rd
augaauaaaauuuuua

SEQ ID NO: 712707 - RNA, 18 nt, Haemophilus influenzae Rd
augaauaaaauuuuuaaa

SEQ ID NO: 712708 - RNA, 19 nt, Haemophilus influenzae Rd
augaauaaaauuuuuaaag

SEQ ID NO: 712709 - RNA, 15 nt, Haemophilus influenzae Rd
augaaguuuuacuga

SEQ ID NO: 712710 - RNA, 22 nt, Haemophilus influenzae Rd
augaaguucacuucaucuauau

SEQ ID NO: 712711 - RNA, 12 nt, Haemophilus influenzae Rd
augaauaaaaau

SEQ ID NO: 712712 - RNA, 12 nt, Haemophilus influenzae Rd
augaauaaaauu

SEQ ID NO: 712713 - RNA, 14 nt, Haemophilus influenzae Rd
augaauaauaaugc

SEQ ID NO: 712714 - RNA, 16 nt, Haemophilus influenzae Rd
augaauaauucaaaac

SEQ ID NO: 712715 - RNA, 14 nt, Haemophilus influenzae Rd
augaauaauuuuua

SEQ ID NO: 712716 - RNA, 20 nt, Haemophilus influenzae Rd
augaaucguuuguucugaca

SEQ ID NO: 712717 - RNA, 14 nt, Haemophilus influenzae Rd
augaauguuucaaa

SEQ ID NO: 712718 - RNA, 16 nt, Haemophilus influenzae Rd
augaauguuucaaaca

SEQ ID NO: 712719 - RNA, 18 nt, Haemophilus influenzae Rd
augaauuaguuucaacuu

SEQ ID NO: 712720 - RNA, 20 nt, Haemophilus influenzae Rd
augaauuaguuucaacuugg

SEQ ID NO: 712721 - RNA, 23 nt, Haemophilus influenzae Rd
augaauuucgccuguuucacgau

SEQ ID NO: 712722 - RNA, 19 nt, Haemophilus influenzae Rd
augaccaaauacaauuuuu

SEQ ID NO: 712723 - RNA, 18 nt, Haemophilus influenzae Rd
augaccaaguaaaccaaa

SEQ ID NO: 712724 - RNA, 12 nt, Haemophilus influenzae Rd
augaugguguuc

SEQ ID NO: 712725 - RNA, 15 nt, Haemophilus influenzae Rd
augauaaauucuuac

SEQ ID NO: 712726 - RNA, 22 nt, Haemophilus influenzae Rd
augauaaauucuuaccaaaagg

SEQ ID NO: 712727 - RNA, 14 nt, Haemophilus influenzae Rd
augcaaccaaacaa

SEQ ID NO: 712728 - RNA, 16 nt, Haemophilus influenzae Rd
augcaaccaaacaaaa

SEQ ID NO: 712729 - RNA, 15 nt, Haemophilus influenzae Rd
augcaacaaguacga

SEQ ID NO: 712730 - RNA, 20 nt, Haemophilus influenzae Rd
augcaaagguaauugccaau

SEQ ID NO: 712731 - RNA, 14 nt, Haemophilus influenzae Rd
augcaaaguauuuu

SEQ ID NO: 712732 - RNA, 17 nt, Haemophilus influenzae Rd
augcaaaguauuuuucu

SEQ ID NO: 712733 - RNA, 16 nt, Haemophilus influenzae Rd
augauuuuaaaauaaa

SEQ ID NO: 712734 - RNA, 17 nt, Haemophilus influenzae Rd
augauuuuaaaauaaau

SEQ ID NO: 712735 - RNA, 13 nt, Haemophilus influenzae Rd
augauuuuaaagc

SEQ ID NO: 712736 - RNA, 24 nt, Haemophilus influenzae Rd
augauuuuaaagccauuuugcuca

SEQ ID NO: 712737 - RNA, 16 nt, Haemophilus influenzae Rd
augauuugcauaaaac

SEQ ID NO: 712738 - RNA, 19 nt, Haemophilus influenzae Rd
augauuugcauaaaaccag

SEQ ID NO: 712739 - RNA, 12 nt, Haemophilus influenzae Rd
augauuuagaac

SEQ ID NO: 712740 - RNA, 14 nt, Haemophilus influenzae Rd
augauuuagaacaa

SEQ ID NO: 712741 - RNA, 13 nt, Haemophilus influenzae Rd
augauuucauuuu

SEQ ID NO: 712742 - RNA, 22 nt, Haemophilus influenzae Rd
augauuggauugggcaacacag

SEQ ID NO: 712743 - RNA, 17 nt, Haemophilus influenzae Rd
augaugugcuugauguc

SEQ ID NO: 712744 - RNA, 19 nt, Haemophilus influenzae Rd
augcaauuggcaauauuaa

SEQ ID NO: 712745 - RNA, 21 nt, Haemophilus influenzae Rd
augcaguaacgcgauaaaucg

SEQ ID NO: 712746 - RNA, 14 nt, Haemophilus influenzae Rd
augccacaaauaaa

SEQ ID NO: 712747 - RNA, 16 nt, Haemophilus influenzae Rd
augccaaucacaauga

SEQ ID NO: 712748 - RNA, 22 nt, Haemophilus influenzae Rd
augccaccgcgaucuguuuuaa

SEQ ID NO: 712749 - RNA, 23 nt, Haemophilus influenzae Rd
augccaaucuaaacacacucuua

SEQ ID NO: 712750 - RNA, 19 nt, Haemophilus influenzae Rd
augccaaugcuauuaucau

SEQ ID NO: 712751 - RNA, 22 nt, Haemophilus influenzae Rd
augccaaugcuauuaucauaaa

SEQ ID NO: 712752 - RNA, 23 nt, Haemophilus influenzae Rd
augccaaugcuauuaucauaaac

SEQ ID NO: 712753 - RNA, 11 nt, Haemophilus influenzae Rd
augccaagauu

SEQ ID NO: 712754 - RNA, 21 nt, Haemophilus influenzae Rd
augcccucaguauuguuuuau

SEQ ID NO: 712755 - RNA, 17 nt, Haemophilus influenzae Rd
augccgaagccuuguaa

SEQ ID NO: 712756 - RNA, 15 nt, Haemophilus influenzae Rd
augccgcaaauacuu

SEQ ID NO: 712757 - RNA, 21 nt, Haemophilus influenzae Rd
augccaguuaaggauuuuuga

SEQ ID NO: 712758 - RNA, 13 nt, Haemophilus influenzae Rd
augccaucaccaa

SEQ ID NO: 712759 - RNA, 19 nt, Haemophilus influenzae Rd
augccaucaccaagaauca

SEQ ID NO: 712760 - RNA, 17 nt, Haemophilus influenzae Rd
augccaucguggaaugg

SEQ ID NO: 712761 - RNA, 15 nt, Haemophilus influenzae Rd
augccauucucccug

SEQ ID NO: 712762 - RNA, 15 nt, Haemophilus influenzae Rd
augcccacuuuuccu

SEQ ID NO: 712763 - RNA, 19 nt, Haemophilus influenzae Rd
augccauugcgugaauauc

SEQ ID NO: 712764 - RNA, 16 nt, Haemophilus influenzae Rd
augccauuaaacuucu

SEQ ID NO: 712765 - RNA, 13 nt, Haemophilus influenzae Rd
augcccaagugcg

SEQ ID NO: 712766 - RNA, 15 nt, Haemophilus influenzae Rd
augccuuauauuuca

SEQ ID NO: 712767 - RNA, 17 nt, Haemophilus influenzae Rd
augccuucuucacuacu

SEQ ID NO: 712768 - RNA, 19 nt, Haemophilus influenzae Rd
augccuucuucacuacuug

SEQ ID NO: 712769 - RNA, 20 nt, Haemophilus influenzae Rd
augccuuuccguucauaaau

SEQ ID NO: 712770 - RNA, 21 nt, Haemophilus influenzae Rd
augccucaucuuuuggguuaa

SEQ ID NO: 712771 - RNA, 16 nt, Haemophilus influenzae Rd
augccucgauauuuau

SEQ ID NO: 712772 - RNA, 18 nt, Haemophilus influenzae Rd
augccgccuuuuaauaaa

SEQ ID NO: 712773 - RNA, 13 nt, Haemophilus influenzae Rd
aucuauaaaaaga

SEQ ID NO: 712774 - RNA, 19 nt, Haemophilus influenzae Rd
aucuagaaaacucauccaa

SEQ ID NO: 712775 - RNA, 14 nt, Haemophilus influenzae Rd
aucuagagauugua

SEQ ID NO: 712776 - RNA, 22 nt, Haemophilus influenzae Rd
aucuagagauuguaugaaaaau

SEQ ID NO: 712777 - RNA, 16 nt, Haemophilus influenzae Rd
aucuagcacaaagaca

SEQ ID NO: 712778 - RNA, 18 nt, Haemophilus influenzae Rd
aucuacuagccaaucaua

SEQ ID NO: 712779 - RNA, 20 nt, Haemophilus influenzae Rd
aucuacuagccaaucauaau

SEQ ID NO: 712780 - RNA, 22 nt, Haemophilus influenzae Rd
aucuacaucaguaccuuuaauu

SEQ ID NO: 712781 - RNA, 14 nt, Haemophilus influenzae Rd
aucuacccaauaaa

SEQ ID NO: 712782 - RNA, 15 nt, Haemophilus influenzae Rd
aucuacccacacacc

SEQ ID NO: 712783 - RNA, 14 nt, Haemophilus influenzae Rd
aucuacuuucagga

SEQ ID NO: 712784 - RNA, 23 nt, Haemophilus influenzae Rd
aucuauauuugaguuauuuuuaa

SEQ ID NO: 712785 - RNA, 15 nt, Haemophilus influenzae Rd
aucuauauuauacuu

SEQ ID NO: 712786 - RNA, 21 nt, Haemophilus influenzae Rd
aucuauauucguuaaauaaug

SEQ ID NO: 712787 - RNA, 16 nt, Haemophilus influenzae Rd
aucuauccaacucauu

SEQ ID NO: 712788 - RNA, 20 nt, Haemophilus influenzae Rd
aucuauaauuucgccauuuu

SEQ ID NO: 712789 - RNA, 18 nt, Haemophilus influenzae Rd
aucucaaaaucagcaaau

SEQ ID NO: 712790 - RNA, 16 nt, Haemophilus influenzae Rd
aucuauugagauuuaa

SEQ ID NO: 712791 - RNA, 17 nt, Haemophilus influenzae Rd
aucuauugagauuuaau

SEQ ID NO: 712792 - RNA, 15 nt, Haemophilus influenzae Rd
aucuauuccuuucuu

SEQ ID NO: 712793 - RNA, 14 nt, Haemophilus influenzae Rd
aucuauuucuuuga

SEQ ID NO: 712794 - RNA, 17 nt, Haemophilus influenzae Rd
aucucacaauaauuuuc

SEQ ID NO: 712795 - RNA, 15 nt, Haemophilus influenzae Rd
aucucagaauuuauu

SEQ ID NO: 712796 - RNA, 14 nt, Haemophilus influenzae Rd
aucucagcaagcug

SEQ ID NO: 712797 - RNA, 20 nt, Haemophilus influenzae Rd
aucucauccacuaaaccauu

SEQ ID NO: 712798 - RNA, 16 nt, Haemophilus influenzae Rd
aucuccaagaauauuu

SEQ ID NO: 712799 - RNA, 13 nt, Haemophilus influenzae Rd
aucucccaaagaa

SEQ ID NO: 712800 - RNA, 16 nt, Haemophilus influenzae Rd
aucucgcauugauucu

SEQ ID NO: 712801 - RNA, 17 nt, Haemophilus influenzae Rd
aucucuuucuuaaaaua

SEQ ID NO: 712802 - RNA, 23 nt, Haemophilus influenzae Rd
aucucuuguuuuuccaauucuuu

SEQ ID NO: 712803 - RNA, 14 nt, Haemophilus influenzae Rd
aucucggcuaaaau

SEQ ID NO: 712804 - RNA, 15 nt, Haemophilus influenzae Rd
aucucuagauuuuuu

SEQ ID NO: 712805 - RNA, 16 nt, Haemophilus influenzae Rd
aucucuagauuuuuua

SEQ ID NO: 712806 - RNA, 15 nt, Haemophilus influenzae Rd
aucugccacuucuug

SEQ ID NO: 712807 - RNA, 13 nt, Haemophilus influenzae Rd
aucugcauuucaa

SEQ ID NO: 712808 - RNA, 17 nt, Haemophilus influenzae Rd
aucugccacagaccaaa

SEQ ID NO: 712809 - RNA, 21 nt, Haemophilus influenzae Rd
aucugccacagaccaaaauuc

SEQ ID NO: 712810 - RNA, 21 nt, Haemophilus influenzae Rd
aucugcaccccaaaagcugga

SEQ ID NO: 712811 - RNA, 19 nt, Haemophilus influenzae Rd
aucugcacuccaaaaguug

SEQ ID NO: 712812 - RNA, 15 nt, Haemophilus influenzae Rd
aucugcacuuuaaca

SEQ ID NO: 712813 - RNA, 21 nt, Haemophilus influenzae Rd
aucugcacaaaguugauaauc

SEQ ID NO: 712814 - RNA, 14 nt, Haemophilus influenzae Rd
aucugauuuugugg

SEQ ID NO: 712815 - RNA, 16 nt, Haemophilus influenzae Rd
aucugauuuaaucauu

SEQ ID NO: 712816 - RNA, 11 nt, Haemophilus influenzae Rd
aucugauaaau

SEQ ID NO: 712817 - RNA, 16 nt, Haemophilus influenzae Rd
aucugauacuuugcuu

SEQ ID NO: 712818 - RNA, 14 nt, Haemophilus influenzae Rd
aucugaaccaccgc

SEQ ID NO: 712819 - RNA, 16 nt, Haemophilus influenzae Rd
aucugaccccaaaaag

SEQ ID NO: 712820 - RNA, 22 nt, Haemophilus influenzae Rd
aucguccaaagaaguuuuccau

SEQ ID NO: 712821 - RNA, 15 nt, Haemophilus influenzae Rd
aucguggucaccaag

SEQ ID NO: 712822 - RNA, 21 nt, Haemophilus influenzae Rd
aucgugaugauuuucauuccu

SEQ ID NO: 712823 - RNA, 14 nt, Haemophilus influenzae Rd
aucguguaaaaguu

SEQ ID NO: 712824 - RNA, 12 nt, Haemophilus influenzae Rd
aucguucauaaa

SEQ ID NO: 712825 - RNA, 19 nt, Haemophilus influenzae Rd
aucguuagcuuucauacgc

SEQ ID NO: 712826 - RNA, 15 nt, Haemophilus influenzae Rd
aucguugcuaccacu

SEQ ID NO: 712827 - RNA, 15 nt, Haemophilus influenzae Rd
aucuaaacuuguuaa

SEQ ID NO: 712828 - RNA, 20 nt, Haemophilus influenzae Rd
aucuaaacuuguuaaauaaa

SEQ ID NO: 712829 - RNA, 16 nt, Haemophilus influenzae Rd
aucuaaaccccguuuu

SEQ ID NO: 712830 - RNA, 23 nt, Haemophilus influenzae Rd
aucuaaaccccguuuuuuagaaa

SEQ ID NO: 712831 - RNA, 20 nt, Haemophilus influenzae Rd
aucuaaaccgauagcuuuug

SEQ ID NO: 712832 - RNA, 13 nt, Haemophilus influenzae Rd
aucuaaaccuugu

SEQ ID NO: 712833 - RNA, 14 nt, Haemophilus influenzae Rd
aucuacauuuuuag

SEQ ID NO: 712834 - RNA, 20 nt, Haemophilus influenzae Rd
aucuaccacaucaaauuuau

SEQ ID NO: 712835 - RNA, 19 nt, Haemophilus influenzae Rd
aucuaccacgauaaauccu

SEQ ID NO: 712836 - RNA, 20 nt, Haemophilus influenzae Rd
aucuacagggcuuaguccuu

SEQ ID NO: 712837 - RNA, 14 nt, Haemophilus influenzae Rd
aucuaaauuaucgu

SEQ ID NO: 712838 - RNA, 12 nt, Haemophilus influenzae Rd
aucuaaauuccu

SEQ ID NO: 712839 - RNA, 21 nt, Haemophilus influenzae Rd
aucuacaaucaaaaaaucuac

SEQ ID NO: 712840 - RNA, 23 nt, Haemophilus influenzae Rd
aucuacacggagauauuguaauc

SEQ ID NO: 712841 - RNA, 18 nt, Haemophilus influenzae Rd
aucuaaaggaaucccaua

SEQ ID NO: 712842 - RNA, 22 nt, Haemophilus influenzae Rd
aucuaaaauucgacgauaacca

SEQ ID NO: 712843 - RNA, 18 nt, Haemophilus influenzae Rd
aucuaaagcgaucaucau

SEQ ID NO: 712844 - RNA, 17 nt, Haemophilus influenzae Rd
aucuaaaguuggcacuu

SEQ ID NO: 712845 - RNA, 14 nt, Haemophilus influenzae Rd
aucuaaaucauuua

SEQ ID NO: 712846 - RNA, 23 nt, Haemophilus influenzae Rd
aucuaaaucugguggagaaaugu

SEQ ID NO: 712847 - RNA, 17 nt, Haemophilus influenzae Rd
aucuaaauauauuuuua

SEQ ID NO: 712848 - RNA, 14 nt, Haemophilus influenzae Rd
aucuaaauggcaaa

SEQ ID NO: 712849 - RNA, 18 nt, Haemophilus influenzae Rd
aucggauuucuuuauucu

SEQ ID NO: 712850 - RNA, 23 nt, Haemophilus influenzae Rd
aucggauuucuuuauucugaaac

SEQ ID NO: 712851 - RNA, 16 nt, Haemophilus influenzae Rd
aucgguacgagaaacg

SEQ ID NO: 712852 - RNA, 13 nt, Haemophilus influenzae Rd
aucgauaauuuaa

SEQ ID NO: 712853 - RNA, 21 nt, Haemophilus influenzae Rd
aucgaguuuuauaagcaaauu

SEQ ID NO: 712854 - RNA, 21 nt, Haemophilus influenzae Rd
aucgauuuuccucuuuuaugu

SEQ ID NO: 712855 - RNA, 21 nt, Haemophilus influenzae Rd
aucgcaagggcugcgcccauu

SEQ ID NO: 712856 - RNA, 15 nt, Haemophilus influenzae Rd
aucgcaauaacaccg

SEQ ID NO: 712857 - RNA, 13 nt, Haemophilus influenzae Rd
aucgcaauuuuuu

SEQ ID NO: 712858 - RNA, 13 nt, Haemophilus influenzae Rd
aucgaguaaaaau

SEQ ID NO: 712859 - RNA, 20 nt, Haemophilus influenzae Rd
aucgaguaaaaauaaaaugc

SEQ ID NO: 712860 - RNA, 16 nt, Haemophilus influenzae Rd
aucgaggccucuugcu

SEQ ID NO: 712861 - RNA, 13 nt, Haemophilus influenzae Rd
aucgaaacauaaa

SEQ ID NO: 712862 - RNA, 20 nt, Haemophilus influenzae Rd
aucgaacacuguaaauaaac

SEQ ID NO: 712863 - RNA, 16 nt, Haemophilus influenzae Rd
aucgaaacgguuagua

SEQ ID NO: 712864 - RNA, 17 nt, Haemophilus influenzae Rd
aucgaaaacauaauccg

SEQ ID NO: 712865 - RNA, 23 nt, Haemophilus influenzae Rd
auccuuuguugucguuauuauga

SEQ ID NO: 712866 - RNA, 14 nt, Haemophilus influenzae Rd
aucagcuccuacau

SEQ ID NO: 712867 - RNA, 18 nt, Haemophilus influenzae Rd
aucagcuccuacauuaaa

SEQ ID NO: 712868 - RNA, 20 nt, Haemophilus influenzae Rd
aucagcuccuacauuaaaag

SEQ ID NO: 712869 - RNA, 23 nt, Haemophilus influenzae Rd
aucagcuaaacgcacuugauuug

SEQ ID NO: 712870 - RNA, 21 nt, Haemophilus influenzae Rd
aucagcuacuucccaaauuuu

SEQ ID NO: 712871 - RNA, 21 nt, Haemophilus influenzae Rd
aucagcuacuuguaagaauaa

SEQ ID NO: 712872 - RNA, 15 nt, Haemophilus influenzae Rd
aucgccuaaaauugc

SEQ ID NO: 712873 - RNA, 15 nt, Haemophilus influenzae Rd
aucgcccgauuuuaa

SEQ ID NO: 712874 - RNA, 22 nt, Haemophilus influenzae Rd
aucgcacuguuauauaaacaau

SEQ ID NO: 712875 - RNA, 16 nt, Haemophilus influenzae Rd
aucgcauaguuaucca

SEQ ID NO: 712876 - RNA, 22 nt, Haemophilus influenzae Rd
aucgcaucaaaggcuaauucua

SEQ ID NO: 712877 - RNA, 21 nt, Haemophilus influenzae Rd
aucgcaucacgcguuucuaaa

SEQ ID NO: 712878 - RNA, 18 nt, Haemophilus influenzae Rd
aucgcaucgucuuuaccu

SEQ ID NO: 712879 - RNA, 22 nt, Haemophilus influenzae Rd
auaauguguugauuucuacacu

SEQ ID NO: 712880 - RNA, 20 nt, Haemophilus influenzae Rd
auaauggcgguaaaaaagua

SEQ ID NO: 712881 - RNA, 22 nt, Haemophilus influenzae Rd
auaaugugagaauaaccacaua

SEQ ID NO: 712882 - RNA, 14 nt, Haemophilus influenzae Rd
auaaugugcaaaaa

SEQ ID NO: 712883 - RNA, 17 nt, Haemophilus influenzae Rd
auaaugugcaaaaauau

SEQ ID NO: 712884 - RNA, 15 nt, Haemophilus influenzae Rd
auaauuaaaaauaaa

SEQ ID NO: 712885 - RNA, 13 nt, Haemophilus influenzae Rd
auaauuaaaaaua

SEQ ID NO: 712886 - RNA, 12 nt, Haemophilus influenzae Rd
auaauuaaacuu

SEQ ID NO: 712887 - RNA, 18 nt, Haemophilus influenzae Rd
auaauuaaacagcacacu

SEQ ID NO: 712888 - RNA, 11 nt, Haemophilus influenzae Rd
auaauuaaauu

SEQ ID NO: 712889 - RNA, 13 nt, Haemophilus influenzae Rd
auaauuaaauuaa

SEQ ID NO: 712890 - RNA, 13 nt, Haemophilus influenzae Rd
auaauuaaauuca

SEQ ID NO: 712891 - RNA, 15 nt, Haemophilus influenzae Rd
auaauuaaauucauu

SEQ ID NO: 712892 - RNA, 15 nt, Haemophilus influenzae Rd
auaauuaacaaauaa

SEQ ID NO: 712893 - RNA, 17 nt, Haemophilus influenzae Rd
auaauuaacaaauaauu

SEQ ID NO: 712894 - RNA, 17 nt, Haemophilus influenzae Rd
auaauggcaauuuuaua

SEQ ID NO: 712895 - RNA, 20 nt, Haemophilus influenzae Rd
auaaugccuacuuuuuaugu

SEQ ID NO: 712896 - RNA, 16 nt, Haemophilus influenzae Rd
auaaugccucuuuaac

SEQ ID NO: 712897 - RNA, 15 nt, Haemophilus influenzae Rd
auaaugcgaucuuuu

SEQ ID NO: 712898 - RNA, 21 nt, Haemophilus influenzae Rd
auaaugcgaucuuuuguuacu

SEQ ID NO: 712899 - RNA, 21 nt, Haemophilus influenzae Rd
auaaugaacgccgcaacuaau

SEQ ID NO: 712900 - RNA, 14 nt, Haemophilus influenzae Rd
auaaugaauaauuu

SEQ ID NO: 712901 - RNA, 22 nt, Haemophilus influenzae Rd
auaaugaauaauuuuuauaauu

SEQ ID NO: 712902 - RNA, 14 nt, Haemophilus influenzae Rd
auaaugaauauauu

SEQ ID NO: 712903 - RNA, 17 nt, Haemophilus influenzae Rd
auaaugaauauauucau

SEQ ID NO: 712904 - RNA, 19 nt, Haemophilus influenzae Rd
auaaucacuugauaaaaau

SEQ ID NO: 712905 - RNA, 21 nt, Haemophilus influenzae Rd
auaaucacuugauaaaaauga

SEQ ID NO: 712906 - RNA, 19 nt, Haemophilus influenzae Rd
auaaucagugauuauauuu

SEQ ID NO: 712907 - RNA, 21 nt, Haemophilus influenzae Rd
auaaucgcaaggucaagaucg

SEQ ID NO: 712908 - RNA, 15 nt, Haemophilus influenzae Rd
auaaucuuuaaaaug

SEQ ID NO: 712909 - RNA, 23 nt, Haemophilus influenzae Rd
auaaucuuuaaaauguaaaaaau

SEQ ID NO: 712910 - RNA, 20 nt, Haemophilus influenzae Rd
auaaucuuuaaauuuugcuu

SEQ ID NO: 712911 - RNA, 16 nt, Haemophilus influenzae Rd
auaaucuaauccaaau

SEQ ID NO: 712912 - RNA, 15 nt, Haemophilus influenzae Rd
auaaucuacaaaaca

SEQ ID NO: 712913 - RNA, 15 nt, Haemophilus influenzae Rd
auaaucuucuuccca

SEQ ID NO: 712914 - RNA, 14 nt, Haemophilus influenzae Rd
auaauauauuaugu

SEQ ID NO: 712915 - RNA, 16 nt, Haemophilus influenzae Rd
auaauaucaaucacuu

SEQ ID NO: 712916 - RNA, 19 nt, Haemophilus influenzae Rd
auaauaguuggguuagcuu

SEQ ID NO: 712917 - RNA, 23 nt, Haemophilus influenzae Rd
auaauaucacaaccaccaauuaa

SEQ ID NO: 712918 - RNA, 18 nt, Haemophilus influenzae Rd
auaauaucauuuuuagaa

SEQ ID NO: 712919 - RNA, 16 nt, Haemophilus influenzae Rd
auaauaucugcuuuuu

SEQ ID NO: 712920 - RNA, 16 nt, Haemophilus influenzae Rd
auaauauuaaagaaaa

SEQ ID NO: 712921 - RNA, 20 nt, Haemophilus influenzae Rd
auaauauuaaagaaaauaca

SEQ ID NO: 712922 - RNA, 20 nt, Haemophilus influenzae Rd
auaauaucgcccgcuuuaag

SEQ ID NO: 712923 - RNA, 15 nt, Haemophilus influenzae Rd
auaauaugcaucacu

SEQ ID NO: 712924 - RNA, 16 nt, Haemophilus influenzae Rd
auaauauucaaaacau

SEQ ID NO: 712925 - RNA, 20 nt, Haemophilus influenzae Rd
auaauauucaaaacauuaau

SEQ ID NO: 712926 - RNA, 18 nt, Haemophilus influenzae Rd
auaauauuccaaaaaaua

SEQ ID NO: 712927 - RNA, 14 nt, Haemophilus influenzae Rd
auaaucaaaaaugc

SEQ ID NO: 712928 - RNA, 15 nt, Haemophilus influenzae Rd
auaaucaaaaaugcu

SEQ ID NO: 712929 - RNA, 15 nt, Haemophilus influenzae Rd
auaauauuuuugcca

SEQ ID NO: 712930 - RNA, 12 nt, Haemophilus influenzae Rd
auaauauuuuua

SEQ ID NO: 712931 - RNA, 20 nt, Haemophilus influenzae Rd
auaauauuuuuacuccuauu

SEQ ID NO: 712932 - RNA, 16 nt, Haemophilus influenzae Rd
auaauagacugaaaaa

SEQ ID NO: 712933 - RNA, 14 nt, Haemophilus influenzae Rd
auaauacugcuugu

SEQ ID NO: 712934 - RNA, 20 nt, Haemophilus influenzae Rd
auaauaggauaaauaaacua

SEQ ID NO: 712935 - RNA, 18 nt, Haemophilus influenzae Rd
auaauaggcgaaucaaaa

SEQ ID NO: 712936 - RNA, 21 nt, Haemophilus influenzae Rd
auaauaggcgaaucaaaaucu

SEQ ID NO: 712937 - RNA, 22 nt, Haemophilus influenzae Rd
auaauaggcgcguaauaaauaa

SEQ ID NO: 712938 - RNA, 14 nt, Haemophilus influenzae Rd
auaauaagaaagua

SEQ ID NO: 712939 - RNA, 13 nt, Haemophilus influenzae Rd
auaauaauuuuuc

SEQ ID NO: 712940 - RNA, 14 nt, Haemophilus influenzae Rd
auaauaauuuuucc

SEQ ID NO: 712941 - RNA, 18 nt, Haemophilus influenzae Rd
auaauacagaaauaugaa

SEQ ID NO: 712942 - RNA, 13 nt, Haemophilus influenzae Rd
auaauaaucacaa

SEQ ID NO: 712943 - RNA, 18 nt, Haemophilus influenzae Rd
auaauaauuagcuaaaua

SEQ ID NO: 712944 - RNA, 21 nt, Haemophilus influenzae Rd
auaauaauuagcuaaauacuu

SEQ ID NO: 712945 - RNA, 22 nt, Haemophilus influenzae Rd
auaagauuaaugauaaguuuug

SEQ ID NO: 712946 - RNA, 17 nt, Haemophilus influenzae Rd
auaagauugugcaauaa

SEQ ID NO: 712947 - RNA, 13 nt, Haemophilus influenzae Rd
auaagauuugcuc

SEQ ID NO: 712948 - RNA, 13 nt, Haemophilus influenzae Rd
auaagauuugcuu

SEQ ID NO: 712949 - RNA, 15 nt, Haemophilus influenzae Rd
auaagcaaagaaauu

SEQ ID NO: 712950 - RNA, 13 nt, Haemophilus influenzae Rd
auaagauuuuuaa

SEQ ID NO: 712951 - RNA, 23 nt, Haemophilus influenzae Rd
auaagauuuuugauaaaaaagaa

SEQ ID NO: 712952 - RNA, 15 nt, Haemophilus influenzae Rd
auaagauaacaucac

SEQ ID NO: 712953 - RNA, 21 nt, Haemophilus influenzae Rd
auaagagcuuacuucuacuuc

SEQ ID NO: 712954 - RNA, 22 nt, Haemophilus influenzae Rd
auaagaaguuaucauuugaauu

SEQ ID NO: 712955 - RNA, 14 nt, Haemophilus influenzae Rd
auaagccuuuucau

SEQ ID NO: 712956 - RNA, 15 nt, Haemophilus influenzae Rd
auaagccauuaacau

SEQ ID NO: 712957 - RNA, 14 nt, Haemophilus influenzae Rd
auaagcccaacuua

SEQ ID NO: 712958 - RNA, 19 nt, Haemophilus influenzae Rd
auaagcauuuuaucacaag

SEQ ID NO: 712959 - RNA, 23 nt, Haemophilus influenzae Rd
auaagcauuuuaucacaaguuaa

SEQ ID NO: 712960 - RNA, 20 nt, Haemophilus influenzae Rd
auaagcuugcguaauguuua

SEQ ID NO: 712961 - RNA, 21 nt, Haemophilus influenzae Rd
auaagcuugcguaauguuuaa

SEQ ID NO: 712962 - RNA, 22 nt, Haemophilus influenzae Rd
auaagcuuggcuuauuuacuuu

SEQ ID NO: 712963 - RNA, 22 nt, Haemophilus influenzae Rd
auaagcuaugaagaagaaaguu

SEQ ID NO: 712964 - RNA, 22 nt, Haemophilus influenzae Rd
auaagcucccagugcugaaaua

SEQ ID NO: 712965 - RNA, 16 nt, Haemophilus influenzae Rd
auaagcuaauuuuuca

SEQ ID NO: 712966 - RNA, 17 nt, Haemophilus influenzae Rd
auaaggggcugaaugga

SEQ ID NO: 712967 - RNA, 15 nt, Haemophilus influenzae Rd
auaagggcgauauuu

SEQ ID NO: 712968 - RNA, 18 nt, Haemophilus influenzae Rd
auaaggcaccuuuuugcu

SEQ ID NO: 712969 - RNA, 16 nt, Haemophilus influenzae Rd
auaaggcagaaaugaa

SEQ ID NO: 712970 - RNA, 20 nt, Haemophilus influenzae Rd
auaaggaucuuguaaagauu

SEQ ID NO: 712971 - RNA, 20 nt, Haemophilus influenzae Rd
auaaggaccaagcaaugcuu

SEQ ID NO: 712972 - RNA, 14 nt, Haemophilus influenzae Rd
auaaggaaaauacu

SEQ ID NO: 712973 - RNA, 21 nt, Haemophilus influenzae Rd
auaaguauuuugcagaauacu

SEQ ID NO: 712974 - RNA, 16 nt, Haemophilus influenzae Rd
auaaguaugugaugua

SEQ ID NO: 712975 - RNA, 21 nt, Haemophilus influenzae Rd
auaaguaugugauguaauauu

SEQ ID NO: 712976 - RNA, 14 nt, Haemophilus influenzae Rd
auaaguagaaaaau

SEQ ID NO: 712977 - RNA, 15 nt, Haemophilus influenzae Rd
auaaguaggcaaaau

SEQ ID NO: 712978 - RNA, 13 nt, Haemophilus influenzae Rd
auaaggugcauua

SEQ ID NO: 712979 - RNA, 19 nt, Haemophilus influenzae Rd
auaaggugcauuaggguua

SEQ ID NO: 712980 - RNA, 19 nt, Haemophilus influenzae Rd
auaaggugcuaauuaaacu

SEQ ID NO: 712981 - RNA, 18 nt, Haemophilus influenzae Rd
auaagguaguuuuccuuu

SEQ ID NO: 712982 - RNA, 18 nt, Haemophilus influenzae Rd
auaaggucagcaaauuau

SEQ ID NO: 712983 - RNA, 19 nt, Haemophilus influenzae Rd
auaaguaaaauagucacuu

SEQ ID NO: 712984 - RNA, 13 nt, Haemophilus influenzae Rd
auaaguaaugaaa

SEQ ID NO: 712985 - RNA, 14 nt, Haemophilus influenzae Rd
auaaguaaugaaaa

SEQ ID NO: 712986 - RNA, 18 nt, Haemophilus influenzae Rd
auaaguggggaaaaauau

SEQ ID NO: 712987 - RNA, 14 nt, Haemophilus influenzae Rd
auaagugauuaaag

SEQ ID NO: 712988 - RNA, 13 nt, Haemophilus influenzae Rd
auaagugaaaugc

SEQ ID NO: 712989 - RNA, 13 nt, Haemophilus influenzae Rd
auaagugccaaca

SEQ ID NO: 712990 - RNA, 17 nt, Haemophilus influenzae Rd
auaagugccaacaauau

SEQ ID NO: 712991 - RNA, 18 nt, Haemophilus influenzae Rd
auaaguucuaaauaaacu

SEQ ID NO: 712992 - RNA, 21 nt, Haemophilus influenzae Rd
auaaguucuaaauaaacuacu

SEQ ID NO: 712993 - RNA, 20 nt, Haemophilus influenzae Rd
auaaguucauaaaaggggca

SEQ ID NO: 712994 - RNA, 14 nt, Haemophilus influenzae Rd
auaaguucaucaac

SEQ ID NO: 712995 - RNA, 17 nt, Haemophilus influenzae Rd
auaaguucaucaacugc

SEQ ID NO: 712996 - RNA, 15 nt, Haemophilus influenzae Rd
auaaguuauuuuuac

SEQ ID NO: 712997 - RNA, 20 nt, Haemophilus influenzae Rd
auaaguuaccgcuucuuccu

SEQ ID NO: 712998 - RNA, 12 nt, Haemophilus influenzae Rd
auaauaaaaugg

SEQ ID NO: 712999 - RNA, 20 nt, Haemophilus influenzae Rd
auaauaaacggaguuuucca

SEQ ID NO: 713000 - RNA, 22 nt, Haemophilus influenzae Rd
auaauaaacggaguuuuccauu

SEQ ID NO: 713001 - RNA, 14 nt, Haemophilus influenzae Rd
auaauaaauauaau

SEQ ID NO: 713002 - RNA, 12 nt, Haemophilus influenzae Rd
auaauaaaaauu

SEQ ID NO: 713003 - RNA, 13 nt, Haemophilus influenzae Rd
auaauaaaaauua

SEQ ID NO: 713004 - RNA, 14 nt, Haemophilus influenzae Rd
auaauaaaaauuaa

SEQ ID NO: 713005 - RNA, 12 nt, Haemophilus influenzae Rd
auaaguuuuuug

SEQ ID NO: 713006 - RNA, 17 nt, Haemophilus influenzae Rd
auaaguugggauaagcu

SEQ ID NO: 713007 - RNA, 21 nt, Haemophilus influenzae Rd
auaaagccuauucucacauca

SEQ ID NO: 713008 - RNA, 12 nt, Haemophilus influenzae Rd
auaaagcccugu

SEQ ID NO: 713009 - RNA, 19 nt, Haemophilus influenzae Rd
auaaagcucagccaaacug

SEQ ID NO: 713010 - RNA, 15 nt, Haemophilus influenzae Rd
auaaagcuugaaaaa

SEQ ID NO: 713011 - RNA, 16 nt, Haemophilus influenzae Rd
auaaagcuugaaaaaa

SEQ ID NO: 713012 - RNA, 17 nt, Haemophilus influenzae Rd
auaaagggaaguucaca

SEQ ID NO: 713013 - RNA, 22 nt, Haemophilus influenzae Rd
auaaagggauaaacccaaaaaa

SEQ ID NO: 713014 - RNA, 16 nt, Haemophilus influenzae Rd
auaaaggauuaaauaa

SEQ ID NO: 713015 - RNA, 18 nt, Haemophilus influenzae Rd
auaaaggauuaaauaaca

SEQ ID NO: 713016 - RNA, 16 nt, Haemophilus influenzae Rd
auaaaggauuuuauca

SEQ ID NO: 713017 - RNA, 17 nt, Haemophilus influenzae Rd
auaaaggauuuuaucau

SEQ ID NO: 713018 - RNA, 15 nt, Haemophilus influenzae Rd
auaaaguaaaauauu

SEQ ID NO: 713019 - RNA, 21 nt, Haemophilus influenzae Rd
auaaaguaguuuuaguaauuu

SEQ ID NO: 713020 - RNA, 13 nt, Haemophilus influenzae Rd
auaaauaaaauau

SEQ ID NO: 713021 - RNA, 16 nt, Haemophilus influenzae Rd
auaaauaaaccagcua

SEQ ID NO: 713022 - RNA, 20 nt, Haemophilus influenzae Rd
auaaauaucuaaacuucaau

SEQ ID NO: 713023 - RNA, 14 nt, Haemophilus influenzae Rd
auaaauaucuugca

SEQ ID NO: 713024 - RNA, 21 nt, Haemophilus influenzae Rd
auaaauauuacuuaacaucau

SEQ ID NO: 713025 - RNA, 15 nt, Haemophilus influenzae Rd
auaaauauuauuaaa

SEQ ID NO: 713026 - RNA, 15 nt, Haemophilus influenzae Rd
auaaauaaaucaaua

SEQ ID NO: 713027 - RNA, 17 nt, Haemophilus influenzae Rd
auaaaucuuuaaaugcu

SEQ ID NO: 713028 - RNA, 19 nt, Haemophilus influenzae Rd
auaaaucuuuaaaugcugc

SEQ ID NO: 713029 - RNA, 17 nt, Haemophilus influenzae Rd
auaaaucggcguauuuu

SEQ ID NO: 713030 - RNA, 21 nt, Haemophilus influenzae Rd
auaaaucggcguauuuuacaa

SEQ ID NO: 713031 - RNA, 19 nt, Haemophilus influenzae Rd
auaaaucuauuccuuucuu

SEQ ID NO: 713032 - RNA, 20 nt, Haemophilus influenzae Rd
auaaaucuauuccuuucuuu

SEQ ID NO: 713033 - RNA, 23 nt, Haemophilus influenzae Rd
auaaauccuucaggauaaaacaa

SEQ ID NO: 713034 - RNA, 15 nt, Haemophilus influenzae Rd
auaaaucaaaagaau

SEQ ID NO: 713035 - RNA, 17 nt, Haemophilus influenzae Rd
auaaauauugauuaccc

SEQ ID NO: 713036 - RNA, 23 nt, Haemophilus influenzae Rd
auaaauauuuaggcuauuuuaua

SEQ ID NO: 713037 - RNA, 15 nt, Haemophilus influenzae Rd
auaaagauaaauuau

SEQ ID NO: 713038 - RNA, 14 nt, Haemophilus influenzae Rd
auaaagauugcaua

SEQ ID NO: 713039 - RNA, 14 nt, Haemophilus influenzae Rd
auaaagcaaccaau

SEQ ID NO: 713040 - RNA, 20 nt, Haemophilus influenzae Rd
auaaacuucugcaaguugag

SEQ ID NO: 713041 - RNA, 15 nt, Haemophilus influenzae Rd
auaaaccgcaucaaa

SEQ ID NO: 713042 - RNA, 23 nt, Haemophilus influenzae Rd
auaaaccgcaucaaaauuauaaa

SEQ ID NO: 713043 - RNA, 20 nt, Haemophilus influenzae Rd
auaaaccguuagguuuaaaa

SEQ ID NO: 713044 - RNA, 21 nt, Haemophilus influenzae Rd
auaaaccguuagguuuaaaag

SEQ ID NO: 713045 - RNA, 24 nt, Haemophilus influenzae Rd
auaaaccguuagguuuaaaagaua

SEQ ID NO: 713046 - RNA, 15 nt, Haemophilus influenzae Rd
auaaaccuaaagcca

SEQ ID NO: 713047 - RNA, 15 nt, Haemophilus influenzae Rd
auaaaccgccaaaaa

SEQ ID NO: 713048 - RNA, 20 nt, Haemophilus influenzae Rd
auaaaccgccaaaaauuaau

SEQ ID NO: 713049 - RNA, 18 nt, Haemophilus influenzae Rd
auaaacccaucauaaaua

SEQ ID NO: 713050 - RNA, 15 nt, Haemophilus influenzae Rd
auaaaccaguuaaau

SEQ ID NO: 713051 - RNA, 19 nt, Haemophilus influenzae Rd
auaaacguugagcaacaag

SEQ ID NO: 713052 - RNA, 18 nt, Haemophilus influenzae Rd
auaaacguugugaacuuu

SEQ ID NO: 713053 - RNA, 14 nt, Haemophilus influenzae Rd
auaaacucuaagcu

SEQ ID NO: 713054 - RNA, 22 nt, Haemophilus influenzae Rd
auaaacuacuucuaaaggcuaa

SEQ ID NO: 713055 - RNA, 22 nt, Haemophilus influenzae Rd
auaaacucauugaacuguuugu

SEQ ID NO: 713056 - RNA, 20 nt, Haemophilus influenzae Rd
auaaaaagauaacuuagaaa

SEQ ID NO: 713057 - RNA, 22 nt, Haemophilus influenzae Rd
auaaaaagugcgguuaauuuuu

SEQ ID NO: 713058 - RNA, 14 nt, Haemophilus influenzae Rd
auaaaaagugggua

SEQ ID NO: 713059 - RNA, 15 nt, Haemophilus influenzae Rd
auaaaaauaauguuu

SEQ ID NO: 713060 - RNA, 16 nt, Haemophilus influenzae Rd
auaaacaauauaacca

SEQ ID NO: 713061 - RNA, 22 nt, Haemophilus influenzae Rd
auaaacaauuccccuuccuuga

SEQ ID NO: 713062 - RNA, 19 nt, Haemophilus influenzae Rd
auaaaccaacauacauuaa

SEQ ID NO: 713063 - RNA, 23 nt, Haemophilus influenzae Rd
auaaaccaccgauuaauaaaauc

SEQ ID NO: 713064 - RNA, 13 nt, Haemophilus influenzae Rd
auaaacaaauugc

SEQ ID NO: 713065 - RNA, 18 nt, Haemophilus influenzae Rd
auaaacaaaauaaacuca

SEQ ID NO: 713066 - RNA, 20 nt, Haemophilus influenzae Rd
auaaacaaagaaucuuaaau

SEQ ID NO: 713067 - RNA, 19 nt, Haemophilus influenzae Rd
auaaaauuuuuaaaguuau

SEQ ID NO: 713068 - RNA, 21 nt, Haemophilus influenzae Rd
auaaaauuuuuaaaguuauuu

SEQ ID NO: 713069 - RNA, 17 nt, Haemophilus influenzae Rd
auaaaauuuuuaccaua

SEQ ID NO: 713070 - RNA, 23 nt, Haemophilus influenzae Rd
auaaaauuuuuaccauauccauu

SEQ ID NO: 713071 - RNA, 19 nt, Haemophilus influenzae Rd
auaaccgcacuuuaaucuc

SEQ ID NO: 713072 - RNA, 22 nt, Haemophilus influenzae Rd
auaaccgccuaaaguuacacaa

SEQ ID NO: 713073 - RNA, 19 nt, Haemophilus influenzae Rd
auaacccuccgcauuaauc

SEQ ID NO: 713074 - RNA, 16 nt, Haemophilus influenzae Rd
auaacccaccaaauua

SEQ ID NO: 713075 - RNA, 18 nt, Haemophilus influenzae Rd
auaacccaccaaauuacu

SEQ ID NO: 713076 - RNA, 18 nt, Haemophilus influenzae Rd
auaaccaaauagaugaaa

SEQ ID NO: 713077 - RNA, 12 nt, Haemophilus influenzae Rd
auaaccaagaaa

SEQ ID NO: 713078 - RNA, 16 nt, Haemophilus influenzae Rd
auaaccaagaaagcau

SEQ ID NO: 713079 - RNA, 19 nt, Haemophilus influenzae Rd
auaaccaagaaagcaugaa

SEQ ID NO: 713080 - RNA, 14 nt, Haemophilus influenzae Rd
auaaccaaaauauu

SEQ ID NO: 713081 - RNA, 15 nt, Haemophilus influenzae Rd
auaacauuguuuuaa

SEQ ID NO: 713082 - RNA, 22 nt, Haemophilus influenzae Rd
auaacacgaccauugaauccaa

SEQ ID NO: 713083 - RNA, 15 nt, Haemophilus influenzae Rd
auaacagauggaucu

SEQ ID NO: 713084 - RNA, 21 nt, Haemophilus influenzae Rd
auaaauuaaaaaaauaguuaa

SEQ ID NO: 713085 - RNA, 15 nt, Haemophilus influenzae Rd
auaaaugacauauaa

SEQ ID NO: 713086 - RNA, 20 nt, Haemophilus influenzae Rd
auaaaugacauauaauauua

SEQ ID NO: 713087 - RNA, 17 nt, Haemophilus influenzae Rd
auaaauguguuaaauaa

SEQ ID NO: 713088 - RNA, 21 nt, Haemophilus influenzae Rd
auaaauuuggauaguuuauua

SEQ ID NO: 713089 - RNA, 20 nt, Haemophilus influenzae Rd
auaaauuuggguaguuuaua

SEQ ID NO: 713090 - RNA, 10 nt, Haemophilus influenzae Rd
auaaauuacc

SEQ ID NO: 713091 - RNA, 19 nt, Haemophilus influenzae Rd
auaaauuagcuuaauaaau

SEQ ID NO: 713092 - RNA, 16 nt, Haemophilus influenzae Rd
auaacaccagugaaua

SEQ ID NO: 713093 - RNA, 13 nt, Haemophilus influenzae Rd
auaacacccucaa

SEQ ID NO: 713094 - RNA, 14 nt, Haemophilus influenzae Rd
auaaauuuuuuaau

SEQ ID NO: 713095 - RNA, 13 nt, Haemophilus influenzae Rd
auaacaauuuuug

SEQ ID NO: 713096 - RNA, 14 nt, Haemophilus influenzae Rd
auaacaauuuuugc

SEQ ID NO: 713097 - RNA, 17 nt, Haemophilus influenzae Rd
auaacaauuuuugcauu

SEQ ID NO: 713098 - RNA, 23 nt, Haemophilus influenzae Rd
auaacaaaagugcgguaaaaauu

SEQ ID NO: 713099 - RNA, 19 nt, Haemophilus influenzae Rd
auaacacaccaacaacgau

SEQ ID NO: 713100 - RNA, 17 nt, Haemophilus influenzae Rd
auaacacagaaaccaau

SEQ ID NO: 713101 - RNA, 14 nt, Haemophilus influenzae Rd
auaaauuuuaaaau

SEQ ID NO: 713102 - RNA, 21 nt, Haemophilus influenzae Rd
auaaauuuuauuccaccacag

SEQ ID NO: 713103 - RNA, 22 nt, Haemophilus influenzae Rd
auaaauuuucaaauugaaaaga

SEQ ID NO: 713104 - RNA, 23 nt, Haemophilus influenzae Rd
auaaauuuucaaauugaaaagaa

SEQ ID NO: 713105 - RNA, 13 nt, Haemophilus influenzae Rd
auaaauuuugccc

SEQ ID NO: 713106 - RNA, 12 nt, Haemophilus influenzae Rd
auaaauuuugug

SEQ ID NO: 713107 - RNA, 22 nt, Haemophilus influenzae Rd
auaaauuuuuagcugauuuuuu

SEQ ID NO: 713108 - RNA, 11 nt, Haemophilus influenzae Rd
auaacaaaaac

SEQ ID NO: 713109 - RNA, 21 nt, Haemophilus influenzae Rd
auaacaaaaacaaucacugaa

SEQ ID NO: 713110 - RNA, 16 nt, Haemophilus influenzae Rd
auaaccucgaaucaca

SEQ ID NO: 713111 - RNA, 13 nt, Haemophilus influenzae Rd
auaacguuaauuc

SEQ ID NO: 713112 - RNA, 14 nt, Haemophilus influenzae Rd
auaaccuaaaauau

SEQ ID NO: 713113 - RNA, 23 nt, Haemophilus influenzae Rd
auaacucaacaccgcaaaaauac

SEQ ID NO: 713114 - RNA, 13 nt, Haemophilus influenzae Rd
auaacucaagcaa

SEQ ID NO: 713115 - RNA, 18 nt, Haemophilus influenzae Rd
auaacuaucacuaauauu

SEQ ID NO: 713116 - RNA, 15 nt, Haemophilus influenzae Rd
auaacuaugccuucu

SEQ ID NO: 713117 - RNA, 13 nt, Haemophilus influenzae Rd
auaacuaauuaag

SEQ ID NO: 713118 - RNA, 22 nt, Haemophilus influenzae Rd
auaacguuuacgauacauagaa

SEQ ID NO: 713119 - RNA, 14 nt, Haemophilus influenzae Rd
auaacuacaacaca

SEQ ID NO: 713120 - RNA, 14 nt, Haemophilus influenzae Rd
auaacuaaaaauac

SEQ ID NO: 713121 - RNA, 17 nt, Haemophilus influenzae Rd
auaacuaaaaauaccgc

SEQ ID NO: 713122 - RNA, 15 nt, Haemophilus influenzae Rd
auaacugccacauca

SEQ ID NO: 713123 - RNA, 19 nt, Haemophilus influenzae Rd
auaacuggaauggauaaac

SEQ ID NO: 713124 - RNA, 13 nt, Haemophilus influenzae Rd
auaacuuagaaaa

SEQ ID NO: 713125 - RNA, 15 nt, Haemophilus influenzae Rd
auaacuuagaaaaua

SEQ ID NO: 713126 - RNA, 17 nt, Haemophilus influenzae Rd
auaacuuagaaaauauc

SEQ ID NO: 713127 - RNA, 17 nt, Haemophilus influenzae Rd
auaacuuaugaauaaua

SEQ ID NO: 713128 - RNA, 14 nt, Haemophilus influenzae Rd
auaacuucaccaau

SEQ ID NO: 713129 - RNA, 20 nt, Haemophilus influenzae Rd
auaacugaucggauuucuuu

SEQ ID NO: 713130 - RNA, 23 nt, Haemophilus influenzae Rd
auaacugauuguccaaagaauaa

SEQ ID NO: 713131 - RNA, 16 nt, Haemophilus influenzae Rd
auaacuucauccauuu

SEQ ID NO: 713132 - RNA, 21 nt, Haemophilus influenzae Rd
auaacuuuuuggcauaguaau

SEQ ID NO: 713133 - RNA, 15 nt, Haemophilus influenzae Rd
auaagaaaauuaucu

SEQ ID NO: 713134 - RNA, 17 nt, Haemophilus influenzae Rd
auaagaaaucucuuuca

SEQ ID NO: 713135 - RNA, 16 nt, Haemophilus influenzae Rd
agucuuucaauguugc

SEQ ID NO: 713136 - RNA, 18 nt, Haemophilus influenzae Rd
agucuuuuuaauuuaaau

SEQ ID NO: 713137 - RNA, 19 nt, Haemophilus influenzae Rd
agucuuuuuaauuuaaaua

SEQ ID NO: 713138 - RNA, 21 nt, Haemophilus influenzae Rd
agucuugccaacgcagguaca

SEQ ID NO: 713139 - RNA, 16 nt, Haemophilus influenzae Rd
agucuugcuuuuuaau

SEQ ID NO: 713140 - RNA, 21 nt, Haemophilus influenzae Rd
agucugcgccuaaaauauuuu

SEQ ID NO: 713141 - RNA, 21 nt, Haemophilus influenzae Rd
agucugcacgggaaauccagc

SEQ ID NO: 713142 - RNA, 14 nt, Haemophilus influenzae Rd
agucuuaauuuguu

SEQ ID NO: 713143 - RNA, 21 nt, Haemophilus influenzae Rd
agucuuagacucguuuuuuau

SEQ ID NO: 713144 - RNA, 13 nt, Haemophilus influenzae Rd
agucuucauaguu

SEQ ID NO: 713145 - RNA, 12 nt, Haemophilus influenzae Rd
agucuucaucuu

SEQ ID NO: 713146 - RNA, 18 nt, Haemophilus influenzae Rd
agucuucaucuuuaaaca

SEQ ID NO: 713147 - RNA, 11 nt, Haemophilus influenzae Rd
aguccuucugc

SEQ ID NO: 713148 - RNA, 15 nt, Haemophilus influenzae Rd
aguccuucugcgauu

SEQ ID NO: 713149 - RNA, 20 nt, Haemophilus influenzae Rd
aguccuucugcgauuucauu

SEQ ID NO: 713150 - RNA, 20 nt, Haemophilus influenzae Rd
aguccuuaaacaaauguauc

SEQ ID NO: 713151 - RNA, 23 nt, Haemophilus influenzae Rd
aguccuuuuacuuuuacuuaaag

SEQ ID NO: 713152 - RNA, 22 nt, Haemophilus influenzae Rd
agucuaaugaugcuucagcguu

SEQ ID NO: 713153 - RNA, 23 nt, Haemophilus influenzae Rd
agucguuuaaccacguauuuuuu

SEQ ID NO: 713154 - RNA, 20 nt, Haemophilus influenzae Rd
agucguucuugaugauaauc

SEQ ID NO: 713155 - RNA, 19 nt, Haemophilus influenzae Rd
agucucuaugauuuuuuug

SEQ ID NO: 713156 - RNA, 14 nt, Haemophilus influenzae Rd
agucuauaaaagaa

SEQ ID NO: 713157 - RNA, 15 nt, Haemophilus influenzae Rd
agucuauaaaagaag

SEQ ID NO: 713158 - RNA, 17 nt, Haemophilus influenzae Rd
agugcaguuucaguauc

SEQ ID NO: 713159 - RNA, 18 nt, Haemophilus influenzae Rd
agugcagcccaaauaaag

SEQ ID NO: 713160 - RNA, 16 nt, Haemophilus influenzae Rd
agugagauaaauaaau

SEQ ID NO: 713161 - RNA, 22 nt, Haemophilus influenzae Rd
agugagaaaguuaaucaaacuu

SEQ ID NO: 713162 - RNA, 20 nt, Haemophilus influenzae Rd
aguggacgagauaaaacuug

SEQ ID NO: 713163 - RNA, 15 nt, Haemophilus influenzae Rd
aguggagcuggaugu

SEQ ID NO: 713164 - RNA, 16 nt, Haemophilus influenzae Rd
aguggaugaccaacac

SEQ ID NO: 713165 - RNA, 23 nt, Haemophilus influenzae Rd
aguggaguauagggaauaaaaaa

SEQ ID NO: 713166 - RNA, 20 nt, Haemophilus influenzae Rd
agugcgguuaauuucugcga

SEQ ID NO: 713167 - RNA, 12 nt, Haemophilus influenzae Rd
agugcuaaaaua

SEQ ID NO: 713168 - RNA, 16 nt, Haemophilus influenzae Rd
agugcuaaaauaaaac

SEQ ID NO: 713169 - RNA, 15 nt, Haemophilus influenzae Rd
agugcgguucuucuu

SEQ ID NO: 713170 - RNA, 15 nt, Haemophilus influenzae Rd
agugcgguugaaauu

SEQ ID NO: 713171 - RNA, 15 nt, Haemophilus influenzae Rd
agugcgguugauuuu

SEQ ID NO: 713172 - RNA, 13 nt, Haemophilus influenzae Rd
aguguauaaauau

SEQ ID NO: 713173 - RNA, 13 nt, Haemophilus influenzae Rd
aguguaauguuuu

SEQ ID NO: 713174 - RNA, 21 nt, Haemophilus influenzae Rd
agugguggaauaaaagucagu

SEQ ID NO: 713175 - RNA, 13 nt, Haemophilus influenzae Rd
agugguuuauuuu

SEQ ID NO: 713176 - RNA, 16 nt, Haemophilus influenzae Rd
agugguuucagaauaa

SEQ ID NO: 713177 - RNA, 17 nt, Haemophilus influenzae Rd
aguggcaauaacuacaa

SEQ ID NO: 713178 - RNA, 18 nt, Haemophilus influenzae Rd
agugggcuuuuuuauuuu

SEQ ID NO: 713179 - RNA, 18 nt, Haemophilus influenzae Rd
agugugauuuuagaaaaa

SEQ ID NO: 713180 - RNA, 18 nt, Haemophilus influenzae Rd
aguguuguuccaccuuga

SEQ ID NO: 713181 - RNA, 22 nt, Haemophilus influenzae Rd
aguguuuccgugauuucuuucg

SEQ ID NO: 713182 - RNA, 19 nt, Haemophilus influenzae Rd
aguguuacaacucuaaauu

SEQ ID NO: 713183 - RNA, 20 nt, Haemophilus influenzae Rd
aguuacuuauuuagcaagcg

SEQ ID NO: 713184 - RNA, 21 nt, Haemophilus influenzae Rd
aguuacucuuggauuaguggu

SEQ ID NO: 713185 - RNA, 16 nt, Haemophilus influenzae Rd
aguuagaccaucuaaa

SEQ ID NO: 713186 - RNA, 20 nt, Haemophilus influenzae Rd
aguuagacugauuuaguuca

SEQ ID NO: 713187 - RNA, 20 nt, Haemophilus influenzae Rd
aguuaaacagcuuuccugua

SEQ ID NO: 713188 - RNA, 12 nt, Haemophilus influenzae Rd
aguuaaaccaaa

SEQ ID NO: 713189 - RNA, 19 nt, Haemophilus influenzae Rd
aguuacgagguugaucuac

SEQ ID NO: 713190 - RNA, 23 nt, Haemophilus influenzae Rd
aguuacgagguugaucuacauca

SEQ ID NO: 713191 - RNA, 19 nt, Haemophilus influenzae Rd
aguuaaacgcuccucugca

SEQ ID NO: 713192 - RNA, 20 nt, Haemophilus influenzae Rd
aguucauuuucacugauaua

SEQ ID NO: 713193 - RNA, 11 nt, Haemophilus influenzae Rd
aguucaagcaa

SEQ ID NO: 713194 - RNA, 16 nt, Haemophilus influenzae Rd
aguucaagugugugaa

SEQ ID NO: 713195 - RNA, 20 nt, Haemophilus influenzae Rd
aguucacaaaucuaaaaaua

SEQ ID NO: 713196 - RNA, 23 nt, Haemophilus influenzae Rd
aguucacaaaucuaaaaauaugu

SEQ ID NO: 713197 - RNA, 17 nt, Haemophilus influenzae Rd
aguucaaauuucuucac

SEQ ID NO: 713198 - RNA, 17 nt, Haemophilus influenzae Rd
aguucguuuuuuccagc

SEQ ID NO: 713199 - RNA, 22 nt, Haemophilus influenzae Rd
aguuccugacccacaucaucaa

SEQ ID NO: 713200 - RNA, 13 nt, Haemophilus influenzae Rd
aguugcagauuua

SEQ ID NO: 713201 - RNA, 19 nt, Haemophilus influenzae Rd
aguugcauaacuucaccaa

SEQ ID NO: 713202 - RNA, 22 nt, Haemophilus influenzae Rd
aguugauuuaaauugaaaaaau

SEQ ID NO: 713203 - RNA, 14 nt, Haemophilus influenzae Rd
aguugauuuuaaaa

SEQ ID NO: 713204 - RNA, 13 nt, Haemophilus influenzae Rd
aguucuuccccuc

SEQ ID NO: 713205 - RNA, 15 nt, Haemophilus influenzae Rd
aguucuuccacgugc

SEQ ID NO: 713206 - RNA, 16 nt, Haemophilus influenzae Rd
aguucuuuuuuggcuu

SEQ ID NO: 713207 - RNA, 22 nt, Haemophilus influenzae Rd
aguucuuuuuuggcuucaucuu

SEQ ID NO: 713208 - RNA, 18 nt, Haemophilus influenzae Rd
aguugaauauuuuguuga

SEQ ID NO: 713209 - RNA, 19 nt, Haemophilus influenzae Rd
aguugaauauuuuguugaa

SEQ ID NO: 713210 - RNA, 23 nt, Haemophilus influenzae Rd
aguugaauuuucaaugguuuaua

SEQ ID NO: 713211 - RNA, 14 nt, Haemophilus influenzae Rd
aguugaaacuguuu

SEQ ID NO: 713212 - RNA, 13 nt, Haemophilus influenzae Rd
aguuguuugugaa

SEQ ID NO: 713213 - RNA, 17 nt, Haemophilus influenzae Rd
aguuguuuguuaugaaa

SEQ ID NO: 713214 - RNA, 21 nt, Haemophilus influenzae Rd
aguuguuucaccauuuccuuu

SEQ ID NO: 713215 - RNA, 16 nt, Haemophilus influenzae Rd
aguuguuuaaaauuag

SEQ ID NO: 713216 - RNA, 17 nt, Haemophilus influenzae Rd
aguuguuuaaaauuagu

SEQ ID NO: 713217 - RNA, 19 nt, Haemophilus influenzae Rd
aguuuaagugguuucaacg

SEQ ID NO: 713218 - RNA, 23 nt, Haemophilus influenzae Rd
aguuuaauacaaucuguccaucu

SEQ ID NO: 713219 - RNA, 19 nt, Haemophilus influenzae Rd
aguuuaaucuuaaagaauu

SEQ ID NO: 713220 - RNA, 15 nt, Haemophilus influenzae Rd
aguuguuuuucuucc

SEQ ID NO: 713221 - RNA, 15 nt, Haemophilus influenzae Rd
aguuggauuaaacaa

SEQ ID NO: 713222 - RNA, 20 nt, Haemophilus influenzae Rd
aguuggauucauuaaguuuu

SEQ ID NO: 713223 - RNA, 17 nt, Haemophilus influenzae Rd
aguuggcaacauauuuu

SEQ ID NO: 713224 - RNA, 20 nt, Haemophilus influenzae Rd
aguuggcaacauauuuucua

SEQ ID NO: 713225 - RNA, 19 nt, Haemophilus influenzae Rd
aguuggacuaaacaacuaa

SEQ ID NO: 713226 - RNA, 19 nt, Haemophilus influenzae Rd
aguuggacuacauaaccca

SEQ ID NO: 713227 - RNA, 18 nt, Haemophilus influenzae Rd
aguuggagauuuuuuagg

SEQ ID NO: 713228 - RNA, 15 nt, Haemophilus influenzae Rd
aguugcugaauaucc

SEQ ID NO: 713229 - RNA, 14 nt, Haemophilus influenzae Rd
aguuucuaauucuu

SEQ ID NO: 713230 - RNA, 16 nt, Haemophilus influenzae Rd
aguuucuaauucuucc

SEQ ID NO: 713231 - RNA, 13 nt, Haemophilus influenzae Rd
aguuucuugggau

SEQ ID NO: 713232 - RNA, 20 nt, Haemophilus influenzae Rd
aguuucuugggauuuugccg

SEQ ID NO: 713233 - RNA, 16 nt, Haemophilus influenzae Rd
aguuugauuaacuuuc

SEQ ID NO: 713234 - RNA, 12 nt, Haemophilus influenzae Rd
aguuuuggcuuu

SEQ ID NO: 713235 - RNA, 17 nt, Haemophilus influenzae Rd
aguuuuuagcaguuugc

SEQ ID NO: 713236 - RNA, 16 nt, Haemophilus influenzae Rd
aguuuuuaguuuuugc

SEQ ID NO: 713237 - RNA, 18 nt, Haemophilus influenzae Rd
aguuuuggucaauauauu

SEQ ID NO: 713238 - RNA, 13 nt, Haemophilus influenzae Rd
aguuuuuuuauaa

SEQ ID NO: 713239 - RNA, 11 nt, Haemophilus influenzae Rd
auaaaaaaaca

SEQ ID NO: 713240 - RNA, 20 nt, Haemophilus influenzae Rd
aguuuguggaguaauucuuu

SEQ ID NO: 713241 - RNA, 21 nt, Haemophilus influenzae Rd
aguuuguuucucaaguuuaac

SEQ ID NO: 713242 - RNA, 20 nt, Haemophilus influenzae Rd
aguuuguuugcugcaccaau

SEQ ID NO: 713243 - RNA, 14 nt, Haemophilus influenzae Rd
aguuuguuuuuaac

SEQ ID NO: 713244 - RNA, 18 nt, Haemophilus influenzae Rd
aguuuucgugauuuugaa

SEQ ID NO: 713245 - RNA, 11 nt, Haemophilus influenzae Rd
aguuuucuagc

SEQ ID NO: 713246 - RNA, 21 nt, Haemophilus influenzae Rd
aguuuuacguugcaacgcugc

SEQ ID NO: 713247 - RNA, 21 nt, Haemophilus influenzae Rd
auaauuacagaaucauuuuca

SEQ ID NO: 713248 - RNA, 18 nt, Haemophilus influenzae Rd
auaauuaccugugaaaac

SEQ ID NO: 713249 - RNA, 22 nt, Haemophilus influenzae Rd
auaauuacgcaacgcuuguuug

SEQ ID NO: 713250 - RNA, 21 nt, Haemophilus influenzae Rd
auaauuaaggucuuacaccua

SEQ ID NO: 713251 - RNA, 15 nt, Haemophilus influenzae Rd
auaauuaauaaaaaa

SEQ ID NO: 713252 - RNA, 16 nt, Haemophilus influenzae Rd
auaauuaauaaaaaau

SEQ ID NO: 713253 - RNA, 18 nt, Haemophilus influenzae Rd
auaauuaaugcuaaacca

SEQ ID NO: 713254 - RNA, 20 nt, Haemophilus influenzae Rd
auaauuagauaauacagaaa

SEQ ID NO: 713255 - RNA, 22 nt, Haemophilus influenzae Rd
auacgccaacgcuuaaugaacu

SEQ ID NO: 713256 - RNA, 18 nt, Haemophilus influenzae Rd
auacgaucacgauuuuuc

SEQ ID NO: 713257 - RNA, 20 nt, Haemophilus influenzae Rd
auacgcccauugaaauaaca

SEQ ID NO: 713258 - RNA, 22 nt, Haemophilus influenzae Rd
auacgcccauugaaauaacaca

SEQ ID NO: 713259 - RNA, 22 nt, Haemophilus influenzae Rd
auacguaaucccauuucaucuu

SEQ ID NO: 713260 - RNA, 15 nt, Haemophilus influenzae Rd
auacguauaauugac

SEQ ID NO: 713261 - RNA, 15 nt, Haemophilus influenzae Rd
auacguuguuuuucu

SEQ ID NO: 713262 - RNA, 15 nt, Haemophilus influenzae Rd
auacgucaauagcgg

SEQ ID NO: 713263 - RNA, 16 nt, Haemophilus influenzae Rd
auacgugauaaugccu

SEQ ID NO: 713264 - RNA, 20 nt, Haemophilus influenzae Rd
auacuccacuauaaaauacu

SEQ ID NO: 713265 - RNA, 22 nt, Haemophilus influenzae Rd
auacuccacuauaaaauacuau

SEQ ID NO: 713266 - RNA, 11 nt, Haemophilus influenzae Rd
auacucacaga

SEQ ID NO: 713267 - RNA, 16 nt, Haemophilus influenzae Rd
auacucacagagccuu

SEQ ID NO: 713268 - RNA, 22 nt, Haemophilus influenzae Rd
auacuggcacuaaaccugcuuc

SEQ ID NO: 713269 - RNA, 17 nt, Haemophilus influenzae Rd
auacugcucuuggauuu

SEQ ID NO: 713270 - RNA, 13 nt, Haemophilus influenzae Rd
auacugcuuguuc

SEQ ID NO: 713271 - RNA, 18 nt, Haemophilus influenzae Rd
auacugccuuuaaagaag

SEQ ID NO: 713272 - RNA, 16 nt, Haemophilus influenzae Rd
auacugaaaugauuau

SEQ ID NO: 713273 - RNA, 13 nt, Haemophilus influenzae Rd
auacugauaccgu

SEQ ID NO: 713274 - RNA, 12 nt, Haemophilus influenzae Rd
auagagaaauaa

SEQ ID NO: 713275 - RNA, 12 nt, Haemophilus influenzae Rd
auagacuucaag

SEQ ID NO: 713276 - RNA, 13 nt, Haemophilus influenzae Rd
auacuugcaguga

SEQ ID NO: 713277 - RNA, 18 nt, Haemophilus influenzae Rd
auacuugccacagguaaa

SEQ ID NO: 713278 - RNA, 20 nt, Haemophilus influenzae Rd
auacuugccacagguaaaga

SEQ ID NO: 713279 - RNA, 21 nt, Haemophilus influenzae Rd
auacuucuuuagcugcaauaa

SEQ ID NO: 713280 - RNA, 16 nt, Haemophilus influenzae Rd
auacuugaccaaaauu

SEQ ID NO: 713281 - RNA, 23 nt, Haemophilus influenzae Rd
auacuuugcuugaguauuuacua

SEQ ID NO: 713282 - RNA, 19 nt, Haemophilus influenzae Rd
auacuuuuaauuaaauaca

SEQ ID NO: 713283 - RNA, 21 nt, Haemophilus influenzae Rd
auacuuuuaauuaaauacaaa

SEQ ID NO: 713284 - RNA, 16 nt, Haemophilus influenzae Rd
auagaggaaccaugua

SEQ ID NO: 713285 - RNA, 21 nt, Haemophilus influenzae Rd
auagauaaaauguugaauaua

SEQ ID NO: 713286 - RNA, 22 nt, Haemophilus influenzae Rd
auagauaaaauuaaucauaaaa

SEQ ID NO: 713287 - RNA, 13 nt, Haemophilus influenzae Rd
auagaugaaauuu

SEQ ID NO: 713288 - RNA, 16 nt, Haemophilus influenzae Rd
auagaugaaauuuauu

SEQ ID NO: 713289 - RNA, 23 nt, Haemophilus influenzae Rd
auagaugaauuagaaaaauuuaa

SEQ ID NO: 713290 - RNA, 19 nt, Haemophilus influenzae Rd
auagcaaugccaaucuaaa

SEQ ID NO: 713291 - RNA, 21 nt, Haemophilus influenzae Rd
auagcaaugccaaucuaaaca

SEQ ID NO: 713292 - RNA, 20 nt, Haemophilus influenzae Rd
auagauuacguagaaaacaa

SEQ ID NO: 713293 - RNA, 19 nt, Haemophilus influenzae Rd
auagccaagugcuuuaccu

SEQ ID NO: 713294 - RNA, 20 nt, Haemophilus influenzae Rd
auagcguuuuucguguuuag

SEQ ID NO: 713295 - RNA, 13 nt, Haemophilus influenzae Rd
auagcggcaugaa

SEQ ID NO: 713296 - RNA, 13 nt, Haemophilus influenzae Rd
auagcuuugcuuu

SEQ ID NO: 713297 - RNA, 18 nt, Haemophilus influenzae Rd
auagcuugaauugcuccu

SEQ ID NO: 713298 - RNA, 18 nt, Haemophilus influenzae Rd
auagcuuuuuaauugugu

SEQ ID NO: 713299 - RNA, 16 nt, Haemophilus influenzae Rd
auaggaaaggcauuuu

SEQ ID NO: 713300 - RNA, 13 nt, Haemophilus influenzae Rd
auagcuuccauuu

SEQ ID NO: 713301 - RNA, 16 nt, Haemophilus influenzae Rd
auagcuaacaaauuua

SEQ ID NO: 713302 - RNA, 23 nt, Haemophilus influenzae Rd
auagcuaacaaauuuaauauuuc

SEQ ID NO: 713303 - RNA, 19 nt, Haemophilus influenzae Rd
auagcuacgguuauuuuuu

SEQ ID NO: 713304 - RNA, 15 nt, Haemophilus influenzae Rd
auagcucgaugagaa

SEQ ID NO: 713305 - RNA, 14 nt, Haemophilus influenzae Rd
auagguaaacuuug

SEQ ID NO: 713306 - RNA, 18 nt, Haemophilus influenzae Rd
auaggguaauaaaaaaua

SEQ ID NO: 713307 - RNA, 16 nt, Haemophilus influenzae Rd
auaggaguaaaaauau

SEQ ID NO: 713308 - RNA, 13 nt, Haemophilus influenzae Rd
auaggauuauuca

SEQ ID NO: 713309 - RNA, 19 nt, Haemophilus influenzae Rd
auaggauugccuucauaua

SEQ ID NO: 713310 - RNA, 15 nt, Haemophilus influenzae Rd
auagguauagccuuc

SEQ ID NO: 713311 - RNA, 15 nt, Haemophilus influenzae Rd
auaguaaaaauuguu

SEQ ID NO: 713312 - RNA, 16 nt, Haemophilus influenzae Rd
auaguaaaaaaucaag

SEQ ID NO: 713313 - RNA, 17 nt, Haemophilus influenzae Rd
auaguaaaaaaucaagc

SEQ ID NO: 713314 - RNA, 22 nt, Haemophilus influenzae Rd
auaguaagcaccaaaauuuguu

SEQ ID NO: 713315 - RNA, 19 nt, Haemophilus influenzae Rd
auaguaaagaauauuuuaa

SEQ ID NO: 713316 - RNA, 20 nt, Haemophilus influenzae Rd
auaguagaauguaaauuauu

SEQ ID NO: 713317 - RNA, 17 nt, Haemophilus influenzae Rd
auaguagagucauuuac

SEQ ID NO: 713318 - RNA, 21 nt, Haemophilus influenzae Rd
auaguggcaauaacuacaaca

SEQ ID NO: 713319 - RNA, 12 nt, Haemophilus influenzae Rd
auagugauuauu

SEQ ID NO: 713320 - RNA, 14 nt, Haemophilus influenzae Rd
auaguaguaaugaa

SEQ ID NO: 713321 - RNA, 20 nt, Haemophilus influenzae Rd
auaguuggauuauuuagaua

SEQ ID NO: 713322 - RNA, 23 nt, Haemophilus influenzae Rd
auaguugaugaaccauaaacaau

SEQ ID NO: 713323 - RNA, 21 nt, Haemophilus influenzae Rd
auaguuuggcugaaauucuaa

SEQ ID NO: 713324 - RNA, 20 nt, Haemophilus influenzae Rd
auaguuuucugauuuaaaac

SEQ ID NO: 713325 - RNA, 24 nt, Haemophilus influenzae Rd
auauaaaaaaagaccgcacuuuua

SEQ ID NO: 713326 - RNA, 22 nt, Haemophilus influenzae Rd
auauaacucaacaccgcaaaaa

SEQ ID NO: 713327 - RNA, 14 nt, Haemophilus influenzae Rd
auauaaauuuagaa

SEQ ID NO: 713328 - RNA, 19 nt, Haemophilus influenzae Rd
auauaaauuauguuaaauu

SEQ ID NO: 713329 - RNA, 10 nt, Haemophilus influenzae Rd
auauaaaaua

SEQ ID NO: 713330 - RNA, 13 nt, Haemophilus influenzae Rd
auauaaaauaaag

SEQ ID NO: 713331 - RNA, 14 nt, Haemophilus influenzae Rd
auauaaaaaacccg

SEQ ID NO: 713332 - RNA, 13 nt, Haemophilus influenzae Rd
auauaagaaauaa

SEQ ID NO: 713333 - RNA, 15 nt, Haemophilus influenzae Rd
auauaagaaauaauc

SEQ ID NO: 713334 - RNA, 21 nt, Haemophilus influenzae Rd
auauaauuuccuauacuaauu

SEQ ID NO: 713335 - RNA, 17 nt, Haemophilus influenzae Rd
auauaauuuaacauaac

SEQ ID NO: 713336 - RNA, 22 nt, Haemophilus influenzae Rd
auaucacuucuguaagcagcua

SEQ ID NO: 713337 - RNA, 13 nt, Haemophilus influenzae Rd
auaucagaaaaga

SEQ ID NO: 713338 - RNA, 16 nt, Haemophilus influenzae Rd
auaucacgauaagcaa

SEQ ID NO: 713339 - RNA, 23 nt, Haemophilus influenzae Rd
auaucacgcaccacuucauauaa

SEQ ID NO: 713340 - RNA, 16 nt, Haemophilus influenzae Rd
auaucacagauuuuua

SEQ ID NO: 713341 - RNA, 17 nt, Haemophilus influenzae Rd
auaucacagauuuuuua

SEQ ID NO: 713342 - RNA, 21 nt, Haemophilus influenzae Rd
auaucacagauuuuuuauuaa

SEQ ID NO: 713343 - RNA, 10 nt, Haemophilus influenzae Rd
auaucaaguc

SEQ ID NO: 713344 - RNA, 22 nt, Haemophilus influenzae Rd
auaucaaaaaguugaauuuuca

SEQ ID NO: 713345 - RNA, 20 nt, Haemophilus influenzae Rd
auauauuuuaucaacuaaaa

SEQ ID NO: 713346 - RNA, 12 nt, Haemophilus influenzae Rd
auauauuuuccu

SEQ ID NO: 713347 - RNA, 12 nt, Haemophilus influenzae Rd
auauauuucuaa

SEQ ID NO: 713348 - RNA, 13 nt, Haemophilus influenzae Rd
auauauugaacau

SEQ ID NO: 713349 - RNA, 20 nt, Haemophilus influenzae Rd
auaucgagcagacaaaauug

SEQ ID NO: 713350 - RNA, 21 nt, Haemophilus influenzae Rd
auaucgaggcuuuuuuuauag

SEQ ID NO: 713351 - RNA, 14 nt, Haemophilus influenzae Rd
auaucuacuuucag

SEQ ID NO: 713352 - RNA, 15 nt, Haemophilus influenzae Rd
auaucuaaacuucaa

SEQ ID NO: 713353 - RNA, 22 nt, Haemophilus influenzae Rd
auaucuaaacuucaauuuuuua

SEQ ID NO: 713354 - RNA, 16 nt, Haemophilus influenzae Rd
auaucgccuuauccca

SEQ ID NO: 713355 - RNA, 23 nt, Haemophilus influenzae Rd
auaucuaaggcgacaaaaugucg

SEQ ID NO: 713356 - RNA, 19 nt, Haemophilus influenzae Rd
auaucgaauuaaagaaaaa

SEQ ID NO: 713357 - RNA, 15 nt, Haemophilus influenzae Rd
auauccaaagcaauu

SEQ ID NO: 713358 - RNA, 16 nt, Haemophilus influenzae Rd
auauccaaaucaaaaa

SEQ ID NO: 713359 - RNA, 19 nt, Haemophilus influenzae Rd
auauccacuucauuaaaac

SEQ ID NO: 713360 - RNA, 13 nt, Haemophilus influenzae Rd
auauccaauuauu

SEQ ID NO: 713361 - RNA, 17 nt, Haemophilus influenzae Rd
auaucuuauauuuuuga

SEQ ID NO: 713362 - RNA, 18 nt, Haemophilus influenzae Rd
auaucuuccaaagcaauc

SEQ ID NO: 713363 - RNA, 19 nt, Haemophilus influenzae Rd
auaucugucauuguaauuu

SEQ ID NO: 713364 - RNA, 22 nt, Haemophilus influenzae Rd
auaucuaggcuaauuauuuaaa

SEQ ID NO: 713365 - RNA, 17 nt, Haemophilus influenzae Rd
auaucugcuuuuucuug

SEQ ID NO: 713366 - RNA, 19 nt, Haemophilus influenzae Rd
auaucuggauguuguaaaa

SEQ ID NO: 713367 - RNA, 20 nt, Haemophilus influenzae Rd
auaucuggauguuguaaaau

SEQ ID NO: 713368 - RNA, 16 nt, Haemophilus influenzae Rd
auaucuucuucuugca

SEQ ID NO: 713369 - RNA, 19 nt, Haemophilus influenzae Rd
auaucuucuucuugcaggg

SEQ ID NO: 713370 - RNA, 22 nt, Haemophilus influenzae Rd
auaucuucuucuugcagggcuu

SEQ ID NO: 713371 - RNA, 13 nt, Haemophilus influenzae Rd
auaucuucucuug

SEQ ID NO: 713372 - RNA, 20 nt, Haemophilus influenzae Rd
auaucuuuaacaaaaucaau

SEQ ID NO: 713373 - RNA, 12 nt, Haemophilus influenzae Rd
auaucuuuaccu

SEQ ID NO: 713374 - RNA, 22 nt, Haemophilus influenzae Rd
auaucuuucucuugcguuuggu

SEQ ID NO: 713375 - RNA, 16 nt, Haemophilus influenzae Rd
auaucuuugaauugaa

SEQ ID NO: 713376 - RNA, 18 nt, Haemophilus influenzae Rd
auaucuuugacuaaauca

SEQ ID NO: 713377 - RNA, 20 nt, Haemophilus influenzae Rd
auaucuuugacuaaaucaug

SEQ ID NO: 713378 - RNA, 14 nt, Haemophilus influenzae Rd
auaugaaaaauaau

SEQ ID NO: 713379 - RNA, 12 nt, Haemophilus influenzae Rd
auauuuaaauac

SEQ ID NO: 713380 - RNA, 19 nt, Haemophilus influenzae Rd
auauuuggcugauauauua

SEQ ID NO: 713381 - RNA, 21 nt, Haemophilus influenzae Rd
auauuuguugccauuguuaaa

SEQ ID NO: 713382 - RNA, 13 nt, Haemophilus influenzae Rd
auauuuuaaauaa

SEQ ID NO: 713383 - RNA, 15 nt, Haemophilus influenzae Rd
auauuuuaaauaauu

SEQ ID NO: 713384 - RNA, 19 nt, Haemophilus influenzae Rd
auauuuuaaauaauuaaaa

SEQ ID NO: 713385 - RNA, 22 nt, Haemophilus influenzae Rd
auauuuuaauaaagauaaauua

SEQ ID NO: 713386 - RNA, 22 nt, Haemophilus influenzae Rd
auauuuuccccuuguucuucau

SEQ ID NO: 713387 - RNA, 19 nt, Haemophilus influenzae Rd
auauuuucccucuuuaucu

SEQ ID NO: 713388 - RNA, 14 nt, Haemophilus influenzae Rd
auauuuucaaauaa

SEQ ID NO: 713389 - RNA, 18 nt, Haemophilus influenzae Rd
auauuuuaaugaaaguaa

SEQ ID NO: 713390 - RNA, 15 nt, Haemophilus influenzae Rd
auauugucuauuugc

SEQ ID NO: 713391 - RNA, 14 nt, Haemophilus influenzae Rd
auauugucuauuuu

SEQ ID NO: 713392 - RNA, 17 nt, Haemophilus influenzae Rd
auauuguuaauuaucaa

SEQ ID NO: 713393 - RNA, 16 nt, Haemophilus influenzae Rd
auauuguugcacauua

SEQ ID NO: 713394 - RNA, 17 nt, Haemophilus influenzae Rd
auauuguuucuucucuu

SEQ ID NO: 713395 - RNA, 16 nt, Haemophilus influenzae Rd
auauugcggacaauaa

SEQ ID NO: 713396 - RNA, 13 nt, Haemophilus influenzae Rd
auauuuuuucuua

SEQ ID NO: 713397 - RNA, 23 nt, Haemophilus influenzae Rd
auauuuuuucagccuauuuuuag

SEQ ID NO: 713398 - RNA, 10 nt, Haemophilus influenzae Rd
auauuuuuga

SEQ ID NO: 713399 - RNA, 16 nt, Haemophilus influenzae Rd
auauuuuuuaguuugu

SEQ ID NO: 713400 - RNA, 21 nt, Haemophilus influenzae Rd
aucaaaaaacgaaauuuuuca

SEQ ID NO: 713401 - RNA, 16 nt, Haemophilus influenzae Rd
aucaaaaaugcuuuug

SEQ ID NO: 713402 - RNA, 15 nt, Haemophilus influenzae Rd
aucaaaaaucaacca

SEQ ID NO: 713403 - RNA, 19 nt, Haemophilus influenzae Rd
auauuuuuaugcuucuucu

SEQ ID NO: 713404 - RNA, 15 nt, Haemophilus influenzae Rd
auauuuuuaauuugg

SEQ ID NO: 713405 - RNA, 21 nt, Haemophilus influenzae Rd
auauuuuuacuccuauuagua

SEQ ID NO: 713406 - RNA, 12 nt, Haemophilus influenzae Rd
auauuuuuagau

SEQ ID NO: 713407 - RNA, 17 nt, Haemophilus influenzae Rd
auauuuugaauaauaaa

SEQ ID NO: 713408 - RNA, 23 nt, Haemophilus influenzae Rd
auauucagacugaauuugacauu

SEQ ID NO: 713409 - RNA, 19 nt, Haemophilus influenzae Rd
auauucagcaaaaucacuc

SEQ ID NO: 713410 - RNA, 17 nt, Haemophilus influenzae Rd
auauuccuuagaaagua

SEQ ID NO: 713411 - RNA, 19 nt, Haemophilus influenzae Rd
auauuccuucggcauauaa

SEQ ID NO: 713412 - RNA, 21 nt, Haemophilus influenzae Rd
auauucgacaggaacauucac

SEQ ID NO: 713413 - RNA, 18 nt, Haemophilus influenzae Rd
auauucgccuaauugcug

SEQ ID NO: 713414 - RNA, 17 nt, Haemophilus influenzae Rd
auauucgccuucacaaa

SEQ ID NO: 713415 - RNA, 18 nt, Haemophilus influenzae Rd
auauucgcuucuuuuaau

SEQ ID NO: 713416 - RNA, 14 nt, Haemophilus influenzae Rd
auauucgcuuucau

SEQ ID NO: 713417 - RNA, 18 nt, Haemophilus influenzae Rd
auauucguuaaauaaugc

SEQ ID NO: 713418 - RNA, 18 nt, Haemophilus influenzae Rd
auauucuaccgcauuuuu

SEQ ID NO: 713419 - RNA, 16 nt, Haemophilus influenzae Rd
auauucuguaucaauu

SEQ ID NO: 713420 - RNA, 18 nt, Haemophilus influenzae Rd
auauucuggcaauauuuc

SEQ ID NO: 713421 - RNA, 19 nt, Haemophilus influenzae Rd
auauucuggcaauauuuca

SEQ ID NO: 713422 - RNA, 22 nt, Haemophilus influenzae Rd
auauucuguugaaugcuauucu

SEQ ID NO: 713423 - RNA, 19 nt, Haemophilus influenzae Rd
auauucugcauaaaauaau

SEQ ID NO: 713424 - RNA, 19 nt, Haemophilus influenzae Rd
auauucucucgcugaauua

SEQ ID NO: 713425 - RNA, 16 nt, Haemophilus influenzae Rd
auauucuauuuauaau

SEQ ID NO: 713426 - RNA, 18 nt, Haemophilus influenzae Rd
auauucuugcguaaccaa

SEQ ID NO: 713427 - RNA, 20 nt, Haemophilus influenzae Rd
auauucuugcguaaccaaag

SEQ ID NO: 713428 - RNA, 17 nt, Haemophilus influenzae Rd
auauucuucauaaaaaa

SEQ ID NO: 713429 - RNA, 16 nt, Haemophilus influenzae Rd
auauucuucgcuuaau

SEQ ID NO: 713430 - RNA, 14 nt, Haemophilus influenzae Rd
auauucuucuaaaa

SEQ ID NO: 713431 - RNA, 15 nt, Haemophilus influenzae Rd
auauugauuucucug

SEQ ID NO: 713432 - RNA, 12 nt, Haemophilus influenzae Rd
auauugcacaau

SEQ ID NO: 713433 - RNA, 23 nt, Haemophilus influenzae Rd
auauugcauaaucauaucuaaca

SEQ ID NO: 713434 - RNA, 13 nt, Haemophilus influenzae Rd
auauucaauuacu

SEQ ID NO: 713435 - RNA, 17 nt, Haemophilus influenzae Rd
auauucacucuuauuca

SEQ ID NO: 713436 - RNA, 14 nt, Haemophilus influenzae Rd
auauuauuuagauu

SEQ ID NO: 713437 - RNA, 16 nt, Haemophilus influenzae Rd
auauuauuuauuuuga

SEQ ID NO: 713438 - RNA, 13 nt, Haemophilus influenzae Rd
auauucaaaacau

SEQ ID NO: 713439 - RNA, 18 nt, Haemophilus influenzae Rd
auauucaaauuucauccu

SEQ ID NO: 713440 - RNA, 14 nt, Haemophilus influenzae Rd
auauuauuaaguaa

SEQ ID NO: 713441 - RNA, 18 nt, Haemophilus influenzae Rd
auauuauuaagucuauua

SEQ ID NO: 713442 - RNA, 22 nt, Haemophilus influenzae Rd
auauuauucagcacuuucgcuu

SEQ ID NO: 713443 - RNA, 21 nt, Haemophilus influenzae Rd
auaugauuacgguuugcgccg

SEQ ID NO: 713444 - RNA, 23 nt, Haemophilus influenzae Rd
auaugauucugugcaauauuucc

SEQ ID NO: 713445 - RNA, 21 nt, Haemophilus influenzae Rd
auauuaugugcuugggcaauu

SEQ ID NO: 713446 - RNA, 16 nt, Haemophilus influenzae Rd
auauuauguucucuca

SEQ ID NO: 713447 - RNA, 14 nt, Haemophilus influenzae Rd
auaugauaaaaaua

SEQ ID NO: 713448 - RNA, 17 nt, Haemophilus influenzae Rd
auaugaucuuuaauuaa

SEQ ID NO: 713449 - RNA, 15 nt, Haemophilus influenzae Rd
aucaaacuuuuagaa

SEQ ID NO: 713450 - RNA, 20 nt, Haemophilus influenzae Rd
aucaaacaguucaauaaaaa

SEQ ID NO: 713451 - RNA, 16 nt, Haemophilus influenzae Rd
aucaaaccaaccacag

SEQ ID NO: 713452 - RNA, 19 nt, Haemophilus influenzae Rd
aucaaaaccaaucauugga

SEQ ID NO: 713453 - RNA, 17 nt, Haemophilus influenzae Rd
aucaaaaccauuuuucg

SEQ ID NO: 713454 - RNA, 18 nt, Haemophilus influenzae Rd
aucaaaaagaaauauuag

SEQ ID NO: 713455 - RNA, 17 nt, Haemophilus influenzae Rd
aucaaaacgaucuaaaa

SEQ ID NO: 713456 - RNA, 15 nt, Haemophilus influenzae Rd
aucaaacaaacccuc

SEQ ID NO: 713457 - RNA, 18 nt, Haemophilus influenzae Rd
aucaaccauuuguuggcg

SEQ ID NO: 713458 - RNA, 19 nt, Haemophilus influenzae Rd
aucaaggcuggaauaugga

SEQ ID NO: 713459 - RNA, 23 nt, Haemophilus influenzae Rd
aucaaggcuuuaauuuuaucuaa

SEQ ID NO: 713460 - RNA, 19 nt, Haemophilus influenzae Rd
aucaagcugugcaaaacua

SEQ ID NO: 713461 - RNA, 15 nt, Haemophilus influenzae Rd
aucaaguaauacuuu

SEQ ID NO: 713462 - RNA, 14 nt, Haemophilus influenzae Rd
aucaagcacaucau

SEQ ID NO: 713463 - RNA, 21 nt, Haemophilus influenzae Rd
aucaagcccucgaauauugag

SEQ ID NO: 713464 - RNA, 23 nt, Haemophilus influenzae Rd
aucaagaugacgaaaugaaauua

SEQ ID NO: 713465 - RNA, 20 nt, Haemophilus influenzae Rd
aucaacgcgccacgguaaau

SEQ ID NO: 713466 - RNA, 20 nt, Haemophilus influenzae Rd
aucacacguccaucacgcau

SEQ ID NO: 713467 - RNA, 17 nt, Haemophilus influenzae Rd
aucacaaugagacuuaa

SEQ ID NO: 713468 - RNA, 19 nt, Haemophilus influenzae Rd
aucacaacuugcaaccaua

SEQ ID NO: 713469 - RNA, 14 nt, Haemophilus influenzae Rd
aucacaagcaaguu

SEQ ID NO: 713470 - RNA, 14 nt, Haemophilus influenzae Rd
aucacaaauuucca

SEQ ID NO: 713471 - RNA, 18 nt, Haemophilus influenzae Rd
aucaauuuuuucuccaca

SEQ ID NO: 713472 - RNA, 20 nt, Haemophilus influenzae Rd
aucacaaaauggcaaacaaa

SEQ ID NO: 713473 - RNA, 21 nt, Haemophilus influenzae Rd
aucacaaaauggcaaacaaaa

SEQ ID NO: 713474 - RNA, 13 nt, Haemophilus influenzae Rd
aucacaaacaaua

SEQ ID NO: 713475 - RNA, 14 nt, Haemophilus influenzae Rd
aucacaaacaauau

SEQ ID NO: 713476 - RNA, 13 nt, Haemophilus influenzae Rd
aucacaaauccau

SEQ ID NO: 713477 - RNA, 22 nt, Haemophilus influenzae Rd
aucaauuuuacguuuuaaauua

SEQ ID NO: 713478 - RNA, 16 nt, Haemophilus influenzae Rd
aucaauuuugacaauu

SEQ ID NO: 713479 - RNA, 11 nt, Haemophilus influenzae Rd
aucaauuuuua

SEQ ID NO: 713480 - RNA, 16 nt, Haemophilus influenzae Rd
aucaauggguuuaaaa

SEQ ID NO: 713481 - RNA, 18 nt, Haemophilus influenzae Rd
aucaauuacguaaucauc

SEQ ID NO: 713482 - RNA, 14 nt, Haemophilus influenzae Rd
aucaaugaauauaa

SEQ ID NO: 713483 - RNA, 16 nt, Haemophilus influenzae Rd
aucaaugaauauaaaa

SEQ ID NO: 713484 - RNA, 14 nt, Haemophilus influenzae Rd
aucaaucuuuaaaa

SEQ ID NO: 713485 - RNA, 13 nt, Haemophilus influenzae Rd
aucaaugcaacau

SEQ ID NO: 713486 - RNA, 15 nt, Haemophilus influenzae Rd
aucaaguuaaaaaau

SEQ ID NO: 713487 - RNA, 21 nt, Haemophilus influenzae Rd
aucaaguuaaaaaaugauuaa

SEQ ID NO: 713488 - RNA, 18 nt, Haemophilus influenzae Rd
aucaauauaaccuugucc

SEQ ID NO: 713489 - RNA, 11 nt, Haemophilus influenzae Rd
aucaauauuau

SEQ ID NO: 713490 - RNA, 14 nt, Haemophilus influenzae Rd
aucaaucaaauuca

SEQ ID NO: 713491 - RNA, 16 nt, Haemophilus influenzae Rd
aucacccggcacauaa

SEQ ID NO: 713492 - RNA, 17 nt, Haemophilus influenzae Rd
aucacccggcacauaaa

SEQ ID NO: 713493 - RNA, 15 nt, Haemophilus influenzae Rd
aucacccaucaaauc

SEQ ID NO: 713494 - RNA, 14 nt, Haemophilus influenzae Rd
aucacccauuaaau

SEQ ID NO: 713495 - RNA, 15 nt, Haemophilus influenzae Rd
aucacccauuaaaua

SEQ ID NO: 713496 - RNA, 18 nt, Haemophilus influenzae Rd
aucaccgcacuuuuauug

SEQ ID NO: 713497 - RNA, 14 nt, Haemophilus influenzae Rd
aucaccgaaauaac

SEQ ID NO: 713498 - RNA, 23 nt, Haemophilus influenzae Rd
aucaccgcccuuuuuaucuauuu

SEQ ID NO: 713499 - RNA, 19 nt, Haemophilus influenzae Rd
aucacauagauuuaagcuu

SEQ ID NO: 713500 - RNA, 14 nt, Haemophilus influenzae Rd
aucacaguuuuauu

SEQ ID NO: 713501 - RNA, 15 nt, Haemophilus influenzae Rd
aucacagauuuuuaa

SEQ ID NO: 713502 - RNA, 16 nt, Haemophilus influenzae Rd
aucacagauuuuuaaa

SEQ ID NO: 713503 - RNA, 18 nt, Haemophilus influenzae Rd
aucaccaagaaucaaggc

SEQ ID NO: 713504 - RNA, 23 nt, Haemophilus influenzae Rd
aucacauuuuauugaagaguaaa

SEQ ID NO: 713505 - RNA, 16 nt, Haemophilus influenzae Rd
aucacguucaaaaaua

SEQ ID NO: 713506 - RNA, 18 nt, Haemophilus influenzae Rd
aucacguucaaaaauauu

SEQ ID NO: 713507 - RNA, 22 nt, Haemophilus influenzae Rd
aucacguucaaaaauauuaugu

SEQ ID NO: 713508 - RNA, 17 nt, Haemophilus influenzae Rd
aucacuaauugcauuaa

SEQ ID NO: 713509 - RNA, 18 nt, Haemophilus influenzae Rd
aucacuaaauucuuguuu

SEQ ID NO: 713510 - RNA, 23 nt, Haemophilus influenzae Rd
aucacuaauauaaagauaauuac

SEQ ID NO: 713511 - RNA, 18 nt, Haemophilus influenzae Rd
aucacugaauuucauuca

SEQ ID NO: 713512 - RNA, 15 nt, Haemophilus influenzae Rd
aucacgccagauaaa

SEQ ID NO: 713513 - RNA, 19 nt, Haemophilus influenzae Rd
aucacgcguuucuaaaaua

SEQ ID NO: 713514 - RNA, 14 nt, Haemophilus influenzae Rd
aucacguaauacaa

SEQ ID NO: 713515 - RNA, 16 nt, Haemophilus influenzae Rd
aucacgaguaauauga

SEQ ID NO: 713516 - RNA, 22 nt, Haemophilus influenzae Rd
aucacgaauugacggugcauuu

SEQ ID NO: 713517 - RNA, 23 nt, Haemophilus influenzae Rd
aucacgaauugacggugcauuug

SEQ ID NO: 713518 - RNA, 14 nt, Haemophilus influenzae Rd
aucacgaucugcaa

SEQ ID NO: 713519 - RNA, 13 nt, Haemophilus influenzae Rd
aucagauuuaggc

SEQ ID NO: 713520 - RNA, 22 nt, Haemophilus influenzae Rd
aucagauuuaggcaauaaaaaa

SEQ ID NO: 713521 - RNA, 23 nt, Haemophilus influenzae Rd
aucagagccucuuggauuuucuu

SEQ ID NO: 713522 - RNA, 17 nt, Haemophilus influenzae Rd
aucagaguuaaaagucg

SEQ ID NO: 713523 - RNA, 15 nt, Haemophilus influenzae Rd
aucagaaugauuauc

SEQ ID NO: 713524 - RNA, 23 nt, Haemophilus influenzae Rd
aucacuugugcgauuaacaauaa

SEQ ID NO: 713525 - RNA, 14 nt, Haemophilus influenzae Rd
aucacuucugcaua

SEQ ID NO: 713526 - RNA, 16 nt, Haemophilus influenzae Rd
aucacuugauaaaaau

SEQ ID NO: 713527 - RNA, 23 nt, Haemophilus influenzae Rd
aucacuugauaaaaaugagauua

SEQ ID NO: 713528 - RNA, 21 nt, Haemophilus influenzae Rd
aucacuguaaauaauagguau

SEQ ID NO: 713529 - RNA, 14 nt, Haemophilus influenzae Rd
aucacuucaaaaaa

SEQ ID NO: 713530 - RNA, 20 nt, Haemophilus influenzae Rd
aucagaacaagcauuuuuca

SEQ ID NO: 713531 - RNA, 17 nt, Haemophilus influenzae Rd
aucagaaguuaaaacuu

SEQ ID NO: 713532 - RNA, 17 nt, Haemophilus influenzae Rd
aucagaaaaucaaaaau

SEQ ID NO: 713533 - RNA, 16 nt, Haemophilus influenzae Rd
aucagaaauaucuuca

SEQ ID NO: 713534 - RNA, 17 nt, Haemophilus influenzae Rd
aucagauuuuucgcauu

SEQ ID NO: 713535 - RNA, 23 nt, Haemophilus influenzae Rd
aucagauuuuucgcauuuuaacu

SEQ ID NO: 713536 - RNA, 20 nt, Haemophilus influenzae Rd
aucagcaacauuauugccaa

SEQ ID NO: 713537 - RNA, 18 nt, Haemophilus influenzae Rd
aucagcauauugaaauug

SEQ ID NO: 713538 - RNA, 19 nt, Haemophilus influenzae Rd
aucagccaccuuaacaaag

SEQ ID NO: 713539 - RNA, 18 nt, Haemophilus influenzae Rd
aucagcccuuauuuuuug

SEQ ID NO: 713540 - RNA, 15 nt, Haemophilus influenzae Rd
aucagcccuuuguuu

SEQ ID NO: 713541 - RNA, 19 nt, Haemophilus influenzae Rd
aucagccccuuaauuauuu

SEQ ID NO: 713542 - RNA, 21 nt, Haemophilus influenzae Rd
aucagccgcuuuuugaucucu

SEQ ID NO: 713543 - RNA, 22 nt, Haemophilus influenzae Rd
aucagcgaauuaaagugcagau

SEQ ID NO: 713544 - RNA, 22 nt, Haemophilus influenzae Rd
aucagcgcauuuuuuauuuuua

SEQ ID NO: 713545 - RNA, 20 nt, Haemophilus influenzae Rd
agguauuucuucaauauguu

SEQ ID NO: 713546 - RNA, 14 nt, Haemophilus influenzae Rd
agguauccacuuuu

SEQ ID NO: 713547 - RNA, 22 nt, Haemophilus influenzae Rd
agguaauguuucauaaaucggu

SEQ ID NO: 713548 - RNA, 18 nt, Haemophilus influenzae Rd
agguacaaguaacgccgc

SEQ ID NO: 713549 - RNA, 22 nt, Haemophilus influenzae Rd
agguaauuuguuagaucaaauu

SEQ ID NO: 713550 - RNA, 15 nt, Haemophilus influenzae Rd
agguaaaacuuucua

SEQ ID NO: 713551 - RNA, 13 nt, Haemophilus influenzae Rd
aggguuuucauca

SEQ ID NO: 713552 - RNA, 15 nt, Haemophilus influenzae Rd
aggguuuucaucauu

SEQ ID NO: 713553 - RNA, 19 nt, Haemophilus influenzae Rd
aggguuauauucagcaaaa

SEQ ID NO: 713554 - RNA, 16 nt, Haemophilus influenzae Rd
agguaagcugaaguuu

SEQ ID NO: 713555 - RNA, 14 nt, Haemophilus influenzae Rd
aggguguucaacuu

SEQ ID NO: 713556 - RNA, 16 nt, Haemophilus influenzae Rd
aggucgagggucaaaa

SEQ ID NO: 713557 - RNA, 16 nt, Haemophilus influenzae Rd
aggugcguucuacacg

SEQ ID NO: 713558 - RNA, 19 nt, Haemophilus influenzae Rd
aggugcuuuuaaauuuuua

SEQ ID NO: 713559 - RNA, 16 nt, Haemophilus influenzae Rd
agguggaacucuuuca

SEQ ID NO: 713560 - RNA, 21 nt, Haemophilus influenzae Rd
agguggaacucuuucaccauu

SEQ ID NO: 713561 - RNA, 16 nt, Haemophilus influenzae Rd
aggugcagauuaaaua

SEQ ID NO: 713562 - RNA, 13 nt, Haemophilus influenzae Rd
agguuuuuuagau

SEQ ID NO: 713563 - RNA, 16 nt, Haemophilus influenzae Rd
agguuuuauuacaaaa

SEQ ID NO: 713564 - RNA, 18 nt, Haemophilus influenzae Rd
agguuuauaacaaagaag

SEQ ID NO: 713565 - RNA, 18 nt, Haemophilus influenzae Rd
agguuucgauauuaauac

SEQ ID NO: 713566 - RNA, 20 nt, Haemophilus influenzae Rd
agguuucuaaaugaauaaaa

SEQ ID NO: 713567 - RNA, 15 nt, Haemophilus influenzae Rd
aguaaaccaaaucca

SEQ ID NO: 713568 - RNA, 18 nt, Haemophilus influenzae Rd
aguaaaccacaauacuua

SEQ ID NO: 713569 - RNA, 21 nt, Haemophilus influenzae Rd
aguaaacacuuaaauaguuaa

SEQ ID NO: 713570 - RNA, 12 nt, Haemophilus influenzae Rd
aguaaaauaaaa

SEQ ID NO: 713571 - RNA, 13 nt, Haemophilus influenzae Rd
aguaaaauaaaaa

SEQ ID NO: 713572 - RNA, 11 nt, Haemophilus influenzae Rd
aguaaaauacg

SEQ ID NO: 713573 - RNA, 13 nt, Haemophilus influenzae Rd
aguaaaauauagc

SEQ ID NO: 713574 - RNA, 18 nt, Haemophilus influenzae Rd
aguaaaaagaaaagugcg

SEQ ID NO: 713575 - RNA, 13 nt, Haemophilus influenzae Rd
aguaaaaauaaaa

SEQ ID NO: 713576 - RNA, 15 nt, Haemophilus influenzae Rd
aguaaaaauaaaaug

SEQ ID NO: 713577 - RNA, 19 nt, Haemophilus influenzae Rd
aguaaaacuugcaaaccaa

SEQ ID NO: 713578 - RNA, 21 nt, Haemophilus influenzae Rd
aguaaacgcguaaaccuacac

SEQ ID NO: 713579 - RNA, 17 nt, Haemophilus influenzae Rd
aguaaagaaauaagcaa

SEQ ID NO: 713580 - RNA, 11 nt, Haemophilus influenzae Rd
aguaaauaauu

SEQ ID NO: 713581 - RNA, 12 nt, Haemophilus influenzae Rd
aguaaauaauuc

SEQ ID NO: 713582 - RNA, 12 nt, Haemophilus influenzae Rd
aguaaaggcacu

SEQ ID NO: 713583 - RNA, 21 nt, Haemophilus influenzae Rd
aguaaagcgugugcuugcauu

SEQ ID NO: 713584 - RNA, 15 nt, Haemophilus influenzae Rd
agguuggcaauaaac

SEQ ID NO: 713585 - RNA, 21 nt, Haemophilus influenzae Rd
agguuggccuguuggaauuuc

SEQ ID NO: 713586 - RNA, 18 nt, Haemophilus influenzae Rd
agguugaagaacguaaau

SEQ ID NO: 713587 - RNA, 11 nt, Haemophilus influenzae Rd
agguucauuaa

SEQ ID NO: 713588 - RNA, 20 nt, Haemophilus influenzae Rd
agguuccccuaaaaaauaag

SEQ ID NO: 713589 - RNA, 20 nt, Haemophilus influenzae Rd
agguucgucaucuucauuaa

SEQ ID NO: 713590 - RNA, 22 nt, Haemophilus influenzae Rd
agguuauaaguuuuuugccaaa

SEQ ID NO: 713591 - RNA, 16 nt, Haemophilus influenzae Rd
agguuagaauaaacca

SEQ ID NO: 713592 - RNA, 16 nt, Haemophilus influenzae Rd
agguuacucauucuaa

SEQ ID NO: 713593 - RNA, 20 nt, Haemophilus influenzae Rd
agguuaauaguuguuuguga

SEQ ID NO: 713594 - RNA, 13 nt, Haemophilus influenzae Rd
aggugucacagca

SEQ ID NO: 713595 - RNA, 14 nt, Haemophilus influenzae Rd
aggugucacagcaa

SEQ ID NO: 713596 - RNA, 22 nt, Haemophilus influenzae Rd
aguaccacuuucaacuguucuu

SEQ ID NO: 713597 - RNA, 22 nt, Haemophilus influenzae Rd
aguacauuauugaauuugguaa

SEQ ID NO: 713598 - RNA, 13 nt, Haemophilus influenzae Rd
aguacaucauuug

SEQ ID NO: 713599 - RNA, 16 nt, Haemophilus influenzae Rd
aguacaucauuugcaa

SEQ ID NO: 713600 - RNA, 18 nt, Haemophilus influenzae Rd
aguacaauuaauuaaaua

SEQ ID NO: 713601 - RNA, 13 nt, Haemophilus influenzae Rd
aguacaaaagagc

SEQ ID NO: 713602 - RNA, 16 nt, Haemophilus influenzae Rd
aguaauauauucuacg

SEQ ID NO: 713603 - RNA, 14 nt, Haemophilus influenzae Rd
aguaauauuucuug

SEQ ID NO: 713604 - RNA, 17 nt, Haemophilus influenzae Rd
aguaauauuucuuguuc

SEQ ID NO: 713605 - RNA, 18 nt, Haemophilus influenzae Rd
aguaauaugauccgccuu

SEQ ID NO: 713606 - RNA, 16 nt, Haemophilus influenzae Rd
aguaauccaaguauaa

SEQ ID NO: 713607 - RNA, 23 nt, Haemophilus influenzae Rd
aguaaucuggugcuuguuuuaaa

SEQ ID NO: 713608 - RNA, 15 nt, Haemophilus influenzae Rd
aguaaucgccccaaa

SEQ ID NO: 713609 - RNA, 20 nt, Haemophilus influenzae Rd
aguaaucgccccaaaagcug

SEQ ID NO: 713610 - RNA, 15 nt, Haemophilus influenzae Rd
aguaaucuaauucuu

SEQ ID NO: 713611 - RNA, 13 nt, Haemophilus influenzae Rd
aguaauguucuac

SEQ ID NO: 713612 - RNA, 14 nt, Haemophilus influenzae Rd
aguaauggaagaau

SEQ ID NO: 713613 - RNA, 19 nt, Haemophilus influenzae Rd
aguaaugguuacuuuauca

SEQ ID NO: 713614 - RNA, 22 nt, Haemophilus influenzae Rd
aguaaugguuacuuuaucacaa

SEQ ID NO: 713615 - RNA, 21 nt, Haemophilus influenzae Rd
aguaauuuuacaguuucaaca

SEQ ID NO: 713616 - RNA, 16 nt, Haemophilus influenzae Rd
aguaauuucauaucuu

SEQ ID NO: 713617 - RNA, 19 nt, Haemophilus influenzae Rd
aguaauuucauaucuucuu

SEQ ID NO: 713618 - RNA, 15 nt, Haemophilus influenzae Rd
aguaauuuaaaaagu

SEQ ID NO: 713619 - RNA, 19 nt, Haemophilus influenzae Rd
aguaauacaccaauaauua

SEQ ID NO: 713620 - RNA, 22 nt, Haemophilus influenzae Rd
aguaauacaccaauaauuaaac

SEQ ID NO: 713621 - RNA, 13 nt, Haemophilus influenzae Rd
aguaauaaauuca

SEQ ID NO: 713622 - RNA, 12 nt, Haemophilus influenzae Rd
aguaauaaaaag

SEQ ID NO: 713623 - RNA, 15 nt, Haemophilus influenzae Rd
aguaagugcuuugag

SEQ ID NO: 713624 - RNA, 23 nt, Haemophilus influenzae Rd
aguaaguaggcugaauacauuaa

SEQ ID NO: 713625 - RNA, 20 nt, Haemophilus influenzae Rd
aguaagucgugaucugcauc

SEQ ID NO: 713626 - RNA, 15 nt, Haemophilus influenzae Rd
aguaagggcaaaaaa

SEQ ID NO: 713627 - RNA, 12 nt, Haemophilus influenzae Rd
aguaagaaacuu

SEQ ID NO: 713628 - RNA, 13 nt, Haemophilus influenzae Rd
aguaacuuucaca

SEQ ID NO: 713629 - RNA, 16 nt, Haemophilus influenzae Rd
aguaacuuucuucaau

SEQ ID NO: 713630 - RNA, 18 nt, Haemophilus influenzae Rd
aguaacuucugcugcacg

SEQ ID NO: 713631 - RNA, 16 nt, Haemophilus influenzae Rd
aguaagcaaguacaac

SEQ ID NO: 713632 - RNA, 14 nt, Haemophilus influenzae Rd
aguaagcauauuug

SEQ ID NO: 713633 - RNA, 14 nt, Haemophilus influenzae Rd
aguaaauuuuaaaa

SEQ ID NO: 713634 - RNA, 18 nt, Haemophilus influenzae Rd
aguaaauuuuuccacauu

SEQ ID NO: 713635 - RNA, 21 nt, Haemophilus influenzae Rd
aguaaauuuuuccacauuaaa

SEQ ID NO: 713636 - RNA, 14 nt, Haemophilus influenzae Rd
aguaaauuuaacaa

SEQ ID NO: 713637 - RNA, 20 nt, Haemophilus influenzae Rd
aguaaaugcgcuuuuaauuu

SEQ ID NO: 713638 - RNA, 15 nt, Haemophilus influenzae Rd
aguaaauucaccaau

SEQ ID NO: 713639 - RNA, 23 nt, Haemophilus influenzae Rd
aguaaauucaguuaagaaaauaa

SEQ ID NO: 713640 - RNA, 17 nt, Haemophilus influenzae Rd
aggcuaauaauaaaaag

SEQ ID NO: 713641 - RNA, 20 nt, Haemophilus influenzae Rd
aggcuacuuuauuuacccaa

SEQ ID NO: 713642 - RNA, 15 nt, Haemophilus influenzae Rd
aggcuaguucuuccu

SEQ ID NO: 713643 - RNA, 19 nt, Haemophilus influenzae Rd
aggcucaacaccuaauauc

SEQ ID NO: 713644 - RNA, 18 nt, Haemophilus influenzae Rd
aggcuaauucuacaccag

SEQ ID NO: 713645 - RNA, 19 nt, Haemophilus influenzae Rd
aggcucaucauuaugaaaa

SEQ ID NO: 713646 - RNA, 13 nt, Haemophilus influenzae Rd
aggcucacaaagg

SEQ ID NO: 713647 - RNA, 12 nt, Haemophilus influenzae Rd
aggcugaacuuu

SEQ ID NO: 713648 - RNA, 17 nt, Haemophilus influenzae Rd
aggcucuaccuaaaaua

SEQ ID NO: 713649 - RNA, 20 nt, Haemophilus influenzae Rd
aggcgaauuugugagguuuu

SEQ ID NO: 713650 - RNA, 23 nt, Haemophilus influenzae Rd
aggcgaauuugugagguuuugag

SEQ ID NO: 713651 - RNA, 16 nt, Haemophilus influenzae Rd
aggcgagggauuuuaa

SEQ ID NO: 713652 - RNA, 22 nt, Haemophilus influenzae Rd
agggcagauuuaauucugcccu

SEQ ID NO: 713653 - RNA, 19 nt, Haemophilus influenzae Rd
agggcgaaguaaaaaguca

SEQ ID NO: 713654 - RNA, 13 nt, Haemophilus influenzae Rd
aggguauacuuua

SEQ ID NO: 713655 - RNA, 13 nt, Haemophilus influenzae Rd
aggguaaauaaaa

SEQ ID NO: 713656 - RNA, 15 nt, Haemophilus influenzae Rd
aggguaaauaaaaau

SEQ ID NO: 713657 - RNA, 13 nt, Haemophilus influenzae Rd
aggggauaaaaua

SEQ ID NO: 713658 - RNA, 19 nt, Haemophilus influenzae Rd
agggcuuguuuuuucguuu

SEQ ID NO: 713659 - RNA, 19 nt, Haemophilus influenzae Rd
aggcuucgccauuuuuaaa

SEQ ID NO: 713660 - RNA, 13 nt, Haemophilus influenzae Rd
aggcuuucauuuu

SEQ ID NO: 713661 - RNA, 13 nt, Haemophilus influenzae Rd
aggcuuucaccaa

SEQ ID NO: 713662 - RNA, 20 nt, Haemophilus influenzae Rd
aggcuuccaacaaaauaaac

SEQ ID NO: 713663 - RNA, 13 nt, Haemophilus influenzae Rd
aggcuuaucuacu

SEQ ID NO: 713664 - RNA, 14 nt, Haemophilus influenzae Rd
aggcuuaauucuug

SEQ ID NO: 713665 - RNA, 21 nt, Haemophilus influenzae Rd
aggcuuauuuuuaaacaauau

SEQ ID NO: 713666 - RNA, 15 nt, Haemophilus influenzae Rd
agggagcaauggagg

SEQ ID NO: 713667 - RNA, 20 nt, Haemophilus influenzae Rd
aggcuuuuuacguucaugua

SEQ ID NO: 713668 - RNA, 22 nt, Haemophilus influenzae Rd
aggcuuuuuacguucauguaaa

SEQ ID NO: 713669 - RNA, 18 nt, Haemophilus influenzae Rd
aggcuuuuuuaauuacuc

SEQ ID NO: 713670 - RNA, 12 nt, Haemophilus influenzae Rd
agggaaaauuuu

SEQ ID NO: 713671 - RNA, 22 nt, Haemophilus influenzae Rd
agggaaaauuuuaaacagcaaa

SEQ ID NO: 713672 - RNA, 22 nt, Haemophilus influenzae Rd
aggcuuuucccuuuucuuauuu

SEQ ID NO: 713673 - RNA, 21 nt, Haemophilus influenzae Rd
agggaacgguucgccugauuu

SEQ ID NO: 713674 - RNA, 14 nt, Haemophilus influenzae Rd
agggauuaagaaaa

SEQ ID NO: 713675 - RNA, 13 nt, Haemophilus influenzae Rd
agggcaaaaaauc

SEQ ID NO: 713676 - RNA, 15 nt, Haemophilus influenzae Rd
agggcaaaaaaucuu

SEQ ID NO: 713677 - RNA, 20 nt, Haemophilus influenzae Rd
agggauuuuaaaucccuugu

SEQ ID NO: 713678 - RNA, 21 nt, Haemophilus influenzae Rd
agggauuuuuuauacuuguuu

SEQ ID NO: 713679 - RNA, 16 nt, Haemophilus influenzae Rd
agggauuugaaaaucc

SEQ ID NO: 713680 - RNA, 12 nt, Haemophilus influenzae Rd
agggauaaaccc

SEQ ID NO: 713681 - RNA, 19 nt, Haemophilus influenzae Rd
agggauaaacccaaaaaag

SEQ ID NO: 713682 - RNA, 22 nt, Haemophilus influenzae Rd
agggaguaugggguuaaaaagc

SEQ ID NO: 713683 - RNA, 17 nt, Haemophilus influenzae Rd
agcggcugacauuacau

SEQ ID NO: 713684 - RNA, 15 nt, Haemophilus influenzae Rd
agcggcgaauguggc

SEQ ID NO: 713685 - RNA, 13 nt, Haemophilus influenzae Rd
agcggaauuuuug

SEQ ID NO: 713686 - RNA, 19 nt, Haemophilus influenzae Rd
agcguucauuuugaucuuc

SEQ ID NO: 713687 - RNA, 23 nt, Haemophilus influenzae Rd
agcguucauuuugaucuuccgcg

SEQ ID NO: 713688 - RNA, 22 nt, Haemophilus influenzae Rd
agcguuauccaucaagaaaguu

SEQ ID NO: 713689 - RNA, 19 nt, Haemophilus influenzae Rd
agcguuauuguaguaagug

SEQ ID NO: 713690 - RNA, 14 nt, Haemophilus influenzae Rd
agcuaauaacacau

SEQ ID NO: 713691 - RNA, 24 nt, Haemophilus influenzae Rd
agcuaauaggcuuaauucuugcca

SEQ ID NO: 713692 - RNA, 15 nt, Haemophilus influenzae Rd
agcuaaucgguacuu

SEQ ID NO: 713693 - RNA, 17 nt, Haemophilus influenzae Rd
agcuaauccaaaucaag

SEQ ID NO: 713694 - RNA, 14 nt, Haemophilus influenzae Rd
agcuaagcauuuca

SEQ ID NO: 713695 - RNA, 18 nt, Haemophilus influenzae Rd
agcuaagauugacaacgc

SEQ ID NO: 713696 - RNA, 15 nt, Haemophilus influenzae Rd
agcuaagaaaaucca

SEQ ID NO: 713697 - RNA, 13 nt, Haemophilus influenzae Rd
agcucaauuauuu

SEQ ID NO: 713698 - RNA, 16 nt, Haemophilus influenzae Rd
agcucaagcaacauag

SEQ ID NO: 713699 - RNA, 14 nt, Haemophilus influenzae Rd
agcucaaaaugcuc

SEQ ID NO: 713700 - RNA, 18 nt, Haemophilus influenzae Rd
agcuauuucggcaguacu

SEQ ID NO: 713701 - RNA, 12 nt, Haemophilus influenzae Rd
agcuauuuuuca

SEQ ID NO: 713702 - RNA, 19 nt, Haemophilus influenzae Rd
agcuauuuuucaauaagca

SEQ ID NO: 713703 - RNA, 17 nt, Haemophilus influenzae Rd
agcuaaugguuggaaga

SEQ ID NO: 713704 - RNA, 16 nt, Haemophilus influenzae Rd
agcuaauugguaaaau

SEQ ID NO: 713705 - RNA, 20 nt, Haemophilus influenzae Rd
agcuaaugcuuuaauuuguu

SEQ ID NO: 713706 - RNA, 20 nt, Haemophilus influenzae Rd
agcuaauucagcuaaacauu

SEQ ID NO: 713707 - RNA, 22 nt, Haemophilus influenzae Rd
agcuaucgucaaauuuaaauag

SEQ ID NO: 713708 - RNA, 20 nt, Haemophilus influenzae Rd
agcgggauaagauuugcucg

SEQ ID NO: 713709 - RNA, 17 nt, Haemophilus influenzae Rd
agcugaaaaauaaaaaa

SEQ ID NO: 713710 - RNA, 17 nt, Haemophilus influenzae Rd
agcugaaauuuagugau

SEQ ID NO: 713711 - RNA, 17 nt, Haemophilus influenzae Rd
agcugcacaagcaccac

SEQ ID NO: 713712 - RNA, 21 nt, Haemophilus influenzae Rd
agcugcauuucaauuucacug

SEQ ID NO: 713713 - RNA, 22 nt, Haemophilus influenzae Rd
agcugcacuauauacauuaaca

SEQ ID NO: 713714 - RNA, 16 nt, Haemophilus influenzae Rd
agcugccgaauagauu

SEQ ID NO: 713715 - RNA, 20 nt, Haemophilus influenzae Rd
agcucuagaaaaucguauuc

SEQ ID NO: 713716 - RNA, 22 nt, Haemophilus influenzae Rd
agcucacuugcauauccgcugc

SEQ ID NO: 713717 - RNA, 17 nt, Haemophilus influenzae Rd
agcucaguugguagagc

SEQ ID NO: 713718 - RNA, 22 nt, Haemophilus influenzae Rd
agcuggcuuucuuuuucaaguu

SEQ ID NO: 713719 - RNA, 15 nt, Haemophilus influenzae Rd
agcugggcaaaauca

SEQ ID NO: 713720 - RNA, 22 nt, Haemophilus influenzae Rd
agcugggcuguucggacuuaca

SEQ ID NO: 713721 - RNA, 15 nt, Haemophilus influenzae Rd
agcuggcguuuacuu

SEQ ID NO: 713722 - RNA, 15 nt, Haemophilus influenzae Rd
agcuggcgguuugaa

SEQ ID NO: 713723 - RNA, 19 nt, Haemophilus influenzae Rd
agcuggcgguuugaaauuu

SEQ ID NO: 713724 - RNA, 14 nt, Haemophilus influenzae Rd
agcugcgaauugca

SEQ ID NO: 713725 - RNA, 14 nt, Haemophilus influenzae Rd
agcuggaaauucca

SEQ ID NO: 713726 - RNA, 16 nt, Haemophilus influenzae Rd
agcuggaaauuccacu

SEQ ID NO: 713727 - RNA, 17 nt, Haemophilus influenzae Rd
agcuggaaauuccacuu

SEQ ID NO: 713728 - RNA, 21 nt, Haemophilus influenzae Rd
agcugcuuguaaccaauaaag

SEQ ID NO: 713729 - RNA, 16 nt, Haemophilus influenzae Rd
agcuguaccagcgaug

SEQ ID NO: 713730 - RNA, 14 nt, Haemophilus influenzae Rd
agcuguguaagcug

SEQ ID NO: 713731 - RNA, 15 nt, Haemophilus influenzae Rd
agcugucuaauuuuu

SEQ ID NO: 713732 - RNA, 16 nt, Haemophilus influenzae Rd
agcugucuaauuuuuu

SEQ ID NO: 713733 - RNA, 18 nt, Haemophilus influenzae Rd
agcugucucauuuugcuc

SEQ ID NO: 713734 - RNA, 23 nt, Haemophilus influenzae Rd
agcuguuguuguggaucguaaau

SEQ ID NO: 713735 - RNA, 14 nt, Haemophilus influenzae Rd
agcuucuucuuccu

SEQ ID NO: 713736 - RNA, 11 nt, Haemophilus influenzae Rd
agcuucugcca

SEQ ID NO: 713737 - RNA, 12 nt, Haemophilus influenzae Rd
agcuucugccag

SEQ ID NO: 713738 - RNA, 16 nt, Haemophilus influenzae Rd
agcuucuuuuaucgac

SEQ ID NO: 713739 - RNA, 19 nt, Haemophilus influenzae Rd
agcuugaguugucacaaca

SEQ ID NO: 713740 - RNA, 20 nt, Haemophilus influenzae Rd
agcuugaguugucacaacag

SEQ ID NO: 713741 - RNA, 14 nt, Haemophilus influenzae Rd
agcuugaauugcuc

SEQ ID NO: 713742 - RNA, 17 nt, Haemophilus influenzae Rd
agcuucuaauuuuugca

SEQ ID NO: 713743 - RNA, 19 nt, Haemophilus influenzae Rd
agcuucuccuacaucgccu

SEQ ID NO: 713744 - RNA, 19 nt, Haemophilus influenzae Rd
agcuuccuuuaaucuguca

SEQ ID NO: 713745 - RNA, 23 nt, Haemophilus influenzae Rd
agcuuccauuuuuuaugguaaau

SEQ ID NO: 713746 - RNA, 22 nt, Haemophilus influenzae Rd
agcuuaauagagaauaauuaag

SEQ ID NO: 713747 - RNA, 16 nt, Haemophilus influenzae Rd
agcuuaauauguucuu

SEQ ID NO: 713748 - RNA, 14 nt, Haemophilus influenzae Rd
agcuuaacaacaaa

SEQ ID NO: 713749 - RNA, 16 nt, Haemophilus influenzae Rd
agcuuaagccuuuauc

SEQ ID NO: 713750 - RNA, 16 nt, Haemophilus influenzae Rd
agcuuauccuauaaaa

SEQ ID NO: 713751 - RNA, 19 nt, Haemophilus influenzae Rd
agcuuauuuuuauuaucaa

SEQ ID NO: 713752 - RNA, 13 nt, Haemophilus influenzae Rd
agcuuccauccac

SEQ ID NO: 713753 - RNA, 12 nt, Haemophilus influenzae Rd
agcuucaucuuc

SEQ ID NO: 713754 - RNA, 11 nt, Haemophilus influenzae Rd
agcuuuaaggc

SEQ ID NO: 713755 - RNA, 18 nt, Haemophilus influenzae Rd
agcuuuaccgucagccaa

SEQ ID NO: 713756 - RNA, 14 nt, Haemophilus influenzae Rd
agcuuuagcaauca

SEQ ID NO: 713757 - RNA, 13 nt, Haemophilus influenzae Rd
agcuuguuucauc

SEQ ID NO: 713758 - RNA, 20 nt, Haemophilus influenzae Rd
agcuuguuggaaaaaugcug

SEQ ID NO: 713759 - RNA, 21 nt, Haemophilus influenzae Rd
agcuuguuggaaaaaugcugg

SEQ ID NO: 713760 - RNA, 17 nt, Haemophilus influenzae Rd
agcuuguuuaaucacau

SEQ ID NO: 713761 - RNA, 18 nt, Haemophilus influenzae Rd
agcuugugcucgauuuuu

SEQ ID NO: 713762 - RNA, 19 nt, Haemophilus influenzae Rd
agcuugugcucgauuuuua

SEQ ID NO: 713763 - RNA, 21 nt, Haemophilus influenzae Rd
agcuugugcucgauuuuuaaa

SEQ ID NO: 713764 - RNA, 17 nt, Haemophilus influenzae Rd
agcuugcguaauguuua

SEQ ID NO: 713765 - RNA, 13 nt, Haemophilus influenzae Rd
agcuugauuuuca

SEQ ID NO: 713766 - RNA, 14 nt, Haemophilus influenzae Rd
agcuugauuuucag

SEQ ID NO: 713767 - RNA, 13 nt, Haemophilus influenzae Rd
aggaucuuuuucu

SEQ ID NO: 713768 - RNA, 19 nt, Haemophilus influenzae Rd
aggaugugaauaagcaaag

SEQ ID NO: 713769 - RNA, 19 nt, Haemophilus influenzae Rd
aggauuaacguaagaaaua

SEQ ID NO: 713770 - RNA, 21 nt, Haemophilus influenzae Rd
aggauuaaugcuauaaaucca

SEQ ID NO: 713771 - RNA, 15 nt, Haemophilus influenzae Rd
aggauuagaaaugau

SEQ ID NO: 713772 - RNA, 16 nt, Haemophilus influenzae Rd
aggauuaguaagugcu

SEQ ID NO: 713773 - RNA, 22 nt, Haemophilus influenzae Rd
aggauugaccgcccaacauuuc

SEQ ID NO: 713774 - RNA, 22 nt, Haemophilus influenzae Rd
aggauucgaaccuucgaccaac

SEQ ID NO: 713775 - RNA, 18 nt, Haemophilus influenzae Rd
aggauuuauuuaacaaug

SEQ ID NO: 713776 - RNA, 19 nt, Haemophilus influenzae Rd
aggauuguugauuuugguu

SEQ ID NO: 713777 - RNA, 15 nt, Haemophilus influenzae Rd
aggauuuuauggcug

SEQ ID NO: 713778 - RNA, 19 nt, Haemophilus influenzae Rd
aggauuucuaaaguuucuu

SEQ ID NO: 713779 - RNA, 22 nt, Haemophilus influenzae Rd
aggauuucuuaugaaaaaaaau

SEQ ID NO: 713780 - RNA, 21 nt, Haemophilus influenzae Rd
aggcaaaaacacucucagaau

SEQ ID NO: 713781 - RNA, 19 nt, Haemophilus influenzae Rd
aggcaagguaucuauaauu

SEQ ID NO: 713782 - RNA, 13 nt, Haemophilus influenzae Rd
aggcaauaaaaaa

SEQ ID NO: 713783 - RNA, 21 nt, Haemophilus influenzae Rd
aggcaauaugauuagucuaca

SEQ ID NO: 713784 - RNA, 22 nt, Haemophilus influenzae Rd
aggcaauguauucaaacgcugu

SEQ ID NO: 713785 - RNA, 17 nt, Haemophilus influenzae Rd
aggcaagcuaggaauga

SEQ ID NO: 713786 - RNA, 19 nt, Haemophilus influenzae Rd
aggcacaacgguugaaauu

SEQ ID NO: 713787 - RNA, 21 nt, Haemophilus influenzae Rd
aggcacagggcugauaaauuu

SEQ ID NO: 713788 - RNA, 20 nt, Haemophilus influenzae Rd
aggcacauaaguaaaauagu

SEQ ID NO: 713789 - RNA, 19 nt, Haemophilus influenzae Rd
aggcaccgugggugugaaa

SEQ ID NO: 713790 - RNA, 17 nt, Haemophilus influenzae Rd
aggcagaaaugaauugg

SEQ ID NO: 713791 - RNA, 16 nt, Haemophilus influenzae Rd
aggcccaucauuuguu

SEQ ID NO: 713792 - RNA, 14 nt, Haemophilus influenzae Rd
aggcagcaagaaag

SEQ ID NO: 713793 - RNA, 19 nt, Haemophilus influenzae Rd
aggcaucaaaauucaaaau

SEQ ID NO: 713794 - RNA, 13 nt, Haemophilus influenzae Rd
aggcauugcgccu

SEQ ID NO: 713795 - RNA, 13 nt, Haemophilus influenzae Rd
aggcauuuucaac

SEQ ID NO: 713796 - RNA, 14 nt, Haemophilus influenzae Rd
aggcauuuucaacu

SEQ ID NO: 713797 - RNA, 15 nt, Haemophilus influenzae Rd
aggcauuuucaacuu

SEQ ID NO: 713798 - RNA, 22 nt, Haemophilus influenzae Rd
aggcauuuagagggauaaaaau

SEQ ID NO: 713799 - RNA, 23 nt, Haemophilus influenzae Rd
aggagcaaucuuuuucuuucagu

SEQ ID NO: 713800 - RNA, 16 nt, Haemophilus influenzae Rd
aggacuaaaucaaaaa

SEQ ID NO: 713801 - RNA, 11 nt, Haemophilus influenzae Rd
aggauaaaaac

SEQ ID NO: 713802 - RNA, 13 nt, Haemophilus influenzae Rd
aggauaaaaacca

SEQ ID NO: 713803 - RNA, 14 nt, Haemophilus influenzae Rd
aggauaaaaaccag

SEQ ID NO: 713804 - RNA, 13 nt, Haemophilus influenzae Rd
aggauaaaaaugg

SEQ ID NO: 713805 - RNA, 18 nt, Haemophilus influenzae Rd
aggagcuggauucauuug

SEQ ID NO: 713806 - RNA, 14 nt, Haemophilus influenzae Rd
aggaggaauaauga

SEQ ID NO: 713807 - RNA, 22 nt, Haemophilus influenzae Rd
aggagcgguuaaaacaaaagaa

SEQ ID NO: 713808 - RNA, 15 nt, Haemophilus influenzae Rd
aggagccaaauuuaa

SEQ ID NO: 713809 - RNA, 20 nt, Haemophilus influenzae Rd
aggagccaaauuuaaaaaag

SEQ ID NO: 713810 - RNA, 16 nt, Haemophilus influenzae Rd
aggaucgauuaaaauu

SEQ ID NO: 713811 - RNA, 20 nt, Haemophilus influenzae Rd
aggaucgaauaauccuucuu

SEQ ID NO: 713812 - RNA, 13 nt, Haemophilus influenzae Rd
agcuuuuuuuaau

SEQ ID NO: 713813 - RNA, 21 nt, Haemophilus influenzae Rd
aggaaaaaggcaucuuuauca

SEQ ID NO: 713814 - RNA, 12 nt, Haemophilus influenzae Rd
aggaaaaauaaa

SEQ ID NO: 713815 - RNA, 16 nt, Haemophilus influenzae Rd
aggaaacguaaaauau

SEQ ID NO: 713816 - RNA, 17 nt, Haemophilus influenzae Rd
aggaaacuacuuucuau

SEQ ID NO: 713817 - RNA, 22 nt, Haemophilus influenzae Rd
aggaaauccugcgggucuuguu

SEQ ID NO: 713818 - RNA, 23 nt, Haemophilus influenzae Rd
aggaagcucgguaaaaaucauua

SEQ ID NO: 713819 - RNA, 14 nt, Haemophilus influenzae Rd
aggaaguaaauagu

SEQ ID NO: 713820 - RNA, 23 nt, Haemophilus influenzae Rd
aggaauaaauugaauaucuaaau

SEQ ID NO: 713821 - RNA, 17 nt, Haemophilus influenzae Rd
aggaaguuaaaauacuu

SEQ ID NO: 713822 - RNA, 20 nt, Haemophilus influenzae Rd
aggaauauucuuuaaauauu

SEQ ID NO: 713823 - RNA, 23 nt, Haemophilus influenzae Rd
aggaauauucuuuaaauauucaa

SEQ ID NO: 713824 - RNA, 22 nt, Haemophilus influenzae Rd
aggaauacucacagagccuuuu

SEQ ID NO: 713825 - RNA, 17 nt, Haemophilus influenzae Rd
aggaauacucuccccuu

SEQ ID NO: 713826 - RNA, 17 nt, Haemophilus influenzae Rd
aggaaucgugucaguaa

SEQ ID NO: 713827 - RNA, 18 nt, Haemophilus influenzae Rd
aggaaucgaaauuaaaau

SEQ ID NO: 713828 - RNA, 22 nt, Haemophilus influenzae Rd
aggaaucgaaauuaaaauaaua

SEQ ID NO: 713829 - RNA, 17 nt, Haemophilus influenzae Rd
aggacaauaauaagcac

SEQ ID NO: 713830 - RNA, 19 nt, Haemophilus influenzae Rd
aggacaauaauaagcacaa

SEQ ID NO: 713831 - RNA, 13 nt, Haemophilus influenzae Rd
aggacaauauuua

SEQ ID NO: 713832 - RNA, 15 nt, Haemophilus influenzae Rd
aggacaaucugcugu

SEQ ID NO: 713833 - RNA, 15 nt, Haemophilus influenzae Rd
acgcaagguauuuuu

SEQ ID NO: 713834 - RNA, 19 nt, Haemophilus influenzae Rd
acgcaagcaccaaagcaaa

SEQ ID NO: 713835 - RNA, 21 nt, Haemophilus influenzae Rd
acgcaagcaccaaagcaaaau

SEQ ID NO: 713836 - RNA, 17 nt, Haemophilus influenzae Rd
acgcaagcgguuaaauu

SEQ ID NO: 713837 - RNA, 14 nt, Haemophilus influenzae Rd
acgcacacaacaaa

SEQ ID NO: 713838 - RNA, 18 nt, Haemophilus influenzae Rd
acgcuggaauauuuuucu

SEQ ID NO: 713839 - RNA, 17 nt, Haemophilus influenzae Rd
acgcuggaauuuucaca

SEQ ID NO: 713840 - RNA, 14 nt, Haemophilus influenzae Rd
acgcuguucuucua

SEQ ID NO: 713841 - RNA, 18 nt, Haemophilus influenzae Rd
acgcuguucuucuaaugu

SEQ ID NO: 713842 - RNA, 21 nt, Haemophilus influenzae Rd
acgcuguuucuuuucaucuuc

SEQ ID NO: 713843 - RNA, 16 nt, Haemophilus influenzae Rd
acggauuacaauaugc

SEQ ID NO: 713844 - RNA, 21 nt, Haemophilus influenzae Rd
acggauuggaccguuugguaa

SEQ ID NO: 713845 - RNA, 17 nt, Haemophilus influenzae Rd
acggcaagcaaacagca

SEQ ID NO: 713846 - RNA, 17 nt, Haemophilus influenzae Rd
acggcaauuggauaaaa

SEQ ID NO: 713847 - RNA, 15 nt, Haemophilus influenzae Rd
acggguuggaagaau

SEQ ID NO: 713848 - RNA, 16 nt, Haemophilus influenzae Rd
acggguuggaagaaug

SEQ ID NO: 713849 - RNA, 21 nt, Haemophilus influenzae Rd
acggguauuaaugcuguuuaa

SEQ ID NO: 713850 - RNA, 16 nt, Haemophilus influenzae Rd
acgguagcaggagaaa

SEQ ID NO: 713851 - RNA, 14 nt, Haemophilus influenzae Rd
acgguuaagucauu

SEQ ID NO: 713852 - RNA, 21 nt, Haemophilus influenzae Rd
acgguuauaccacauaaaugu

SEQ ID NO: 713853 - RNA, 12 nt, Haemophilus influenzae Rd
acgguugaaauu

SEQ ID NO: 713854 - RNA, 19 nt, Haemophilus influenzae Rd
acgguuucaauaugacgaa

SEQ ID NO: 713855 - RNA, 21 nt, Haemophilus influenzae Rd
acgguuuuccacuucuucuuu

SEQ ID NO: 713856 - RNA, 20 nt, Haemophilus influenzae Rd
acguaaaaguuuuccgacaa

SEQ ID NO: 713857 - RNA, 16 nt, Haemophilus influenzae Rd
acguaaaauaucuuuc

SEQ ID NO: 713858 - RNA, 21 nt, Haemophilus influenzae Rd
acguaaaaucauuguuuccac

SEQ ID NO: 713859 - RNA, 16 nt, Haemophilus influenzae Rd
acguaaacgguuugga

SEQ ID NO: 713860 - RNA, 17 nt, Haemophilus influenzae Rd
acguaaauucaauacuu

SEQ ID NO: 713861 - RNA, 21 nt, Haemophilus influenzae Rd
acguaauaaguuuucaucaau

SEQ ID NO: 713862 - RNA, 20 nt, Haemophilus influenzae Rd
acguaacuaaaaaaguuuaa

SEQ ID NO: 713863 - RNA, 23 nt, Haemophilus influenzae Rd
acggucgauaccuaaaccuuccc

SEQ ID NO: 713864 - RNA, 15 nt, Haemophilus influenzae Rd
acggucgcaccaccu

SEQ ID NO: 713865 - RNA, 21 nt, Haemophilus influenzae Rd
acggucgcaccaccuuuauua

SEQ ID NO: 713866 - RNA, 21 nt, Haemophilus influenzae Rd
acgguauuuucuuauugaaga

SEQ ID NO: 713867 - RNA, 21 nt, Haemophilus influenzae Rd
acggugggcugaagcccaccc

SEQ ID NO: 713868 - RNA, 16 nt, Haemophilus influenzae Rd
acggugaaauuucacc

SEQ ID NO: 713869 - RNA, 23 nt, Haemophilus influenzae Rd
acgucgaaucugaguauguuguu

SEQ ID NO: 713870 - RNA, 13 nt, Haemophilus influenzae Rd
acguccaugaacu

SEQ ID NO: 713871 - RNA, 19 nt, Haemophilus influenzae Rd
acguaauucgcaaauccua

SEQ ID NO: 713872 - RNA, 14 nt, Haemophilus influenzae Rd
acguaauuguucca

SEQ ID NO: 713873 - RNA, 15 nt, Haemophilus influenzae Rd
acgucucaaaucguu

SEQ ID NO: 713874 - RNA, 12 nt, Haemophilus influenzae Rd
acgucuaagaua

SEQ ID NO: 713875 - RNA, 16 nt, Haemophilus influenzae Rd
acgugcgaauuuuuau

SEQ ID NO: 713876 - RNA, 23 nt, Haemophilus influenzae Rd
acgugcuguuuaguguguccccc

SEQ ID NO: 713877 - RNA, 18 nt, Haemophilus influenzae Rd
acguuacgcgcagcacca

SEQ ID NO: 713878 - RNA, 13 nt, Haemophilus influenzae Rd
acguuacuaaaau

SEQ ID NO: 713879 - RNA, 17 nt, Haemophilus influenzae Rd
acguuacucaucauaua

SEQ ID NO: 713880 - RNA, 18 nt, Haemophilus influenzae Rd
acgugcgauaaaaucaaa

SEQ ID NO: 713881 - RNA, 15 nt, Haemophilus influenzae Rd
acuaaaccauuuaau

SEQ ID NO: 713882 - RNA, 19 nt, Haemophilus influenzae Rd
acuaaaauggugcuuuuua

SEQ ID NO: 713883 - RNA, 16 nt, Haemophilus influenzae Rd
acuaaaauaauuuuuu

SEQ ID NO: 713884 - RNA, 23 nt, Haemophilus influenzae Rd
acuaaaauaauuuuuugaauaug

SEQ ID NO: 713885 - RNA, 15 nt, Haemophilus influenzae Rd
acuaaaaaauuaaau

SEQ ID NO: 713886 - RNA, 20 nt, Haemophilus influenzae Rd
acuaaaaagcccaaaugcaa

SEQ ID NO: 713887 - RNA, 18 nt, Haemophilus influenzae Rd
acuaaaaguaccaaaauc

SEQ ID NO: 713888 - RNA, 18 nt, Haemophilus influenzae Rd
acuaaaacacguuugcca

SEQ ID NO: 713889 - RNA, 20 nt, Haemophilus influenzae Rd
acuaaaauaaccuuaaauca

SEQ ID NO: 713890 - RNA, 21 nt, Haemophilus influenzae Rd
acguuuuaaauuaauuaaguc

SEQ ID NO: 713891 - RNA, 12 nt, Haemophilus influenzae Rd
acguuuucaaca

SEQ ID NO: 713892 - RNA, 14 nt, Haemophilus influenzae Rd
acguuuucaacagu

SEQ ID NO: 713893 - RNA, 15 nt, Haemophilus influenzae Rd
acguuucaaaucguu

SEQ ID NO: 713894 - RNA, 23 nt, Haemophilus influenzae Rd
acguuugguuaccgcugcaggua

SEQ ID NO: 713895 - RNA, 11 nt, Haemophilus influenzae Rd
acguuuugcuu

SEQ ID NO: 713896 - RNA, 22 nt, Haemophilus influenzae Rd
acguuuugugccguugcucgag

SEQ ID NO: 713897 - RNA, 14 nt, Haemophilus influenzae Rd
acguuuugcaccac

SEQ ID NO: 713898 - RNA, 23 nt, Haemophilus influenzae Rd
acguuuuugcgugaauuugauaa

SEQ ID NO: 713899 - RNA, 19 nt, Haemophilus influenzae Rd
acguuuuuuacuuggaaua

SEQ ID NO: 713900 - RNA, 12 nt, Haemophilus influenzae Rd
acguugugcauc

SEQ ID NO: 713901 - RNA, 18 nt, Haemophilus influenzae Rd
acguugucacauuuuguc

SEQ ID NO: 713902 - RNA, 17 nt, Haemophilus influenzae Rd
acguuggguuugauuua

SEQ ID NO: 713903 - RNA, 19 nt, Haemophilus influenzae Rd
acguuucaucacuucaaaa

SEQ ID NO: 713904 - RNA, 16 nt, Haemophilus influenzae Rd
acguuuauuuauucca

SEQ ID NO: 713905 - RNA, 17 nt, Haemophilus influenzae Rd
acguuuaguaaaauaaa

SEQ ID NO: 713906 - RNA, 17 nt, Haemophilus influenzae Rd
acguuuauauugaacaa

SEQ ID NO: 713907 - RNA, 15 nt, Haemophilus influenzae Rd
acguuucuaauacca

SEQ ID NO: 713908 - RNA, 18 nt, Haemophilus influenzae Rd
acguugcucuuucaaguu

SEQ ID NO: 713909 - RNA, 23 nt, Haemophilus influenzae Rd
acguuaugcguuuuuaauuuuau

SEQ ID NO: 713910 - RNA, 16 nt, Haemophilus influenzae Rd
acguuauaaacaacaa

SEQ ID NO: 713911 - RNA, 23 nt, Haemophilus influenzae Rd
acguuaucaucuguaaaccauuc

SEQ ID NO: 713912 - RNA, 18 nt, Haemophilus influenzae Rd
acuauuaauguuauuaaa

SEQ ID NO: 713913 - RNA, 18 nt, Haemophilus influenzae Rd
acuauuaaguucaaauuu

SEQ ID NO: 713914 - RNA, 16 nt, Haemophilus influenzae Rd
acuauuaccuaaccaa

SEQ ID NO: 713915 - RNA, 12 nt, Haemophilus influenzae Rd
acuauuaucuac

SEQ ID NO: 713916 - RNA, 21 nt, Haemophilus influenzae Rd
acuaucauccgcuuguaauuu

SEQ ID NO: 713917 - RNA, 13 nt, Haemophilus influenzae Rd
acuauaaaauacu

SEQ ID NO: 713918 - RNA, 12 nt, Haemophilus influenzae Rd
acuauuuuuaau

SEQ ID NO: 713919 - RNA, 23 nt, Haemophilus influenzae Rd
acuauuuaaguguuuacuauuaa

SEQ ID NO: 713920 - RNA, 14 nt, Haemophilus influenzae Rd
acuauuucaucuuu

SEQ ID NO: 713921 - RNA, 17 nt, Haemophilus influenzae Rd
acuauuauuccaaauau

SEQ ID NO: 713922 - RNA, 20 nt, Haemophilus influenzae Rd
acuauucuaaccgcacuuuu

SEQ ID NO: 713923 - RNA, 13 nt, Haemophilus influenzae Rd
acuacccaaauuu

SEQ ID NO: 713924 - RNA, 15 nt, Haemophilus influenzae Rd
acuaguucaucauca

SEQ ID NO: 713925 - RNA, 13 nt, Haemophilus influenzae Rd
acuacuuuccaau

SEQ ID NO: 713926 - RNA, 20 nt, Haemophilus influenzae Rd
acuacuuucuauuaaaaaau

SEQ ID NO: 713927 - RNA, 18 nt, Haemophilus influenzae Rd
acuacuugaacuaauauc

SEQ ID NO: 713928 - RNA, 22 nt, Haemophilus influenzae Rd
acuacuugaacuaauaucacuu

SEQ ID NO: 713929 - RNA, 24 nt, Haemophilus influenzae Rd
acuacuugaacuaauaucacuuug

SEQ ID NO: 713930 - RNA, 22 nt, Haemophilus influenzae Rd
acuacuugacguaaugcuccag

SEQ ID NO: 713931 - RNA, 17 nt, Haemophilus influenzae Rd
acuaauuaguuuuuaau

SEQ ID NO: 713932 - RNA, 19 nt, Haemophilus influenzae Rd
acuaauucaagcaaauauu

SEQ ID NO: 713933 - RNA, 20 nt, Haemophilus influenzae Rd
acuaauucauuacauaauac

SEQ ID NO: 713934 - RNA, 15 nt, Haemophilus influenzae Rd
acuaauucguuucuu

SEQ ID NO: 713935 - RNA, 16 nt, Haemophilus influenzae Rd
acuaauucguuucuug

SEQ ID NO: 713936 - RNA, 20 nt, Haemophilus influenzae Rd
acuaauugcauuaaaagucu

SEQ ID NO: 713937 - RNA, 16 nt, Haemophilus influenzae Rd
acuaauuuauuaaaaa

SEQ ID NO: 713938 - RNA, 22 nt, Haemophilus influenzae Rd
acuaauuucacaccauuuuuaa

SEQ ID NO: 713939 - RNA, 23 nt, Haemophilus influenzae Rd
acuaauuucacaccauuuuuaau

SEQ ID NO: 713940 - RNA, 13 nt, Haemophilus influenzae Rd
acuacaucagguu

SEQ ID NO: 713941 - RNA, 22 nt, Haemophilus influenzae Rd
acuacauugaguuacuuuucuu

SEQ ID NO: 713942 - RNA, 24 nt, Haemophilus influenzae Rd
acuacauugaguuacuuuucuuca

SEQ ID NO: 713943 - RNA, 14 nt, Haemophilus influenzae Rd
acuaaauauucaau

SEQ ID NO: 713944 - RNA, 11 nt, Haemophilus influenzae Rd
acuaaaucaaa

SEQ ID NO: 713945 - RNA, 14 nt, Haemophilus influenzae Rd
acuaaauaaaucac

SEQ ID NO: 713946 - RNA, 22 nt, Haemophilus influenzae Rd
acuaaauaaggcguaaaacuau

SEQ ID NO: 713947 - RNA, 17 nt, Haemophilus influenzae Rd
acuaaauacauuuuuau

SEQ ID NO: 713948 - RNA, 18 nt, Haemophilus influenzae Rd
acuaaaggcacaaaaaau

SEQ ID NO: 713949 - RNA, 14 nt, Haemophilus influenzae Rd
acuaaaguaaauuu

SEQ ID NO: 713950 - RNA, 15 nt, Haemophilus influenzae Rd
acuaaaccugcuucu

SEQ ID NO: 713951 - RNA, 18 nt, Haemophilus influenzae Rd
acuaaacguaacuaaaaa

SEQ ID NO: 713952 - RNA, 11 nt, Haemophilus influenzae Rd
acuaauuaaaa

SEQ ID NO: 713953 - RNA, 13 nt, Haemophilus influenzae Rd
acuaauuaaaagg

SEQ ID NO: 713954 - RNA, 15 nt, Haemophilus influenzae Rd
acuaauuaaaaggac

SEQ ID NO: 713955 - RNA, 15 nt, Haemophilus influenzae Rd
acuaaaucaaaaaua

SEQ ID NO: 713956 - RNA, 19 nt, Haemophilus influenzae Rd
acucaacaccgcaaaaaua

SEQ ID NO: 713957 - RNA, 23 nt, Haemophilus influenzae Rd
acucaacaccgcaaaaauacuaa

SEQ ID NO: 713958 - RNA, 16 nt, Haemophilus influenzae Rd
acucaaugaauuaaaa

SEQ ID NO: 713959 - RNA, 16 nt, Haemophilus influenzae Rd
acucaagcaaccuaaa

SEQ ID NO: 713960 - RNA, 21 nt, Haemophilus influenzae Rd
acucaauaaggcuuuuuuaau

SEQ ID NO: 713961 - RNA, 12 nt, Haemophilus influenzae Rd
acucgaaggaaa

SEQ ID NO: 713962 - RNA, 12 nt, Haemophilus influenzae Rd
acucggaaugcc

SEQ ID NO: 713963 - RNA, 17 nt, Haemophilus influenzae Rd
acucggagcauuuuggu

SEQ ID NO: 713964 - RNA, 21 nt, Haemophilus influenzae Rd
acucuaauaagugagaaaguu

SEQ ID NO: 713965 - RNA, 14 nt, Haemophilus influenzae Rd
acucuaucuaaaau

SEQ ID NO: 713966 - RNA, 22 nt, Haemophilus influenzae Rd
acucuaucuaaauggcaaaauu

SEQ ID NO: 713967 - RNA, 22 nt, Haemophilus influenzae Rd
acucugacaguuuaucucuuuc

SEQ ID NO: 713968 - RNA, 17 nt, Haemophilus influenzae Rd
acucugcuaguucgguu

SEQ ID NO: 713969 - RNA, 21 nt, Haemophilus influenzae Rd
acucucuugggugguaaaaau

SEQ ID NO: 713970 - RNA, 15 nt, Haemophilus influenzae Rd
acucuuaauuuuuga

SEQ ID NO: 713971 - RNA, 16 nt, Haemophilus influenzae Rd
acucuuaauuuuugau

SEQ ID NO: 713972 - RNA, 15 nt, Haemophilus influenzae Rd
acugagaucucuaug

SEQ ID NO: 713973 - RNA, 17 nt, Haemophilus influenzae Rd
acugaguucugucauuc

SEQ ID NO: 713974 - RNA, 20 nt, Haemophilus influenzae Rd
acugauauagcuagaaagca

SEQ ID NO: 713975 - RNA, 16 nt, Haemophilus influenzae Rd
acugaaaugauuauaa

SEQ ID NO: 713976 - RNA, 14 nt, Haemophilus influenzae Rd
acugaaauucuguu

SEQ ID NO: 713977 - RNA, 16 nt, Haemophilus influenzae Rd
acugaaaauucaucau

SEQ ID NO: 713978 - RNA, 14 nt, Haemophilus influenzae Rd
acucuuuuuuagau

SEQ ID NO: 713979 - RNA, 12 nt, Haemophilus influenzae Rd
acugacuuucua

SEQ ID NO: 713980 - RNA, 15 nt, Haemophilus influenzae Rd
acugauuuuaagaaa

SEQ ID NO: 713981 - RNA, 16 nt, Haemophilus influenzae Rd
acugauuuuaagaaau

SEQ ID NO: 713982 - RNA, 18 nt, Haemophilus influenzae Rd
acugauuuuguuuucuuu

SEQ ID NO: 713983 - RNA, 22 nt, Haemophilus influenzae Rd
acugauuuuuuuauaauuaaau

SEQ ID NO: 713984 - RNA, 23 nt, Haemophilus influenzae Rd
acugaugauggccaugacaagca

SEQ ID NO: 713985 - RNA, 21 nt, Haemophilus influenzae Rd
acugauuauauuguugcacau

SEQ ID NO: 713986 - RNA, 15 nt, Haemophilus influenzae Rd
acugccuuuuucuuc

SEQ ID NO: 713987 - RNA, 22 nt, Haemophilus influenzae Rd
acugcgaccacguuugccuuuu

SEQ ID NO: 713988 - RNA, 13 nt, Haemophilus influenzae Rd
acugccaaacaaa

SEQ ID NO: 713989 - RNA, 17 nt, Haemophilus influenzae Rd
acugccaaacaaauugc

SEQ ID NO: 713990 - RNA, 18 nt, Haemophilus influenzae Rd
acugccaaugcagcuuca

SEQ ID NO: 713991 - RNA, 14 nt, Haemophilus influenzae Rd
acugcaguaaaauc

SEQ ID NO: 713992 - RNA, 22 nt, Haemophilus influenzae Rd
acugcaccguauucuuuacaaa

SEQ ID NO: 713993 - RNA, 14 nt, Haemophilus influenzae Rd
acugcaucuguugu

SEQ ID NO: 713994 - RNA, 14 nt, Haemophilus influenzae Rd
acugcaucaauuug

SEQ ID NO: 713995 - RNA, 17 nt, Haemophilus influenzae Rd
acuggaaauucuucaau

SEQ ID NO: 713996 - RNA, 16 nt, Haemophilus influenzae Rd
acuggagccuugggaa

SEQ ID NO: 713997 - RNA, 20 nt, Haemophilus influenzae Rd
acuggagccuugggaauaug

SEQ ID NO: 713998 - RNA, 15 nt, Haemophilus influenzae Rd
acuggaauaaagcaa

SEQ ID NO: 713999 - RNA, 21 nt, Haemophilus influenzae Rd
acugcuucauaaauguaagau

SEQ ID NO: 714000 - RNA, 18 nt, Haemophilus influenzae Rd
acugcuuguucagcaaca

SEQ ID NO: 714001 - RNA, 14 nt, Haemophilus influenzae Rd
acugcuuucaaaag

SEQ ID NO: 714002 - RNA, 18 nt, Haemophilus influenzae Rd
acuggcacuaaaccugcu

SEQ ID NO: 714003 - RNA, 13 nt, Haemophilus influenzae Rd
acuggcagacaag

SEQ ID NO: 714004 - RNA, 19 nt, Haemophilus influenzae Rd
acuggcagacaaguuuaau

SEQ ID NO: 714005 - RNA, 21 nt, Haemophilus influenzae Rd
acuggcauuuuuuguugagca

SEQ ID NO: 714006 - RNA, 20 nt, Haemophilus influenzae Rd
acuggcguaaucguagaaau

SEQ ID NO: 714007 - RNA, 15 nt, Haemophilus influenzae Rd
acuggcguagcugca

SEQ ID NO: 714008 - RNA, 20 nt, Haemophilus influenzae Rd
acuggcuguguaaaacauug

SEQ ID NO: 714009 - RNA, 21 nt, Haemophilus influenzae Rd
acuggcucaaguaaugcuuua

SEQ ID NO: 714010 - RNA, 16 nt, Haemophilus influenzae Rd
acuggcugagagaaga

SEQ ID NO: 714011 - RNA, 12 nt, Haemophilus influenzae Rd
acugucuacugg

SEQ ID NO: 714012 - RNA, 13 nt, Haemophilus influenzae Rd
acugucuacuggc

SEQ ID NO: 714013 - RNA, 16 nt, Haemophilus influenzae Rd
acugucgaaccaaguu

SEQ ID NO: 714014 - RNA, 13 nt, Haemophilus influenzae Rd
acuguaaauaaac

SEQ ID NO: 714015 - RNA, 23 nt, Haemophilus influenzae Rd
acuguucuucugggauuggcuug

SEQ ID NO: 714016 - RNA, 20 nt, Haemophilus influenzae Rd
acuguuauuugcaaagauau

SEQ ID NO: 714017 - RNA, 22 nt, Haemophilus influenzae Rd
acuguuaccaauaacuaaaaau

SEQ ID NO: 714018 - RNA, 14 nt, Haemophilus influenzae Rd
acuuaaauacauug

SEQ ID NO: 714019 - RNA, 22 nt, Haemophilus influenzae Rd
acuuaaauaguuaauugauuua

SEQ ID NO: 714020 - RNA, 20 nt, Haemophilus influenzae Rd
acuuaaauuuuuauaaaguu

SEQ ID NO: 714021 - RNA, 12 nt, Haemophilus influenzae Rd
acuuaacaucau

SEQ ID NO: 714022 - RNA, 17 nt, Haemophilus influenzae Rd
acuuaaagaauacuuaa

SEQ ID NO: 714023 - RNA, 13 nt, Haemophilus influenzae Rd
acuuaaaaauaaa

SEQ ID NO: 714024 - RNA, 14 nt, Haemophilus influenzae Rd
acuuaaaaauaaag

SEQ ID NO: 714025 - RNA, 16 nt, Haemophilus influenzae Rd
acuuaaaaauaaagua

SEQ ID NO: 714026 - RNA, 21 nt, Haemophilus influenzae Rd
acuuaaaaauaaaguaagcac

SEQ ID NO: 714027 - RNA, 16 nt, Haemophilus influenzae Rd
acuuagcccuuaaacu

SEQ ID NO: 714028 - RNA, 17 nt, Haemophilus influenzae Rd
acuuagcccuuaaacua

SEQ ID NO: 714029 - RNA, 20 nt, Haemophilus influenzae Rd
acuuagcccuuaaacuaaau

SEQ ID NO: 714030 - RNA, 13 nt, Haemophilus influenzae Rd
acuuaaccaaaua

SEQ ID NO: 714031 - RNA, 20 nt, Haemophilus influenzae Rd
acuuaaccaaauaggcacau

SEQ ID NO: 714032 - RNA, 17 nt, Haemophilus influenzae Rd
acuuaaucaaauaagau

SEQ ID NO: 714033 - RNA, 23 nt, Haemophilus influenzae Rd
acuuaaucacugaauuucauuca

SEQ ID NO: 714034 - RNA, 20 nt, Haemophilus influenzae Rd
acuuaaguugggcuuauuaa

SEQ ID NO: 714035 - RNA, 23 nt, Haemophilus influenzae Rd
acuuaaguugggcuuauuuguuu

SEQ ID NO: 714036 - RNA, 13 nt, Haemophilus influenzae Rd
acuuaauaaaaau

SEQ ID NO: 714037 - RNA, 14 nt, Haemophilus influenzae Rd
acuuccgauuuuaa

SEQ ID NO: 714038 - RNA, 20 nt, Haemophilus influenzae Rd
acuuccgauuuuaauugugc

SEQ ID NO: 714039 - RNA, 22 nt, Haemophilus influenzae Rd
acuuccccuguaauaaaugcgu

SEQ ID NO: 714040 - RNA, 15 nt, Haemophilus influenzae Rd
acuuccguuccccaa

SEQ ID NO: 714041 - RNA, 21 nt, Haemophilus influenzae Rd
acuucagcagauacaucuucu

SEQ ID NO: 714042 - RNA, 15 nt, Haemophilus influenzae Rd
acuucagcuaauaaa

SEQ ID NO: 714043 - RNA, 15 nt, Haemophilus influenzae Rd
acuuaucuuaaaaaa

SEQ ID NO: 714044 - RNA, 21 nt, Haemophilus influenzae Rd
acuucaagugauuauuucucu

SEQ ID NO: 714045 - RNA, 15 nt, Haemophilus influenzae Rd
acuuaucuaaaaaga

SEQ ID NO: 714046 - RNA, 14 nt, Haemophilus influenzae Rd
acuuauaaagauau

SEQ ID NO: 714047 - RNA, 14 nt, Haemophilus influenzae Rd
acuuauaaauuuaa

SEQ ID NO: 714048 - RNA, 17 nt, Haemophilus influenzae Rd
agagcaaauuuaaauaa

SEQ ID NO: 714049 - RNA, 14 nt, Haemophilus influenzae Rd
agagauuuuauuca

SEQ ID NO: 714050 - RNA, 15 nt, Haemophilus influenzae Rd
agagauuuuauucau

SEQ ID NO: 714051 - RNA, 16 nt, Haemophilus influenzae Rd
agagauuuuauucaua

SEQ ID NO: 714052 - RNA, 15 nt, Haemophilus influenzae Rd
agagauaauaaauau

SEQ ID NO: 714053 - RNA, 16 nt, Haemophilus influenzae Rd
agagauaauaaauaua

SEQ ID NO: 714054 - RNA, 13 nt, Haemophilus influenzae Rd
agacuaugaaauc

SEQ ID NO: 714055 - RNA, 23 nt, Haemophilus influenzae Rd
agacuaauucguuucuugguuua

SEQ ID NO: 714056 - RNA, 22 nt, Haemophilus influenzae Rd
agacguuugauuguaaaagucc

SEQ ID NO: 714057 - RNA, 19 nt, Haemophilus influenzae Rd
agacuaaaaccacaucauu

SEQ ID NO: 714058 - RNA, 13 nt, Haemophilus influenzae Rd
agacuaauagcca

SEQ ID NO: 714059 - RNA, 18 nt, Haemophilus influenzae Rd
agagcaccaaauuaaaaa

SEQ ID NO: 714060 - RNA, 22 nt, Haemophilus influenzae Rd
agagccuccacaagcaacaaua

SEQ ID NO: 714061 - RNA, 16 nt, Haemophilus influenzae Rd
agagcaagcaauauaa

SEQ ID NO: 714062 - RNA, 17 nt, Haemophilus influenzae Rd
agaggggauaaaauaaa

SEQ ID NO: 714063 - RNA, 19 nt, Haemophilus influenzae Rd
agagcuuagauacauaaaa

SEQ ID NO: 714064 - RNA, 17 nt, Haemophilus influenzae Rd
agagcuucucuuuuuau

SEQ ID NO: 714065 - RNA, 14 nt, Haemophilus influenzae Rd
agagucaauccagu

SEQ ID NO: 714066 - RNA, 19 nt, Haemophilus influenzae Rd
agagucauuuacagguugc

SEQ ID NO: 714067 - RNA, 20 nt, Haemophilus influenzae Rd
agagucgaugccaagggcug

SEQ ID NO: 714068 - RNA, 17 nt, Haemophilus influenzae Rd
agauacgaaauagcguu

SEQ ID NO: 714069 - RNA, 15 nt, Haemophilus influenzae Rd
agauacaaaauguuu

SEQ ID NO: 714070 - RNA, 18 nt, Haemophilus influenzae Rd
agauacaaauaacacaga

SEQ ID NO: 714071 - RNA, 13 nt, Haemophilus influenzae Rd
agauaauuuuucu

SEQ ID NO: 714072 - RNA, 20 nt, Haemophilus influenzae Rd
agauacacucacuuuuccuu

SEQ ID NO: 714073 - RNA, 23 nt, Haemophilus influenzae Rd
agauacagaaggauccauuacaa

SEQ ID NO: 714074 - RNA, 18 nt, Haemophilus influenzae Rd
agauacauaaaaaacaca

SEQ ID NO: 714075 - RNA, 15 nt, Haemophilus influenzae Rd
agaguuuuuucacuu

SEQ ID NO: 714076 - RNA, 21 nt, Haemophilus influenzae Rd
agauacuauauuuucuucugc

SEQ ID NO: 714077 - RNA, 18 nt, Haemophilus influenzae Rd
agauauuauuauuaaauc

SEQ ID NO: 714078 - RNA, 20 nt, Haemophilus influenzae Rd
agauaugaaauaaagaaagg

SEQ ID NO: 714079 - RNA, 19 nt, Haemophilus influenzae Rd
agauauauugguuugcuua

SEQ ID NO: 714080 - RNA, 14 nt, Haemophilus influenzae Rd
agauauaagaaaua

SEQ ID NO: 714081 - RNA, 10 nt, Haemophilus influenzae Rd
agauauaaaa

SEQ ID NO: 714082 - RNA, 18 nt, Haemophilus influenzae Rd
agaucaagcacuuuuccu

SEQ ID NO: 714083 - RNA, 15 nt, Haemophilus influenzae Rd
agaucagauuuuuuu

SEQ ID NO: 714084 - RNA, 18 nt, Haemophilus influenzae Rd
agaucauaaaaaaaugua

SEQ ID NO: 714085 - RNA, 14 nt, Haemophilus influenzae Rd
agaucaguuaccau

SEQ ID NO: 714086 - RNA, 17 nt, Haemophilus influenzae Rd
agauccgcgagauacua

SEQ ID NO: 714087 - RNA, 22 nt, Haemophilus influenzae Rd
agaucccgcuccaccuugaauu

SEQ ID NO: 714088 - RNA, 24 nt, Haemophilus influenzae Rd
agauccauugauauauucuucuuc

SEQ ID NO: 714089 - RNA, 22 nt, Haemophilus influenzae Rd
agaucauuuuuuuaaauauuuu

SEQ ID NO: 714090 - RNA, 15 nt, Haemophilus influenzae Rd
agaucgaaauuaggu

SEQ ID NO: 714091 - RNA, 18 nt, Haemophilus influenzae Rd
agaucgauaucaucaaga

SEQ ID NO: 714092 - RNA, 17 nt, Haemophilus influenzae Rd
agaugaaaugccgauaa

SEQ ID NO: 714093 - RNA, 16 nt, Haemophilus influenzae Rd
agaugaagugaacuuc

SEQ ID NO: 714094 - RNA, 22 nt, Haemophilus influenzae Rd
agaugaacucaauuccuucauc

SEQ ID NO: 714095 - RNA, 15 nt, Haemophilus influenzae Rd
agaugacgaaaugaa

SEQ ID NO: 714096 - RNA, 22 nt, Haemophilus influenzae Rd
agaugacugcaauuaucaagcu

SEQ ID NO: 714097 - RNA, 17 nt, Haemophilus influenzae Rd
agaugacuggcaaaaau

SEQ ID NO: 714098 - RNA, 13 nt, Haemophilus influenzae Rd
agaugaugaaauu

SEQ ID NO: 714099 - RNA, 15 nt, Haemophilus influenzae Rd
agaugaugaaauuuu

SEQ ID NO: 714100 - RNA, 17 nt, Haemophilus influenzae Rd
agaugaugaaauuuuuc

SEQ ID NO: 714101 - RNA, 22 nt, Haemophilus influenzae Rd
agaugaucaaggguacaacaaa

SEQ ID NO: 714102 - RNA, 15 nt, Haemophilus influenzae Rd
agaugccaauuuuuc

SEQ ID NO: 714103 - RNA, 22 nt, Haemophilus influenzae Rd
agaugccauuucgcuugaguga

SEQ ID NO: 714104 - RNA, 19 nt, Haemophilus influenzae Rd
agauucaacaauaauuuuu

SEQ ID NO: 714105 - RNA, 23 nt, Haemophilus influenzae Rd
agauuauugcccgugaguaaaau

SEQ ID NO: 714106 - RNA, 18 nt, Haemophilus influenzae Rd
agauuauguucauuuucu

SEQ ID NO: 714107 - RNA, 19 nt, Haemophilus influenzae Rd
agauuauguucauuuucuu

SEQ ID NO: 714108 - RNA, 12 nt, Haemophilus influenzae Rd
agauuauuucua

SEQ ID NO: 714109 - RNA, 15 nt, Haemophilus influenzae Rd
agauuauuucuacuu

SEQ ID NO: 714110 - RNA, 14 nt, Haemophilus influenzae Rd
agauuauuucuccu

SEQ ID NO: 714111 - RNA, 19 nt, Haemophilus influenzae Rd
agauuauuugcauauaaaa

SEQ ID NO: 714112 - RNA, 19 nt, Haemophilus influenzae Rd
agauuaucgccuaaaauug

SEQ ID NO: 714113 - RNA, 20 nt, Haemophilus influenzae Rd
agauuaucugaggauuaaag

SEQ ID NO: 714114 - RNA, 13 nt, Haemophilus influenzae Rd
agauuacuuucau

SEQ ID NO: 714115 - RNA, 23 nt, Haemophilus influenzae Rd
agauucgcuuuuuuuuuugcuca

SEQ ID NO: 714116 - RNA, 18 nt, Haemophilus influenzae Rd
agauucuaauuccccuuc

SEQ ID NO: 714117 - RNA, 17 nt, Haemophilus influenzae Rd
agauugaauguuuuuca

SEQ ID NO: 714118 - RNA, 18 nt, Haemophilus influenzae Rd
agauugcugacaaauuug

SEQ ID NO: 714119 - RNA, 19 nt, Haemophilus influenzae Rd
agauugcugacaaauuugu

SEQ ID NO: 714120 - RNA, 23 nt, Haemophilus influenzae Rd
agauugcuccuacuuuuacaaac

SEQ ID NO: 714121 - RNA, 12 nt, Haemophilus influenzae Rd
agauuggaugga

SEQ ID NO: 714122 - RNA, 23 nt, Haemophilus influenzae Rd
agauuacacauuaacagaauuug

SEQ ID NO: 714123 - RNA, 17 nt, Haemophilus influenzae Rd
agauguuccuacagaac

SEQ ID NO: 714124 - RNA, 21 nt, Haemophilus influenzae Rd
agaacuuguaguucucccuga

SEQ ID NO: 714125 - RNA, 23 nt, Haemophilus influenzae Rd
agaacuuuccaccccagaauuaa

SEQ ID NO: 714126 - RNA, 14 nt, Haemophilus influenzae Rd
agaagccaaaucau

SEQ ID NO: 714127 - RNA, 14 nt, Haemophilus influenzae Rd
agaagcuuuccauc

SEQ ID NO: 714128 - RNA, 18 nt, Haemophilus influenzae Rd
agaagcugaauaaaagag

SEQ ID NO: 714129 - RNA, 14 nt, Haemophilus influenzae Rd
agaagcguucaaaa

SEQ ID NO: 714130 - RNA, 15 nt, Haemophilus influenzae Rd
agaagcguucaaaaa

SEQ ID NO: 714131 - RNA, 18 nt, Haemophilus influenzae Rd
agaagcguucaaaaagaa

SEQ ID NO: 714132 - RNA, 20 nt, Haemophilus influenzae Rd
agaauacaccccaaaauccc

SEQ ID NO: 714133 - RNA, 20 nt, Haemophilus influenzae Rd
agaauaauuaacaaauaauu

SEQ ID NO: 714134 - RNA, 18 nt, Haemophilus influenzae Rd
agaaugcggugaaauuuc

SEQ ID NO: 714135 - RNA, 19 nt, Haemophilus influenzae Rd
agaaucuucuaauuugcca

SEQ ID NO: 714136 - RNA, 15 nt, Haemophilus influenzae Rd
agaaugggcauugac

SEQ ID NO: 714137 - RNA, 22 nt, Haemophilus influenzae Rd
agaaugucagguuuaucuacca

SEQ ID NO: 714138 - RNA, 14 nt, Haemophilus influenzae Rd
agaauauucuuuuc

SEQ ID NO: 714139 - RNA, 22 nt, Haemophilus influenzae Rd
agaauauugguagcuaaaaaua

SEQ ID NO: 714140 - RNA, 15 nt, Haemophilus influenzae Rd
agaaucaaggcugga

SEQ ID NO: 714141 - RNA, 14 nt, Haemophilus influenzae Rd
agaauauuuccacu

SEQ ID NO: 714142 - RNA, 16 nt, Haemophilus influenzae Rd
agaauagccgcaauca

SEQ ID NO: 714143 - RNA, 22 nt, Haemophilus influenzae Rd
agaauagccgcaaucacaaaau

SEQ ID NO: 714144 - RNA, 14 nt, Haemophilus influenzae Rd
agacgauuuuagag

SEQ ID NO: 714145 - RNA, 18 nt, Haemophilus influenzae Rd
agacggcgcguucuucug

SEQ ID NO: 714146 - RNA, 16 nt, Haemophilus influenzae Rd
agaccguuuaacgcag

SEQ ID NO: 714147 - RNA, 21 nt, Haemophilus influenzae Rd
agaauuggcgaaccuucacuu

SEQ ID NO: 714148 - RNA, 23 nt, Haemophilus influenzae Rd
agaauuggugcgucuuuuaacau

SEQ ID NO: 714149 - RNA, 19 nt, Haemophilus influenzae Rd
agaauuucgucaaaaaugu

SEQ ID NO: 714150 - RNA, 19 nt, Haemophilus influenzae Rd
agaauuuacgaaaacuuuc

SEQ ID NO: 714151 - RNA, 18 nt, Haemophilus influenzae Rd
agacaauauugaaauaag

SEQ ID NO: 714152 - RNA, 20 nt, Haemophilus influenzae Rd
agacauauccucaacaucaa

SEQ ID NO: 714153 - RNA, 21 nt, Haemophilus influenzae Rd
agacagacuauuucuguauuu

SEQ ID NO: 714154 - RNA, 17 nt, Haemophilus influenzae Rd
agaaauuuuguuuuguu

SEQ ID NO: 714155 - RNA, 20 nt, Haemophilus influenzae Rd
agaaauugccauauaagcaa

SEQ ID NO: 714156 - RNA, 13 nt, Haemophilus influenzae Rd
agaaaguaaacaa

SEQ ID NO: 714157 - RNA, 13 nt, Haemophilus influenzae Rd
agaaaguauuaaa

SEQ ID NO: 714158 - RNA, 16 nt, Haemophilus influenzae Rd
agaaaguauuaaauau

SEQ ID NO: 714159 - RNA, 16 nt, Haemophilus influenzae Rd
agaacaacaauacguu

SEQ ID NO: 714160 - RNA, 21 nt, Haemophilus influenzae Rd
agaaauuuuuuugcuggaaaa

SEQ ID NO: 714161 - RNA, 18 nt, Haemophilus influenzae Rd
agaacaaaaggcuuuuua

SEQ ID NO: 714162 - RNA, 19 nt, Haemophilus influenzae Rd
agaaauuuuauccaucaaa

SEQ ID NO: 714163 - RNA, 23 nt, Haemophilus influenzae Rd
agaacaccgagaugcauuuuuua

SEQ ID NO: 714164 - RNA, 17 nt, Haemophilus influenzae Rd
agaacaagcauuuuuca

SEQ ID NO: 714165 - RNA, 22 nt, Haemophilus influenzae Rd
agaacaaggggaaaauauuaug

SEQ ID NO: 714166 - RNA, 15 nt, Haemophilus influenzae Rd
agaacaauauuuaua

SEQ ID NO: 714167 - RNA, 22 nt, Haemophilus influenzae Rd
agaacagguugcugauaaagau

SEQ ID NO: 714168 - RNA, 16 nt, Haemophilus influenzae Rd
agaacauugauaagau

SEQ ID NO: 714169 - RNA, 17 nt, Haemophilus influenzae Rd
agaacauugauaagauu

SEQ ID NO: 714170 - RNA, 14 nt, Haemophilus influenzae Rd
agaacauugugaca

SEQ ID NO: 714171 - RNA, 19 nt, Haemophilus influenzae Rd
agaacuauuauuccaaaua

SEQ ID NO: 714172 - RNA, 23 nt, Haemophilus influenzae Rd
agaacuauuauuccaaauaucuu

SEQ ID NO: 714173 - RNA, 16 nt, Haemophilus influenzae Rd
agaacguuuuuuacuu

SEQ ID NO: 714174 - RNA, 12 nt, Haemophilus influenzae Rd
agaacguauuau

SEQ ID NO: 714175 - RNA, 15 nt, Haemophilus influenzae Rd
agaacguaaauuaug

SEQ ID NO: 714176 - RNA, 16 nt, Haemophilus influenzae Rd
agaaccuaaugcagua

SEQ ID NO: 714177 - RNA, 16 nt, Haemophilus influenzae Rd
agaaccgaaagcccac

SEQ ID NO: 714178 - RNA, 18 nt, Haemophilus influenzae Rd
agaacgacgccaaauaug

SEQ ID NO: 714179 - RNA, 18 nt, Haemophilus influenzae Rd
agaaccuuggaaauuaac

SEQ ID NO: 714180 - RNA, 22 nt, Haemophilus influenzae Rd
acuuuugagucaauuugaccga

SEQ ID NO: 714181 - RNA, 23 nt, Haemophilus influenzae Rd
acuuuugagugcuguacacacac

SEQ ID NO: 714182 - RNA, 18 nt, Haemophilus influenzae Rd
acuuuugguggauuauaa

SEQ ID NO: 714183 - RNA, 17 nt, Haemophilus influenzae Rd
acuuuucuucaauuacc

SEQ ID NO: 714184 - RNA, 18 nt, Haemophilus influenzae Rd
acuuuucuucaauuaccu

SEQ ID NO: 714185 - RNA, 16 nt, Haemophilus influenzae Rd
acuucgcuaauuuuuu

SEQ ID NO: 714186 - RNA, 22 nt, Haemophilus influenzae Rd
acuuuuucauguacaagugaau

SEQ ID NO: 714187 - RNA, 20 nt, Haemophilus influenzae Rd
acuuuuucagauacuuucua

SEQ ID NO: 714188 - RNA, 13 nt, Haemophilus influenzae Rd
acuuuuucaucuu

SEQ ID NO: 714189 - RNA, 21 nt, Haemophilus influenzae Rd
acuuuuugacccgcuuuuaau

SEQ ID NO: 714190 - RNA, 16 nt, Haemophilus influenzae Rd
acuuuuuguuuguaau

SEQ ID NO: 714191 - RNA, 16 nt, Haemophilus influenzae Rd
acuuuuuaucuaaaaa

SEQ ID NO: 714192 - RNA, 16 nt, Haemophilus influenzae Rd
acuuuuuaucuaaauu

SEQ ID NO: 714193 - RNA, 19 nt, Haemophilus influenzae Rd
acuuuuuagcucguugcca

SEQ ID NO: 714194 - RNA, 15 nt, Haemophilus influenzae Rd
acuuuuucaccauug

SEQ ID NO: 714195 - RNA, 16 nt, Haemophilus influenzae Rd
acuuuuuauguuuugu

SEQ ID NO: 714196 - RNA, 14 nt, Haemophilus influenzae Rd
acuuuuuauuuucu

SEQ ID NO: 714197 - RNA, 15 nt, Haemophilus influenzae Rd
acuuuuuauuuuucc

SEQ ID NO: 714198 - RNA, 14 nt, Haemophilus influenzae Rd
acuuuuuucuaccg

SEQ ID NO: 714199 - RNA, 23 nt, Haemophilus influenzae Rd
acuuuuuuauaaucuuuaaauuu

SEQ ID NO: 714200 - RNA, 20 nt, Haemophilus influenzae Rd
acuuuuuuaucgguuauuac

SEQ ID NO: 714201 - RNA, 17 nt, Haemophilus influenzae Rd
acuuuuuugauaugcca

SEQ ID NO: 714202 - RNA, 22 nt, Haemophilus influenzae Rd
acuuuuuuguauaaaaauuauu

SEQ ID NO: 714203 - RNA, 22 nt, Haemophilus influenzae Rd
agaaaaucguaucuuuccaaua

SEQ ID NO: 714204 - RNA, 18 nt, Haemophilus influenzae Rd
agaaaaucguauucucau

SEQ ID NO: 714205 - RNA, 12 nt, Haemophilus influenzae Rd
agaaaacaaacg

SEQ ID NO: 714206 - RNA, 19 nt, Haemophilus influenzae Rd
agaaaauaucuuuggcuuu

SEQ ID NO: 714207 - RNA, 20 nt, Haemophilus influenzae Rd
agaaaauauuuaacuaauuu

SEQ ID NO: 714208 - RNA, 20 nt, Haemophilus influenzae Rd
agaaaaaucgaagaaauaug

SEQ ID NO: 714209 - RNA, 21 nt, Haemophilus influenzae Rd
agaaaaaucgaagaaauauga

SEQ ID NO: 714210 - RNA, 22 nt, Haemophilus influenzae Rd
agaaaaaucuuuaccaaaaaau

SEQ ID NO: 714211 - RNA, 23 nt, Haemophilus influenzae Rd
agaaaaaucuuuaccaaaaaauu

SEQ ID NO: 714212 - RNA, 23 nt, Haemophilus influenzae Rd
agaaaaauugguacgagaaaaau

SEQ ID NO: 714213 - RNA, 17 nt, Haemophilus influenzae Rd
agaaaauuaaaaauuua

SEQ ID NO: 714214 - RNA, 21 nt, Haemophilus influenzae Rd
agaaaauugucgcuaacauau

SEQ ID NO: 714215 - RNA, 23 nt, Haemophilus influenzae Rd
agaaacugaccgcacuuuugcga

SEQ ID NO: 714216 - RNA, 19 nt, Haemophilus influenzae Rd
agaaacuaauuaguuuuua

SEQ ID NO: 714217 - RNA, 11 nt, Haemophilus influenzae Rd
agaaacguuuu

SEQ ID NO: 714218 - RNA, 20 nt, Haemophilus influenzae Rd
agaaagccccaguuuauuca

SEQ ID NO: 714219 - RNA, 20 nt, Haemophilus influenzae Rd
agaaagcaauguaguuggca

SEQ ID NO: 714220 - RNA, 10 nt, Haemophilus influenzae Rd
agaaagcgac

SEQ ID NO: 714221 - RNA, 13 nt, Haemophilus influenzae Rd
agaaagcggauuu

SEQ ID NO: 714222 - RNA, 15 nt, Haemophilus influenzae Rd
agaaagccuuuuaaa

SEQ ID NO: 714223 - RNA, 17 nt, Haemophilus influenzae Rd
agaaagccuuuuaaaau

SEQ ID NO: 714224 - RNA, 20 nt, Haemophilus influenzae Rd
agaaagccuuuuauuucuua

SEQ ID NO: 714225 - RNA, 20 nt, Haemophilus influenzae Rd
agaaaggcaauauuuuagca

SEQ ID NO: 714226 - RNA, 21 nt, Haemophilus influenzae Rd
agaaagguguaauuccauauu

SEQ ID NO: 714227 - RNA, 14 nt, Haemophilus influenzae Rd
agaaagggauuuua

SEQ ID NO: 714228 - RNA, 15 nt, Haemophilus influenzae Rd
accccugaauuuugu

SEQ ID NO: 714229 - RNA, 15 nt, Haemophilus influenzae Rd
accgcacuuaauaaa

SEQ ID NO: 714230 - RNA, 20 nt, Haemophilus influenzae Rd
accgcacuuagauuugaacc

SEQ ID NO: 714231 - RNA, 19 nt, Haemophilus influenzae Rd
accgcacuuuaaauauuua

SEQ ID NO: 714232 - RNA, 22 nt, Haemophilus influenzae Rd
accgcacuuuaaauauuuaaaa

SEQ ID NO: 714233 - RNA, 21 nt, Haemophilus influenzae Rd
accgcacuuuaaucugugccu

SEQ ID NO: 714234 - RNA, 17 nt, Haemophilus influenzae Rd
accgcacuuugauuuug

SEQ ID NO: 714235 - RNA, 23 nt, Haemophilus influenzae Rd
accgcacuuugcacuuuaaagaa

SEQ ID NO: 714236 - RNA, 19 nt, Haemophilus influenzae Rd
accgcacuuuguggcuuuu

SEQ ID NO: 714237 - RNA, 17 nt, Haemophilus influenzae Rd
accgcacuuuuaaaauu

SEQ ID NO: 714238 - RNA, 17 nt, Haemophilus influenzae Rd
accgcacuuuuaauuaa

SEQ ID NO: 714239 - RNA, 21 nt, Haemophilus influenzae Rd
accgcacuuuuauccaccagc

SEQ ID NO: 714240 - RNA, 21 nt, Haemophilus influenzae Rd
accgcacuuuucaacaaaaaa

SEQ ID NO: 714241 - RNA, 14 nt, Haemophilus influenzae Rd
accgcacuuuucuu

SEQ ID NO: 714242 - RNA, 21 nt, Haemophilus influenzae Rd
accgcacuuuugagugcugua

SEQ ID NO: 714243 - RNA, 22 nt, Haemophilus influenzae Rd
accgcacuuuugugauuaaaau

SEQ ID NO: 714244 - RNA, 16 nt, Haemophilus influenzae Rd
accgcacuuuuuacuu

SEQ ID NO: 714245 - RNA, 14 nt, Haemophilus influenzae Rd
accgcacuuuuuau

SEQ ID NO: 714246 - RNA, 21 nt, Haemophilus influenzae Rd
accgcacuuuuuauauuuuuu

SEQ ID NO: 714247 - RNA, 22 nt, Haemophilus influenzae Rd
accgcacuuuuuaucuaaaaaa

SEQ ID NO: 714248 - RNA, 20 nt, Haemophilus influenzae Rd
accgcacuuuuuaucuaaau

SEQ ID NO: 714249 - RNA, 21 nt, Haemophilus influenzae Rd
accgcacuuuuucuugaucuu

SEQ ID NO: 714250 - RNA, 13 nt, Haemophilus influenzae Rd
accgcacuuuuug

SEQ ID NO: 714251 - RNA, 15 nt, Haemophilus influenzae Rd
accgcacuuuuuugu

SEQ ID NO: 714252 - RNA, 16 nt, Haemophilus influenzae Rd
accgccagugauuuuu

SEQ ID NO: 714253 - RNA, 19 nt, Haemophilus influenzae Rd
accgcauuuuuaauuuuua

SEQ ID NO: 714254 - RNA, 21 nt, Haemophilus influenzae Rd
accgcucuuuaacaaauucac

SEQ ID NO: 714255 - RNA, 20 nt, Haemophilus influenzae Rd
accgcugucauauucauuuu

SEQ ID NO: 714256 - RNA, 14 nt, Haemophilus influenzae Rd
accgccuacaugau

SEQ ID NO: 714257 - RNA, 21 nt, Haemophilus influenzae Rd
accgccuaaaguuacacaaug

SEQ ID NO: 714258 - RNA, 16 nt, Haemophilus influenzae Rd
accgggcgauaaaauc

SEQ ID NO: 714259 - RNA, 17 nt, Haemophilus influenzae Rd
accgguuacuuggauga

SEQ ID NO: 714260 - RNA, 15 nt, Haemophilus influenzae Rd
accgguacagaugcc

SEQ ID NO: 714261 - RNA, 16 nt, Haemophilus influenzae Rd
accuaaauuguugcuc

SEQ ID NO: 714262 - RNA, 18 nt, Haemophilus influenzae Rd
accuaaauuguugcucug

SEQ ID NO: 714263 - RNA, 13 nt, Haemophilus influenzae Rd
accuaaagccaag

SEQ ID NO: 714264 - RNA, 20 nt, Haemophilus influenzae Rd
accuaaaccuuauuuuaaau

SEQ ID NO: 714265 - RNA, 16 nt, Haemophilus influenzae Rd
accuaaaccuucccca

SEQ ID NO: 714266 - RNA, 22 nt, Haemophilus influenzae Rd
accuaaaugagaaaaauccugu

SEQ ID NO: 714267 - RNA, 18 nt, Haemophilus influenzae Rd
accuaaacgaucaucuau

SEQ ID NO: 714268 - RNA, 19 nt, Haemophilus influenzae Rd
accuaaacgaucaucuaua

SEQ ID NO: 714269 - RNA, 17 nt, Haemophilus influenzae Rd
accguuugacguaucca

SEQ ID NO: 714270 - RNA, 21 nt, Haemophilus influenzae Rd
accguuuuuucuuuuuccuga

SEQ ID NO: 714271 - RNA, 16 nt, Haemophilus influenzae Rd
accuaaaauaaauuuu

SEQ ID NO: 714272 - RNA, 21 nt, Haemophilus influenzae Rd
accuaaaauagagcaaauaua

SEQ ID NO: 714273 - RNA, 14 nt, Haemophilus influenzae Rd
accuaaaauauuua

SEQ ID NO: 714274 - RNA, 14 nt, Haemophilus influenzae Rd
accuaaaaauuuaa

SEQ ID NO: 714275 - RNA, 19 nt, Haemophilus influenzae Rd
accuaaaaauuuaaauaua

SEQ ID NO: 714276 - RNA, 14 nt, Haemophilus influenzae Rd
accuaaaaauuuua

SEQ ID NO: 714277 - RNA, 23 nt, Haemophilus influenzae Rd
accuaaaaauuuuaggugcuuuu

SEQ ID NO: 714278 - RNA, 15 nt, Haemophilus influenzae Rd
accguguuuuucacg

SEQ ID NO: 714279 - RNA, 18 nt, Haemophilus influenzae Rd
accguguuuuucaucaau

SEQ ID NO: 714280 - RNA, 18 nt, Haemophilus influenzae Rd
accguugaaugcuucuac

SEQ ID NO: 714281 - RNA, 17 nt, Haemophilus influenzae Rd
accuagcgggauaagau

SEQ ID NO: 714282 - RNA, 15 nt, Haemophilus influenzae Rd
accuaccggaaacca

SEQ ID NO: 714283 - RNA, 15 nt, Haemophilus influenzae Rd
accuacauuaaucac

SEQ ID NO: 714284 - RNA, 22 nt, Haemophilus influenzae Rd
accuaauggauauagaaaucau

SEQ ID NO: 714285 - RNA, 23 nt, Haemophilus influenzae Rd
accuaagcacaaagaaaaacuaa

SEQ ID NO: 714286 - RNA, 13 nt, Haemophilus influenzae Rd
accuaauaaagcg

SEQ ID NO: 714287 - RNA, 14 nt, Haemophilus influenzae Rd
accgugggugugaa

SEQ ID NO: 714288 - RNA, 18 nt, Haemophilus influenzae Rd
accgugggugugaaauau

SEQ ID NO: 714289 - RNA, 15 nt, Haemophilus influenzae Rd
accguagucagauaa

SEQ ID NO: 714290 - RNA, 21 nt, Haemophilus influenzae Rd
accguccaagguuuuaauuuu

SEQ ID NO: 714291 - RNA, 17 nt, Haemophilus influenzae Rd
accuauuagaauuuaua

SEQ ID NO: 714292 - RNA, 14 nt, Haemophilus influenzae Rd
accuauuuuuuccu

SEQ ID NO: 714293 - RNA, 16 nt, Haemophilus influenzae Rd
accucgccauuuuuca

SEQ ID NO: 714294 - RNA, 16 nt, Haemophilus influenzae Rd
accugauaaguagaaa

SEQ ID NO: 714295 - RNA, 19 nt, Haemophilus influenzae Rd
accugauucauugcauuuu

SEQ ID NO: 714296 - RNA, 22 nt, Haemophilus influenzae Rd
accugauucauugcauuuuuau

SEQ ID NO: 714297 - RNA, 18 nt, Haemophilus influenzae Rd
accugaugcuuuaacacc

SEQ ID NO: 714298 - RNA, 22 nt, Haemophilus influenzae Rd
accucgugcuguuuucaauuuu

SEQ ID NO: 714299 - RNA, 14 nt, Haemophilus influenzae Rd
accucgcuauaaau

SEQ ID NO: 714300 - RNA, 16 nt, Haemophilus influenzae Rd
accugcggauuucacu

SEQ ID NO: 714301 - RNA, 15 nt, Haemophilus influenzae Rd
accugcccugaagca

SEQ ID NO: 714302 - RNA, 18 nt, Haemophilus influenzae Rd
accugcccugaagcaaca

SEQ ID NO: 714303 - RNA, 15 nt, Haemophilus influenzae Rd
accugcauuuuggau

SEQ ID NO: 714304 - RNA, 20 nt, Haemophilus influenzae Rd
accugccauaauaacgccac

SEQ ID NO: 714305 - RNA, 13 nt, Haemophilus influenzae Rd
accugcagaaagg

SEQ ID NO: 714306 - RNA, 14 nt, Haemophilus influenzae Rd
accugcagaccaag

SEQ ID NO: 714307 - RNA, 22 nt, Haemophilus influenzae Rd
accugcagccauaauauuuaaa

SEQ ID NO: 714308 - RNA, 17 nt, Haemophilus influenzae Rd
accugcaucaauuuuac

SEQ ID NO: 714309 - RNA, 19 nt, Haemophilus influenzae Rd
accugcuucuuuuaauaag

SEQ ID NO: 714310 - RNA, 19 nt, Haemophilus influenzae Rd
accugguugcauaaaaucu

SEQ ID NO: 714311 - RNA, 21 nt, Haemophilus influenzae Rd
accugugaaaacacguccgca

SEQ ID NO: 714312 - RNA, 21 nt, Haemophilus influenzae Rd
accuguuucguacauuguuuc

SEQ ID NO: 714313 - RNA, 14 nt, Haemophilus influenzae Rd
accuuauuuuaaau

SEQ ID NO: 714314 - RNA, 17 nt, Haemophilus influenzae Rd
accuucaaccauuuucu

SEQ ID NO: 714315 - RNA, 16 nt, Haemophilus influenzae Rd
accuuaaaucaaacaa

SEQ ID NO: 714316 - RNA, 20 nt, Haemophilus influenzae Rd
accuuaaaucaaacaaaauu

SEQ ID NO: 714317 - RNA, 22 nt, Haemophilus influenzae Rd
accuucugcaucaguauuaaga

SEQ ID NO: 714318 - RNA, 16 nt, Haemophilus influenzae Rd
accuucuguuuucaau

SEQ ID NO: 714319 - RNA, 19 nt, Haemophilus influenzae Rd
accuucugcggaaaugaaa

SEQ ID NO: 714320 - RNA, 16 nt, Haemophilus influenzae Rd
accuucaucaccugcu

SEQ ID NO: 714321 - RNA, 21 nt, Haemophilus influenzae Rd
accuucagcggcuucaucuaa

SEQ ID NO: 714322 - RNA, 21 nt, Haemophilus influenzae Rd
accuucacagauuucaauuaa

SEQ ID NO: 714323 - RNA, 14 nt, Haemophilus influenzae Rd
accuucaauugugc

SEQ ID NO: 714324 - RNA, 22 nt, Haemophilus influenzae Rd
accuucacuuggcgaaaaucau

SEQ ID NO: 714325 - RNA, 21 nt, Haemophilus influenzae Rd
accuuguuccaggaaaauuuu

SEQ ID NO: 714326 - RNA, 21 nt, Haemophilus influenzae Rd
accuugugcgacaaguuugau

SEQ ID NO: 714327 - RNA, 19 nt, Haemophilus influenzae Rd
accuuguaaacuuuccuca

SEQ ID NO: 714328 - RNA, 13 nt, Haemophilus influenzae Rd
accuuguaaagca

SEQ ID NO: 714329 - RNA, 18 nt, Haemophilus influenzae Rd
accuuggcuuucuacaua

SEQ ID NO: 714330 - RNA, 21 nt, Haemophilus influenzae Rd
accuugcauuucauuugagaa

SEQ ID NO: 714331 - RNA, 21 nt, Haemophilus influenzae Rd
accuugauugagaugccauuu

SEQ ID NO: 714332 - RNA, 19 nt, Haemophilus influenzae Rd
accuucuugauuauuuaau

SEQ ID NO: 714333 - RNA, 21 nt, Haemophilus influenzae Rd
accuugaauugcauuuucuuc

SEQ ID NO: 714334 - RNA, 12 nt, Haemophilus influenzae Rd
acgaaauaauug

SEQ ID NO: 714335 - RNA, 12 nt, Haemophilus influenzae Rd
acgaaaugaaau

SEQ ID NO: 714336 - RNA, 16 nt, Haemophilus influenzae Rd
acgaaaugaaauuaau

SEQ ID NO: 714337 - RNA, 14 nt, Haemophilus influenzae Rd
accuuuuucuaccg

SEQ ID NO: 714338 - RNA, 20 nt, Haemophilus influenzae Rd
accuuuuucuuccauuucaa

SEQ ID NO: 714339 - RNA, 20 nt, Haemophilus influenzae Rd
accuuuuugcguauccgcug

SEQ ID NO: 714340 - RNA, 18 nt, Haemophilus influenzae Rd
acgaaaccaacgaaaaua

SEQ ID NO: 714341 - RNA, 17 nt, Haemophilus influenzae Rd
accuuuacguuuaacug

SEQ ID NO: 714342 - RNA, 15 nt, Haemophilus influenzae Rd
accuuucauauaaau

SEQ ID NO: 714343 - RNA, 15 nt, Haemophilus influenzae Rd
accuuucuguaaaua

SEQ ID NO: 714344 - RNA, 13 nt, Haemophilus influenzae Rd
accuuuuagcaac

SEQ ID NO: 714345 - RNA, 17 nt, Haemophilus influenzae Rd
accuuuucgaauuaaac

SEQ ID NO: 714346 - RNA, 23 nt, Haemophilus influenzae Rd
accuuuucguagccaauuuuguc

SEQ ID NO: 714347 - RNA, 15 nt, Haemophilus influenzae Rd
acgacauuuuuaacu

SEQ ID NO: 714348 - RNA, 14 nt, Haemophilus influenzae Rd
acgacaucuuaaau

SEQ ID NO: 714349 - RNA, 19 nt, Haemophilus influenzae Rd
acgacaucuuaaauuauag

SEQ ID NO: 714350 - RNA, 17 nt, Haemophilus influenzae Rd
acgaccauugaauccaa

SEQ ID NO: 714351 - RNA, 22 nt, Haemophilus influenzae Rd
acgaccuuuacuuuuuaauaaa

SEQ ID NO: 714352 - RNA, 13 nt, Haemophilus influenzae Rd
acgacuaaaacga

SEQ ID NO: 714353 - RNA, 16 nt, Haemophilus influenzae Rd
acgacuaaaauuagau

SEQ ID NO: 714354 - RNA, 15 nt, Haemophilus influenzae Rd
acgacgugcuucaaa

SEQ ID NO: 714355 - RNA, 13 nt, Haemophilus influenzae Rd
acgagauaagcau

SEQ ID NO: 714356 - RNA, 23 nt, Haemophilus influenzae Rd
acgagauaagcauuuuaucacaa

SEQ ID NO: 714357 - RNA, 13 nt, Haemophilus influenzae Rd
acgagcaauaaua

SEQ ID NO: 714358 - RNA, 13 nt, Haemophilus influenzae Rd
acgagaaguuaaa

SEQ ID NO: 714359 - RNA, 22 nt, Haemophilus influenzae Rd
acgagaaguuaaaccugccaac

SEQ ID NO: 714360 - RNA, 20 nt, Haemophilus influenzae Rd
acgagaacgagccucaucua

SEQ ID NO: 714361 - RNA, 22 nt, Haemophilus influenzae Rd
acgaauaauuaaaucuucgccu

SEQ ID NO: 714362 - RNA, 18 nt, Haemophilus influenzae Rd
acgaagugcgguaaauuc

SEQ ID NO: 714363 - RNA, 18 nt, Haemophilus influenzae Rd
acgaaguggcguuugcuc

SEQ ID NO: 714364 - RNA, 16 nt, Haemophilus influenzae Rd
acgaaguguuaagcac

SEQ ID NO: 714365 - RNA, 18 nt, Haemophilus influenzae Rd
acgaaguguuaagcacca

SEQ ID NO: 714366 - RNA, 17 nt, Haemophilus influenzae Rd
acgaauuaagcgaacac

SEQ ID NO: 714367 - RNA, 20 nt, Haemophilus influenzae Rd
acgaauugguucuaaauauu

SEQ ID NO: 714368 - RNA, 17 nt, Haemophilus influenzae Rd
acgaauugcaauaacca

SEQ ID NO: 714369 - RNA, 15 nt, Haemophilus influenzae Rd
acgacacacuauuaa

SEQ ID NO: 714370 - RNA, 21 nt, Haemophilus influenzae Rd
acgaaggggcauuaacagcac

SEQ ID NO: 714371 - RNA, 13 nt, Haemophilus influenzae Rd
acgaaguaaaagc

SEQ ID NO: 714372 - RNA, 12 nt, Haemophilus influenzae Rd
acgaagaaucca

SEQ ID NO: 714373 - RNA, 16 nt, Haemophilus influenzae Rd
acgaagaauccacauu

SEQ ID NO: 714374 - RNA, 21 nt, Haemophilus influenzae Rd
acgaacuaaaauggugcuuuu

SEQ ID NO: 714375 - RNA, 23 nt, Haemophilus influenzae Rd
acgaacgugggaauuuucccauu

SEQ ID NO: 714376 - RNA, 15 nt, Haemophilus influenzae Rd
acgaguauauugcau

SEQ ID NO: 714377 - RNA, 21 nt, Haemophilus influenzae Rd
acgagugcgaguuggaucaca

SEQ ID NO: 714378 - RNA, 16 nt, Haemophilus influenzae Rd
acgaguucuuuuggua

SEQ ID NO: 714379 - RNA, 13 nt, Haemophilus influenzae Rd
acgaguaaaaaau

SEQ ID NO: 714380 - RNA, 17 nt, Haemophilus influenzae Rd
acgagcaggaaaaccac

SEQ ID NO: 714381 - RNA, 20 nt, Haemophilus influenzae Rd
acgagcaggaaaaccacaag

SEQ ID NO: 714382 - RNA, 13 nt, Haemophilus influenzae Rd
acgauauuuuuau

SEQ ID NO: 714383 - RNA, 23 nt, Haemophilus influenzae Rd
acgauauucuugcguaaccaaag

SEQ ID NO: 714384 - RNA, 15 nt, Haemophilus influenzae Rd
acgauauugcacaau

SEQ ID NO: 714385 - RNA, 16 nt, Haemophilus influenzae Rd
acgauaagauuugcuu

SEQ ID NO: 714386 - RNA, 20 nt, Haemophilus influenzae Rd
acgauaauauuuuugccaau

SEQ ID NO: 714387 - RNA, 19 nt, Haemophilus influenzae Rd
acgauaaugccauuugcuu

SEQ ID NO: 714388 - RNA, 22 nt, Haemophilus influenzae Rd
acgauagguaaacuuuggaaua

SEQ ID NO: 714389 - RNA, 19 nt, Haemophilus influenzae Rd
acgauacuuuuaauuaaau

SEQ ID NO: 714390 - RNA, 13 nt, Haemophilus influenzae Rd
acgaucugcaaca

SEQ ID NO: 714391 - RNA, 20 nt, Haemophilus influenzae Rd
acgaugcaacgcauuagcau

SEQ ID NO: 714392 - RNA, 11 nt, Haemophilus influenzae Rd
acgaugggcaa

SEQ ID NO: 714393 - RNA, 18 nt, Haemophilus influenzae Rd
acgcaaacuacaacuuuu

SEQ ID NO: 714394 - RNA, 17 nt, Haemophilus influenzae Rd
acgauuuucaauacauc

SEQ ID NO: 714395 - RNA, 20 nt, Haemophilus influenzae Rd
acgauuuuuuuauaaaaaaa

SEQ ID NO: 714396 - RNA, 23 nt, Haemophilus influenzae Rd
acgauuuuuuuauaaaaaaacua

SEQ ID NO: 714397 - RNA, 21 nt, Haemophilus influenzae Rd
acgcaaccuugagcaauauaa

SEQ ID NO: 714398 - RNA, 20 nt, Haemophilus influenzae Rd
acgauuuuccgaaaaaacaa

SEQ ID NO: 714399 - RNA, 18 nt, Haemophilus influenzae Rd
acgauuucaguaucaaua

SEQ ID NO: 714400 - RNA, 17 nt, Haemophilus influenzae Rd
acauuuaaccaaaacgu

SEQ ID NO: 714401 - RNA, 17 nt, Haemophilus influenzae Rd
acaugguuaaaauauuc

SEQ ID NO: 714402 - RNA, 14 nt, Haemophilus influenzae Rd
acauggaacguuuu

SEQ ID NO: 714403 - RNA, 13 nt, Haemophilus influenzae Rd
acauuuuuuuuau

SEQ ID NO: 714404 - RNA, 17 nt, Haemophilus influenzae Rd
acauuuuuuuuauccaa

SEQ ID NO: 714405 - RNA, 14 nt, Haemophilus influenzae Rd
acauuuuuucaacu

SEQ ID NO: 714406 - RNA, 13 nt, Haemophilus influenzae Rd
acauuuuuugcug

SEQ ID NO: 714407 - RNA, 15 nt, Haemophilus influenzae Rd
acauuuuuuguaauu

SEQ ID NO: 714408 - RNA, 21 nt, Haemophilus influenzae Rd
acauuuuugucuuuguugauu

SEQ ID NO: 714409 - RNA, 22 nt, Haemophilus influenzae Rd
acauuuccaagcguaaaaguau

SEQ ID NO: 714410 - RNA, 12 nt, Haemophilus influenzae Rd
accaaaaauccu

SEQ ID NO: 714411 - RNA, 18 nt, Haemophilus influenzae Rd
accaaauagaugaaauuu

SEQ ID NO: 714412 - RNA, 16 nt, Haemophilus influenzae Rd
accaaauaucgcaauc

SEQ ID NO: 714413 - RNA, 12 nt, Haemophilus influenzae Rd
accaacacuugc

SEQ ID NO: 714414 - RNA, 20 nt, Haemophilus influenzae Rd
accaacacuugcagcccaac

SEQ ID NO: 714415 - RNA, 23 nt, Haemophilus influenzae Rd
accaaaguuuccuucgccauuuu

SEQ ID NO: 714416 - RNA, 23 nt, Haemophilus influenzae Rd
accaaauaaugaccauuggcuuu

SEQ ID NO: 714417 - RNA, 18 nt, Haemophilus influenzae Rd
accaaacugccaaacaaa

SEQ ID NO: 714418 - RNA, 16 nt, Haemophilus influenzae Rd
accaaccuuuuacaac

SEQ ID NO: 714419 - RNA, 15 nt, Haemophilus influenzae Rd
accaaccgguaaaau

SEQ ID NO: 714420 - RNA, 16 nt, Haemophilus influenzae Rd
accaaccgguaaaauu

SEQ ID NO: 714421 - RNA, 17 nt, Haemophilus influenzae Rd
accaacggauuaaaagu

SEQ ID NO: 714422 - RNA, 19 nt, Haemophilus influenzae Rd
accaacggauuaaaagucc

SEQ ID NO: 714423 - RNA, 18 nt, Haemophilus influenzae Rd
accaacguaaaaucgccu

SEQ ID NO: 714424 - RNA, 17 nt, Haemophilus influenzae Rd
accaacguggcuuuucu

SEQ ID NO: 714425 - RNA, 15 nt, Haemophilus influenzae Rd
accaagaaaccaaca

SEQ ID NO: 714426 - RNA, 18 nt, Haemophilus influenzae Rd
accaagaaagcaugaaua

SEQ ID NO: 714427 - RNA, 20 nt, Haemophilus influenzae Rd
accaaggcauuuuuucugca

SEQ ID NO: 714428 - RNA, 19 nt, Haemophilus influenzae Rd
accaagucagcucaagcaa

SEQ ID NO: 714429 - RNA, 19 nt, Haemophilus influenzae Rd
accaaguaaaccaaaucca

SEQ ID NO: 714430 - RNA, 21 nt, Haemophilus influenzae Rd
accacaaaauaaaugauuauc

SEQ ID NO: 714431 - RNA, 20 nt, Haemophilus influenzae Rd
accacauucaaauccaauga

SEQ ID NO: 714432 - RNA, 21 nt, Haemophilus influenzae Rd
accacauuucgaguuugucau

SEQ ID NO: 714433 - RNA, 16 nt, Haemophilus influenzae Rd
accaauuugugcgcau

SEQ ID NO: 714434 - RNA, 23 nt, Haemophilus influenzae Rd
accaauuucuggcauacccaaug

SEQ ID NO: 714435 - RNA, 16 nt, Haemophilus influenzae Rd
accaauugaugcacaa

SEQ ID NO: 714436 - RNA, 15 nt, Haemophilus influenzae Rd
accaaucauaaaauu

SEQ ID NO: 714437 - RNA, 21 nt, Haemophilus influenzae Rd
accaaucauaaaauuuccgcc

SEQ ID NO: 714438 - RNA, 15 nt, Haemophilus influenzae Rd
accaaucacaacaca

SEQ ID NO: 714439 - RNA, 19 nt, Haemophilus influenzae Rd
accaauucaaaaaccaaac

SEQ ID NO: 714440 - RNA, 21 nt, Haemophilus influenzae Rd
accaauucaaagauuuuaaaa

SEQ ID NO: 714441 - RNA, 16 nt, Haemophilus influenzae Rd
accaauauaauuuacu

SEQ ID NO: 714442 - RNA, 22 nt, Haemophilus influenzae Rd
accaauauucuuuaaaacauuc

SEQ ID NO: 714443 - RNA, 13 nt, Haemophilus influenzae Rd
accagaugcaaua

SEQ ID NO: 714444 - RNA, 18 nt, Haemophilus influenzae Rd
accagauucaucaaagua

SEQ ID NO: 714445 - RNA, 23 nt, Haemophilus influenzae Rd
accagccugaaaaagcuaaaaaa

SEQ ID NO: 714446 - RNA, 20 nt, Haemophilus influenzae Rd
accaccgauuaauaaaauca

SEQ ID NO: 714447 - RNA, 18 nt, Haemophilus influenzae Rd
accacccuucuuucaaau

SEQ ID NO: 714448 - RNA, 16 nt, Haemophilus influenzae Rd
accaccccauuucuug

SEQ ID NO: 714449 - RNA, 19 nt, Haemophilus influenzae Rd
accacccgauaaaugcaca

SEQ ID NO: 714450 - RNA, 16 nt, Haemophilus influenzae Rd
accacgaguauauugc

SEQ ID NO: 714451 - RNA, 20 nt, Haemophilus influenzae Rd
accacgaguauauugcauaa

SEQ ID NO: 714452 - RNA, 18 nt, Haemophilus influenzae Rd
accacgaccuaagaaaag

SEQ ID NO: 714453 - RNA, 22 nt, Haemophilus influenzae Rd
accacucacuggcucaaguaau

SEQ ID NO: 714454 - RNA, 18 nt, Haemophilus influenzae Rd
accagucaagguugcaac

SEQ ID NO: 714455 - RNA, 15 nt, Haemophilus influenzae Rd
accagugguauauac

SEQ ID NO: 714456 - RNA, 13 nt, Haemophilus influenzae Rd
accauaucaauuu

SEQ ID NO: 714457 - RNA, 20 nt, Haemophilus influenzae Rd
accauaucguaaccaucaga

SEQ ID NO: 714458 - RNA, 13 nt, Haemophilus influenzae Rd
accauauccauug

SEQ ID NO: 714459 - RNA, 19 nt, Haemophilus influenzae Rd
accauauccauugcaacac

SEQ ID NO: 714460 - RNA, 18 nt, Haemophilus influenzae Rd
accauauuaaucgcaaua

SEQ ID NO: 714461 - RNA, 20 nt, Haemophilus influenzae Rd
accaucacguaauacaaaau

SEQ ID NO: 714462 - RNA, 15 nt, Haemophilus influenzae Rd
accauacauaaaauc

SEQ ID NO: 714463 - RNA, 21 nt, Haemophilus influenzae Rd
accauaacuuaugaauaauaa

SEQ ID NO: 714464 - RNA, 23 nt, Haemophilus influenzae Rd
accccauuucuugaccuuucaau

SEQ ID NO: 714465 - RNA, 15 nt, Haemophilus influenzae Rd
accccauuugccaaa

SEQ ID NO: 714466 - RNA, 23 nt, Haemophilus influenzae Rd
accccaaacuuggaucauacaua

SEQ ID NO: 714467 - RNA, 15 nt, Haemophilus influenzae Rd
accauucccauucca

SEQ ID NO: 714468 - RNA, 13 nt, Haemophilus influenzae Rd
accauucuuucaa

SEQ ID NO: 714469 - RNA, 23 nt, Haemophilus influenzae Rd
accauucuuucaauaauuuuucu

SEQ ID NO: 714470 - RNA, 19 nt, Haemophilus influenzae Rd
accauugagcauuuuuuau

SEQ ID NO: 714471 - RNA, 21 nt, Haemophilus influenzae Rd
accauucucuaacgcauucaa

SEQ ID NO: 714472 - RNA, 20 nt, Haemophilus influenzae Rd
accauugcguucacucacuu

SEQ ID NO: 714473 - RNA, 22 nt, Haemophilus influenzae Rd
accauugcguucacucacuuua

SEQ ID NO: 714474 - RNA, 14 nt, Haemophilus influenzae Rd
accauugaugaaau

SEQ ID NO: 714475 - RNA, 18 nt, Haemophilus influenzae Rd
accauuacauaaaaccaa

SEQ ID NO: 714476 - RNA, 18 nt, Haemophilus influenzae Rd
accauccaugacagaauu

SEQ ID NO: 714477 - RNA, 14 nt, Haemophilus influenzae Rd
accauccaucaaau

SEQ ID NO: 714478 - RNA, 13 nt, Haemophilus influenzae Rd
acccacaucauca

SEQ ID NO: 714479 - RNA, 17 nt, Haemophilus influenzae Rd
acccacaucaucaagca

SEQ ID NO: 714480 - RNA, 11 nt, Haemophilus influenzae Rd
acccacacacc

SEQ ID NO: 714481 - RNA, 20 nt, Haemophilus influenzae Rd
acccaauuagaugauuuuaa

SEQ ID NO: 714482 - RNA, 21 nt, Haemophilus influenzae Rd
acccaauuagaugauuuuaaa

SEQ ID NO: 714483 - RNA, 23 nt, Haemophilus influenzae Rd
acccaauuagaugauuuuaaaau

SEQ ID NO: 714484 - RNA, 22 nt, Haemophilus influenzae Rd
acccacaacuuuuucaucuuua

SEQ ID NO: 714485 - RNA, 22 nt, Haemophilus influenzae Rd
acccacuucacaacuuuuuaac

SEQ ID NO: 714486 - RNA, 17 nt, Haemophilus influenzae Rd
acccacuucaccuuggc

SEQ ID NO: 714487 - RNA, 17 nt, Haemophilus influenzae Rd
acccaagccaauuauuu

SEQ ID NO: 714488 - RNA, 18 nt, Haemophilus influenzae Rd
acccaagccaauuauuua

SEQ ID NO: 714489 - RNA, 14 nt, Haemophilus influenzae Rd
acccaaauuaaaaa

SEQ ID NO: 714490 - RNA, 15 nt, Haemophilus influenzae Rd
acccaaauuaaaaaa

SEQ ID NO: 714491 - RNA, 13 nt, Haemophilus influenzae Rd
accauuguuuaau

SEQ ID NO: 714492 - RNA, 13 nt, Haemophilus influenzae Rd
accauugugccaa

SEQ ID NO: 714493 - RNA, 19 nt, Haemophilus influenzae Rd
accauugugccaaauucag

SEQ ID NO: 714494 - RNA, 16 nt, Haemophilus influenzae Rd
aauuucagaauuagua

SEQ ID NO: 714495 - RNA, 19 nt, Haemophilus influenzae Rd
aauuucagcuuaaauacua

SEQ ID NO: 714496 - RNA, 19 nt, Haemophilus influenzae Rd
aauuucagcaucagaaaua

SEQ ID NO: 714497 - RNA, 23 nt, Haemophilus influenzae Rd
aauuucagcaucagaaauaccga

SEQ ID NO: 714498 - RNA, 15 nt, Haemophilus influenzae Rd
acacucucagaauua

SEQ ID NO: 714499 - RNA, 14 nt, Haemophilus influenzae Rd
aauuucauaaaaau

SEQ ID NO: 714500 - RNA, 17 nt, Haemophilus influenzae Rd
aauuucauaaaaauuag

SEQ ID NO: 714501 - RNA, 20 nt, Haemophilus influenzae Rd
acacugauuguggugagaug

SEQ ID NO: 714502 - RNA, 17 nt, Haemophilus influenzae Rd
acacugcgcagauuaau

SEQ ID NO: 714503 - RNA, 14 nt, Haemophilus influenzae Rd
acacuguaaauaaa

SEQ ID NO: 714504 - RNA, 20 nt, Haemophilus influenzae Rd
acacuucaucacuaaauucu

SEQ ID NO: 714505 - RNA, 21 nt, Haemophilus influenzae Rd
acacuuaaacucgaaggaaau

SEQ ID NO: 714506 - RNA, 17 nt, Haemophilus influenzae Rd
acacuuuaaauuuuccu

SEQ ID NO: 714507 - RNA, 16 nt, Haemophilus influenzae Rd
acacuugcuguuuuuc

SEQ ID NO: 714508 - RNA, 13 nt, Haemophilus influenzae Rd
acacuuuuucuau

SEQ ID NO: 714509 - RNA, 17 nt, Haemophilus influenzae Rd
acagacaguagcauucc

SEQ ID NO: 714510 - RNA, 15 nt, Haemophilus influenzae Rd
acagauuuaauacca

SEQ ID NO: 714511 - RNA, 17 nt, Haemophilus influenzae Rd
acagauuuaauaccaua

SEQ ID NO: 714512 - RNA, 14 nt, Haemophilus influenzae Rd
acagauuucaauua

SEQ ID NO: 714513 - RNA, 17 nt, Haemophilus influenzae Rd
acagcaauuugaauuaa

SEQ ID NO: 714514 - RNA, 16 nt, Haemophilus influenzae Rd
acagaggggauaaaau

SEQ ID NO: 714515 - RNA, 21 nt, Haemophilus influenzae Rd
acagaggcauuauguaauaua

SEQ ID NO: 714516 - RNA, 22 nt, Haemophilus influenzae Rd
acagaggcauuauguaauauaa

SEQ ID NO: 714517 - RNA, 20 nt, Haemophilus influenzae Rd
acagcuauuaaaaaaagcaa

SEQ ID NO: 714518 - RNA, 22 nt, Haemophilus influenzae Rd
acagcuauuaaaaaaagcaaua

SEQ ID NO: 714519 - RNA, 15 nt, Haemophilus influenzae Rd
acagcucaaaaugcu

SEQ ID NO: 714520 - RNA, 21 nt, Haemophilus influenzae Rd
acagcucuguaaaacauuuca

SEQ ID NO: 714521 - RNA, 24 nt, Haemophilus influenzae Rd
acagcucuguaaaacauuucaucg

SEQ ID NO: 714522 - RNA, 21 nt, Haemophilus influenzae Rd
acagcugauaaguucauaaaa

SEQ ID NO: 714523 - RNA, 16 nt, Haemophilus influenzae Rd
acagcugcauaaagcu

SEQ ID NO: 714524 - RNA, 18 nt, Haemophilus influenzae Rd
acagccugcgagcaguuu

SEQ ID NO: 714525 - RNA, 20 nt, Haemophilus influenzae Rd
acagcguuauccaucaagaa

SEQ ID NO: 714526 - RNA, 15 nt, Haemophilus influenzae Rd
acaucagaaaaucaa

SEQ ID NO: 714527 - RNA, 15 nt, Haemophilus influenzae Rd
acaucaacaaauguc

SEQ ID NO: 714528 - RNA, 23 nt, Haemophilus influenzae Rd
acaucaaauccuuguuuuucaaa

SEQ ID NO: 714529 - RNA, 13 nt, Haemophilus influenzae Rd
acaucauuugcaa

SEQ ID NO: 714530 - RNA, 19 nt, Haemophilus influenzae Rd
acaucauuuucaaguaacu

SEQ ID NO: 714531 - RNA, 17 nt, Haemophilus influenzae Rd
acaucauuauugccuuu

SEQ ID NO: 714532 - RNA, 12 nt, Haemophilus influenzae Rd
acauauuucacc

SEQ ID NO: 714533 - RNA, 18 nt, Haemophilus influenzae Rd
acauauuuucuaaaaaac

SEQ ID NO: 714534 - RNA, 15 nt, Haemophilus influenzae Rd
acauauuuuuagauu

SEQ ID NO: 714535 - RNA, 16 nt, Haemophilus influenzae Rd
acauacaucuaauuuu

SEQ ID NO: 714536 - RNA, 13 nt, Haemophilus influenzae Rd
acauaauuucaca

SEQ ID NO: 714537 - RNA, 14 nt, Haemophilus influenzae Rd
acaugaauuucuaa

SEQ ID NO: 714538 - RNA, 18 nt, Haemophilus influenzae Rd
acaugaauuucuaauuuu

SEQ ID NO: 714539 - RNA, 22 nt, Haemophilus influenzae Rd
acaugaauuucuaauuuuuguu

SEQ ID NO: 714540 - RNA, 15 nt, Haemophilus influenzae Rd
acaugacaguuugua

SEQ ID NO: 714541 - RNA, 18 nt, Haemophilus influenzae Rd
acaugacaguuuguaauc

SEQ ID NO: 714542 - RNA, 15 nt, Haemophilus influenzae Rd
acaugcaaaauauuc

SEQ ID NO: 714543 - RNA, 12 nt, Haemophilus influenzae Rd
acaucuuaaauu

SEQ ID NO: 714544 - RNA, 15 nt, Haemophilus influenzae Rd
acaucuucaaaaaca

SEQ ID NO: 714545 - RNA, 11 nt, Haemophilus influenzae Rd
acaucuucaca

SEQ ID NO: 714546 - RNA, 14 nt, Haemophilus influenzae Rd
acaucgcugugaaa

SEQ ID NO: 714547 - RNA, 14 nt, Haemophilus influenzae Rd
acaucgcuucauca

SEQ ID NO: 714548 - RNA, 16 nt, Haemophilus influenzae Rd
acaucuaaguauucau

SEQ ID NO: 714549 - RNA, 19 nt, Haemophilus influenzae Rd
acaucuaaguauucaugau

SEQ ID NO: 714550 - RNA, 18 nt, Haemophilus influenzae Rd
acaucuaaugccgcaaau

SEQ ID NO: 714551 - RNA, 12 nt, Haemophilus influenzae Rd
acaucuaauuuu

SEQ ID NO: 714552 - RNA, 22 nt, Haemophilus influenzae Rd
acaucuaauuuuaguuguuugu

SEQ ID NO: 714553 - RNA, 12 nt, Haemophilus influenzae Rd
acaucuacaauu

SEQ ID NO: 714554 - RNA, 15 nt, Haemophilus influenzae Rd
acaguuauuuuuuau

SEQ ID NO: 714555 - RNA, 13 nt, Haemophilus influenzae Rd
acauaaccaaagg

SEQ ID NO: 714556 - RNA, 19 nt, Haemophilus influenzae Rd
acauaacccacuguuaaag

SEQ ID NO: 714557 - RNA, 23 nt, Haemophilus influenzae Rd
acauaaacggcugccgcaucaac

SEQ ID NO: 714558 - RNA, 15 nt, Haemophilus influenzae Rd
acauaaagauuaaaa

SEQ ID NO: 714559 - RNA, 21 nt, Haemophilus influenzae Rd
acauaaagaauaauuuucaaa

SEQ ID NO: 714560 - RNA, 19 nt, Haemophilus influenzae Rd
acagucugcgccuaaaaua

SEQ ID NO: 714561 - RNA, 22 nt, Haemophilus influenzae Rd
acagucuuuuaacacauaagca

SEQ ID NO: 714562 - RNA, 13 nt, Haemophilus influenzae Rd
acagucaaauugu

SEQ ID NO: 714563 - RNA, 14 nt, Haemophilus influenzae Rd
acagugacaaauuu

SEQ ID NO: 714564 - RNA, 19 nt, Haemophilus influenzae Rd
acagugacaaauuuugcau

SEQ ID NO: 714565 - RNA, 17 nt, Haemophilus influenzae Rd
acagugacuaaaacaac

SEQ ID NO: 714566 - RNA, 17 nt, Haemophilus influenzae Rd
acaguggguuauguagu

SEQ ID NO: 714567 - RNA, 19 nt, Haemophilus influenzae Rd
acaggcuucaauuugagaa

SEQ ID NO: 714568 - RNA, 18 nt, Haemophilus influenzae Rd
acaggcuuccaacaaaau

SEQ ID NO: 714569 - RNA, 13 nt, Haemophilus influenzae Rd
acagguacuuuua

SEQ ID NO: 714570 - RNA, 18 nt, Haemophilus influenzae Rd
acagggcuuuauuuuuga

SEQ ID NO: 714571 - RNA, 18 nt, Haemophilus influenzae Rd
acagggcgaccuguugca

SEQ ID NO: 714572 - RNA, 16 nt, Haemophilus influenzae Rd
acagggugguugcgaa

SEQ ID NO: 714573 - RNA, 18 nt, Haemophilus influenzae Rd
acagguguaguuagcaca

SEQ ID NO: 714574 - RNA, 20 nt, Haemophilus influenzae Rd
acagguguguuuuucaaaaa

SEQ ID NO: 714575 - RNA, 13 nt, Haemophilus influenzae Rd
acaguaaagauua

SEQ ID NO: 714576 - RNA, 15 nt, Haemophilus influenzae Rd
acagguuucucuagc

SEQ ID NO: 714577 - RNA, 15 nt, Haemophilus influenzae Rd
acagguuugacauuc

SEQ ID NO: 714578 - RNA, 13 nt, Haemophilus influenzae Rd
acaguaaauuuaa

SEQ ID NO: 714579 - RNA, 21 nt, Haemophilus influenzae Rd
acaguauauccugcacauccu

SEQ ID NO: 714580 - RNA, 13 nt, Haemophilus influenzae Rd
aacaagaaucauc

SEQ ID NO: 714581 - RNA, 20 nt, Haemophilus influenzae Rd
aacaagcacccauuugccaa

SEQ ID NO: 714582 - RNA, 16 nt, Haemophilus influenzae Rd
aacaagcgcaaguucu

SEQ ID NO: 714583 - RNA, 15 nt, Haemophilus influenzae Rd
aacaagcgcgauaaa

SEQ ID NO: 714584 - RNA, 15 nt, Haemophilus influenzae Rd
aacaagcucuagaaa

SEQ ID NO: 714585 - RNA, 18 nt, Haemophilus influenzae Rd
aacaagcucuagaaaauc

SEQ ID NO: 714586 - RNA, 16 nt, Haemophilus influenzae Rd
aacaagcuuauguaaa

SEQ ID NO: 714587 - RNA, 15 nt, Haemophilus influenzae Rd
aacaaguaauuuauc

SEQ ID NO: 714588 - RNA, 22 nt, Haemophilus influenzae Rd
aacaaggaaucgaaauuaaaau

SEQ ID NO: 714589 - RNA, 15 nt, Haemophilus influenzae Rd
aacaacgcacgaccu

SEQ ID NO: 714590 - RNA, 18 nt, Haemophilus influenzae Rd
aacaacgcguacuuuuuu

SEQ ID NO: 714591 - RNA, 15 nt, Haemophilus influenzae Rd
aacaaccacauucaa

SEQ ID NO: 714592 - RNA, 20 nt, Haemophilus influenzae Rd
aacaacaguagaaaucacaa

SEQ ID NO: 714593 - RNA, 17 nt, Haemophilus influenzae Rd
aacaacuggaauuugua

SEQ ID NO: 714594 - RNA, 15 nt, Haemophilus influenzae Rd
aacaacuaaauaagg

SEQ ID NO: 714595 - RNA, 13 nt, Haemophilus influenzae Rd
aacaaaaagauug

SEQ ID NO: 714596 - RNA, 17 nt, Haemophilus influenzae Rd
aacaaaagaaauuuuaa

SEQ ID NO: 714597 - RNA, 12 nt, Haemophilus influenzae Rd
aacaaaaucaau

SEQ ID NO: 714598 - RNA, 13 nt, Haemophilus influenzae Rd
aacaaaauggcuu

SEQ ID NO: 714599 - RNA, 17 nt, Haemophilus influenzae Rd
aacaaaauuaaugccaa

SEQ ID NO: 714600 - RNA, 21 nt, Haemophilus influenzae Rd
aacaaaauuuuaaauaaaaua

SEQ ID NO: 714601 - RNA, 12 nt, Haemophilus influenzae Rd
aacaaaaaccau

SEQ ID NO: 714602 - RNA, 18 nt, Haemophilus influenzae Rd
aacaaaaaccauccauaa

SEQ ID NO: 714603 - RNA, 17 nt, Haemophilus influenzae Rd
aaauuuuuuugcuggaa

SEQ ID NO: 714604 - RNA, 11 nt, Haemophilus influenzae Rd
aacaaaaauac

SEQ ID NO: 714605 - RNA, 16 nt, Haemophilus influenzae Rd
aacaaaaauacagcca

SEQ ID NO: 714606 - RNA, 13 nt, Haemophilus influenzae Rd
aacaaaaauacgu

SEQ ID NO: 714607 - RNA, 18 nt, Haemophilus influenzae Rd
aaauuuuuguugauaaac

SEQ ID NO: 714608 - RNA, 21 nt, Haemophilus influenzae Rd
aaauuuuuguugauaaacaua

SEQ ID NO: 714609 - RNA, 22 nt, Haemophilus influenzae Rd
aaauuuuuguugauaaacauaa

SEQ ID NO: 714610 - RNA, 18 nt, Haemophilus influenzae Rd
aaauuuuucuuuucuucu

SEQ ID NO: 714611 - RNA, 21 nt, Haemophilus influenzae Rd
aaauuuuucuuuucuucuaau

SEQ ID NO: 714612 - RNA, 14 nt, Haemophilus influenzae Rd
aaauuuuugcaaaa

SEQ ID NO: 714613 - RNA, 14 nt, Haemophilus influenzae Rd
aaauuuuucauucu

SEQ ID NO: 714614 - RNA, 14 nt, Haemophilus influenzae Rd
aaauuuuuauaaag

SEQ ID NO: 714615 - RNA, 18 nt, Haemophilus influenzae Rd
aaauuuuuaucuaaauua

SEQ ID NO: 714616 - RNA, 18 nt, Haemophilus influenzae Rd
aacaaaugucgaaauuuu

SEQ ID NO: 714617 - RNA, 19 nt, Haemophilus influenzae Rd
aacaaauauuccacaucac

SEQ ID NO: 714618 - RNA, 14 nt, Haemophilus influenzae Rd
aacaaauccgcuuu

SEQ ID NO: 714619 - RNA, 11 nt, Haemophilus influenzae Rd
aacaaauuuca

SEQ ID NO: 714620 - RNA, 20 nt, Haemophilus influenzae Rd
aacaaauuagcgauuaaagu

SEQ ID NO: 714621 - RNA, 10 nt, Haemophilus influenzae Rd
aacaaauuca

SEQ ID NO: 714622 - RNA, 23 nt, Haemophilus influenzae Rd
aacaaaccuaaaccuuauuuuaa

SEQ ID NO: 714623 - RNA, 17 nt, Haemophilus influenzae Rd
aacaaauaggauaaaaa

SEQ ID NO: 714624 - RNA, 23 nt, Haemophilus influenzae Rd
aacaaauacaucuucacaaaaca

SEQ ID NO: 714625 - RNA, 17 nt, Haemophilus influenzae Rd
aacaaagucaauacaca

SEQ ID NO: 714626 - RNA, 15 nt, Haemophilus influenzae Rd
aacaaagucaauuuu

SEQ ID NO: 714627 - RNA, 21 nt, Haemophilus influenzae Rd
aacaaagggcugauauuuaaa

SEQ ID NO: 714628 - RNA, 22 nt, Haemophilus influenzae Rd
aacaaagggcugauauuuaaaa

SEQ ID NO: 714629 - RNA, 22 nt, Haemophilus influenzae Rd
aacaaagguuaaaccuaaaucc

SEQ ID NO: 714630 - RNA, 15 nt, Haemophilus influenzae Rd
aaauuuacuuuccaa

SEQ ID NO: 714631 - RNA, 20 nt, Haemophilus influenzae Rd
aaauuuaggguauuuauuau

SEQ ID NO: 714632 - RNA, 22 nt, Haemophilus influenzae Rd
aaauuuaggguauuuauuauuc

SEQ ID NO: 714633 - RNA, 21 nt, Haemophilus influenzae Rd
aaauuuaccgcacuuugauuu

SEQ ID NO: 714634 - RNA, 14 nt, Haemophilus influenzae Rd
aaauuuaauacuuu

SEQ ID NO: 714635 - RNA, 17 nt, Haemophilus influenzae Rd
aaauuuaaaagcaccua

SEQ ID NO: 714636 - RNA, 20 nt, Haemophilus influenzae Rd
aaauuuaaaaucgcaauuuu

SEQ ID NO: 714637 - RNA, 16 nt, Haemophilus influenzae Rd
aaauuuaaaggacuaa

SEQ ID NO: 714638 - RNA, 20 nt, Haemophilus influenzae Rd
aaauuuaaaggcggauuuau

SEQ ID NO: 714639 - RNA, 18 nt, Haemophilus influenzae Rd
aaauuguuugaaaucaaa

SEQ ID NO: 714640 - RNA, 15 nt, Haemophilus influenzae Rd
aaauuguuuuuccca

SEQ ID NO: 714641 - RNA, 11 nt, Haemophilus influenzae Rd
aaauuuaaaaa

SEQ ID NO: 714642 - RNA, 13 nt, Haemophilus influenzae Rd
aaauuuaaaaaag

SEQ ID NO: 714643 - RNA, 20 nt, Haemophilus influenzae Rd
aaauuguugccgccaaucca

SEQ ID NO: 714644 - RNA, 21 nt, Haemophilus influenzae Rd
aaauuguaacuauaugauaua

SEQ ID NO: 714645 - RNA, 21 nt, Haemophilus influenzae Rd
aaauugucguccuucaaauuc

SEQ ID NO: 714646 - RNA, 22 nt, Haemophilus influenzae Rd
aaauuggccgcacuuuugaucu

SEQ ID NO: 714647 - RNA, 20 nt, Haemophilus influenzae Rd
aaauuggaaaauaaaaugac

SEQ ID NO: 714648 - RNA, 13 nt, Haemophilus influenzae Rd
aaauugcuguaau

SEQ ID NO: 714649 - RNA, 19 nt, Haemophilus influenzae Rd
aaauuggguucgcaaauaa

SEQ ID NO: 714650 - RNA, 19 nt, Haemophilus influenzae Rd
aaauugguacgagaaaaau

SEQ ID NO: 714651 - RNA, 17 nt, Haemophilus influenzae Rd
aaauugguuaauguaaa

SEQ ID NO: 714652 - RNA, 12 nt, Haemophilus influenzae Rd
aaauuguaaaac

SEQ ID NO: 714653 - RNA, 17 nt, Haemophilus influenzae Rd
aaauugccccuucaccu

SEQ ID NO: 714654 - RNA, 19 nt, Haemophilus influenzae Rd
aaauugccccuucaccuuu

SEQ ID NO: 714655 - RNA, 21 nt, Haemophilus influenzae Rd
aaauugcccguagcacuggca

SEQ ID NO: 714656 - RNA, 14 nt, Haemophilus influenzae Rd
aaauugccaaaaaa

SEQ ID NO: 714657 - RNA, 15 nt, Haemophilus influenzae Rd
aaauugccaaaaaag

SEQ ID NO: 714658 - RNA, 22 nt, Haemophilus influenzae Rd
aaauugccauauaagcaaagaa

SEQ ID NO: 714659 - RNA, 18 nt, Haemophilus influenzae Rd
aaauugcguguuuauaua

SEQ ID NO: 714660 - RNA, 21 nt, Haemophilus influenzae Rd
uuucaaaaauagccuucauca

SEQ ID NO: 714661 - RNA, 15 nt, Haemophilus influenzae Rd
uuucaaaaagauauu

SEQ ID NO: 714662 - RNA, 17 nt, Haemophilus influenzae Rd
uuucaaaaauuuuugca

SEQ ID NO: 714663 - RNA, 18 nt, Haemophilus influenzae Rd
uuucaaaacguucuacuu

SEQ ID NO: 714664 - RNA, 17 nt, Haemophilus influenzae Rd
aaauugaugaaaauucu

SEQ ID NO: 714665 - RNA, 15 nt, Haemophilus influenzae Rd
aaauugauaccaaga

SEQ ID NO: 714666 - RNA, 13 nt, Haemophilus influenzae Rd
aaauugcaccuuc

SEQ ID NO: 714667 - RNA, 24 nt, Haemophilus influenzae Rd
aaauugcaaaaaugcaaaguaacu

SEQ ID NO: 714668 - RNA, 22 nt, Haemophilus influenzae Rd
aaauuuauauaugauaaaaaua

SEQ ID NO: 714669 - RNA, 20 nt, Haemophilus influenzae Rd
aaauuuagauaacaaugaaa

SEQ ID NO: 714670 - RNA, 18 nt, Haemophilus influenzae Rd
aaauuuaucgggaauaau

SEQ ID NO: 714671 - RNA, 12 nt, Haemophilus influenzae Rd
aaauuuauuaua

SEQ ID NO: 714672 - RNA, 22 nt, Haemophilus influenzae Rd
aaauuuauuauaaaaauauuuu

SEQ ID NO: 714673 - RNA, 17 nt, Haemophilus influenzae Rd
aaauuuauuauauaaaa

SEQ ID NO: 714674 - RNA, 18 nt, Haemophilus influenzae Rd
aaauuuauuauauaaaaa

SEQ ID NO: 714675 - RNA, 22 nt, Haemophilus influenzae Rd
aaauuucauccuaaaaaaauaa

SEQ ID NO: 714676 - RNA, 15 nt, Haemophilus influenzae Rd
aaauuucagcuaguc

SEQ ID NO: 714677 - RNA, 15 nt, Haemophilus influenzae Rd
aaauuucaguuuaag

SEQ ID NO: 714678 - RNA, 20 nt, Haemophilus influenzae Rd
aaauuucaauuaaaucaaaa

SEQ ID NO: 714679 - RNA, 15 nt, Haemophilus influenzae Rd
aaauuucagaauuag

SEQ ID NO: 714680 - RNA, 14 nt, Haemophilus influenzae Rd
aaauuucagacaaa

SEQ ID NO: 714681 - RNA, 18 nt, Haemophilus influenzae Rd
aaauuucgcuauuuucua

SEQ ID NO: 714682 - RNA, 19 nt, Haemophilus influenzae Rd
aaauuucgcaggcuuucac

SEQ ID NO: 714683 - RNA, 16 nt, Haemophilus influenzae Rd
aaauuuccauaugacc

SEQ ID NO: 714684 - RNA, 21 nt, Haemophilus influenzae Rd
aaauuucuccguuagcaauaa

SEQ ID NO: 714685 - RNA, 16 nt, Haemophilus influenzae Rd
aaauuucuucuacacc

SEQ ID NO: 714686 - RNA, 20 nt, Haemophilus influenzae Rd
aaauuucuucuacaccuucu

SEQ ID NO: 714687 - RNA, 15 nt, Haemophilus influenzae Rd
aaauuucuugcuauc

SEQ ID NO: 714688 - RNA, 24 nt, Haemophilus influenzae Rd
aaauuucuugcucuaauuuuacca

SEQ ID NO: 714689 - RNA, 12 nt, Haemophilus influenzae Rd
aaauuucuuuug

SEQ ID NO: 714690 - RNA, 21 nt, Haemophilus influenzae Rd
aaauuucuuuuuuaucaaaaa

SEQ ID NO: 714691 - RNA, 21 nt, Haemophilus influenzae Rd
aaauuugaauguaaaaauaac

SEQ ID NO: 714692 - RNA, 12 nt, Haemophilus influenzae Rd
aaauuuuaaaua

SEQ ID NO: 714693 - RNA, 13 nt, Haemophilus influenzae Rd
aaauuuuaauuua

SEQ ID NO: 714694 - RNA, 23 nt, Haemophilus influenzae Rd
aaauuuuaccgccgaaauuccca

SEQ ID NO: 714695 - RNA, 17 nt, Haemophilus influenzae Rd
aaauuuuaaaaaauaau

SEQ ID NO: 714696 - RNA, 14 nt, Haemophilus influenzae Rd
aaauuuuaaaauag

SEQ ID NO: 714697 - RNA, 15 nt, Haemophilus influenzae Rd
aaauuuuaaaauagu

SEQ ID NO: 714698 - RNA, 14 nt, Haemophilus influenzae Rd
aaauuuuaaaaucu

SEQ ID NO: 714699 - RNA, 20 nt, Haemophilus influenzae Rd
aaauuuuccaauucuaguuc

SEQ ID NO: 714700 - RNA, 12 nt, Haemophilus influenzae Rd
aaauuuugauau

SEQ ID NO: 714701 - RNA, 17 nt, Haemophilus influenzae Rd
aaauuuugccaauuaca

SEQ ID NO: 714702 - RNA, 13 nt, Haemophilus influenzae Rd
aaauuuugcccuc

SEQ ID NO: 714703 - RNA, 17 nt, Haemophilus influenzae Rd
aaauuuuguccguauaa

SEQ ID NO: 714704 - RNA, 21 nt, Haemophilus influenzae Rd
aaauuuuuaauaaaguaaaau

SEQ ID NO: 714705 - RNA, 22 nt, Haemophilus influenzae Rd
aaauuuuuaauaaaguaaaaua

SEQ ID NO: 714706 - RNA, 17 nt, Haemophilus influenzae Rd
aaauuuuuaaugcguuu

SEQ ID NO: 714707 - RNA, 21 nt, Haemophilus influenzae Rd
aaauuuuuaaugcuuacaaaa

SEQ ID NO: 714708 - RNA, 15 nt, Haemophilus influenzae Rd
aaauuuuuaggugcu

SEQ ID NO: 714709 - RNA, 21 nt, Haemophilus influenzae Rd
aaauuuucugcguuuggcaca

SEQ ID NO: 714710 - RNA, 22 nt, Haemophilus influenzae Rd
aaauuuucuuuucuaacgcuuu

SEQ ID NO: 714711 - RNA, 21 nt, Haemophilus influenzae Rd
aaauuuuccgcauaaauaaua

SEQ ID NO: 714712 - RNA, 22 nt, Haemophilus influenzae Rd
aaauuuuccgcauaaauaauaa

SEQ ID NO: 714713 - RNA, 23 nt, Haemophilus influenzae Rd
aaauuuuccgcauaaauaauaaa

SEQ ID NO: 714714 - RNA, 19 nt, Haemophilus influenzae Rd
aaauuuucggcaagaaauu

SEQ ID NO: 714715 - RNA, 17 nt, Haemophilus influenzae Rd
aaauuuucaaauugaaa

SEQ ID NO: 714716 - RNA, 18 nt, Haemophilus influenzae Rd
aaauuuucaaauugaaaa

SEQ ID NO: 714717 - RNA, 21 nt, Haemophilus influenzae Rd
aacacaacauagcugaaaaau

SEQ ID NO: 714718 - RNA, 22 nt, Haemophilus influenzae Rd
aacacaacauagcugaaaaaua

SEQ ID NO: 714719 - RNA, 22 nt, Haemophilus influenzae Rd
aacacaaucgguaacaguuuug

SEQ ID NO: 714720 - RNA, 22 nt, Haemophilus influenzae Rd
aacacaaacugguuaaaaucca

SEQ ID NO: 714721 - RNA, 18 nt, Haemophilus influenzae Rd
aacaauuuuugcauuuuc

SEQ ID NO: 714722 - RNA, 20 nt, Haemophilus influenzae Rd
aacaauuuuugcauuuucag

SEQ ID NO: 714723 - RNA, 22 nt, Haemophilus influenzae Rd
aacaauuuuugcauuuucaggg

SEQ ID NO: 714724 - RNA, 17 nt, Haemophilus influenzae Rd
aacaauuucacugaaag

SEQ ID NO: 714725 - RNA, 13 nt, Haemophilus influenzae Rd
aacaauuucuaac

SEQ ID NO: 714726 - RNA, 13 nt, Haemophilus influenzae Rd
aacaauuccccuu

SEQ ID NO: 714727 - RNA, 23 nt, Haemophilus influenzae Rd
aacaauuccccuuccuugacaua

SEQ ID NO: 714728 - RNA, 21 nt, Haemophilus influenzae Rd
aacaauguaguuucuucuuuc

SEQ ID NO: 714729 - RNA, 14 nt, Haemophilus influenzae Rd
aacaaugucagaaa

SEQ ID NO: 714730 - RNA, 19 nt, Haemophilus influenzae Rd
aacaaugucagaaaagauu

SEQ ID NO: 714731 - RNA, 18 nt, Haemophilus influenzae Rd
aacaauggcaacaaauau

SEQ ID NO: 714732 - RNA, 15 nt, Haemophilus influenzae Rd
aacaauaauuuuuaa

SEQ ID NO: 714733 - RNA, 23 nt, Haemophilus influenzae Rd
aacaauacgauucguuucaguac

SEQ ID NO: 714734 - RNA, 19 nt, Haemophilus influenzae Rd
aacaauaacugccacauca

SEQ ID NO: 714735 - RNA, 20 nt, Haemophilus influenzae Rd
aacaauaacugccacaucau

SEQ ID NO: 714736 - RNA, 11 nt, Haemophilus influenzae Rd
aacaauaaugu

SEQ ID NO: 714737 - RNA, 14 nt, Haemophilus influenzae Rd
aacaauaaugugag

SEQ ID NO: 714738 - RNA, 19 nt, Haemophilus influenzae Rd
aacaaucacuguaucuuuu

SEQ ID NO: 714739 - RNA, 22 nt, Haemophilus influenzae Rd
aacaauauuaggaauagcaaga

SEQ ID NO: 714740 - RNA, 12 nt, Haemophilus influenzae Rd
aacaauaucauu

SEQ ID NO: 714741 - RNA, 18 nt, Haemophilus influenzae Rd
aacaauacucuuaacaaa

SEQ ID NO: 714742 - RNA, 15 nt, Haemophilus influenzae Rd
aacaaucgcuucauu

SEQ ID NO: 714743 - RNA, 23 nt, Haemophilus influenzae Rd
aacaaucgcuucauucucuucug

SEQ ID NO: 714744 - RNA, 20 nt, Haemophilus influenzae Rd
aacaauauuucacuauucag

SEQ ID NO: 714745 - RNA, 22 nt, Haemophilus influenzae Rd
aacaauggcugaaaaauucaaa

SEQ ID NO: 714746 - RNA, 15 nt, Haemophilus influenzae Rd
aacaaugcaaauaca

SEQ ID NO: 714747 - RNA, 15 nt, Haemophilus influenzae Rd
aacaaugcggagaaa

SEQ ID NO: 714748 - RNA, 18 nt, Haemophilus influenzae Rd
aacaaugcuauaaaaccu

SEQ ID NO: 714749 - RNA, 15 nt, Haemophilus influenzae Rd
aacaaucuuguugga

SEQ ID NO: 714750 - RNA, 12 nt, Haemophilus influenzae Rd
aacacaucgcuu

SEQ ID NO: 714751 - RNA, 17 nt, Haemophilus influenzae Rd
aacacauccguuaagaa

SEQ ID NO: 714752 - RNA, 23 nt, Haemophilus influenzae Rd
aacacagagcacacaagguugua

SEQ ID NO: 714753 - RNA, 17 nt, Haemophilus influenzae Rd
aacacaguuauuuuuua

SEQ ID NO: 714754 - RNA, 15 nt, Haemophilus influenzae Rd
aacacauaauauuuu

SEQ ID NO: 714755 - RNA, 18 nt, Haemophilus influenzae Rd
aacacauaauauuuuuac

SEQ ID NO: 714756 - RNA, 20 nt, Haemophilus influenzae Rd
aacacaucagaaaaucaaaa

SEQ ID NO: 714757 - RNA, 15 nt, Haemophilus influenzae Rd
aacacagauuuuuac

SEQ ID NO: 714758 - RNA, 22 nt, Haemophilus influenzae Rd
aacacagauuuuuacuucauca

SEQ ID NO: 714759 - RNA, 15 nt, Haemophilus influenzae Rd
aacacagcagcuaaa

SEQ ID NO: 714760 - RNA, 15 nt, Haemophilus influenzae Rd
aacaccauugagcau

SEQ ID NO: 714761 - RNA, 18 nt, Haemophilus influenzae Rd
aacacccaaucuggauug

SEQ ID NO: 714762 - RNA, 13 nt, Haemophilus influenzae Rd
aacacccacauca

SEQ ID NO: 714763 - RNA, 21 nt, Haemophilus influenzae Rd
aacaccgcuaauaaaaauccu

SEQ ID NO: 714764 - RNA, 14 nt, Haemophilus influenzae Rd
aacaccuuccuugu

SEQ ID NO: 714765 - RNA, 22 nt, Haemophilus influenzae Rd
aacacgaaaccaacgaaaauag

SEQ ID NO: 714766 - RNA, 17 nt, Haemophilus influenzae Rd
aacaccuaauaucaagu

SEQ ID NO: 714767 - RNA, 14 nt, Haemophilus influenzae Rd
aacacguuugccag

SEQ ID NO: 714768 - RNA, 16 nt, Haemophilus influenzae Rd
aacacuaugauuuuua

SEQ ID NO: 714769 - RNA, 19 nt, Haemophilus influenzae Rd
aacacuaugauuuuuaacc

SEQ ID NO: 714770 - RNA, 15 nt, Haemophilus influenzae Rd
aacacuccaacacca

SEQ ID NO: 714771 - RNA, 22 nt, Haemophilus influenzae Rd
aacacuuaaauaguuaauugau

SEQ ID NO: 714772 - RNA, 12 nt, Haemophilus influenzae Rd
aacacugccaau

SEQ ID NO: 714773 - RNA, 17 nt, Haemophilus influenzae Rd
aacacucuaucuaaaau

SEQ ID NO: 714774 - RNA, 14 nt, Haemophilus influenzae Rd
aacacucucagaau

SEQ ID NO: 714775 - RNA, 15 nt, Haemophilus influenzae Rd
aacacgccuaacaua

SEQ ID NO: 714776 - RNA, 21 nt, Haemophilus influenzae Rd
aacacguccgcaaccagcaga

SEQ ID NO: 714777 - RNA, 23 nt, Haemophilus influenzae Rd
aacagaaguauuuacugauuuua

SEQ ID NO: 714778 - RNA, 18 nt, Haemophilus influenzae Rd
aacacuugcuguuuuucc

SEQ ID NO: 714779 - RNA, 20 nt, Haemophilus influenzae Rd
aacacuugguucgcuucauu

SEQ ID NO: 714780 - RNA, 22 nt, Haemophilus influenzae Rd
aacacuugguucgcuucauuau

SEQ ID NO: 714781 - RNA, 19 nt, Haemophilus influenzae Rd
aacacuuuauuacuuuuau

SEQ ID NO: 714782 - RNA, 19 nt, Haemophilus influenzae Rd
aacacuuuuucuauuuuuu

SEQ ID NO: 714783 - RNA, 20 nt, Haemophilus influenzae Rd
aacacuuuuucuauuuuuuc

SEQ ID NO: 714784 - RNA, 15 nt, Haemophilus influenzae Rd
aacagaucgugauau

SEQ ID NO: 714785 - RNA, 15 nt, Haemophilus influenzae Rd
aacagcacacuaaua

SEQ ID NO: 714786 - RNA, 17 nt, Haemophilus influenzae Rd
aacagccaguaaauugg

SEQ ID NO: 714787 - RNA, 18 nt, Haemophilus influenzae Rd
aacagccauggcuuuuuc

SEQ ID NO: 714788 - RNA, 23 nt, Haemophilus influenzae Rd
aacagccauggcuuuuuccugau

SEQ ID NO: 714789 - RNA, 13 nt, Haemophilus influenzae Rd
aacagccaaacaa

SEQ ID NO: 714790 - RNA, 16 nt, Haemophilus influenzae Rd
aacagccaaacaaauu

SEQ ID NO: 714791 - RNA, 16 nt, Haemophilus influenzae Rd
aacagcggucaaaaua

SEQ ID NO: 714792 - RNA, 13 nt, Haemophilus influenzae Rd
aacagcuaaaaau

SEQ ID NO: 714793 - RNA, 21 nt, Haemophilus influenzae Rd
aacauaggguguucaacuucc

SEQ ID NO: 714794 - RNA, 22 nt, Haemophilus influenzae Rd
aacauaguaaauuuuaaccgca

SEQ ID NO: 714795 - RNA, 20 nt, Haemophilus influenzae Rd
aacauaucguuaucuuuaaa

SEQ ID NO: 714796 - RNA, 22 nt, Haemophilus influenzae Rd
aacauaauaaaauuuauuacaa

SEQ ID NO: 714797 - RNA, 15 nt, Haemophilus influenzae Rd
aacauaccuaaaaau

SEQ ID NO: 714798 - RNA, 17 nt, Haemophilus influenzae Rd
aacauaccuaaaaaugc

SEQ ID NO: 714799 - RNA, 23 nt, Haemophilus influenzae Rd
aacauaccuaaaaaugccccagc

SEQ ID NO: 714800 - RNA, 14 nt, Haemophilus influenzae Rd
aacauagaaaucac

SEQ ID NO: 714801 - RNA, 21 nt, Haemophilus influenzae Rd
aacaucauaagguacaacaga

SEQ ID NO: 714802 - RNA, 18 nt, Haemophilus influenzae Rd
aacaucagcuucaauuuc

SEQ ID NO: 714803 - RNA, 20 nt, Haemophilus influenzae Rd
aacaucaccgauaauaugca

SEQ ID NO: 714804 - RNA, 19 nt, Haemophilus influenzae Rd
aacaucaauaagaauuacc

SEQ ID NO: 714805 - RNA, 19 nt, Haemophilus influenzae Rd
aacaucaccuguaaacaaa

SEQ ID NO: 714806 - RNA, 20 nt, Haemophilus influenzae Rd
aacaucaccuguaaacaaau

SEQ ID NO: 714807 - RNA, 18 nt, Haemophilus influenzae Rd
aacaucacgccaucgcca

SEQ ID NO: 714808 - RNA, 19 nt, Haemophilus influenzae Rd
aacaucacgccaucgccau

SEQ ID NO: 714809 - RNA, 21 nt, Haemophilus influenzae Rd
aacaucaacgguuuucauugc

SEQ ID NO: 714810 - RNA, 14 nt, Haemophilus influenzae Rd
aacaucaaaaccau

SEQ ID NO: 714811 - RNA, 15 nt, Haemophilus influenzae Rd
aacagggcauucauu

SEQ ID NO: 714812 - RNA, 19 nt, Haemophilus influenzae Rd
aacagggugucguagaaau

SEQ ID NO: 714813 - RNA, 22 nt, Haemophilus influenzae Rd
aacaggguguuuauaagugcca

SEQ ID NO: 714814 - RNA, 23 nt, Haemophilus influenzae Rd
aacaggguguuuauaagugccaa

SEQ ID NO: 714815 - RNA, 14 nt, Haemophilus influenzae Rd
aacagguaaaauac

SEQ ID NO: 714816 - RNA, 22 nt, Haemophilus influenzae Rd
aacaguaaugaaagaaacacca

SEQ ID NO: 714817 - RNA, 12 nt, Haemophilus influenzae Rd
aacaguaaauuu

SEQ ID NO: 714818 - RNA, 15 nt, Haemophilus influenzae Rd
aacaguaaauuuuuc

SEQ ID NO: 714819 - RNA, 15 nt, Haemophilus influenzae Rd
aacaggcuuauuaaa

SEQ ID NO: 714820 - RNA, 21 nt, Haemophilus influenzae Rd
aacaggcuuauuaaaaacuaa

SEQ ID NO: 714821 - RNA, 16 nt, Haemophilus influenzae Rd
aacagcuugcauacgg

SEQ ID NO: 714822 - RNA, 17 nt, Haemophilus influenzae Rd
aacaggaaucgugacaa

SEQ ID NO: 714823 - RNA, 21 nt, Haemophilus influenzae Rd
aacaguuaagcuaccugccau

SEQ ID NO: 714824 - RNA, 19 nt, Haemophilus influenzae Rd
aacaguucaauaaaaauau

SEQ ID NO: 714825 - RNA, 13 nt, Haemophilus influenzae Rd
aacauaaagauua

SEQ ID NO: 714826 - RNA, 16 nt, Haemophilus influenzae Rd
aacauaaagauuaaaa

SEQ ID NO: 714827 - RNA, 13 nt, Haemophilus influenzae Rd
aacauaaacauug

SEQ ID NO: 714828 - RNA, 11 nt, Haemophilus influenzae Rd
aacaguggguu

SEQ ID NO: 714829 - RNA, 21 nt, Haemophilus influenzae Rd
aacagucugcgccuaaaauau

SEQ ID NO: 714830 - RNA, 19 nt, Haemophilus influenzae Rd
aacaguaguacgaccugaa

SEQ ID NO: 714831 - RNA, 17 nt, Haemophilus influenzae Rd
aaccaaauuucuugcua

SEQ ID NO: 714832 - RNA, 13 nt, Haemophilus influenzae Rd
aaccaaauugauu

SEQ ID NO: 714833 - RNA, 22 nt, Haemophilus influenzae Rd
aaccaaauugauucauuugaug

SEQ ID NO: 714834 - RNA, 11 nt, Haemophilus influenzae Rd
aaccaaccugc

SEQ ID NO: 714835 - RNA, 13 nt, Haemophilus influenzae Rd
aaccaacauaaac

SEQ ID NO: 714836 - RNA, 13 nt, Haemophilus influenzae Rd
aaccaaaauacaa

SEQ ID NO: 714837 - RNA, 14 nt, Haemophilus influenzae Rd
aaccaaaagauuca

SEQ ID NO: 714838 - RNA, 15 nt, Haemophilus influenzae Rd
aaccaaaccugcccu

SEQ ID NO: 714839 - RNA, 19 nt, Haemophilus influenzae Rd
aaccaaacugccaaacaaa

SEQ ID NO: 714840 - RNA, 12 nt, Haemophilus influenzae Rd
aaccaaagaaag

SEQ ID NO: 714841 - RNA, 13 nt, Haemophilus influenzae Rd
aaccaaagaaagc

SEQ ID NO: 714842 - RNA, 18 nt, Haemophilus influenzae Rd
aaccaaauaggcacauaa

SEQ ID NO: 714843 - RNA, 23 nt, Haemophilus influenzae Rd
aaccaaauaggcacauaaguaaa

SEQ ID NO: 714844 - RNA, 20 nt, Haemophilus influenzae Rd
aaccaacguggcuuuucuga

SEQ ID NO: 714845 - RNA, 11 nt, Haemophilus influenzae Rd
aaccaagaaag

SEQ ID NO: 714846 - RNA, 15 nt, Haemophilus influenzae Rd
aaccaagagccucca

SEQ ID NO: 714847 - RNA, 18 nt, Haemophilus influenzae Rd
aaccaagccauuuaacua

SEQ ID NO: 714848 - RNA, 19 nt, Haemophilus influenzae Rd
aaccaagcgcgugugaaau

SEQ ID NO: 714849 - RNA, 23 nt, Haemophilus influenzae Rd
aaccaagcgcgugugaaauuccu

SEQ ID NO: 714850 - RNA, 18 nt, Haemophilus influenzae Rd
aaccaauaauccuuuuuu

SEQ ID NO: 714851 - RNA, 23 nt, Haemophilus influenzae Rd
aaccaauauugggaauauaauuc

SEQ ID NO: 714852 - RNA, 18 nt, Haemophilus influenzae Rd
aaccaauggcaaucacaa

SEQ ID NO: 714853 - RNA, 23 nt, Haemophilus influenzae Rd
aaccaauggcaaucacaaaucca

SEQ ID NO: 714854 - RNA, 17 nt, Haemophilus influenzae Rd
aacauuuccugugcauu

SEQ ID NO: 714855 - RNA, 16 nt, Haemophilus influenzae Rd
aacauuuuucauuuuc

SEQ ID NO: 714856 - RNA, 13 nt, Haemophilus influenzae Rd
aacauuuuucccu

SEQ ID NO: 714857 - RNA, 17 nt, Haemophilus influenzae Rd
aacauuuuugguuucau

SEQ ID NO: 714858 - RNA, 20 nt, Haemophilus influenzae Rd
aacauuuuguaucuaaauau

SEQ ID NO: 714859 - RNA, 19 nt, Haemophilus influenzae Rd
aacauugcaucagccaccu

SEQ ID NO: 714860 - RNA, 15 nt, Haemophilus influenzae Rd
aacauugccaaagca

SEQ ID NO: 714861 - RNA, 16 nt, Haemophilus influenzae Rd
aacauuaugaaaaaaa

SEQ ID NO: 714862 - RNA, 12 nt, Haemophilus influenzae Rd
aacauucaguuu

SEQ ID NO: 714863 - RNA, 21 nt, Haemophilus influenzae Rd
aacaugucuuguggguuuauu

SEQ ID NO: 714864 - RNA, 13 nt, Haemophilus influenzae Rd
aacauuaaccugc

SEQ ID NO: 714865 - RNA, 16 nt, Haemophilus influenzae Rd
aacaucucuugaauac

SEQ ID NO: 714866 - RNA, 21 nt, Haemophilus influenzae Rd
aacaucuucugcagaaaaaug

SEQ ID NO: 714867 - RNA, 22 nt, Haemophilus influenzae Rd
aacaucuucugcagaaaaaugu

SEQ ID NO: 714868 - RNA, 16 nt, Haemophilus influenzae Rd
aacaucuuaguauuuu

SEQ ID NO: 714869 - RNA, 20 nt, Haemophilus influenzae Rd
aacaucgcagugaucccagc

SEQ ID NO: 714870 - RNA, 13 nt, Haemophilus influenzae Rd
aacaucgcuaaau

SEQ ID NO: 714871 - RNA, 16 nt, Haemophilus influenzae Rd
aaccagcgcaccacac

SEQ ID NO: 714872 - RNA, 14 nt, Haemophilus influenzae Rd
aaccagcagaaaau

SEQ ID NO: 714873 - RNA, 15 nt, Haemophilus influenzae Rd
aaccagcagaaaaua

SEQ ID NO: 714874 - RNA, 19 nt, Haemophilus influenzae Rd
aaccagccugaaaaagcua

SEQ ID NO: 714875 - RNA, 17 nt, Haemophilus influenzae Rd
aaccacuucaaauaccu

SEQ ID NO: 714876 - RNA, 18 nt, Haemophilus influenzae Rd
aaccacuugucauuaaaa

SEQ ID NO: 714877 - RNA, 21 nt, Haemophilus influenzae Rd
aaccacuugucauuaaaaaau

SEQ ID NO: 714878 - RNA, 14 nt, Haemophilus influenzae Rd
aaccacuaaaacac

SEQ ID NO: 714879 - RNA, 16 nt, Haemophilus influenzae Rd
aaccacccauacuuua

SEQ ID NO: 714880 - RNA, 19 nt, Haemophilus influenzae Rd
aaccacccauacuuuaacu

SEQ ID NO: 714881 - RNA, 20 nt, Haemophilus influenzae Rd
aaccacccauacuuuaacuu

SEQ ID NO: 714882 - RNA, 15 nt, Haemophilus influenzae Rd
aaccacacaagcacc

SEQ ID NO: 714883 - RNA, 16 nt, Haemophilus influenzae Rd
aaccacaguguccagc

SEQ ID NO: 714884 - RNA, 19 nt, Haemophilus influenzae Rd
aaccaucccuuuuuacauu

SEQ ID NO: 714885 - RNA, 15 nt, Haemophilus influenzae Rd
aaccaucuucaacga

SEQ ID NO: 714886 - RNA, 17 nt, Haemophilus influenzae Rd
aaccaucuuuaauucca

SEQ ID NO: 714887 - RNA, 20 nt, Haemophilus influenzae Rd
aaccaucuuuaauuccaacu

SEQ ID NO: 714888 - RNA, 18 nt, Haemophilus influenzae Rd
aaccaucuuuuuuugcaa

SEQ ID NO: 714889 - RNA, 14 nt, Haemophilus influenzae Rd
aaccauaaacaaua

SEQ ID NO: 714890 - RNA, 15 nt, Haemophilus influenzae Rd
aaccauaacaagaau

SEQ ID NO: 714891 - RNA, 13 nt, Haemophilus influenzae Rd
aaccauucccauu

SEQ ID NO: 714892 - RNA, 21 nt, Haemophilus influenzae Rd
aaccauucccauuccaguaau

SEQ ID NO: 714893 - RNA, 15 nt, Haemophilus influenzae Rd
aaccauuuauaaugc

SEQ ID NO: 714894 - RNA, 13 nt, Haemophilus influenzae Rd
aaccauuuguugg

SEQ ID NO: 714895 - RNA, 16 nt, Haemophilus influenzae Rd
aaccauuuuaaucaua

SEQ ID NO: 714896 - RNA, 18 nt, Haemophilus influenzae Rd
aacccaggaguaaccaca

SEQ ID NO: 714897 - RNA, 20 nt, Haemophilus influenzae Rd
aacccaucauaaauaugggu

SEQ ID NO: 714898 - RNA, 15 nt, Haemophilus influenzae Rd
aacccauaauugugg

SEQ ID NO: 714899 - RNA, 14 nt, Haemophilus influenzae Rd
aacccauuacuaaa

SEQ ID NO: 714900 - RNA, 20 nt, Haemophilus influenzae Rd
aaccgacucguccaucaaaa

SEQ ID NO: 714901 - RNA, 24 nt, Haemophilus influenzae Rd
aaccgagcuacauggauuugcaau

SEQ ID NO: 714902 - RNA, 21 nt, Haemophilus influenzae Rd
aacccgcuugcuuacauuuug

SEQ ID NO: 714903 - RNA, 13 nt, Haemophilus influenzae Rd
aacccgcuuuuaa

SEQ ID NO: 714904 - RNA, 22 nt, Haemophilus influenzae Rd
aacccgcuuuuaacaaauacau

SEQ ID NO: 714905 - RNA, 16 nt, Haemophilus influenzae Rd
aacccauuuauuuaaa

SEQ ID NO: 714906 - RNA, 18 nt, Haemophilus influenzae Rd
aaccgcuucaggugcuuu

SEQ ID NO: 714907 - RNA, 19 nt, Haemophilus influenzae Rd
aaccgcuuuaucaaagaau

SEQ ID NO: 714908 - RNA, 19 nt, Haemophilus influenzae Rd
aaccgcccgguaaaucuac

SEQ ID NO: 714909 - RNA, 21 nt, Haemophilus influenzae Rd
aaccgccguauugaauaauua

SEQ ID NO: 714910 - RNA, 21 nt, Haemophilus influenzae Rd
aaccgcuguaccagugccaau

SEQ ID NO: 714911 - RNA, 13 nt, Haemophilus influenzae Rd
aaccgcugucaua

SEQ ID NO: 714912 - RNA, 21 nt, Haemophilus influenzae Rd
aaccgcucuuuuuauuuagaa

SEQ ID NO: 714913 - RNA, 15 nt, Haemophilus influenzae Rd
aaccgcaucaaaauu

SEQ ID NO: 714914 - RNA, 20 nt, Haemophilus influenzae Rd
aaccgcacuuaauaaauauu

SEQ ID NO: 714915 - RNA, 24 nt, Haemophilus influenzae Rd
aaccgcacuuaauaaauauugauu

SEQ ID NO: 714916 - RNA, 23 nt, Haemophilus influenzae Rd
aaccgcacuucuaugaagaacaa

SEQ ID NO: 714917 - RNA, 23 nt, Haemophilus influenzae Rd
aaccgcacuuuuuaauaaaaugu

SEQ ID NO: 714918 - RNA, 15 nt, Haemophilus influenzae Rd
aaccgcacuuuuuau

SEQ ID NO: 714919 - RNA, 18 nt, Haemophilus influenzae Rd
aaccuguggcaggugggu

SEQ ID NO: 714920 - RNA, 21 nt, Haemophilus influenzae Rd
aaccuguacguuaucugacac

SEQ ID NO: 714921 - RNA, 21 nt, Haemophilus influenzae Rd
aaccugucgcaaugaagauua

SEQ ID NO: 714922 - RNA, 22 nt, Haemophilus influenzae Rd
aaccuguuugggauaagcaauc

SEQ ID NO: 714923 - RNA, 21 nt, Haemophilus influenzae Rd
aaccuguugguuguucaguau

SEQ ID NO: 714924 - RNA, 20 nt, Haemophilus influenzae Rd
aaccuuaacgaguugauuaa

SEQ ID NO: 714925 - RNA, 22 nt, Haemophilus influenzae Rd
aaccuuacugccuuuuucuucu

SEQ ID NO: 714926 - RNA, 19 nt, Haemophilus influenzae Rd
aaccuuauuuuaaauaaaa

SEQ ID NO: 714927 - RNA, 19 nt, Haemophilus influenzae Rd
aaccuucuggguaaaauaa

SEQ ID NO: 714928 - RNA, 20 nt, Haemophilus influenzae Rd
aaccuucuggguaaaauaau

SEQ ID NO: 714929 - RNA, 20 nt, Haemophilus influenzae Rd
aaccuuguuccaggaaaauu

SEQ ID NO: 714930 - RNA, 15 nt, Haemophilus influenzae Rd
aaccuuguaaagcac

SEQ ID NO: 714931 - RNA, 19 nt, Haemophilus influenzae Rd
aaccuuuaccgucaauaaa

SEQ ID NO: 714932 - RNA, 19 nt, Haemophilus influenzae Rd
aaccuuucuguaaauaugc

SEQ ID NO: 714933 - RNA, 20 nt, Haemophilus influenzae Rd
aacgaauuuagggaaaauuu

SEQ ID NO: 714934 - RNA, 12 nt, Haemophilus influenzae Rd
aacgacaaaacu

SEQ ID NO: 714935 - RNA, 12 nt, Haemophilus influenzae Rd
aacgaagaaaca

SEQ ID NO: 714936 - RNA, 23 nt, Haemophilus influenzae Rd
aacgaacuggcugagagaagaaa

SEQ ID NO: 714937 - RNA, 14 nt, Haemophilus influenzae Rd
aacgaacaauuucu

SEQ ID NO: 714938 - RNA, 17 nt, Haemophilus influenzae Rd
aacgaaaaaaauaaaaa

SEQ ID NO: 714939 - RNA, 19 nt, Haemophilus influenzae Rd
aacgaaaaaaauaaaaaau

SEQ ID NO: 714940 - RNA, 17 nt, Haemophilus influenzae Rd
aaccuacauuaaucacc

SEQ ID NO: 714941 - RNA, 17 nt, Haemophilus influenzae Rd
aaccuaccggaaaccag

SEQ ID NO: 714942 - RNA, 20 nt, Haemophilus influenzae Rd
aaccuaaaccuuauuuuaaa

SEQ ID NO: 714943 - RNA, 16 nt, Haemophilus influenzae Rd
aaccuaaacgcugacg

SEQ ID NO: 714944 - RNA, 20 nt, Haemophilus influenzae Rd
aaccguuuuuauuuguucua

SEQ ID NO: 714945 - RNA, 22 nt, Haemophilus influenzae Rd
aaccguuuuuauuuguucuacu

SEQ ID NO: 714946 - RNA, 15 nt, Haemophilus influenzae Rd
aaccuaaaauauuua

SEQ ID NO: 714947 - RNA, 14 nt, Haemophilus influenzae Rd
aaccgucuuuaaau

SEQ ID NO: 714948 - RNA, 17 nt, Haemophilus influenzae Rd
aaccugaguaaauaaac

SEQ ID NO: 714949 - RNA, 18 nt, Haemophilus influenzae Rd
aaccugauaaguagaaaa

SEQ ID NO: 714950 - RNA, 21 nt, Haemophilus influenzae Rd
aaccugauaaguagaaaaauu

SEQ ID NO: 714951 - RNA, 16 nt, Haemophilus influenzae Rd
aaccucagaagaaauu

SEQ ID NO: 714952 - RNA, 23 nt, Haemophilus influenzae Rd
aaccucccaaaaacuaaauauuc

SEQ ID NO: 714953 - RNA, 13 nt, Haemophilus influenzae Rd
aacgcacacaaca

SEQ ID NO: 714954 - RNA, 22 nt, Haemophilus influenzae Rd
aacgcacuugauuugcuuggaa

SEQ ID NO: 714955 - RNA, 16 nt, Haemophilus influenzae Rd
aacgcacguaacaaau

SEQ ID NO: 714956 - RNA, 15 nt, Haemophilus influenzae Rd
aacgcauauuuuguu

SEQ ID NO: 714957 - RNA, 21 nt, Haemophilus influenzae Rd
aacgcaagcugugcaagcauu

SEQ ID NO: 714958 - RNA, 19 nt, Haemophilus influenzae Rd
aacgcaaauaccaggagaa

SEQ ID NO: 714959 - RNA, 19 nt, Haemophilus influenzae Rd
aacgauuucgugcaauaac

SEQ ID NO: 714960 - RNA, 18 nt, Haemophilus influenzae Rd
aacgacgguauaaaccuu

SEQ ID NO: 714961 - RNA, 19 nt, Haemophilus influenzae Rd
aacgacguuugcuaccuuc

SEQ ID NO: 714962 - RNA, 16 nt, Haemophilus influenzae Rd
aacgacgccaaauaug

SEQ ID NO: 714963 - RNA, 21 nt, Haemophilus influenzae Rd
aacgacgccacuguugugaag

SEQ ID NO: 714964 - RNA, 18 nt, Haemophilus influenzae Rd
aacgaccuugcaaauuuu

SEQ ID NO: 714965 - RNA, 15 nt, Haemophilus influenzae Rd
aacgagcaauauuca

SEQ ID NO: 714966 - RNA, 22 nt, Haemophilus influenzae Rd
aacgauagccguccauuucaau

SEQ ID NO: 714967 - RNA, 23 nt, Haemophilus influenzae Rd
aacgauaacacccucaaccacuu

SEQ ID NO: 714968 - RNA, 22 nt, Haemophilus influenzae Rd
aacgccacgcuuugucaguggu

SEQ ID NO: 714969 - RNA, 22 nt, Haemophilus influenzae Rd
aacgccagaaguuguuuuucuu

SEQ ID NO: 714970 - RNA, 13 nt, Haemophilus influenzae Rd
aacgcaucuauug

SEQ ID NO: 714971 - RNA, 14 nt, Haemophilus influenzae Rd
aacgcaucuauugu

SEQ ID NO: 714972 - RNA, 18 nt, Haemophilus influenzae Rd
aacgcauuguuacaaauu

SEQ ID NO: 714973 - RNA, 21 nt, Haemophilus influenzae Rd
aacgcauuguuacaaauuccu

SEQ ID NO: 714974 - RNA, 13 nt, Haemophilus influenzae Rd
aacgcccuucuuu

SEQ ID NO: 714975 - RNA, 20 nt, Haemophilus influenzae Rd
aacgccauucacauucuuuu

SEQ ID NO: 714976 - RNA, 20 nt, Haemophilus influenzae Rd
aacgccaucaaccauaacaa

SEQ ID NO: 714977 - RNA, 15 nt, Haemophilus influenzae Rd
aacgccuacaucuua

SEQ ID NO: 714978 - RNA, 14 nt, Haemophilus influenzae Rd
aacgcgagguugaa

SEQ ID NO: 714979 - RNA, 17 nt, Haemophilus influenzae Rd
aacgcgaguaaaauaaa

SEQ ID NO: 714980 - RNA, 18 nt, Haemophilus influenzae Rd
aacgcgaguaaaauaaaa

SEQ ID NO: 714981 - RNA, 16 nt, Haemophilus influenzae Rd
aacgccugcugcaguu

SEQ ID NO: 714982 - RNA, 16 nt, Haemophilus influenzae Rd
aacgcucaaaaauuuc

SEQ ID NO: 714983 - RNA, 22 nt, Haemophilus influenzae Rd
aacgcucaaaaauuucagaauu

SEQ ID NO: 714984 - RNA, 19 nt, Haemophilus influenzae Rd
aacgcucaaauaaauugcc

SEQ ID NO: 714985 - RNA, 17 nt, Haemophilus influenzae Rd
aacgcucgcgauauugc

SEQ ID NO: 714986 - RNA, 20 nt, Haemophilus influenzae Rd
aacgcugcuuaaagcaauca

SEQ ID NO: 714987 - RNA, 21 nt, Haemophilus influenzae Rd
aacgcucugcaccuucaccac

SEQ ID NO: 714988 - RNA, 23 nt, Haemophilus influenzae Rd
aacgcugaaacgggcucaucaca

SEQ ID NO: 714989 - RNA, 23 nt, Haemophilus influenzae Rd
aacgcuguaaaccuucaaacauc

SEQ ID NO: 714990 - RNA, 14 nt, Haemophilus influenzae Rd
aacggauuaaaagu

SEQ ID NO: 714991 - RNA, 16 nt, Haemophilus influenzae Rd
aacggcuggugacagc

SEQ ID NO: 714992 - RNA, 16 nt, Haemophilus influenzae Rd
aacguaauagauaaag

SEQ ID NO: 714993 - RNA, 14 nt, Haemophilus influenzae Rd
aacguaagaaauaa

SEQ ID NO: 714994 - RNA, 13 nt, Haemophilus influenzae Rd
aacguaagaucag

SEQ ID NO: 714995 - RNA, 12 nt, Haemophilus influenzae Rd
aacguaaaaacg

SEQ ID NO: 714996 - RNA, 14 nt, Haemophilus influenzae Rd
aacguaaauuaugu

SEQ ID NO: 714997 - RNA, 13 nt, Haemophilus influenzae Rd
aacguaaauucag

SEQ ID NO: 714998 - RNA, 15 nt, Haemophilus influenzae Rd
aacguaacaacgcac

SEQ ID NO: 714999 - RNA, 13 nt, Haemophilus influenzae Rd
aacgguuaugaaa

SEQ ID NO: 715000 - RNA, 13 nt, Haemophilus influenzae Rd
aacgguuaauaaa

SEQ ID NO: 715001 - RNA, 17 nt, Haemophilus influenzae Rd
aacgguuaauaaauucu

SEQ ID NO: 715002 - RNA, 18 nt, Haemophilus influenzae Rd
aacggugugggugcugca

SEQ ID NO: 715003 - RNA, 16 nt, Haemophilus influenzae Rd
aacggucgaguuuuuc

SEQ ID NO: 715004 - RNA, 17 nt, Haemophilus influenzae Rd
aacgguagcaggagaaa

SEQ ID NO: 715005 - RNA, 16 nt, Haemophilus influenzae Rd
aacuaccuaauaaagc

SEQ ID NO: 715006 - RNA, 23 nt, Haemophilus influenzae Rd
aacuacggacuaaauaaaucaca

SEQ ID NO: 715007 - RNA, 17 nt, Haemophilus influenzae Rd
aacuacccaaauuuaua

SEQ ID NO: 715008 - RNA, 15 nt, Haemophilus influenzae Rd
aacuaauuuauuaaa

SEQ ID NO: 715009 - RNA, 16 nt, Haemophilus influenzae Rd
aacuaauuuauuaaaa

SEQ ID NO: 715010 - RNA, 17 nt, Haemophilus influenzae Rd
aacuaauuuauuaaaaa

SEQ ID NO: 715011 - RNA, 14 nt, Haemophilus influenzae Rd
aacuaauuucauuu

SEQ ID NO: 715012 - RNA, 17 nt, Haemophilus influenzae Rd
aacuaauuugggugcag

SEQ ID NO: 715013 - RNA, 18 nt, Haemophilus influenzae Rd
aacuacaacuucaucaau

SEQ ID NO: 715014 - RNA, 12 nt, Haemophilus influenzae Rd
aacuacaaguac

SEQ ID NO: 715015 - RNA, 23 nt, Haemophilus influenzae Rd
aacuauaacuaggcaucaaaauu

SEQ ID NO: 715016 - RNA, 15 nt, Haemophilus influenzae Rd
aacuaacuggcugug

SEQ ID NO: 715017 - RNA, 16 nt, Haemophilus influenzae Rd
aacuaagcucauccau

SEQ ID NO: 715018 - RNA, 14 nt, Haemophilus influenzae Rd
aacuaagaugauca

SEQ ID NO: 715019 - RNA, 16 nt, Haemophilus influenzae Rd
aacuaauuaguuuuua

SEQ ID NO: 715020 - RNA, 13 nt, Haemophilus influenzae Rd
aacuaauucggaa

SEQ ID NO: 715021 - RNA, 18 nt, Haemophilus influenzae Rd
aacuaauaucacuuugua

SEQ ID NO: 715022 - RNA, 17 nt, Haemophilus influenzae Rd
aacuaaggugcagauuu

SEQ ID NO: 715023 - RNA, 16 nt, Haemophilus influenzae Rd
aacuaacauacccaug

SEQ ID NO: 715024 - RNA, 13 nt, Haemophilus influenzae Rd
aacuaaagaauca

SEQ ID NO: 715025 - RNA, 17 nt, Haemophilus influenzae Rd
aacuaaagaaucaaauu

SEQ ID NO: 715026 - RNA, 17 nt, Haemophilus influenzae Rd
aacuaaaggcacaaaaa

SEQ ID NO: 715027 - RNA, 17 nt, Haemophilus influenzae Rd
aacuaaaccauuuaaua

SEQ ID NO: 715028 - RNA, 22 nt, Haemophilus influenzae Rd
aacuaaaccauuuaauaaaaca

SEQ ID NO: 715029 - RNA, 15 nt, Haemophilus influenzae Rd
aacuaaaaggacuaa

SEQ ID NO: 715030 - RNA, 17 nt, Haemophilus influenzae Rd
aacuaaaaaaauucaac

SEQ ID NO: 715031 - RNA, 18 nt, Haemophilus influenzae Rd
aacuaaaaaucccauuua

SEQ ID NO: 715032 - RNA, 16 nt, Haemophilus influenzae Rd
aacuaaaaacaaauau

SEQ ID NO: 715033 - RNA, 20 nt, Haemophilus influenzae Rd
aacguagguaguuuucaaua

SEQ ID NO: 715034 - RNA, 15 nt, Haemophilus influenzae Rd
aacgucgugggauuu

SEQ ID NO: 715035 - RNA, 19 nt, Haemophilus influenzae Rd
aacgucgugggauuugcca

SEQ ID NO: 715036 - RNA, 14 nt, Haemophilus influenzae Rd
aacgugaaguaaau

SEQ ID NO: 715037 - RNA, 17 nt, Haemophilus influenzae Rd
aacgugggaauuuuccc

SEQ ID NO: 715038 - RNA, 14 nt, Haemophilus influenzae Rd
aacguuaaaugaac

SEQ ID NO: 715039 - RNA, 15 nt, Haemophilus influenzae Rd
aacguucuaagaauu

SEQ ID NO: 715040 - RNA, 19 nt, Haemophilus influenzae Rd
aacguugcucuuucaaguu

SEQ ID NO: 715041 - RNA, 20 nt, Haemophilus influenzae Rd
aacguugcucuuucaaguuu

SEQ ID NO: 715042 - RNA, 22 nt, Haemophilus influenzae Rd
aacguuuauggcuuucaauuuc

SEQ ID NO: 715043 - RNA, 21 nt, Haemophilus influenzae Rd
aacguuggguuugauuuauac

SEQ ID NO: 715044 - RNA, 19 nt, Haemophilus influenzae Rd
aacguuuuaaguuuucacc

SEQ ID NO: 715045 - RNA, 15 nt, Haemophilus influenzae Rd
aacguuuaaauuaua

SEQ ID NO: 715046 - RNA, 16 nt, Haemophilus influenzae Rd
aacucuuggcuaacuu

SEQ ID NO: 715047 - RNA, 23 nt, Haemophilus influenzae Rd
aacucuugugccaaauucauucu

SEQ ID NO: 715048 - RNA, 16 nt, Haemophilus influenzae Rd
aacucuuucaccauua

SEQ ID NO: 715049 - RNA, 20 nt, Haemophilus influenzae Rd
aacucuaauuccaccgcacu

SEQ ID NO: 715050 - RNA, 15 nt, Haemophilus influenzae Rd
aacucuaagcuuaau

SEQ ID NO: 715051 - RNA, 17 nt, Haemophilus influenzae Rd
aacucgaacaugaaguu

SEQ ID NO: 715052 - RNA, 22 nt, Haemophilus influenzae Rd
aacuccguccaaucuaauucuu

SEQ ID NO: 715053 - RNA, 22 nt, Haemophilus influenzae Rd
aacucauccaaucaucagaaua

SEQ ID NO: 715054 - RNA, 17 nt, Haemophilus influenzae Rd
aacucaugcugagugaa

SEQ ID NO: 715055 - RNA, 19 nt, Haemophilus influenzae Rd
aacucauuacacaaaauau

SEQ ID NO: 715056 - RNA, 16 nt, Haemophilus influenzae Rd
aacucagaauauaagu

SEQ ID NO: 715057 - RNA, 21 nt, Haemophilus influenzae Rd
aacuauuuuuuauuuauauaa

SEQ ID NO: 715058 - RNA, 12 nt, Haemophilus influenzae Rd
aacuauuuuuaa

SEQ ID NO: 715059 - RNA, 20 nt, Haemophilus influenzae Rd
aacucaacaccgcaaaaaua

SEQ ID NO: 715060 - RNA, 23 nt, Haemophilus influenzae Rd
aacucaacaccgcaaaaauacua

SEQ ID NO: 715061 - RNA, 14 nt, Haemophilus influenzae Rd
aacucacaauugau

SEQ ID NO: 715062 - RNA, 17 nt, Haemophilus influenzae Rd
aacuaucuuacuugccu

SEQ ID NO: 715063 - RNA, 22 nt, Haemophilus influenzae Rd
aacuauaauuagaucauaaaaa

SEQ ID NO: 715064 - RNA, 22 nt, Haemophilus influenzae Rd
aacuauauccaaaucaaaaagc

SEQ ID NO: 715065 - RNA, 22 nt, Haemophilus influenzae Rd
aacuauaugauauauaaaaccc

SEQ ID NO: 715066 - RNA, 16 nt, Haemophilus influenzae Rd
aacuauucaaaugaaa

SEQ ID NO: 715067 - RNA, 15 nt, Haemophilus influenzae Rd
aacuauugaaaauua

SEQ ID NO: 715068 - RNA, 15 nt, Haemophilus influenzae Rd
aacuaugccuucuuc

SEQ ID NO: 715069 - RNA, 22 nt, Haemophilus influenzae Rd
aacuauuacgcuguccaauaau

SEQ ID NO: 715070 - RNA, 14 nt, Haemophilus influenzae Rd
aacuaugaagacua

SEQ ID NO: 715071 - RNA, 15 nt, Haemophilus influenzae Rd
aacuaugaagacuaa

SEQ ID NO: 715072 - RNA, 20 nt, Haemophilus influenzae Rd
aacuaugcagaaucagaaua

SEQ ID NO: 715073 - RNA, 22 nt, Haemophilus influenzae Rd
aacugaauucucaauugcagau

SEQ ID NO: 715074 - RNA, 13 nt, Haemophilus influenzae Rd
aacugaagcaauc

SEQ ID NO: 715075 - RNA, 12 nt, Haemophilus influenzae Rd
aacugaaaauua

SEQ ID NO: 715076 - RNA, 17 nt, Haemophilus influenzae Rd
aacugaaaauucaucau

SEQ ID NO: 715077 - RNA, 21 nt, Haemophilus influenzae Rd
aacugauuagggugcagauuu

SEQ ID NO: 715078 - RNA, 21 nt, Haemophilus influenzae Rd
aacugauuguccaaagaauaa

SEQ ID NO: 715079 - RNA, 14 nt, Haemophilus influenzae Rd
aacugccaaacaaa

SEQ ID NO: 715080 - RNA, 23 nt, Haemophilus influenzae Rd
aacugcgauagaaucuacagcug

SEQ ID NO: 715081 - RNA, 16 nt, Haemophilus influenzae Rd
aacuggaugaaaucau

SEQ ID NO: 715082 - RNA, 15 nt, Haemophilus influenzae Rd
aacugcuuucuucca

SEQ ID NO: 715083 - RNA, 22 nt, Haemophilus influenzae Rd
aacuggguuuuuuuauuuuuau

SEQ ID NO: 715084 - RNA, 17 nt, Haemophilus influenzae Rd
aacugugcggucuguug

SEQ ID NO: 715085 - RNA, 20 nt, Haemophilus influenzae Rd
aacugugcggucuguugcaa

SEQ ID NO: 715086 - RNA, 23 nt, Haemophilus influenzae Rd
aacugugcggucuguugcaaauu

SEQ ID NO: 715087 - RNA, 21 nt, Haemophilus influenzae Rd
aacuguuauuugcaaagauau

SEQ ID NO: 715088 - RNA, 22 nt, Haemophilus influenzae Rd
aacuuaaacaagcucuagaaaa

SEQ ID NO: 715089 - RNA, 15 nt, Haemophilus influenzae Rd
aacuuaaagaauacu

SEQ ID NO: 715090 - RNA, 14 nt, Haemophilus influenzae Rd
aacuuaaauuuuua

SEQ ID NO: 715091 - RNA, 15 nt, Haemophilus influenzae Rd
aacuuaaauuuuuau

SEQ ID NO: 715092 - RNA, 21 nt, Haemophilus influenzae Rd
aacuguuuuggcauuuucaau

SEQ ID NO: 715093 - RNA, 14 nt, Haemophilus influenzae Rd
aacuugaauaccug

SEQ ID NO: 715094 - RNA, 14 nt, Haemophilus influenzae Rd
aacuugaauggcua

SEQ ID NO: 715095 - RNA, 16 nt, Haemophilus influenzae Rd
aacuugaauugaagag

SEQ ID NO: 715096 - RNA, 15 nt, Haemophilus influenzae Rd
aacuugcaaaccaac

SEQ ID NO: 715097 - RNA, 15 nt, Haemophilus influenzae Rd
aacuugcuauuuucu

SEQ ID NO: 715098 - RNA, 22 nt, Haemophilus influenzae Rd
aacuugauauaaguucuaaaua

SEQ ID NO: 715099 - RNA, 20 nt, Haemophilus influenzae Rd
aacuuguuuuccaaacauuu

SEQ ID NO: 715100 - RNA, 21 nt, Haemophilus influenzae Rd
aacuuguuuuccaaacauuuu

SEQ ID NO: 715101 - RNA, 21 nt, Haemophilus influenzae Rd
aacuugguguaauuugaugcu

SEQ ID NO: 715102 - RNA, 13 nt, Haemophilus influenzae Rd
aacuuggaaugca

SEQ ID NO: 715103 - RNA, 13 nt, Haemophilus influenzae Rd
aacuuucuaguuc

SEQ ID NO: 715104 - RNA, 19 nt, Haemophilus influenzae Rd
aacuuucgcguaauaacaa

SEQ ID NO: 715105 - RNA, 13 nt, Haemophilus influenzae Rd
aacuuuccuacua

SEQ ID NO: 715106 - RNA, 23 nt, Haemophilus influenzae Rd
aacuuuccaccccagaauuaaga

SEQ ID NO: 715107 - RNA, 13 nt, Haemophilus influenzae Rd
aacuuuccauaua

SEQ ID NO: 715108 - RNA, 11 nt, Haemophilus influenzae Rd
aacuuucaaaa

SEQ ID NO: 715109 - RNA, 21 nt, Haemophilus influenzae Rd
aacuuucacaacuaccacagg

SEQ ID NO: 715110 - RNA, 12 nt, Haemophilus influenzae Rd
aacuuucaguua

SEQ ID NO: 715111 - RNA, 22 nt, Haemophilus influenzae Rd
aacuuuacggauaauuucccua

SEQ ID NO: 715112 - RNA, 15 nt, Haemophilus influenzae Rd
aacuuuauccccuac

SEQ ID NO: 715113 - RNA, 16 nt, Haemophilus influenzae Rd
aacuuuagucgcuuuc

SEQ ID NO: 715114 - RNA, 20 nt, Haemophilus influenzae Rd
aacuuuuaaaacacgcccuu

SEQ ID NO: 715115 - RNA, 21 nt, Haemophilus influenzae Rd
aacuuuuagaaugcagauuaa

SEQ ID NO: 715116 - RNA, 15 nt, Haemophilus influenzae Rd
aacuuuguucauuuu

SEQ ID NO: 715117 - RNA, 14 nt, Haemophilus influenzae Rd
aacuuuugagucaa

SEQ ID NO: 715118 - RNA, 14 nt, Haemophilus influenzae Rd
aacuucuaaaaaac

SEQ ID NO: 715119 - RNA, 16 nt, Haemophilus influenzae Rd
aacuucucaguguuuc

SEQ ID NO: 715120 - RNA, 13 nt, Haemophilus influenzae Rd
aacuucuauguuu

SEQ ID NO: 715121 - RNA, 19 nt, Haemophilus influenzae Rd
aacuucuauguuugcauca

SEQ ID NO: 715122 - RNA, 12 nt, Haemophilus influenzae Rd
aacuucucuuau

SEQ ID NO: 715123 - RNA, 22 nt, Haemophilus influenzae Rd
aacuucacuuuucgcaauuuua

SEQ ID NO: 715124 - RNA, 13 nt, Haemophilus influenzae Rd
aacuucauccauu

SEQ ID NO: 715125 - RNA, 14 nt, Haemophilus influenzae Rd
aacuucauccauuu

SEQ ID NO: 715126 - RNA, 18 nt, Haemophilus influenzae Rd
aacuucauccauuuucga

SEQ ID NO: 715127 - RNA, 23 nt, Haemophilus influenzae Rd
aacuucauuuaguuuaagggcua

SEQ ID NO: 715128 - RNA, 17 nt, Haemophilus influenzae Rd
aacuuccgcuaauacua

SEQ ID NO: 715129 - RNA, 16 nt, Haemophilus influenzae Rd
aacuuaucuaaaaaga

SEQ ID NO: 715130 - RNA, 16 nt, Haemophilus influenzae Rd
aacuuaucauuaaucu

SEQ ID NO: 715131 - RNA, 15 nt, Haemophilus influenzae Rd
aacuuaugaauaaua

SEQ ID NO: 715132 - RNA, 12 nt, Haemophilus influenzae Rd
aacuucaccaau

SEQ ID NO: 715133 - RNA, 16 nt, Haemophilus influenzae Rd
aacuucaaccacuuca

SEQ ID NO: 715134 - RNA, 15 nt, Haemophilus influenzae Rd
aacuuauaaagauau

SEQ ID NO: 715135 - RNA, 16 nt, Haemophilus influenzae Rd
aacuuauaaagauauu

SEQ ID NO: 715136 - RNA, 21 nt, Haemophilus influenzae Rd
aacuuacuacguguucaucau

SEQ ID NO: 715137 - RNA, 22 nt, Haemophilus influenzae Rd
aacuuaccuaaaaauuuaaaua

SEQ ID NO: 715138 - RNA, 13 nt, Haemophilus influenzae Rd
aacuuagaaaaua

SEQ ID NO: 715139 - RNA, 17 nt, Haemophilus influenzae Rd
aacuuagcccuuaaacu

SEQ ID NO: 715140 - RNA, 16 nt, Haemophilus influenzae Rd
aacuuaggaugauaca

SEQ ID NO: 715141 - RNA, 17 nt, Haemophilus influenzae Rd
aacuuaccgaucauuuc

SEQ ID NO: 715142 - RNA, 21 nt, Haemophilus influenzae Rd
aagaagcucacuuuauauagu

SEQ ID NO: 715143 - RNA, 20 nt, Haemophilus influenzae Rd
aagaagcuauuacucuuaau

SEQ ID NO: 715144 - RNA, 15 nt, Haemophilus influenzae Rd
aagaagcuuuccauc

SEQ ID NO: 715145 - RNA, 21 nt, Haemophilus influenzae Rd
aagaagcgaauauuguuaauu

SEQ ID NO: 715146 - RNA, 18 nt, Haemophilus influenzae Rd
aagaacuugauaaucauu

SEQ ID NO: 715147 - RNA, 22 nt, Haemophilus influenzae Rd
aagaacuacauugaguuacuuu

SEQ ID NO: 715148 - RNA, 20 nt, Haemophilus influenzae Rd
aagaacggucaaaaugcagu

SEQ ID NO: 715149 - RNA, 22 nt, Haemophilus influenzae Rd
aagaaauuuuaaccgcacuuuu

SEQ ID NO: 715150 - RNA, 21 nt, Haemophilus influenzae Rd
aagaaauuuuaaucacuguca

SEQ ID NO: 715151 - RNA, 14 nt, Haemophilus influenzae Rd
aagaaauuuuguuu

SEQ ID NO: 715152 - RNA, 21 nt, Haemophilus influenzae Rd
aagaaauuuuguuuuguucau

SEQ ID NO: 715153 - RNA, 20 nt, Haemophilus influenzae Rd
aagaacaaggggaaaauauu

SEQ ID NO: 715154 - RNA, 13 nt, Haemophilus influenzae Rd
aagaaaguuaaaa

SEQ ID NO: 715155 - RNA, 20 nt, Haemophilus influenzae Rd
aagaaauaacgauaagauuu

SEQ ID NO: 715156 - RNA, 14 nt, Haemophilus influenzae Rd
aagaaauauauuau

SEQ ID NO: 715157 - RNA, 21 nt, Haemophilus influenzae Rd
aagaaauauaauaaauauguu

SEQ ID NO: 715158 - RNA, 21 nt, Haemophilus influenzae Rd
aagaaauucacucaauucaaa

SEQ ID NO: 715159 - RNA, 15 nt, Haemophilus influenzae Rd
aagaaacguuuugga

SEQ ID NO: 715160 - RNA, 18 nt, Haemophilus influenzae Rd
aagaaacgccagcuuaag

SEQ ID NO: 715161 - RNA, 19 nt, Haemophilus influenzae Rd
aagaaagcgacauuuuguc

SEQ ID NO: 715162 - RNA, 18 nt, Haemophilus influenzae Rd
aagaaagcaugaauaaaa

SEQ ID NO: 715163 - RNA, 21 nt, Haemophilus influenzae Rd
aagaaagaaauauaauaaaua

SEQ ID NO: 715164 - RNA, 23 nt, Haemophilus influenzae Rd
aagaaaauagaaagaauauuuaa

SEQ ID NO: 715165 - RNA, 21 nt, Haemophilus influenzae Rd
aagaaaaguuuuauauuuuuu

SEQ ID NO: 715166 - RNA, 17 nt, Haemophilus influenzae Rd
aagaaaaccaaaacaua

SEQ ID NO: 715167 - RNA, 19 nt, Haemophilus influenzae Rd
aagaaaaccaaaacauaag

SEQ ID NO: 715168 - RNA, 15 nt, Haemophilus influenzae Rd
aagaaaagcauuaau

SEQ ID NO: 715169 - RNA, 21 nt, Haemophilus influenzae Rd
aagaaaauaauauaagugauu

SEQ ID NO: 715170 - RNA, 13 nt, Haemophilus influenzae Rd
aagaaaauacaau

SEQ ID NO: 715171 - RNA, 15 nt, Haemophilus influenzae Rd
aagaaaauacaauau

SEQ ID NO: 715172 - RNA, 16 nt, Haemophilus influenzae Rd
aagaaaauacauaauu

SEQ ID NO: 715173 - RNA, 14 nt, Haemophilus influenzae Rd
aagaaaaaggcagu

SEQ ID NO: 715174 - RNA, 14 nt, Haemophilus influenzae Rd
aacuuuuuggcaua

SEQ ID NO: 715175 - RNA, 16 nt, Haemophilus influenzae Rd
aauccaacuaaaccac

SEQ ID NO: 715176 - RNA, 13 nt, Haemophilus influenzae Rd
aauccaaguuugu

SEQ ID NO: 715177 - RNA, 15 nt, Haemophilus influenzae Rd
aauccaaguauaaaa

SEQ ID NO: 715178 - RNA, 15 nt, Haemophilus influenzae Rd
aauccaaucagcaaa

SEQ ID NO: 715179 - RNA, 18 nt, Haemophilus influenzae Rd
aauccaaugauccccauu

SEQ ID NO: 715180 - RNA, 14 nt, Haemophilus influenzae Rd
aauccaaugcacuu

SEQ ID NO: 715181 - RNA, 22 nt, Haemophilus influenzae Rd
aauccacacuuuaaaaguuuac

SEQ ID NO: 715182 - RNA, 23 nt, Haemophilus influenzae Rd
aauccacacuuuaaaaguuuacu

SEQ ID NO: 715183 - RNA, 15 nt, Haemophilus influenzae Rd
aauccacacuuuaau

SEQ ID NO: 715184 - RNA, 18 nt, Haemophilus influenzae Rd
aauccacgccccaacaua

SEQ ID NO: 715185 - RNA, 16 nt, Haemophilus influenzae Rd
aaucauuucuaagccu

SEQ ID NO: 715186 - RNA, 12 nt, Haemophilus influenzae Rd
aaucauuucaau

SEQ ID NO: 715187 - RNA, 16 nt, Haemophilus influenzae Rd
aaucauuucaauauca

SEQ ID NO: 715188 - RNA, 19 nt, Haemophilus influenzae Rd
aaucauuggauaauugcca

SEQ ID NO: 715189 - RNA, 21 nt, Haemophilus influenzae Rd
aaucauuggauaauugccacu

SEQ ID NO: 715190 - RNA, 20 nt, Haemophilus influenzae Rd
aauccaaauuguccgccauc

SEQ ID NO: 715191 - RNA, 14 nt, Haemophilus influenzae Rd
aaucauuuucacuc

SEQ ID NO: 715192 - RNA, 23 nt, Haemophilus influenzae Rd
aaucauuuuuuaacuugauuuug

SEQ ID NO: 715193 - RNA, 20 nt, Haemophilus influenzae Rd
aaucauuugccgccaaaaug

SEQ ID NO: 715194 - RNA, 21 nt, Haemophilus influenzae Rd
aaucauuugccgccaaaauga

SEQ ID NO: 715195 - RNA, 24 nt, Haemophilus influenzae Rd
aaucauuugccgccaaaaugagcu

SEQ ID NO: 715196 - RNA, 21 nt, Haemophilus influenzae Rd
aauccagcuacauucaucaaa

SEQ ID NO: 715197 - RNA, 20 nt, Haemophilus influenzae Rd
aauccagcaugagcuucaaa

SEQ ID NO: 715198 - RNA, 23 nt, Haemophilus influenzae Rd
aauccagcaugagcuucaaaauc

SEQ ID NO: 715199 - RNA, 21 nt, Haemophilus influenzae Rd
aauccacucuuuuaauaaaac

SEQ ID NO: 715200 - RNA, 14 nt, Haemophilus influenzae Rd
aauccacuaaaaac

SEQ ID NO: 715201 - RNA, 17 nt, Haemophilus influenzae Rd
aauccagauaacaaacc

SEQ ID NO: 715202 - RNA, 17 nt, Haemophilus influenzae Rd
aauccaucaauucuucc

SEQ ID NO: 715203 - RNA, 15 nt, Haemophilus influenzae Rd
aauccaucauuucuu

SEQ ID NO: 715204 - RNA, 23 nt, Haemophilus influenzae Rd
aauccauuucgucgcuuuucccu

SEQ ID NO: 715205 - RNA, 18 nt, Haemophilus influenzae Rd
aauccauugguggguuca

SEQ ID NO: 715206 - RNA, 15 nt, Haemophilus influenzae Rd
aaucauuaaauaacu

SEQ ID NO: 715207 - RNA, 12 nt, Haemophilus influenzae Rd
aaucauuaacuu

SEQ ID NO: 715208 - RNA, 20 nt, Haemophilus influenzae Rd
aaucauuaacuuaccacguu

SEQ ID NO: 715209 - RNA, 18 nt, Haemophilus influenzae Rd
aaucaucguauuaaaagu

SEQ ID NO: 715210 - RNA, 20 nt, Haemophilus influenzae Rd
aaucaucuaguucaguuuug

SEQ ID NO: 715211 - RNA, 23 nt, Haemophilus influenzae Rd
aaucaucgcgaugacuaaacaaa

SEQ ID NO: 715212 - RNA, 22 nt, Haemophilus influenzae Rd
aaucauauugauuuacauuaau

SEQ ID NO: 715213 - RNA, 15 nt, Haemophilus influenzae Rd
aaucauaucaucaac

SEQ ID NO: 715214 - RNA, 16 nt, Haemophilus influenzae Rd
aaucauaucaucaacc

SEQ ID NO: 715215 - RNA, 15 nt, Haemophilus influenzae Rd
aaucaucucuaaccu

SEQ ID NO: 715216 - RNA, 20 nt, Haemophilus influenzae Rd
aaucaucucuaaccuaaaau

SEQ ID NO: 715217 - RNA, 23 nt, Haemophilus influenzae Rd
aaucaucuucaucugcaucacaa

SEQ ID NO: 715218 - RNA, 22 nt, Haemophilus influenzae Rd
aaucaugaauaauuuuguuacu

SEQ ID NO: 715219 - RNA, 14 nt, Haemophilus influenzae Rd
aaucauaagcaaua

SEQ ID NO: 715220 - RNA, 20 nt, Haemophilus influenzae Rd
aaucauaagcaauaauuuca

SEQ ID NO: 715221 - RNA, 21 nt, Haemophilus influenzae Rd
aaucauaaucgccaaaaucau

SEQ ID NO: 715222 - RNA, 14 nt, Haemophilus influenzae Rd
aaucauacacacca

SEQ ID NO: 715223 - RNA, 22 nt, Haemophilus influenzae Rd
aaucaggguuauuugcaauaaa

SEQ ID NO: 715224 - RNA, 19 nt, Haemophilus influenzae Rd
aaucaggcuuucauuuucc

SEQ ID NO: 715225 - RNA, 18 nt, Haemophilus influenzae Rd
aauauguaauauuuuccc

SEQ ID NO: 715226 - RNA, 20 nt, Haemophilus influenzae Rd
aauauguaauauuuucccuc

SEQ ID NO: 715227 - RNA, 16 nt, Haemophilus influenzae Rd
aauauguuuaccaccg

SEQ ID NO: 715228 - RNA, 16 nt, Haemophilus influenzae Rd
aauauuaaagaaaaua

SEQ ID NO: 715229 - RNA, 18 nt, Haemophilus influenzae Rd
aauauuaaagaaaauaca

SEQ ID NO: 715230 - RNA, 19 nt, Haemophilus influenzae Rd
aaucccuuauguuaugaag

SEQ ID NO: 715231 - RNA, 20 nt, Haemophilus influenzae Rd
aaucccuucugcuccacaaa

SEQ ID NO: 715232 - RNA, 15 nt, Haemophilus influenzae Rd
aaucccucaaauaca

SEQ ID NO: 715233 - RNA, 20 nt, Haemophilus influenzae Rd
aaucccucgccuuucgaggc

SEQ ID NO: 715234 - RNA, 13 nt, Haemophilus influenzae Rd
aaucccuugcugg

SEQ ID NO: 715235 - RNA, 14 nt, Haemophilus influenzae Rd
aaucccgauuaaga

SEQ ID NO: 715236 - RNA, 20 nt, Haemophilus influenzae Rd
aaucccauauuuaaaaccaa

SEQ ID NO: 715237 - RNA, 17 nt, Haemophilus influenzae Rd
aaucccauuucaucuuc

SEQ ID NO: 715238 - RNA, 15 nt, Haemophilus influenzae Rd
aaucccacuuguugg

SEQ ID NO: 715239 - RNA, 18 nt, Haemophilus influenzae Rd
aaucccacuuguuuuuuc

SEQ ID NO: 715240 - RNA, 19 nt, Haemophilus influenzae Rd
aauccugguauuuacaagu

SEQ ID NO: 715241 - RNA, 23 nt, Haemophilus influenzae Rd
aauccugguauuuacaagucucu

SEQ ID NO: 715242 - RNA, 19 nt, Haemophilus influenzae Rd
aauccugccaguagaaaau

SEQ ID NO: 715243 - RNA, 17 nt, Haemophilus influenzae Rd
aauccugcuugaauauc

SEQ ID NO: 715244 - RNA, 16 nt, Haemophilus influenzae Rd
aauccugcauuuucuu

SEQ ID NO: 715245 - RNA, 18 nt, Haemophilus influenzae Rd
aauccugcauuuucuuuc

SEQ ID NO: 715246 - RNA, 16 nt, Haemophilus influenzae Rd
aauccuaagaauccca

SEQ ID NO: 715247 - RNA, 14 nt, Haemophilus influenzae Rd
aauccgcugcagcu

SEQ ID NO: 715248 - RNA, 16 nt, Haemophilus influenzae Rd
aauccguuaaauuuag

SEQ ID NO: 715249 - RNA, 17 nt, Haemophilus influenzae Rd
aauccuagaguaaguaa

SEQ ID NO: 715250 - RNA, 23 nt, Haemophilus influenzae Rd
aauccuagaguaaguaaccauaa

SEQ ID NO: 715251 - RNA, 13 nt, Haemophilus influenzae Rd
aaucuacuaaaau

SEQ ID NO: 715252 - RNA, 22 nt, Haemophilus influenzae Rd
aaucguccaaagaaguuuucca

SEQ ID NO: 715253 - RNA, 23 nt, Haemophilus influenzae Rd
aaucguccaauuucaucccaauu

SEQ ID NO: 715254 - RNA, 13 nt, Haemophilus influenzae Rd
aaucuaauuugcu

SEQ ID NO: 715255 - RNA, 18 nt, Haemophilus influenzae Rd
aaucgguagacacaaggg

SEQ ID NO: 715256 - RNA, 19 nt, Haemophilus influenzae Rd
aaucgggcguucuuuaaua

SEQ ID NO: 715257 - RNA, 14 nt, Haemophilus influenzae Rd
aaucggugcaacaa

SEQ ID NO: 715258 - RNA, 20 nt, Haemophilus influenzae Rd
aaucguauucucauuuuaga

SEQ ID NO: 715259 - RNA, 15 nt, Haemophilus influenzae Rd
aaucgucaaaaucau

SEQ ID NO: 715260 - RNA, 23 nt, Haemophilus influenzae Rd
aaucgcugggauuuugucaccaa

SEQ ID NO: 715261 - RNA, 19 nt, Haemophilus influenzae Rd
aaucgccaauucuucagau

SEQ ID NO: 715262 - RNA, 20 nt, Haemophilus influenzae Rd
aaucgcaucgucuuuaccug

SEQ ID NO: 715263 - RNA, 14 nt, Haemophilus influenzae Rd
aaucgcauugcguu

SEQ ID NO: 715264 - RNA, 21 nt, Haemophilus influenzae Rd
aauccuugaaucauuucaucu

SEQ ID NO: 715265 - RNA, 12 nt, Haemophilus influenzae Rd
aauccuucuucg

SEQ ID NO: 715266 - RNA, 19 nt, Haemophilus influenzae Rd
aaucgcccacgaaaagcac

SEQ ID NO: 715267 - RNA, 17 nt, Haemophilus influenzae Rd
aaucuauuccuuucuuu

SEQ ID NO: 715268 - RNA, 15 nt, Haemophilus influenzae Rd
aaucuauuucuuuga

SEQ ID NO: 715269 - RNA, 22 nt, Haemophilus influenzae Rd
aaucuauuucuuugaguaaaaa

SEQ ID NO: 715270 - RNA, 23 nt, Haemophilus influenzae Rd
aaucuauuucuuugaguaaaaaa

SEQ ID NO: 715271 - RNA, 23 nt, Haemophilus influenzae Rd
aaucuaucccaacagaaaauuug

SEQ ID NO: 715272 - RNA, 22 nt, Haemophilus influenzae Rd
aaucugugcaaaguuaccauuu

SEQ ID NO: 715273 - RNA, 19 nt, Haemophilus influenzae Rd
aaucugugccuuaaagcug

SEQ ID NO: 715274 - RNA, 21 nt, Haemophilus influenzae Rd
aaucugucacgagcuaaaaaa

SEQ ID NO: 715275 - RNA, 22 nt, Haemophilus influenzae Rd
aaucugucacgagcuaaaaaau

SEQ ID NO: 715276 - RNA, 15 nt, Haemophilus influenzae Rd
aaucuuaaagaauuu

SEQ ID NO: 715277 - RNA, 19 nt, Haemophilus influenzae Rd
aaucuguuucauuuguuag

SEQ ID NO: 715278 - RNA, 14 nt, Haemophilus influenzae Rd
aaucuuaaauucau

SEQ ID NO: 715279 - RNA, 20 nt, Haemophilus influenzae Rd
aaucuuaacugcaaguccgc

SEQ ID NO: 715280 - RNA, 17 nt, Haemophilus influenzae Rd
aaucuuuuacaccgucc

SEQ ID NO: 715281 - RNA, 16 nt, Haemophilus influenzae Rd
aaucuuacgaagaauc

SEQ ID NO: 715282 - RNA, 23 nt, Haemophilus influenzae Rd
aaucuuacgaagaauccacauuu

SEQ ID NO: 715283 - RNA, 13 nt, Haemophilus influenzae Rd
aaucuuauacaac

SEQ ID NO: 715284 - RNA, 17 nt, Haemophilus influenzae Rd
aaucuuaucaaacacuu

SEQ ID NO: 715285 - RNA, 18 nt, Haemophilus influenzae Rd
aaucuuauuaauaaaaau

SEQ ID NO: 715286 - RNA, 13 nt, Haemophilus influenzae Rd
aaugaaagggaaa

SEQ ID NO: 715287 - RNA, 17 nt, Haemophilus influenzae Rd
aaugaaagggaaauaac

SEQ ID NO: 715288 - RNA, 18 nt, Haemophilus influenzae Rd
aaugaaagggaaauaaca

SEQ ID NO: 715289 - RNA, 20 nt, Haemophilus influenzae Rd
aaugaaagggaaauaacaaa

SEQ ID NO: 715290 - RNA, 23 nt, Haemophilus influenzae Rd
aaugaaagggaaauuuauuauau

SEQ ID NO: 715291 - RNA, 22 nt, Haemophilus influenzae Rd
aaugaaaauaaccgcacuuuag

SEQ ID NO: 715292 - RNA, 18 nt, Haemophilus influenzae Rd
aaugaaaacuaugcucua

SEQ ID NO: 715293 - RNA, 18 nt, Haemophilus influenzae Rd
aaugaaauuucuugcucu

SEQ ID NO: 715294 - RNA, 14 nt, Haemophilus influenzae Rd
aaugaacaaaaaau

SEQ ID NO: 715295 - RNA, 15 nt, Haemophilus influenzae Rd
aaugaacaaaaaauu

SEQ ID NO: 715296 - RNA, 16 nt, Haemophilus influenzae Rd
aaugaaauuauugcuu

SEQ ID NO: 715297 - RNA, 16 nt, Haemophilus influenzae Rd
aaugaaauucagugau

SEQ ID NO: 715298 - RNA, 17 nt, Haemophilus influenzae Rd
aaugaaauucagugauu

SEQ ID NO: 715299 - RNA, 16 nt, Haemophilus influenzae Rd
aaugaauuaaaaguuu

SEQ ID NO: 715300 - RNA, 15 nt, Haemophilus influenzae Rd
aaugaauauaaaauu

SEQ ID NO: 715301 - RNA, 19 nt, Haemophilus influenzae Rd
aaugaauauacucaugagu

SEQ ID NO: 715302 - RNA, 18 nt, Haemophilus influenzae Rd
aaugaauaauuuuuauaa

SEQ ID NO: 715303 - RNA, 17 nt, Haemophilus influenzae Rd
aaugacguaauuugugc

SEQ ID NO: 715304 - RNA, 21 nt, Haemophilus influenzae Rd
aaugagcacgccuaauaccaa

SEQ ID NO: 715305 - RNA, 14 nt, Haemophilus influenzae Rd
aaugagauuauuuc

SEQ ID NO: 715306 - RNA, 20 nt, Haemophilus influenzae Rd
aaugagacuuaaccaaauag

SEQ ID NO: 715307 - RNA, 20 nt, Haemophilus influenzae Rd
aaugauuuuuucagguuggu

SEQ ID NO: 715308 - RNA, 16 nt, Haemophilus influenzae Rd
aaugcagcagcuucuu

SEQ ID NO: 715309 - RNA, 15 nt, Haemophilus influenzae Rd
aaugcaaaaucuuua

SEQ ID NO: 715310 - RNA, 22 nt, Haemophilus influenzae Rd
aaugcaaaccauuuauccauga

SEQ ID NO: 715311 - RNA, 19 nt, Haemophilus influenzae Rd
aaugcaaaguaacuuuaau

SEQ ID NO: 715312 - RNA, 19 nt, Haemophilus influenzae Rd
aaugcaacaauaacugcca

SEQ ID NO: 715313 - RNA, 18 nt, Haemophilus influenzae Rd
aaugcaaccaaacaaaaa

SEQ ID NO: 715314 - RNA, 16 nt, Haemophilus influenzae Rd
aaugaucagcuaaacg

SEQ ID NO: 715315 - RNA, 14 nt, Haemophilus influenzae Rd
aaugaugaaacaag

SEQ ID NO: 715316 - RNA, 19 nt, Haemophilus influenzae Rd
aaugaucgaguaaaaauaa

SEQ ID NO: 715317 - RNA, 17 nt, Haemophilus influenzae Rd
aaugccugcauuaauaa

SEQ ID NO: 715318 - RNA, 13 nt, Haemophilus influenzae Rd
aaugccuguuacg

SEQ ID NO: 715319 - RNA, 19 nt, Haemophilus influenzae Rd
aaugccuugugcauaaaca

SEQ ID NO: 715320 - RNA, 21 nt, Haemophilus influenzae Rd
aaugccuugugcauaaacaaa

SEQ ID NO: 715321 - RNA, 20 nt, Haemophilus influenzae Rd
aaugccuuuccguucauaaa

SEQ ID NO: 715322 - RNA, 18 nt, Haemophilus influenzae Rd
aaugcaucauuaauacac

SEQ ID NO: 715323 - RNA, 20 nt, Haemophilus influenzae Rd
aaugcauugaugacugcauc

SEQ ID NO: 715324 - RNA, 22 nt, Haemophilus influenzae Rd
aaugcauugauugcuaaauaaa

SEQ ID NO: 715325 - RNA, 19 nt, Haemophilus influenzae Rd
aaugcaguaacgcgauaaa

SEQ ID NO: 715326 - RNA, 20 nt, Haemophilus influenzae Rd
aaugcaguaacgcgauaaau

SEQ ID NO: 715327 - RNA, 21 nt, Haemophilus influenzae Rd
aaugcaguaacuucugcugca

SEQ ID NO: 715328 - RNA, 15 nt, Haemophilus influenzae Rd
aaugcaguaauaaau

SEQ ID NO: 715329 - RNA, 18 nt, Haemophilus influenzae Rd
aaugcagccaucaauaaa

SEQ ID NO: 715330 - RNA, 19 nt, Haemophilus influenzae Rd
aaugcagccaucaauaaaa

SEQ ID NO: 715331 - RNA, 20 nt, Haemophilus influenzae Rd
aaugcagccaucaauaaaaa

SEQ ID NO: 715332 - RNA, 21 nt, Haemophilus influenzae Rd
aaugccaccgcgaucuguuuu

SEQ ID NO: 715333 - RNA, 21 nt, Haemophilus influenzae Rd
aauggaggauuagaaaugauc

SEQ ID NO: 715334 - RNA, 21 nt, Haemophilus influenzae Rd
aauggauauagaaaucauaaa

SEQ ID NO: 715335 - RNA, 13 nt, Haemophilus influenzae Rd
aauggcaucaaua

SEQ ID NO: 715336 - RNA, 21 nt, Haemophilus influenzae Rd
aauggcaucaauauuaugugc

SEQ ID NO: 715337 - RNA, 21 nt, Haemophilus influenzae Rd
aauggcccguguuucaauucu

SEQ ID NO: 715338 - RNA, 22 nt, Haemophilus influenzae Rd
aauggcgacggcaucaaaccaa

SEQ ID NO: 715339 - RNA, 23 nt, Haemophilus influenzae Rd
aauggcgacggcaucaaaccaac

SEQ ID NO: 715340 - RNA, 19 nt, Haemophilus influenzae Rd
aaugguuucaguugcuucg

SEQ ID NO: 715341 - RNA, 14 nt, Haemophilus influenzae Rd
aauguaaauuggca

SEQ ID NO: 715342 - RNA, 17 nt, Haemophilus influenzae Rd
aauguaaaauuggguuu

SEQ ID NO: 715343 - RNA, 12 nt, Haemophilus influenzae Rd
aauguaaaaaau

SEQ ID NO: 715344 - RNA, 15 nt, Haemophilus influenzae Rd
aauguaaaaaauaau

SEQ ID NO: 715345 - RNA, 22 nt, Haemophilus influenzae Rd
aauguaaaaauaaccuauaaua

SEQ ID NO: 715346 - RNA, 20 nt, Haemophilus influenzae Rd
aauguaaaaauuggaaaaua

SEQ ID NO: 715347 - RNA, 17 nt, Haemophilus influenzae Rd
aaugguugcauuugcuc

SEQ ID NO: 715348 - RNA, 23 nt, Haemophilus influenzae Rd
aaugguugcauuugcucaauacc

SEQ ID NO: 715349 - RNA, 15 nt, Haemophilus influenzae Rd
aaugguuggaagaaa

SEQ ID NO: 715350 - RNA, 12 nt, Haemophilus influenzae Rd
aaugguuguucu

SEQ ID NO: 715351 - RNA, 15 nt, Haemophilus influenzae Rd
aaugguuuaaauaac

SEQ ID NO: 715352 - RNA, 18 nt, Haemophilus influenzae Rd
aaugguguguaaugucuu

SEQ ID NO: 715353 - RNA, 15 nt, Haemophilus influenzae Rd
aaugguuaauacaaa

SEQ ID NO: 715354 - RNA, 18 nt, Haemophilus influenzae Rd
aaugguuacagaaauauu

SEQ ID NO: 715355 - RNA, 19 nt, Haemophilus influenzae Rd
aaugguuacuuuaucacaa

SEQ ID NO: 715356 - RNA, 15 nt, Haemophilus influenzae Rd
aaugcgugaacugcu

SEQ ID NO: 715357 - RNA, 19 nt, Haemophilus influenzae Rd
aaugcgucgcagccuuguu

SEQ ID NO: 715358 - RNA, 21 nt, Haemophilus influenzae Rd
aaugcgucgcagccuuguucu

SEQ ID NO: 715359 - RNA, 17 nt, Haemophilus influenzae Rd
aaugcuuacaaaauuag

SEQ ID NO: 715360 - RNA, 19 nt, Haemophilus influenzae Rd
aaugcgguaaguucaacac

SEQ ID NO: 715361 - RNA, 13 nt, Haemophilus influenzae Rd
aauggaaaccauu

SEQ ID NO: 715362 - RNA, 20 nt, Haemophilus influenzae Rd
aauggaaaccauugaugaaa

SEQ ID NO: 715363 - RNA, 17 nt, Haemophilus influenzae Rd
aauggaauguagauaau

SEQ ID NO: 715364 - RNA, 20 nt, Haemophilus influenzae Rd
aauggaauucuucuggcaua

SEQ ID NO: 715365 - RNA, 15 nt, Haemophilus influenzae Rd
aaugcuuuugcuuca

SEQ ID NO: 715366 - RNA, 16 nt, Haemophilus influenzae Rd
aaugcuuuugcuucaa

SEQ ID NO: 715367 - RNA, 22 nt, Haemophilus influenzae Rd
aaugcuuuauuuaaauuaaaaa

SEQ ID NO: 715368 - RNA, 15 nt, Haemophilus influenzae Rd
aaugcuuuaaucauu

SEQ ID NO: 715369 - RNA, 15 nt, Haemophilus influenzae Rd
aaugcuuuaauuugu

SEQ ID NO: 715370 - RNA, 15 nt, Haemophilus influenzae Rd
aauugcucuaauuca

SEQ ID NO: 715371 - RNA, 15 nt, Haemophilus influenzae Rd
aauugcucugacacu

SEQ ID NO: 715372 - RNA, 21 nt, Haemophilus influenzae Rd
aauugcuggcuugccaauuca

SEQ ID NO: 715373 - RNA, 19 nt, Haemophilus influenzae Rd
aauugcugggcaauauaaa

SEQ ID NO: 715374 - RNA, 20 nt, Haemophilus influenzae Rd
aauuggcgcaggcaaaccaa

SEQ ID NO: 715375 - RNA, 19 nt, Haemophilus influenzae Rd
aauuggauuugaacguguu

SEQ ID NO: 715376 - RNA, 19 nt, Haemophilus influenzae Rd
aauuggacaagaaauaaua

SEQ ID NO: 715377 - RNA, 13 nt, Haemophilus influenzae Rd
aauuggaaauaau

SEQ ID NO: 715378 - RNA, 18 nt, Haemophilus influenzae Rd
aauugcuuuguuaauuca

SEQ ID NO: 715379 - RNA, 19 nt, Haemophilus influenzae Rd
aauugauggcgugaaauau

SEQ ID NO: 715380 - RNA, 16 nt, Haemophilus influenzae Rd
aauugauguaaaagau

SEQ ID NO: 715381 - RNA, 20 nt, Haemophilus influenzae Rd
aauugauguaaaagauaaaa

SEQ ID NO: 715382 - RNA, 13 nt, Haemophilus influenzae Rd
aauugauuaaaaa

SEQ ID NO: 715383 - RNA, 18 nt, Haemophilus influenzae Rd
aauugaucgaaugauuca

SEQ ID NO: 715384 - RNA, 15 nt, Haemophilus influenzae Rd
aauugaucuaaauua

SEQ ID NO: 715385 - RNA, 21 nt, Haemophilus influenzae Rd
aauugauaccaagauaauaaa

SEQ ID NO: 715386 - RNA, 23 nt, Haemophilus influenzae Rd
aauugaucaagccacugauuaua

SEQ ID NO: 715387 - RNA, 16 nt, Haemophilus influenzae Rd
aauugcaccuucuuuu

SEQ ID NO: 715388 - RNA, 22 nt, Haemophilus influenzae Rd
aauugauuccgauuuuacgauu

SEQ ID NO: 715389 - RNA, 18 nt, Haemophilus influenzae Rd
aauugauucgauaaauua

SEQ ID NO: 715390 - RNA, 14 nt, Haemophilus influenzae Rd
aauugcaauaacca

SEQ ID NO: 715391 - RNA, 14 nt, Haemophilus influenzae Rd
aauugauuuaaaaa

SEQ ID NO: 715392 - RNA, 15 nt, Haemophilus influenzae Rd
aauugauuuaaaaau

SEQ ID NO: 715393 - RNA, 18 nt, Haemophilus influenzae Rd
aauugauuuaaaaaucug

SEQ ID NO: 715394 - RNA, 15 nt, Haemophilus influenzae Rd
aauugauuuuaaaga

SEQ ID NO: 715395 - RNA, 16 nt, Haemophilus influenzae Rd
aauugauuuucagaaa

SEQ ID NO: 715396 - RNA, 14 nt, Haemophilus influenzae Rd
aauugcauuaaaag

SEQ ID NO: 715397 - RNA, 12 nt, Haemophilus influenzae Rd
aauugcauuuuc

SEQ ID NO: 715398 - RNA, 14 nt, Haemophilus influenzae Rd
aauugccaaaaaag

SEQ ID NO: 715399 - RNA, 16 nt, Haemophilus influenzae Rd
aauugcccaauaaaag

SEQ ID NO: 715400 - RNA, 18 nt, Haemophilus influenzae Rd
aauugcccaauaaaagua

SEQ ID NO: 715401 - RNA, 18 nt, Haemophilus influenzae Rd
aauugccgacacuaaaaa

SEQ ID NO: 715402 - RNA, 19 nt, Haemophilus influenzae Rd
aauugccgacacuaaaaag

SEQ ID NO: 715403 - RNA, 16 nt, Haemophilus influenzae Rd
aauugaagaguuugau

SEQ ID NO: 715404 - RNA, 15 nt, Haemophilus influenzae Rd
aauugaaauuuaucu

SEQ ID NO: 715405 - RNA, 11 nt, Haemophilus influenzae Rd
aauugaaaaaa

SEQ ID NO: 715406 - RNA, 18 nt, Haemophilus influenzae Rd
aauugaaaagaaaguauu

SEQ ID NO: 715407 - RNA, 18 nt, Haemophilus influenzae Rd
aauugacaauuaauauaa

SEQ ID NO: 715408 - RNA, 20 nt, Haemophilus influenzae Rd
aauugacuugcacaauuacu

SEQ ID NO: 715409 - RNA, 21 nt, Haemophilus influenzae Rd
aauugacguaaaaguuuuccg

SEQ ID NO: 715410 - RNA, 17 nt, Haemophilus influenzae Rd
aauugagaucuuugcca

SEQ ID NO: 715411 - RNA, 22 nt, Haemophilus influenzae Rd
aauugagcguccacuucuuccg

SEQ ID NO: 715412 - RNA, 18 nt, Haemophilus influenzae Rd
aauugaggauuugccucu

SEQ ID NO: 715413 - RNA, 12 nt, Haemophilus influenzae Rd
aauugagugaau

SEQ ID NO: 715414 - RNA, 22 nt, Haemophilus influenzae Rd
aauugaguguggugaacagcuu

SEQ ID NO: 715415 - RNA, 20 nt, Haemophilus influenzae Rd
aauucuucuauuuuaucaag

SEQ ID NO: 715416 - RNA, 15 nt, Haemophilus influenzae Rd
aauucuucgaaaaua

SEQ ID NO: 715417 - RNA, 16 nt, Haemophilus influenzae Rd
aauucuucuggcauau

SEQ ID NO: 715418 - RNA, 11 nt, Haemophilus influenzae Rd
aauucuuuucu

SEQ ID NO: 715419 - RNA, 19 nt, Haemophilus influenzae Rd
aauucuuuucuuagauaaa

SEQ ID NO: 715420 - RNA, 20 nt, Haemophilus influenzae Rd
aauucuuucacgucaccuac

SEQ ID NO: 715421 - RNA, 9 nt, Haemophilus influenzae Rd
aauucuucc

SEQ ID NO: 715422 - RNA, 16 nt, Haemophilus influenzae Rd
aauucuuccaaaaguu

SEQ ID NO: 715423 - RNA, 11 nt, Haemophilus influenzae Rd
aauucuuccca

SEQ ID NO: 715424 - RNA, 22 nt, Haemophilus influenzae Rd
aauucuucccagcguaaaaaug

SEQ ID NO: 715425 - RNA, 21 nt, Haemophilus influenzae Rd
aauucuuaaaugggaaacuga

SEQ ID NO: 715426 - RNA, 15 nt, Haemophilus influenzae Rd
aauucugcuaaaucu

SEQ ID NO: 715427 - RNA, 17 nt, Haemophilus influenzae Rd
aauucuggugcauuuau

SEQ ID NO: 715428 - RNA, 13 nt, Haemophilus influenzae Rd
aauuuaugcuguu

SEQ ID NO: 715429 - RNA, 19 nt, Haemophilus influenzae Rd
aauuuaugcuguuuuauag

SEQ ID NO: 715430 - RNA, 13 nt, Haemophilus influenzae Rd
aauuuauuaaaaa

SEQ ID NO: 715431 - RNA, 13 nt, Haemophilus influenzae Rd
aauuuauuauaaa

SEQ ID NO: 715432 - RNA, 13 nt, Haemophilus influenzae Rd
aauuuauuauaua

SEQ ID NO: 715433 - RNA, 15 nt, Haemophilus influenzae Rd
aauuuauccaauacu

SEQ ID NO: 715434 - RNA, 19 nt, Haemophilus influenzae Rd
aauuuaucauuaaaacaaa

SEQ ID NO: 715435 - RNA, 13 nt, Haemophilus influenzae Rd
aauuuauucaaaa

SEQ ID NO: 715436 - RNA, 16 nt, Haemophilus influenzae Rd
aauuuauucaaaauaa

SEQ ID NO: 715437 - RNA, 22 nt, Haemophilus influenzae Rd
aauuuauucaaaauaaaaccau

SEQ ID NO: 715438 - RNA, 14 nt, Haemophilus influenzae Rd
aauuuauuauuaca

SEQ ID NO: 715439 - RNA, 16 nt, Haemophilus influenzae Rd
aauuuauuucaucaau

SEQ ID NO: 715440 - RNA, 16 nt, Haemophilus influenzae Rd
aauuuauuuucuaaua

SEQ ID NO: 715441 - RNA, 22 nt, Haemophilus influenzae Rd
aauuuauuuuuuaaaacuuacc

SEQ ID NO: 715442 - RNA, 20 nt, Haemophilus influenzae Rd
aauuucaaagaggccucuac

SEQ ID NO: 715443 - RNA, 19 nt, Haemophilus influenzae Rd
aauuucacguaguuaaacc

SEQ ID NO: 715444 - RNA, 13 nt, Haemophilus influenzae Rd
aauuucaccgcac

SEQ ID NO: 715445 - RNA, 22 nt, Haemophilus influenzae Rd
aauuucaccgcauucuucuuuu

SEQ ID NO: 715446 - RNA, 16 nt, Haemophilus influenzae Rd
aauuucacaauuuuug

SEQ ID NO: 715447 - RNA, 18 nt, Haemophilus influenzae Rd
aauuucaauuaaaucaaa

SEQ ID NO: 715448 - RNA, 16 nt, Haemophilus influenzae Rd
aauuuacucacaacaa

SEQ ID NO: 715449 - RNA, 17 nt, Haemophilus influenzae Rd
aauuuacucacaacaaa

SEQ ID NO: 715450 - RNA, 17 nt, Haemophilus influenzae Rd
aauuuacuguuuaaaua

SEQ ID NO: 715451 - RNA, 20 nt, Haemophilus influenzae Rd
aauuuagaaaaagaaaaccu

SEQ ID NO: 715452 - RNA, 15 nt, Haemophilus influenzae Rd
aauuuaaucaaagua

SEQ ID NO: 715453 - RNA, 14 nt, Haemophilus influenzae Rd
aauuuaauucuaaa

SEQ ID NO: 715454 - RNA, 16 nt, Haemophilus influenzae Rd
aauuuaacugaauuaa

SEQ ID NO: 715455 - RNA, 12 nt, Haemophilus influenzae Rd
aauuuaagaaaa

SEQ ID NO: 715456 - RNA, 18 nt, Haemophilus influenzae Rd
aauuuaagaaaaaauaua

SEQ ID NO: 715457 - RNA, 13 nt, Haemophilus influenzae Rd
aauuuagcuaaac

SEQ ID NO: 715458 - RNA, 21 nt, Haemophilus influenzae Rd
aauuuaggauuuggcacuaaa

SEQ ID NO: 715459 - RNA, 15 nt, Haemophilus influenzae Rd
aauuuagauaacaau

SEQ ID NO: 715460 - RNA, 19 nt, Haemophilus influenzae Rd
aauuuagauacaaagauuu

SEQ ID NO: 715461 - RNA, 15 nt, Haemophilus influenzae Rd
aauuuagcccgaaaa

SEQ ID NO: 715462 - RNA, 17 nt, Haemophilus influenzae Rd
aauuuagucauacagaa

SEQ ID NO: 715463 - RNA, 14 nt, Haemophilus influenzae Rd
aauuuaguccuucu

SEQ ID NO: 715464 - RNA, 23 nt, Haemophilus influenzae Rd
aauuuaguuauaugccuaaaaag

SEQ ID NO: 715465 - RNA, 18 nt, Haemophilus influenzae Rd
aauuuauacuaaauuagu

SEQ ID NO: 715466 - RNA, 16 nt, Haemophilus influenzae Rd
aauuuauauaugauaa

SEQ ID NO: 715467 - RNA, 14 nt, Haemophilus influenzae Rd
aauuuaaauaaagc

SEQ ID NO: 715468 - RNA, 23 nt, Haemophilus influenzae Rd
aauuuaaauaauaaauccaaaua

SEQ ID NO: 715469 - RNA, 12 nt, Haemophilus influenzae Rd
aauuuaaauaua

SEQ ID NO: 715470 - RNA, 14 nt, Haemophilus influenzae Rd
aauuuaaauauaau

SEQ ID NO: 715471 - RNA, 16 nt, Haemophilus influenzae Rd
aauuuaaauauaauuu

SEQ ID NO: 715472 - RNA, 15 nt, Haemophilus influenzae Rd
aauuuaaaugaugaa

SEQ ID NO: 715473 - RNA, 18 nt, Haemophilus influenzae Rd
aauuuaaccacuaaaaaa

SEQ ID NO: 715474 - RNA, 19 nt, Haemophilus influenzae Rd
aauuguugccgccaaucca

SEQ ID NO: 715475 - RNA, 15 nt, Haemophilus influenzae Rd
aauuguuuaaugaaa

SEQ ID NO: 715476 - RNA, 14 nt, Haemophilus influenzae Rd
aauuguugcaccaa

SEQ ID NO: 715477 - RNA, 20 nt, Haemophilus influenzae Rd
aauuguugguuacuaaaugu

SEQ ID NO: 715478 - RNA, 17 nt, Haemophilus influenzae Rd
aauuguucuucuguuaa

SEQ ID NO: 715479 - RNA, 13 nt, Haemophilus influenzae Rd
aauuguuuuaaaa

SEQ ID NO: 715480 - RNA, 15 nt, Haemophilus influenzae Rd
aauuguuugaaauca

SEQ ID NO: 715481 - RNA, 12 nt, Haemophilus influenzae Rd
aauuuaaaaaag

SEQ ID NO: 715482 - RNA, 16 nt, Haemophilus influenzae Rd
aauuuaaaaaguagua

SEQ ID NO: 715483 - RNA, 20 nt, Haemophilus influenzae Rd
aauuuaaaagcaccuaaaau

SEQ ID NO: 715484 - RNA, 16 nt, Haemophilus influenzae Rd
aauugugcuaaauuuu

SEQ ID NO: 715485 - RNA, 13 nt, Haemophilus influenzae Rd
aauuguguaauga

SEQ ID NO: 715486 - RNA, 13 nt, Haemophilus influenzae Rd
aauugugauggaa

SEQ ID NO: 715487 - RNA, 17 nt, Haemophilus influenzae Rd
aauugugauggaaguag

SEQ ID NO: 715488 - RNA, 19 nt, Haemophilus influenzae Rd
aauugucaaaauugaugaa

SEQ ID NO: 715489 - RNA, 20 nt, Haemophilus influenzae Rd
aauuguccgccaucaguaaa

SEQ ID NO: 715490 - RNA, 17 nt, Haemophilus influenzae Rd
aauuguguuggaacguu

SEQ ID NO: 715491 - RNA, 16 nt, Haemophilus influenzae Rd
aauugguguuuaaaug

SEQ ID NO: 715492 - RNA, 20 nt, Haemophilus influenzae Rd
aauugguuaauguaaacaaa

SEQ ID NO: 715493 - RNA, 22 nt, Haemophilus influenzae Rd
aauugguuaauguaaacaaaaa

SEQ ID NO: 715494 - RNA, 17 nt, Haemophilus influenzae Rd
aauugguuuugugcuug

SEQ ID NO: 715495 - RNA, 14 nt, Haemophilus influenzae Rd
aauuguaacuauau

SEQ ID NO: 715496 - RNA, 20 nt, Haemophilus influenzae Rd
aauuccccagcagaguuaau

SEQ ID NO: 715497 - RNA, 21 nt, Haemophilus influenzae Rd
aauucccuagccuuuucuagc

SEQ ID NO: 715498 - RNA, 16 nt, Haemophilus influenzae Rd
aauucaucuucugcug

SEQ ID NO: 715499 - RNA, 19 nt, Haemophilus influenzae Rd
aauucauugacuucuguau

SEQ ID NO: 715500 - RNA, 17 nt, Haemophilus influenzae Rd
aauucauugaguuuagu

SEQ ID NO: 715501 - RNA, 21 nt, Haemophilus influenzae Rd
aauucauugaugcccacuuuu

SEQ ID NO: 715502 - RNA, 15 nt, Haemophilus influenzae Rd
aauucauuuaaaaua

SEQ ID NO: 715503 - RNA, 13 nt, Haemophilus influenzae Rd
aauuccauauuac

SEQ ID NO: 715504 - RNA, 22 nt, Haemophilus influenzae Rd
aauuccaagccauguugaugua

SEQ ID NO: 715505 - RNA, 17 nt, Haemophilus influenzae Rd
aauucaguuaagaaaau

SEQ ID NO: 715506 - RNA, 18 nt, Haemophilus influenzae Rd
aauucaguuaagaaaaua

SEQ ID NO: 715507 - RNA, 12 nt, Haemophilus influenzae Rd
aauucaguucaa

SEQ ID NO: 715508 - RNA, 19 nt, Haemophilus influenzae Rd
aauucaguguaauguuuua

SEQ ID NO: 715509 - RNA, 21 nt, Haemophilus influenzae Rd
aauucaguguaauguuuuaau

SEQ ID NO: 715510 - RNA, 13 nt, Haemophilus influenzae Rd
aauucauaaaaau

SEQ ID NO: 715511 - RNA, 18 nt, Haemophilus influenzae Rd
aauucagggauuaagaaa

SEQ ID NO: 715512 - RNA, 19 nt, Haemophilus influenzae Rd
aauucagggauuaagaaaa

SEQ ID NO: 715513 - RNA, 18 nt, Haemophilus influenzae Rd
aauucaggcucuaacaua

SEQ ID NO: 715514 - RNA, 15 nt, Haemophilus influenzae Rd
aauucaucacaucag

SEQ ID NO: 715515 - RNA, 12 nt, Haemophilus influenzae Rd
aauucaucagaa

SEQ ID NO: 715516 - RNA, 15 nt, Haemophilus influenzae Rd
aauucaucagaaagu

SEQ ID NO: 715517 - RNA, 17 nt, Haemophilus influenzae Rd
aauucaucaaaauuuaa

SEQ ID NO: 715518 - RNA, 22 nt, Haemophilus influenzae Rd
aauucacgcauuuaaauaaaau

SEQ ID NO: 715519 - RNA, 16 nt, Haemophilus influenzae Rd
aauucacgcagaauaa

SEQ ID NO: 715520 - RNA, 23 nt, Haemophilus influenzae Rd
aauucaccgcacuuuuuacuuuu

SEQ ID NO: 715521 - RNA, 11 nt, Haemophilus influenzae Rd
aauucaccaau

SEQ ID NO: 715522 - RNA, 23 nt, Haemophilus influenzae Rd
aauucacuaccucgaauagcaau

SEQ ID NO: 715523 - RNA, 15 nt, Haemophilus influenzae Rd
aauucacucaauuca

SEQ ID NO: 715524 - RNA, 22 nt, Haemophilus influenzae Rd
aauucacugacaucaagcacau

SEQ ID NO: 715525 - RNA, 14 nt, Haemophilus influenzae Rd
aauucacugcaacg

SEQ ID NO: 715526 - RNA, 16 nt, Haemophilus influenzae Rd
aauucagcgagagaau

SEQ ID NO: 715527 - RNA, 21 nt, Haemophilus influenzae Rd
aauucagcgagagaauauuua

SEQ ID NO: 715528 - RNA, 13 nt, Haemophilus influenzae Rd
aauucagcaagaa

SEQ ID NO: 715529 - RNA, 18 nt, Haemophilus influenzae Rd
aauucagcggcuuucuuc

SEQ ID NO: 715530 - RNA, 13 nt, Haemophilus influenzae Rd
aauuccuuuuuaa

SEQ ID NO: 715531 - RNA, 21 nt, Haemophilus influenzae Rd
aauuccuuuuucuacuucuuc

SEQ ID NO: 715532 - RNA, 18 nt, Haemophilus influenzae Rd
aauucgacgauaaccauc

SEQ ID NO: 715533 - RNA, 14 nt, Haemophilus influenzae Rd
aauuccuuccaaca

SEQ ID NO: 715534 - RNA, 15 nt, Haemophilus influenzae Rd
aauuccuuauuuuac

SEQ ID NO: 715535 - RNA, 17 nt, Haemophilus influenzae Rd
aauuccuaaaauacaaa

SEQ ID NO: 715536 - RNA, 16 nt, Haemophilus influenzae Rd
aauucguacaaaugaa

SEQ ID NO: 715537 - RNA, 17 nt, Haemophilus influenzae Rd
aauucgcuuuucuuuug

SEQ ID NO: 715538 - RNA, 18 nt, Haemophilus influenzae Rd
aauucgugcaaauuuuuu

SEQ ID NO: 715539 - RNA, 21 nt, Haemophilus influenzae Rd
aauucgcaaauccuacaacac

SEQ ID NO: 715540 - RNA, 14 nt, Haemophilus influenzae Rd
aauucgcuuccagu

SEQ ID NO: 715541 - RNA, 18 nt, Haemophilus influenzae Rd
aauucgcguuuauuuaac

SEQ ID NO: 715542 - RNA, 21 nt, Haemophilus influenzae Rd
aauucgcguuuauuuaacaau

SEQ ID NO: 715543 - RNA, 19 nt, Haemophilus influenzae Rd
aauucuauauuauuuaagc

SEQ ID NO: 715544 - RNA, 13 nt, Haemophilus influenzae Rd
aauucuauuaaaa

SEQ ID NO: 715545 - RNA, 16 nt, Haemophilus influenzae Rd
aauucuauuaaaauau

SEQ ID NO: 715546 - RNA, 21 nt, Haemophilus influenzae Rd
aauucuauuaaaauauuuccg

SEQ ID NO: 715547 - RNA, 14 nt, Haemophilus influenzae Rd
aauucucauacaaa

SEQ ID NO: 715548 - RNA, 20 nt, Haemophilus influenzae Rd
aauucucuguuucuuuaaau

SEQ ID NO: 715549 - RNA, 20 nt, Haemophilus influenzae Rd
aauucucuuuccacuuuccg

SEQ ID NO: 715550 - RNA, 18 nt, Haemophilus influenzae Rd
aauucguuucuugguuua

SEQ ID NO: 715551 - RNA, 19 nt, Haemophilus influenzae Rd
aauucuaagguuaugccaa

SEQ ID NO: 715552 - RNA, 16 nt, Haemophilus influenzae Rd
aauucuaguucuuccc

SEQ ID NO: 715553 - RNA, 17 nt, Haemophilus influenzae Rd
aauucuaguucuucccc

SEQ ID NO: 715554 - RNA, 18 nt, Haemophilus influenzae Rd
aauucuaguucuuccccu

SEQ ID NO: 715555 - RNA, 20 nt, Haemophilus influenzae Rd
aauucuaguucuuccccuca

SEQ ID NO: 715556 - RNA, 19 nt, Haemophilus influenzae Rd
aauuaaugucgcauuugua

SEQ ID NO: 715557 - RNA, 16 nt, Haemophilus influenzae Rd
aauuaaccgcacuuuu

SEQ ID NO: 715558 - RNA, 14 nt, Haemophilus influenzae Rd
aauuaauugcucug

SEQ ID NO: 715559 - RNA, 18 nt, Haemophilus influenzae Rd
aauuaauucguccauucu

SEQ ID NO: 715560 - RNA, 18 nt, Haemophilus influenzae Rd
aauuaauucucauacaaa

SEQ ID NO: 715561 - RNA, 23 nt, Haemophilus influenzae Rd
aauuaauucgaucagcacgauaa

SEQ ID NO: 715562 - RNA, 15 nt, Haemophilus influenzae Rd
aauuacaaaaccaau

SEQ ID NO: 715563 - RNA, 16 nt, Haemophilus influenzae Rd
aauuacaaaaccaauc

SEQ ID NO: 715564 - RNA, 17 nt, Haemophilus influenzae Rd
aauuaauuuauaaauua

SEQ ID NO: 715565 - RNA, 17 nt, Haemophilus influenzae Rd
aauguagagauaauaaa

SEQ ID NO: 715566 - RNA, 21 nt, Haemophilus influenzae Rd
aauguagagauaauaaauaua

SEQ ID NO: 715567 - RNA, 22 nt, Haemophilus influenzae Rd
aauguaccacgguugauaccaa

SEQ ID NO: 715568 - RNA, 18 nt, Haemophilus influenzae Rd
aauuaaauuguaacuaua

SEQ ID NO: 715569 - RNA, 12 nt, Haemophilus influenzae Rd
aauuaacaauau

SEQ ID NO: 715570 - RNA, 16 nt, Haemophilus influenzae Rd
aauguagauaaugaua

SEQ ID NO: 715571 - RNA, 15 nt, Haemophilus influenzae Rd
aauuaaauucauuua

SEQ ID NO: 715572 - RNA, 20 nt, Haemophilus influenzae Rd
aauuaaauucauuuaaaaua

SEQ ID NO: 715573 - RNA, 19 nt, Haemophilus influenzae Rd
aauuacuggcguagcugca

SEQ ID NO: 715574 - RNA, 14 nt, Haemophilus influenzae Rd
aauuacuauauagu

SEQ ID NO: 715575 - RNA, 15 nt, Haemophilus influenzae Rd
aauuacguagauaau

SEQ ID NO: 715576 - RNA, 16 nt, Haemophilus influenzae Rd
aauuacgccugcaaau

SEQ ID NO: 715577 - RNA, 19 nt, Haemophilus influenzae Rd
aauuacgccugcaaauaag

SEQ ID NO: 715578 - RNA, 18 nt, Haemophilus influenzae Rd
aauuacgccugcccaagu

SEQ ID NO: 715579 - RNA, 20 nt, Haemophilus influenzae Rd
aauuagcuaaauacuugcuu

SEQ ID NO: 715580 - RNA, 23 nt, Haemophilus influenzae Rd
aauuagcgauuaaagucccaaaa

SEQ ID NO: 715581 - RNA, 19 nt, Haemophilus influenzae Rd
aauuaggcgaugaucauaa

SEQ ID NO: 715582 - RNA, 14 nt, Haemophilus influenzae Rd
aauuagguuuugua

SEQ ID NO: 715583 - RNA, 13 nt, Haemophilus influenzae Rd
aauuauagagaaa

SEQ ID NO: 715584 - RNA, 17 nt, Haemophilus influenzae Rd
aauuauagagaaauaau

SEQ ID NO: 715585 - RNA, 20 nt, Haemophilus influenzae Rd
aauuauagauaaauaucaaa

SEQ ID NO: 715586 - RNA, 23 nt, Haemophilus influenzae Rd
aauuauagauaaauaucaaaauu

SEQ ID NO: 715587 - RNA, 22 nt, Haemophilus influenzae Rd
aauuagccuuucuggcucugcu

SEQ ID NO: 715588 - RNA, 21 nt, Haemophilus influenzae Rd
aauuacuuaauuaaauaaaca

SEQ ID NO: 715589 - RNA, 21 nt, Haemophilus influenzae Rd
aauuagauaauacagaaauau

SEQ ID NO: 715590 - RNA, 22 nt, Haemophilus influenzae Rd
aauuagaucauaaaaaaaugua

SEQ ID NO: 715591 - RNA, 19 nt, Haemophilus influenzae Rd
aauuagaugacuggcaaaa

SEQ ID NO: 715592 - RNA, 20 nt, Haemophilus influenzae Rd
aauuagaugacuggcaaaaa

SEQ ID NO: 715593 - RNA, 19 nt, Haemophilus influenzae Rd
aauuagaugauuuuaaaau

SEQ ID NO: 715594 - RNA, 22 nt, Haemophilus influenzae Rd
aauuagaugauuuuaaaauaaa

SEQ ID NO: 715595 - RNA, 19 nt, Haemophilus influenzae Rd
aauuagaugauuuuaaagu

SEQ ID NO: 715596 - RNA, 21 nt, Haemophilus influenzae Rd
aauucaauggcuuauugcuau

SEQ ID NO: 715597 - RNA, 18 nt, Haemophilus influenzae Rd
aauucaagaugauauuua

SEQ ID NO: 715598 - RNA, 19 nt, Haemophilus influenzae Rd
aauucaagcaaauauuuag

SEQ ID NO: 715599 - RNA, 21 nt, Haemophilus influenzae Rd
aauucaauagguuauaaguuu

SEQ ID NO: 715600 - RNA, 17 nt, Haemophilus influenzae Rd
aauucaaaucuugacau

SEQ ID NO: 715601 - RNA, 15 nt, Haemophilus influenzae Rd
aauucaacacgccua

SEQ ID NO: 715602 - RNA, 21 nt, Haemophilus influenzae Rd
aauucaaaacggucagucacu

SEQ ID NO: 715603 - RNA, 19 nt, Haemophilus influenzae Rd
aauucaaagauuauuuaau

SEQ ID NO: 715604 - RNA, 20 nt, Haemophilus influenzae Rd
aauucaaagauuuuaaaauu

SEQ ID NO: 715605 - RNA, 13 nt, Haemophilus influenzae Rd
aauucaaagcgau

SEQ ID NO: 715606 - RNA, 12 nt, Haemophilus influenzae Rd
aauucaaaaacc

SEQ ID NO: 715607 - RNA, 15 nt, Haemophilus influenzae Rd
aauucaaaaaccaaa

SEQ ID NO: 715608 - RNA, 16 nt, Haemophilus influenzae Rd
aauucaaaaaccaaac

SEQ ID NO: 715609 - RNA, 15 nt, Haemophilus influenzae Rd
aauuauugucuuuuc

SEQ ID NO: 715610 - RNA, 22 nt, Haemophilus influenzae Rd
aauuauuuaaacuugaauaaua

SEQ ID NO: 715611 - RNA, 13 nt, Haemophilus influenzae Rd
aauuauuuaaauc

SEQ ID NO: 715612 - RNA, 15 nt, Haemophilus influenzae Rd
aauuauuuauacuaa

SEQ ID NO: 715613 - RNA, 18 nt, Haemophilus influenzae Rd
aauuauugcuuaugauuu

SEQ ID NO: 715614 - RNA, 18 nt, Haemophilus influenzae Rd
aauuauucuucaucuucu

SEQ ID NO: 715615 - RNA, 15 nt, Haemophilus influenzae Rd
aauuauuugacuuau

SEQ ID NO: 715616 - RNA, 15 nt, Haemophilus influenzae Rd
aauuaucaauguuug

SEQ ID NO: 715617 - RNA, 21 nt, Haemophilus influenzae Rd
aauuaucaaaagaaaagauga

SEQ ID NO: 715618 - RNA, 23 nt, Haemophilus influenzae Rd
aauuaucaaaagaaaagaugaau

SEQ ID NO: 715619 - RNA, 14 nt, Haemophilus influenzae Rd
aauuaucaucauuu

SEQ ID NO: 715620 - RNA, 16 nt, Haemophilus influenzae Rd
aauuauaggcuauaaa

SEQ ID NO: 715621 - RNA, 21 nt, Haemophilus influenzae Rd
aauuauaggcuauaaagagau

SEQ ID NO: 715622 - RNA, 21 nt, Haemophilus influenzae Rd
aauuauguuaaauugcaaaaa

SEQ ID NO: 715623 - RNA, 20 nt, Haemophilus influenzae Rd
aauuauguuuacggaugcaa

SEQ ID NO: 715624 - RNA, 21 nt, Haemophilus influenzae Rd
aauuauguuuuaucuuuaccc

SEQ ID NO: 715625 - RNA, 15 nt, Haemophilus influenzae Rd
aauuauggugaauaa

SEQ ID NO: 715626 - RNA, 14 nt, Haemophilus influenzae Rd
aauuauguauuuua

SEQ ID NO: 715627 - RNA, 19 nt, Haemophilus influenzae Rd
aaguucccaaagucuuaau

SEQ ID NO: 715628 - RNA, 15 nt, Haemophilus influenzae Rd
aaguucauauaaaua

SEQ ID NO: 715629 - RNA, 17 nt, Haemophilus influenzae Rd
aaguucauauaaauaag

SEQ ID NO: 715630 - RNA, 13 nt, Haemophilus influenzae Rd
aaguucaucaacu

SEQ ID NO: 715631 - RNA, 16 nt, Haemophilus influenzae Rd
aaguucaucauaaauu

SEQ ID NO: 715632 - RNA, 14 nt, Haemophilus influenzae Rd
aaguugauaaucau

SEQ ID NO: 715633 - RNA, 15 nt, Haemophilus influenzae Rd
aaguugauauucacu

SEQ ID NO: 715634 - RNA, 10 nt, Haemophilus influenzae Rd
aauaaaguug

SEQ ID NO: 715635 - RNA, 13 nt, Haemophilus influenzae Rd
aauaaauaaaaua

SEQ ID NO: 715636 - RNA, 16 nt, Haemophilus influenzae Rd
aauaaauagauacaag

SEQ ID NO: 715637 - RNA, 19 nt, Haemophilus influenzae Rd
aauaaauagauacaagaaa

SEQ ID NO: 715638 - RNA, 23 nt, Haemophilus influenzae Rd
aauaaauagauacaagaaagaaa

SEQ ID NO: 715639 - RNA, 16 nt, Haemophilus influenzae Rd
aauaaaucaaaagaau

SEQ ID NO: 715640 - RNA, 21 nt, Haemophilus influenzae Rd
aauaaauauucugcauuaaau

SEQ ID NO: 715641 - RNA, 11 nt, Haemophilus influenzae Rd
aauaaaucaag

SEQ ID NO: 715642 - RNA, 12 nt, Haemophilus influenzae Rd
aauaaauauaau

SEQ ID NO: 715643 - RNA, 16 nt, Haemophilus influenzae Rd
aauaaauauuauuaaa

SEQ ID NO: 715644 - RNA, 21 nt, Haemophilus influenzae Rd
aauaaauauuauuaaaaacua

SEQ ID NO: 715645 - RNA, 15 nt, Haemophilus influenzae Rd
aauaaauauguugaa

SEQ ID NO: 715646 - RNA, 22 nt, Haemophilus influenzae Rd
aauaaauauguugaauaguaaa

SEQ ID NO: 715647 - RNA, 18 nt, Haemophilus influenzae Rd
aauaaaugcgucgcagcc

SEQ ID NO: 715648 - RNA, 22 nt, Haemophilus influenzae Rd
aauaaaugauguaggcaaaaac

SEQ ID NO: 715649 - RNA, 23 nt, Haemophilus influenzae Rd
aauaaaugauguaggcaaaaaca

SEQ ID NO: 715650 - RNA, 21 nt, Haemophilus influenzae Rd
aauaaaugcaucauuaauaca

SEQ ID NO: 715651 - RNA, 23 nt, Haemophilus influenzae Rd
aauaaaugcaucauuaauacaca

SEQ ID NO: 715652 - RNA, 23 nt, Haemophilus influenzae Rd
aauaaauccuucaggauaaaaca

SEQ ID NO: 715653 - RNA, 22 nt, Haemophilus influenzae Rd
aauaaaucccaauagguuugua

SEQ ID NO: 715654 - RNA, 15 nt, Haemophilus influenzae Rd
aauaaauuaaaaaaa

SEQ ID NO: 715655 - RNA, 20 nt, Haemophilus influenzae Rd
aauaaauuaacuuaucuaaa

SEQ ID NO: 715656 - RNA, 19 nt, Haemophilus influenzae Rd
aauaaauugaauaucuaaa

SEQ ID NO: 715657 - RNA, 21 nt, Haemophilus influenzae Rd
aauaacaaaagggcgauuaaa

SEQ ID NO: 715658 - RNA, 22 nt, Haemophilus influenzae Rd
aauaaauuuuucgccuaauuca

SEQ ID NO: 715659 - RNA, 12 nt, Haemophilus influenzae Rd
aauaaauuuuuu

SEQ ID NO: 715660 - RNA, 14 nt, Haemophilus influenzae Rd
aauaacaacaaaag

SEQ ID NO: 715661 - RNA, 17 nt, Haemophilus influenzae Rd
aauaacacagaaaccaa

SEQ ID NO: 715662 - RNA, 18 nt, Haemophilus influenzae Rd
aauaacacagaaaccaau

SEQ ID NO: 715663 - RNA, 13 nt, Haemophilus influenzae Rd
aauaacaagcaca

SEQ ID NO: 715664 - RNA, 24 nt, Haemophilus influenzae Rd
aauaacaagcacaagauuugccaa

SEQ ID NO: 715665 - RNA, 13 nt, Haemophilus influenzae Rd
aauaacaagcuca

SEQ ID NO: 715666 - RNA, 17 nt, Haemophilus influenzae Rd
aauaacaagcucagguu

SEQ ID NO: 715667 - RNA, 21 nt, Haemophilus influenzae Rd
aauaaauuuauuuaauaauau

SEQ ID NO: 715668 - RNA, 23 nt, Haemophilus influenzae Rd
aauaaauuuauuuaauaauauca

SEQ ID NO: 715669 - RNA, 13 nt, Haemophilus influenzae Rd
aauaaauuuuaaa

SEQ ID NO: 715670 - RNA, 17 nt, Haemophilus influenzae Rd
aauaaauuuuaaaaucu

SEQ ID NO: 715671 - RNA, 12 nt, Haemophilus influenzae Rd
aauaaauuuuau

SEQ ID NO: 715672 - RNA, 20 nt, Haemophilus influenzae Rd
aauaaauuuugcccucuuuu

SEQ ID NO: 715673 - RNA, 22 nt, Haemophilus influenzae Rd
aauaacgcaucaccacaaaaua

SEQ ID NO: 715674 - RNA, 19 nt, Haemophilus influenzae Rd
aauaacgauaagauuugcu

SEQ ID NO: 715675 - RNA, 18 nt, Haemophilus influenzae Rd
aauaaccucgaaucacac

SEQ ID NO: 715676 - RNA, 18 nt, Haemophilus influenzae Rd
aauaaccuuaaaucaaac

SEQ ID NO: 715677 - RNA, 19 nt, Haemophilus influenzae Rd
aauaaccuuaaaucaaaca

SEQ ID NO: 715678 - RNA, 16 nt, Haemophilus influenzae Rd
aauaaccuugcugaua

SEQ ID NO: 715679 - RNA, 18 nt, Haemophilus influenzae Rd
aauaaccuugcugauaaa

SEQ ID NO: 715680 - RNA, 23 nt, Haemophilus influenzae Rd
aauaacacucauuguaaagccca

SEQ ID NO: 715681 - RNA, 15 nt, Haemophilus influenzae Rd
aauaaccacgccuuc

SEQ ID NO: 715682 - RNA, 20 nt, Haemophilus influenzae Rd
aauaaccacuccaaauaaua

SEQ ID NO: 715683 - RNA, 17 nt, Haemophilus influenzae Rd
aauaaccaauaacgaua

SEQ ID NO: 715684 - RNA, 14 nt, Haemophilus influenzae Rd
aauaacucaagcaa

SEQ ID NO: 715685 - RNA, 14 nt, Haemophilus influenzae Rd
aauaacugccacau

SEQ ID NO: 715686 - RNA, 18 nt, Haemophilus influenzae Rd
aauaacugauuuugaguu

SEQ ID NO: 715687 - RNA, 16 nt, Haemophilus influenzae Rd
aauaacugaauaauuu

SEQ ID NO: 715688 - RNA, 15 nt, Haemophilus influenzae Rd
aauaacgucauuaau

SEQ ID NO: 715689 - RNA, 23 nt, Haemophilus influenzae Rd
aauaacgucauuaauuuuuucac

SEQ ID NO: 715690 - RNA, 17 nt, Haemophilus influenzae Rd
aauaacgcucauaagca

SEQ ID NO: 715691 - RNA, 17 nt, Haemophilus influenzae Rd
aauaacuacaacacaga

SEQ ID NO: 715692 - RNA, 20 nt, Haemophilus influenzae Rd
aauaacguuacuaaaauccu

SEQ ID NO: 715693 - RNA, 14 nt, Haemophilus influenzae Rd
aauaacuaaaaaua

SEQ ID NO: 715694 - RNA, 14 nt, Haemophilus influenzae Rd
aauaagaauuuuaa

SEQ ID NO: 715695 - RNA, 15 nt, Haemophilus influenzae Rd
aauaagaauuuuaau

SEQ ID NO: 715696 - RNA, 21 nt, Haemophilus influenzae Rd
aauaagcaacgcaucgcccaa

SEQ ID NO: 715697 - RNA, 19 nt, Haemophilus influenzae Rd
aauaagcaaguaauuuaaa

SEQ ID NO: 715698 - RNA, 23 nt, Haemophilus influenzae Rd
aauaagcaaguaauuuaaaaagu

SEQ ID NO: 715699 - RNA, 19 nt, Haemophilus influenzae Rd
aauaagcaauccuaagaau

SEQ ID NO: 715700 - RNA, 14 nt, Haemophilus influenzae Rd
aauaacuuuauuua

SEQ ID NO: 715701 - RNA, 18 nt, Haemophilus influenzae Rd
aauaagaaugucagguuu

SEQ ID NO: 715702 - RNA, 23 nt, Haemophilus influenzae Rd
aauaauauuugguguauuuauaa

SEQ ID NO: 715703 - RNA, 12 nt, Haemophilus influenzae Rd
aauaauauucaa

SEQ ID NO: 715704 - RNA, 16 nt, Haemophilus influenzae Rd
aauaauauuaaagaaa

SEQ ID NO: 715705 - RNA, 19 nt, Haemophilus influenzae Rd
aauaauauuaaagaaaaua

SEQ ID NO: 715706 - RNA, 21 nt, Haemophilus influenzae Rd
aauaauauaggcgaacaaaag

SEQ ID NO: 715707 - RNA, 11 nt, Haemophilus influenzae Rd
aauaauaucaa

SEQ ID NO: 715708 - RNA, 18 nt, Haemophilus influenzae Rd
aauaaucaggauauuuua

SEQ ID NO: 715709 - RNA, 23 nt, Haemophilus influenzae Rd
aauaaucacuugauaaaaaugag

SEQ ID NO: 715710 - RNA, 12 nt, Haemophilus influenzae Rd
aauaaucaaauc

SEQ ID NO: 715711 - RNA, 21 nt, Haemophilus influenzae Rd
aauaaucacaacaaaccagcc

SEQ ID NO: 715712 - RNA, 18 nt, Haemophilus influenzae Rd
aauaaucacaauuuuuaa

SEQ ID NO: 715713 - RNA, 13 nt, Haemophilus influenzae Rd
aauaauaaauugg

SEQ ID NO: 715714 - RNA, 16 nt, Haemophilus influenzae Rd
aauaauaagauuuuug

SEQ ID NO: 715715 - RNA, 19 nt, Haemophilus influenzae Rd
aauaauaggcgaaucaaaa

SEQ ID NO: 715716 - RNA, 20 nt, Haemophilus influenzae Rd
aauaauaggcgaaucaaaau

SEQ ID NO: 715717 - RNA, 14 nt, Haemophilus influenzae Rd
aauaauagacauaa

SEQ ID NO: 715718 - RNA, 16 nt, Haemophilus influenzae Rd
aauaauagccauaucc

SEQ ID NO: 715719 - RNA, 18 nt, Haemophilus influenzae Rd
aauaauacguucguaacu

SEQ ID NO: 715720 - RNA, 15 nt, Haemophilus influenzae Rd
aauaagcauaaaagu

SEQ ID NO: 715721 - RNA, 21 nt, Haemophilus influenzae Rd
aauaagccaaucauugcuaaa

SEQ ID NO: 715722 - RNA, 16 nt, Haemophilus influenzae Rd
aauaagcgaaaaacau

SEQ ID NO: 715723 - RNA, 17 nt, Haemophilus influenzae Rd
aauaagcgaaaaacaua

SEQ ID NO: 715724 - RNA, 18 nt, Haemophilus influenzae Rd
aauaaggcuagauaacac

SEQ ID NO: 715725 - RNA, 20 nt, Haemophilus influenzae Rd
aauaagcuaaguacaaaaga

SEQ ID NO: 715726 - RNA, 21 nt, Haemophilus influenzae Rd
aauaagcuaaguacaaaagag

SEQ ID NO: 715727 - RNA, 16 nt, Haemophilus influenzae Rd
aauaaguaguuaccau

SEQ ID NO: 715728 - RNA, 22 nt, Haemophilus influenzae Rd
aauaagggcugauuuuaaauau

SEQ ID NO: 715729 - RNA, 11 nt, Haemophilus influenzae Rd
aauaauaaaaa

SEQ ID NO: 715730 - RNA, 15 nt, Haemophilus influenzae Rd
aauaaguuuucauca

SEQ ID NO: 715731 - RNA, 22 nt, Haemophilus influenzae Rd
aauaauguugcugauugcacau

SEQ ID NO: 715732 - RNA, 16 nt, Haemophilus influenzae Rd
aauaauguuuucauua

SEQ ID NO: 715733 - RNA, 18 nt, Haemophilus influenzae Rd
aauaauguuuucauuaau

SEQ ID NO: 715734 - RNA, 13 nt, Haemophilus influenzae Rd
aauaauuaaaaau

SEQ ID NO: 715735 - RNA, 14 nt, Haemophilus influenzae Rd
aauaauuaaaaaua

SEQ ID NO: 715736 - RNA, 17 nt, Haemophilus influenzae Rd
aauaauuaaaaauaaau

SEQ ID NO: 715737 - RNA, 19 nt, Haemophilus influenzae Rd
aauaauuaaaucuucgccu

SEQ ID NO: 715738 - RNA, 11 nt, Haemophilus influenzae Rd
aauaauguuuu

SEQ ID NO: 715739 - RNA, 14 nt, Haemophilus influenzae Rd
aauaauuaaacuuu

SEQ ID NO: 715740 - RNA, 13 nt, Haemophilus influenzae Rd
aauaauuaagaaa

SEQ ID NO: 715741 - RNA, 15 nt, Haemophilus influenzae Rd
aauaauugaagcaau

SEQ ID NO: 715742 - RNA, 23 nt, Haemophilus influenzae Rd
aauaauucauguuuuuuagauuu

SEQ ID NO: 715743 - RNA, 20 nt, Haemophilus influenzae Rd
aauaauuauggugaauaaaa

SEQ ID NO: 715744 - RNA, 24 nt, Haemophilus influenzae Rd
aauaauuauuauccuauaguagaa

SEQ ID NO: 715745 - RNA, 22 nt, Haemophilus influenzae Rd
aauaauucaagaugauauuuaa

SEQ ID NO: 715746 - RNA, 11 nt, Haemophilus influenzae Rd
aauaauucagc

SEQ ID NO: 715747 - RNA, 14 nt, Haemophilus influenzae Rd
aauaauugaugcua

SEQ ID NO: 715748 - RNA, 17 nt, Haemophilus influenzae Rd
aauaaugccucaucuuu

SEQ ID NO: 715749 - RNA, 18 nt, Haemophilus influenzae Rd
aauaaugcuaauuucaaa

SEQ ID NO: 715750 - RNA, 19 nt, Haemophilus influenzae Rd
aauaaugcuaauuucaaac

SEQ ID NO: 715751 - RNA, 18 nt, Haemophilus influenzae Rd
aauaaugcccgcacuuuu

SEQ ID NO: 715752 - RNA, 17 nt, Haemophilus influenzae Rd
aauaaugcauagccaag

SEQ ID NO: 715753 - RNA, 21 nt, Haemophilus influenzae Rd
aauaaugccaagaaagucauu

SEQ ID NO: 715754 - RNA, 18 nt, Haemophilus influenzae Rd
aauaaugaauaauuuuua

SEQ ID NO: 715755 - RNA, 18 nt, Haemophilus influenzae Rd
aauaaugaauauauucau

SEQ ID NO: 715756 - RNA, 16 nt, Haemophilus influenzae Rd
aauaaucuucuuccca

SEQ ID NO: 715757 - RNA, 17 nt, Haemophilus influenzae Rd
aauaauccccuaaacua

SEQ ID NO: 715758 - RNA, 17 nt, Haemophilus influenzae Rd
aauaauccucuuuaaaa

SEQ ID NO: 715759 - RNA, 18 nt, Haemophilus influenzae Rd
aauaauccucuuuaaaau

SEQ ID NO: 715760 - RNA, 19 nt, Haemophilus influenzae Rd
aauaauccucuuuaaaauu

SEQ ID NO: 715761 - RNA, 15 nt, Haemophilus influenzae Rd
aauaaucgaaaaagu

SEQ ID NO: 715762 - RNA, 13 nt, Haemophilus influenzae Rd
aauacauuuuuau

SEQ ID NO: 715763 - RNA, 21 nt, Haemophilus influenzae Rd
aauaccacuccccaaaaacca

SEQ ID NO: 715764 - RNA, 13 nt, Haemophilus influenzae Rd
aauaauuuccuuu

SEQ ID NO: 715765 - RNA, 23 nt, Haemophilus influenzae Rd
aauaauuuccuuuccuugacaua

SEQ ID NO: 715766 - RNA, 22 nt, Haemophilus influenzae Rd
aauaauuuccuuuuuuauuuau

SEQ ID NO: 715767 - RNA, 18 nt, Haemophilus influenzae Rd
aauaauuuucauugaaaa

SEQ ID NO: 715768 - RNA, 19 nt, Haemophilus influenzae Rd
aauaauuuuacuugugcau

SEQ ID NO: 715769 - RNA, 18 nt, Haemophilus influenzae Rd
aauaauuuuuugaauaug

SEQ ID NO: 715770 - RNA, 15 nt, Haemophilus influenzae Rd
aauaauuuuguuacu

SEQ ID NO: 715771 - RNA, 17 nt, Haemophilus influenzae Rd
aauaauuuuuaauucuu

SEQ ID NO: 715772 - RNA, 19 nt, Haemophilus influenzae Rd
aauaauuuuuaauucuuuu

SEQ ID NO: 715773 - RNA, 20 nt, Haemophilus influenzae Rd
aauaauuuuuaauucuuuuu

SEQ ID NO: 715774 - RNA, 17 nt, Haemophilus influenzae Rd
aauacgcggcggaacag

SEQ ID NO: 715775 - RNA, 15 nt, Haemophilus influenzae Rd
aauacgccaagauaa

SEQ ID NO: 715776 - RNA, 17 nt, Haemophilus influenzae Rd
aauaccgcuugcaacca

SEQ ID NO: 715777 - RNA, 18 nt, Haemophilus influenzae Rd
aauaccgcacuuuggcaa

SEQ ID NO: 715778 - RNA, 21 nt, Haemophilus influenzae Rd
aauaccgcagcagguuuuccu

SEQ ID NO: 715779 - RNA, 15 nt, Haemophilus influenzae Rd
aauagcacagccaag

SEQ ID NO: 715780 - RNA, 17 nt, Haemophilus influenzae Rd
aauagauuuaauaucuu

SEQ ID NO: 715781 - RNA, 13 nt, Haemophilus influenzae Rd
aauagauuugcuc

SEQ ID NO: 715782 - RNA, 21 nt, Haemophilus influenzae Rd
aauagauuacguagaaaacaa

SEQ ID NO: 715783 - RNA, 23 nt, Haemophilus influenzae Rd
aauagauuacguagaaaacaaua

SEQ ID NO: 715784 - RNA, 17 nt, Haemophilus influenzae Rd
aauagauccgcaauaua

SEQ ID NO: 715785 - RNA, 13 nt, Haemophilus influenzae Rd
aauagauucuugc

SEQ ID NO: 715786 - RNA, 13 nt, Haemophilus influenzae Rd
aauagaugaaauu

SEQ ID NO: 715787 - RNA, 22 nt, Haemophilus influenzae Rd
aauagaugaaauuuauuauaaa

SEQ ID NO: 715788 - RNA, 19 nt, Haemophilus influenzae Rd
aauacuuuuagcuccuaaa

SEQ ID NO: 715789 - RNA, 22 nt, Haemophilus influenzae Rd
aauacuuuucccaaugcaccaa

SEQ ID NO: 715790 - RNA, 22 nt, Haemophilus influenzae Rd
aauagaaaguggcuuaauuuau

SEQ ID NO: 715791 - RNA, 24 nt, Haemophilus influenzae Rd
aauagaaaguggcuuaauuuauua

SEQ ID NO: 715792 - RNA, 19 nt, Haemophilus influenzae Rd
aauacugcgacuuucccug

SEQ ID NO: 715793 - RNA, 11 nt, Haemophilus influenzae Rd
aauacugcacc

SEQ ID NO: 715794 - RNA, 22 nt, Haemophilus influenzae Rd
aauacugcaccguauucuuuac

SEQ ID NO: 715795 - RNA, 20 nt, Haemophilus influenzae Rd
aauacugcugaauaaaccua

SEQ ID NO: 715796 - RNA, 19 nt, Haemophilus influenzae Rd
aauacugucacaauauuug

SEQ ID NO: 715797 - RNA, 13 nt, Haemophilus influenzae Rd
aauacugauaccg

SEQ ID NO: 715798 - RNA, 15 nt, Haemophilus influenzae Rd
aauacucuuaacaaa

SEQ ID NO: 715799 - RNA, 16 nt, Haemophilus influenzae Rd
aauacucuuaacaaaa

SEQ ID NO: 715800 - RNA, 18 nt, Haemophilus influenzae Rd
aauacucuuaacaaaaca

SEQ ID NO: 715801 - RNA, 18 nt, Haemophilus influenzae Rd
aauaucagcccuuuguuu

SEQ ID NO: 715802 - RNA, 15 nt, Haemophilus influenzae Rd
aauauauaaauccgu

SEQ ID NO: 715803 - RNA, 17 nt, Haemophilus influenzae Rd
aauauaggguaaauaaa

SEQ ID NO: 715804 - RNA, 18 nt, Haemophilus influenzae Rd
aauauaggguaaauaaaa

SEQ ID NO: 715805 - RNA, 21 nt, Haemophilus influenzae Rd
aauauaggguaaauaaaaaug

SEQ ID NO: 715806 - RNA, 12 nt, Haemophilus influenzae Rd
aauauagucaaa

SEQ ID NO: 715807 - RNA, 13 nt, Haemophilus influenzae Rd
aauauagucaaau

SEQ ID NO: 715808 - RNA, 20 nt, Haemophilus influenzae Rd
aauaucauggcgaccauucu

SEQ ID NO: 715809 - RNA, 14 nt, Haemophilus influenzae Rd
aauauccaaaaugu

SEQ ID NO: 715810 - RNA, 16 nt, Haemophilus influenzae Rd
aauauccaaaauguuc

SEQ ID NO: 715811 - RNA, 12 nt, Haemophilus influenzae Rd
aauauccaaugu

SEQ ID NO: 715812 - RNA, 17 nt, Haemophilus influenzae Rd
aauauccacauaaccaa

SEQ ID NO: 715813 - RNA, 23 nt, Haemophilus influenzae Rd
aauaugcgcuucaucaaauugau

SEQ ID NO: 715814 - RNA, 17 nt, Haemophilus influenzae Rd
aauaugcauucaaauuu

SEQ ID NO: 715815 - RNA, 15 nt, Haemophilus influenzae Rd
aauaugccaaauaaa

SEQ ID NO: 715816 - RNA, 19 nt, Haemophilus influenzae Rd
aauaugccaaauaaaauua

SEQ ID NO: 715817 - RNA, 14 nt, Haemophilus influenzae Rd
aauaugcugacaaa

SEQ ID NO: 715818 - RNA, 17 nt, Haemophilus influenzae Rd
aauaugcguugaugcaa

SEQ ID NO: 715819 - RNA, 14 nt, Haemophilus influenzae Rd
aauauggaaaugcu

SEQ ID NO: 715820 - RNA, 17 nt, Haemophilus influenzae Rd
aauauccguuacauauu

SEQ ID NO: 715821 - RNA, 14 nt, Haemophilus influenzae Rd
aauaucuaacauaa

SEQ ID NO: 715822 - RNA, 14 nt, Haemophilus influenzae Rd
aauaucuaagauuu

SEQ ID NO: 715823 - RNA, 22 nt, Haemophilus influenzae Rd
aauaucuaaggcgacaaaaugu

SEQ ID NO: 715824 - RNA, 23 nt, Haemophilus influenzae Rd
aauauccacuucauuaaaaccaa

SEQ ID NO: 715825 - RNA, 17 nt, Haemophilus influenzae Rd
aauaucccuuauuuuag

SEQ ID NO: 715826 - RNA, 12 nt, Haemophilus influenzae Rd
aauaucugcuaa

SEQ ID NO: 715827 - RNA, 16 nt, Haemophilus influenzae Rd
aauaucugcuuuuucu

SEQ ID NO: 715828 - RNA, 20 nt, Haemophilus influenzae Rd
aauaguggugccuucuucag

SEQ ID NO: 715829 - RNA, 22 nt, Haemophilus influenzae Rd
aauaggugcuuaacugaaaauu

SEQ ID NO: 715830 - RNA, 22 nt, Haemophilus influenzae Rd
aauagguuauaaguuuuuugcc

SEQ ID NO: 715831 - RNA, 17 nt, Haemophilus influenzae Rd
aauaggcgaaucaaaau

SEQ ID NO: 715832 - RNA, 17 nt, Haemophilus influenzae Rd
aauagcgacuugccgcu

SEQ ID NO: 715833 - RNA, 18 nt, Haemophilus influenzae Rd
aauagccuaaauauuuau

SEQ ID NO: 715834 - RNA, 21 nt, Haemophilus influenzae Rd
aauagccuaaauauuuauaca

SEQ ID NO: 715835 - RNA, 18 nt, Haemophilus influenzae Rd
aauauaggcgaacaaaag

SEQ ID NO: 715836 - RNA, 20 nt, Haemophilus influenzae Rd
aauauagcaaacuagguaau

SEQ ID NO: 715837 - RNA, 18 nt, Haemophilus influenzae Rd
aauauagaugaagugaac

SEQ ID NO: 715838 - RNA, 21 nt, Haemophilus influenzae Rd
aauaguuaauaaucacaauuu

SEQ ID NO: 715839 - RNA, 15 nt, Haemophilus influenzae Rd
aauaguuaaucgaaa

SEQ ID NO: 715840 - RNA, 20 nt, Haemophilus influenzae Rd
aauaguuaaucgaaaauuua

SEQ ID NO: 715841 - RNA, 22 nt, Haemophilus influenzae Rd
aauaguuaauugauuuaaaaau

SEQ ID NO: 715842 - RNA, 14 nt, Haemophilus influenzae Rd
aauaguuaaagaaa

SEQ ID NO: 715843 - RNA, 20 nt, Haemophilus influenzae Rd
aauaguuaaagaaaauauuu

SEQ ID NO: 715844 - RNA, 13 nt, Haemophilus influenzae Rd
aauauaauaaaua

SEQ ID NO: 715845 - RNA, 15 nt, Haemophilus influenzae Rd
aauauaauuaucaac

SEQ ID NO: 715846 - RNA, 13 nt, Haemophilus influenzae Rd
aauauaaucuuuu

SEQ ID NO: 715847 - RNA, 21 nt, Haemophilus influenzae Rd
aaguuaugggcugacauaaau

SEQ ID NO: 715848 - RNA, 18 nt, Haemophilus influenzae Rd
aaguuauuuauauaauuu

SEQ ID NO: 715849 - RNA, 19 nt, Haemophilus influenzae Rd
aaguuauuuauauaauuua

SEQ ID NO: 715850 - RNA, 16 nt, Haemophilus influenzae Rd
aaguucacaaaucuaa

SEQ ID NO: 715851 - RNA, 23 nt, Haemophilus influenzae Rd
aaguucacaaaucuaaaaauaug

SEQ ID NO: 715852 - RNA, 13 nt, Haemophilus influenzae Rd
aaguucacuucau

SEQ ID NO: 715853 - RNA, 13 nt, Haemophilus influenzae Rd
aaguucagaaaga

SEQ ID NO: 715854 - RNA, 14 nt, Haemophilus influenzae Rd
aaguucagaaagag

SEQ ID NO: 715855 - RNA, 15 nt, Haemophilus influenzae Rd
aaguucagaaagaga

SEQ ID NO: 715856 - RNA, 15 nt, Haemophilus influenzae Rd
aaguucagauucaau

SEQ ID NO: 715857 - RNA, 17 nt, Haemophilus influenzae Rd
aaguuauaguauauuua

SEQ ID NO: 715858 - RNA, 19 nt, Haemophilus influenzae Rd
aagugcgguuaauuuuuac

SEQ ID NO: 715859 - RNA, 23 nt, Haemophilus influenzae Rd
aagugcgguugaaaaauuuguug

SEQ ID NO: 715860 - RNA, 17 nt, Haemophilus influenzae Rd
aagugcgguugaaauuu

SEQ ID NO: 715861 - RNA, 19 nt, Haemophilus influenzae Rd
aagugcgguugaauuuuuu

SEQ ID NO: 715862 - RNA, 15 nt, Haemophilus influenzae Rd
aagugcgguugcuuu

SEQ ID NO: 715863 - RNA, 22 nt, Haemophilus influenzae Rd
aaguguauggucgguauucaua

SEQ ID NO: 715864 - RNA, 23 nt, Haemophilus influenzae Rd
aaguguggauuuuguaauaaaac

SEQ ID NO: 715865 - RNA, 20 nt, Haemophilus influenzae Rd
aaguguggcuuuuuuuccuu

SEQ ID NO: 715866 - RNA, 14 nt, Haemophilus influenzae Rd
aagugcggagaaaa

SEQ ID NO: 715867 - RNA, 17 nt, Haemophilus influenzae Rd
aagugcggaugaaauuu

SEQ ID NO: 715868 - RNA, 20 nt, Haemophilus influenzae Rd
aagugcggaugaaauuuuuc

SEQ ID NO: 715869 - RNA, 21 nt, Haemophilus influenzae Rd
aagugcggcaaaaaauggcuu

SEQ ID NO: 715870 - RNA, 17 nt, Haemophilus influenzae Rd
aagugcgguaaaaaaau

SEQ ID NO: 715871 - RNA, 15 nt, Haemophilus influenzae Rd
aagugcgguaaaaau

SEQ ID NO: 715872 - RNA, 24 nt, Haemophilus influenzae Rd
aagugcgguaaaauucuauuaaaa

SEQ ID NO: 715873 - RNA, 17 nt, Haemophilus influenzae Rd
aagugcgguaaaauuuu

SEQ ID NO: 715874 - RNA, 19 nt, Haemophilus influenzae Rd
aagugcgguaaaauuuuuc

SEQ ID NO: 715875 - RNA, 16 nt, Haemophilus influenzae Rd
aagugcgguaaauuuu

SEQ ID NO: 715876 - RNA, 23 nt, Haemophilus influenzae Rd
aagugcgguaaauuuuaaaauag

SEQ ID NO: 715877 - RNA, 18 nt, Haemophilus influenzae Rd
aagugcgguaaauuuuua

SEQ ID NO: 715878 - RNA, 19 nt, Haemophilus influenzae Rd
aagugcgguaaauuuuuac

SEQ ID NO: 715879 - RNA, 17 nt, Haemophilus influenzae Rd
aagugcgguaauuuuua

SEQ ID NO: 715880 - RNA, 17 nt, Haemophilus influenzae Rd
aagugcgguagaaauua

SEQ ID NO: 715881 - RNA, 23 nt, Haemophilus influenzae Rd
aagugcggucaacauaaagauua

SEQ ID NO: 715882 - RNA, 20 nt, Haemophilus influenzae Rd
aagugcggucaauaaaaaua

SEQ ID NO: 715883 - RNA, 19 nt, Haemophilus influenzae Rd
aagugcggucaauuucaaa

SEQ ID NO: 715884 - RNA, 17 nt, Haemophilus influenzae Rd
aagugcggucaauuuuu

SEQ ID NO: 715885 - RNA, 18 nt, Haemophilus influenzae Rd
aagugcggucaauuuuuc

SEQ ID NO: 715886 - RNA, 22 nt, Haemophilus influenzae Rd
aagugcggucagcauaaagaga

SEQ ID NO: 715887 - RNA, 23 nt, Haemophilus influenzae Rd
aagugcggucagcauaaagagaa

SEQ ID NO: 715888 - RNA, 14 nt, Haemophilus influenzae Rd
aagugcggugaaaa

SEQ ID NO: 715889 - RNA, 18 nt, Haemophilus influenzae Rd
aagugcggugaaaaauca

SEQ ID NO: 715890 - RNA, 18 nt, Haemophilus influenzae Rd
aagucugcugaaauacaa

SEQ ID NO: 715891 - RNA, 13 nt, Haemophilus influenzae Rd
aagucucuaugau

SEQ ID NO: 715892 - RNA, 19 nt, Haemophilus influenzae Rd
aagugagaaaguuaaucaa

SEQ ID NO: 715893 - RNA, 13 nt, Haemophilus influenzae Rd
aagugagaaauau

SEQ ID NO: 715894 - RNA, 18 nt, Haemophilus influenzae Rd
aagucuuaaugacauuaa

SEQ ID NO: 715895 - RNA, 15 nt, Haemophilus influenzae Rd
aagucaguaaaccaa

SEQ ID NO: 715896 - RNA, 13 nt, Haemophilus influenzae Rd
aaguauuuuccuu

SEQ ID NO: 715897 - RNA, 21 nt, Haemophilus influenzae Rd
aaguauuuucuuuccaaccag

SEQ ID NO: 715898 - RNA, 14 nt, Haemophilus influenzae Rd
aaguauuuuucuaa

SEQ ID NO: 715899 - RNA, 15 nt, Haemophilus influenzae Rd
aaguauuuuucuaaa

SEQ ID NO: 715900 - RNA, 21 nt, Haemophilus influenzae Rd
aagucaaaaauugauaccaag

SEQ ID NO: 715901 - RNA, 14 nt, Haemophilus influenzae Rd
aagucaucgaguuu

SEQ ID NO: 715902 - RNA, 19 nt, Haemophilus influenzae Rd
aagucaucgaguuuuaucu

SEQ ID NO: 715903 - RNA, 15 nt, Haemophilus influenzae Rd
aagucgcuaauuuuu

SEQ ID NO: 715904 - RNA, 16 nt, Haemophilus influenzae Rd
aagucgauucaaauaa

SEQ ID NO: 715905 - RNA, 16 nt, Haemophilus influenzae Rd
aagucgcaucaacaac

SEQ ID NO: 715906 - RNA, 20 nt, Haemophilus influenzae Rd
aaguaguauuuuauuuauag

SEQ ID NO: 715907 - RNA, 19 nt, Haemophilus influenzae Rd
aaguaggcugaauacauua

SEQ ID NO: 715908 - RNA, 14 nt, Haemophilus influenzae Rd
aaguagcacuuucc

SEQ ID NO: 715909 - RNA, 18 nt, Haemophilus influenzae Rd
aaguauaaguuauuuuua

SEQ ID NO: 715910 - RNA, 14 nt, Haemophilus influenzae Rd
aagggcguuuagga

SEQ ID NO: 715911 - RNA, 20 nt, Haemophilus influenzae Rd
aagggauaaacccaaaaaag

SEQ ID NO: 715912 - RNA, 15 nt, Haemophilus influenzae Rd
aagggauuugaaaau

SEQ ID NO: 715913 - RNA, 15 nt, Haemophilus influenzae Rd
aaggcucaucauuau

SEQ ID NO: 715914 - RNA, 15 nt, Haemophilus influenzae Rd
aaggcuaccugauac

SEQ ID NO: 715915 - RNA, 15 nt, Haemophilus influenzae Rd
aaggcuuuucuuuua

SEQ ID NO: 715916 - RNA, 18 nt, Haemophilus influenzae Rd
aaguaaucagaacaagca

SEQ ID NO: 715917 - RNA, 23 nt, Haemophilus influenzae Rd
aaguaaaucggcuggauuucccg

SEQ ID NO: 715918 - RNA, 23 nt, Haemophilus influenzae Rd
aaguaaauaauccagauaacaaa

SEQ ID NO: 715919 - RNA, 16 nt, Haemophilus influenzae Rd
aaguaaauaguuauaa

SEQ ID NO: 715920 - RNA, 13 nt, Haemophilus influenzae Rd
aaguaaauauuuc

SEQ ID NO: 715921 - RNA, 13 nt, Haemophilus influenzae Rd
aaguaaauauuuu

SEQ ID NO: 715922 - RNA, 14 nt, Haemophilus influenzae Rd
aaguaaauuuuaaa

SEQ ID NO: 715923 - RNA, 17 nt, Haemophilus influenzae Rd
aaguaacaauguagaaa

SEQ ID NO: 715924 - RNA, 23 nt, Haemophilus influenzae Rd
aaguaaauucaguuaagaaaaua

SEQ ID NO: 715925 - RNA, 13 nt, Haemophilus influenzae Rd
aaguaaaauaguc

SEQ ID NO: 715926 - RNA, 14 nt, Haemophilus influenzae Rd
aaguaaacaauuuu

SEQ ID NO: 715927 - RNA, 13 nt, Haemophilus influenzae Rd
aaguaaacccuuu

SEQ ID NO: 715928 - RNA, 12 nt, Haemophilus influenzae Rd
aaguaaaaccau

SEQ ID NO: 715929 - RNA, 18 nt, Haemophilus influenzae Rd
aaguaaaaggacuaaauu

SEQ ID NO: 715930 - RNA, 14 nt, Haemophilus influenzae Rd
aaguaaaaguaaaa

SEQ ID NO: 715931 - RNA, 18 nt, Haemophilus influenzae Rd
aagguauuuuuuuuaaag

SEQ ID NO: 715932 - RNA, 15 nt, Haemophilus influenzae Rd
aaguaaaaagaaaag

SEQ ID NO: 715933 - RNA, 22 nt, Haemophilus influenzae Rd
aaguacgacaucuuaaauuaua

SEQ ID NO: 715934 - RNA, 18 nt, Haemophilus influenzae Rd
aaguagauaacaaaagug

SEQ ID NO: 715935 - RNA, 15 nt, Haemophilus influenzae Rd
aaguacauucaacca

SEQ ID NO: 715936 - RNA, 14 nt, Haemophilus influenzae Rd
aaguacaacugagc

SEQ ID NO: 715937 - RNA, 18 nt, Haemophilus influenzae Rd
aaguaaugaaaaguuauu

SEQ ID NO: 715938 - RNA, 22 nt, Haemophilus influenzae Rd
aaguacacgaugaugcaggaaa

SEQ ID NO: 715939 - RNA, 13 nt, Haemophilus influenzae Rd
aaguaauuuaaaa

SEQ ID NO: 715940 - RNA, 21 nt, Haemophilus influenzae Rd
aaguacaauuaaauccaucaa

SEQ ID NO: 715941 - RNA, 22 nt, Haemophilus influenzae Rd
aaguaauuuaucgccauagaaa

SEQ ID NO: 715942 - RNA, 24 nt, Haemophilus influenzae Rd
aaguaauuuaucgccauagaaaau

SEQ ID NO: 715943 - RNA, 20 nt, Haemophilus influenzae Rd
aagccacugugcauuaaauc

SEQ ID NO: 715944 - RNA, 15 nt, Haemophilus influenzae Rd
aagccacugauuaua

SEQ ID NO: 715945 - RNA, 21 nt, Haemophilus influenzae Rd
aagccacugauuauauuguug

SEQ ID NO: 715946 - RNA, 13 nt, Haemophilus influenzae Rd
aagccacuugcug

SEQ ID NO: 715947 - RNA, 23 nt, Haemophilus influenzae Rd
aagccacuugcuguuaagaccaa

SEQ ID NO: 715948 - RNA, 23 nt, Haemophilus influenzae Rd
aagcccaauuacgaaguggcguu

SEQ ID NO: 715949 - RNA, 12 nt, Haemophilus influenzae Rd
aagccauuuucu

SEQ ID NO: 715950 - RNA, 14 nt, Haemophilus influenzae Rd
aagccauuuucugc

SEQ ID NO: 715951 - RNA, 17 nt, Haemophilus influenzae Rd
aagccauguugauguaa

SEQ ID NO: 715952 - RNA, 19 nt, Haemophilus influenzae Rd
aagccauuaacauuuaaca

SEQ ID NO: 715953 - RNA, 16 nt, Haemophilus influenzae Rd
aagcccugcguuauau

SEQ ID NO: 715954 - RNA, 23 nt, Haemophilus influenzae Rd
aagcccuucuaugccaaucacaa

SEQ ID NO: 715955 - RNA, 20 nt, Haemophilus influenzae Rd
aagccuucuaaaauaagaau

SEQ ID NO: 715956 - RNA, 21 nt, Haemophilus influenzae Rd
aagccuucagccugcucacga

SEQ ID NO: 715957 - RNA, 21 nt, Haemophilus influenzae Rd
aagccuucaccuaauccuacu

SEQ ID NO: 715958 - RNA, 18 nt, Haemophilus influenzae Rd
aagccuguugauguuuua

SEQ ID NO: 715959 - RNA, 23 nt, Haemophilus influenzae Rd
aagccuguugauguuuuaacaaa

SEQ ID NO: 715960 - RNA, 13 nt, Haemophilus influenzae Rd
aagccuuuuaaaa

SEQ ID NO: 715961 - RNA, 20 nt, Haemophilus influenzae Rd
aagccuuuuaaaaugaacaa

SEQ ID NO: 715962 - RNA, 22 nt, Haemophilus influenzae Rd
aagcgagcaaaaagucaaaaua

SEQ ID NO: 715963 - RNA, 19 nt, Haemophilus influenzae Rd
aagcgaguuuugaaguuau

SEQ ID NO: 715964 - RNA, 16 nt, Haemophilus influenzae Rd
aagcgaacaaucgcuu

SEQ ID NO: 715965 - RNA, 21 nt, Haemophilus influenzae Rd
aagccugcuacagaagcugcg

SEQ ID NO: 715966 - RNA, 21 nt, Haemophilus influenzae Rd
aagccucugcagggaaaaauu

SEQ ID NO: 715967 - RNA, 23 nt, Haemophilus influenzae Rd
aagccucugcagggaaaaauuuu

SEQ ID NO: 715968 - RNA, 16 nt, Haemophilus influenzae Rd
aagccuaaaccaaaua

SEQ ID NO: 715969 - RNA, 14 nt, Haemophilus influenzae Rd
aaggaacaauuucu

SEQ ID NO: 715970 - RNA, 20 nt, Haemophilus influenzae Rd
aaggacgaaggauaaauuga

SEQ ID NO: 715971 - RNA, 14 nt, Haemophilus influenzae Rd
aaggacuaaacuuu

SEQ ID NO: 715972 - RNA, 15 nt, Haemophilus influenzae Rd
aaggacuaggcucug

SEQ ID NO: 715973 - RNA, 16 nt, Haemophilus influenzae Rd
aaggaaacguaaaaua

SEQ ID NO: 715974 - RNA, 22 nt, Haemophilus influenzae Rd
aaggaaagccccauuucuuuuu

SEQ ID NO: 715975 - RNA, 18 nt, Haemophilus influenzae Rd
aagcuugcguaauguuua

SEQ ID NO: 715976 - RNA, 18 nt, Haemophilus influenzae Rd
aagcuggcguucugucua

SEQ ID NO: 715977 - RNA, 19 nt, Haemophilus influenzae Rd
aagcuuauuucacuuuaca

SEQ ID NO: 715978 - RNA, 14 nt, Haemophilus influenzae Rd
aagcugaccacuuu

SEQ ID NO: 715979 - RNA, 21 nt, Haemophilus influenzae Rd
aagcugaccacuuucaauuug

SEQ ID NO: 715980 - RNA, 15 nt, Haemophilus influenzae Rd
aagcugcuuuuaaua

SEQ ID NO: 715981 - RNA, 17 nt, Haemophilus influenzae Rd
aagcuaaguacaaaaga

SEQ ID NO: 715982 - RNA, 13 nt, Haemophilus influenzae Rd
aagcuaagaaaau

SEQ ID NO: 715983 - RNA, 19 nt, Haemophilus influenzae Rd
aagcuauuguuauagaaaa

SEQ ID NO: 715984 - RNA, 18 nt, Haemophilus influenzae Rd
aagcucaaaaguauaaac

SEQ ID NO: 715985 - RNA, 14 nt, Haemophilus influenzae Rd
aagcucaacugcca

SEQ ID NO: 715986 - RNA, 15 nt, Haemophilus influenzae Rd
aagcucacuuuauau

SEQ ID NO: 715987 - RNA, 15 nt, Haemophilus influenzae Rd
aagcguugaaaauaa

SEQ ID NO: 715988 - RNA, 17 nt, Haemophilus influenzae Rd
aagcguugaaaauaaau

SEQ ID NO: 715989 - RNA, 19 nt, Haemophilus influenzae Rd
aagcguugaagcuaauucu

SEQ ID NO: 715990 - RNA, 21 nt, Haemophilus influenzae Rd
aagcguaaugcacuuucaucu

SEQ ID NO: 715991 - RNA, 17 nt, Haemophilus influenzae Rd
aagcguucaaaaagaac

SEQ ID NO: 715992 - RNA, 15 nt, Haemophilus influenzae Rd
aagcguucaucaauu

SEQ ID NO: 715993 - RNA, 19 nt, Haemophilus influenzae Rd
aagcguucaucuuauaaag

SEQ ID NO: 715994 - RNA, 21 nt, Haemophilus influenzae Rd
aagcgguaacgacaaaacuau

SEQ ID NO: 715995 - RNA, 18 nt, Haemophilus influenzae Rd
aagcgguuguaauuguug

SEQ ID NO: 715996 - RNA, 14 nt, Haemophilus influenzae Rd
aagcguaaaaguau

SEQ ID NO: 715997 - RNA, 16 nt, Haemophilus influenzae Rd
aagcgcauuuaaauaa

SEQ ID NO: 715998 - RNA, 13 nt, Haemophilus influenzae Rd
uugagccugaauc

SEQ ID NO: 715999 - RNA, 13 nt, Haemophilus influenzae Rd
uugagccuucaaa

SEQ ID NO: 716000 - RNA, 17 nt, Haemophilus influenzae Rd
uugagcccuaagucaua

SEQ ID NO: 716001 - RNA, 16 nt, Haemophilus influenzae Rd
uugagcuaaagugcgg

SEQ ID NO: 716002 - RNA, 15 nt, Haemophilus influenzae Rd
uugagcucuaguaau

SEQ ID NO: 716003 - RNA, 23 nt, Haemophilus influenzae Rd
uugagcuuauuuuuauuaucaaa

SEQ ID NO: 716004 - RNA, 23 nt, Haemophilus influenzae Rd
uucuuguuuuaaaucuucuaucu

SEQ ID NO: 716005 - RNA, 15 nt, Haemophilus influenzae Rd
uugagccaauaacuu

SEQ ID NO: 716006 - RNA, 21 nt, Haemophilus influenzae Rd
uugagcauaaggaccaagcaa

SEQ ID NO: 716007 - RNA, 22 nt, Haemophilus influenzae Rd
uucuuguaagccaaauaaugca

SEQ ID NO: 716008 - RNA, 15 nt, Haemophilus influenzae Rd
uucuuguuuagcaag

SEQ ID NO: 716009 - RNA, 23 nt, Haemophilus influenzae Rd
uucuuguaaugcuguaaugauca

SEQ ID NO: 716010 - RNA, 15 nt, Haemophilus influenzae Rd
uucuuggauaauuuc

SEQ ID NO: 716011 - RNA, 23 nt, Haemophilus influenzae Rd
uucuuggcaauauuuaauauauu

SEQ ID NO: 716012 - RNA, 21 nt, Haemophilus influenzae Rd
uucuuggagauaauauuccaa

SEQ ID NO: 716013 - RNA, 22 nt, Haemophilus influenzae Rd
uucuuggagauaauauuccaaa

SEQ ID NO: 716014 - RNA, 18 nt, Haemophilus influenzae Rd
uucuuggaaaucuuggcu

SEQ ID NO: 716015 - RNA, 21 nt, Haemophilus influenzae Rd
uucuuggaacaucauuuucaa

SEQ ID NO: 716016 - RNA, 11 nt, Haemophilus influenzae Rd
uucuucuuuuu

SEQ ID NO: 716017 - RNA, 11 nt, Haemophilus influenzae Rd
uucuucuuuua

SEQ ID NO: 716018 - RNA, 13 nt, Haemophilus influenzae Rd
uugaggacuuaaa

SEQ ID NO: 716019 - RNA, 19 nt, Haemophilus influenzae Rd
uugaguaaaaaaucuagag

SEQ ID NO: 716020 - RNA, 21 nt, Haemophilus influenzae Rd
uugaggcuaaacuuuucgcaa

SEQ ID NO: 716021 - RNA, 12 nt, Haemophilus influenzae Rd
uugagguaaaag

SEQ ID NO: 716022 - RNA, 22 nt, Haemophilus influenzae Rd
uugauaauacacguuaauaggc

SEQ ID NO: 716023 - RNA, 21 nt, Haemophilus influenzae Rd
uugaguauagucauucaaugc

SEQ ID NO: 716024 - RNA, 19 nt, Haemophilus influenzae Rd
uugaguauaucgaauuaaa

SEQ ID NO: 716025 - RNA, 16 nt, Haemophilus influenzae Rd
uugagugagauaaaug

SEQ ID NO: 716026 - RNA, 18 nt, Haemophilus influenzae Rd
uugagugcuguacacaca

SEQ ID NO: 716027 - RNA, 19 nt, Haemophilus influenzae Rd
uugagugcuguacacacac

SEQ ID NO: 716028 - RNA, 17 nt, Haemophilus influenzae Rd
uugaucuaauuugccaa

SEQ ID NO: 716029 - RNA, 16 nt, Haemophilus influenzae Rd
uugaucuacagaagug

SEQ ID NO: 716030 - RNA, 16 nt, Haemophilus influenzae Rd
uugaucgguuuuauua

SEQ ID NO: 716031 - RNA, 15 nt, Haemophilus influenzae Rd
uugauauaaauuguu

SEQ ID NO: 716032 - RNA, 19 nt, Haemophilus influenzae Rd
uugauaauuuaagcaaaau

SEQ ID NO: 716033 - RNA, 16 nt, Haemophilus influenzae Rd
uugauacauuucuaaa

SEQ ID NO: 716034 - RNA, 20 nt, Haemophilus influenzae Rd
uugauacauuucuaaaauaa

SEQ ID NO: 716035 - RNA, 17 nt, Haemophilus influenzae Rd
uugauacggcaaacuaa

SEQ ID NO: 716036 - RNA, 16 nt, Haemophilus influenzae Rd
uugauagacaauauaa

SEQ ID NO: 716037 - RNA, 23 nt, Haemophilus influenzae Rd
uugauguaaaaacucgaauagaa

SEQ ID NO: 716038 - RNA, 18 nt, Haemophilus influenzae Rd
uugauggaucauaaguaa

SEQ ID NO: 716039 - RNA, 15 nt, Haemophilus influenzae Rd
uugaucucuuucuau

SEQ ID NO: 716040 - RNA, 21 nt, Haemophilus influenzae Rd
uugauguuuuugaaguaaaaa

SEQ ID NO: 716041 - RNA, 18 nt, Haemophilus influenzae Rd
uugauuaaguauaacuaa

SEQ ID NO: 716042 - RNA, 17 nt, Haemophilus influenzae Rd
uugauuagcuaauauaa

SEQ ID NO: 716043 - RNA, 21 nt, Haemophilus influenzae Rd
uugauuucagaacaugacuua

SEQ ID NO: 716044 - RNA, 17 nt, Haemophilus influenzae Rd
uugauuuagccaguaau

SEQ ID NO: 716045 - RNA, 23 nt, Haemophilus influenzae Rd
uugauuuuaaaacacgaaaaaaa

SEQ ID NO: 716046 - RNA, 16 nt, Haemophilus influenzae Rd
uugauuuuaaaauauc

SEQ ID NO: 716047 - RNA, 17 nt, Haemophilus influenzae Rd
uugauuuuaaaauauca

SEQ ID NO: 716048 - RNA, 19 nt, Haemophilus influenzae Rd
uugauuuuaaaauaucaaa

SEQ ID NO: 716049 - RNA, 15 nt, Haemophilus influenzae Rd
uugauuuuaauguaa

SEQ ID NO: 716050 - RNA, 12 nt, Haemophilus influenzae Rd
uugauuuuauuu

SEQ ID NO: 716051 - RNA, 16 nt, Haemophilus influenzae Rd
uugauuuuauuuacuu

SEQ ID NO: 716052 - RNA, 12 nt, Haemophilus influenzae Rd
uugauuuuccug

SEQ ID NO: 716053 - RNA, 13 nt, Haemophilus influenzae Rd
uugcacuuucuau

SEQ ID NO: 716054 - RNA, 17 nt, Haemophilus influenzae Rd
uugcacuuuaaaaauaa

SEQ ID NO: 716055 - RNA, 21 nt, Haemophilus influenzae Rd
uugcacuuuaaagaaauaaau

SEQ ID NO: 716056 - RNA, 20 nt, Haemophilus influenzae Rd
uugcagaacagguguugcau

SEQ ID NO: 716057 - RNA, 15 nt, Haemophilus influenzae Rd
uugcagaaccgccac

SEQ ID NO: 716058 - RNA, 17 nt, Haemophilus influenzae Rd
uugcagggauauugccu

SEQ ID NO: 716059 - RNA, 21 nt, Haemophilus influenzae Rd
uugcaucgugaccuaauauga

SEQ ID NO: 716060 - RNA, 24 nt, Haemophilus influenzae Rd
uugcauuaaagcgagaauaguuaa

SEQ ID NO: 716061 - RNA, 13 nt, Haemophilus influenzae Rd
uugcauuuaacuu

SEQ ID NO: 716062 - RNA, 16 nt, Haemophilus influenzae Rd
uugcauugaguuuuuc

SEQ ID NO: 716063 - RNA, 14 nt, Haemophilus influenzae Rd
uugcauaaaccaac

SEQ ID NO: 716064 - RNA, 17 nt, Haemophilus influenzae Rd
uugcauaacuucaccaa

SEQ ID NO: 716065 - RNA, 17 nt, Haemophilus influenzae Rd
uugcauagccucuaaga

SEQ ID NO: 716066 - RNA, 12 nt, Haemophilus influenzae Rd
uugcauaguuuu

SEQ ID NO: 716067 - RNA, 18 nt, Haemophilus influenzae Rd
uugcaucuuggcauuuuu

SEQ ID NO: 716068 - RNA, 15 nt, Haemophilus influenzae Rd
uugcauauugaacuu

SEQ ID NO: 716069 - RNA, 23 nt, Haemophilus influenzae Rd
uugcaucagccaccuuaacaaag

SEQ ID NO: 716070 - RNA, 19 nt, Haemophilus influenzae Rd
uugcaucagguacgucuuu

SEQ ID NO: 716071 - RNA, 21 nt, Haemophilus influenzae Rd
uugcgauaauuugcaucauuu

SEQ ID NO: 716072 - RNA, 17 nt, Haemophilus influenzae Rd
uugcgauauugaccauu

SEQ ID NO: 716073 - RNA, 18 nt, Haemophilus influenzae Rd
uugccuuuauggugugca

SEQ ID NO: 716074 - RNA, 23 nt, Haemophilus influenzae Rd
uugccucgcaugcggaauaauuu

SEQ ID NO: 716075 - RNA, 21 nt, Haemophilus influenzae Rd
uugccuaaauacaucacuaau

SEQ ID NO: 716076 - RNA, 15 nt, Haemophilus influenzae Rd
uugccauuuugcuau

SEQ ID NO: 716077 - RNA, 22 nt, Haemophilus influenzae Rd
uugccaucacucaauuuacaca

SEQ ID NO: 716078 - RNA, 14 nt, Haemophilus influenzae Rd
uugccauuugcuuc

SEQ ID NO: 716079 - RNA, 13 nt, Haemophilus influenzae Rd
uugccauauuuaa

SEQ ID NO: 716080 - RNA, 15 nt, Haemophilus influenzae Rd
uugccaguaacuuuc

SEQ ID NO: 716081 - RNA, 21 nt, Haemophilus influenzae Rd
uuggaucuuguggaucuaaau

SEQ ID NO: 716082 - RNA, 17 nt, Haemophilus influenzae Rd
uuggaucauuauccaaa

SEQ ID NO: 716083 - RNA, 20 nt, Haemophilus influenzae Rd
uuggauaacaaauugcuucu

SEQ ID NO: 716084 - RNA, 20 nt, Haemophilus influenzae Rd
uuggauacauuccaucaaaa

SEQ ID NO: 716085 - RNA, 19 nt, Haemophilus influenzae Rd
uuggauagaccacaugaau

SEQ ID NO: 716086 - RNA, 16 nt, Haemophilus influenzae Rd
uuggcacaacaucaga

SEQ ID NO: 716087 - RNA, 19 nt, Haemophilus influenzae Rd
uuggcaauauuuaauauau

SEQ ID NO: 716088 - RNA, 22 nt, Haemophilus influenzae Rd
uuggcauaaaauuauaagauaa

SEQ ID NO: 716089 - RNA, 18 nt, Haemophilus influenzae Rd
uuggaaauuaacaauacg

SEQ ID NO: 716090 - RNA, 17 nt, Haemophilus influenzae Rd
uuggaacgauuaaaaau

SEQ ID NO: 716091 - RNA, 12 nt, Haemophilus influenzae Rd
uuggaacaucau

SEQ ID NO: 716092 - RNA, 20 nt, Haemophilus influenzae Rd
uuggaaaaguaagaaacuug

SEQ ID NO: 716093 - RNA, 18 nt, Haemophilus influenzae Rd
uuggaaacuaugcagaau

SEQ ID NO: 716094 - RNA, 17 nt, Haemophilus influenzae Rd
uuggaauugugcuaaau

SEQ ID NO: 716095 - RNA, 16 nt, Haemophilus influenzae Rd
uuggaaugguauaaaa

SEQ ID NO: 716096 - RNA, 22 nt, Haemophilus influenzae Rd
uuggaaugguugcaaaggcagg

SEQ ID NO: 716097 - RNA, 15 nt, Haemophilus influenzae Rd
uuggaauguugugac

SEQ ID NO: 716098 - RNA, 16 nt, Haemophilus influenzae Rd
uugcuauuuucuaauu

SEQ ID NO: 716099 - RNA, 19 nt, Haemophilus influenzae Rd
uugcuauccaguaaagaau

SEQ ID NO: 716100 - RNA, 16 nt, Haemophilus influenzae Rd
uugcuaccuucaacca

SEQ ID NO: 716101 - RNA, 14 nt, Haemophilus influenzae Rd
uugcuagccaauaa

SEQ ID NO: 716102 - RNA, 16 nt, Haemophilus influenzae Rd
uugcguaucacuuaaa

SEQ ID NO: 716103 - RNA, 17 nt, Haemophilus influenzae Rd
uugcguaucacuuaaac

SEQ ID NO: 716104 - RNA, 21 nt, Haemophilus influenzae Rd
uugcguaucacuuaaaccaaa

SEQ ID NO: 716105 - RNA, 22 nt, Haemophilus influenzae Rd
uugcuguuucgcaucaaagaau

SEQ ID NO: 716106 - RNA, 17 nt, Haemophilus influenzae Rd
uugcuguucgauuucau

SEQ ID NO: 716107 - RNA, 16 nt, Haemophilus influenzae Rd
uugcuguuaagaccaa

SEQ ID NO: 716108 - RNA, 20 nt, Haemophilus influenzae Rd
uugcuguuaagaccaauucu

SEQ ID NO: 716109 - RNA, 20 nt, Haemophilus influenzae Rd
uugcugugcgaccugaagau

SEQ ID NO: 716110 - RNA, 17 nt, Haemophilus influenzae Rd
uugcuuagugaaaagaa

SEQ ID NO: 716111 - RNA, 21 nt, Haemophilus influenzae Rd
uugcuuugguuuaguuuacuu

SEQ ID NO: 716112 - RNA, 21 nt, Haemophilus influenzae Rd
uugcuuucuuauauauaaaau

SEQ ID NO: 716113 - RNA, 17 nt, Haemophilus influenzae Rd
uugcuucgugaauacga

SEQ ID NO: 716114 - RNA, 23 nt, Haemophilus influenzae Rd
uugcuucgugaauacgaucugca

SEQ ID NO: 716115 - RNA, 15 nt, Haemophilus influenzae Rd
uugcuugaucaucca

SEQ ID NO: 716116 - RNA, 21 nt, Haemophilus influenzae Rd
uuggcuuccagaaaauuggcg

SEQ ID NO: 716117 - RNA, 16 nt, Haemophilus influenzae Rd
uuggcuuacagcaaaa

SEQ ID NO: 716118 - RNA, 17 nt, Haemophilus influenzae Rd
uuggcuuacagcaaaag

SEQ ID NO: 716119 - RNA, 17 nt, Haemophilus influenzae Rd
uugggauauuccaaggu

SEQ ID NO: 716120 - RNA, 14 nt, Haemophilus influenzae Rd
uugggauuauuuuu

SEQ ID NO: 716121 - RNA, 19 nt, Haemophilus influenzae Rd
uugggauuuuuuauuuugu

SEQ ID NO: 716122 - RNA, 18 nt, Haemophilus influenzae Rd
uuggcuaacuucuuccac

SEQ ID NO: 716123 - RNA, 21 nt, Haemophilus influenzae Rd
uuggcuaugucaauuacuguu

SEQ ID NO: 716124 - RNA, 23 nt, Haemophilus influenzae Rd
uuggcuauuaugaggaauuuguu

SEQ ID NO: 716125 - RNA, 17 nt, Haemophilus influenzae Rd
uuggcucaagccuuugg

SEQ ID NO: 716126 - RNA, 17 nt, Haemophilus influenzae Rd
uuggcugaaauucuaaa

SEQ ID NO: 716127 - RNA, 12 nt, Haemophilus influenzae Rd
uuggcugaauuu

SEQ ID NO: 716128 - RNA, 17 nt, Haemophilus influenzae Rd
uuggcgaguaaauuuag

SEQ ID NO: 716129 - RNA, 16 nt, Haemophilus influenzae Rd
uuggcgaaaaucauca

SEQ ID NO: 716130 - RNA, 22 nt, Haemophilus influenzae Rd
uuggcgaaccuucacuuaaauu

SEQ ID NO: 716131 - RNA, 23 nt, Haemophilus influenzae Rd
uuggugcgucuuuuaacauuaca

SEQ ID NO: 716132 - RNA, 20 nt, Haemophilus influenzae Rd
uuggugugcaauaccuuugu

SEQ ID NO: 716133 - RNA, 16 nt, Haemophilus influenzae Rd
uugguuaauguaaaca

SEQ ID NO: 716134 - RNA, 17 nt, Haemophilus influenzae Rd
uugguuagaucagaaaa

SEQ ID NO: 716135 - RNA, 17 nt, Haemophilus influenzae Rd
uugguucugcaguuucu

SEQ ID NO: 716136 - RNA, 16 nt, Haemophilus influenzae Rd
uugguucgauaucuaa

SEQ ID NO: 716137 - RNA, 13 nt, Haemophilus influenzae Rd
uugguucuaaaua

SEQ ID NO: 716138 - RNA, 20 nt, Haemophilus influenzae Rd
uuggugaucaccgaaauaac

SEQ ID NO: 716139 - RNA, 21 nt, Haemophilus influenzae Rd
uuggucacgcuguaaacaaga

SEQ ID NO: 716140 - RNA, 20 nt, Haemophilus influenzae Rd
uuggucaauuagcaaagaau

SEQ ID NO: 716141 - RNA, 13 nt, Haemophilus influenzae Rd
uuggggaaguaau

SEQ ID NO: 716142 - RNA, 14 nt, Haemophilus influenzae Rd
uuggguaaucaaau

SEQ ID NO: 716143 - RNA, 17 nt, Haemophilus influenzae Rd
uugguauuuacuaaauu

SEQ ID NO: 716144 - RNA, 15 nt, Haemophilus influenzae Rd
uugguagcuaaaaau

SEQ ID NO: 716145 - RNA, 19 nt, Haemophilus influenzae Rd
uugguagaguaaauucucg

SEQ ID NO: 716146 - RNA, 20 nt, Haemophilus influenzae Rd
uugguacauguugggcuaaa

SEQ ID NO: 716147 - RNA, 13 nt, Haemophilus influenzae Rd
uugguacgccagu

SEQ ID NO: 716148 - RNA, 23 nt, Haemophilus influenzae Rd
uugguaaucaaauucuguguaau

SEQ ID NO: 716149 - RNA, 13 nt, Haemophilus influenzae Rd
uugguaauuuggc

SEQ ID NO: 716150 - RNA, 15 nt, Haemophilus influenzae Rd
uugguaaaucuaaca

SEQ ID NO: 716151 - RNA, 17 nt, Haemophilus influenzae Rd
uugguaaauuagcaaua

SEQ ID NO: 716152 - RNA, 19 nt, Haemophilus influenzae Rd
uugguaaagccaacuuuuu

SEQ ID NO: 716153 - RNA, 15 nt, Haemophilus influenzae Rd
uuggguugugguguc

SEQ ID NO: 716154 - RNA, 23 nt, Haemophilus influenzae Rd
uuggguuguuacguuucacuaca

SEQ ID NO: 716155 - RNA, 18 nt, Haemophilus influenzae Rd
uuuaaugauaaauuuuau

SEQ ID NO: 716156 - RNA, 14 nt, Haemophilus influenzae Rd
uuuaaugaaaguaa

SEQ ID NO: 716157 - RNA, 18 nt, Haemophilus influenzae Rd
uuuaaugaaccaaaucua

SEQ ID NO: 716158 - RNA, 15 nt, Haemophilus influenzae Rd
uuuaaucucccaaag

SEQ ID NO: 716159 - RNA, 14 nt, Haemophilus influenzae Rd
uuuaaucaaauaaa

SEQ ID NO: 716160 - RNA, 21 nt, Haemophilus influenzae Rd
uuuaaucuuaaagaauuucuu

SEQ ID NO: 716161 - RNA, 19 nt, Haemophilus influenzae Rd
uuuaauccguuaauuucau

SEQ ID NO: 716162 - RNA, 16 nt, Haemophilus influenzae Rd
uuuaauccugucaucu

SEQ ID NO: 716163 - RNA, 16 nt, Haemophilus influenzae Rd
uuuaauccaaacuaaa

SEQ ID NO: 716164 - RNA, 17 nt, Haemophilus influenzae Rd
uuuaauccaaacuaaau

SEQ ID NO: 716165 - RNA, 16 nt, Haemophilus influenzae Rd
uuuaauauuuuuuuca

SEQ ID NO: 716166 - RNA, 22 nt, Haemophilus influenzae Rd
uuuaauacgugauaaugccucu

SEQ ID NO: 716167 - RNA, 15 nt, Haemophilus influenzae Rd
uuuaauaaaauguaa

SEQ ID NO: 716168 - RNA, 16 nt, Haemophilus influenzae Rd
uuuaauaagccuugca

SEQ ID NO: 716169 - RNA, 20 nt, Haemophilus influenzae Rd
uuuaauaaucuuaaauaauu

SEQ ID NO: 716170 - RNA, 20 nt, Haemophilus influenzae Rd
uuuaauaucuuccguuuuuu

SEQ ID NO: 716171 - RNA, 16 nt, Haemophilus influenzae Rd
uuuaauaucuucuaau

SEQ ID NO: 716172 - RNA, 20 nt, Haemophilus influenzae Rd
uuuaauaucuucuaauaaaa

SEQ ID NO: 716173 - RNA, 22 nt, Haemophilus influenzae Rd
uuuaauauaauugugauaaaug

SEQ ID NO: 716174 - RNA, 11 nt, Haemophilus influenzae Rd
uuuaauauuuc

SEQ ID NO: 716175 - RNA, 16 nt, Haemophilus influenzae Rd
uuuaacuuuuuuauuu

SEQ ID NO: 716176 - RNA, 16 nt, Haemophilus influenzae Rd
uuuaagaaaaaauaua

SEQ ID NO: 716177 - RNA, 17 nt, Haemophilus influenzae Rd
uuuaagaaaaaauauaa

SEQ ID NO: 716178 - RNA, 16 nt, Haemophilus influenzae Rd
uuuaagauagcacuug

SEQ ID NO: 716179 - RNA, 14 nt, Haemophilus influenzae Rd
uuuaaaagauacua

SEQ ID NO: 716180 - RNA, 19 nt, Haemophilus influenzae Rd
uuuaacuuaaucauuuuuu

SEQ ID NO: 716181 - RNA, 23 nt, Haemophilus influenzae Rd
uuuaaaacgcgcauuaaacugga

SEQ ID NO: 716182 - RNA, 11 nt, Haemophilus influenzae Rd
uuuaaaacuau

SEQ ID NO: 716183 - RNA, 20 nt, Haemophilus influenzae Rd
uuuaaaacuauuuuuaauuu

SEQ ID NO: 716184 - RNA, 17 nt, Haemophilus influenzae Rd
uuuaaaacaaaaggccu

SEQ ID NO: 716185 - RNA, 22 nt, Haemophilus influenzae Rd
uuuaaaacaugaauaucaucag

SEQ ID NO: 716186 - RNA, 17 nt, Haemophilus influenzae Rd
uuuaaaaccaaaagauu

SEQ ID NO: 716187 - RNA, 23 nt, Haemophilus influenzae Rd
uuuaaaaccacaauaaaauaaua

SEQ ID NO: 716188 - RNA, 13 nt, Haemophilus influenzae Rd
uuuaauaaaacca

SEQ ID NO: 716189 - RNA, 16 nt, Haemophilus influenzae Rd
uuuaaguuuucaccaa

SEQ ID NO: 716190 - RNA, 13 nt, Haemophilus influenzae Rd
uuuaauaaacaua

SEQ ID NO: 716191 - RNA, 12 nt, Haemophilus influenzae Rd
uuuaauaaaccc

SEQ ID NO: 716192 - RNA, 22 nt, Haemophilus influenzae Rd
uuuaaguugggcgacguuuuaa

SEQ ID NO: 716193 - RNA, 17 nt, Haemophilus influenzae Rd
uuuaaguaguguuuuau

SEQ ID NO: 716194 - RNA, 20 nt, Haemophilus influenzae Rd
uuuaaguaaugcuaaauaua

SEQ ID NO: 716195 - RNA, 16 nt, Haemophilus influenzae Rd
uuuaaggaaacguaaa

SEQ ID NO: 716196 - RNA, 20 nt, Haemophilus influenzae Rd
uuuaccgcaaucuucacaaa

SEQ ID NO: 716197 - RNA, 19 nt, Haemophilus influenzae Rd
uuuaccgcacuuucuucgu

SEQ ID NO: 716198 - RNA, 21 nt, Haemophilus influenzae Rd
uuuaccgcacuuuuuuucuua

SEQ ID NO: 716199 - RNA, 19 nt, Haemophilus influenzae Rd
uuuacauuuggcaaaauaa

SEQ ID NO: 716200 - RNA, 20 nt, Haemophilus influenzae Rd
uuuacccuauuacuuuccau

SEQ ID NO: 716201 - RNA, 20 nt, Haemophilus influenzae Rd
uuuacccgugccaauugccc

SEQ ID NO: 716202 - RNA, 16 nt, Haemophilus influenzae Rd
uuuaccgaaagaggca

SEQ ID NO: 716203 - RNA, 16 nt, Haemophilus influenzae Rd
uuuaccgaaguaagau

SEQ ID NO: 716204 - RNA, 19 nt, Haemophilus influenzae Rd
uuuaccuucagcacuuaau

SEQ ID NO: 716205 - RNA, 19 nt, Haemophilus influenzae Rd
uuuaccucgccauuuugag

SEQ ID NO: 716206 - RNA, 16 nt, Haemophilus influenzae Rd
uuuaaucuugagguaa

SEQ ID NO: 716207 - RNA, 20 nt, Haemophilus influenzae Rd
uuuaaugggugauccauaau

SEQ ID NO: 716208 - RNA, 13 nt, Haemophilus influenzae Rd
uuuaauguaauaa

SEQ ID NO: 716209 - RNA, 18 nt, Haemophilus influenzae Rd
uuuaauguaauaaaaaau

SEQ ID NO: 716210 - RNA, 14 nt, Haemophilus influenzae Rd
uuuaauguauaaaa

SEQ ID NO: 716211 - RNA, 17 nt, Haemophilus influenzae Rd
uuuacagaacaaaauaa

SEQ ID NO: 716212 - RNA, 13 nt, Haemophilus influenzae Rd
uuuacagauaaau

SEQ ID NO: 716213 - RNA, 17 nt, Haemophilus influenzae Rd
uuuacagguugccagcc

SEQ ID NO: 716214 - RNA, 16 nt, Haemophilus influenzae Rd
uuuacaucaauuguga

SEQ ID NO: 716215 - RNA, 23 nt, Haemophilus influenzae Rd
uuuaauggauuccaucauuguga

SEQ ID NO: 716216 - RNA, 13 nt, Haemophilus influenzae Rd
uuuacuuuuucca

SEQ ID NO: 716217 - RNA, 13 nt, Haemophilus influenzae Rd
uuuacuucuucag

SEQ ID NO: 716218 - RNA, 21 nt, Haemophilus influenzae Rd
uuuacuuggaauaucaucuag

SEQ ID NO: 716219 - RNA, 14 nt, Haemophilus influenzae Rd
uuuacuuggcauuu

SEQ ID NO: 716220 - RNA, 12 nt, Haemophilus influenzae Rd
uuuacuugugca

SEQ ID NO: 716221 - RNA, 15 nt, Haemophilus influenzae Rd
uuuacuugugcauuu

SEQ ID NO: 716222 - RNA, 14 nt, Haemophilus influenzae Rd
uuuagaacauugau

SEQ ID NO: 716223 - RNA, 18 nt, Haemophilus influenzae Rd
uuuagaauaaauuaaaaa

SEQ ID NO: 716224 - RNA, 13 nt, Haemophilus influenzae Rd
uuuacguuucauu

SEQ ID NO: 716225 - RNA, 17 nt, Haemophilus influenzae Rd
uuuacguuuuaaauuaa

SEQ ID NO: 716226 - RNA, 18 nt, Haemophilus influenzae Rd
uuuacguuuuaaauuaau

SEQ ID NO: 716227 - RNA, 19 nt, Haemophilus influenzae Rd
uuuacgugcgaauuuuuau

SEQ ID NO: 716228 - RNA, 16 nt, Haemophilus influenzae Rd
uuuacuaauuaaaagg

SEQ ID NO: 716229 - RNA, 17 nt, Haemophilus influenzae Rd
uuuacguaguacaucau

SEQ ID NO: 716230 - RNA, 19 nt, Haemophilus influenzae Rd
uuuacuaaacguaacuaaa

SEQ ID NO: 716231 - RNA, 13 nt, Haemophilus influenzae Rd
uuuacuacaucag

SEQ ID NO: 716232 - RNA, 22 nt, Haemophilus influenzae Rd
uuuagauuacuuuuagauaaau

SEQ ID NO: 716233 - RNA, 13 nt, Haemophilus influenzae Rd
uuuagauacaaaa

SEQ ID NO: 716234 - RNA, 15 nt, Haemophilus influenzae Rd
uuuagauauaaaaau

SEQ ID NO: 716235 - RNA, 21 nt, Haemophilus influenzae Rd
uuuagacaacaacuuuucuaa

SEQ ID NO: 716236 - RNA, 22 nt, Haemophilus influenzae Rd
uuuagacaacaacuuuucuaaa

SEQ ID NO: 716237 - RNA, 19 nt, Haemophilus influenzae Rd
uuuagagcuuuuugcgcca

SEQ ID NO: 716238 - RNA, 23 nt, Haemophilus influenzae Rd
uuuagaggcuaugauuuuaaagc

SEQ ID NO: 716239 - RNA, 20 nt, Haemophilus influenzae Rd
uuuagauaaauuucaauuaa

SEQ ID NO: 716240 - RNA, 13 nt, Haemophilus influenzae Rd
uuuauaacauaau

SEQ ID NO: 716241 - RNA, 22 nt, Haemophilus influenzae Rd
uuuauaaugcaaccaaacaaaa

SEQ ID NO: 716242 - RNA, 21 nt, Haemophilus influenzae Rd
uuuauacacuuuuaacuuaau

SEQ ID NO: 716243 - RNA, 22 nt, Haemophilus influenzae Rd
uuuauacaguuagaacaacaau

SEQ ID NO: 716244 - RNA, 17 nt, Haemophilus influenzae Rd
uuuauauauugcuguca

SEQ ID NO: 716245 - RNA, 14 nt, Haemophilus influenzae Rd
uuuaucgacaaauu

SEQ ID NO: 716246 - RNA, 16 nt, Haemophilus influenzae Rd
uuuaucgacaaauuaa

SEQ ID NO: 716247 - RNA, 15 nt, Haemophilus influenzae Rd
uuuaucgagaaaauu

SEQ ID NO: 716248 - RNA, 18 nt, Haemophilus influenzae Rd
uuuaucgagauuucuuug

SEQ ID NO: 716249 - RNA, 19 nt, Haemophilus influenzae Rd
uuuaucgaggacaaucugc

SEQ ID NO: 716250 - RNA, 19 nt, Haemophilus influenzae Rd
uuuauccgguuggaaaagc

SEQ ID NO: 716251 - RNA, 15 nt, Haemophilus influenzae Rd
uuuauccccaauuaa

SEQ ID NO: 716252 - RNA, 16 nt, Haemophilus influenzae Rd
uuuauccccaauuaag

SEQ ID NO: 716253 - RNA, 17 nt, Haemophilus influenzae Rd
uuuauccccuacaguga

SEQ ID NO: 716254 - RNA, 14 nt, Haemophilus influenzae Rd
uuuaucaucugcau

SEQ ID NO: 716255 - RNA, 15 nt, Haemophilus influenzae Rd
uuuauccaaaauuaa

SEQ ID NO: 716256 - RNA, 12 nt, Haemophilus influenzae Rd
uuuaucauugcu

SEQ ID NO: 716257 - RNA, 14 nt, Haemophilus influenzae Rd
uuuauccaucaaac

SEQ ID NO: 716258 - RNA, 19 nt, Haemophilus influenzae Rd
uuuauccaugacuaaucca

SEQ ID NO: 716259 - RNA, 17 nt, Haemophilus influenzae Rd
uuuauccacaugauaua

SEQ ID NO: 716260 - RNA, 21 nt, Haemophilus influenzae Rd
uuuauccaaccuacauuaauc

SEQ ID NO: 716261 - RNA, 21 nt, Haemophilus influenzae Rd
uuuauccaauagauaaaauaa

SEQ ID NO: 716262 - RNA, 22 nt, Haemophilus influenzae Rd
uuuaucaacuaaaaaauaguua

SEQ ID NO: 716263 - RNA, 16 nt, Haemophilus influenzae Rd
uuuaucaagcacaauc

SEQ ID NO: 716264 - RNA, 21 nt, Haemophilus influenzae Rd
uuuaucaaucaagcauaaauc

SEQ ID NO: 716265 - RNA, 19 nt, Haemophilus influenzae Rd
uuuauauucauuuaaaaca

SEQ ID NO: 716266 - RNA, 22 nt, Haemophilus influenzae Rd
uuuauauucauuuaaaacaaaa

SEQ ID NO: 716267 - RNA, 13 nt, Haemophilus influenzae Rd
uuuauauugaaca

SEQ ID NO: 716268 - RNA, 16 nt, Haemophilus influenzae Rd
uuuaucaaaaaucuua

SEQ ID NO: 716269 - RNA, 23 nt, Haemophilus influenzae Rd
uuuaucaaaaaucuuauuucaau

SEQ ID NO: 716270 - RNA, 18 nt, Haemophilus influenzae Rd
uuuauauuuuuucuuaaa

SEQ ID NO: 716271 - RNA, 13 nt, Haemophilus influenzae Rd
uuuauauuuccau

SEQ ID NO: 716272 - RNA, 13 nt, Haemophilus influenzae Rd
uuuaucuaaaaaa

SEQ ID NO: 716273 - RNA, 12 nt, Haemophilus influenzae Rd
uuuaucuaaauu

SEQ ID NO: 716274 - RNA, 15 nt, Haemophilus influenzae Rd
uuuaucuaaauuaau

SEQ ID NO: 716275 - RNA, 21 nt, Haemophilus influenzae Rd
uuuaucuaaauuaauuaggac

SEQ ID NO: 716276 - RNA, 14 nt, Haemophilus influenzae Rd
uuuaucuaauugga

SEQ ID NO: 716277 - RNA, 21 nt, Haemophilus influenzae Rd
uuuaucuaauuggacaagaaa

SEQ ID NO: 716278 - RNA, 23 nt, Haemophilus influenzae Rd
uuuaucggcaaauacguauaauu

SEQ ID NO: 716279 - RNA, 16 nt, Haemophilus influenzae Rd
uuuaucgccauagaaa

SEQ ID NO: 716280 - RNA, 22 nt, Haemophilus influenzae Rd
uuuaucgccauagaaaauagaa

SEQ ID NO: 716281 - RNA, 19 nt, Haemophilus influenzae Rd
uuuaucuucaaaauaguaa

SEQ ID NO: 716282 - RNA, 14 nt, Haemophilus influenzae Rd
uuuaucuaaaagua

SEQ ID NO: 716283 - RNA, 19 nt, Haemophilus influenzae Rd
uuuaucuauugauucuaaa

SEQ ID NO: 716284 - RNA, 11 nt, Haemophilus influenzae Rd
uuuaugcuuua

SEQ ID NO: 716285 - RNA, 16 nt, Haemophilus influenzae Rd
uuuaugauaaccaucu

SEQ ID NO: 716286 - RNA, 11 nt, Haemophilus influenzae Rd
uuuaucuuuua

SEQ ID NO: 716287 - RNA, 17 nt, Haemophilus influenzae Rd
uuuaugaauguuucaaa

SEQ ID NO: 716288 - RNA, 14 nt, Haemophilus influenzae Rd
uuuaugacuauuuu

SEQ ID NO: 716289 - RNA, 16 nt, Haemophilus influenzae Rd
uuuaugacuauuuuuu

SEQ ID NO: 716290 - RNA, 17 nt, Haemophilus influenzae Rd
uuuaugaccaaauacaa

SEQ ID NO: 716291 - RNA, 12 nt, Haemophilus influenzae Rd
uuuauuaacaaa

SEQ ID NO: 716292 - RNA, 14 nt, Haemophilus influenzae Rd
uuuauuaaaaauaa

SEQ ID NO: 716293 - RNA, 14 nt, Haemophilus influenzae Rd
uuuauuacauuaaa

SEQ ID NO: 716294 - RNA, 18 nt, Haemophilus influenzae Rd
uuuauuacccuauucuaa

SEQ ID NO: 716295 - RNA, 14 nt, Haemophilus influenzae Rd
uuuauguuucucuc

SEQ ID NO: 716296 - RNA, 17 nt, Haemophilus influenzae Rd
uuuauguuacaaauugc

SEQ ID NO: 716297 - RNA, 22 nt, Haemophilus influenzae Rd
uuuauguucuggauuguuguaa

SEQ ID NO: 716298 - RNA, 19 nt, Haemophilus influenzae Rd
uuuauguugaauuuucacc

SEQ ID NO: 716299 - RNA, 15 nt, Haemophilus influenzae Rd
uuuauugaaauuuua

SEQ ID NO: 716300 - RNA, 20 nt, Haemophilus influenzae Rd
uuuauuacgauaguaaaaaa

SEQ ID NO: 716301 - RNA, 15 nt, Haemophilus influenzae Rd
uuuauuagaaauaua

SEQ ID NO: 716302 - RNA, 23 nt, Haemophilus influenzae Rd
uuuauugccauauaccaauaauu

SEQ ID NO: 716303 - RNA, 22 nt, Haemophilus influenzae Rd
uuuauuuuuccuuuucauaaaa

SEQ ID NO: 716304 - RNA, 14 nt, Haemophilus influenzae Rd
uuuauuuuuucuaa

SEQ ID NO: 716305 - RNA, 15 nt, Haemophilus influenzae Rd
uuuauuuuuucuaaa

SEQ ID NO: 716306 - RNA, 14 nt, Haemophilus influenzae Rd
uuuauuuaacaaua

SEQ ID NO: 716307 - RNA, 16 nt, Haemophilus influenzae Rd
uuuauugguaaauguc

SEQ ID NO: 716308 - RNA, 22 nt, Haemophilus influenzae Rd
uugucucaaaauccaaguuugu

SEQ ID NO: 716309 - RNA, 14 nt, Haemophilus influenzae Rd
uugucguaauaaca

SEQ ID NO: 716310 - RNA, 16 nt, Haemophilus influenzae Rd
uugucguugaacucac

SEQ ID NO: 716311 - RNA, 22 nt, Haemophilus influenzae Rd
uugucuaagguuuccauaaugu

SEQ ID NO: 716312 - RNA, 16 nt, Haemophilus influenzae Rd
uugugacggugaauuu

SEQ ID NO: 716313 - RNA, 23 nt, Haemophilus influenzae Rd
uugugacuacaaacaaauuuuua

SEQ ID NO: 716314 - RNA, 16 nt, Haemophilus influenzae Rd
uugugacucaaacuug

SEQ ID NO: 716315 - RNA, 16 nt, Haemophilus influenzae Rd
uugugcaaaauaaccu

SEQ ID NO: 716316 - RNA, 14 nt, Haemophilus influenzae Rd
uugugccaaauuca

SEQ ID NO: 716317 - RNA, 17 nt, Haemophilus influenzae Rd
uugugccaaauucagua

SEQ ID NO: 716318 - RNA, 20 nt, Haemophilus influenzae Rd
uugugcaucaaagcguucau

SEQ ID NO: 716319 - RNA, 15 nt, Haemophilus influenzae Rd
uugugauguaccaau

SEQ ID NO: 716320 - RNA, 20 nt, Haemophilus influenzae Rd
uugugauguaccaauuugua

SEQ ID NO: 716321 - RNA, 16 nt, Haemophilus influenzae Rd
uugugaguaaaauacg

SEQ ID NO: 716322 - RNA, 14 nt, Haemophilus influenzae Rd
uugugccauuucua

SEQ ID NO: 716323 - RNA, 21 nt, Haemophilus influenzae Rd
uugugccuuuaaagucacgag

SEQ ID NO: 716324 - RNA, 12 nt, Haemophilus influenzae Rd
uugugcuggagu

SEQ ID NO: 716325 - RNA, 22 nt, Haemophilus influenzae Rd
uugugcuggaguugcagauuua

SEQ ID NO: 716326 - RNA, 14 nt, Haemophilus influenzae Rd
uugugcuauacaaa

SEQ ID NO: 716327 - RNA, 15 nt, Haemophilus influenzae Rd
uugugcuaaauuaaa

SEQ ID NO: 716328 - RNA, 19 nt, Haemophilus influenzae Rd
uugugcuguguuuuguaau

SEQ ID NO: 716329 - RNA, 16 nt, Haemophilus influenzae Rd
uuguggacguuucaaa

SEQ ID NO: 716330 - RNA, 19 nt, Haemophilus influenzae Rd
uuguggaaacgugcaauua

SEQ ID NO: 716331 - RNA, 15 nt, Haemophilus influenzae Rd
uuguggaauaaaaua

SEQ ID NO: 716332 - RNA, 19 nt, Haemophilus influenzae Rd
uuguggaauaaaauaaucu

SEQ ID NO: 716333 - RNA, 15 nt, Haemophilus influenzae Rd
uuguggaaugcccag

SEQ ID NO: 716334 - RNA, 19 nt, Haemophilus influenzae Rd
uugugguaauuuauuuaca

SEQ ID NO: 716335 - RNA, 11 nt, Haemophilus influenzae Rd
uugugggaauu

SEQ ID NO: 716336 - RNA, 18 nt, Haemophilus influenzae Rd
uugugugcagaauuugga

SEQ ID NO: 716337 - RNA, 14 nt, Haemophilus influenzae Rd
uuguguauuaagua

SEQ ID NO: 716338 - RNA, 19 nt, Haemophilus influenzae Rd
uuguguuucaacaaaaaua

SEQ ID NO: 716339 - RNA, 20 nt, Haemophilus influenzae Rd
uuguguuucaacaaaaauac

SEQ ID NO: 716340 - RNA, 14 nt, Haemophilus influenzae Rd
uuguuaaauaaaca

SEQ ID NO: 716341 - RNA, 22 nt, Haemophilus influenzae Rd
uuguucaagaugugauauuaaa

SEQ ID NO: 716342 - RNA, 18 nt, Haemophilus influenzae Rd
uuguucaaguuguuugau

SEQ ID NO: 716343 - RNA, 21 nt, Haemophilus influenzae Rd
uuguucaauaucucgugaugc

SEQ ID NO: 716344 - RNA, 15 nt, Haemophilus influenzae Rd
uuguucacaucaaaa

SEQ ID NO: 716345 - RNA, 21 nt, Haemophilus influenzae Rd
uuguucagccaauuuuucaaa

SEQ ID NO: 716346 - RNA, 14 nt, Haemophilus influenzae Rd
uuguuccaggaaaa

SEQ ID NO: 716347 - RNA, 18 nt, Haemophilus influenzae Rd
uuguucgaacguuucaaa

SEQ ID NO: 716348 - RNA, 18 nt, Haemophilus influenzae Rd
uuguucuaagaaaguuuu

SEQ ID NO: 716349 - RNA, 15 nt, Haemophilus influenzae Rd
uuguucuacugguuu

SEQ ID NO: 716350 - RNA, 20 nt, Haemophilus influenzae Rd
uuguucgucaccguauugcu

SEQ ID NO: 716351 - RNA, 23 nt, Haemophilus influenzae Rd
uuguugaauuggaaguuuuuccg

SEQ ID NO: 716352 - RNA, 20 nt, Haemophilus influenzae Rd
uuguugcacauuaauuugug

SEQ ID NO: 716353 - RNA, 15 nt, Haemophilus influenzae Rd
uuguugcacccauuu

SEQ ID NO: 716354 - RNA, 22 nt, Haemophilus influenzae Rd
uuguuuucugaacuaaaauaac

SEQ ID NO: 716355 - RNA, 13 nt, Haemophilus influenzae Rd
uuguuuugcaaua

SEQ ID NO: 716356 - RNA, 18 nt, Haemophilus influenzae Rd
uuuaaaaaguaguaucag

SEQ ID NO: 716357 - RNA, 17 nt, Haemophilus influenzae Rd
uuguuuucuuuuuuucu

SEQ ID NO: 716358 - RNA, 12 nt, Haemophilus influenzae Rd
uuuaaaaauaaa

SEQ ID NO: 716359 - RNA, 17 nt, Haemophilus influenzae Rd
uuguuuucaauaguuuu

SEQ ID NO: 716360 - RNA, 20 nt, Haemophilus influenzae Rd
uuguuugcguucaauaugca

SEQ ID NO: 716361 - RNA, 22 nt, Haemophilus influenzae Rd
uuguuugcguucaauaugcaaa

SEQ ID NO: 716362 - RNA, 15 nt, Haemophilus influenzae Rd
uuguuuuaaaaugga

SEQ ID NO: 716363 - RNA, 15 nt, Haemophilus influenzae Rd
uuguuuuacuucauc

SEQ ID NO: 716364 - RNA, 17 nt, Haemophilus influenzae Rd
uuguuuuacuugaccag

SEQ ID NO: 716365 - RNA, 21 nt, Haemophilus influenzae Rd
uuguuuuacuugaccagagcc

SEQ ID NO: 716366 - RNA, 13 nt, Haemophilus influenzae Rd
uuguaaagauugu

SEQ ID NO: 716367 - RNA, 23 nt, Haemophilus influenzae Rd
uuguaaaagugcgguugauuuuc

SEQ ID NO: 716368 - RNA, 14 nt, Haemophilus influenzae Rd
uuguaaaauaucca

SEQ ID NO: 716369 - RNA, 15 nt, Haemophilus influenzae Rd
uuguaaaauauccac

SEQ ID NO: 716370 - RNA, 16 nt, Haemophilus influenzae Rd
uuguaaaaucucuauu

SEQ ID NO: 716371 - RNA, 16 nt, Haemophilus influenzae Rd
uuguaaaauugguggg

SEQ ID NO: 716372 - RNA, 16 nt, Haemophilus influenzae Rd
uuguaaguuguaaauu

SEQ ID NO: 716373 - RNA, 18 nt, Haemophilus influenzae Rd
uuguaaguuguaaauugc

SEQ ID NO: 716374 - RNA, 17 nt, Haemophilus influenzae Rd
uuguaacguauuuaaaa

SEQ ID NO: 716375 - RNA, 17 nt, Haemophilus influenzae Rd
uuguaagcgauaaauau

SEQ ID NO: 716376 - RNA, 20 nt, Haemophilus influenzae Rd
uuguaagcaacacagauuuu

SEQ ID NO: 716377 - RNA, 21 nt, Haemophilus influenzae Rd
uuguaagcguaaugcacuuuc

SEQ ID NO: 716378 - RNA, 20 nt, Haemophilus influenzae Rd
uuguaauugauuuucagaaa

SEQ ID NO: 716379 - RNA, 17 nt, Haemophilus influenzae Rd
uuguaauugcucuaauu

SEQ ID NO: 716380 - RNA, 21 nt, Haemophilus influenzae Rd
uuguaauaaauuuuauuaugu

SEQ ID NO: 716381 - RNA, 23 nt, Haemophilus influenzae Rd
uuguaauaaauuuuauuauguuu

SEQ ID NO: 716382 - RNA, 14 nt, Haemophilus influenzae Rd
uuguaauaaugaau

SEQ ID NO: 716383 - RNA, 20 nt, Haemophilus influenzae Rd
uuguaauccauuuugaacaa

SEQ ID NO: 716384 - RNA, 15 nt, Haemophilus influenzae Rd
uuguaauccugcauu

SEQ ID NO: 716385 - RNA, 18 nt, Haemophilus influenzae Rd
uuguaauccugcauuuuc

SEQ ID NO: 716386 - RNA, 22 nt, Haemophilus influenzae Rd
uuguaaugcaaaccauuuaucc

SEQ ID NO: 716387 - RNA, 20 nt, Haemophilus influenzae Rd
uuguaaugucgugaaagaau

SEQ ID NO: 716388 - RNA, 22 nt, Haemophilus influenzae Rd
uuguaccuucugcugcaguuuc

SEQ ID NO: 716389 - RNA, 19 nt, Haemophilus influenzae Rd
uuguagagcagggauuuuc

SEQ ID NO: 716390 - RNA, 15 nt, Haemophilus influenzae Rd
uuguaggauguucaa

SEQ ID NO: 716391 - RNA, 20 nt, Haemophilus influenzae Rd
uuguaggauguucaaguaaa

SEQ ID NO: 716392 - RNA, 16 nt, Haemophilus influenzae Rd
uuguacuuuagaaauu

SEQ ID NO: 716393 - RNA, 18 nt, Haemophilus influenzae Rd
uuguacuauuuuauaauc

SEQ ID NO: 716394 - RNA, 19 nt, Haemophilus influenzae Rd
uuguacuguggauaauuca

SEQ ID NO: 716395 - RNA, 16 nt, Haemophilus influenzae Rd
uuguacuucuaaaagc

SEQ ID NO: 716396 - RNA, 18 nt, Haemophilus influenzae Rd
uuguacuucuaaaagcug

SEQ ID NO: 716397 - RNA, 22 nt, Haemophilus influenzae Rd
uuguagaaaagaccaugccugu

SEQ ID NO: 716398 - RNA, 22 nt, Haemophilus influenzae Rd
uuguauguuggcgaauuugguu

SEQ ID NO: 716399 - RNA, 14 nt, Haemophilus influenzae Rd
uuguauauugugac

SEQ ID NO: 716400 - RNA, 22 nt, Haemophilus influenzae Rd
uuguauagaacgguuaugaaaa

SEQ ID NO: 716401 - RNA, 13 nt, Haemophilus influenzae Rd
uugucagauuuac

SEQ ID NO: 716402 - RNA, 16 nt, Haemophilus influenzae Rd
uuguccaaagaauaau

SEQ ID NO: 716403 - RNA, 21 nt, Haemophilus influenzae Rd
uuguccaaagaauaauaagug

SEQ ID NO: 716404 - RNA, 15 nt, Haemophilus influenzae Rd
uuguccaugaaaaac

SEQ ID NO: 716405 - RNA, 14 nt, Haemophilus influenzae Rd
uugucccaaaauau

SEQ ID NO: 716406 - RNA, 18 nt, Haemophilus influenzae Rd
uugucccgcauauaaaau

SEQ ID NO: 716407 - RNA, 17 nt, Haemophilus influenzae Rd
uugucauugccauuucu

SEQ ID NO: 716408 - RNA, 20 nt, Haemophilus influenzae Rd
uugucauugccauuucugca

SEQ ID NO: 716409 - RNA, 12 nt, Haemophilus influenzae Rd
uuguccucccau

SEQ ID NO: 716410 - RNA, 15 nt, Haemophilus influenzae Rd
uuguccuuuugccau

SEQ ID NO: 716411 - RNA, 17 nt, Haemophilus influenzae Rd
uuccaauacaaucagcu

SEQ ID NO: 716412 - RNA, 17 nt, Haemophilus influenzae Rd
uuccaauaggaaacuac

SEQ ID NO: 716413 - RNA, 17 nt, Haemophilus influenzae Rd
uuccgcaauuucugcca

SEQ ID NO: 716414 - RNA, 23 nt, Haemophilus influenzae Rd
uuccgcacuuuuuauucaaaucg

SEQ ID NO: 716415 - RNA, 13 nt, Haemophilus influenzae Rd
uucgacaauuugu

SEQ ID NO: 716416 - RNA, 22 nt, Haemophilus influenzae Rd
uucgaccaagucagcucaagca

SEQ ID NO: 716417 - RNA, 21 nt, Haemophilus influenzae Rd
uucgacaggaacauucacacc

SEQ ID NO: 716418 - RNA, 13 nt, Haemophilus influenzae Rd
uuccuuauucaaa

SEQ ID NO: 716419 - RNA, 19 nt, Haemophilus influenzae Rd
uuccuuauucgcugcaaaa

SEQ ID NO: 716420 - RNA, 15 nt, Haemophilus influenzae Rd
uuccgugacaucauc

SEQ ID NO: 716421 - RNA, 20 nt, Haemophilus influenzae Rd
uuccgugccacgaauaagca

SEQ ID NO: 716422 - RNA, 16 nt, Haemophilus influenzae Rd
uuccuaaaauacaaau

SEQ ID NO: 716423 - RNA, 12 nt, Haemophilus influenzae Rd
uuccuuauauuc

SEQ ID NO: 716424 - RNA, 19 nt, Haemophilus influenzae Rd
uuccugacccacaucauca

SEQ ID NO: 716425 - RNA, 14 nt, Haemophilus influenzae Rd
uuccugaauaacua

SEQ ID NO: 716426 - RNA, 15 nt, Haemophilus influenzae Rd
uuccugaauaacuac

SEQ ID NO: 716427 - RNA, 14 nt, Haemophilus influenzae Rd
uucgccaccuuuua

SEQ ID NO: 716428 - RNA, 18 nt, Haemophilus influenzae Rd
uucgccccaaacaggaau

SEQ ID NO: 716429 - RNA, 16 nt, Haemophilus influenzae Rd
uucgccauuuuuaaaa

SEQ ID NO: 716430 - RNA, 22 nt, Haemophilus influenzae Rd
uucgauuuaacacuuuuucuau

SEQ ID NO: 716431 - RNA, 21 nt, Haemophilus influenzae Rd
uucgccacuggugcugaaaau

SEQ ID NO: 716432 - RNA, 23 nt, Haemophilus influenzae Rd
uucgccagcaccacguucauaaa

SEQ ID NO: 716433 - RNA, 12 nt, Haemophilus influenzae Rd
uucgcaaauaac

SEQ ID NO: 716434 - RNA, 21 nt, Haemophilus influenzae Rd
uucgcaauaucgcgugagcga

SEQ ID NO: 716435 - RNA, 14 nt, Haemophilus influenzae Rd
uucgcaaucagcau

SEQ ID NO: 716436 - RNA, 12 nt, Haemophilus influenzae Rd
uucgcacaaacu

SEQ ID NO: 716437 - RNA, 18 nt, Haemophilus influenzae Rd
uucgaucucugccauacu

SEQ ID NO: 716438 - RNA, 18 nt, Haemophilus influenzae Rd
uucguccaguuauaauaa

SEQ ID NO: 716439 - RNA, 16 nt, Haemophilus influenzae Rd
uucguccaaaaucucu

SEQ ID NO: 716440 - RNA, 14 nt, Haemophilus influenzae Rd
uucgggcaccauuu

SEQ ID NO: 716441 - RNA, 15 nt, Haemophilus influenzae Rd
uucgcguuguucaau

SEQ ID NO: 716442 - RNA, 19 nt, Haemophilus influenzae Rd
uucgcguuuauuuaacaau

SEQ ID NO: 716443 - RNA, 16 nt, Haemophilus influenzae Rd
uucggauuaagugcgg

SEQ ID NO: 716444 - RNA, 17 nt, Haemophilus influenzae Rd
uucggcgaugguaaaau

SEQ ID NO: 716445 - RNA, 21 nt, Haemophilus influenzae Rd
uucuccgccugauucgccaaa

SEQ ID NO: 716446 - RNA, 17 nt, Haemophilus influenzae Rd
uucuccguuagcaauaa

SEQ ID NO: 716447 - RNA, 22 nt, Haemophilus influenzae Rd
uucuccauuaagcacaggcgua

SEQ ID NO: 716448 - RNA, 14 nt, Haemophilus influenzae Rd
uucuccauuugccc

SEQ ID NO: 716449 - RNA, 15 nt, Haemophilus influenzae Rd
uucucccugauuauu

SEQ ID NO: 716450 - RNA, 13 nt, Haemophilus influenzae Rd
uucugaauaaauu

SEQ ID NO: 716451 - RNA, 13 nt, Haemophilus influenzae Rd
uucugcugcacga

SEQ ID NO: 716452 - RNA, 19 nt, Haemophilus influenzae Rd
uucugcuugguaauaauca

SEQ ID NO: 716453 - RNA, 15 nt, Haemophilus influenzae Rd
uucuggaaauucgua

SEQ ID NO: 716454 - RNA, 22 nt, Haemophilus influenzae Rd
uucuggauuguuguaauccauu

SEQ ID NO: 716455 - RNA, 15 nt, Haemophilus influenzae Rd
uucugauaauuuuuc

SEQ ID NO: 716456 - RNA, 16 nt, Haemophilus influenzae Rd
uucugauaauuuuuca

SEQ ID NO: 716457 - RNA, 23 nt, Haemophilus influenzae Rd
uucugauaauuuuucacuguauu

SEQ ID NO: 716458 - RNA, 16 nt, Haemophilus influenzae Rd
uucugcuccacaaaaa

SEQ ID NO: 716459 - RNA, 17 nt, Haemophilus influenzae Rd
uucugcucuucaucaaa

SEQ ID NO: 716460 - RNA, 23 nt, Haemophilus influenzae Rd
uucuaaaaaugcguucagaauuu

SEQ ID NO: 716461 - RNA, 13 nt, Haemophilus influenzae Rd
uucuaaaaauuac

SEQ ID NO: 716462 - RNA, 14 nt, Haemophilus influenzae Rd
uucuaaaaauuacc

SEQ ID NO: 716463 - RNA, 18 nt, Haemophilus influenzae Rd
uucuaaaaaacguauuau

SEQ ID NO: 716464 - RNA, 18 nt, Haemophilus influenzae Rd
uucuaaaaccaauaaucc

SEQ ID NO: 716465 - RNA, 17 nt, Haemophilus influenzae Rd
uucuaaaauaauaucac

SEQ ID NO: 716466 - RNA, 15 nt, Haemophilus influenzae Rd
uucuagcgguaaacc

SEQ ID NO: 716467 - RNA, 21 nt, Haemophilus influenzae Rd
uucuagcgguaaaccaacucu

SEQ ID NO: 716468 - RNA, 17 nt, Haemophilus influenzae Rd
uucuaaacgaugugcau

SEQ ID NO: 716469 - RNA, 23 nt, Haemophilus influenzae Rd
uucuaaacucggaauuuuuuuca

SEQ ID NO: 716470 - RNA, 17 nt, Haemophilus influenzae Rd
uucuacuugaguugcgg

SEQ ID NO: 716471 - RNA, 16 nt, Haemophilus influenzae Rd
uucuaucagaucgaua

SEQ ID NO: 716472 - RNA, 15 nt, Haemophilus influenzae Rd
uucuauauuauuuaa

SEQ ID NO: 716473 - RNA, 18 nt, Haemophilus influenzae Rd
uucuauauuuugaauaau

SEQ ID NO: 716474 - RNA, 21 nt, Haemophilus influenzae Rd
uucuaucuacuacgcuaacac

SEQ ID NO: 716475 - RNA, 15 nt, Haemophilus influenzae Rd
uucucaauaaauauc

SEQ ID NO: 716476 - RNA, 18 nt, Haemophilus influenzae Rd
uucuuaagguuuauagau

SEQ ID NO: 716477 - RNA, 17 nt, Haemophilus influenzae Rd
uucuuacaacaaauugu

SEQ ID NO: 716478 - RNA, 18 nt, Haemophilus influenzae Rd
uucuuacaacaaauugug

SEQ ID NO: 716479 - RNA, 22 nt, Haemophilus influenzae Rd
uucuuaucuacaaucaaaaaau

SEQ ID NO: 716480 - RNA, 14 nt, Haemophilus influenzae Rd
uucuuauauucaaa

SEQ ID NO: 716481 - RNA, 18 nt, Haemophilus influenzae Rd
uucuuauauucaaauuuc

SEQ ID NO: 716482 - RNA, 19 nt, Haemophilus influenzae Rd
uucuuauagauaaaauguu

SEQ ID NO: 716483 - RNA, 16 nt, Haemophilus influenzae Rd
uucuuauauauaaaau

SEQ ID NO: 716484 - RNA, 20 nt, Haemophilus influenzae Rd
uucuuagauuucuaauaaca

SEQ ID NO: 716485 - RNA, 21 nt, Haemophilus influenzae Rd
uucuggguaaaauaaugcaaa

SEQ ID NO: 716486 - RNA, 19 nt, Haemophilus influenzae Rd
uucugguaucggucuugcu

SEQ ID NO: 716487 - RNA, 14 nt, Haemophilus influenzae Rd
uucuggcuguuuug

SEQ ID NO: 716488 - RNA, 15 nt, Haemophilus influenzae Rd
uucuguaccugcauu

SEQ ID NO: 716489 - RNA, 16 nt, Haemophilus influenzae Rd
uucuguaaauaugccu

SEQ ID NO: 716490 - RNA, 22 nt, Haemophilus influenzae Rd
uucugugcaauauuuccucuaa

SEQ ID NO: 716491 - RNA, 13 nt, Haemophilus influenzae Rd
uucuguugcuuca

SEQ ID NO: 716492 - RNA, 18 nt, Haemophilus influenzae Rd
uucuguugggaauaauuc

SEQ ID NO: 716493 - RNA, 13 nt, Haemophilus influenzae Rd
uucuucagaacug

SEQ ID NO: 716494 - RNA, 18 nt, Haemophilus influenzae Rd
uucuucagcuuguuuaau

SEQ ID NO: 716495 - RNA, 13 nt, Haemophilus influenzae Rd
uucuucaauaaca

SEQ ID NO: 716496 - RNA, 13 nt, Haemophilus influenzae Rd
uucuucaauaauu

SEQ ID NO: 716497 - RNA, 17 nt, Haemophilus influenzae Rd
uucuucaauaauugaag

SEQ ID NO: 716498 - RNA, 13 nt, Haemophilus influenzae Rd
uucuucaaagauu

SEQ ID NO: 716499 - RNA, 13 nt, Haemophilus influenzae Rd
uucuuauucagua

SEQ ID NO: 716500 - RNA, 15 nt, Haemophilus influenzae Rd
uucuucgcgagaauu

SEQ ID NO: 716501 - RNA, 14 nt, Haemophilus influenzae Rd
uucuuccuguuuau

SEQ ID NO: 716502 - RNA, 18 nt, Haemophilus influenzae Rd
uucuuccuugguuaaucc

SEQ ID NO: 716503 - RNA, 19 nt, Haemophilus influenzae Rd
uucuuccuugguuaauccu

SEQ ID NO: 716504 - RNA, 13 nt, Haemophilus influenzae Rd
uucuucgauuuuu

SEQ ID NO: 716505 - RNA, 18 nt, Haemophilus influenzae Rd
uucuucgauuuuucuaaa

SEQ ID NO: 716506 - RNA, 22 nt, Haemophilus influenzae Rd
uucuucgccauuuucuuguucu

SEQ ID NO: 716507 - RNA, 22 nt, Haemophilus influenzae Rd
uucuucccagcguaaaaaugcu

SEQ ID NO: 716508 - RNA, 23 nt, Haemophilus influenzae Rd
uucuucccaaccuaauuguucag

SEQ ID NO: 716509 - RNA, 21 nt, Haemophilus influenzae Rd
uucuucccaaucuuguuuuaa

SEQ ID NO: 716510 - RNA, 15 nt, Haemophilus influenzae Rd
uucuucugcaggaaa

SEQ ID NO: 716511 - RNA, 17 nt, Haemophilus influenzae Rd
uucuucugauagaggaa

SEQ ID NO: 716512 - RNA, 14 nt, Haemophilus influenzae Rd
uucuucuaauucuu

SEQ ID NO: 716513 - RNA, 23 nt, Haemophilus influenzae Rd
uucaguugcuucgccagcagugc

SEQ ID NO: 716514 - RNA, 12 nt, Haemophilus influenzae Rd
uucauaaaaauu

SEQ ID NO: 716515 - RNA, 23 nt, Haemophilus influenzae Rd
uucaguuuucauuuuuuggugca

SEQ ID NO: 716516 - RNA, 11 nt, Haemophilus influenzae Rd
uucauaaaaaa

SEQ ID NO: 716517 - RNA, 13 nt, Haemophilus influenzae Rd
uucauaaaaaaag

SEQ ID NO: 716518 - RNA, 20 nt, Haemophilus influenzae Rd
uucagugguaaucauuaagc

SEQ ID NO: 716519 - RNA, 13 nt, Haemophilus influenzae Rd
uucauaaauaauu

SEQ ID NO: 716520 - RNA, 15 nt, Haemophilus influenzae Rd
uucauaaauucaucu

SEQ ID NO: 716521 - RNA, 20 nt, Haemophilus influenzae Rd
uucauaagcucgaaguuuug

SEQ ID NO: 716522 - RNA, 16 nt, Haemophilus influenzae Rd
uucaguaagaaaccaa

SEQ ID NO: 716523 - RNA, 17 nt, Haemophilus influenzae Rd
uucaguaagaaaccaac

SEQ ID NO: 716524 - RNA, 20 nt, Haemophilus influenzae Rd
uucagguugcgguaaaucua

SEQ ID NO: 716525 - RNA, 23 nt, Haemophilus influenzae Rd
uucaguaaacaaguauaaaaaau

SEQ ID NO: 716526 - RNA, 23 nt, Haemophilus influenzae Rd
uucaggugcuauuuuauuuagaa

SEQ ID NO: 716527 - RNA, 16 nt, Haemophilus influenzae Rd
uucagugcuuuuucaa

SEQ ID NO: 716528 - RNA, 22 nt, Haemophilus influenzae Rd
uucagcguugucaucagaaaua

SEQ ID NO: 716529 - RNA, 20 nt, Haemophilus influenzae Rd
uucauagaaggcuaguucuu

SEQ ID NO: 716530 - RNA, 15 nt, Haemophilus influenzae Rd
uucauaguuuggcuc

SEQ ID NO: 716531 - RNA, 22 nt, Haemophilus influenzae Rd
uucauaguuuucugauuuaaaa

SEQ ID NO: 716532 - RNA, 19 nt, Haemophilus influenzae Rd
uucauauaaucuccauaau

SEQ ID NO: 716533 - RNA, 22 nt, Haemophilus influenzae Rd
uucauauaaucuccauaauauu

SEQ ID NO: 716534 - RNA, 13 nt, Haemophilus influenzae Rd
uucauaccgauaa

SEQ ID NO: 716535 - RNA, 20 nt, Haemophilus influenzae Rd
uucauauucccaaggcucca

SEQ ID NO: 716536 - RNA, 21 nt, Haemophilus influenzae Rd
uucauaugcgaucacugcacc

SEQ ID NO: 716537 - RNA, 17 nt, Haemophilus influenzae Rd
uucauaucucacaauaa

SEQ ID NO: 716538 - RNA, 18 nt, Haemophilus influenzae Rd
uucauaucucacaauaau

SEQ ID NO: 716539 - RNA, 21 nt, Haemophilus influenzae Rd
uucauauccaccacaauuaau

SEQ ID NO: 716540 - RNA, 21 nt, Haemophilus influenzae Rd
uucauauuugaaguugccaua

SEQ ID NO: 716541 - RNA, 16 nt, Haemophilus influenzae Rd
uucauauuuuaaauaa

SEQ ID NO: 716542 - RNA, 13 nt, Haemophilus influenzae Rd
uucaucaaaauga

SEQ ID NO: 716543 - RNA, 17 nt, Haemophilus influenzae Rd
uucaucccagauuuuac

SEQ ID NO: 716544 - RNA, 14 nt, Haemophilus influenzae Rd
uucauccaauacug

SEQ ID NO: 716545 - RNA, 16 nt, Haemophilus influenzae Rd
uucauccaauccuuua

SEQ ID NO: 716546 - RNA, 14 nt, Haemophilus influenzae Rd
uucaucacuucaaa

SEQ ID NO: 716547 - RNA, 18 nt, Haemophilus influenzae Rd
uucaucaggcauugcgcc

SEQ ID NO: 716548 - RNA, 16 nt, Haemophilus influenzae Rd
uucaucacccaucaaa

SEQ ID NO: 716549 - RNA, 14 nt, Haemophilus influenzae Rd
uucaucaauuuuga

SEQ ID NO: 716550 - RNA, 18 nt, Haemophilus influenzae Rd
uucaucauaauuuauuca

SEQ ID NO: 716551 - RNA, 15 nt, Haemophilus influenzae Rd
uucaucauaaauuuc

SEQ ID NO: 716552 - RNA, 16 nt, Haemophilus influenzae Rd
uucaucauuacuuuuu

SEQ ID NO: 716553 - RNA, 12 nt, Haemophilus influenzae Rd
uucaucauugcu

SEQ ID NO: 716554 - RNA, 16 nt, Haemophilus influenzae Rd
uucaucauuucuuaau

SEQ ID NO: 716555 - RNA, 18 nt, Haemophilus influenzae Rd
uuccaaaucauaccaauu

SEQ ID NO: 716556 - RNA, 23 nt, Haemophilus influenzae Rd
uuccaaaucauaccaauugcaac

SEQ ID NO: 716557 - RNA, 22 nt, Haemophilus influenzae Rd
uuccaaauuccaucaauuaaug

SEQ ID NO: 716558 - RNA, 13 nt, Haemophilus influenzae Rd
uuccaacaaaaua

SEQ ID NO: 716559 - RNA, 14 nt, Haemophilus influenzae Rd
uucauuuuaaauua

SEQ ID NO: 716560 - RNA, 16 nt, Haemophilus influenzae Rd
uucauuuuaaauuauu

SEQ ID NO: 716561 - RNA, 22 nt, Haemophilus influenzae Rd
uucauuuucgacauucgcauau

SEQ ID NO: 716562 - RNA, 14 nt, Haemophilus influenzae Rd
uuccaaaaaccaac

SEQ ID NO: 716563 - RNA, 15 nt, Haemophilus influenzae Rd
uucauuccauucuaa

SEQ ID NO: 716564 - RNA, 18 nt, Haemophilus influenzae Rd
uucauuccauuuugcaua

SEQ ID NO: 716565 - RNA, 18 nt, Haemophilus influenzae Rd
uucauucguauaaauauu

SEQ ID NO: 716566 - RNA, 15 nt, Haemophilus influenzae Rd
uucauugcauuuuua

SEQ ID NO: 716567 - RNA, 16 nt, Haemophilus influenzae Rd
uucauugcauuuuuau

SEQ ID NO: 716568 - RNA, 22 nt, Haemophilus influenzae Rd
uucauucaaaaauaaagcccug

SEQ ID NO: 716569 - RNA, 16 nt, Haemophilus influenzae Rd
uucauucaacaaaaau

SEQ ID NO: 716570 - RNA, 14 nt, Haemophilus influenzae Rd
uucauuguuaaaua

SEQ ID NO: 716571 - RNA, 21 nt, Haemophilus influenzae Rd
uucauuguuucucaauaaaua

SEQ ID NO: 716572 - RNA, 13 nt, Haemophilus influenzae Rd
uucauuuaaaaua

SEQ ID NO: 716573 - RNA, 19 nt, Haemophilus influenzae Rd
uucauuuaaaauauauauu

SEQ ID NO: 716574 - RNA, 18 nt, Haemophilus influenzae Rd
uucauuuaguuuaagggc

SEQ ID NO: 716575 - RNA, 19 nt, Haemophilus influenzae Rd
uucauuuauguuauuuuga

SEQ ID NO: 716576 - RNA, 15 nt, Haemophilus influenzae Rd
uucauuugaacaauu

SEQ ID NO: 716577 - RNA, 18 nt, Haemophilus influenzae Rd
uucauuugcuuuaaccca

SEQ ID NO: 716578 - RNA, 16 nt, Haemophilus influenzae Rd
uucaugauguaauucu

SEQ ID NO: 716579 - RNA, 22 nt, Haemophilus influenzae Rd
uucaugauguaauucugcuuuu

SEQ ID NO: 716580 - RNA, 19 nt, Haemophilus influenzae Rd
uucaugauuaacaaugauu

SEQ ID NO: 716581 - RNA, 18 nt, Haemophilus influenzae Rd
uucaugauuuuccaaaau

SEQ ID NO: 716582 - RNA, 21 nt, Haemophilus influenzae Rd
uucaugauuuuccaaaauuuc

SEQ ID NO: 716583 - RNA, 21 nt, Haemophilus influenzae Rd
uucaugguuuguuccaauucu

SEQ ID NO: 716584 - RNA, 18 nt, Haemophilus influenzae Rd
uucaugugggcuuuacaa

SEQ ID NO: 716585 - RNA, 21 nt, Haemophilus influenzae Rd
uucaugugggcuuuacaauga

SEQ ID NO: 716586 - RNA, 22 nt, Haemophilus influenzae Rd
uucauuaauaaccuugcugaua

SEQ ID NO: 716587 - RNA, 19 nt, Haemophilus influenzae Rd
uucauuaacgcuuaaauga

SEQ ID NO: 716588 - RNA, 23 nt, Haemophilus influenzae Rd
uucauuaaaaccaauuuuuucau

SEQ ID NO: 716589 - RNA, 13 nt, Haemophilus influenzae Rd
uucauuaaacuga

SEQ ID NO: 716590 - RNA, 15 nt, Haemophilus influenzae Rd
uucauuaaagaagaa

SEQ ID NO: 716591 - RNA, 19 nt, Haemophilus influenzae Rd
uucaucguuugaacaaauu

SEQ ID NO: 716592 - RNA, 15 nt, Haemophilus influenzae Rd
uucaucguuaauuaa

SEQ ID NO: 716593 - RNA, 22 nt, Haemophilus influenzae Rd
uucaucuacaccaaaaccaaua

SEQ ID NO: 716594 - RNA, 16 nt, Haemophilus influenzae Rd
uucaucuggugaguga

SEQ ID NO: 716595 - RNA, 16 nt, Haemophilus influenzae Rd
uucaucuguuggaaug

SEQ ID NO: 716596 - RNA, 19 nt, Haemophilus influenzae Rd
uucaucuuuuaacacgaaa

SEQ ID NO: 716597 - RNA, 15 nt, Haemophilus influenzae Rd
uucaucuucaucaau

SEQ ID NO: 716598 - RNA, 22 nt, Haemophilus influenzae Rd
uucaucuucauuccauuuugca

SEQ ID NO: 716599 - RNA, 20 nt, Haemophilus influenzae Rd
uucaucuucagcauuuaaaa

SEQ ID NO: 716600 - RNA, 14 nt, Haemophilus influenzae Rd
uucaucuuuaccca

SEQ ID NO: 716601 - RNA, 18 nt, Haemophilus influenzae Rd
uucaucuuuuuauaaaaa

SEQ ID NO: 716602 - RNA, 16 nt, Haemophilus influenzae Rd
uucaacaauucauaaa

SEQ ID NO: 716603 - RNA, 22 nt, Haemophilus influenzae Rd
uucaacacgguggcauuuacgu

SEQ ID NO: 716604 - RNA, 19 nt, Haemophilus influenzae Rd
uucaacacgccuaacauaa

SEQ ID NO: 716605 - RNA, 19 nt, Haemophilus influenzae Rd
uucaaauuucauccuaaaa

SEQ ID NO: 716606 - RNA, 23 nt, Haemophilus influenzae Rd
uucaacaaaaaacaccuaaaaug

SEQ ID NO: 716607 - RNA, 13 nt, Haemophilus influenzae Rd
uucaacaaaaaua

SEQ ID NO: 716608 - RNA, 23 nt, Haemophilus influenzae Rd
uucaacaaaaauacguuguuuuu

SEQ ID NO: 716609 - RNA, 17 nt, Haemophilus influenzae Rd
uucaaaucuugacauaa

SEQ ID NO: 716610 - RNA, 17 nt, Haemophilus influenzae Rd
uucaaauccaaugaucc

SEQ ID NO: 716611 - RNA, 20 nt, Haemophilus influenzae Rd
uucaacuaaaggcacaaaaa

SEQ ID NO: 716612 - RNA, 22 nt, Haemophilus influenzae Rd
uucaacuaaaggcacaaaaaau

SEQ ID NO: 716613 - RNA, 18 nt, Haemophilus influenzae Rd
uucaacuugccacaguag

SEQ ID NO: 716614 - RNA, 19 nt, Haemophilus influenzae Rd
uucaacuuccgcuaauacu

SEQ ID NO: 716615 - RNA, 20 nt, Haemophilus influenzae Rd
uucaacuuccgcuaauacua

SEQ ID NO: 716616 - RNA, 17 nt, Haemophilus influenzae Rd
uucaaacugaucauaau

SEQ ID NO: 716617 - RNA, 13 nt, Haemophilus influenzae Rd
uuauuuuaaauaa

SEQ ID NO: 716618 - RNA, 14 nt, Haemophilus influenzae Rd
uuauuuuaaauaaa

SEQ ID NO: 716619 - RNA, 12 nt, Haemophilus influenzae Rd
uuauuuuaauuu

SEQ ID NO: 716620 - RNA, 12 nt, Haemophilus influenzae Rd
uuauuuuaugaa

SEQ ID NO: 716621 - RNA, 19 nt, Haemophilus influenzae Rd
uucaaauaacguaaccauu

SEQ ID NO: 716622 - RNA, 17 nt, Haemophilus influenzae Rd
uucaaagauuuuaaaau

SEQ ID NO: 716623 - RNA, 17 nt, Haemophilus influenzae Rd
uucaaagauuauuuaau

SEQ ID NO: 716624 - RNA, 12 nt, Haemophilus influenzae Rd
uucaaagcgaug

SEQ ID NO: 716625 - RNA, 15 nt, Haemophilus influenzae Rd
uuauuaucuucuaaa

SEQ ID NO: 716626 - RNA, 19 nt, Haemophilus influenzae Rd
uuauuaucuucuaaaagag

SEQ ID NO: 716627 - RNA, 20 nt, Haemophilus influenzae Rd
uuauuaucaacaguaaauuu

SEQ ID NO: 716628 - RNA, 23 nt, Haemophilus influenzae Rd
uuaggagaagauuuauauuccau

SEQ ID NO: 716629 - RNA, 19 nt, Haemophilus influenzae Rd
uuagcgugaauauauuauu

SEQ ID NO: 716630 - RNA, 15 nt, Haemophilus influenzae Rd
uuaggacaauauuua

SEQ ID NO: 716631 - RNA, 19 nt, Haemophilus influenzae Rd
uuaggacaauauuuacucu

SEQ ID NO: 716632 - RNA, 15 nt, Haemophilus influenzae Rd
uuauucauauccaaa

SEQ ID NO: 716633 - RNA, 16 nt, Haemophilus influenzae Rd
uuauucccccauuaaa

SEQ ID NO: 716634 - RNA, 20 nt, Haemophilus influenzae Rd
uuauucccccauuaaaagaa

SEQ ID NO: 716635 - RNA, 23 nt, Haemophilus influenzae Rd
uuauuauuucguuguuuuaauaa

SEQ ID NO: 716636 - RNA, 16 nt, Haemophilus influenzae Rd
uuauuuaguuuaacuu

SEQ ID NO: 716637 - RNA, 14 nt, Haemophilus influenzae Rd
uuauuguagccuag

SEQ ID NO: 716638 - RNA, 13 nt, Haemophilus influenzae Rd
uuauuuacuuuau

SEQ ID NO: 716639 - RNA, 16 nt, Haemophilus influenzae Rd
uuauuuacuuuauaaa

SEQ ID NO: 716640 - RNA, 20 nt, Haemophilus influenzae Rd
uuauuuauagcauuuaaaua

SEQ ID NO: 716641 - RNA, 15 nt, Haemophilus influenzae Rd
uuauuuauucagcuu

SEQ ID NO: 716642 - RNA, 22 nt, Haemophilus influenzae Rd
uuauuuauuugcuaaaauuacc

SEQ ID NO: 716643 - RNA, 14 nt, Haemophilus influenzae Rd
uuauucguuugcaa

SEQ ID NO: 716644 - RNA, 21 nt, Haemophilus influenzae Rd
uuauucgguguucugcaucaa

SEQ ID NO: 716645 - RNA, 21 nt, Haemophilus influenzae Rd
uuauuggacugcauauucaua

SEQ ID NO: 716646 - RNA, 23 nt, Haemophilus influenzae Rd
uuauuggacugcauauucauaaa

SEQ ID NO: 716647 - RNA, 23 nt, Haemophilus influenzae Rd
uuauugcccgugaguaaaauaua

SEQ ID NO: 716648 - RNA, 12 nt, Haemophilus influenzae Rd
uuauugccuaau

SEQ ID NO: 716649 - RNA, 20 nt, Haemophilus influenzae Rd
uuauugccuaauaaaaaaua

SEQ ID NO: 716650 - RNA, 21 nt, Haemophilus influenzae Rd
uuauugccuaauaaaaaauaa

SEQ ID NO: 716651 - RNA, 18 nt, Haemophilus influenzae Rd
uuauugccuuucaucauu

SEQ ID NO: 716652 - RNA, 16 nt, Haemophilus influenzae Rd
uuauugcggguuuuau

SEQ ID NO: 716653 - RNA, 18 nt, Haemophilus influenzae Rd
uuauugcggguuuuauuu

SEQ ID NO: 716654 - RNA, 17 nt, Haemophilus influenzae Rd
uucacauucuuuuaaau

SEQ ID NO: 716655 - RNA, 13 nt, Haemophilus influenzae Rd
uucacaacuuuuu

SEQ ID NO: 716656 - RNA, 18 nt, Haemophilus influenzae Rd
uucacaacuuuuuaacug

SEQ ID NO: 716657 - RNA, 17 nt, Haemophilus influenzae Rd
uucacaaaucuaaaaau

SEQ ID NO: 716658 - RNA, 12 nt, Haemophilus influenzae Rd
uucacaaacaua

SEQ ID NO: 716659 - RNA, 16 nt, Haemophilus influenzae Rd
uucacaaacauaccua

SEQ ID NO: 716660 - RNA, 12 nt, Haemophilus influenzae Rd
uucacaaaccca

SEQ ID NO: 716661 - RNA, 14 nt, Haemophilus influenzae Rd
uucaauuuuuccac

SEQ ID NO: 716662 - RNA, 15 nt, Haemophilus influenzae Rd
uucacaaaacaacca

SEQ ID NO: 716663 - RNA, 19 nt, Haemophilus influenzae Rd
uucacaaaaguuugcaaca

SEQ ID NO: 716664 - RNA, 22 nt, Haemophilus influenzae Rd
uucacaaaaguuugcaacauau

SEQ ID NO: 716665 - RNA, 17 nt, Haemophilus influenzae Rd
uucaauuugaccuugaa

SEQ ID NO: 716666 - RNA, 23 nt, Haemophilus influenzae Rd
uucaauuuuccccucaauuugug

SEQ ID NO: 716667 - RNA, 18 nt, Haemophilus influenzae Rd
uucaauuuucugugaguc

SEQ ID NO: 716668 - RNA, 18 nt, Haemophilus influenzae Rd
uucaauuaccuuagccaa

SEQ ID NO: 716669 - RNA, 15 nt, Haemophilus influenzae Rd
uucaauuaaaucaaa

SEQ ID NO: 716670 - RNA, 21 nt, Haemophilus influenzae Rd
uucaauuaaaucaaaaauuaa

SEQ ID NO: 716671 - RNA, 14 nt, Haemophilus influenzae Rd
uucaauucuucuaa

SEQ ID NO: 716672 - RNA, 15 nt, Haemophilus influenzae Rd
uucaauucuucuaau

SEQ ID NO: 716673 - RNA, 23 nt, Haemophilus influenzae Rd
uucaauugccauaggauuauuca

SEQ ID NO: 716674 - RNA, 23 nt, Haemophilus influenzae Rd
uucaaucgaaaguggcuuuuuuc

SEQ ID NO: 716675 - RNA, 20 nt, Haemophilus influenzae Rd
uucaaucuuuuuguuaauaa

SEQ ID NO: 716676 - RNA, 19 nt, Haemophilus influenzae Rd
uucaaugacugauauuuaa

SEQ ID NO: 716677 - RNA, 14 nt, Haemophilus influenzae Rd
uucaaugcaacaau

SEQ ID NO: 716678 - RNA, 15 nt, Haemophilus influenzae Rd
uucaaugcuuccuuc

SEQ ID NO: 716679 - RNA, 17 nt, Haemophilus influenzae Rd
uucaaguaacuuucaca

SEQ ID NO: 716680 - RNA, 14 nt, Haemophilus influenzae Rd
uucaagcuuugcaa

SEQ ID NO: 716681 - RNA, 22 nt, Haemophilus influenzae Rd
uucaaggagcuuuauuauuggc

SEQ ID NO: 716682 - RNA, 22 nt, Haemophilus influenzae Rd
uucaaucgcaucauucaaugca

SEQ ID NO: 716683 - RNA, 19 nt, Haemophilus influenzae Rd
uucaaguuguuugauaaug

SEQ ID NO: 716684 - RNA, 19 nt, Haemophilus influenzae Rd
uucaagugugugaaaggca

SEQ ID NO: 716685 - RNA, 14 nt, Haemophilus influenzae Rd
uucaagucuuuuuu

SEQ ID NO: 716686 - RNA, 18 nt, Haemophilus influenzae Rd
uucaccauugauuuuuac

SEQ ID NO: 716687 - RNA, 20 nt, Haemophilus influenzae Rd
uucaccacuuggugcaacca

SEQ ID NO: 716688 - RNA, 12 nt, Haemophilus influenzae Rd
uucacugaaagu

SEQ ID NO: 716689 - RNA, 15 nt, Haemophilus influenzae Rd
uucacucuuauucau

SEQ ID NO: 716690 - RNA, 14 nt, Haemophilus influenzae Rd
uucacucggaaugc

SEQ ID NO: 716691 - RNA, 21 nt, Haemophilus influenzae Rd
uucacgguuauaccacauaaa

SEQ ID NO: 716692 - RNA, 22 nt, Haemophilus influenzae Rd
uucacguaaaaucauuguuucc

SEQ ID NO: 716693 - RNA, 16 nt, Haemophilus influenzae Rd
uucacucaauucaaag

SEQ ID NO: 716694 - RNA, 16 nt, Haemophilus influenzae Rd
uucagauaaucaaaaa

SEQ ID NO: 716695 - RNA, 17 nt, Haemophilus influenzae Rd
uucagauaaucaaaaau

SEQ ID NO: 716696 - RNA, 20 nt, Haemophilus influenzae Rd
uucagaagauaaaagugcgg

SEQ ID NO: 716697 - RNA, 18 nt, Haemophilus influenzae Rd
uucagaacugcuuucuuc

SEQ ID NO: 716698 - RNA, 20 nt, Haemophilus influenzae Rd
uucagaacugcuuucuucca

SEQ ID NO: 716699 - RNA, 13 nt, Haemophilus influenzae Rd
uucagaaccuguc

SEQ ID NO: 716700 - RNA, 12 nt, Haemophilus influenzae Rd
uucacuuucaca

SEQ ID NO: 716701 - RNA, 19 nt, Haemophilus influenzae Rd
uucacuucuaaaaccaaua

SEQ ID NO: 716702 - RNA, 15 nt, Haemophilus influenzae Rd
uucagaaagagacuc

SEQ ID NO: 716703 - RNA, 20 nt, Haemophilus influenzae Rd
uucagaaaugaccuucacuu

SEQ ID NO: 716704 - RNA, 19 nt, Haemophilus influenzae Rd
ugggauaauccauaucuca

SEQ ID NO: 716705 - RNA, 18 nt, Haemophilus influenzae Rd
ugggauaaacauuucuau

SEQ ID NO: 716706 - RNA, 16 nt, Haemophilus influenzae Rd
ugggauagauuuuuua

SEQ ID NO: 716707 - RNA, 14 nt, Haemophilus influenzae Rd
uggcuuuuuucaua

SEQ ID NO: 716708 - RNA, 18 nt, Haemophilus influenzae Rd
uggcuuuucucaaaacau

SEQ ID NO: 716709 - RNA, 22 nt, Haemophilus influenzae Rd
ugggauuucaaacaauaugugc

SEQ ID NO: 716710 - RNA, 21 nt, Haemophilus influenzae Rd
ugggcaagucccuguucaaau

SEQ ID NO: 716711 - RNA, 15 nt, Haemophilus influenzae Rd
ugggaugaaaucaaa

SEQ ID NO: 716712 - RNA, 14 nt, Haemophilus influenzae Rd
ugggauaaauucau

SEQ ID NO: 716713 - RNA, 13 nt, Haemophilus influenzae Rd
uggcuuacagcaa

SEQ ID NO: 716714 - RNA, 20 nt, Haemophilus influenzae Rd
uggcguggaggauuaauuac

SEQ ID NO: 716715 - RNA, 15 nt, Haemophilus influenzae Rd
uggcgugagauccuu

SEQ ID NO: 716716 - RNA, 16 nt, Haemophilus influenzae Rd
uggcuucaucuuuuaa

SEQ ID NO: 716717 - RNA, 12 nt, Haemophilus influenzae Rd
uggcuuccaaca

SEQ ID NO: 716718 - RNA, 14 nt, Haemophilus influenzae Rd
uggcuuccaacaua

SEQ ID NO: 716719 - RNA, 20 nt, Haemophilus influenzae Rd
uggcuugcucuguauuuugu

SEQ ID NO: 716720 - RNA, 14 nt, Haemophilus influenzae Rd
uggcuugaaaauau

SEQ ID NO: 716721 - RNA, 19 nt, Haemophilus influenzae Rd
uggcuuuacgcauuuuuuc

SEQ ID NO: 716722 - RNA, 20 nt, Haemophilus influenzae Rd
uggcuugugaaauaaaauau

SEQ ID NO: 716723 - RNA, 16 nt, Haemophilus influenzae Rd
uggcuuuaaagguuua

SEQ ID NO: 716724 - RNA, 18 nt, Haemophilus influenzae Rd
uggcuuuaaagguuuaaa

SEQ ID NO: 716725 - RNA, 19 nt, Haemophilus influenzae Rd
uggggcuaauuuuuaaaau

SEQ ID NO: 716726 - RNA, 18 nt, Haemophilus influenzae Rd
uggggcuuuuuuuuauuc

SEQ ID NO: 716727 - RNA, 19 nt, Haemophilus influenzae Rd
uggggcuuuuuuuuauuca

SEQ ID NO: 716728 - RNA, 17 nt, Haemophilus influenzae Rd
ugggcggcuuguugaaa

SEQ ID NO: 716729 - RNA, 17 nt, Haemophilus influenzae Rd
uggggaauaaaauaaga

SEQ ID NO: 716730 - RNA, 15 nt, Haemophilus influenzae Rd
uggggaaguaauauu

SEQ ID NO: 716731 - RNA, 17 nt, Haemophilus influenzae Rd
uggggaaguaauauuuc

SEQ ID NO: 716732 - RNA, 18 nt, Haemophilus influenzae Rd
uggguucaucuaauaaua

SEQ ID NO: 716733 - RNA, 12 nt, Haemophilus influenzae Rd
uggguuaaaagc

SEQ ID NO: 716734 - RNA, 15 nt, Haemophilus influenzae Rd
uggguuuuuuuauuu

SEQ ID NO: 716735 - RNA, 12 nt, Haemophilus influenzae Rd
uggguuguggug

SEQ ID NO: 716736 - RNA, 17 nt, Haemophilus influenzae Rd
ugguaaaauuucuucua

SEQ ID NO: 716737 - RNA, 20 nt, Haemophilus influenzae Rd
ugguaaacgaacuucacuuu

SEQ ID NO: 716738 - RNA, 15 nt, Haemophilus influenzae Rd
ugguaauaaaucaaa

SEQ ID NO: 716739 - RNA, 20 nt, Haemophilus influenzae Rd
ugguaauaaaucaaaagaau

SEQ ID NO: 716740 - RNA, 14 nt, Haemophilus influenzae Rd
ugguaauaaucaau

SEQ ID NO: 716741 - RNA, 20 nt, Haemophilus influenzae Rd
ugguaaugcacguucuaaug

SEQ ID NO: 716742 - RNA, 17 nt, Haemophilus influenzae Rd
ugguaauuaacgugcau

SEQ ID NO: 716743 - RNA, 14 nt, Haemophilus influenzae Rd
ugguacaaauuuag

SEQ ID NO: 716744 - RNA, 13 nt, Haemophilus influenzae Rd
ugguaaauacugu

SEQ ID NO: 716745 - RNA, 16 nt, Haemophilus influenzae Rd
ugguaaauacuguuga

SEQ ID NO: 716746 - RNA, 12 nt, Haemophilus influenzae Rd
ugguaaauauug

SEQ ID NO: 716747 - RNA, 22 nt, Haemophilus influenzae Rd
ugguaaauauuguauuuaagua

SEQ ID NO: 716748 - RNA, 19 nt, Haemophilus influenzae Rd
ugguaugguuuuccaaaaa

SEQ ID NO: 716749 - RNA, 14 nt, Haemophilus influenzae Rd
ugguauucuuucca

SEQ ID NO: 716750 - RNA, 17 nt, Haemophilus influenzae Rd
ugguauuuacuaaauuc

SEQ ID NO: 716751 - RNA, 22 nt, Haemophilus influenzae Rd
ugguauuuacuaaauucuuuug

SEQ ID NO: 716752 - RNA, 14 nt, Haemophilus influenzae Rd
ugguagguauuauc

SEQ ID NO: 716753 - RNA, 17 nt, Haemophilus influenzae Rd
ugguaccgguugugcag

SEQ ID NO: 716754 - RNA, 14 nt, Haemophilus influenzae Rd
ugguagaaaauuug

SEQ ID NO: 716755 - RNA, 15 nt, Haemophilus influenzae Rd
uggcggcaggcuuaa

SEQ ID NO: 716756 - RNA, 16 nt, Haemophilus influenzae Rd
uggcgaaggcaaauca

SEQ ID NO: 716757 - RNA, 15 nt, Haemophilus influenzae Rd
uggcauuuucaaucc

SEQ ID NO: 716758 - RNA, 13 nt, Haemophilus influenzae Rd
uggcaacccacuu

SEQ ID NO: 716759 - RNA, 20 nt, Haemophilus influenzae Rd
uggcaaucacaguuuuauuu

SEQ ID NO: 716760 - RNA, 17 nt, Haemophilus influenzae Rd
uggcaaucguucuaaaa

SEQ ID NO: 716761 - RNA, 20 nt, Haemophilus influenzae Rd
uggcaauuacgacauucuuu

SEQ ID NO: 716762 - RNA, 22 nt, Haemophilus influenzae Rd
uggcaauuacgacauucuuuag

SEQ ID NO: 716763 - RNA, 21 nt, Haemophilus influenzae Rd
uggcacaucaaauucuaaaac

SEQ ID NO: 716764 - RNA, 15 nt, Haemophilus influenzae Rd
ugcguucaauaugca

SEQ ID NO: 716765 - RNA, 22 nt, Haemophilus influenzae Rd
ugcguguuacgcccuacaaugc

SEQ ID NO: 716766 - RNA, 19 nt, Haemophilus influenzae Rd
ugcguucaugguuguaaua

SEQ ID NO: 716767 - RNA, 15 nt, Haemophilus influenzae Rd
ugcguucauauuuga

SEQ ID NO: 716768 - RNA, 20 nt, Haemophilus influenzae Rd
ugcguugcgguuaaaauugc

SEQ ID NO: 716769 - RNA, 23 nt, Haemophilus influenzae Rd
uggauucauuaaguuuucuacag

SEQ ID NO: 716770 - RNA, 17 nt, Haemophilus influenzae Rd
uggcaaacaaaauaaau

SEQ ID NO: 716771 - RNA, 21 nt, Haemophilus influenzae Rd
uggcaaacucuugugccaaau

SEQ ID NO: 716772 - RNA, 17 nt, Haemophilus influenzae Rd
uggauuuacuuuaaugc

SEQ ID NO: 716773 - RNA, 16 nt, Haemophilus influenzae Rd
uggauuggauuuugaa

SEQ ID NO: 716774 - RNA, 17 nt, Haemophilus influenzae Rd
uggauuggcaaugagca

SEQ ID NO: 716775 - RNA, 21 nt, Haemophilus influenzae Rd
uguaaaccaaauuucuugcua

SEQ ID NO: 716776 - RNA, 17 nt, Haemophilus influenzae Rd
uguaaacaagauucuga

SEQ ID NO: 716777 - RNA, 23 nt, Haemophilus influenzae Rd
uguaaacaagauucugaaagaua

SEQ ID NO: 716778 - RNA, 15 nt, Haemophilus influenzae Rd
uguaaauugguuuua

SEQ ID NO: 716779 - RNA, 12 nt, Haemophilus influenzae Rd
uguaaaacauug

SEQ ID NO: 716780 - RNA, 15 nt, Haemophilus influenzae Rd
uguaaaacauuucau

SEQ ID NO: 716781 - RNA, 13 nt, Haemophilus influenzae Rd
uguaaaauaguga

SEQ ID NO: 716782 - RNA, 23 nt, Haemophilus influenzae Rd
uguaaaagugcgguugauuuucc

SEQ ID NO: 716783 - RNA, 16 nt, Haemophilus influenzae Rd
uguaaaagauaaaaca

SEQ ID NO: 716784 - RNA, 22 nt, Haemophilus influenzae Rd
uguaaaaaauccucaaaaacaa

SEQ ID NO: 716785 - RNA, 19 nt, Haemophilus influenzae Rd
uguaaaaaaucuuuaagug

SEQ ID NO: 716786 - RNA, 22 nt, Haemophilus influenzae Rd
uggugacgagaacuuuugaauu

SEQ ID NO: 716787 - RNA, 21 nt, Haemophilus influenzae Rd
uggugaaaucaacaauccauu

SEQ ID NO: 716788 - RNA, 21 nt, Haemophilus influenzae Rd
ugguuuugugaguucaagcaa

SEQ ID NO: 716789 - RNA, 18 nt, Haemophilus influenzae Rd
ugguuuaaauuuuaaaaa

SEQ ID NO: 716790 - RNA, 17 nt, Haemophilus influenzae Rd
uguacaccaaaauaacc

SEQ ID NO: 716791 - RNA, 13 nt, Haemophilus influenzae Rd
uguacaagugcua

SEQ ID NO: 716792 - RNA, 14 nt, Haemophilus influenzae Rd
uguacacaaugcua

SEQ ID NO: 716793 - RNA, 17 nt, Haemophilus influenzae Rd
uguaccauacuugccac

SEQ ID NO: 716794 - RNA, 19 nt, Haemophilus influenzae Rd
uguagaaaggcaauauuuu

SEQ ID NO: 716795 - RNA, 12 nt, Haemophilus influenzae Rd
uguacuuuagaa

SEQ ID NO: 716796 - RNA, 16 nt, Haemophilus influenzae Rd
uguaccuucugcugca

SEQ ID NO: 716797 - RNA, 15 nt, Haemophilus influenzae Rd
uguaccugcauuuug

SEQ ID NO: 716798 - RNA, 17 nt, Haemophilus influenzae Rd
uguacgccacauacauc

SEQ ID NO: 716799 - RNA, 15 nt, Haemophilus influenzae Rd
uguaauuuuuucucu

SEQ ID NO: 716800 - RNA, 23 nt, Haemophilus influenzae Rd
uguaauuuuuucucuuuuuauua

SEQ ID NO: 716801 - RNA, 15 nt, Haemophilus influenzae Rd
uguaaugcaaaccau

SEQ ID NO: 716802 - RNA, 18 nt, Haemophilus influenzae Rd
uguaaugcuugaacaaaa

SEQ ID NO: 716803 - RNA, 14 nt, Haemophilus influenzae Rd
uguaauccaacgaa

SEQ ID NO: 716804 - RNA, 15 nt, Haemophilus influenzae Rd
uguaaucuaaauauu

SEQ ID NO: 716805 - RNA, 15 nt, Haemophilus influenzae Rd
uguaacgagcaacuu

SEQ ID NO: 716806 - RNA, 17 nt, Haemophilus influenzae Rd
uguaacgcuuaaccauc

SEQ ID NO: 716807 - RNA, 16 nt, Haemophilus influenzae Rd
uguaacguauuuaaaa

SEQ ID NO: 716808 - RNA, 18 nt, Haemophilus influenzae Rd
uguaauauaugaaaaaua

SEQ ID NO: 716809 - RNA, 14 nt, Haemophilus influenzae Rd
uguaggcucuuucg

SEQ ID NO: 716810 - RNA, 15 nt, Haemophilus influenzae Rd
uguaggcaaaaacac

SEQ ID NO: 716811 - RNA, 23 nt, Haemophilus influenzae Rd
uguaggcaaaaacacucucagaa

SEQ ID NO: 716812 - RNA, 15 nt, Haemophilus influenzae Rd
uguagauaaaauauu

SEQ ID NO: 716813 - RNA, 13 nt, Haemophilus influenzae Rd
uguagauaaugau

SEQ ID NO: 716814 - RNA, 15 nt, Haemophilus influenzae Rd
uguagcugaaacuaa

SEQ ID NO: 716815 - RNA, 15 nt, Haemophilus influenzae Rd
uguagcuugaauauu

SEQ ID NO: 716816 - RNA, 15 nt, Haemophilus influenzae Rd
uguauaccaaccauu

SEQ ID NO: 716817 - RNA, 16 nt, Haemophilus influenzae Rd
uguauauuuuuaauuu

SEQ ID NO: 716818 - RNA, 19 nt, Haemophilus influenzae Rd
uguaguugugauuuucagc

SEQ ID NO: 716819 - RNA, 17 nt, Haemophilus influenzae Rd
uguaguuggaacugauu

SEQ ID NO: 716820 - RNA, 12 nt, Haemophilus influenzae Rd
uguauaaauauu

SEQ ID NO: 716821 - RNA, 12 nt, Haemophilus influenzae Rd
uguauaaaaauu

SEQ ID NO: 716822 - RNA, 13 nt, Haemophilus influenzae Rd
uguauaagauuaa

SEQ ID NO: 716823 - RNA, 22 nt, Haemophilus influenzae Rd
uguauaagauuaaugauaaguu

SEQ ID NO: 716824 - RNA, 16 nt, Haemophilus influenzae Rd
uguauaauuccuaaaa

SEQ ID NO: 716825 - RNA, 20 nt, Haemophilus influenzae Rd
uguauaauuccuaaaauaca

SEQ ID NO: 716826 - RNA, 14 nt, Haemophilus influenzae Rd
uguauaauuuuuca

SEQ ID NO: 716827 - RNA, 16 nt, Haemophilus influenzae Rd
uguauuaaguaaauau

SEQ ID NO: 716828 - RNA, 21 nt, Haemophilus influenzae Rd
uguauuaaguaaauauuuuuu

SEQ ID NO: 716829 - RNA, 22 nt, Haemophilus influenzae Rd
uguauuaaguaaauauuuuuua

SEQ ID NO: 716830 - RNA, 20 nt, Haemophilus influenzae Rd
uguauguggcguacaacgug

SEQ ID NO: 716831 - RNA, 14 nt, Haemophilus influenzae Rd
ugucaaaauugaug

SEQ ID NO: 716832 - RNA, 19 nt, Haemophilus influenzae Rd
ugucaaaauugaugaaaau

SEQ ID NO: 716833 - RNA, 14 nt, Haemophilus influenzae Rd
uguauuuuuuauuu

SEQ ID NO: 716834 - RNA, 16 nt, Haemophilus influenzae Rd
uguauuagaaguaaau

SEQ ID NO: 716835 - RNA, 20 nt, Haemophilus influenzae Rd
uguauuagguaaauuugguu

SEQ ID NO: 716836 - RNA, 13 nt, Haemophilus influenzae Rd
ugucaaaauuacg

SEQ ID NO: 716837 - RNA, 17 nt, Haemophilus influenzae Rd
ugucaaacgaaaaaaau

SEQ ID NO: 716838 - RNA, 23 nt, Haemophilus influenzae Rd
ugucaaacgaaaaaaauaaaaaa

SEQ ID NO: 716839 - RNA, 15 nt, Haemophilus influenzae Rd
ugucaaaugugaccg

SEQ ID NO: 716840 - RNA, 23 nt, Haemophilus influenzae Rd
ugucaaauuaauuaaucaauaag

SEQ ID NO: 716841 - RNA, 17 nt, Haemophilus influenzae Rd
ugucacgagcuaaaaaa

SEQ ID NO: 716842 - RNA, 19 nt, Haemophilus influenzae Rd
ugucacuagauuuucuuca

SEQ ID NO: 716843 - RNA, 13 nt, Haemophilus influenzae Rd
ugucaguuugcuu

SEQ ID NO: 716844 - RNA, 14 nt, Haemophilus influenzae Rd
ugucagaaaagauu

SEQ ID NO: 716845 - RNA, 20 nt, Haemophilus influenzae Rd
ugucaucuaguaccugauuu

SEQ ID NO: 716846 - RNA, 18 nt, Haemophilus influenzae Rd
ugucgcuaauaccgcgua

SEQ ID NO: 716847 - RNA, 14 nt, Haemophilus influenzae Rd
ugucuaauuuuuua

SEQ ID NO: 716848 - RNA, 22 nt, Haemophilus influenzae Rd
ugucguaauaacauucaguuuu

SEQ ID NO: 716849 - RNA, 16 nt, Haemophilus influenzae Rd
ugucuaagguuuccau

SEQ ID NO: 716850 - RNA, 15 nt, Haemophilus influenzae Rd
ugucuaaguaauucg

SEQ ID NO: 716851 - RNA, 17 nt, Haemophilus influenzae Rd
ugucuauuuuauuugcc

SEQ ID NO: 716852 - RNA, 16 nt, Haemophilus influenzae Rd
ugucuauuuauuuuca

SEQ ID NO: 716853 - RNA, 16 nt, Haemophilus influenzae Rd
uguccauaacugucaa

SEQ ID NO: 716854 - RNA, 13 nt, Haemophilus influenzae Rd
ugucauuaaaaaa

SEQ ID NO: 716855 - RNA, 16 nt, Haemophilus influenzae Rd
ugucauuaaaaaauaa

SEQ ID NO: 716856 - RNA, 18 nt, Haemophilus influenzae Rd
ugucauuaaaaaauaauu

SEQ ID NO: 716857 - RNA, 20 nt, Haemophilus influenzae Rd
ugucauuaaaccaaaagauc

SEQ ID NO: 716858 - RNA, 21 nt, Haemophilus influenzae Rd
ugugacuacaaacaaauuuuu

SEQ ID NO: 716859 - RNA, 20 nt, Haemophilus influenzae Rd
ugugaguaaaccacaauacu

SEQ ID NO: 716860 - RNA, 23 nt, Haemophilus influenzae Rd
ugugaccaaauaaucgugaguuu

SEQ ID NO: 716861 - RNA, 17 nt, Haemophilus influenzae Rd
ugugccaacuucuacac

SEQ ID NO: 716862 - RNA, 18 nt, Haemophilus influenzae Rd
ugugccaauccauaaaau

SEQ ID NO: 716863 - RNA, 21 nt, Haemophilus influenzae Rd
ugugcaucagaaaguucuaau

SEQ ID NO: 716864 - RNA, 16 nt, Haemophilus influenzae Rd
ugugcauugaauuuuu

SEQ ID NO: 716865 - RNA, 20 nt, Haemophilus influenzae Rd
ugugagucuugcuuuuuaau

SEQ ID NO: 716866 - RNA, 19 nt, Haemophilus influenzae Rd
ugugauaacuaugccuucu

SEQ ID NO: 716867 - RNA, 17 nt, Haemophilus influenzae Rd
ugugauaccgauaaaac

SEQ ID NO: 716868 - RNA, 19 nt, Haemophilus influenzae Rd
ugugauaccgauaaaaccu

SEQ ID NO: 716869 - RNA, 18 nt, Haemophilus influenzae Rd
uguggugccguuugugcu

SEQ ID NO: 716870 - RNA, 13 nt, Haemophilus influenzae Rd
ugugggcuuuaca

SEQ ID NO: 716871 - RNA, 15 nt, Haemophilus influenzae Rd
uguguagauaaaaua

SEQ ID NO: 716872 - RNA, 16 nt, Haemophilus influenzae Rd
uguguaccgucuaaac

SEQ ID NO: 716873 - RNA, 23 nt, Haemophilus influenzae Rd
uguguaaguguagcaauaaacag

SEQ ID NO: 716874 - RNA, 16 nt, Haemophilus influenzae Rd
uguggcggguuucuuu

SEQ ID NO: 716875 - RNA, 13 nt, Haemophilus influenzae Rd
uguggauuuugua

SEQ ID NO: 716876 - RNA, 15 nt, Haemophilus influenzae Rd
uguggcuucaucuaa

SEQ ID NO: 716877 - RNA, 21 nt, Haemophilus influenzae Rd
uguggcuuuucagcuaaaauu

SEQ ID NO: 716878 - RNA, 14 nt, Haemophilus influenzae Rd
ugugcuauacaaaa

SEQ ID NO: 716879 - RNA, 12 nt, Haemophilus influenzae Rd
ugugcucccccc

SEQ ID NO: 716880 - RNA, 16 nt, Haemophilus influenzae Rd
ugugcuaaauuuuuuu

SEQ ID NO: 716881 - RNA, 19 nt, Haemophilus influenzae Rd
ugugcuaaauuuuuuugca

SEQ ID NO: 716882 - RNA, 21 nt, Haemophilus influenzae Rd
uguuacaacgccucaaucgcu

SEQ ID NO: 716883 - RNA, 21 nt, Haemophilus influenzae Rd
uguuacuaaaauaauuuuuug

SEQ ID NO: 716884 - RNA, 17 nt, Haemophilus influenzae Rd
uguuacuucuuucacaa

SEQ ID NO: 716885 - RNA, 14 nt, Haemophilus influenzae Rd
uguuacuuuccauu

SEQ ID NO: 716886 - RNA, 20 nt, Haemophilus influenzae Rd
uguuagaaagccuuuuaaaa

SEQ ID NO: 716887 - RNA, 19 nt, Haemophilus influenzae Rd
uguuagaaauacauuauua

SEQ ID NO: 716888 - RNA, 21 nt, Haemophilus influenzae Rd
uguuaauaaaccuuuuucuaa

SEQ ID NO: 716889 - RNA, 14 nt, Haemophilus influenzae Rd
uguuaauaaacgcc

SEQ ID NO: 716890 - RNA, 15 nt, Haemophilus influenzae Rd
uguuaauaaacgccu

SEQ ID NO: 716891 - RNA, 15 nt, Haemophilus influenzae Rd
uguuaauuuuaaauu

SEQ ID NO: 716892 - RNA, 16 nt, Haemophilus influenzae Rd
uguuaauuuuaaauuu

SEQ ID NO: 716893 - RNA, 15 nt, Haemophilus influenzae Rd
uguguugauuucuac

SEQ ID NO: 716894 - RNA, 21 nt, Haemophilus influenzae Rd
uguguugauuucuacacuuaa

SEQ ID NO: 716895 - RNA, 18 nt, Haemophilus influenzae Rd
uguguuggaacguuuaaa

SEQ ID NO: 716896 - RNA, 13 nt, Haemophilus influenzae Rd
ugugugcguuuuc

SEQ ID NO: 716897 - RNA, 13 nt, Haemophilus influenzae Rd
uguguuuuggaua

SEQ ID NO: 716898 - RNA, 17 nt, Haemophilus influenzae Rd
uguguuuuggauagcau

SEQ ID NO: 716899 - RNA, 14 nt, Haemophilus influenzae Rd
uguguuuauuuaac

SEQ ID NO: 716900 - RNA, 20 nt, Haemophilus influenzae Rd
uguguuucaacaaaaauacg

SEQ ID NO: 716901 - RNA, 13 nt, Haemophilus influenzae Rd
uguguuuuucaaa

SEQ ID NO: 716902 - RNA, 14 nt, Haemophilus influenzae Rd
uguguuuuucaaaa

SEQ ID NO: 716903 - RNA, 15 nt, Haemophilus influenzae Rd
uguuaaaucuacauu

SEQ ID NO: 716904 - RNA, 14 nt, Haemophilus influenzae Rd
uuaccgcuucuucc

SEQ ID NO: 716905 - RNA, 15 nt, Haemophilus influenzae Rd
uuaccgcuucuuccu

SEQ ID NO: 716906 - RNA, 16 nt, Haemophilus influenzae Rd
uuaccgcuucuuccug

SEQ ID NO: 716907 - RNA, 14 nt, Haemophilus influenzae Rd
uuacccacaacuca

SEQ ID NO: 716908 - RNA, 19 nt, Haemophilus influenzae Rd
uuaccagugguauauacca

SEQ ID NO: 716909 - RNA, 12 nt, Haemophilus influenzae Rd
uuaccauaaaac

SEQ ID NO: 716910 - RNA, 13 nt, Haemophilus influenzae Rd
uuaccauugcguu

SEQ ID NO: 716911 - RNA, 23 nt, Haemophilus influenzae Rd
uuaccauugcguucacucacuuu

SEQ ID NO: 716912 - RNA, 22 nt, Haemophilus influenzae Rd
uuacaucauccuuaccuuccac

SEQ ID NO: 716913 - RNA, 23 nt, Haemophilus influenzae Rd
uuacaucauccuuaccuuccacu

SEQ ID NO: 716914 - RNA, 13 nt, Haemophilus influenzae Rd
uuacauauuucac

SEQ ID NO: 716915 - RNA, 15 nt, Haemophilus influenzae Rd
uuacagaacaaaaua

SEQ ID NO: 716916 - RNA, 16 nt, Haemophilus influenzae Rd
uuacagaacaaaauaa

SEQ ID NO: 716917 - RNA, 23 nt, Haemophilus influenzae Rd
uuacauaaauucucgccauaaua

SEQ ID NO: 716918 - RNA, 20 nt, Haemophilus influenzae Rd
uuacauagauugaaaaguaa

SEQ ID NO: 716919 - RNA, 15 nt, Haemophilus influenzae Rd
uuacgacgugcaagu

SEQ ID NO: 716920 - RNA, 13 nt, Haemophilus influenzae Rd
uuacgaagaaucc

SEQ ID NO: 716921 - RNA, 16 nt, Haemophilus influenzae Rd
uuaccuuuggcuaaac

SEQ ID NO: 716922 - RNA, 22 nt, Haemophilus influenzae Rd
uuacgaaaaguugaaacuguuu

SEQ ID NO: 716923 - RNA, 21 nt, Haemophilus influenzae Rd
uuaccuugcauuucuuuaaua

SEQ ID NO: 716924 - RNA, 13 nt, Haemophilus influenzae Rd
uuaccuuagccaa

SEQ ID NO: 716925 - RNA, 14 nt, Haemophilus influenzae Rd
uuaccugugaaaac

SEQ ID NO: 716926 - RNA, 13 nt, Haemophilus influenzae Rd
uuacccaacaaau

SEQ ID NO: 716927 - RNA, 23 nt, Haemophilus influenzae Rd
uuaccgucaugggauaaacauuu

SEQ ID NO: 716928 - RNA, 18 nt, Haemophilus influenzae Rd
uuaauuuagauaaaaauu

SEQ ID NO: 716929 - RNA, 21 nt, Haemophilus influenzae Rd
uuaauuuaguuaaacaucgca

SEQ ID NO: 716930 - RNA, 13 nt, Haemophilus influenzae Rd
uuaauuuauacaa

SEQ ID NO: 716931 - RNA, 20 nt, Haemophilus influenzae Rd
uuaauuggaaauaauauuca

SEQ ID NO: 716932 - RNA, 12 nt, Haemophilus influenzae Rd
uuaauuuaauuc

SEQ ID NO: 716933 - RNA, 13 nt, Haemophilus influenzae Rd
uuaaucugcaccu

SEQ ID NO: 716934 - RNA, 12 nt, Haemophilus influenzae Rd
uuaaucugucac

SEQ ID NO: 716935 - RNA, 14 nt, Haemophilus influenzae Rd
uuaaucuuauacaa

SEQ ID NO: 716936 - RNA, 13 nt, Haemophilus influenzae Rd
uuaaucuuaucaa

SEQ ID NO: 716937 - RNA, 16 nt, Haemophilus influenzae Rd
uuaaucuuaucaaaca

SEQ ID NO: 716938 - RNA, 17 nt, Haemophilus influenzae Rd
uuaauccaucauuuuuc

SEQ ID NO: 716939 - RNA, 22 nt, Haemophilus influenzae Rd
uuaauccaucgcaagauaagau

SEQ ID NO: 716940 - RNA, 22 nt, Haemophilus influenzae Rd
uuaaugaaacuugguguaauuu

SEQ ID NO: 716941 - RNA, 15 nt, Haemophilus influenzae Rd
uuaaugaaaguaaca

SEQ ID NO: 716942 - RNA, 16 nt, Haemophilus influenzae Rd
uuaaugaaccaaaucu

SEQ ID NO: 716943 - RNA, 22 nt, Haemophilus influenzae Rd
uuaaugaacuuucuacgacauu

SEQ ID NO: 716944 - RNA, 14 nt, Haemophilus influenzae Rd
uuaaugacauuaaa

SEQ ID NO: 716945 - RNA, 13 nt, Haemophilus influenzae Rd
uuacaaaaaguac

SEQ ID NO: 716946 - RNA, 13 nt, Haemophilus influenzae Rd
uuacaaaaccaau

SEQ ID NO: 716947 - RNA, 14 nt, Haemophilus influenzae Rd
uuacaaaauauacg

SEQ ID NO: 716948 - RNA, 23 nt, Haemophilus influenzae Rd
uuacaaaaaaguacuugcaaggg

SEQ ID NO: 716949 - RNA, 17 nt, Haemophilus influenzae Rd
uuaauuuuuuauaaaau

SEQ ID NO: 716950 - RNA, 21 nt, Haemophilus influenzae Rd
uuaauuuuuuauaaaauuuca

SEQ ID NO: 716951 - RNA, 12 nt, Haemophilus influenzae Rd
uuaauuuuuaaa

SEQ ID NO: 716952 - RNA, 15 nt, Haemophilus influenzae Rd
uuaauuuuuaaagaa

SEQ ID NO: 716953 - RNA, 16 nt, Haemophilus influenzae Rd
uuaauuuuuagauuau

SEQ ID NO: 716954 - RNA, 12 nt, Haemophilus influenzae Rd
uuaauuuuuccg

SEQ ID NO: 716955 - RNA, 11 nt, Haemophilus influenzae Rd
uuaauuuuucg

SEQ ID NO: 716956 - RNA, 21 nt, Haemophilus influenzae Rd
uuacaaauagcuguaagauaa

SEQ ID NO: 716957 - RNA, 18 nt, Haemophilus influenzae Rd
uuacacagaugccauuaa

SEQ ID NO: 716958 - RNA, 15 nt, Haemophilus influenzae Rd
uuacaaggacaauaa

SEQ ID NO: 716959 - RNA, 15 nt, Haemophilus influenzae Rd
uuacacaaaauauuc

SEQ ID NO: 716960 - RNA, 14 nt, Haemophilus influenzae Rd
uuacaacucuaaau

SEQ ID NO: 716961 - RNA, 15 nt, Haemophilus influenzae Rd
uuacaacucuaaauu

SEQ ID NO: 716962 - RNA, 17 nt, Haemophilus influenzae Rd
uuacacauugccauauu

SEQ ID NO: 716963 - RNA, 16 nt, Haemophilus influenzae Rd
uuacaccguccaaggu

SEQ ID NO: 716964 - RNA, 15 nt, Haemophilus influenzae Rd
uuacaccuaacauau

SEQ ID NO: 716965 - RNA, 14 nt, Haemophilus influenzae Rd
uuacacgagcaaug

SEQ ID NO: 716966 - RNA, 16 nt, Haemophilus influenzae Rd
uuagauauuauuuauu

SEQ ID NO: 716967 - RNA, 17 nt, Haemophilus influenzae Rd
uuagauauuauuuauuu

SEQ ID NO: 716968 - RNA, 14 nt, Haemophilus influenzae Rd
uuagaucagaaaac

SEQ ID NO: 716969 - RNA, 18 nt, Haemophilus influenzae Rd
uuagaugauuuuaaaaua

SEQ ID NO: 716970 - RNA, 19 nt, Haemophilus influenzae Rd
uuagaugauuuuaaaguaa

SEQ ID NO: 716971 - RNA, 21 nt, Haemophilus influenzae Rd
uuagauuugaaccuucacaga

SEQ ID NO: 716972 - RNA, 20 nt, Haemophilus influenzae Rd
uuagauugaacguuuaacuu

SEQ ID NO: 716973 - RNA, 23 nt, Haemophilus influenzae Rd
uuagcgaaaauuuugccaauuac

SEQ ID NO: 716974 - RNA, 14 nt, Haemophilus influenzae Rd
uuagccuagauauu

SEQ ID NO: 716975 - RNA, 20 nt, Haemophilus influenzae Rd
uuagcaaggcguucaauauu

SEQ ID NO: 716976 - RNA, 14 nt, Haemophilus influenzae Rd
uuagcaacugcuga

SEQ ID NO: 716977 - RNA, 20 nt, Haemophilus influenzae Rd
uuagcaacugcugaacgcua

SEQ ID NO: 716978 - RNA, 20 nt, Haemophilus influenzae Rd
uuagcgcauuuuucuuuaaa

SEQ ID NO: 716979 - RNA, 20 nt, Haemophilus influenzae Rd
uuagcucagucgguagagca

SEQ ID NO: 716980 - RNA, 12 nt, Haemophilus influenzae Rd
uuagcguaaaca

SEQ ID NO: 716981 - RNA, 15 nt, Haemophilus influenzae Rd
uuagcguuuagcuuu

SEQ ID NO: 716982 - RNA, 14 nt, Haemophilus influenzae Rd
uuagcuaaugcaaa

SEQ ID NO: 716983 - RNA, 13 nt, Haemophilus influenzae Rd
uuagauacaaaga

SEQ ID NO: 716984 - RNA, 16 nt, Haemophilus influenzae Rd
uuagauacauaaaaaa

SEQ ID NO: 716985 - RNA, 20 nt, Haemophilus influenzae Rd
uuagauaaauuucaauuaaa

SEQ ID NO: 716986 - RNA, 21 nt, Haemophilus influenzae Rd
uuagauaagccauuaacauuu

SEQ ID NO: 716987 - RNA, 13 nt, Haemophilus influenzae Rd
uuagauaauaaaa

SEQ ID NO: 716988 - RNA, 15 nt, Haemophilus influenzae Rd
uuagauaaaaauuuc

SEQ ID NO: 716989 - RNA, 17 nt, Haemophilus influenzae Rd
uuagacaauaaaacaca

SEQ ID NO: 716990 - RNA, 22 nt, Haemophilus influenzae Rd
uuagacaauaaaacacaacaua

SEQ ID NO: 716991 - RNA, 23 nt, Haemophilus influenzae Rd
uuagacagacuauuucuguauuu

SEQ ID NO: 716992 - RNA, 15 nt, Haemophilus influenzae Rd
uuagaauuuuuauuu

SEQ ID NO: 716993 - RNA, 13 nt, Haemophilus influenzae Rd
uuagacaaaaaug

SEQ ID NO: 716994 - RNA, 22 nt, Haemophilus influenzae Rd
uuagacaacaacuuuucuaaac

SEQ ID NO: 716995 - RNA, 15 nt, Haemophilus influenzae Rd
uuagaauuuuaacuu

SEQ ID NO: 716996 - RNA, 19 nt, Haemophilus influenzae Rd
uuagaaagcuggcgaccuu

SEQ ID NO: 716997 - RNA, 22 nt, Haemophilus influenzae Rd
uuagaaagccuuuuaaaaugaa

SEQ ID NO: 716998 - RNA, 13 nt, Haemophilus influenzae Rd
uuagaaaguaaac

SEQ ID NO: 716999 - RNA, 22 nt, Haemophilus influenzae Rd
uuagaauccaaaauuacuuuuc

SEQ ID NO: 717000 - RNA, 22 nt, Haemophilus influenzae Rd
uuagaauauaacaccaaacaga

SEQ ID NO: 717001 - RNA, 22 nt, Haemophilus influenzae Rd
uuagaaauacauuauuaaaagc

SEQ ID NO: 717002 - RNA, 13 nt, Haemophilus influenzae Rd
uuacuuuuuuaag

SEQ ID NO: 717003 - RNA, 15 nt, Haemophilus influenzae Rd
uuacuuuuuuaagua

SEQ ID NO: 717004 - RNA, 18 nt, Haemophilus influenzae Rd
uuacugucgaaccaaguu

SEQ ID NO: 717005 - RNA, 20 nt, Haemophilus influenzae Rd
uuacucguccaaauucauuu

SEQ ID NO: 717006 - RNA, 13 nt, Haemophilus influenzae Rd
uuacuuaacauca

SEQ ID NO: 717007 - RNA, 21 nt, Haemophilus influenzae Rd
uuacuuaacaucaucaucgca

SEQ ID NO: 717008 - RNA, 16 nt, Haemophilus influenzae Rd
uuacuguucaaauaag

SEQ ID NO: 717009 - RNA, 16 nt, Haemophilus influenzae Rd
uuacuguuugaacgcu

SEQ ID NO: 717010 - RNA, 15 nt, Haemophilus influenzae Rd
uuacuucaucaaaac

SEQ ID NO: 717011 - RNA, 16 nt, Haemophilus influenzae Rd
uuacuucaucccauuu

SEQ ID NO: 717012 - RNA, 13 nt, Haemophilus influenzae Rd
uuacguaauaagu

SEQ ID NO: 717013 - RNA, 18 nt, Haemophilus influenzae Rd
uuacguaauguaccacgg

SEQ ID NO: 717014 - RNA, 20 nt, Haemophilus influenzae Rd
uuacguagaaaacaauaaaa

SEQ ID NO: 717015 - RNA, 13 nt, Haemophilus influenzae Rd
uuacgccuaacca

SEQ ID NO: 717016 - RNA, 18 nt, Haemophilus influenzae Rd
uuacgcuaauuuaagaaa

SEQ ID NO: 717017 - RNA, 15 nt, Haemophilus influenzae Rd
uuacgcgcaauuuca

SEQ ID NO: 717018 - RNA, 21 nt, Haemophilus influenzae Rd
uuacgcgcagcaccaaagaaa

SEQ ID NO: 717019 - RNA, 18 nt, Haemophilus influenzae Rd
uuaaaggcaguauaaccu

SEQ ID NO: 717020 - RNA, 17 nt, Haemophilus influenzae Rd
uuaaaggcggauuuauu

SEQ ID NO: 717021 - RNA, 18 nt, Haemophilus influenzae Rd
uuaaaggcggauuuauua

SEQ ID NO: 717022 - RNA, 22 nt, Haemophilus influenzae Rd
uuaaaggcggauuuauuauuua

SEQ ID NO: 717023 - RNA, 14 nt, Haemophilus influenzae Rd
uuaaaggcugaaua

SEQ ID NO: 717024 - RNA, 22 nt, Haemophilus influenzae Rd
uuaaaggcugaauaaaucagcg

SEQ ID NO: 717025 - RNA, 18 nt, Haemophilus influenzae Rd
uuaaagccuugauuauca

SEQ ID NO: 717026 - RNA, 15 nt, Haemophilus influenzae Rd
uuaaagcuucauuug

SEQ ID NO: 717027 - RNA, 23 nt, Haemophilus influenzae Rd
uuaaagcucguauaauauuuucu

SEQ ID NO: 717028 - RNA, 14 nt, Haemophilus influenzae Rd
uuaaagcugaauaa

SEQ ID NO: 717029 - RNA, 16 nt, Haemophilus influenzae Rd
uuaaagccauuuugcu

SEQ ID NO: 717030 - RNA, 18 nt, Haemophilus influenzae Rd
uuaaagugcgguuaauuu

SEQ ID NO: 717031 - RNA, 12 nt, Haemophilus influenzae Rd
uuaaagugcaga

SEQ ID NO: 717032 - RNA, 14 nt, Haemophilus influenzae Rd
uuaaagugcagauu

SEQ ID NO: 717033 - RNA, 15 nt, Haemophilus influenzae Rd
uuaaaguuaucaaac

SEQ ID NO: 717034 - RNA, 12 nt, Haemophilus influenzae Rd
uuaaauaaaaua

SEQ ID NO: 717035 - RNA, 20 nt, Haemophilus influenzae Rd
uuaaauaaaauaacaaaaaa

SEQ ID NO: 717036 - RNA, 13 nt, Haemophilus influenzae Rd
uuaaauaaacaca

SEQ ID NO: 717037 - RNA, 19 nt, Haemophilus influenzae Rd
uuaaauaaacauuaugaaa

SEQ ID NO: 717038 - RNA, 14 nt, Haemophilus influenzae Rd
uuaaauaaaaaaua

SEQ ID NO: 717039 - RNA, 19 nt, Haemophilus influenzae Rd
uuaaauacagcucaaaaug

SEQ ID NO: 717040 - RNA, 23 nt, Haemophilus influenzae Rd
uuaaauaaccauaucugaaaaua

SEQ ID NO: 717041 - RNA, 20 nt, Haemophilus influenzae Rd
uuaaauaaggaucuuguaaa

SEQ ID NO: 717042 - RNA, 22 nt, Haemophilus influenzae Rd
uuaaauauaggguaaauaaaaa

SEQ ID NO: 717043 - RNA, 22 nt, Haemophilus influenzae Rd
uuaaauacuaauaggaguaaaa

SEQ ID NO: 717044 - RNA, 16 nt, Haemophilus influenzae Rd
uuaaauagauaaucag

SEQ ID NO: 717045 - RNA, 17 nt, Haemophilus influenzae Rd
uuaaauauuuaaaaaga

SEQ ID NO: 717046 - RNA, 18 nt, Haemophilus influenzae Rd
uuaaauauuuaaaaagaa

SEQ ID NO: 717047 - RNA, 17 nt, Haemophilus influenzae Rd
uuaaauauucaauuaca

SEQ ID NO: 717048 - RNA, 17 nt, Haemophilus influenzae Rd
uuaaauauuuucauuua

SEQ ID NO: 717049 - RNA, 19 nt, Haemophilus influenzae Rd
uuaaauauuuucauuuaug

SEQ ID NO: 717050 - RNA, 20 nt, Haemophilus influenzae Rd
uuaaauauuuuuacaaaaaa

SEQ ID NO: 717051 - RNA, 14 nt, Haemophilus influenzae Rd
uuaaaucaaaaauu

SEQ ID NO: 717052 - RNA, 15 nt, Haemophilus influenzae Rd
uuaaaucaaaaccaa

SEQ ID NO: 717053 - RNA, 20 nt, Haemophilus influenzae Rd
uuaaaucaaaaccaaucauu

SEQ ID NO: 717054 - RNA, 23 nt, Haemophilus influenzae Rd
uuaaaucaaacaaaauuuuaaau

SEQ ID NO: 717055 - RNA, 20 nt, Haemophilus influenzae Rd
uuaaauaugauaaaugcaau

SEQ ID NO: 717056 - RNA, 15 nt, Haemophilus influenzae Rd
uuaaaucaaauuuag

SEQ ID NO: 717057 - RNA, 18 nt, Haemophilus influenzae Rd
uuaaaucacaauuaauuu

SEQ ID NO: 717058 - RNA, 16 nt, Haemophilus influenzae Rd
uuaaaucgauuacucu

SEQ ID NO: 717059 - RNA, 21 nt, Haemophilus influenzae Rd
uuaaauccaucaauucuuccc

SEQ ID NO: 717060 - RNA, 15 nt, Haemophilus influenzae Rd
uuaacaaugaaauua

SEQ ID NO: 717061 - RNA, 12 nt, Haemophilus influenzae Rd
uuaacaauuacu

SEQ ID NO: 717062 - RNA, 23 nt, Haemophilus influenzae Rd
uuaacacgaaaccaacgaaaaua

SEQ ID NO: 717063 - RNA, 16 nt, Haemophilus influenzae Rd
uuaacaaaacagacug

SEQ ID NO: 717064 - RNA, 22 nt, Haemophilus influenzae Rd
uuaacaaaacagacugaaauuc

SEQ ID NO: 717065 - RNA, 17 nt, Haemophilus influenzae Rd
uuaacaaauaauuauua

SEQ ID NO: 717066 - RNA, 15 nt, Haemophilus influenzae Rd
uuaacaaauacaucu

SEQ ID NO: 717067 - RNA, 16 nt, Haemophilus influenzae Rd
uuaaauuuuuaauaaa

SEQ ID NO: 717068 - RNA, 15 nt, Haemophilus influenzae Rd
uuaaauuuuuaauuu

SEQ ID NO: 717069 - RNA, 12 nt, Haemophilus influenzae Rd
uuaaauuuuuaa

SEQ ID NO: 717070 - RNA, 15 nt, Haemophilus influenzae Rd
uuaaauuuuaaaaaa

SEQ ID NO: 717071 - RNA, 13 nt, Haemophilus influenzae Rd
uuaaauugaaaaa

SEQ ID NO: 717072 - RNA, 14 nt, Haemophilus influenzae Rd
uuaaauugaaaaaa

SEQ ID NO: 717073 - RNA, 22 nt, Haemophilus influenzae Rd
uuaaauugaacugaauuaaaaa

SEQ ID NO: 717074 - RNA, 15 nt, Haemophilus influenzae Rd
uuaaauuguaacuau

SEQ ID NO: 717075 - RNA, 16 nt, Haemophilus influenzae Rd
uuaaauuauauuuucc

SEQ ID NO: 717076 - RNA, 14 nt, Haemophilus influenzae Rd
uuaaauuauuuuuu

SEQ ID NO: 717077 - RNA, 23 nt, Haemophilus influenzae Rd
uuaaauuaaggacuaaacuuuua

SEQ ID NO: 717078 - RNA, 21 nt, Haemophilus influenzae Rd
uuaaauuacauucccaaauaa

SEQ ID NO: 717079 - RNA, 13 nt, Haemophilus influenzae Rd
uuaaauuauacau

SEQ ID NO: 717080 - RNA, 19 nt, Haemophilus influenzae Rd
uuaaauguauuuuccaugc

SEQ ID NO: 717081 - RNA, 14 nt, Haemophilus influenzae Rd
uuaaauuaaaaaga

SEQ ID NO: 717082 - RNA, 19 nt, Haemophilus influenzae Rd
uuaaaugggacaaagcagu

SEQ ID NO: 717083 - RNA, 21 nt, Haemophilus influenzae Rd
uuaaaugaccaaguaaaccaa

SEQ ID NO: 717084 - RNA, 14 nt, Haemophilus influenzae Rd
uuaaaugaaaagca

SEQ ID NO: 717085 - RNA, 17 nt, Haemophilus influenzae Rd
uuaauauaccccaaacu

SEQ ID NO: 717086 - RNA, 22 nt, Haemophilus influenzae Rd
uuaauacgaaaaauuacuuaau

SEQ ID NO: 717087 - RNA, 17 nt, Haemophilus influenzae Rd
uuaauacgaacuaaaag

SEQ ID NO: 717088 - RNA, 18 nt, Haemophilus influenzae Rd
uuaauaucuuuaacaaaa

SEQ ID NO: 717089 - RNA, 15 nt, Haemophilus influenzae Rd
uuaaucauuuucacu

SEQ ID NO: 717090 - RNA, 14 nt, Haemophilus influenzae Rd
uuaaucauuuuuua

SEQ ID NO: 717091 - RNA, 22 nt, Haemophilus influenzae Rd
uuaagcccguuaauuaagcagc

SEQ ID NO: 717092 - RNA, 17 nt, Haemophilus influenzae Rd
uuaagccaucacugcca

SEQ ID NO: 717093 - RNA, 20 nt, Haemophilus influenzae Rd
uuaaggauuuuugaauuuca

SEQ ID NO: 717094 - RNA, 19 nt, Haemophilus influenzae Rd
uuaaguaguguuuuauuua

SEQ ID NO: 717095 - RNA, 14 nt, Haemophilus influenzae Rd
uuaaguaaauauuu

SEQ ID NO: 717096 - RNA, 15 nt, Haemophilus influenzae Rd
uuaaguaauacauuu

SEQ ID NO: 717097 - RNA, 19 nt, Haemophilus influenzae Rd
uuaagguuguuggcaaacu

SEQ ID NO: 717098 - RNA, 19 nt, Haemophilus influenzae Rd
uuaagguuucuucuaaagc

SEQ ID NO: 717099 - RNA, 21 nt, Haemophilus influenzae Rd
uuaagguuucuucuaaagcga

SEQ ID NO: 717100 - RNA, 12 nt, Haemophilus influenzae Rd
uuaagguuuuuu

SEQ ID NO: 717101 - RNA, 16 nt, Haemophilus influenzae Rd
uuaaguaaaaguaaaa

SEQ ID NO: 717102 - RNA, 19 nt, Haemophilus influenzae Rd
uuaagguuaaauucacugu

SEQ ID NO: 717103 - RNA, 18 nt, Haemophilus influenzae Rd
uuaauaaaaauuguaaaa

SEQ ID NO: 717104 - RNA, 19 nt, Haemophilus influenzae Rd
uuaaguaugccauaaaaua

SEQ ID NO: 717105 - RNA, 20 nt, Haemophilus influenzae Rd
uuaauaaaauguuuauauuu

SEQ ID NO: 717106 - RNA, 12 nt, Haemophilus influenzae Rd
uuaauaaaccaa

SEQ ID NO: 717107 - RNA, 18 nt, Haemophilus influenzae Rd
uuaauaaaccaacauaca

SEQ ID NO: 717108 - RNA, 20 nt, Haemophilus influenzae Rd
uuaauaaaccaacauacauu

SEQ ID NO: 717109 - RNA, 23 nt, Haemophilus influenzae Rd
uuaauaaaccaacauacauuaau

SEQ ID NO: 717110 - RNA, 23 nt, Haemophilus influenzae Rd
uuaauaauguauuucuaacaaau

SEQ ID NO: 717111 - RNA, 17 nt, Haemophilus influenzae Rd
uuaauaaaguaaaauau

SEQ ID NO: 717112 - RNA, 22 nt, Haemophilus influenzae Rd
uuaauaaagauaaauuauauuu

SEQ ID NO: 717113 - RNA, 22 nt, Haemophilus influenzae Rd
uuaauaaauauugauuacccau

SEQ ID NO: 717114 - RNA, 15 nt, Haemophilus influenzae Rd
uuaacuuuuuuauuu

SEQ ID NO: 717115 - RNA, 22 nt, Haemophilus influenzae Rd
uuaacuugcuauuuucuaauuu

SEQ ID NO: 717116 - RNA, 17 nt, Haemophilus influenzae Rd
uuaacuugcucugguug

SEQ ID NO: 717117 - RNA, 17 nt, Haemophilus influenzae Rd
uuaacuuaaucuccaau

SEQ ID NO: 717118 - RNA, 13 nt, Haemophilus influenzae Rd
uuaacuucaacca

SEQ ID NO: 717119 - RNA, 16 nt, Haemophilus influenzae Rd
uuaacuucaaccacuu

SEQ ID NO: 717120 - RNA, 15 nt, Haemophilus influenzae Rd
uuaacugcuuuaaua

SEQ ID NO: 717121 - RNA, 20 nt, Haemophilus influenzae Rd
uuaacugcuuuuuuccagcc

SEQ ID NO: 717122 - RNA, 24 nt, Haemophilus influenzae Rd
uuaacuggcguuucuaccacgaua

SEQ ID NO: 717123 - RNA, 20 nt, Haemophilus influenzae Rd
uuaagcauuguccacagcaa

SEQ ID NO: 717124 - RNA, 22 nt, Haemophilus influenzae Rd
uuaagcauccaucgacauacaa

SEQ ID NO: 717125 - RNA, 16 nt, Haemophilus influenzae Rd
uuaagcaauugaauaa

SEQ ID NO: 717126 - RNA, 13 nt, Haemophilus influenzae Rd
uuaagcaccauca

SEQ ID NO: 717127 - RNA, 15 nt, Haemophilus influenzae Rd
uuaagcaccaucaua

SEQ ID NO: 717128 - RNA, 11 nt, Haemophilus influenzae Rd
uuaagaucuaa

SEQ ID NO: 717129 - RNA, 20 nt, Haemophilus influenzae Rd
uuaagauuuacagaacaaaa

SEQ ID NO: 717130 - RNA, 11 nt, Haemophilus influenzae Rd
uuaagaaaaaa

SEQ ID NO: 717131 - RNA, 23 nt, Haemophilus influenzae Rd
uuaagaaagguugguugaauuaa

SEQ ID NO: 717132 - RNA, 20 nt, Haemophilus influenzae Rd
uuaacauaacuuuccauaua

SEQ ID NO: 717133 - RNA, 18 nt, Haemophilus influenzae Rd
uuaacauuaauaaaccaa

SEQ ID NO: 717134 - RNA, 21 nt, Haemophilus influenzae Rd
uuaacaucaucaucgcaucug

SEQ ID NO: 717135 - RNA, 18 nt, Haemophilus influenzae Rd
uuaacaucaugaaaugca

SEQ ID NO: 717136 - RNA, 16 nt, Haemophilus influenzae Rd
uuaacaucuuaguauu

SEQ ID NO: 717137 - RNA, 20 nt, Haemophilus influenzae Rd
uuaacaucuuaguauuuuau

SEQ ID NO: 717138 - RNA, 16 nt, Haemophilus influenzae Rd
uuaacgcucaaaaauu

SEQ ID NO: 717139 - RNA, 18 nt, Haemophilus influenzae Rd
uuaacugaaaauucauca

SEQ ID NO: 717140 - RNA, 19 nt, Haemophilus influenzae Rd
uguuuuaauuuuaguuauc

SEQ ID NO: 717141 - RNA, 14 nt, Haemophilus influenzae Rd
uguuuuauagccuu

SEQ ID NO: 717142 - RNA, 11 nt, Haemophilus influenzae Rd
uguuuuauaca

SEQ ID NO: 717143 - RNA, 15 nt, Haemophilus influenzae Rd
uguuuucaauuuuaa

SEQ ID NO: 717144 - RNA, 16 nt, Haemophilus influenzae Rd
uguuuucaauuuuaaa

SEQ ID NO: 717145 - RNA, 17 nt, Haemophilus influenzae Rd
uguuuucaauuuuaaaa

SEQ ID NO: 717146 - RNA, 14 nt, Haemophilus influenzae Rd
uguuuuaucagaau

SEQ ID NO: 717147 - RNA, 14 nt, Haemophilus influenzae Rd
uguuuuauuuauca

SEQ ID NO: 717148 - RNA, 16 nt, Haemophilus influenzae Rd
uguuuggcaauggcug

SEQ ID NO: 717149 - RNA, 21 nt, Haemophilus influenzae Rd
uguuuguaauaaauuuuauua

SEQ ID NO: 717150 - RNA, 13 nt, Haemophilus influenzae Rd
uguuuuaaaucuu

SEQ ID NO: 717151 - RNA, 16 nt, Haemophilus influenzae Rd
uguuuuaaaucuucua

SEQ ID NO: 717152 - RNA, 13 nt, Haemophilus influenzae Rd
uguuuuaaaaugg

SEQ ID NO: 717153 - RNA, 22 nt, Haemophilus influenzae Rd
uguuuuaaaauggaaauuugag

SEQ ID NO: 717154 - RNA, 11 nt, Haemophilus influenzae Rd
uguuuuaaccg

SEQ ID NO: 717155 - RNA, 14 nt, Haemophilus influenzae Rd
uguuuguuuuauuu

SEQ ID NO: 717156 - RNA, 21 nt, Haemophilus influenzae Rd
uguuuuaaaacuauuuuuaau

SEQ ID NO: 717157 - RNA, 23 nt, Haemophilus influenzae Rd
uguuuguuccacuucauaaaucc

SEQ ID NO: 717158 - RNA, 22 nt, Haemophilus influenzae Rd
uguuuuccaaacauuuuuauuu

SEQ ID NO: 717159 - RNA, 17 nt, Haemophilus influenzae Rd
uguuuuggcauuuucaa

SEQ ID NO: 717160 - RNA, 18 nt, Haemophilus influenzae Rd
uguuuuggcauuuucaau

SEQ ID NO: 717161 - RNA, 17 nt, Haemophilus influenzae Rd
uguuuugcaauaaaguu

SEQ ID NO: 717162 - RNA, 23 nt, Haemophilus influenzae Rd
uguuuugcaauaaaguugagaau

SEQ ID NO: 717163 - RNA, 13 nt, Haemophilus influenzae Rd
uguuuuucaucaa

SEQ ID NO: 717164 - RNA, 22 nt, Haemophilus influenzae Rd
uguuuuucauucuauuuuaaaa

SEQ ID NO: 717165 - RNA, 21 nt, Haemophilus influenzae Rd
uguuuuucccacaaagguaaa

SEQ ID NO: 717166 - RNA, 18 nt, Haemophilus influenzae Rd
uguuuuucgaucucugcc

SEQ ID NO: 717167 - RNA, 22 nt, Haemophilus influenzae Rd
uguuuuucgcguucuuucgcaa

SEQ ID NO: 717168 - RNA, 12 nt, Haemophilus influenzae Rd
uguuuuucuucc

SEQ ID NO: 717169 - RNA, 18 nt, Haemophilus influenzae Rd
uguuuuuuaauaucuucc

SEQ ID NO: 717170 - RNA, 21 nt, Haemophilus influenzae Rd
uguuuuuuacgaacuaauaag

SEQ ID NO: 717171 - RNA, 22 nt, Haemophilus influenzae Rd
uguuuuuguucugccuaauaag

SEQ ID NO: 717172 - RNA, 18 nt, Haemophilus influenzae Rd
uguuucaaugucuuuuuc

SEQ ID NO: 717173 - RNA, 16 nt, Haemophilus influenzae Rd
uguuucaguuuuauua

SEQ ID NO: 717174 - RNA, 18 nt, Haemophilus influenzae Rd
uguuucauaaaaaaugcu

SEQ ID NO: 717175 - RNA, 16 nt, Haemophilus influenzae Rd
uguuucgauacuuucu

SEQ ID NO: 717176 - RNA, 18 nt, Haemophilus influenzae Rd
uguuuccaaguauuuucu

SEQ ID NO: 717177 - RNA, 21 nt, Haemophilus influenzae Rd
uguuuccaaguauuuucuggu

SEQ ID NO: 717178 - RNA, 13 nt, Haemophilus influenzae Rd
uguuuccacacga

SEQ ID NO: 717179 - RNA, 13 nt, Haemophilus influenzae Rd
uguuucaucauuc

SEQ ID NO: 717180 - RNA, 22 nt, Haemophilus influenzae Rd
uguuuaucaggcggguauuuau

SEQ ID NO: 717181 - RNA, 16 nt, Haemophilus influenzae Rd
uguuuaugucuaaacu

SEQ ID NO: 717182 - RNA, 14 nt, Haemophilus influenzae Rd
uguuucaauucucc

SEQ ID NO: 717183 - RNA, 20 nt, Haemophilus influenzae Rd
uguuucacaaguucuugcgc

SEQ ID NO: 717184 - RNA, 16 nt, Haemophilus influenzae Rd
uguuucacuaaaaaua

SEQ ID NO: 717185 - RNA, 19 nt, Haemophilus influenzae Rd
uguuugccaucuaaaaaac

SEQ ID NO: 717186 - RNA, 21 nt, Haemophilus influenzae Rd
uguuugcggaaacauaucaaa

SEQ ID NO: 717187 - RNA, 17 nt, Haemophilus influenzae Rd
uguuuggaaugguagug

SEQ ID NO: 717188 - RNA, 18 nt, Haemophilus influenzae Rd
uguuugaacgcuauuaag

SEQ ID NO: 717189 - RNA, 20 nt, Haemophilus influenzae Rd
uguuucugucauuuauggaa

SEQ ID NO: 717190 - RNA, 18 nt, Haemophilus influenzae Rd
uguuucgcacaauucuca

SEQ ID NO: 717191 - RNA, 18 nt, Haemophilus influenzae Rd
uguuucuaauuuuucacu

SEQ ID NO: 717192 - RNA, 14 nt, Haemophilus influenzae Rd
uuaaagaaaauauu

SEQ ID NO: 717193 - RNA, 15 nt, Haemophilus influenzae Rd
uuaaagaaaauauuu

SEQ ID NO: 717194 - RNA, 23 nt, Haemophilus influenzae Rd
uuaaagaaaauacauaauuaaau

SEQ ID NO: 717195 - RNA, 19 nt, Haemophilus influenzae Rd
uuaaagaauuucuuucgcu

SEQ ID NO: 717196 - RNA, 23 nt, Haemophilus influenzae Rd
uuaaagagcaaauuuaaauaaua

SEQ ID NO: 717197 - RNA, 20 nt, Haemophilus influenzae Rd
uuaaagcacccaucacauuu

SEQ ID NO: 717198 - RNA, 21 nt, Haemophilus influenzae Rd
uuaaagcacccaucacauuuu

SEQ ID NO: 717199 - RNA, 22 nt, Haemophilus influenzae Rd
uuaaagcacccaucacauuuuc

SEQ ID NO: 717200 - RNA, 15 nt, Haemophilus influenzae Rd
uuaaacuugaauaau

SEQ ID NO: 717201 - RNA, 15 nt, Haemophilus influenzae Rd
uuaaacuuucaauuu

SEQ ID NO: 717202 - RNA, 18 nt, Haemophilus influenzae Rd
uuaaacuggaugaaauca

SEQ ID NO: 717203 - RNA, 18 nt, Haemophilus influenzae Rd
uuaaacuggguuuuauuu

SEQ ID NO: 717204 - RNA, 13 nt, Haemophilus influenzae Rd
uuaaacuaaauaa

SEQ ID NO: 717205 - RNA, 15 nt, Haemophilus influenzae Rd
uuaaacucacuaaau

SEQ ID NO: 717206 - RNA, 17 nt, Haemophilus influenzae Rd
uuaaacguugugcauca

SEQ ID NO: 717207 - RNA, 17 nt, Haemophilus influenzae Rd
uuaaacguuuauuuauu

SEQ ID NO: 717208 - RNA, 20 nt, Haemophilus influenzae Rd
uuaaacgcauauuuuguucu

SEQ ID NO: 717209 - RNA, 19 nt, Haemophilus influenzae Rd
uuaaacggucauuuacaaa

SEQ ID NO: 717210 - RNA, 18 nt, Haemophilus influenzae Rd
uuaaacgcuccucugcau

SEQ ID NO: 717211 - RNA, 17 nt, Haemophilus influenzae Rd
uuaaaaugaacaaaaaa

SEQ ID NO: 717212 - RNA, 18 nt, Haemophilus influenzae Rd
uuaaaaugaacaaaaaau

SEQ ID NO: 717213 - RNA, 13 nt, Haemophilus influenzae Rd
uuaaaauuaguaa

SEQ ID NO: 717214 - RNA, 13 nt, Haemophilus influenzae Rd
uuaaaauucaaag

SEQ ID NO: 717215 - RNA, 14 nt, Haemophilus influenzae Rd
uuaaaauuuaauaa

SEQ ID NO: 717216 - RNA, 14 nt, Haemophilus influenzae Rd
uuaaacaauucacu

SEQ ID NO: 717217 - RNA, 18 nt, Haemophilus influenzae Rd
uuaaacaauucacugcaa

SEQ ID NO: 717218 - RNA, 14 nt, Haemophilus influenzae Rd
uuaaaccaaauuga

SEQ ID NO: 717219 - RNA, 15 nt, Haemophilus influenzae Rd
uuaaaccuuauugca

SEQ ID NO: 717220 - RNA, 15 nt, Haemophilus influenzae Rd
uuaaacagcaaaagu

SEQ ID NO: 717221 - RNA, 18 nt, Haemophilus influenzae Rd
uuaaacagcaaaagugcu

SEQ ID NO: 717222 - RNA, 23 nt, Haemophilus influenzae Rd
uuaaacaccaaauauucuucuaa

SEQ ID NO: 717223 - RNA, 22 nt, Haemophilus influenzae Rd
uuaaacaccaauucaaagauuu

SEQ ID NO: 717224 - RNA, 20 nt, Haemophilus influenzae Rd
uuaaaaaacauuaauuuacg

SEQ ID NO: 717225 - RNA, 12 nt, Haemophilus influenzae Rd
uuaaaaaaauag

SEQ ID NO: 717226 - RNA, 15 nt, Haemophilus influenzae Rd
uuaaaaaaauaguua

SEQ ID NO: 717227 - RNA, 13 nt, Haemophilus influenzae Rd
uguuuuuuuucuu

SEQ ID NO: 717228 - RNA, 16 nt, Haemophilus influenzae Rd
uuaaaaaaagcaauau

SEQ ID NO: 717229 - RNA, 13 nt, Haemophilus influenzae Rd
uguuuuuuuaggu

SEQ ID NO: 717230 - RNA, 13 nt, Haemophilus influenzae Rd
uguuuuuuuauua

SEQ ID NO: 717231 - RNA, 13 nt, Haemophilus influenzae Rd
uuaaaaagcucca

SEQ ID NO: 717232 - RNA, 20 nt, Haemophilus influenzae Rd
uuaaaaaccgacuuugucaa

SEQ ID NO: 717233 - RNA, 18 nt, Haemophilus influenzae Rd
uuaaaaaagugaaagacg

SEQ ID NO: 717234 - RNA, 20 nt, Haemophilus influenzae Rd
uuaaaaaauaaauuuaaauu

SEQ ID NO: 717235 - RNA, 22 nt, Haemophilus influenzae Rd
uuaaaaaaucaccgcacuuugu

SEQ ID NO: 717236 - RNA, 18 nt, Haemophilus influenzae Rd
uuaaaauccaaccgauaa

SEQ ID NO: 717237 - RNA, 12 nt, Haemophilus influenzae Rd
uuaaaauaccca

SEQ ID NO: 717238 - RNA, 15 nt, Haemophilus influenzae Rd
uuaaaauacccauaa

SEQ ID NO: 717239 - RNA, 17 nt, Haemophilus influenzae Rd
uuaaaauagaaugaaaa

SEQ ID NO: 717240 - RNA, 22 nt, Haemophilus influenzae Rd
uuaaaaguuuaguccuuaauuu

SEQ ID NO: 717241 - RNA, 18 nt, Haemophilus influenzae Rd
uuaaaaguccgcugcucu

SEQ ID NO: 717242 - RNA, 19 nt, Haemophilus influenzae Rd
uuaaaagucuguuuaaaaa

SEQ ID NO: 717243 - RNA, 12 nt, Haemophilus influenzae Rd
uuaaaagugcgg

SEQ ID NO: 717244 - RNA, 18 nt, Haemophilus influenzae Rd
uuaaaaguguauaaauau

SEQ ID NO: 717245 - RNA, 21 nt, Haemophilus influenzae Rd
uuaaaauaaaagaauuuuuaa

SEQ ID NO: 717246 - RNA, 18 nt, Haemophilus influenzae Rd
uuaaaagccaauauggaa

SEQ ID NO: 717247 - RNA, 22 nt, Haemophilus influenzae Rd
uuaaaaggcuuucuaacacaga

SEQ ID NO: 717248 - RNA, 16 nt, Haemophilus influenzae Rd
uuaaaaguaaaaauaa

SEQ ID NO: 717249 - RNA, 22 nt, Haemophilus influenzae Rd
uuaaaaguaaaaauaaaaacau

SEQ ID NO: 717250 - RNA, 12 nt, Haemophilus influenzae Rd
uuaaaaguaaac

SEQ ID NO: 717251 - RNA, 14 nt, Haemophilus influenzae Rd
uuaaaaguaaacaa

SEQ ID NO: 717252 - RNA, 21 nt, Haemophilus influenzae Rd
uuaaaacugugcccgcagcaa

SEQ ID NO: 717253 - RNA, 13 nt, Haemophilus influenzae Rd
uuaaaagaaauuc

SEQ ID NO: 717254 - RNA, 16 nt, Haemophilus influenzae Rd
uuaaaagaaccuaucu

SEQ ID NO: 717255 - RNA, 22 nt, Haemophilus influenzae Rd
uuaaaaccguaagucccagcaa

SEQ ID NO: 717256 - RNA, 16 nt, Haemophilus influenzae Rd
uuaaaaccgucacaaa

SEQ ID NO: 717257 - RNA, 19 nt, Haemophilus influenzae Rd
uuaaaacgccauucacauu

SEQ ID NO: 717258 - RNA, 13 nt, Haemophilus influenzae Rd
uuaaaacuauaaa

SEQ ID NO: 717259 - RNA, 16 nt, Haemophilus influenzae Rd
uuaaaacuauuuuuaa

SEQ ID NO: 717260 - RNA, 18 nt, Haemophilus influenzae Rd
uuaaaacuauuuuuaauu

SEQ ID NO: 717261 - RNA, 14 nt, Haemophilus influenzae Rd
uuaaaacaaaagaa

SEQ ID NO: 717262 - RNA, 18 nt, Haemophilus influenzae Rd
uuaaaaauauaaccgcac

SEQ ID NO: 717263 - RNA, 19 nt, Haemophilus influenzae Rd
uuaaaaauauacagcacua

SEQ ID NO: 717264 - RNA, 16 nt, Haemophilus influenzae Rd
uuaaaacacgaaaaaa

SEQ ID NO: 717265 - RNA, 18 nt, Haemophilus influenzae Rd
uuaaaacaugaauaucau

SEQ ID NO: 717266 - RNA, 22 nt, Haemophilus influenzae Rd
uuaaaacaugaauaucaucaga

SEQ ID NO: 717267 - RNA, 15 nt, Haemophilus influenzae Rd
uuaaaaccaaaagau

SEQ ID NO: 717268 - RNA, 18 nt, Haemophilus influenzae Rd
uguucagccaauuuuuca

SEQ ID NO: 717269 - RNA, 21 nt, Haemophilus influenzae Rd
uguucaacuuccgcuaauacu

SEQ ID NO: 717270 - RNA, 17 nt, Haemophilus influenzae Rd
uguucacuaaagagaaa

SEQ ID NO: 717271 - RNA, 19 nt, Haemophilus influenzae Rd
uguucaguaucuggcucaa

SEQ ID NO: 717272 - RNA, 23 nt, Haemophilus influenzae Rd
uguucaguaucuggcucaauguu

SEQ ID NO: 717273 - RNA, 15 nt, Haemophilus influenzae Rd
uguucacaucaaaau

SEQ ID NO: 717274 - RNA, 13 nt, Haemophilus influenzae Rd
uguucaauaauau

SEQ ID NO: 717275 - RNA, 15 nt, Haemophilus influenzae Rd
uguucaauaauauua

SEQ ID NO: 717276 - RNA, 20 nt, Haemophilus influenzae Rd
uguuagaucaguuuuacguu

SEQ ID NO: 717277 - RNA, 23 nt, Haemophilus influenzae Rd
uguuauuaaaauuaauaaauauu

SEQ ID NO: 717278 - RNA, 17 nt, Haemophilus influenzae Rd
uguuauuaaauaaaccg

SEQ ID NO: 717279 - RNA, 13 nt, Haemophilus influenzae Rd
uguuaugcuuauc

SEQ ID NO: 717280 - RNA, 13 nt, Haemophilus influenzae Rd
uguucauuuuuau

SEQ ID NO: 717281 - RNA, 20 nt, Haemophilus influenzae Rd
uguuccaccacucacuggcu

SEQ ID NO: 717282 - RNA, 15 nt, Haemophilus influenzae Rd
uguuccgcaguuaaa

SEQ ID NO: 717283 - RNA, 17 nt, Haemophilus influenzae Rd
uguucccacaaagacua

SEQ ID NO: 717284 - RNA, 17 nt, Haemophilus influenzae Rd
uguuccaggaaaauuuu

SEQ ID NO: 717285 - RNA, 19 nt, Haemophilus influenzae Rd
uguuccaggaaaauuuuau

SEQ ID NO: 717286 - RNA, 19 nt, Haemophilus influenzae Rd
uguucuaagaaaguuuuau

SEQ ID NO: 717287 - RNA, 18 nt, Haemophilus influenzae Rd
uguucuacguaauuuaau

SEQ ID NO: 717288 - RNA, 22 nt, Haemophilus influenzae Rd
uguucuacugguuuuuguaagg

SEQ ID NO: 717289 - RNA, 14 nt, Haemophilus influenzae Rd
uguucuacuuuuuu

SEQ ID NO: 717290 - RNA, 13 nt, Haemophilus influenzae Rd
uguucuagugcaa

SEQ ID NO: 717291 - RNA, 15 nt, Haemophilus influenzae Rd
uguucugcaucaaua

SEQ ID NO: 717292 - RNA, 16 nt, Haemophilus influenzae Rd
uguucugcaucaauaa

SEQ ID NO: 717293 - RNA, 22 nt, Haemophilus influenzae Rd
uguucucacuaacuuuccuacu

SEQ ID NO: 717294 - RNA, 20 nt, Haemophilus influenzae Rd
uguucuccauuaagcacagg

SEQ ID NO: 717295 - RNA, 22 nt, Haemophilus influenzae Rd
uguucgguaagcgaggauaaug

SEQ ID NO: 717296 - RNA, 13 nt, Haemophilus influenzae Rd
uguucgguuuuuu

SEQ ID NO: 717297 - RNA, 13 nt, Haemophilus influenzae Rd
uguugcaauaauc

SEQ ID NO: 717298 - RNA, 23 nt, Haemophilus influenzae Rd
uguugcaauaccuagacgauugc

SEQ ID NO: 717299 - RNA, 21 nt, Haemophilus influenzae Rd
uguugccaguaacuuucuuca

SEQ ID NO: 717300 - RNA, 14 nt, Haemophilus influenzae Rd
uguugccaucaacg

SEQ ID NO: 717301 - RNA, 15 nt, Haemophilus influenzae Rd
uguugcuucaauugu

SEQ ID NO: 717302 - RNA, 19 nt, Haemophilus influenzae Rd
uguugcuuggucaaguuau

SEQ ID NO: 717303 - RNA, 21 nt, Haemophilus influenzae Rd
uguugcucagccaguuuucua

SEQ ID NO: 717304 - RNA, 23 nt, Haemophilus influenzae Rd
uguugcggcuuggaguagugcau

SEQ ID NO: 717305 - RNA, 15 nt, Haemophilus influenzae Rd
uguucuguuccugca

SEQ ID NO: 717306 - RNA, 19 nt, Haemophilus influenzae Rd
uguucuguuccugcauuau

SEQ ID NO: 717307 - RNA, 23 nt, Haemophilus influenzae Rd
uguucuucggguuuauguaaaua

SEQ ID NO: 717308 - RNA, 20 nt, Haemophilus influenzae Rd
uguucuuuauaagaaaguuu

SEQ ID NO: 717309 - RNA, 21 nt, Haemophilus influenzae Rd
uguugaaugccauucucccug

SEQ ID NO: 717310 - RNA, 16 nt, Haemophilus influenzae Rd
uguuuaauccaaacua

SEQ ID NO: 717311 - RNA, 17 nt, Haemophilus influenzae Rd
uguuuaauccaaacuaa

SEQ ID NO: 717312 - RNA, 20 nt, Haemophilus influenzae Rd
uguuuaauauuuuuuucaaa

SEQ ID NO: 717313 - RNA, 17 nt, Haemophilus influenzae Rd
uguuguuuaauaagccu

SEQ ID NO: 717314 - RNA, 17 nt, Haemophilus influenzae Rd
uguuuacuauuaauucu

SEQ ID NO: 717315 - RNA, 18 nt, Haemophilus influenzae Rd
uguuuacuuuuauaaaga

SEQ ID NO: 717316 - RNA, 21 nt, Haemophilus influenzae Rd
uguuuaccaccgauaaacacu

SEQ ID NO: 717317 - RNA, 21 nt, Haemophilus influenzae Rd
uguuuaauuggaaauaauauu

SEQ ID NO: 717318 - RNA, 17 nt, Haemophilus influenzae Rd
uguuuaauuauagaaaa

SEQ ID NO: 717319 - RNA, 19 nt, Haemophilus influenzae Rd
uguuuaauuauagaaaaga

SEQ ID NO: 717320 - RNA, 12 nt, Haemophilus influenzae Rd
uguuguacuuua

SEQ ID NO: 717321 - RNA, 15 nt, Haemophilus influenzae Rd
uguuguacuuuagaa

SEQ ID NO: 717322 - RNA, 18 nt, Haemophilus influenzae Rd
uguuguaauccauuuuga

SEQ ID NO: 717323 - RNA, 19 nt, Haemophilus influenzae Rd
uguuguaauccauuuugaa

SEQ ID NO: 717324 - RNA, 15 nt, Haemophilus influenzae Rd
uguuggaaaaaugcu

SEQ ID NO: 717325 - RNA, 17 nt, Haemophilus influenzae Rd
uguuggaacguuuaaau

SEQ ID NO: 717326 - RNA, 17 nt, Haemophilus influenzae Rd
ugauuuguuacuaaaau

SEQ ID NO: 717327 - RNA, 16 nt, Haemophilus influenzae Rd
ugauuuguaucauauc

SEQ ID NO: 717328 - RNA, 18 nt, Haemophilus influenzae Rd
ugauuuuaaaauaaauuu

SEQ ID NO: 717329 - RNA, 12 nt, Haemophilus influenzae Rd
ugauuucuucaa

SEQ ID NO: 717330 - RNA, 13 nt, Haemophilus influenzae Rd
ugauuugcauaaa

SEQ ID NO: 717331 - RNA, 20 nt, Haemophilus influenzae Rd
ugauuugcuuggaauaaauu

SEQ ID NO: 717332 - RNA, 22 nt, Haemophilus influenzae Rd
ugcaccccaaaagcuggauuaa

SEQ ID NO: 717333 - RNA, 19 nt, Haemophilus influenzae Rd
ugcaccuuuauuugcaccu

SEQ ID NO: 717334 - RNA, 14 nt, Haemophilus influenzae Rd
ugcacgaccaccca

SEQ ID NO: 717335 - RNA, 20 nt, Haemophilus influenzae Rd
ugcacuuucucgagcuaaau

SEQ ID NO: 717336 - RNA, 11 nt, Haemophilus influenzae Rd
ugcagaaaaau

SEQ ID NO: 717337 - RNA, 16 nt, Haemophilus influenzae Rd
ugcagaaccgccaccc

SEQ ID NO: 717338 - RNA, 23 nt, Haemophilus influenzae Rd
ugcagcuggaguucguuauaagc

SEQ ID NO: 717339 - RNA, 20 nt, Haemophilus influenzae Rd
ugcagacuagugaaauauuu

SEQ ID NO: 717340 - RNA, 15 nt, Haemophilus influenzae Rd
ugcagagaagaaaua

SEQ ID NO: 717341 - RNA, 16 nt, Haemophilus influenzae Rd
ugcagcagcuucuucu

SEQ ID NO: 717342 - RNA, 18 nt, Haemophilus influenzae Rd
ugcaucuuguuuaucgaa

SEQ ID NO: 717343 - RNA, 23 nt, Haemophilus influenzae Rd
ugcauuaaaaaacauuaauuuac

SEQ ID NO: 717344 - RNA, 15 nt, Haemophilus influenzae Rd
ugcaugagcuuugcu

SEQ ID NO: 717345 - RNA, 14 nt, Haemophilus influenzae Rd
ugcauauucauaaa

SEQ ID NO: 717346 - RNA, 23 nt, Haemophilus influenzae Rd
ugcauauuaaugcggugcuuuaa

SEQ ID NO: 717347 - RNA, 20 nt, Haemophilus influenzae Rd
ugcauauguugguaauucag

SEQ ID NO: 717348 - RNA, 14 nt, Haemophilus influenzae Rd
ugcauaguuuuaug

SEQ ID NO: 717349 - RNA, 21 nt, Haemophilus influenzae Rd
ugcauaguuuuccauuuuuga

SEQ ID NO: 717350 - RNA, 13 nt, Haemophilus influenzae Rd
ugcauauaaaaaa

SEQ ID NO: 717351 - RNA, 20 nt, Haemophilus influenzae Rd
ugccaaagcauuaaguuuuu

SEQ ID NO: 717352 - RNA, 16 nt, Haemophilus influenzae Rd
ugcauuuuuuaaucua

SEQ ID NO: 717353 - RNA, 13 nt, Haemophilus influenzae Rd
ugcauuuuuauaa

SEQ ID NO: 717354 - RNA, 15 nt, Haemophilus influenzae Rd
ugcauuuuuauaaag

SEQ ID NO: 717355 - RNA, 13 nt, Haemophilus influenzae Rd
ugcauuuuggaua

SEQ ID NO: 717356 - RNA, 13 nt, Haemophilus influenzae Rd
ugcauuuucuucc

SEQ ID NO: 717357 - RNA, 17 nt, Haemophilus influenzae Rd
ugcauuuucuuccaaug

SEQ ID NO: 717358 - RNA, 13 nt, Haemophilus influenzae Rd
ugcauuaauaauc

SEQ ID NO: 717359 - RNA, 14 nt, Haemophilus influenzae Rd
ugcauuaauaaucu

SEQ ID NO: 717360 - RNA, 18 nt, Haemophilus influenzae Rd
ugccaaccacccaaauau

SEQ ID NO: 717361 - RNA, 15 nt, Haemophilus influenzae Rd
ugccaacaauaucac

SEQ ID NO: 717362 - RNA, 17 nt, Haemophilus influenzae Rd
ugccaacaccuaagaac

SEQ ID NO: 717363 - RNA, 14 nt, Haemophilus influenzae Rd
ugccaacgcaggua

SEQ ID NO: 717364 - RNA, 21 nt, Haemophilus influenzae Rd
ugccaagcuaauugguaaaau

SEQ ID NO: 717365 - RNA, 13 nt, Haemophilus influenzae Rd
ugccaaggcuccc

SEQ ID NO: 717366 - RNA, 13 nt, Haemophilus influenzae Rd
ugccaaguaaauc

SEQ ID NO: 717367 - RNA, 18 nt, Haemophilus influenzae Rd
ugccaaguaaaucggcug

SEQ ID NO: 717368 - RNA, 12 nt, Haemophilus influenzae Rd
ugccacaucauc

SEQ ID NO: 717369 - RNA, 17 nt, Haemophilus influenzae Rd
ugccacaggauaaaaac

SEQ ID NO: 717370 - RNA, 17 nt, Haemophilus influenzae Rd
ugccacuuccacuucug

SEQ ID NO: 717371 - RNA, 19 nt, Haemophilus influenzae Rd
ugccacuuggugaucaccg

SEQ ID NO: 717372 - RNA, 23 nt, Haemophilus influenzae Rd
ugccaguaacuuucuucaauaau

SEQ ID NO: 717373 - RNA, 18 nt, Haemophilus influenzae Rd
ugccaguggcucaauauc

SEQ ID NO: 717374 - RNA, 17 nt, Haemophilus influenzae Rd
ugccagucuuacgccaa

SEQ ID NO: 717375 - RNA, 22 nt, Haemophilus influenzae Rd
ugccaguuaaggauuuuugaau

SEQ ID NO: 717376 - RNA, 18 nt, Haemophilus influenzae Rd
ugccauuauccacaacag

SEQ ID NO: 717377 - RNA, 15 nt, Haemophilus influenzae Rd
ugccauguacauuaa

SEQ ID NO: 717378 - RNA, 13 nt, Haemophilus influenzae Rd
ugccauugcuaaa

SEQ ID NO: 717379 - RNA, 16 nt, Haemophilus influenzae Rd
ugccauugcuaaauuu

SEQ ID NO: 717380 - RNA, 20 nt, Haemophilus influenzae Rd
ugccauuuuuuggaguuguu

SEQ ID NO: 717381 - RNA, 12 nt, Haemophilus influenzae Rd
ugcccaagugcg

SEQ ID NO: 717382 - RNA, 15 nt, Haemophilus influenzae Rd
ugcccaauauaacaa

SEQ ID NO: 717383 - RNA, 14 nt, Haemophilus influenzae Rd
ugccauuugcuucu

SEQ ID NO: 717384 - RNA, 22 nt, Haemophilus influenzae Rd
ugccauuuuucagcaagcauuu

SEQ ID NO: 717385 - RNA, 16 nt, Haemophilus influenzae Rd
ugccauuguuaaaugu

SEQ ID NO: 717386 - RNA, 14 nt, Haemophilus influenzae Rd
ugccaucaccaaga

SEQ ID NO: 717387 - RNA, 16 nt, Haemophilus influenzae Rd
ugccaucaccaagaau

SEQ ID NO: 717388 - RNA, 15 nt, Haemophilus influenzae Rd
ugccauauuuaauaa

SEQ ID NO: 717389 - RNA, 16 nt, Haemophilus influenzae Rd
ugccauauuuaauaag

SEQ ID NO: 717390 - RNA, 21 nt, Haemophilus influenzae Rd
ugccaucacagucuuuuaaca

SEQ ID NO: 717391 - RNA, 18 nt, Haemophilus influenzae Rd
ugccauauaccaauaauu

SEQ ID NO: 717392 - RNA, 17 nt, Haemophilus influenzae Rd
ugccauaggacaggcua

SEQ ID NO: 717393 - RNA, 13 nt, Haemophilus influenzae Rd
ugcccacauagcu

SEQ ID NO: 717394 - RNA, 18 nt, Haemophilus influenzae Rd
ugcccagcaauuuauugu

SEQ ID NO: 717395 - RNA, 21 nt, Haemophilus influenzae Rd
ugcccagcaauuuauuguagc

SEQ ID NO: 717396 - RNA, 14 nt, Haemophilus influenzae Rd
ugccccagcaagaa

SEQ ID NO: 717397 - RNA, 13 nt, Haemophilus influenzae Rd
ugcccaugcuuug

SEQ ID NO: 717398 - RNA, 15 nt, Haemophilus influenzae Rd
ugcccauauuauucc

SEQ ID NO: 717399 - RNA, 15 nt, Haemophilus influenzae Rd
ugccccugcaauugu

SEQ ID NO: 717400 - RNA, 20 nt, Haemophilus influenzae Rd
ugcccgcagcaauuaaaaag

SEQ ID NO: 717401 - RNA, 19 nt, Haemophilus influenzae Rd
ugcccgugaguaaaauaua

SEQ ID NO: 717402 - RNA, 20 nt, Haemophilus influenzae Rd
ugccgacacuaaaaagccca

SEQ ID NO: 717403 - RNA, 22 nt, Haemophilus influenzae Rd
ugccgaauagauuuaaacaauu

SEQ ID NO: 717404 - RNA, 16 nt, Haemophilus influenzae Rd
ugccgaagccuaaauc

SEQ ID NO: 717405 - RNA, 16 nt, Haemophilus influenzae Rd
ugcccuagugcaacca

SEQ ID NO: 717406 - RNA, 23 nt, Haemophilus influenzae Rd
ugcccuagugcaaccacacaagc

SEQ ID NO: 717407 - RNA, 14 nt, Haemophilus influenzae Rd
ugccgcaaacauca

SEQ ID NO: 717408 - RNA, 18 nt, Haemophilus influenzae Rd
ugccgcaaacaucaucac

SEQ ID NO: 717409 - RNA, 14 nt, Haemophilus influenzae Rd
ugccgccaauccag

SEQ ID NO: 717410 - RNA, 12 nt, Haemophilus influenzae Rd
ugccguucaaaa

SEQ ID NO: 717411 - RNA, 16 nt, Haemophilus influenzae Rd
ugccuauuuauuuauu

SEQ ID NO: 717412 - RNA, 20 nt, Haemophilus influenzae Rd
ugccuacuuuuuauuuuuga

SEQ ID NO: 717413 - RNA, 14 nt, Haemophilus influenzae Rd
ugccuaauaaaaaa

SEQ ID NO: 717414 - RNA, 15 nt, Haemophilus influenzae Rd
ugccuaauaaaaaau

SEQ ID NO: 717415 - RNA, 22 nt, Haemophilus influenzae Rd
ugccuaauucagcggcuuucuu

SEQ ID NO: 717416 - RNA, 15 nt, Haemophilus influenzae Rd
ugccgccuuuuaaua

SEQ ID NO: 717417 - RNA, 17 nt, Haemophilus influenzae Rd
ugccgccuuuuaauaaa

SEQ ID NO: 717418 - RNA, 14 nt, Haemophilus influenzae Rd
ugccgcuuuacaaa

SEQ ID NO: 717419 - RNA, 15 nt, Haemophilus influenzae Rd
ugccgcugcaacaaa

SEQ ID NO: 717420 - RNA, 16 nt, Haemophilus influenzae Rd
ugccgcugcagcagga

SEQ ID NO: 717421 - RNA, 20 nt, Haemophilus influenzae Rd
ugcgacuugguggauugugc

SEQ ID NO: 717422 - RNA, 12 nt, Haemophilus influenzae Rd
ugcgauuuccaa

SEQ ID NO: 717423 - RNA, 15 nt, Haemophilus influenzae Rd
ugcgauuuccaagcu

SEQ ID NO: 717424 - RNA, 14 nt, Haemophilus influenzae Rd
ugcgauuucuuuug

SEQ ID NO: 717425 - RNA, 16 nt, Haemophilus influenzae Rd
ugcgcgcagaaagacg

SEQ ID NO: 717426 - RNA, 17 nt, Haemophilus influenzae Rd
aaaugggucaagauuaa

SEQ ID NO: 717427 - RNA, 15 nt, Haemophilus influenzae Rd
ugcgcauuuaauacu

SEQ ID NO: 717428 - RNA, 16 nt, Haemophilus influenzae Rd
ugcgccauuucccaua

SEQ ID NO: 717429 - RNA, 16 nt, Haemophilus influenzae Rd
ugcgccauuuuuaaaa

SEQ ID NO: 717430 - RNA, 18 nt, Haemophilus influenzae Rd
aaauggcguuuugcguga

SEQ ID NO: 717431 - RNA, 15 nt, Haemophilus influenzae Rd
aaaugggccucuuua

SEQ ID NO: 717432 - RNA, 15 nt, Haemophilus influenzae Rd
aaauggcauuuauaa

SEQ ID NO: 717433 - RNA, 16 nt, Haemophilus influenzae Rd
aaauggcccugaaagu

SEQ ID NO: 717434 - RNA, 16 nt, Haemophilus influenzae Rd
aaauggcaaacaaaau

SEQ ID NO: 717435 - RNA, 22 nt, Haemophilus influenzae Rd
aaauggcaaacaaaauaaauga

SEQ ID NO: 717436 - RNA, 13 nt, Haemophilus influenzae Rd
ugcgggcaaaaac

SEQ ID NO: 717437 - RNA, 23 nt, Haemophilus influenzae Rd
ugcgguaaaaaaaugaaauauuu

SEQ ID NO: 717438 - RNA, 14 nt, Haemophilus influenzae Rd
ugcgguaaaaauuc

SEQ ID NO: 717439 - RNA, 16 nt, Haemophilus influenzae Rd
ugcgguaaaaauuuac

SEQ ID NO: 717440 - RNA, 18 nt, Haemophilus influenzae Rd
ugcgguaaaaauuuaccg

SEQ ID NO: 717441 - RNA, 17 nt, Haemophilus influenzae Rd
ugcgguaaaauuuuucu

SEQ ID NO: 717442 - RNA, 23 nt, Haemophilus influenzae Rd
ugcgguaauuauagagaaauaau

SEQ ID NO: 717443 - RNA, 19 nt, Haemophilus influenzae Rd
ugcgguaauuuuuagaaga

SEQ ID NO: 717444 - RNA, 19 nt, Haemophilus influenzae Rd
ugcgggucuuguuccaaca

SEQ ID NO: 717445 - RNA, 14 nt, Haemophilus influenzae Rd
ugcggucaacauaa

SEQ ID NO: 717446 - RNA, 19 nt, Haemophilus influenzae Rd
ugcggauucgccaaagcua

SEQ ID NO: 717447 - RNA, 15 nt, Haemophilus influenzae Rd
ugcggacuuuuucau

SEQ ID NO: 717448 - RNA, 18 nt, Haemophilus influenzae Rd
ugcggacuuuuucauuau

SEQ ID NO: 717449 - RNA, 13 nt, Haemophilus influenzae Rd
ugcgcugaccaau

SEQ ID NO: 717450 - RNA, 19 nt, Haemophilus influenzae Rd
ugacgaaaaauuaaccauc

SEQ ID NO: 717451 - RNA, 13 nt, Haemophilus influenzae Rd
ugacgaaauaaau

SEQ ID NO: 717452 - RNA, 15 nt, Haemophilus influenzae Rd
ugacgaaaugaaauu

SEQ ID NO: 717453 - RNA, 16 nt, Haemophilus influenzae Rd
ugaccuucauaaacuu

SEQ ID NO: 717454 - RNA, 15 nt, Haemophilus influenzae Rd
ugacuggcaaaaaug

SEQ ID NO: 717455 - RNA, 20 nt, Haemophilus influenzae Rd
ugacuuggauugauauuugg

SEQ ID NO: 717456 - RNA, 15 nt, Haemophilus influenzae Rd
ugacuuguuuuaaaa

SEQ ID NO: 717457 - RNA, 20 nt, Haemophilus influenzae Rd
ugacuuucgaguaauagauu

SEQ ID NO: 717458 - RNA, 15 nt, Haemophilus influenzae Rd
ugagaauuaauuuau

SEQ ID NO: 717459 - RNA, 23 nt, Haemophilus influenzae Rd
ugagaauuaauuuauaaauuauu

SEQ ID NO: 717460 - RNA, 18 nt, Haemophilus influenzae Rd
ugagauggccgagcaggc

SEQ ID NO: 717461 - RNA, 15 nt, Haemophilus influenzae Rd
ugagauuauuucuac

SEQ ID NO: 717462 - RNA, 17 nt, Haemophilus influenzae Rd
ugagccuucaaaauuug

SEQ ID NO: 717463 - RNA, 21 nt, Haemophilus influenzae Rd
ugagccguuauauuuccuucu

SEQ ID NO: 717464 - RNA, 16 nt, Haemophilus influenzae Rd
ugagcauuuuuuauua

SEQ ID NO: 717465 - RNA, 17 nt, Haemophilus influenzae Rd
ugagcauuuuuuauuaa

SEQ ID NO: 717466 - RNA, 23 nt, Haemophilus influenzae Rd
ugagcauuuuuuauuaaaaaagu

SEQ ID NO: 717467 - RNA, 17 nt, Haemophilus influenzae Rd
ugaguaaaccacaauac

SEQ ID NO: 717468 - RNA, 14 nt, Haemophilus influenzae Rd
ugagguuugccauc

SEQ ID NO: 717469 - RNA, 13 nt, Haemophilus influenzae Rd
ugaguaaauaaac

SEQ ID NO: 717470 - RNA, 13 nt, Haemophilus influenzae Rd
ugaguauaaauuu

SEQ ID NO: 717471 - RNA, 12 nt, Haemophilus influenzae Rd
ugaguauaguca

SEQ ID NO: 717472 - RNA, 20 nt, Haemophilus influenzae Rd
ugaguauagucauucaaugc

SEQ ID NO: 717473 - RNA, 16 nt, Haemophilus influenzae Rd
ugaguauaaauuugug

SEQ ID NO: 717474 - RNA, 21 nt, Haemophilus influenzae Rd
ugagcugucuaauuuuuuauu

SEQ ID NO: 717475 - RNA, 14 nt, Haemophilus influenzae Rd
ugagcuugauuuuc

SEQ ID NO: 717476 - RNA, 17 nt, Haemophilus influenzae Rd
ugagcugcuuguaacca

SEQ ID NO: 717477 - RNA, 22 nt, Haemophilus influenzae Rd
ugauaaccuuuagacaacaacu

SEQ ID NO: 717478 - RNA, 17 nt, Haemophilus influenzae Rd
ugauaaccaucuauauu

SEQ ID NO: 717479 - RNA, 17 nt, Haemophilus influenzae Rd
ugauaaauuucuaaccg

SEQ ID NO: 717480 - RNA, 21 nt, Haemophilus influenzae Rd
ugauaacgcuugaauaaaucc

SEQ ID NO: 717481 - RNA, 18 nt, Haemophilus influenzae Rd
ugauaaucauugaaaugu

SEQ ID NO: 717482 - RNA, 15 nt, Haemophilus influenzae Rd
ugauaauuucaucgc

SEQ ID NO: 717483 - RNA, 21 nt, Haemophilus influenzae Rd
ugauacaaucgguuaaaagua

SEQ ID NO: 717484 - RNA, 15 nt, Haemophilus influenzae Rd
ugauaauuaacaaua

SEQ ID NO: 717485 - RNA, 16 nt, Haemophilus influenzae Rd
ugauaauuaacaauau

SEQ ID NO: 717486 - RNA, 15 nt, Haemophilus influenzae Rd
ugaguauguugcuuu

SEQ ID NO: 717487 - RNA, 20 nt, Haemophilus influenzae Rd
ugaguauguugcuuuuauca

SEQ ID NO: 717488 - RNA, 13 nt, Haemophilus influenzae Rd
ugaguaucuuuua

SEQ ID NO: 717489 - RNA, 15 nt, Haemophilus influenzae Rd
ugaguaucuuuuaau

SEQ ID NO: 717490 - RNA, 20 nt, Haemophilus influenzae Rd
ugaguccgauccauacagua

SEQ ID NO: 717491 - RNA, 23 nt, Haemophilus influenzae Rd
ugaguccgauccauacaguaaaa

SEQ ID NO: 717492 - RNA, 23 nt, Haemophilus influenzae Rd
ugagucggggauuuuuuauauga

SEQ ID NO: 717493 - RNA, 22 nt, Haemophilus influenzae Rd
ugaguccuuuuaguuuccccug

SEQ ID NO: 717494 - RNA, 18 nt, Haemophilus influenzae Rd
ugaguucucguugcaucu

SEQ ID NO: 717495 - RNA, 18 nt, Haemophilus influenzae Rd
ugagucucaaauuuuuca

SEQ ID NO: 717496 - RNA, 21 nt, Haemophilus influenzae Rd
ugauaaaggcauuuauuucaa

SEQ ID NO: 717497 - RNA, 17 nt, Haemophilus influenzae Rd
ugaguuuucaucuaagu

SEQ ID NO: 717498 - RNA, 13 nt, Haemophilus influenzae Rd
ugaguuuggaaua

SEQ ID NO: 717499 - RNA, 23 nt, Haemophilus influenzae Rd
ugaguugucccgcauauaaaaua

SEQ ID NO: 717500 - RNA, 19 nt, Haemophilus influenzae Rd
ugaguuuccacguuuucaa

SEQ ID NO: 717501 - RNA, 21 nt, Haemophilus influenzae Rd
ugaguuuccacguuuucaacu

SEQ ID NO: 717502 - RNA, 13 nt, Haemophilus influenzae Rd
ugauccacacuuc

SEQ ID NO: 717503 - RNA, 13 nt, Haemophilus influenzae Rd
ugauccaaaaaua

SEQ ID NO: 717504 - RNA, 19 nt, Haemophilus influenzae Rd
ugaucacuucauaaauugu

SEQ ID NO: 717505 - RNA, 14 nt, Haemophilus influenzae Rd
ugaucgguuuuauu

SEQ ID NO: 717506 - RNA, 16 nt, Haemophilus influenzae Rd
ugauccauauauugaa

SEQ ID NO: 717507 - RNA, 16 nt, Haemophilus influenzae Rd
ugaucguuaauaucau

SEQ ID NO: 717508 - RNA, 16 nt, Haemophilus influenzae Rd
ugaucuaaauuaucgu

SEQ ID NO: 717509 - RNA, 22 nt, Haemophilus influenzae Rd
ugaucuaauuugccaaguacaa

SEQ ID NO: 717510 - RNA, 17 nt, Haemophilus influenzae Rd
ugaucaccgaaauaacc

SEQ ID NO: 717511 - RNA, 13 nt, Haemophilus influenzae Rd
ugaucaaaauuau

SEQ ID NO: 717512 - RNA, 22 nt, Haemophilus influenzae Rd
ugaucaaaucaaauuuuccuuc

SEQ ID NO: 717513 - RNA, 14 nt, Haemophilus influenzae Rd
ugauauuuaauaaa

SEQ ID NO: 717514 - RNA, 12 nt, Haemophilus influenzae Rd
ugauauuuuuca

SEQ ID NO: 717515 - RNA, 23 nt, Haemophilus influenzae Rd
ugauauuucaauuuaagcccugc

SEQ ID NO: 717516 - RNA, 19 nt, Haemophilus influenzae Rd
ugauauuucacuaaauccu

SEQ ID NO: 717517 - RNA, 16 nt, Haemophilus influenzae Rd
ugauauuguuuuaauu

SEQ ID NO: 717518 - RNA, 21 nt, Haemophilus influenzae Rd
ugauauuccauaguucacuaa

SEQ ID NO: 717519 - RNA, 13 nt, Haemophilus influenzae Rd
ugauauucaauua

SEQ ID NO: 717520 - RNA, 15 nt, Haemophilus influenzae Rd
ugauauucaauuacu

SEQ ID NO: 717521 - RNA, 18 nt, Haemophilus influenzae Rd
ugauaccaagcauauuug

SEQ ID NO: 717522 - RNA, 18 nt, Haemophilus influenzae Rd
ugauacauuucuaaaaua

SEQ ID NO: 717523 - RNA, 21 nt, Haemophilus influenzae Rd
ugauacauuucuaaaauaaua

SEQ ID NO: 717524 - RNA, 17 nt, Haemophilus influenzae Rd
ugaugggaauucauaaa

SEQ ID NO: 717525 - RNA, 20 nt, Haemophilus influenzae Rd
ugauggacuuauaaauuuaa

SEQ ID NO: 717526 - RNA, 15 nt, Haemophilus influenzae Rd
ugaugcucugcauaa

SEQ ID NO: 717527 - RNA, 15 nt, Haemophilus influenzae Rd
ugauggaauuuauac

SEQ ID NO: 717528 - RNA, 16 nt, Haemophilus influenzae Rd
ugauggaauuuauacg

SEQ ID NO: 717529 - RNA, 15 nt, Haemophilus influenzae Rd
ugaugccauuuuuug

SEQ ID NO: 717530 - RNA, 14 nt, Haemophilus influenzae Rd
ugaugcaggaaagg

SEQ ID NO: 717531 - RNA, 14 nt, Haemophilus influenzae Rd
ugaugaaacaagcu

SEQ ID NO: 717532 - RNA, 21 nt, Haemophilus influenzae Rd
ugaugaaacugaaccagccau

SEQ ID NO: 717533 - RNA, 21 nt, Haemophilus influenzae Rd
ugaucuugguagaaaauuuga

SEQ ID NO: 717534 - RNA, 18 nt, Haemophilus influenzae Rd
ugaucuccgcgacauuaa

SEQ ID NO: 717535 - RNA, 16 nt, Haemophilus influenzae Rd
ugauugcuacagcaaa

SEQ ID NO: 717536 - RNA, 16 nt, Haemophilus influenzae Rd
ugauugcgaauauuaa

SEQ ID NO: 717537 - RNA, 21 nt, Haemophilus influenzae Rd
ugauugcgcauuuaauacuga

SEQ ID NO: 717538 - RNA, 21 nt, Haemophilus influenzae Rd
ugauucugugcaauauuuccu

SEQ ID NO: 717539 - RNA, 19 nt, Haemophilus influenzae Rd
ugauucuucgccauuuucu

SEQ ID NO: 717540 - RNA, 22 nt, Haemophilus influenzae Rd
ugauuuagccaguaauuuuaca

SEQ ID NO: 717541 - RNA, 14 nt, Haemophilus influenzae Rd
ugauuuaucauaau

SEQ ID NO: 717542 - RNA, 13 nt, Haemophilus influenzae Rd
ugauuuaucauuc

SEQ ID NO: 717543 - RNA, 20 nt, Haemophilus influenzae Rd
ugauuguccaaagaauaaua

SEQ ID NO: 717544 - RNA, 18 nt, Haemophilus influenzae Rd
ugauugguucauagcuga

SEQ ID NO: 717545 - RNA, 14 nt, Haemophilus influenzae Rd
ugauuguaaaaguc

SEQ ID NO: 717546 - RNA, 19 nt, Haemophilus influenzae Rd
ugauuguaaaagucccuga

SEQ ID NO: 717547 - RNA, 22 nt, Haemophilus influenzae Rd
ugauuucuauguuauuaaaauu

SEQ ID NO: 717548 - RNA, 18 nt, Haemophilus influenzae Rd
ugauuucauuuucuaaua

SEQ ID NO: 717549 - RNA, 23 nt, Haemophilus influenzae Rd
ugauuucaauuccuuuaacgccu

SEQ ID NO: 717550 - RNA, 21 nt, Haemophilus influenzae Rd
ugauuauugaucgccuaaaua

SEQ ID NO: 717551 - RNA, 18 nt, Haemophilus influenzae Rd
ugauuauuuaauuucaaa

SEQ ID NO: 717552 - RNA, 22 nt, Haemophilus influenzae Rd
ugauuauuucucuauaauuacc

SEQ ID NO: 717553 - RNA, 19 nt, Haemophilus influenzae Rd
ugauucaaugcuuccuuca

SEQ ID NO: 717554 - RNA, 16 nt, Haemophilus influenzae Rd
ugauucuaaaaacucc

SEQ ID NO: 717555 - RNA, 19 nt, Haemophilus influenzae Rd
ugauuaucuaaauuucgcu

SEQ ID NO: 717556 - RNA, 20 nt, Haemophilus influenzae Rd
ugauuaucuagcacaaagac

SEQ ID NO: 717557 - RNA, 22 nt, Haemophilus influenzae Rd
ugauuaugaccuuuuuuuagaa

SEQ ID NO: 717558 - RNA, 18 nt, Haemophilus influenzae Rd
ugauuauccacuaaaaaa

SEQ ID NO: 717559 - RNA, 23 nt, Haemophilus influenzae Rd
ugauuauucucuauuaauuuuaa

SEQ ID NO: 717560 - RNA, 18 nt, Haemophilus influenzae Rd
ugauuaccaggaaauauu

SEQ ID NO: 717561 - RNA, 14 nt, Haemophilus influenzae Rd
ugauuacuuaaagu

SEQ ID NO: 717562 - RNA, 14 nt, Haemophilus influenzae Rd
ugauuaaucaaaaa

SEQ ID NO: 717563 - RNA, 19 nt, Haemophilus influenzae Rd
ugauguuaugcuuaucauu

SEQ ID NO: 717564 - RNA, 19 nt, Haemophilus influenzae Rd
ugauuaaaaugguuuaaau

SEQ ID NO: 717565 - RNA, 15 nt, Haemophilus influenzae Rd
ugauuaaguauaacu

SEQ ID NO: 717566 - RNA, 16 nt, Haemophilus influenzae Rd
ugauuaaguuaaaagu

SEQ ID NO: 717567 - RNA, 22 nt, Haemophilus influenzae Rd
ugauuaaguuaaaaguguauaa

SEQ ID NO: 717568 - RNA, 17 nt, Haemophilus influenzae Rd
ugauuaacaaugauuaa

SEQ ID NO: 717569 - RNA, 12 nt, Haemophilus influenzae Rd
ugauguggcuuu

SEQ ID NO: 717570 - RNA, 17 nt, Haemophilus influenzae Rd
ugauguggcuuuugguc

SEQ ID NO: 717571 - RNA, 17 nt, Haemophilus influenzae Rd
ugauguaccaauuugua

SEQ ID NO: 717572 - RNA, 20 nt, Haemophilus influenzae Rd
ugauguaccaauuuguacca

SEQ ID NO: 717573 - RNA, 19 nt, Haemophilus influenzae Rd
ugaaugugaucaugguugu

SEQ ID NO: 717574 - RNA, 16 nt, Haemophilus influenzae Rd
ugaauggguuaguaag

SEQ ID NO: 717575 - RNA, 15 nt, Haemophilus influenzae Rd
ugaauuaaaaguuua

SEQ ID NO: 717576 - RNA, 14 nt, Haemophilus influenzae Rd
ugaauuaaaaguag

SEQ ID NO: 717577 - RNA, 16 nt, Haemophilus influenzae Rd
ugaauuaaaaguagaa

SEQ ID NO: 717578 - RNA, 17 nt, Haemophilus influenzae Rd
ugaauuaaaaguagaag

SEQ ID NO: 717579 - RNA, 23 nt, Haemophilus influenzae Rd
ugaauuaguuucaacuuggaaag

SEQ ID NO: 717580 - RNA, 16 nt, Haemophilus influenzae Rd
ugaauuaccacaucau

SEQ ID NO: 717581 - RNA, 17 nt, Haemophilus influenzae Rd
ugaauuaccacaucauu

SEQ ID NO: 717582 - RNA, 14 nt, Haemophilus influenzae Rd
ugaauugagugaau

SEQ ID NO: 717583 - RNA, 13 nt, Haemophilus influenzae Rd
ugaauuuaaacuu

SEQ ID NO: 717584 - RNA, 13 nt, Haemophilus influenzae Rd
ugaauugcuuuaa

SEQ ID NO: 717585 - RNA, 19 nt, Haemophilus influenzae Rd
ugaauuggaaguuuuuccg

SEQ ID NO: 717586 - RNA, 19 nt, Haemophilus influenzae Rd
ugaauugguguuuaaaugg

SEQ ID NO: 717587 - RNA, 14 nt, Haemophilus influenzae Rd
ugaauuuaauucac

SEQ ID NO: 717588 - RNA, 15 nt, Haemophilus influenzae Rd
ugaauuuaauucacc

SEQ ID NO: 717589 - RNA, 22 nt, Haemophilus influenzae Rd
ugaauuuauauuaauuuugaua

SEQ ID NO: 717590 - RNA, 18 nt, Haemophilus influenzae Rd
ugaauuuuuuuaguuuug

SEQ ID NO: 717591 - RNA, 14 nt, Haemophilus influenzae Rd
ugacaaaaaauauc

SEQ ID NO: 717592 - RNA, 18 nt, Haemophilus influenzae Rd
ugaauuuucaaugguuua

SEQ ID NO: 717593 - RNA, 21 nt, Haemophilus influenzae Rd
ugaauuucuugccgaaaauuu

SEQ ID NO: 717594 - RNA, 11 nt, Haemophilus influenzae Rd
ugaauuucuaa

SEQ ID NO: 717595 - RNA, 22 nt, Haemophilus influenzae Rd
ugaaugacuuucacuacagguu

SEQ ID NO: 717596 - RNA, 17 nt, Haemophilus influenzae Rd
ugaaugaucgaguaaaa

SEQ ID NO: 717597 - RNA, 15 nt, Haemophilus influenzae Rd
ugaaugaugaguaga

SEQ ID NO: 717598 - RNA, 22 nt, Haemophilus influenzae Rd
ugaauggcgucugcaauuagaa

SEQ ID NO: 717599 - RNA, 16 nt, Haemophilus influenzae Rd
ugaauggcuaucugcu

SEQ ID NO: 717600 - RNA, 20 nt, Haemophilus influenzae Rd
ugaauggcuaucugcuuuuc

SEQ ID NO: 717601 - RNA, 17 nt, Haemophilus influenzae Rd
ugaauggcgaauuucac

SEQ ID NO: 717602 - RNA, 16 nt, Haemophilus influenzae Rd
ugaauggauuauaaau

SEQ ID NO: 717603 - RNA, 18 nt, Haemophilus influenzae Rd
ugaaugcgagcaucggua

SEQ ID NO: 717604 - RNA, 19 nt, Haemophilus influenzae Rd
ugaaugcauuggcugaauu

SEQ ID NO: 717605 - RNA, 22 nt, Haemophilus influenzae Rd
ugaaugcauuggcugaauuuaa

SEQ ID NO: 717606 - RNA, 19 nt, Haemophilus influenzae Rd
ugaaugccauucucccuga

SEQ ID NO: 717607 - RNA, 15 nt, Haemophilus influenzae Rd
ugaauccaaugcacu

SEQ ID NO: 717608 - RNA, 21 nt, Haemophilus influenzae Rd
ugaaucaauuagaugacuggc

SEQ ID NO: 717609 - RNA, 19 nt, Haemophilus influenzae Rd
ugaauauugguuuuauuca

SEQ ID NO: 717610 - RNA, 22 nt, Haemophilus influenzae Rd
ugaauauuugggaaauggcuuu

SEQ ID NO: 717611 - RNA, 18 nt, Haemophilus influenzae Rd
ugaaucguuuguaaaagu

SEQ ID NO: 717612 - RNA, 16 nt, Haemophilus influenzae Rd
ugaaucguuuguucug

SEQ ID NO: 717613 - RNA, 22 nt, Haemophilus influenzae Rd
ugaaucgaggcgauaagcaauu

SEQ ID NO: 717614 - RNA, 22 nt, Haemophilus influenzae Rd
ugaaucuaaucgggcuuuauca

SEQ ID NO: 717615 - RNA, 17 nt, Haemophilus influenzae Rd
ugaaucucacguacuuu

SEQ ID NO: 717616 - RNA, 19 nt, Haemophilus influenzae Rd
ugaaucucauaccaaggca

SEQ ID NO: 717617 - RNA, 21 nt, Haemophilus influenzae Rd
ugacaauaacugcgccaauau

SEQ ID NO: 717618 - RNA, 13 nt, Haemophilus influenzae Rd
ugacaagcaaccu

SEQ ID NO: 717619 - RNA, 18 nt, Haemophilus influenzae Rd
ugacaaaucugccugauu

SEQ ID NO: 717620 - RNA, 23 nt, Haemophilus influenzae Rd
ugacaacgcucacuuaauugacg

SEQ ID NO: 717621 - RNA, 15 nt, Haemophilus influenzae Rd
ugacaaacggaaaau

SEQ ID NO: 717622 - RNA, 23 nt, Haemophilus influenzae Rd
ugacaaagucgguuuuuaauuca

SEQ ID NO: 717623 - RNA, 14 nt, Haemophilus influenzae Rd
ugaauuuuucuaag

SEQ ID NO: 717624 - RNA, 14 nt, Haemophilus influenzae Rd
ugacagauagcaua

SEQ ID NO: 717625 - RNA, 21 nt, Haemophilus influenzae Rd
ugacagauagcauaaguuaau

SEQ ID NO: 717626 - RNA, 20 nt, Haemophilus influenzae Rd
ugacagcaauauauaaaucc

SEQ ID NO: 717627 - RNA, 20 nt, Haemophilus influenzae Rd
ugacagaauuacguaauauu

SEQ ID NO: 717628 - RNA, 16 nt, Haemophilus influenzae Rd
ugacacccaaauuaaa

SEQ ID NO: 717629 - RNA, 16 nt, Haemophilus influenzae Rd
ugacaguuuaucucuu

SEQ ID NO: 717630 - RNA, 22 nt, Haemophilus influenzae Rd
ugacaguuuguaauccugcauu

SEQ ID NO: 717631 - RNA, 16 nt, Haemophilus influenzae Rd
ugacauauaauauuaa

SEQ ID NO: 717632 - RNA, 17 nt, Haemophilus influenzae Rd
ugacauauuuucuaaaa

SEQ ID NO: 717633 - RNA, 23 nt, Haemophilus influenzae Rd
ugaccgcuuguuuauuauuuccu

SEQ ID NO: 717634 - RNA, 18 nt, Haemophilus influenzae Rd
ugaccuguacuugcuuca

SEQ ID NO: 717635 - RNA, 19 nt, Haemophilus influenzae Rd
ugaccucguggcaaaagau

SEQ ID NO: 717636 - RNA, 14 nt, Haemophilus influenzae Rd
ugaaaccuaaacuu

SEQ ID NO: 717637 - RNA, 15 nt, Haemophilus influenzae Rd
ugaaaccaaauccuu

SEQ ID NO: 717638 - RNA, 17 nt, Haemophilus influenzae Rd
ugaaaccaaauccuuuu

SEQ ID NO: 717639 - RNA, 16 nt, Haemophilus influenzae Rd
ucuucgugcugaagag

SEQ ID NO: 717640 - RNA, 14 nt, Haemophilus influenzae Rd
ucuucgucaucauc

SEQ ID NO: 717641 - RNA, 15 nt, Haemophilus influenzae Rd
ucuucgucaucauca

SEQ ID NO: 717642 - RNA, 21 nt, Haemophilus influenzae Rd
ugaaacuugguguaauuugau

SEQ ID NO: 717643 - RNA, 17 nt, Haemophilus influenzae Rd
ugaaacuguuuuggcau

SEQ ID NO: 717644 - RNA, 17 nt, Haemophilus influenzae Rd
ugaaaccucccaaaaac

SEQ ID NO: 717645 - RNA, 14 nt, Haemophilus influenzae Rd
ugaaagaagaaaaa

SEQ ID NO: 717646 - RNA, 13 nt, Haemophilus influenzae Rd
ugaaagaaauuuu

SEQ ID NO: 717647 - RNA, 20 nt, Haemophilus influenzae Rd
ugaaagaauaauccccuaaa

SEQ ID NO: 717648 - RNA, 17 nt, Haemophilus influenzae Rd
ugaaagggaaauuuauu

SEQ ID NO: 717649 - RNA, 23 nt, Haemophilus influenzae Rd
ugaaagacccaccgcaaaagcca

SEQ ID NO: 717650 - RNA, 15 nt, Haemophilus influenzae Rd
ugaaagacgaaucau

SEQ ID NO: 717651 - RNA, 22 nt, Haemophilus influenzae Rd
ugaaagucgauucaaauaacgc

SEQ ID NO: 717652 - RNA, 20 nt, Haemophilus influenzae Rd
ugaaaguauaauauagauga

SEQ ID NO: 717653 - RNA, 23 nt, Haemophilus influenzae Rd
ugaaauagacuacuuaaaauuca

SEQ ID NO: 717654 - RNA, 13 nt, Haemophilus influenzae Rd
ugaaauauagcuu

SEQ ID NO: 717655 - RNA, 20 nt, Haemophilus influenzae Rd
ugaaauaguuaaagaaaaua

SEQ ID NO: 717656 - RNA, 20 nt, Haemophilus influenzae Rd
ugaaccaaaucuaacauuuc

SEQ ID NO: 717657 - RNA, 23 nt, Haemophilus influenzae Rd
ugaaccaccgcaagcagaagaau

SEQ ID NO: 717658 - RNA, 23 nt, Haemophilus influenzae Rd
ugaacauuaugugcaauuugaca

SEQ ID NO: 717659 - RNA, 19 nt, Haemophilus influenzae Rd
ugaacaaugucagaaaaga

SEQ ID NO: 717660 - RNA, 13 nt, Haemophilus influenzae Rd
ugaacaagcaccc

SEQ ID NO: 717661 - RNA, 20 nt, Haemophilus influenzae Rd
ugaaaugcaagguuuauacc

SEQ ID NO: 717662 - RNA, 20 nt, Haemophilus influenzae Rd
ugaaauaugacuuauuaucu

SEQ ID NO: 717663 - RNA, 16 nt, Haemophilus influenzae Rd
ugaaauauugaucucc

SEQ ID NO: 717664 - RNA, 15 nt, Haemophilus influenzae Rd
ugaaauguagcacga

SEQ ID NO: 717665 - RNA, 19 nt, Haemophilus influenzae Rd
ugaaaugcuugguuuuaua

SEQ ID NO: 717666 - RNA, 22 nt, Haemophilus influenzae Rd
ugaaauguuuuuuccauuuuuu

SEQ ID NO: 717667 - RNA, 21 nt, Haemophilus influenzae Rd
ugaaauuaauaagaaagaauc

SEQ ID NO: 717668 - RNA, 15 nt, Haemophilus influenzae Rd
ugaaauuaauaagcc

SEQ ID NO: 717669 - RNA, 17 nt, Haemophilus influenzae Rd
ugaaauuaauaagcccu

SEQ ID NO: 717670 - RNA, 17 nt, Haemophilus influenzae Rd
ugaaauuucuuuaauug

SEQ ID NO: 717671 - RNA, 15 nt, Haemophilus influenzae Rd
ugaaauuugaauaua

SEQ ID NO: 717672 - RNA, 22 nt, Haemophilus influenzae Rd
ugaaauuuuauaaaaaauuaau

SEQ ID NO: 717673 - RNA, 22 nt, Haemophilus influenzae Rd
ugaaauuuuucaucuuuuuaua

SEQ ID NO: 717674 - RNA, 15 nt, Haemophilus influenzae Rd
ugaaauuuccugaga

SEQ ID NO: 717675 - RNA, 13 nt, Haemophilus influenzae Rd
ugaaauuuauuau

SEQ ID NO: 717676 - RNA, 19 nt, Haemophilus influenzae Rd
ugaaauugaggauuugccu

SEQ ID NO: 717677 - RNA, 16 nt, Haemophilus influenzae Rd
ugaaauucuaaaaaaa

SEQ ID NO: 717678 - RNA, 16 nt, Haemophilus influenzae Rd
ugaaauuagacaaaaa

SEQ ID NO: 717679 - RNA, 23 nt, Haemophilus influenzae Rd
ugaaauuagguuauuuuuucaau

SEQ ID NO: 717680 - RNA, 12 nt, Haemophilus influenzae Rd
ugaacuuucaau

SEQ ID NO: 717681 - RNA, 15 nt, Haemophilus influenzae Rd
ugaacuuucaauaau

SEQ ID NO: 717682 - RNA, 13 nt, Haemophilus influenzae Rd
ugaacgcaaauac

SEQ ID NO: 717683 - RNA, 22 nt, Haemophilus influenzae Rd
ugaaccauaaacaauauaacca

SEQ ID NO: 717684 - RNA, 15 nt, Haemophilus influenzae Rd
ugaacgaguaaauua

SEQ ID NO: 717685 - RNA, 21 nt, Haemophilus influenzae Rd
ugaacgaguaaauuaauuuag

SEQ ID NO: 717686 - RNA, 22 nt, Haemophilus influenzae Rd
ugaacuuuuaacugcuuuaaua

SEQ ID NO: 717687 - RNA, 13 nt, Haemophilus influenzae Rd
ugaagaaaauuuc

SEQ ID NO: 717688 - RNA, 14 nt, Haemophilus influenzae Rd
ugaagaaaauuucu

SEQ ID NO: 717689 - RNA, 17 nt, Haemophilus influenzae Rd
ugaagaaaauuucugcu

SEQ ID NO: 717690 - RNA, 19 nt, Haemophilus influenzae Rd
ugaagaaaauuucugcugc

SEQ ID NO: 717691 - RNA, 17 nt, Haemophilus influenzae Rd
ugaagaacguaaauuau

SEQ ID NO: 717692 - RNA, 16 nt, Haemophilus influenzae Rd
ugaagaguaaaacuaa

SEQ ID NO: 717693 - RNA, 22 nt, Haemophilus influenzae Rd
ugaagaguaaaacuaauuugca

SEQ ID NO: 717694 - RNA, 20 nt, Haemophilus influenzae Rd
ugaagcuccaguaagcauau

SEQ ID NO: 717695 - RNA, 17 nt, Haemophilus influenzae Rd
ugaagcuaaacuuuaga

SEQ ID NO: 717696 - RNA, 13 nt, Haemophilus influenzae Rd
ugaagauugaaau

SEQ ID NO: 717697 - RNA, 11 nt, Haemophilus influenzae Rd
ugaagccugac

SEQ ID NO: 717698 - RNA, 14 nt, Haemophilus influenzae Rd
ugaagauuaaaugu

SEQ ID NO: 717699 - RNA, 15 nt, Haemophilus influenzae Rd
ugaagauuaaaugua

SEQ ID NO: 717700 - RNA, 15 nt, Haemophilus influenzae Rd
ugaagaguuaagccg

SEQ ID NO: 717701 - RNA, 16 nt, Haemophilus influenzae Rd
ugaagagaauuuucau

SEQ ID NO: 717702 - RNA, 21 nt, Haemophilus influenzae Rd
ugaagaugaagcuaagaaaau

SEQ ID NO: 717703 - RNA, 13 nt, Haemophilus influenzae Rd
ugaagaugauaua

SEQ ID NO: 717704 - RNA, 22 nt, Haemophilus influenzae Rd
ugaauaugaucuuuaauuaaaa

SEQ ID NO: 717705 - RNA, 14 nt, Haemophilus influenzae Rd
ugaauaucugucau

SEQ ID NO: 717706 - RNA, 16 nt, Haemophilus influenzae Rd
ugaauaucuaacauaa

SEQ ID NO: 717707 - RNA, 21 nt, Haemophilus influenzae Rd
ugaauauaagaaaucucuuuc

SEQ ID NO: 717708 - RNA, 14 nt, Haemophilus influenzae Rd
ugaauauaauaaaa

SEQ ID NO: 717709 - RNA, 18 nt, Haemophilus influenzae Rd
ugaauaccugauuucgca

SEQ ID NO: 717710 - RNA, 14 nt, Haemophilus influenzae Rd
ugaaguaauaaucu

SEQ ID NO: 717711 - RNA, 12 nt, Haemophilus influenzae Rd
ugaaguaaauau

SEQ ID NO: 717712 - RNA, 13 nt, Haemophilus influenzae Rd
ugaaguaaauauu

SEQ ID NO: 717713 - RNA, 14 nt, Haemophilus influenzae Rd
ugaagguuucgcau

SEQ ID NO: 717714 - RNA, 14 nt, Haemophilus influenzae Rd
ugaaguaaaaaaau

SEQ ID NO: 717715 - RNA, 14 nt, Haemophilus influenzae Rd
ugaaguaaauauuu

SEQ ID NO: 717716 - RNA, 21 nt, Haemophilus influenzae Rd
ugaagugaaagauaaauuaca

SEQ ID NO: 717717 - RNA, 15 nt, Haemophilus influenzae Rd
ugaaguuagaaacag

SEQ ID NO: 717718 - RNA, 18 nt, Haemophilus influenzae Rd
ugaaguuauaguauauuu

SEQ ID NO: 717719 - RNA, 16 nt, Haemophilus influenzae Rd
ugaaguugccauagac

SEQ ID NO: 717720 - RNA, 16 nt, Haemophilus influenzae Rd
ugaaguuggagauuuu

SEQ ID NO: 717721 - RNA, 14 nt, Haemophilus influenzae Rd
ugaauacacuuuaa

SEQ ID NO: 717722 - RNA, 12 nt, Haemophilus influenzae Rd
ugaauaauuuuu

SEQ ID NO: 717723 - RNA, 20 nt, Haemophilus influenzae Rd
ugaauaauucaaaacgguca

SEQ ID NO: 717724 - RNA, 20 nt, Haemophilus influenzae Rd
ucgcgauacuuggcguucau

SEQ ID NO: 717725 - RNA, 17 nt, Haemophilus influenzae Rd
ucgccuugcuuuuaaua

SEQ ID NO: 717726 - RNA, 22 nt, Haemophilus influenzae Rd
ucgccuuuuugaagguuaggga

SEQ ID NO: 717727 - RNA, 22 nt, Haemophilus influenzae Rd
ucgccuuaccgcauuuuuaauu

SEQ ID NO: 717728 - RNA, 18 nt, Haemophilus influenzae Rd
ucgcgccaccaucuacac

SEQ ID NO: 717729 - RNA, 22 nt, Haemophilus influenzae Rd
ucgccuaauucaauaucugcac

SEQ ID NO: 717730 - RNA, 13 nt, Haemophilus influenzae Rd
ucgccugacugcc

SEQ ID NO: 717731 - RNA, 14 nt, Haemophilus influenzae Rd
ucgccugccgcaua

SEQ ID NO: 717732 - RNA, 16 nt, Haemophilus influenzae Rd
ucgcccguauuuugca

SEQ ID NO: 717733 - RNA, 23 nt, Haemophilus influenzae Rd
ucgccauuuaagccuuuguagcc

SEQ ID NO: 717734 - RNA, 21 nt, Haemophilus influenzae Rd
ucgccauuuugaggaauaaau

SEQ ID NO: 717735 - RNA, 18 nt, Haemophilus influenzae Rd
ucgccauuuuuaaaaaua

SEQ ID NO: 717736 - RNA, 20 nt, Haemophilus influenzae Rd
ucgccgaguaaauucaccaa

SEQ ID NO: 717737 - RNA, 21 nt, Haemophilus influenzae Rd
ucgccgaguaaauucaccaau

SEQ ID NO: 717738 - RNA, 13 nt, Haemophilus influenzae Rd
ucgccagcaccac

SEQ ID NO: 717739 - RNA, 14 nt, Haemophilus influenzae Rd
ucgccagcaccacg

SEQ ID NO: 717740 - RNA, 15 nt, Haemophilus influenzae Rd
ucgccagcaccacgu

SEQ ID NO: 717741 - RNA, 20 nt, Haemophilus influenzae Rd
ucgccauaauaaaaauuaaa

SEQ ID NO: 717742 - RNA, 16 nt, Haemophilus influenzae Rd
ucgccaguuuagaaag

SEQ ID NO: 717743 - RNA, 21 nt, Haemophilus influenzae Rd
ucgccaaaucucaaaaucagc

SEQ ID NO: 717744 - RNA, 22 nt, Haemophilus influenzae Rd
ucgccaauagguugcaaaucga

SEQ ID NO: 717745 - RNA, 17 nt, Haemophilus influenzae Rd
ucgccaagaauaaaaug

SEQ ID NO: 717746 - RNA, 16 nt, Haemophilus influenzae Rd
uccauacccuugcuuc

SEQ ID NO: 717747 - RNA, 20 nt, Haemophilus influenzae Rd
uccauaccguuacgaacuuc

SEQ ID NO: 717748 - RNA, 15 nt, Haemophilus influenzae Rd
uccauaccaaaaugu

SEQ ID NO: 717749 - RNA, 16 nt, Haemophilus influenzae Rd
ucgcguagugugcgag

SEQ ID NO: 717750 - RNA, 13 nt, Haemophilus influenzae Rd
ucgcgugauuuag

SEQ ID NO: 717751 - RNA, 15 nt, Haemophilus influenzae Rd
ucgcuacguuagaga

SEQ ID NO: 717752 - RNA, 12 nt, Haemophilus influenzae Rd
ucgcuauuuuga

SEQ ID NO: 717753 - RNA, 16 nt, Haemophilus influenzae Rd
ucgcuauguuuaaaua

SEQ ID NO: 717754 - RNA, 12 nt, Haemophilus influenzae Rd
ucgcuacauuuc

SEQ ID NO: 717755 - RNA, 16 nt, Haemophilus influenzae Rd
ucgcuaauuuuuuucc

SEQ ID NO: 717756 - RNA, 20 nt, Haemophilus influenzae Rd
ucgcuaauuuuuuuucuaau

SEQ ID NO: 717757 - RNA, 15 nt, Haemophilus influenzae Rd
ucgcuaagaauaaag

SEQ ID NO: 717758 - RNA, 21 nt, Haemophilus influenzae Rd
ucgcucuaacaauauuucacu

SEQ ID NO: 717759 - RNA, 16 nt, Haemophilus influenzae Rd
ucgcucaauaauuuuc

SEQ ID NO: 717760 - RNA, 19 nt, Haemophilus influenzae Rd
ucgcucaucguaucaauuu

SEQ ID NO: 717761 - RNA, 16 nt, Haemophilus influenzae Rd
ucgcuccaaucaucau

SEQ ID NO: 717762 - RNA, 18 nt, Haemophilus influenzae Rd
ucgcuccaaucaucaucc

SEQ ID NO: 717763 - RNA, 19 nt, Haemophilus influenzae Rd
ucgcucuucagcuucuuca

SEQ ID NO: 717764 - RNA, 20 nt, Haemophilus influenzae Rd
ucgcucuaguuuuaagguug

SEQ ID NO: 717765 - RNA, 16 nt, Haemophilus influenzae Rd
ucgcugcgaugugacc

SEQ ID NO: 717766 - RNA, 17 nt, Haemophilus influenzae Rd
ucgcugggauuuuguca

SEQ ID NO: 717767 - RNA, 14 nt, Haemophilus influenzae Rd
ucgcuggaaucaau

SEQ ID NO: 717768 - RNA, 18 nt, Haemophilus influenzae Rd
ucgcuuaagucagcauaa

SEQ ID NO: 717769 - RNA, 17 nt, Haemophilus influenzae Rd
ucgcuucauuauauucc

SEQ ID NO: 717770 - RNA, 18 nt, Haemophilus influenzae Rd
ucgcuucauucucuucug

SEQ ID NO: 717771 - RNA, 20 nt, Haemophilus influenzae Rd
ucgcuuauacgaguaaaaaa

SEQ ID NO: 717772 - RNA, 16 nt, Haemophilus influenzae Rd
ucgcuuacaaaauaua

SEQ ID NO: 717773 - RNA, 14 nt, Haemophilus influenzae Rd
ucgcuucaucaucg

SEQ ID NO: 717774 - RNA, 21 nt, Haemophilus influenzae Rd
ucgcuucaucaucgcccgcuu

SEQ ID NO: 717775 - RNA, 12 nt, Haemophilus influenzae Rd
ucgcuucuuuua

SEQ ID NO: 717776 - RNA, 16 nt, Haemophilus influenzae Rd
ucgcuucugcuuggua

SEQ ID NO: 717777 - RNA, 21 nt, Haemophilus influenzae Rd
ucgcuucugcuugguaauaau

SEQ ID NO: 717778 - RNA, 19 nt, Haemophilus influenzae Rd
ucgcuuuauacugcucuug

SEQ ID NO: 717779 - RNA, 12 nt, Haemophilus influenzae Rd
ucgcuuuuuccu

SEQ ID NO: 717780 - RNA, 13 nt, Haemophilus influenzae Rd
ucgcuuuuuccuc

SEQ ID NO: 717781 - RNA, 14 nt, Haemophilus influenzae Rd
ucggaaaauaauau

SEQ ID NO: 717782 - RNA, 16 nt, Haemophilus influenzae Rd
ucggaaaauaauauug

SEQ ID NO: 717783 - RNA, 16 nt, Haemophilus influenzae Rd
ucggagcauuuuggua

SEQ ID NO: 717784 - RNA, 20 nt, Haemophilus influenzae Rd
ucggaaugccgccucagcaa

SEQ ID NO: 717785 - RNA, 20 nt, Haemophilus influenzae Rd
ucggaacgccuaaacacaua

SEQ ID NO: 717786 - RNA, 19 nt, Haemophilus influenzae Rd
ucggcaguacucgaaaagg

SEQ ID NO: 717787 - RNA, 14 nt, Haemophilus influenzae Rd
ucggcaauguuuua

SEQ ID NO: 717788 - RNA, 18 nt, Haemophilus influenzae Rd
ucggauaauaauuuuucc

SEQ ID NO: 717789 - RNA, 21 nt, Haemophilus influenzae Rd
ucggaugacggaauacaucac

SEQ ID NO: 717790 - RNA, 21 nt, Haemophilus influenzae Rd
ucggauuucuuuauucugaaa

SEQ ID NO: 717791 - RNA, 13 nt, Haemophilus influenzae Rd
ucggauuuuucaa

SEQ ID NO: 717792 - RNA, 21 nt, Haemophilus influenzae Rd
ucgguauucauaucaaugcca

SEQ ID NO: 717793 - RNA, 14 nt, Haemophilus influenzae Rd
ucgguaaaaaucau

SEQ ID NO: 717794 - RNA, 17 nt, Haemophilus influenzae Rd
ucgggcaaacgcucuuu

SEQ ID NO: 717795 - RNA, 19 nt, Haemophilus influenzae Rd
ucggggcauuggcaagcau

SEQ ID NO: 717796 - RNA, 13 nt, Haemophilus influenzae Rd
ucgguuuuuucau

SEQ ID NO: 717797 - RNA, 22 nt, Haemophilus influenzae Rd
ucgguguucugcaucaauaauu

SEQ ID NO: 717798 - RNA, 15 nt, Haemophilus influenzae Rd
ucgguuucaugauug

SEQ ID NO: 717799 - RNA, 17 nt, Haemophilus influenzae Rd
ucggugaagacaucaua

SEQ ID NO: 717800 - RNA, 13 nt, Haemophilus influenzae Rd
ucggcuuuuucaa

SEQ ID NO: 717801 - RNA, 20 nt, Haemophilus influenzae Rd
ucgggauaaggcagaaauga

SEQ ID NO: 717802 - RNA, 21 nt, Haemophilus influenzae Rd
ucgggauaaggcagaaaugaa

SEQ ID NO: 717803 - RNA, 20 nt, Haemophilus influenzae Rd
ucggcuacuauacacaucag

SEQ ID NO: 717804 - RNA, 13 nt, Haemophilus influenzae Rd
ucgucaucaucaa

SEQ ID NO: 717805 - RNA, 14 nt, Haemophilus influenzae Rd
ucgucaucuucauu

SEQ ID NO: 717806 - RNA, 15 nt, Haemophilus influenzae Rd
ucgucaaaaaugucg

SEQ ID NO: 717807 - RNA, 20 nt, Haemophilus influenzae Rd
ucgucaaaggaacagacagu

SEQ ID NO: 717808 - RNA, 21 nt, Haemophilus influenzae Rd
ucguauuuuugucccaaaaua

SEQ ID NO: 717809 - RNA, 17 nt, Haemophilus influenzae Rd
ucguauucccaaauuuu

SEQ ID NO: 717810 - RNA, 19 nt, Haemophilus influenzae Rd
ucguauucccaaauuuuuu

SEQ ID NO: 717811 - RNA, 19 nt, Haemophilus influenzae Rd
ucguauucucauuuuagac

SEQ ID NO: 717812 - RNA, 13 nt, Haemophilus influenzae Rd
ucguauaagcccc

SEQ ID NO: 717813 - RNA, 14 nt, Haemophilus influenzae Rd
ucguauaaauauuu

SEQ ID NO: 717814 - RNA, 17 nt, Haemophilus influenzae Rd
ucguagaguuuuuucac

SEQ ID NO: 717815 - RNA, 13 nt, Haemophilus influenzae Rd
ucguagaaauaag

SEQ ID NO: 717816 - RNA, 20 nt, Haemophilus influenzae Rd
ucguagaaaucaaaaaugcu

SEQ ID NO: 717817 - RNA, 20 nt, Haemophilus influenzae Rd
ucguacaaaugaaaagggcg

SEQ ID NO: 717818 - RNA, 17 nt, Haemophilus influenzae Rd
ucguacaucgaaaacau

SEQ ID NO: 717819 - RNA, 18 nt, Haemophilus influenzae Rd
ucguacaucgaaaacaua

SEQ ID NO: 717820 - RNA, 15 nt, Haemophilus influenzae Rd
ucguaauuuuaaaac

SEQ ID NO: 717821 - RNA, 19 nt, Haemophilus influenzae Rd
ucguaauaacauucaguuu

SEQ ID NO: 717822 - RNA, 22 nt, Haemophilus influenzae Rd
ucguaaccgacucguccaucaa

SEQ ID NO: 717823 - RNA, 14 nt, Haemophilus influenzae Rd
ucgucuaaaucuuu

SEQ ID NO: 717824 - RNA, 18 nt, Haemophilus influenzae Rd
ucgucugcacgaauaauu

SEQ ID NO: 717825 - RNA, 14 nt, Haemophilus influenzae Rd
ucgugagcuuguug

SEQ ID NO: 717826 - RNA, 19 nt, Haemophilus influenzae Rd
ucgugaccaaguucacaaa

SEQ ID NO: 717827 - RNA, 14 nt, Haemophilus influenzae Rd
ucgucuuugaagcc

SEQ ID NO: 717828 - RNA, 20 nt, Haemophilus influenzae Rd
ucgucuuaauuuuuuaaccg

SEQ ID NO: 717829 - RNA, 15 nt, Haemophilus influenzae Rd
ucgugaaagaauaau

SEQ ID NO: 717830 - RNA, 17 nt, Haemophilus influenzae Rd
ucgugaaagaauaaucc

SEQ ID NO: 717831 - RNA, 20 nt, Haemophilus influenzae Rd
ucgugcuuggauauucugca

SEQ ID NO: 717832 - RNA, 22 nt, Haemophilus influenzae Rd
ucgugcuguuuucaauuuuaaa

SEQ ID NO: 717833 - RNA, 21 nt, Haemophilus influenzae Rd
ucguguaaaaguuguuuugcu

SEQ ID NO: 717834 - RNA, 18 nt, Haemophilus influenzae Rd
ucguguauuuuuaucuaa

SEQ ID NO: 717835 - RNA, 15 nt, Haemophilus influenzae Rd
ucgugugaaauuacu

SEQ ID NO: 717836 - RNA, 18 nt, Haemophilus influenzae Rd
ucgugcaaauuuuuucaa

SEQ ID NO: 717837 - RNA, 16 nt, Haemophilus influenzae Rd
ucguuucaucgagaaa

SEQ ID NO: 717838 - RNA, 15 nt, Haemophilus influenzae Rd
ucguuuaaauuaaaa

SEQ ID NO: 717839 - RNA, 13 nt, Haemophilus influenzae Rd
ucguuuacaucac

SEQ ID NO: 717840 - RNA, 13 nt, Haemophilus influenzae Rd
ucguuguucuuua

SEQ ID NO: 717841 - RNA, 15 nt, Haemophilus influenzae Rd
ucguugaucagcaau

SEQ ID NO: 717842 - RNA, 16 nt, Haemophilus influenzae Rd
ucguugcaucuucuau

SEQ ID NO: 717843 - RNA, 14 nt, Haemophilus influenzae Rd
ucguucuugaugau

SEQ ID NO: 717844 - RNA, 19 nt, Haemophilus influenzae Rd
ucguucuuaccccaacaaa

SEQ ID NO: 717845 - RNA, 21 nt, Haemophilus influenzae Rd
ucguucuuaccccaacaaaca

SEQ ID NO: 717846 - RNA, 17 nt, Haemophilus influenzae Rd
ucguucguuauuuugau

SEQ ID NO: 717847 - RNA, 12 nt, Haemophilus influenzae Rd
ucguucuaaaau

SEQ ID NO: 717848 - RNA, 13 nt, Haemophilus influenzae Rd
ucguucuaaaaug

SEQ ID NO: 717849 - RNA, 19 nt, Haemophilus influenzae Rd
ucguuaaaccaaauaauga

SEQ ID NO: 717850 - RNA, 23 nt, Haemophilus influenzae Rd
ucguuaaacugccgccuucuucc

SEQ ID NO: 717851 - RNA, 15 nt, Haemophilus influenzae Rd
ucguguuuaguuuua

SEQ ID NO: 717852 - RNA, 19 nt, Haemophilus influenzae Rd
ucguguuuaguuuuauagu

SEQ ID NO: 717853 - RNA, 20 nt, Haemophilus influenzae Rd
ucguuaauuaauugcucuga

SEQ ID NO: 717854 - RNA, 19 nt, Haemophilus influenzae Rd
ucguuagcuuucauacgcg

SEQ ID NO: 717855 - RNA, 14 nt, Haemophilus influenzae Rd
ucguuauuaugaaa

SEQ ID NO: 717856 - RNA, 15 nt, Haemophilus influenzae Rd
ucguucccaaauauc

SEQ ID NO: 717857 - RNA, 20 nt, Haemophilus influenzae Rd
ucuccaagaauauuucacac

SEQ ID NO: 717858 - RNA, 17 nt, Haemophilus influenzae Rd
ucuccaaauauaaaaua

SEQ ID NO: 717859 - RNA, 14 nt, Haemophilus influenzae Rd
ucuccauaauauug

SEQ ID NO: 717860 - RNA, 16 nt, Haemophilus influenzae Rd
ucuccauuaagcacag

SEQ ID NO: 717861 - RNA, 17 nt, Haemophilus influenzae Rd
ucuccccuuguucuaaa

SEQ ID NO: 717862 - RNA, 19 nt, Haemophilus influenzae Rd
ucucccgaaaauuguucag

SEQ ID NO: 717863 - RNA, 16 nt, Haemophilus influenzae Rd
ucucccucaacccaua

SEQ ID NO: 717864 - RNA, 18 nt, Haemophilus influenzae Rd
ucucccuugcccaguuua

SEQ ID NO: 717865 - RNA, 15 nt, Haemophilus influenzae Rd
ucucgaguaucaaaa

SEQ ID NO: 717866 - RNA, 16 nt, Haemophilus influenzae Rd
ucucgaguaucaaaac

SEQ ID NO: 717867 - RNA, 20 nt, Haemophilus influenzae Rd
ucucgaguaucaaaacuugc

SEQ ID NO: 717868 - RNA, 18 nt, Haemophilus influenzae Rd
ucuccuugguuuucuugc

SEQ ID NO: 717869 - RNA, 13 nt, Haemophilus influenzae Rd
ucugauaauuuuu

SEQ ID NO: 717870 - RNA, 14 nt, Haemophilus influenzae Rd
ucugauaauuuuuc

SEQ ID NO: 717871 - RNA, 15 nt, Haemophilus influenzae Rd
ucugauaauuuuuca

SEQ ID NO: 717872 - RNA, 20 nt, Haemophilus influenzae Rd
ucugagcuuuucuuguaaug

SEQ ID NO: 717873 - RNA, 18 nt, Haemophilus influenzae Rd
ucugagguuuuauuacaa

SEQ ID NO: 717874 - RNA, 16 nt, Haemophilus influenzae Rd
ucugcaccccaaaagc

SEQ ID NO: 717875 - RNA, 17 nt, Haemophilus influenzae Rd
ucugcaccccaaaaguu

SEQ ID NO: 717876 - RNA, 17 nt, Haemophilus influenzae Rd
ucugcacgggaaaucca

SEQ ID NO: 717877 - RNA, 19 nt, Haemophilus influenzae Rd
ucugcacgggaaauccagc

SEQ ID NO: 717878 - RNA, 12 nt, Haemophilus influenzae Rd
ucugcagaaaaa

SEQ ID NO: 717879 - RNA, 18 nt, Haemophilus influenzae Rd
ucugcagaaaaauguuca

SEQ ID NO: 717880 - RNA, 17 nt, Haemophilus influenzae Rd
ucugaaaccacuaaaaa

SEQ ID NO: 717881 - RNA, 22 nt, Haemophilus influenzae Rd
ucugaaaaucaaaagaaauuaa

SEQ ID NO: 717882 - RNA, 15 nt, Haemophilus influenzae Rd
ucucuuguuuuucca

SEQ ID NO: 717883 - RNA, 13 nt, Haemophilus influenzae Rd
ucugacacuucuc

SEQ ID NO: 717884 - RNA, 20 nt, Haemophilus influenzae Rd
ucugacacccaaauuaaaaa

SEQ ID NO: 717885 - RNA, 14 nt, Haemophilus influenzae Rd
ucugacgcauugca

SEQ ID NO: 717886 - RNA, 16 nt, Haemophilus influenzae Rd
ucucuaaccuaaaaua

SEQ ID NO: 717887 - RNA, 19 nt, Haemophilus influenzae Rd
ucucuauucaucuaaaaaa

SEQ ID NO: 717888 - RNA, 21 nt, Haemophilus influenzae Rd
ucucuauucaucuaaaaaacu

SEQ ID NO: 717889 - RNA, 18 nt, Haemophilus influenzae Rd
ucucuauuaauuuuaaau

SEQ ID NO: 717890 - RNA, 14 nt, Haemophilus influenzae Rd
ucucucacgugaau

SEQ ID NO: 717891 - RNA, 17 nt, Haemophilus influenzae Rd
ucucuauugcuuuuacc

SEQ ID NO: 717892 - RNA, 14 nt, Haemophilus influenzae Rd
ucucucaaaaauca

SEQ ID NO: 717893 - RNA, 22 nt, Haemophilus influenzae Rd
ucucugcccauaagaaaauaga

SEQ ID NO: 717894 - RNA, 14 nt, Haemophilus influenzae Rd
ucucuucuaaaaau

SEQ ID NO: 717895 - RNA, 12 nt, Haemophilus influenzae Rd
aaaugcuuugac

SEQ ID NO: 717896 - RNA, 21 nt, Haemophilus influenzae Rd
aaauggaauggauguaaugag

SEQ ID NO: 717897 - RNA, 20 nt, Haemophilus influenzae Rd
aaauggaauguagauaauga

SEQ ID NO: 717898 - RNA, 22 nt, Haemophilus influenzae Rd
aaauggaauucuucuggcauau

SEQ ID NO: 717899 - RNA, 17 nt, Haemophilus influenzae Rd
aaauggacuaaauuuag

SEQ ID NO: 717900 - RNA, 14 nt, Haemophilus influenzae Rd
ucuuauauauaaaa

SEQ ID NO: 717901 - RNA, 22 nt, Haemophilus influenzae Rd
ucuuauauauaaaauauauaau

SEQ ID NO: 717902 - RNA, 12 nt, Haemophilus influenzae Rd
ucuuauaauuac

SEQ ID NO: 717903 - RNA, 13 nt, Haemophilus influenzae Rd
ucuuauaauuaca

SEQ ID NO: 717904 - RNA, 23 nt, Haemophilus influenzae Rd
ucuuauaauuacagaaucauuuu

SEQ ID NO: 717905 - RNA, 19 nt, Haemophilus influenzae Rd
ucuuauauucaaauuucau

SEQ ID NO: 717906 - RNA, 16 nt, Haemophilus influenzae Rd
ucuuauccguuacauu

SEQ ID NO: 717907 - RNA, 20 nt, Haemophilus influenzae Rd
ucuuauccguuacauuauuu

SEQ ID NO: 717908 - RNA, 16 nt, Haemophilus influenzae Rd
ucuuaguauuuuauuu

SEQ ID NO: 717909 - RNA, 18 nt, Haemophilus influenzae Rd
ucuuaccccaacaaacac

SEQ ID NO: 717910 - RNA, 18 nt, Haemophilus influenzae Rd
ucuuaccaaaaggucuua

SEQ ID NO: 717911 - RNA, 19 nt, Haemophilus influenzae Rd
ucuguuccugcauuauaac

SEQ ID NO: 717912 - RNA, 19 nt, Haemophilus influenzae Rd
ucuguuaaacgcauauuuu

SEQ ID NO: 717913 - RNA, 19 nt, Haemophilus influenzae Rd
ucuucgcuccaaucaucau

SEQ ID NO: 717914 - RNA, 16 nt, Haemophilus influenzae Rd
ucuucggauuuuucaa

SEQ ID NO: 717915 - RNA, 14 nt, Haemophilus influenzae Rd
ucuucccagaaugg

SEQ ID NO: 717916 - RNA, 19 nt, Haemophilus influenzae Rd
ucuucccaaccuaauuguu

SEQ ID NO: 717917 - RNA, 16 nt, Haemophilus influenzae Rd
ucuucacaaauaauau

SEQ ID NO: 717918 - RNA, 21 nt, Haemophilus influenzae Rd
ucuucaauuaccuuagccaaa

SEQ ID NO: 717919 - RNA, 22 nt, Haemophilus influenzae Rd
ucuuccaccgcuuugcuugccc

SEQ ID NO: 717920 - RNA, 22 nt, Haemophilus influenzae Rd
ucuucacugugccaacuucuac

SEQ ID NO: 717921 - RNA, 16 nt, Haemophilus influenzae Rd
ucuuccacaacaacca

SEQ ID NO: 717922 - RNA, 20 nt, Haemophilus influenzae Rd
ucuuccaauaauucuuuaau

SEQ ID NO: 717923 - RNA, 23 nt, Haemophilus influenzae Rd
ucugugacgccauccaaaacuaa

SEQ ID NO: 717924 - RNA, 18 nt, Haemophilus influenzae Rd
ucuguguuagaaagccuu

SEQ ID NO: 717925 - RNA, 14 nt, Haemophilus influenzae Rd
ucugugauauauau

SEQ ID NO: 717926 - RNA, 17 nt, Haemophilus influenzae Rd
ucugugauauauaucac

SEQ ID NO: 717927 - RNA, 23 nt, Haemophilus influenzae Rd
ucugugccuuaaagcugaauaaa

SEQ ID NO: 717928 - RNA, 18 nt, Haemophilus influenzae Rd
ucuguggcguauuuagaa

SEQ ID NO: 717929 - RNA, 19 nt, Haemophilus influenzae Rd
ucugucacgagcuaaaaaa

SEQ ID NO: 717930 - RNA, 13 nt, Haemophilus influenzae Rd
ucuguauuuuuca

SEQ ID NO: 717931 - RNA, 19 nt, Haemophilus influenzae Rd
ucuguauuuuucauaucuu

SEQ ID NO: 717932 - RNA, 16 nt, Haemophilus influenzae Rd
ucuguaucuuuagcuu

SEQ ID NO: 717933 - RNA, 22 nt, Haemophilus influenzae Rd
ucuguaugacuauuuagaaauu

SEQ ID NO: 717934 - RNA, 16 nt, Haemophilus influenzae Rd
ucuguauuaucuaauu

SEQ ID NO: 717935 - RNA, 23 nt, Haemophilus influenzae Rd
ucugucgcuuuuuccucagcaaa

SEQ ID NO: 717936 - RNA, 14 nt, Haemophilus influenzae Rd
ucugucauauaacc

SEQ ID NO: 717937 - RNA, 14 nt, Haemophilus influenzae Rd
ucuguaauugguau

SEQ ID NO: 717938 - RNA, 15 nt, Haemophilus influenzae Rd
ucuguaucaauuccu

SEQ ID NO: 717939 - RNA, 15 nt, Haemophilus influenzae Rd
ucuguauaccaacca

SEQ ID NO: 717940 - RNA, 16 nt, Haemophilus influenzae Rd
ucuguauaccaaccau

SEQ ID NO: 717941 - RNA, 15 nt, Haemophilus influenzae Rd
ucuguaaauaugccu

SEQ ID NO: 717942 - RNA, 21 nt, Haemophilus influenzae Rd
ucuguaagcagcuaacaaaau

SEQ ID NO: 717943 - RNA, 17 nt, Haemophilus influenzae Rd
ucuguaaacuaaaucuu

SEQ ID NO: 717944 - RNA, 21 nt, Haemophilus influenzae Rd
ucuguaaacuaaaucuugcuu

SEQ ID NO: 717945 - RNA, 17 nt, Haemophilus influenzae Rd
ucuguaaaacauuucau

SEQ ID NO: 717946 - RNA, 21 nt, Haemophilus influenzae Rd
ucuggcacaucaaauucuaaa

SEQ ID NO: 717947 - RNA, 12 nt, Haemophilus influenzae Rd
ucuggauuggau

SEQ ID NO: 717948 - RNA, 14 nt, Haemophilus influenzae Rd
ucugcaucaguauu

SEQ ID NO: 717949 - RNA, 18 nt, Haemophilus influenzae Rd
ucugcauaacuuaaauuu

SEQ ID NO: 717950 - RNA, 16 nt, Haemophilus influenzae Rd
ucugcauaaaauaauu

SEQ ID NO: 717951 - RNA, 22 nt, Haemophilus influenzae Rd
ucugcauaauguagagcucaau

SEQ ID NO: 717952 - RNA, 18 nt, Haemophilus influenzae Rd
ucugcauuugauuucaga

SEQ ID NO: 717953 - RNA, 23 nt, Haemophilus influenzae Rd
ucugcuuguucgcguuguucaau

SEQ ID NO: 717954 - RNA, 19 nt, Haemophilus influenzae Rd
ucugcuuuuucuugcucau

SEQ ID NO: 717955 - RNA, 22 nt, Haemophilus influenzae Rd
ucugcuuuuuuacugcuugguu

SEQ ID NO: 717956 - RNA, 20 nt, Haemophilus influenzae Rd
aaaugauguaggcaaaaaca

SEQ ID NO: 717957 - RNA, 23 nt, Haemophilus influenzae Rd
aaaugauuauccacuaaaaaacu

SEQ ID NO: 717958 - RNA, 14 nt, Haemophilus influenzae Rd
aaaugcaacaauaa

SEQ ID NO: 717959 - RNA, 20 nt, Haemophilus influenzae Rd
aaaugcaauaggauugccuu

SEQ ID NO: 717960 - RNA, 21 nt, Haemophilus influenzae Rd
aaaugcaauaggauugccuuc

SEQ ID NO: 717961 - RNA, 16 nt, Haemophilus influenzae Rd
aaaugcacauaacaaa

SEQ ID NO: 717962 - RNA, 18 nt, Haemophilus influenzae Rd
aaaugcacccgcuguaau

SEQ ID NO: 717963 - RNA, 21 nt, Haemophilus influenzae Rd
aaaugcagauccuuucacaaa

SEQ ID NO: 717964 - RNA, 19 nt, Haemophilus influenzae Rd
aaaugcaggggcuuuuaau

SEQ ID NO: 717965 - RNA, 21 nt, Haemophilus influenzae Rd
ucuagcuuaacaacaaaguca

SEQ ID NO: 717966 - RNA, 23 nt, Haemophilus influenzae Rd
ucuagcuuaccuuaauuaaucuu

SEQ ID NO: 717967 - RNA, 12 nt, Haemophilus influenzae Rd
ucuaguucuucc

SEQ ID NO: 717968 - RNA, 18 nt, Haemophilus influenzae Rd
aaaugaugauaauuuuua

SEQ ID NO: 717969 - RNA, 19 nt, Haemophilus influenzae Rd
ucuaguaccugauuuguaa

SEQ ID NO: 717970 - RNA, 19 nt, Haemophilus influenzae Rd
ucuaguaaaacuaauacuu

SEQ ID NO: 717971 - RNA, 17 nt, Haemophilus influenzae Rd
aaaugaucaaaucaaau

SEQ ID NO: 717972 - RNA, 17 nt, Haemophilus influenzae Rd
ucuagacaaaaccugca

SEQ ID NO: 717973 - RNA, 14 nt, Haemophilus influenzae Rd
aaaugaucuaaugg

SEQ ID NO: 717974 - RNA, 13 nt, Haemophilus influenzae Rd
ucuagcacaaaga

SEQ ID NO: 717975 - RNA, 19 nt, Haemophilus influenzae Rd
ucuagagauuguaugaaaa

SEQ ID NO: 717976 - RNA, 16 nt, Haemophilus influenzae Rd
ucuaucuaaaauauaa

SEQ ID NO: 717977 - RNA, 18 nt, Haemophilus influenzae Rd
ucuaucgcauuuuacaga

SEQ ID NO: 717978 - RNA, 22 nt, Haemophilus influenzae Rd
ucuaucccaacagaaaauuuga

SEQ ID NO: 717979 - RNA, 17 nt, Haemophilus influenzae Rd
ucuauauucguuaaaua

SEQ ID NO: 717980 - RNA, 21 nt, Haemophilus influenzae Rd
ucuauauucguuaaauaaugc

SEQ ID NO: 717981 - RNA, 23 nt, Haemophilus influenzae Rd
ucuauaauuucgccauuuuuucc

SEQ ID NO: 717982 - RNA, 17 nt, Haemophilus influenzae Rd
ucuauaauuuuagaacu

SEQ ID NO: 717983 - RNA, 13 nt, Haemophilus influenzae Rd
ucuauacaaaauu

SEQ ID NO: 717984 - RNA, 15 nt, Haemophilus influenzae Rd
ucuauacaaaauugu

SEQ ID NO: 717985 - RNA, 16 nt, Haemophilus influenzae Rd
ucuauaucuguaaugc

SEQ ID NO: 717986 - RNA, 13 nt, Haemophilus influenzae Rd
ucuauaucagaaa

SEQ ID NO: 717987 - RNA, 15 nt, Haemophilus influenzae Rd
ucuauaucagaaaag

SEQ ID NO: 717988 - RNA, 13 nt, Haemophilus influenzae Rd
ucuauagauaaca

SEQ ID NO: 717989 - RNA, 16 nt, Haemophilus influenzae Rd
ucucaauugcaaaauc

SEQ ID NO: 717990 - RNA, 21 nt, Haemophilus influenzae Rd
ucucaaaaucagcaaauuguu

SEQ ID NO: 717991 - RNA, 13 nt, Haemophilus influenzae Rd
ucucaaauauuuu

SEQ ID NO: 717992 - RNA, 16 nt, Haemophilus influenzae Rd
ucucaaaugaaaugca

SEQ ID NO: 717993 - RNA, 15 nt, Haemophilus influenzae Rd
ucuauuuuauuaauu

SEQ ID NO: 717994 - RNA, 16 nt, Haemophilus influenzae Rd
ucuauuuuauuaauuu

SEQ ID NO: 717995 - RNA, 16 nt, Haemophilus influenzae Rd
ucuauuuuuucugcaa

SEQ ID NO: 717996 - RNA, 17 nt, Haemophilus influenzae Rd
ucuauuuuuucugcaaa

SEQ ID NO: 717997 - RNA, 22 nt, Haemophilus influenzae Rd
ucuauuuuuucugcaaagucuu

SEQ ID NO: 717998 - RNA, 16 nt, Haemophilus influenzae Rd
ucucaaaaaguuaaau

SEQ ID NO: 717999 - RNA, 14 nt, Haemophilus influenzae Rd
ucuauugauucuaa

SEQ ID NO: 718000 - RNA, 17 nt, Haemophilus influenzae Rd
ucuauugagauuuaauu

SEQ ID NO: 718001 - RNA, 22 nt, Haemophilus influenzae Rd
ucuauugagauuuaauuuauuu

SEQ ID NO: 718002 - RNA, 12 nt, Haemophilus influenzae Rd
ucuauuccuuuc

SEQ ID NO: 718003 - RNA, 15 nt, Haemophilus influenzae Rd
ucuauuauaaauuug

SEQ ID NO: 718004 - RNA, 14 nt, Haemophilus influenzae Rd
ucuauuaaaauauu

SEQ ID NO: 718005 - RNA, 15 nt, Haemophilus influenzae Rd
ucuauuaaaauauuu

SEQ ID NO: 718006 - RNA, 17 nt, Haemophilus influenzae Rd
ucuauuaaaaaaucauc

SEQ ID NO: 718007 - RNA, 15 nt, Haemophilus influenzae Rd
ucuauuucuuugagu

SEQ ID NO: 718008 - RNA, 18 nt, Haemophilus influenzae Rd
ucuauuugucggaaaaua

SEQ ID NO: 718009 - RNA, 14 nt, Haemophilus influenzae Rd
ucuauuugauuuaa

SEQ ID NO: 718010 - RNA, 19 nt, Haemophilus influenzae Rd
ucuauuguuuuuuucuaaa

SEQ ID NO: 718011 - RNA, 17 nt, Haemophilus influenzae Rd
ucuauugauauuaauuu

SEQ ID NO: 718012 - RNA, 23 nt, Haemophilus influenzae Rd
ucucaguaacgauguugcaaccu

SEQ ID NO: 718013 - RNA, 16 nt, Haemophilus influenzae Rd
ucucauaauagaaaac

SEQ ID NO: 718014 - RNA, 12 nt, Haemophilus influenzae Rd
ucucagcuuucu

SEQ ID NO: 718015 - RNA, 16 nt, Haemophilus influenzae Rd
ucucaggaaauuucaa

SEQ ID NO: 718016 - RNA, 18 nt, Haemophilus influenzae Rd
ucucaccgugccacgccc

SEQ ID NO: 718017 - RNA, 22 nt, Haemophilus influenzae Rd
aaaugcggcaaugguuaauaca

SEQ ID NO: 718018 - RNA, 22 nt, Haemophilus influenzae Rd
aaaugcgaucuaaaucauuuau

SEQ ID NO: 718019 - RNA, 14 nt, Haemophilus influenzae Rd
aaaugccuacuaaa

SEQ ID NO: 718020 - RNA, 22 nt, Haemophilus influenzae Rd
aaaugccuuuccguucauaaau

SEQ ID NO: 718021 - RNA, 23 nt, Haemophilus influenzae Rd
aaaugccgauaauagacauagaa

SEQ ID NO: 718022 - RNA, 13 nt, Haemophilus influenzae Rd
ucucacaauaauu

SEQ ID NO: 718023 - RNA, 15 nt, Haemophilus influenzae Rd
aaaucuucuaucuac

SEQ ID NO: 718024 - RNA, 21 nt, Haemophilus influenzae Rd
aaaucuucuugaaaccuccca

SEQ ID NO: 718025 - RNA, 15 nt, Haemophilus influenzae Rd
aaaucuugacauaau

SEQ ID NO: 718026 - RNA, 23 nt, Haemophilus influenzae Rd
ucuaacgcaaacuacaacuuuuu

SEQ ID NO: 718027 - RNA, 17 nt, Haemophilus influenzae Rd
ucuaacaauauuucacu

SEQ ID NO: 718028 - RNA, 15 nt, Haemophilus influenzae Rd
ucuaacguauuuaaa

SEQ ID NO: 718029 - RNA, 19 nt, Haemophilus influenzae Rd
ucuaagauacccauuucga

SEQ ID NO: 718030 - RNA, 15 nt, Haemophilus influenzae Rd
ucuaagccuaagcca

SEQ ID NO: 718031 - RNA, 17 nt, Haemophilus influenzae Rd
ucuaagccuaagccaaa

SEQ ID NO: 718032 - RNA, 15 nt, Haemophilus influenzae Rd
aaaugaacaaaaaau

SEQ ID NO: 718033 - RNA, 23 nt, Haemophilus influenzae Rd
ucuaaggcuuguuguucaaaauu

SEQ ID NO: 718034 - RNA, 16 nt, Haemophilus influenzae Rd
ucuaagguauaaauaa

SEQ ID NO: 718035 - RNA, 15 nt, Haemophilus influenzae Rd
ucuaagguuuuauuu

SEQ ID NO: 718036 - RNA, 22 nt, Haemophilus influenzae Rd
ucuaaguauucaugauguaauu

SEQ ID NO: 718037 - RNA, 19 nt, Haemophilus influenzae Rd
ucuaaguuuaagugguuuc

SEQ ID NO: 718038 - RNA, 12 nt, Haemophilus influenzae Rd
ucuaauaagaag

SEQ ID NO: 718039 - RNA, 23 nt, Haemophilus influenzae Rd
ucuaauaauaagauuuuuggcug

SEQ ID NO: 718040 - RNA, 20 nt, Haemophilus influenzae Rd
ucuaauaauccucuuuaaaa

SEQ ID NO: 718041 - RNA, 15 nt, Haemophilus influenzae Rd
aaaucuuuaccaaaa

SEQ ID NO: 718042 - RNA, 18 nt, Haemophilus influenzae Rd
aaaucuuuaccaaaaaau

SEQ ID NO: 718043 - RNA, 19 nt, Haemophilus influenzae Rd
aaaucuuuugaaagauuuu

SEQ ID NO: 718044 - RNA, 22 nt, Haemophilus influenzae Rd
aaaucuuuugaaagauuuucua

SEQ ID NO: 718045 - RNA, 18 nt, Haemophilus influenzae Rd
aaaugaaaccaaauccuu

SEQ ID NO: 718046 - RNA, 18 nt, Haemophilus influenzae Rd
aaaugaaaacuaugcucu

SEQ ID NO: 718047 - RNA, 20 nt, Haemophilus influenzae Rd
ucuaaaaaaucaaucaggcu

SEQ ID NO: 718048 - RNA, 15 nt, Haemophilus influenzae Rd
ucuaaaaaagaguaa

SEQ ID NO: 718049 - RNA, 20 nt, Haemophilus influenzae Rd
ucuaaaaaagaguaaauauu

SEQ ID NO: 718050 - RNA, 23 nt, Haemophilus influenzae Rd
ucuaaaaaagaguaaauauuguc

SEQ ID NO: 718051 - RNA, 15 nt, Haemophilus influenzae Rd
ucuaaaaaaaucacc

SEQ ID NO: 718052 - RNA, 19 nt, Haemophilus influenzae Rd
ucuaaaaaaccaccagaaa

SEQ ID NO: 718053 - RNA, 13 nt, Haemophilus influenzae Rd
ucuaaaaaacccg

SEQ ID NO: 718054 - RNA, 13 nt, Haemophilus influenzae Rd
ucguuuguucuga

SEQ ID NO: 718055 - RNA, 13 nt, Haemophilus influenzae Rd
ucuaaaauuauag

SEQ ID NO: 718056 - RNA, 16 nt, Haemophilus influenzae Rd
ucuaaacgaugugcau

SEQ ID NO: 718057 - RNA, 18 nt, Haemophilus influenzae Rd
ucuaaaccuuguaaagca

SEQ ID NO: 718058 - RNA, 22 nt, Haemophilus influenzae Rd
ucuaaaaguuugauuaacuuuc

SEQ ID NO: 718059 - RNA, 17 nt, Haemophilus influenzae Rd
ucuaaaauaauaucaca

SEQ ID NO: 718060 - RNA, 21 nt, Haemophilus influenzae Rd
ucuaaaauauaacauuuauuu

SEQ ID NO: 718061 - RNA, 22 nt, Haemophilus influenzae Rd
ucuaaaaauaggcugaaaaaau

SEQ ID NO: 718062 - RNA, 19 nt, Haemophilus influenzae Rd
ucuaaaaauggcccugaaa

SEQ ID NO: 718063 - RNA, 12 nt, Haemophilus influenzae Rd
ucuaaaagcugu

SEQ ID NO: 718064 - RNA, 11 nt, Haemophilus influenzae Rd
ucuaaaaguaa

SEQ ID NO: 718065 - RNA, 14 nt, Haemophilus influenzae Rd
ucuaaaaccaauaa

SEQ ID NO: 718066 - RNA, 12 nt, Haemophilus influenzae Rd
ucuaaauuaauu

SEQ ID NO: 718067 - RNA, 13 nt, Haemophilus influenzae Rd
ucuaaauuaauuu

SEQ ID NO: 718068 - RNA, 23 nt, Haemophilus influenzae Rd
ucuaaauuaucguuuacuuaaaa

SEQ ID NO: 718069 - RNA, 23 nt, Haemophilus influenzae Rd
ucuaaauuauggguguuuaaauu

SEQ ID NO: 718070 - RNA, 14 nt, Haemophilus influenzae Rd
ucuaaauucucaag

SEQ ID NO: 718071 - RNA, 12 nt, Haemophilus influenzae Rd
ucuaaauauuuu

SEQ ID NO: 718072 - RNA, 16 nt, Haemophilus influenzae Rd
ucuaaaugugauuucc

SEQ ID NO: 718073 - RNA, 17 nt, Haemophilus influenzae Rd
ucuaaaugugcccagcg

SEQ ID NO: 718074 - RNA, 15 nt, Haemophilus influenzae Rd
ucuaaaugaauaaaa

SEQ ID NO: 718075 - RNA, 23 nt, Haemophilus influenzae Rd
ucuaaauuuuagcguuuagcuuu

SEQ ID NO: 718076 - RNA, 22 nt, Haemophilus influenzae Rd
ucuaacaaaugauuagaaguaa

SEQ ID NO: 718077 - RNA, 14 nt, Haemophilus influenzae Rd
ucuaacaucucuug

SEQ ID NO: 718078 - RNA, 18 nt, Haemophilus influenzae Rd
ucuaaaggcuaaauaacc

SEQ ID NO: 718079 - RNA, 22 nt, Haemophilus influenzae Rd
ucuaaaggcugagguucaaaac

SEQ ID NO: 718080 - RNA, 19 nt, Haemophilus influenzae Rd
ucuaaagugcgguuaauuu

SEQ ID NO: 718081 - RNA, 20 nt, Haemophilus influenzae Rd
ucuaaaguuggcacuucaau

SEQ ID NO: 718082 - RNA, 13 nt, Haemophilus influenzae Rd
ucuaaauaaaaac

SEQ ID NO: 718083 - RNA, 21 nt, Haemophilus influenzae Rd
ucuaaagcacguuucaucagc

SEQ ID NO: 718084 - RNA, 16 nt, Haemophilus influenzae Rd
ucuaaacuuauauuau

SEQ ID NO: 718085 - RNA, 22 nt, Haemophilus influenzae Rd
ucuacguaaggaucuuuuucuu

SEQ ID NO: 718086 - RNA, 13 nt, Haemophilus influenzae Rd
ucuacuaaaauaa

SEQ ID NO: 718087 - RNA, 22 nt, Haemophilus influenzae Rd
ucuacucguagaguuuuuucac

SEQ ID NO: 718088 - RNA, 16 nt, Haemophilus influenzae Rd
ucuacucguuuacuau

SEQ ID NO: 718089 - RNA, 17 nt, Haemophilus influenzae Rd
ucuacgacauuuuuaac

SEQ ID NO: 718090 - RNA, 15 nt, Haemophilus influenzae Rd
ucuacgccuaaugca

SEQ ID NO: 718091 - RNA, 17 nt, Haemophilus influenzae Rd
aaaugagauuauuucua

SEQ ID NO: 718092 - RNA, 20 nt, Haemophilus influenzae Rd
ucuacuuccgauuuuaauug

SEQ ID NO: 718093 - RNA, 14 nt, Haemophilus influenzae Rd
ucuacuuuauucaa

SEQ ID NO: 718094 - RNA, 19 nt, Haemophilus influenzae Rd
ucuacuuguguuuuagaaa

SEQ ID NO: 718095 - RNA, 14 nt, Haemophilus influenzae Rd
ucuacuuguucaaa

SEQ ID NO: 718096 - RNA, 18 nt, Haemophilus influenzae Rd
ucuacuuguucaaaaauu

SEQ ID NO: 718097 - RNA, 21 nt, Haemophilus influenzae Rd
ucuacuuguucaaaaauuucg

SEQ ID NO: 718098 - RNA, 22 nt, Haemophilus influenzae Rd
ucuacuuugcgccuguacugca

SEQ ID NO: 718099 - RNA, 14 nt, Haemophilus influenzae Rd
ucuacuguuaauuu

SEQ ID NO: 718100 - RNA, 16 nt, Haemophilus influenzae Rd
ucuaccaucuaaaguu

SEQ ID NO: 718101 - RNA, 17 nt, Haemophilus influenzae Rd
aaaugagaaaaauccug

SEQ ID NO: 718102 - RNA, 19 nt, Haemophilus influenzae Rd
ucuacccauucaaauggua

SEQ ID NO: 718103 - RNA, 15 nt, Haemophilus influenzae Rd
ucuaccgacugagcu

SEQ ID NO: 718104 - RNA, 14 nt, Haemophilus influenzae Rd
ucuaccgcacuuuu

SEQ ID NO: 718105 - RNA, 17 nt, Haemophilus influenzae Rd
ucuaccgcauuuuuaau

SEQ ID NO: 718106 - RNA, 14 nt, Haemophilus influenzae Rd
ucuacauuuuuagu

SEQ ID NO: 718107 - RNA, 15 nt, Haemophilus influenzae Rd
aaaugaaguuuuacu

SEQ ID NO: 718108 - RNA, 13 nt, Haemophilus influenzae Rd
aaaugaauaaaac

SEQ ID NO: 718109 - RNA, 21 nt, Haemophilus influenzae Rd
aaaugacagucgauuacaaaa

SEQ ID NO: 718110 - RNA, 24 nt, Haemophilus influenzae Rd
aaaugacauauaauauuaauccau

SEQ ID NO: 718111 - RNA, 21 nt, Haemophilus influenzae Rd
aaaugacaucauuaauaagcu

SEQ ID NO: 718112 - RNA, 15 nt, Haemophilus influenzae Rd
ucuaccaacugagcu

SEQ ID NO: 718113 - RNA, 21 nt, Haemophilus influenzae Rd
ucuacaucaguaccuuuaauu

SEQ ID NO: 718114 - RNA, 13 nt, Haemophilus influenzae Rd
ucuacaacgcuua

SEQ ID NO: 718115 - RNA, 15 nt, Haemophilus influenzae Rd
ucuaauuuuuuauuc

SEQ ID NO: 718116 - RNA, 19 nt, Haemophilus influenzae Rd
ucuaauuuuuuauucaaaa

SEQ ID NO: 718117 - RNA, 21 nt, Haemophilus influenzae Rd
ucuacaccucgauaaagaauu

SEQ ID NO: 718118 - RNA, 16 nt, Haemophilus influenzae Rd
ucuacaaucaaaaaau

SEQ ID NO: 718119 - RNA, 23 nt, Haemophilus influenzae Rd
ucuacacuuguacaguaauuguu

SEQ ID NO: 718120 - RNA, 22 nt, Haemophilus influenzae Rd
ucuaauuuuaccaagaaauaag

SEQ ID NO: 718121 - RNA, 19 nt, Haemophilus influenzae Rd
ucuaaugguuguaaauuuu

SEQ ID NO: 718122 - RNA, 14 nt, Haemophilus influenzae Rd
ucuaauguuaauuu

SEQ ID NO: 718123 - RNA, 18 nt, Haemophilus influenzae Rd
ucuaauguuaauuuuaaa

SEQ ID NO: 718124 - RNA, 15 nt, Haemophilus influenzae Rd
ucuaaugccuuuccu

SEQ ID NO: 718125 - RNA, 12 nt, Haemophilus influenzae Rd
ucuaaucccauu

SEQ ID NO: 718126 - RNA, 15 nt, Haemophilus influenzae Rd
ucuaaucuuaaaaaa

SEQ ID NO: 718127 - RNA, 17 nt, Haemophilus influenzae Rd
ucuaauacgucuaauuu

SEQ ID NO: 718128 - RNA, 23 nt, Haemophilus influenzae Rd
ucuaaugaaauuucuugcucuaa

SEQ ID NO: 718129 - RNA, 15 nt, Haemophilus influenzae Rd
ucuaauugauucaaa

SEQ ID NO: 718130 - RNA, 23 nt, Haemophilus influenzae Rd
ucuaauuggacaagaaauaauaa

SEQ ID NO: 718131 - RNA, 18 nt, Haemophilus influenzae Rd
ucuaauuugccaaguaca

SEQ ID NO: 718132 - RNA, 15 nt, Haemophilus influenzae Rd
ucuaauuugccauca

SEQ ID NO: 718133 - RNA, 17 nt, Haemophilus influenzae Rd
ucuaauuugcuuacauu

SEQ ID NO: 718134 - RNA, 14 nt, Haemophilus influenzae Rd
ucuaauucuugccc

SEQ ID NO: 718135 - RNA, 13 nt, Haemophilus influenzae Rd
ucuaauucugcac

SEQ ID NO: 718136 - RNA, 13 nt, Haemophilus influenzae Rd
ucuaauucuucca

SEQ ID NO: 718137 - RNA, 14 nt, Haemophilus influenzae Rd
ucuaauucuuccaa

SEQ ID NO: 718138 - RNA, 21 nt, Haemophilus influenzae Rd
ucuaauucuuccaaaaguugu

SEQ ID NO: 718139 - RNA, 22 nt, Haemophilus influenzae Rd
ucuaauucuuccaaaaguugug

SEQ ID NO: 718140 - RNA, 13 nt, Haemophilus influenzae Rd
ucuaauucuuccc

SEQ ID NO: 718141 - RNA, 18 nt, Haemophilus influenzae Rd
ucuaauuaacugaaaauu

SEQ ID NO: 718142 - RNA, 19 nt, Haemophilus influenzae Rd
ucuaauucagcaaaaagug

SEQ ID NO: 718143 - RNA, 15 nt, Haemophilus influenzae Rd
uauugcgccuuguug

SEQ ID NO: 718144 - RNA, 12 nt, Haemophilus influenzae Rd
uauugcucuccc

SEQ ID NO: 718145 - RNA, 15 nt, Haemophilus influenzae Rd
uauugcucucccuug

SEQ ID NO: 718146 - RNA, 18 nt, Haemophilus influenzae Rd
uauuguaguaauaaaaag

SEQ ID NO: 718147 - RNA, 15 nt, Haemophilus influenzae Rd
uauugguuauuuaaa

SEQ ID NO: 718148 - RNA, 23 nt, Haemophilus influenzae Rd
uauugcugucaaacgaaaaaaau

SEQ ID NO: 718149 - RNA, 18 nt, Haemophilus influenzae Rd
uauugugagauaugaaau

SEQ ID NO: 718150 - RNA, 22 nt, Haemophilus influenzae Rd
uauugugucacuagauuuucuu

SEQ ID NO: 718151 - RNA, 18 nt, Haemophilus influenzae Rd
uauuuaaaccauuuuaau

SEQ ID NO: 718152 - RNA, 19 nt, Haemophilus influenzae Rd
uauuuaaauacacuucuaa

SEQ ID NO: 718153 - RNA, 21 nt, Haemophilus influenzae Rd
uauuuaaauacacuucuaaaa

SEQ ID NO: 718154 - RNA, 17 nt, Haemophilus influenzae Rd
aaauccuucaggauaaa

SEQ ID NO: 718155 - RNA, 20 nt, Haemophilus influenzae Rd
aaauccuuguuuuucaaaaa

SEQ ID NO: 718156 - RNA, 20 nt, Haemophilus influenzae Rd
uauucuggcaauauuucaau

SEQ ID NO: 718157 - RNA, 11 nt, Haemophilus influenzae Rd
uauugaauaau

SEQ ID NO: 718158 - RNA, 17 nt, Haemophilus influenzae Rd
uauugccauaauaauca

SEQ ID NO: 718159 - RNA, 22 nt, Haemophilus influenzae Rd
uauugcccgugaguaaaauaua

SEQ ID NO: 718160 - RNA, 23 nt, Haemophilus influenzae Rd
uauugcccgugaguaaaauauag

SEQ ID NO: 718161 - RNA, 22 nt, Haemophilus influenzae Rd
uauugauucaaugcuuccuuca

SEQ ID NO: 718162 - RNA, 22 nt, Haemophilus influenzae Rd
uauugaucgccuaaauacauuu

SEQ ID NO: 718163 - RNA, 16 nt, Haemophilus influenzae Rd
uauugagauuuaauuu

SEQ ID NO: 718164 - RNA, 21 nt, Haemophilus influenzae Rd
uauuuaccgcuuucaauuaau

SEQ ID NO: 718165 - RNA, 17 nt, Haemophilus influenzae Rd
uauuuacgacuaaaauu

SEQ ID NO: 718166 - RNA, 12 nt, Haemophilus influenzae Rd
uauuuacuaaau

SEQ ID NO: 718167 - RNA, 18 nt, Haemophilus influenzae Rd
uauuuacucuuuuuuaga

SEQ ID NO: 718168 - RNA, 16 nt, Haemophilus influenzae Rd
uauuuacugauuuaaa

SEQ ID NO: 718169 - RNA, 18 nt, Haemophilus influenzae Rd
uauuuacugauuuaaaaa

SEQ ID NO: 718170 - RNA, 20 nt, Haemophilus influenzae Rd
uauuuacuuccuaaacuaca

SEQ ID NO: 718171 - RNA, 23 nt, Haemophilus influenzae Rd
uauuuacuuccuaaacuacaaca

SEQ ID NO: 718172 - RNA, 16 nt, Haemophilus influenzae Rd
uauuuacuuuauaaau

SEQ ID NO: 718173 - RNA, 22 nt, Haemophilus influenzae Rd
uauuuacuguuuuuauauuuag

SEQ ID NO: 718174 - RNA, 14 nt, Haemophilus influenzae Rd
uauuuagauauaaa

SEQ ID NO: 718175 - RNA, 20 nt, Haemophilus influenzae Rd
uauuuagaauuuuuauuuuu

SEQ ID NO: 718176 - RNA, 15 nt, Haemophilus influenzae Rd
uauuuagauuacuuu

SEQ ID NO: 718177 - RNA, 21 nt, Haemophilus influenzae Rd
uauuuauaacacagaugaaaa

SEQ ID NO: 718178 - RNA, 19 nt, Haemophilus influenzae Rd
uauuuauaauccauucagc

SEQ ID NO: 718179 - RNA, 23 nt, Haemophilus influenzae Rd
uauuuauagcauuuaaauauuau

SEQ ID NO: 718180 - RNA, 12 nt, Haemophilus influenzae Rd
uauuuauauaau

SEQ ID NO: 718181 - RNA, 22 nt, Haemophilus influenzae Rd
uauuuauauaauuuaacauaac

SEQ ID NO: 718182 - RNA, 22 nt, Haemophilus influenzae Rd
uauuucacuggcucauuauuca

SEQ ID NO: 718183 - RNA, 20 nt, Haemophilus influenzae Rd
uauuucacuucuaacuaaaa

SEQ ID NO: 718184 - RNA, 14 nt, Haemophilus influenzae Rd
uauuucaucuuuag

SEQ ID NO: 718185 - RNA, 20 nt, Haemophilus influenzae Rd
uauuucaguaacuuuaauaa

SEQ ID NO: 718186 - RNA, 17 nt, Haemophilus influenzae Rd
uauuucagcugcaauau

SEQ ID NO: 718187 - RNA, 11 nt, Haemophilus influenzae Rd
uauuucaauuu

SEQ ID NO: 718188 - RNA, 16 nt, Haemophilus influenzae Rd
uauuuauuuaauuucg

SEQ ID NO: 718189 - RNA, 20 nt, Haemophilus influenzae Rd
uauuuauuauucuugaguau

SEQ ID NO: 718190 - RNA, 13 nt, Haemophilus influenzae Rd
uauuuauauuuuu

SEQ ID NO: 718191 - RNA, 15 nt, Haemophilus influenzae Rd
uauuuauuuauugaa

SEQ ID NO: 718192 - RNA, 12 nt, Haemophilus influenzae Rd
uauuuauuucua

SEQ ID NO: 718193 - RNA, 16 nt, Haemophilus influenzae Rd
uauuuauuucuauaga

SEQ ID NO: 718194 - RNA, 19 nt, Haemophilus influenzae Rd
uauuuauuucuauagauuu

SEQ ID NO: 718195 - RNA, 12 nt, Haemophilus influenzae Rd
uauuuauuugcu

SEQ ID NO: 718196 - RNA, 15 nt, Haemophilus influenzae Rd
uauuuauuuugaauu

SEQ ID NO: 718197 - RNA, 12 nt, Haemophilus influenzae Rd
uauucggaaaaa

SEQ ID NO: 718198 - RNA, 20 nt, Haemophilus influenzae Rd
uauuccuuucuuuauuucau

SEQ ID NO: 718199 - RNA, 12 nt, Haemophilus influenzae Rd
uauucgccuuca

SEQ ID NO: 718200 - RNA, 21 nt, Haemophilus influenzae Rd
uauucuccuugguuuucuugc

SEQ ID NO: 718201 - RNA, 20 nt, Haemophilus influenzae Rd
uauucuccaaauauaaaaua

SEQ ID NO: 718202 - RNA, 23 nt, Haemophilus influenzae Rd
uauucuccaaauauaaaauaaaa

SEQ ID NO: 718203 - RNA, 20 nt, Haemophilus influenzae Rd
uauucucuauuaauuuuaaa

SEQ ID NO: 718204 - RNA, 16 nt, Haemophilus influenzae Rd
uauuccaaauaucuuc

SEQ ID NO: 718205 - RNA, 12 nt, Haemophilus influenzae Rd
uauuccaccaca

SEQ ID NO: 718206 - RNA, 15 nt, Haemophilus influenzae Rd
uauuccaaaaaauaa

SEQ ID NO: 718207 - RNA, 21 nt, Haemophilus influenzae Rd
uauuccuucaaucgcaucauu

SEQ ID NO: 718208 - RNA, 16 nt, Haemophilus influenzae Rd
uauuccuuacaacaaa

SEQ ID NO: 718209 - RNA, 19 nt, Haemophilus influenzae Rd
uauucgcaccuucagccac

SEQ ID NO: 718210 - RNA, 17 nt, Haemophilus influenzae Rd
uauucagugcuuuuuca

SEQ ID NO: 718211 - RNA, 23 nt, Haemophilus influenzae Rd
uauucauauccaaauugagaucu

SEQ ID NO: 718212 - RNA, 15 nt, Haemophilus influenzae Rd
uauucauaccgauaa

SEQ ID NO: 718213 - RNA, 19 nt, Haemophilus influenzae Rd
uauucaugaaucguuuuuu

SEQ ID NO: 718214 - RNA, 22 nt, Haemophilus influenzae Rd
uauucaugagcugggcaaacaa

SEQ ID NO: 718215 - RNA, 17 nt, Haemophilus influenzae Rd
uauucagcaaaaucacu

SEQ ID NO: 718216 - RNA, 20 nt, Haemophilus influenzae Rd
uauucagcaaccuaaauugu

SEQ ID NO: 718217 - RNA, 18 nt, Haemophilus influenzae Rd
uauucacucuuauucauu

SEQ ID NO: 718218 - RNA, 16 nt, Haemophilus influenzae Rd
uauuauuuauuuugaa

SEQ ID NO: 718219 - RNA, 19 nt, Haemophilus influenzae Rd
uauuauuggcuauugaaaa

SEQ ID NO: 718220 - RNA, 13 nt, Haemophilus influenzae Rd
uauuauugugaua

SEQ ID NO: 718221 - RNA, 14 nt, Haemophilus influenzae Rd
uauuacuuuccaua

SEQ ID NO: 718222 - RNA, 16 nt, Haemophilus influenzae Rd
uauuacuuuccauaau

SEQ ID NO: 718223 - RNA, 21 nt, Haemophilus influenzae Rd
uauuacuuuccauaauagaaa

SEQ ID NO: 718224 - RNA, 12 nt, Haemophilus influenzae Rd
uauuacuuucca

SEQ ID NO: 718225 - RNA, 15 nt, Haemophilus influenzae Rd
uauuagaaauauauu

SEQ ID NO: 718226 - RNA, 13 nt, Haemophilus influenzae Rd
uauuagaauauaa

SEQ ID NO: 718227 - RNA, 14 nt, Haemophilus influenzae Rd
uauuauauaaaaaa

SEQ ID NO: 718228 - RNA, 15 nt, Haemophilus influenzae Rd
uauuauauaaaaaac

SEQ ID NO: 718229 - RNA, 13 nt, Haemophilus influenzae Rd
uauuauuccuuuc

SEQ ID NO: 718230 - RNA, 17 nt, Haemophilus influenzae Rd
uauuaccugguugcaua

SEQ ID NO: 718231 - RNA, 21 nt, Haemophilus influenzae Rd
uauuacgauaguaaaaaauca

SEQ ID NO: 718232 - RNA, 13 nt, Haemophilus influenzae Rd
uauuaccuaacca

SEQ ID NO: 718233 - RNA, 16 nt, Haemophilus influenzae Rd
uauuaccuaaccaaag

SEQ ID NO: 718234 - RNA, 18 nt, Haemophilus influenzae Rd
uauccgagcucuuucauu

SEQ ID NO: 718235 - RNA, 17 nt, Haemophilus influenzae Rd
uauccauccagaaaauu

SEQ ID NO: 718236 - RNA, 22 nt, Haemophilus influenzae Rd
ucaaagaggagguagaaaaucg

SEQ ID NO: 718237 - RNA, 21 nt, Haemophilus influenzae Rd
ucaaaggcucuaccuaaaaua

SEQ ID NO: 718238 - RNA, 19 nt, Haemophilus influenzae Rd
ucaaagugcgguaaucuuu

SEQ ID NO: 718239 - RNA, 23 nt, Haemophilus influenzae Rd
ucaaagugcgguaaucuuucacu

SEQ ID NO: 718240 - RNA, 19 nt, Haemophilus influenzae Rd
ucaaagugcgguuaaauau

SEQ ID NO: 718241 - RNA, 20 nt, Haemophilus influenzae Rd
ucaaaguuccuagaauuaaa

SEQ ID NO: 718242 - RNA, 18 nt, Haemophilus influenzae Rd
ucaaauaacguuuuaagu

SEQ ID NO: 718243 - RNA, 12 nt, Haemophilus influenzae Rd
ucaaauaaauug

SEQ ID NO: 718244 - RNA, 12 nt, Haemophilus influenzae Rd
ucaaauaaaaua

SEQ ID NO: 718245 - RNA, 17 nt, Haemophilus influenzae Rd
ucaaauacaccaagcau

SEQ ID NO: 718246 - RNA, 15 nt, Haemophilus influenzae Rd
ucaaauaccucaauu

SEQ ID NO: 718247 - RNA, 23 nt, Haemophilus influenzae Rd
ucaaaucauuuuuugcaaacgca

SEQ ID NO: 718248 - RNA, 15 nt, Haemophilus influenzae Rd
ucaaacgcuguaaac

SEQ ID NO: 718249 - RNA, 16 nt, Haemophilus influenzae Rd
ucaaacgacuuaauuu

SEQ ID NO: 718250 - RNA, 14 nt, Haemophilus influenzae Rd
ucaaagaauugauc

SEQ ID NO: 718251 - RNA, 23 nt, Haemophilus influenzae Rd
ucaaagaaguagccgccuuuuuc

SEQ ID NO: 718252 - RNA, 18 nt, Haemophilus influenzae Rd
ucaaaaucaaguuaaaaa

SEQ ID NO: 718253 - RNA, 19 nt, Haemophilus influenzae Rd
ucaaaaucaaguuaaaaaa

SEQ ID NO: 718254 - RNA, 17 nt, Haemophilus influenzae Rd
ucaaaaguauaaacuuu

SEQ ID NO: 718255 - RNA, 17 nt, Haemophilus influenzae Rd
ucaaaauaaauaaaaua

SEQ ID NO: 718256 - RNA, 18 nt, Haemophilus influenzae Rd
ucaaaauaaauaaaauau

SEQ ID NO: 718257 - RNA, 15 nt, Haemophilus influenzae Rd
ucaaaauacucacaa

SEQ ID NO: 718258 - RNA, 19 nt, Haemophilus influenzae Rd
ucaaaauagcuuuuuaauu

SEQ ID NO: 718259 - RNA, 22 nt, Haemophilus influenzae Rd
ucaaaacaguuuucaaauuaac

SEQ ID NO: 718260 - RNA, 23 nt, Haemophilus influenzae Rd
ucaaaacauuaauugacaauuaa

SEQ ID NO: 718261 - RNA, 11 nt, Haemophilus influenzae Rd
ucaaaaccaaa

SEQ ID NO: 718262 - RNA, 21 nt, Haemophilus influenzae Rd
ucaaaacaauggcugaaaaau

SEQ ID NO: 718263 - RNA, 23 nt, Haemophilus influenzae Rd
ucaaaaauugauaccaagauaau

SEQ ID NO: 718264 - RNA, 16 nt, Haemophilus influenzae Rd
ucaaaaauaaaaagua

SEQ ID NO: 718265 - RNA, 11 nt, Haemophilus influenzae Rd
ucaaaaauauc

SEQ ID NO: 718266 - RNA, 12 nt, Haemophilus influenzae Rd
ucaaaaaugaaa

SEQ ID NO: 718267 - RNA, 23 nt, Haemophilus influenzae Rd
ucaaaaaugaaagggaaauaaca

SEQ ID NO: 718268 - RNA, 17 nt, Haemophilus influenzae Rd
ucaaaaaccgcuuuuau

SEQ ID NO: 718269 - RNA, 18 nt, Haemophilus influenzae Rd
ucaaaaacggauuuauuu

SEQ ID NO: 718270 - RNA, 19 nt, Haemophilus influenzae Rd
uauuuuuguggaaugccca

SEQ ID NO: 718271 - RNA, 21 nt, Haemophilus influenzae Rd
uauuuuuguggcgugagaucc

SEQ ID NO: 718272 - RNA, 21 nt, Haemophilus influenzae Rd
uauuuuuuauccuauuaauuu

SEQ ID NO: 718273 - RNA, 21 nt, Haemophilus influenzae Rd
uauuuuuuauuacauuaaaau

SEQ ID NO: 718274 - RNA, 22 nt, Haemophilus influenzae Rd
uauuuuuuauuacccuauucua

SEQ ID NO: 718275 - RNA, 22 nt, Haemophilus influenzae Rd
uauuuuuucagccuauuuuuag

SEQ ID NO: 718276 - RNA, 20 nt, Haemophilus influenzae Rd
uauuuuuucgaucuaaucca

SEQ ID NO: 718277 - RNA, 17 nt, Haemophilus influenzae Rd
uauuuuuccuuuucaua

SEQ ID NO: 718278 - RNA, 15 nt, Haemophilus influenzae Rd
uauuuuucuaaaucg

SEQ ID NO: 718279 - RNA, 19 nt, Haemophilus influenzae Rd
uauuuuuucugcaaagucu

SEQ ID NO: 718280 - RNA, 13 nt, Haemophilus influenzae Rd
uauuucuguuacu

SEQ ID NO: 718281 - RNA, 18 nt, Haemophilus influenzae Rd
uauuucugaagguuuucu

SEQ ID NO: 718282 - RNA, 19 nt, Haemophilus influenzae Rd
uauuucugaagguuuucuu

SEQ ID NO: 718283 - RNA, 21 nt, Haemophilus influenzae Rd
uauuucugcaaauaaagaaga

SEQ ID NO: 718284 - RNA, 19 nt, Haemophilus influenzae Rd
uauuucuguauuaucuaau

SEQ ID NO: 718285 - RNA, 24 nt, Haemophilus influenzae Rd
uauuucuguauuaucuaauuauuu

SEQ ID NO: 718286 - RNA, 16 nt, Haemophilus influenzae Rd
uauuucuucauuuuaa

SEQ ID NO: 718287 - RNA, 21 nt, Haemophilus influenzae Rd
uauuucuauuguuuuuuucua

SEQ ID NO: 718288 - RNA, 16 nt, Haemophilus influenzae Rd
uauuucucacuucuuu

SEQ ID NO: 718289 - RNA, 17 nt, Haemophilus influenzae Rd
uauuucucacuucuuua

SEQ ID NO: 718290 - RNA, 17 nt, Haemophilus influenzae Rd
uauuucguuguuuuaau

SEQ ID NO: 718291 - RNA, 14 nt, Haemophilus influenzae Rd
uauuucucuauaau

SEQ ID NO: 718292 - RNA, 17 nt, Haemophilus influenzae Rd
uauuucuaacaaaugau

SEQ ID NO: 718293 - RNA, 15 nt, Haemophilus influenzae Rd
uauuucuauagauuu

SEQ ID NO: 718294 - RNA, 22 nt, Haemophilus influenzae Rd
uauuucuauagauuuauuuacu

SEQ ID NO: 718295 - RNA, 14 nt, Haemophilus influenzae Rd
uauuucccucaaaa

SEQ ID NO: 718296 - RNA, 14 nt, Haemophilus influenzae Rd
uauuuccaucaaaa

SEQ ID NO: 718297 - RNA, 20 nt, Haemophilus influenzae Rd
uauuucgucuuaauuuuuua

SEQ ID NO: 718298 - RNA, 14 nt, Haemophilus influenzae Rd
uauuuccucuucuu

SEQ ID NO: 718299 - RNA, 21 nt, Haemophilus influenzae Rd
uauuucgcccuuauacaaaac

SEQ ID NO: 718300 - RNA, 19 nt, Haemophilus influenzae Rd
uauuugcaccuuguaacca

SEQ ID NO: 718301 - RNA, 18 nt, Haemophilus influenzae Rd
uauuugcgauaauuugca

SEQ ID NO: 718302 - RNA, 13 nt, Haemophilus influenzae Rd
uauuugcuaaaau

SEQ ID NO: 718303 - RNA, 24 nt, Haemophilus influenzae Rd
uauuugcuaguuuagguuuauguu

SEQ ID NO: 718304 - RNA, 17 nt, Haemophilus influenzae Rd
uauuuggaacaguaaau

SEQ ID NO: 718305 - RNA, 17 nt, Haemophilus influenzae Rd
uauuuggcauagaaaag

SEQ ID NO: 718306 - RNA, 11 nt, Haemophilus influenzae Rd
uauuuggcauu

SEQ ID NO: 718307 - RNA, 18 nt, Haemophilus influenzae Rd
uauuuggcugauauauua

SEQ ID NO: 718308 - RNA, 17 nt, Haemophilus influenzae Rd
uauuugaagcaagaaac

SEQ ID NO: 718309 - RNA, 15 nt, Haemophilus influenzae Rd
uauuucuuucguuca

SEQ ID NO: 718310 - RNA, 14 nt, Haemophilus influenzae Rd
uauuucuuuuugau

SEQ ID NO: 718311 - RNA, 16 nt, Haemophilus influenzae Rd
uauuugacuuaaauga

SEQ ID NO: 718312 - RNA, 21 nt, Haemophilus influenzae Rd
uauuugagcaagaugaauuaa

SEQ ID NO: 718313 - RNA, 16 nt, Haemophilus influenzae Rd
uauuugaguuauuuuu

SEQ ID NO: 718314 - RNA, 14 nt, Haemophilus influenzae Rd
uauuuuaaauaaaa

SEQ ID NO: 718315 - RNA, 16 nt, Haemophilus influenzae Rd
uauuuuaaauaaaaaa

SEQ ID NO: 718316 - RNA, 17 nt, Haemophilus influenzae Rd
uauuuuaaauaaauaau

SEQ ID NO: 718317 - RNA, 23 nt, Haemophilus influenzae Rd
uauuuguguaacagcucuguaaa

SEQ ID NO: 718318 - RNA, 15 nt, Haemophilus influenzae Rd
uauuuguuuuuuagg

SEQ ID NO: 718319 - RNA, 20 nt, Haemophilus influenzae Rd
uauuuguguggaaaaaugua

SEQ ID NO: 718320 - RNA, 18 nt, Haemophilus influenzae Rd
uauuuuaugaacucuguu

SEQ ID NO: 718321 - RNA, 13 nt, Haemophilus influenzae Rd
uauuuuauauauu

SEQ ID NO: 718322 - RNA, 22 nt, Haemophilus influenzae Rd
uauuuuaguuagauaagccauu

SEQ ID NO: 718323 - RNA, 17 nt, Haemophilus influenzae Rd
uauuuuauaauuaauaa

SEQ ID NO: 718324 - RNA, 17 nt, Haemophilus influenzae Rd
uauuuuauuuuguauau

SEQ ID NO: 718325 - RNA, 19 nt, Haemophilus influenzae Rd
uauuuuggcuaauaccauu

SEQ ID NO: 718326 - RNA, 15 nt, Haemophilus influenzae Rd
uauuuugguauuuuu

SEQ ID NO: 718327 - RNA, 11 nt, Haemophilus influenzae Rd
uauuuuuacuc

SEQ ID NO: 718328 - RNA, 14 nt, Haemophilus influenzae Rd
uauuuuuauaaauu

SEQ ID NO: 718329 - RNA, 13 nt, Haemophilus influenzae Rd
uauuuuuaaacaa

SEQ ID NO: 718330 - RNA, 19 nt, Haemophilus influenzae Rd
uauuuuguguauuaaguaa

SEQ ID NO: 718331 - RNA, 12 nt, Haemophilus influenzae Rd
uauuuugugauc

SEQ ID NO: 718332 - RNA, 20 nt, Haemophilus influenzae Rd
uauuuuccccuuguucuuca

SEQ ID NO: 718333 - RNA, 16 nt, Haemophilus influenzae Rd
uauuuuccccuuucca

SEQ ID NO: 718334 - RNA, 14 nt, Haemophilus influenzae Rd
uauuuucccaguaa

SEQ ID NO: 718335 - RNA, 13 nt, Haemophilus influenzae Rd
uauuuucuaaaaa

SEQ ID NO: 718336 - RNA, 14 nt, Haemophilus influenzae Rd
uauuuucuaaaaaa

SEQ ID NO: 718337 - RNA, 13 nt, Haemophilus influenzae Rd
uauuuucuaaagu

SEQ ID NO: 718338 - RNA, 18 nt, Haemophilus influenzae Rd
uauuuucuaaugaaauuu

SEQ ID NO: 718339 - RNA, 14 nt, Haemophilus influenzae Rd
uauuuucuaauuuu

SEQ ID NO: 718340 - RNA, 20 nt, Haemophilus influenzae Rd
uauuuucuuaauuuuauuaa

SEQ ID NO: 718341 - RNA, 15 nt, Haemophilus influenzae Rd
uauuuugaauaauaa

SEQ ID NO: 718342 - RNA, 17 nt, Haemophilus influenzae Rd
ucaacuggcuuaaauga

SEQ ID NO: 718343 - RNA, 15 nt, Haemophilus influenzae Rd
ucaacuuaaacaagc

SEQ ID NO: 718344 - RNA, 14 nt, Haemophilus influenzae Rd
ucaagaauauauuu

SEQ ID NO: 718345 - RNA, 13 nt, Haemophilus influenzae Rd
ucaagaauuccau

SEQ ID NO: 718346 - RNA, 15 nt, Haemophilus influenzae Rd
ucaagacaaauuugu

SEQ ID NO: 718347 - RNA, 18 nt, Haemophilus influenzae Rd
ucaagacugaauuuuaca

SEQ ID NO: 718348 - RNA, 19 nt, Haemophilus influenzae Rd
ucaacgguaacugauuuug

SEQ ID NO: 718349 - RNA, 19 nt, Haemophilus influenzae Rd
ucaaauccuuguuuuucaa

SEQ ID NO: 718350 - RNA, 20 nt, Haemophilus influenzae Rd
ucaaaucuaacguauuuaaa

SEQ ID NO: 718351 - RNA, 20 nt, Haemophilus influenzae Rd
ucaaaucuucagcaguuugg

SEQ ID NO: 718352 - RNA, 15 nt, Haemophilus influenzae Rd
ucaacgguuuucauu

SEQ ID NO: 718353 - RNA, 18 nt, Haemophilus influenzae Rd
ucaagcugugcaaaacua

SEQ ID NO: 718354 - RNA, 22 nt, Haemophilus influenzae Rd
ucaagcuuugcaacaaagugcg

SEQ ID NO: 718355 - RNA, 24 nt, Haemophilus influenzae Rd
ucaagcuuugcaacaaagugcggc

SEQ ID NO: 718356 - RNA, 14 nt, Haemophilus influenzae Rd
ucaagcugguuuuc

SEQ ID NO: 718357 - RNA, 19 nt, Haemophilus influenzae Rd
ucaaggccauauuuuccca

SEQ ID NO: 718358 - RNA, 16 nt, Haemophilus influenzae Rd
ucaaggaaaaaggcau

SEQ ID NO: 718359 - RNA, 12 nt, Haemophilus influenzae Rd
ucaaguaaaugc

SEQ ID NO: 718360 - RNA, 15 nt, Haemophilus influenzae Rd
ucaaguaacuuucac

SEQ ID NO: 718361 - RNA, 15 nt, Haemophilus influenzae Rd
ucaagguugcaacau

SEQ ID NO: 718362 - RNA, 19 nt, Haemophilus influenzae Rd
ucaaguaaugcuuuaaauu

SEQ ID NO: 718363 - RNA, 18 nt, Haemophilus influenzae Rd
ucaaguauucagugccua

SEQ ID NO: 718364 - RNA, 16 nt, Haemophilus influenzae Rd
ucaaggcuuuaauuuu

SEQ ID NO: 718365 - RNA, 18 nt, Haemophilus influenzae Rd
ucaaggcuuuaauuuuau

SEQ ID NO: 718366 - RNA, 15 nt, Haemophilus influenzae Rd
ucaagauuaaucuuu

SEQ ID NO: 718367 - RNA, 14 nt, Haemophilus influenzae Rd
ucaagcacaaucag

SEQ ID NO: 718368 - RNA, 13 nt, Haemophilus influenzae Rd
ucaagcacuuuau

SEQ ID NO: 718369 - RNA, 23 nt, Haemophilus influenzae Rd
ucaagcacuuuauuuaauucacg

SEQ ID NO: 718370 - RNA, 18 nt, Haemophilus influenzae Rd
ucaagcacuuuuccuuuu

SEQ ID NO: 718371 - RNA, 14 nt, Haemophilus influenzae Rd
ucaagauaccaaua

SEQ ID NO: 718372 - RNA, 19 nt, Haemophilus influenzae Rd
ucaagccuucuaaaauaag

SEQ ID NO: 718373 - RNA, 18 nt, Haemophilus influenzae Rd
ucaaucaagcauaaaucu

SEQ ID NO: 718374 - RNA, 23 nt, Haemophilus influenzae Rd
ucaagugugugaaaggcaagcuc

SEQ ID NO: 718375 - RNA, 19 nt, Haemophilus influenzae Rd
ucaauauugucuauuuuau

SEQ ID NO: 718376 - RNA, 21 nt, Haemophilus influenzae Rd
ucaauauugucuauuuuauuu

SEQ ID NO: 718377 - RNA, 13 nt, Haemophilus influenzae Rd
ucaaucaaauuca

SEQ ID NO: 718378 - RNA, 14 nt, Haemophilus influenzae Rd
ucaauccagaacga

SEQ ID NO: 718379 - RNA, 18 nt, Haemophilus influenzae Rd
ucaaguaauacuuuuuau

SEQ ID NO: 718380 - RNA, 16 nt, Haemophilus influenzae Rd
ucaagugauuauuucu

SEQ ID NO: 718381 - RNA, 18 nt, Haemophilus influenzae Rd
ucaaugcagaaauacuuu

SEQ ID NO: 718382 - RNA, 15 nt, Haemophilus influenzae Rd
ucaaugccaaaugcg

SEQ ID NO: 718383 - RNA, 18 nt, Haemophilus influenzae Rd
ucaaugccaaaugcggcc

SEQ ID NO: 718384 - RNA, 19 nt, Haemophilus influenzae Rd
ucaaucuuuacaacuggag

SEQ ID NO: 718385 - RNA, 13 nt, Haemophilus influenzae Rd
ucaaugcuuccuu

SEQ ID NO: 718386 - RNA, 12 nt, Haemophilus influenzae Rd
ucaaugcuuuuu

SEQ ID NO: 718387 - RNA, 19 nt, Haemophilus influenzae Rd
ucaauccccgcaucuuugg

SEQ ID NO: 718388 - RNA, 16 nt, Haemophilus influenzae Rd
ucaaucgcaucauuca

SEQ ID NO: 718389 - RNA, 12 nt, Haemophilus influenzae Rd
ucaaucucuuua

SEQ ID NO: 718390 - RNA, 17 nt, Haemophilus influenzae Rd
ucaaucuuuuuguuaau

SEQ ID NO: 718391 - RNA, 14 nt, Haemophilus influenzae Rd
ucacaauuuuuaac

SEQ ID NO: 718392 - RNA, 13 nt, Haemophilus influenzae Rd
ucacaaugauuaa

SEQ ID NO: 718393 - RNA, 17 nt, Haemophilus influenzae Rd
ucacaccauuuuuaauu

SEQ ID NO: 718394 - RNA, 16 nt, Haemophilus influenzae Rd
ucacaccgucuaaaaa

SEQ ID NO: 718395 - RNA, 17 nt, Haemophilus influenzae Rd
ucacaccgucuaaaaau

SEQ ID NO: 718396 - RNA, 18 nt, Haemophilus influenzae Rd
ucacaccgucuaaaaauc

SEQ ID NO: 718397 - RNA, 23 nt, Haemophilus influenzae Rd
ucacaaauugaccuuuuaaugcu

SEQ ID NO: 718398 - RNA, 15 nt, Haemophilus influenzae Rd
ucacaacuaccacag

SEQ ID NO: 718399 - RNA, 21 nt, Haemophilus influenzae Rd
ucacaauauuugguugaacuu

SEQ ID NO: 718400 - RNA, 20 nt, Haemophilus influenzae Rd
ucacaaugagacuuaaccaa

SEQ ID NO: 718401 - RNA, 11 nt, Haemophilus influenzae Rd
ucacaaugagc

SEQ ID NO: 718402 - RNA, 16 nt, Haemophilus influenzae Rd
ucaauuuucugugagu

SEQ ID NO: 718403 - RNA, 19 nt, Haemophilus influenzae Rd
ucaauuuuuuaucaaauaa

SEQ ID NO: 718404 - RNA, 21 nt, Haemophilus influenzae Rd
ucaauuuuacguuuuaaauua

SEQ ID NO: 718405 - RNA, 18 nt, Haemophilus influenzae Rd
ucaauuugaccuugaagu

SEQ ID NO: 718406 - RNA, 21 nt, Haemophilus influenzae Rd
ucaauuugugcauaaacagcc

SEQ ID NO: 718407 - RNA, 12 nt, Haemophilus influenzae Rd
ucaauuuuaaaa

SEQ ID NO: 718408 - RNA, 15 nt, Haemophilus influenzae Rd
ucaauuuuaaaauuu

SEQ ID NO: 718409 - RNA, 18 nt, Haemophilus influenzae Rd
ucaauuuggcucacaaga

SEQ ID NO: 718410 - RNA, 11 nt, Haemophilus influenzae Rd
ucacaaagcac

SEQ ID NO: 718411 - RNA, 13 nt, Haemophilus influenzae Rd
ucacaaauaauau

SEQ ID NO: 718412 - RNA, 15 nt, Haemophilus influenzae Rd
ucacaaauaauauga

SEQ ID NO: 718413 - RNA, 20 nt, Haemophilus influenzae Rd
ucacaaaugaucauuuuggg

SEQ ID NO: 718414 - RNA, 15 nt, Haemophilus influenzae Rd
ucacaaaucuaaaaa

SEQ ID NO: 718415 - RNA, 17 nt, Haemophilus influenzae Rd
ucacaaaucuaaaaaua

SEQ ID NO: 718416 - RNA, 18 nt, Haemophilus influenzae Rd
ucacaaaucuaaaaauau

SEQ ID NO: 718417 - RNA, 19 nt, Haemophilus influenzae Rd
ucacaaccaccaauuaauu

SEQ ID NO: 718418 - RNA, 20 nt, Haemophilus influenzae Rd
ucaauuagaugacuggcaaa

SEQ ID NO: 718419 - RNA, 23 nt, Haemophilus influenzae Rd
ucaauuagaugacuggcaaaaau

SEQ ID NO: 718420 - RNA, 17 nt, Haemophilus influenzae Rd
ucaauuaacuauuuaag

SEQ ID NO: 718421 - RNA, 16 nt, Haemophilus influenzae Rd
ucaauguucgauuuua

SEQ ID NO: 718422 - RNA, 20 nt, Haemophilus influenzae Rd
ucaauguucgauuuuacuuu

SEQ ID NO: 718423 - RNA, 16 nt, Haemophilus influenzae Rd
ucaccaacaaauucua

SEQ ID NO: 718424 - RNA, 18 nt, Haemophilus influenzae Rd
ucaccaacaaauucuaau

SEQ ID NO: 718425 - RNA, 13 nt, Haemophilus influenzae Rd
ucacauuguuucc

SEQ ID NO: 718426 - RNA, 15 nt, Haemophilus influenzae Rd
ucacauuuucaaauu

SEQ ID NO: 718427 - RNA, 18 nt, Haemophilus influenzae Rd
ucacauuuucaaauuguc

SEQ ID NO: 718428 - RNA, 20 nt, Haemophilus influenzae Rd
ucacauuugagaugaaaaaa

SEQ ID NO: 718429 - RNA, 20 nt, Haemophilus influenzae Rd
ucaccaaauacauuuuugau

SEQ ID NO: 718430 - RNA, 17 nt, Haemophilus influenzae Rd
ucacagaaccuaaugca

SEQ ID NO: 718431 - RNA, 14 nt, Haemophilus influenzae Rd
ucacagagaauaaa

SEQ ID NO: 718432 - RNA, 15 nt, Haemophilus influenzae Rd
ucacagagaauaaau

SEQ ID NO: 718433 - RNA, 17 nt, Haemophilus influenzae Rd
ucacagagccuuuuucu

SEQ ID NO: 718434 - RNA, 20 nt, Haemophilus influenzae Rd
ucacagagccuuuuucuaau

SEQ ID NO: 718435 - RNA, 16 nt, Haemophilus influenzae Rd
ucacauucuuuuaaau

SEQ ID NO: 718436 - RNA, 13 nt, Haemophilus influenzae Rd
ucacauugccauu

SEQ ID NO: 718437 - RNA, 17 nt, Haemophilus influenzae Rd
ucacauuaugauauuuc

SEQ ID NO: 718438 - RNA, 22 nt, Haemophilus influenzae Rd
ucacauuaugauauuucaauuu

SEQ ID NO: 718439 - RNA, 19 nt, Haemophilus influenzae Rd
ucaccacuuggugcaacca

SEQ ID NO: 718440 - RNA, 22 nt, Haemophilus influenzae Rd
ucacccaagauucuaaauauug

SEQ ID NO: 718441 - RNA, 13 nt, Haemophilus influenzae Rd
ucacccacaaccc

SEQ ID NO: 718442 - RNA, 12 nt, Haemophilus influenzae Rd
ucaccauuuccu

SEQ ID NO: 718443 - RNA, 17 nt, Haemophilus influenzae Rd
ucaccgugcaaaccaac

SEQ ID NO: 718444 - RNA, 17 nt, Haemophilus influenzae Rd
ucaccgggcgauaaaau

SEQ ID NO: 718445 - RNA, 18 nt, Haemophilus influenzae Rd
ucaccgggcgauaaaauc

SEQ ID NO: 718446 - RNA, 21 nt, Haemophilus influenzae Rd
ucaccgccaagcgcugcagua

SEQ ID NO: 718447 - RNA, 21 nt, Haemophilus influenzae Rd
ucaccgcacuuuuaucuugcu

SEQ ID NO: 718448 - RNA, 22 nt, Haemophilus influenzae Rd
ucaccgcagaaguaaaauagcu

SEQ ID NO: 718449 - RNA, 16 nt, Haemophilus influenzae Rd
ucaccgauaauaugca

SEQ ID NO: 718450 - RNA, 15 nt, Haemophilus influenzae Rd
ucaccgaaauaaccu

SEQ ID NO: 718451 - RNA, 18 nt, Haemophilus influenzae Rd
ucacccgcauaaccacua

SEQ ID NO: 718452 - RNA, 15 nt, Haemophilus influenzae Rd
ucacccaucuaaacu

SEQ ID NO: 718453 - RNA, 19 nt, Haemophilus influenzae Rd
ucacccaucaaaucuuuug

SEQ ID NO: 718454 - RNA, 14 nt, Haemophilus influenzae Rd
ucaccguuuuuccu

SEQ ID NO: 718455 - RNA, 19 nt, Haemophilus influenzae Rd
ucaccuaaaucuuuaucaa

SEQ ID NO: 718456 - RNA, 16 nt, Haemophilus influenzae Rd
ucaccucguaaaauau

SEQ ID NO: 718457 - RNA, 23 nt, Haemophilus influenzae Rd
ucaccucgugcuguuuucaauuu

SEQ ID NO: 718458 - RNA, 15 nt, Haemophilus influenzae Rd
ucaccuucaacauaa

SEQ ID NO: 718459 - RNA, 14 nt, Haemophilus influenzae Rd
ucacgaaaaucacg

SEQ ID NO: 718460 - RNA, 23 nt, Haemophilus influenzae Rd
ucacgacccaccacuuaaaaaua

SEQ ID NO: 718461 - RNA, 18 nt, Haemophilus influenzae Rd
ucacgacgccaauuaaua

SEQ ID NO: 718462 - RNA, 16 nt, Haemophilus influenzae Rd
ucacgccuuugucuua

SEQ ID NO: 718463 - RNA, 21 nt, Haemophilus influenzae Rd
ucacgcgugguauucuuucca

SEQ ID NO: 718464 - RNA, 23 nt, Haemophilus influenzae Rd
ucacgcucaaucucuuuacuguu

SEQ ID NO: 718465 - RNA, 15 nt, Haemophilus influenzae Rd
ucacgcucuuuuauc

SEQ ID NO: 718466 - RNA, 15 nt, Haemophilus influenzae Rd
ucacgcucguuaaau

SEQ ID NO: 718467 - RNA, 22 nt, Haemophilus influenzae Rd
ucacgcacaccaccugaugcuu

SEQ ID NO: 718468 - RNA, 23 nt, Haemophilus influenzae Rd
ucacgcacaccaccugaugcuuu

SEQ ID NO: 718469 - RNA, 22 nt, Haemophilus influenzae Rd
ucacgcaaaggaacaauuucua

SEQ ID NO: 718470 - RNA, 19 nt, Haemophilus influenzae Rd
ucacgauuuuuuuauaaaa

SEQ ID NO: 718471 - RNA, 15 nt, Haemophilus influenzae Rd
ucacgcagaauaaac

SEQ ID NO: 718472 - RNA, 14 nt, Haemophilus influenzae Rd
ucacuaaauucuug

SEQ ID NO: 718473 - RNA, 14 nt, Haemophilus influenzae Rd
ucacuaaauaaaug

SEQ ID NO: 718474 - RNA, 12 nt, Haemophilus influenzae Rd
ucacuaaauuuc

SEQ ID NO: 718475 - RNA, 16 nt, Haemophilus influenzae Rd
ucacuaaauuucagcu

SEQ ID NO: 718476 - RNA, 17 nt, Haemophilus influenzae Rd
ucacuaacuuuccuacu

SEQ ID NO: 718477 - RNA, 21 nt, Haemophilus influenzae Rd
ucacuaauacgcggucagaaa

SEQ ID NO: 718478 - RNA, 20 nt, Haemophilus influenzae Rd
ucacuacacccucaguuacc

SEQ ID NO: 718479 - RNA, 18 nt, Haemophilus influenzae Rd
ucacuaauugcauuaaaa

SEQ ID NO: 718480 - RNA, 20 nt, Haemophilus influenzae Rd
ucacguaaguaagucaagcu

SEQ ID NO: 718481 - RNA, 20 nt, Haemophilus influenzae Rd
ucacgguguuuuuuaauaaa

SEQ ID NO: 718482 - RNA, 18 nt, Haemophilus influenzae Rd
ucacuacguguuaauaac

SEQ ID NO: 718483 - RNA, 22 nt, Haemophilus influenzae Rd
ucacuacguguuaauaaccaag

SEQ ID NO: 718484 - RNA, 20 nt, Haemophilus influenzae Rd
ucacuauuaccgcguaaaaa

SEQ ID NO: 718485 - RNA, 23 nt, Haemophilus influenzae Rd
ucacuauuaccgcguaaaaauuc

SEQ ID NO: 718486 - RNA, 15 nt, Haemophilus influenzae Rd
ucacuauuucaucuu

SEQ ID NO: 718487 - RNA, 14 nt, Haemophilus influenzae Rd
uccagcuacauuca

SEQ ID NO: 718488 - RNA, 16 nt, Haemophilus influenzae Rd
uccagcuacauucauc

SEQ ID NO: 718489 - RNA, 19 nt, Haemophilus influenzae Rd
uccagcguuaaguaauuuu

SEQ ID NO: 718490 - RNA, 11 nt, Haemophilus influenzae Rd
uccauaacaac

SEQ ID NO: 718491 - RNA, 15 nt, Haemophilus influenzae Rd
uccauaacaaccauu

SEQ ID NO: 718492 - RNA, 20 nt, Haemophilus influenzae Rd
uccauaaaagaccucucuag

SEQ ID NO: 718493 - RNA, 20 nt, Haemophilus influenzae Rd
uccauaauuucagcaucaga

SEQ ID NO: 718494 - RNA, 22 nt, Haemophilus influenzae Rd
uccauaauuucagcaucagaaa

SEQ ID NO: 718495 - RNA, 16 nt, Haemophilus influenzae Rd
uccauacaguaaaaau

SEQ ID NO: 718496 - RNA, 23 nt, Haemophilus influenzae Rd
uccauaauguucccuauaaauaa

SEQ ID NO: 718497 - RNA, 19 nt, Haemophilus influenzae Rd
uccauaauaucuuucuucg

SEQ ID NO: 718498 - RNA, 23 nt, Haemophilus influenzae Rd
uccaguaaugguuacuuuaucac

SEQ ID NO: 718499 - RNA, 17 nt, Haemophilus influenzae Rd
uccaguauuaaucugau

SEQ ID NO: 718500 - RNA, 19 nt, Haemophilus influenzae Rd
uccagauugguauuccgcu

SEQ ID NO: 718501 - RNA, 22 nt, Haemophilus influenzae Rd
uccagcaaaaaaauuucuuuuu

SEQ ID NO: 718502 - RNA, 14 nt, Haemophilus influenzae Rd
uccagauuaaaaau

SEQ ID NO: 718503 - RNA, 15 nt, Haemophilus influenzae Rd
uccagauuaaaaauu

SEQ ID NO: 718504 - RNA, 16 nt, Haemophilus influenzae Rd
uccagauuaaaaauuc

SEQ ID NO: 718505 - RNA, 14 nt, Haemophilus influenzae Rd
uccagacgcauucu

SEQ ID NO: 718506 - RNA, 21 nt, Haemophilus influenzae Rd
uccaccuugauugagaugcca

SEQ ID NO: 718507 - RNA, 16 nt, Haemophilus influenzae Rd
uccaccuugaauaaug

SEQ ID NO: 718508 - RNA, 21 nt, Haemophilus influenzae Rd
uccaccuugaauugcauuuuc

SEQ ID NO: 718509 - RNA, 17 nt, Haemophilus influenzae Rd
uccacuauucguaaugc

SEQ ID NO: 718510 - RNA, 14 nt, Haemophilus influenzae Rd
uccacucuuuuaau

SEQ ID NO: 718511 - RNA, 17 nt, Haemophilus influenzae Rd
uccacaagcaacaauau

SEQ ID NO: 718512 - RNA, 13 nt, Haemophilus influenzae Rd
uccacaacaacca

SEQ ID NO: 718513 - RNA, 18 nt, Haemophilus influenzae Rd
uccaauucuuuuaaaugu

SEQ ID NO: 718514 - RNA, 19 nt, Haemophilus influenzae Rd
uccaauucuuuuaaaugug

SEQ ID NO: 718515 - RNA, 17 nt, Haemophilus influenzae Rd
uccaauuucaucccaau

SEQ ID NO: 718516 - RNA, 16 nt, Haemophilus influenzae Rd
uccaaauauaaaauaa

SEQ ID NO: 718517 - RNA, 19 nt, Haemophilus influenzae Rd
uccaaauauaaaauaaaau

SEQ ID NO: 718518 - RNA, 21 nt, Haemophilus influenzae Rd
uccaaauaauccuagaguaag

SEQ ID NO: 718519 - RNA, 22 nt, Haemophilus influenzae Rd
uccaaauaauccuagaguaagu

SEQ ID NO: 718520 - RNA, 20 nt, Haemophilus influenzae Rd
uccaaauucauuuuuuauuu

SEQ ID NO: 718521 - RNA, 21 nt, Haemophilus influenzae Rd
uccaaauuccaucaauuaaug

SEQ ID NO: 718522 - RNA, 14 nt, Haemophilus influenzae Rd
uccaaauucuuuaa

SEQ ID NO: 718523 - RNA, 16 nt, Haemophilus influenzae Rd
uccaauucuaguucuu

SEQ ID NO: 718524 - RNA, 15 nt, Haemophilus influenzae Rd
uccaaaauuuaaagu

SEQ ID NO: 718525 - RNA, 12 nt, Haemophilus influenzae Rd
uccaaaaucucu

SEQ ID NO: 718526 - RNA, 14 nt, Haemophilus influenzae Rd
uccaaaauuucuga

SEQ ID NO: 718527 - RNA, 18 nt, Haemophilus influenzae Rd
uccaaaauuaaauugaaa

SEQ ID NO: 718528 - RNA, 16 nt, Haemophilus influenzae Rd
uccacaugauauauuu

SEQ ID NO: 718529 - RNA, 13 nt, Haemophilus influenzae Rd
uccacauuuugau

SEQ ID NO: 718530 - RNA, 19 nt, Haemophilus influenzae Rd
uccaccacccuucuuucaa

SEQ ID NO: 718531 - RNA, 20 nt, Haemophilus influenzae Rd
uccaccacccuucuuucaaa

SEQ ID NO: 718532 - RNA, 22 nt, Haemophilus influenzae Rd
uccacccgguacgcaaccuuga

SEQ ID NO: 718533 - RNA, 19 nt, Haemophilus influenzae Rd
uccaccgcacuuuggacaa

SEQ ID NO: 718534 - RNA, 18 nt, Haemophilus influenzae Rd
ucauuaacgcuuaaauga

SEQ ID NO: 718535 - RNA, 12 nt, Haemophilus influenzae Rd
ucauuaaauaac

SEQ ID NO: 718536 - RNA, 13 nt, Haemophilus influenzae Rd
ucauuaaacugaa

SEQ ID NO: 718537 - RNA, 13 nt, Haemophilus influenzae Rd
ucauuaauacaca

SEQ ID NO: 718538 - RNA, 23 nt, Haemophilus influenzae Rd
ucauuaaggugcagauuaaauau

SEQ ID NO: 718539 - RNA, 21 nt, Haemophilus influenzae Rd
ucauguaaauaguuauuuauu

SEQ ID NO: 718540 - RNA, 17 nt, Haemophilus influenzae Rd
ucaugguuucaaccauu

SEQ ID NO: 718541 - RNA, 14 nt, Haemophilus influenzae Rd
ucauucaaaaauaa

SEQ ID NO: 718542 - RNA, 17 nt, Haemophilus influenzae Rd
ucauucuauuuuaaaaa

SEQ ID NO: 718543 - RNA, 16 nt, Haemophilus influenzae Rd
ucauucaaugcagaaa

SEQ ID NO: 718544 - RNA, 14 nt, Haemophilus influenzae Rd
ucauucacaucuug

SEQ ID NO: 718545 - RNA, 22 nt, Haemophilus influenzae Rd
ucauucaacaauucauaaauaa

SEQ ID NO: 718546 - RNA, 12 nt, Haemophilus influenzae Rd
ucauuacauaau

SEQ ID NO: 718547 - RNA, 15 nt, Haemophilus influenzae Rd
ucauuaauuuuuuca

SEQ ID NO: 718548 - RNA, 16 nt, Haemophilus influenzae Rd
ucauuaauuuuuucac

SEQ ID NO: 718549 - RNA, 19 nt, Haemophilus influenzae Rd
ucauuacacaaaauauucu

SEQ ID NO: 718550 - RNA, 19 nt, Haemophilus influenzae Rd
ucauuacgugcaaauaaau

SEQ ID NO: 718551 - RNA, 20 nt, Haemophilus influenzae Rd
ucauuacgugcaaauaaauu

SEQ ID NO: 718552 - RNA, 20 nt, Haemophilus influenzae Rd
ucauuauccaacauuaauaa

SEQ ID NO: 718553 - RNA, 13 nt, Haemophilus influenzae Rd
uccaaaaaccaac

SEQ ID NO: 718554 - RNA, 12 nt, Haemophilus influenzae Rd
uccaaaaaauaa

SEQ ID NO: 718555 - RNA, 16 nt, Haemophilus influenzae Rd
uccaaaaaauaagggc

SEQ ID NO: 718556 - RNA, 18 nt, Haemophilus influenzae Rd
ucauuuuuuggugcauac

SEQ ID NO: 718557 - RNA, 13 nt, Haemophilus influenzae Rd
ucauuuuuuuaaa

SEQ ID NO: 718558 - RNA, 16 nt, Haemophilus influenzae Rd
ucauuuuuuuaaauau

SEQ ID NO: 718559 - RNA, 19 nt, Haemophilus influenzae Rd
ucauuuuagaauccaaaau

SEQ ID NO: 718560 - RNA, 21 nt, Haemophilus influenzae Rd
ucauuuuagguucaauaaugu

SEQ ID NO: 718561 - RNA, 19 nt, Haemophilus influenzae Rd
ucauuuguugguaaaucua

SEQ ID NO: 718562 - RNA, 20 nt, Haemophilus influenzae Rd
ucauuuguugguaaaucuaa

SEQ ID NO: 718563 - RNA, 22 nt, Haemophilus influenzae Rd
ucauuuguugguaaaucuaaca

SEQ ID NO: 718564 - RNA, 16 nt, Haemophilus influenzae Rd
ucauuuguuagaucag

SEQ ID NO: 718565 - RNA, 22 nt, Haemophilus influenzae Rd
ucauuuguuagaucaguuuuac

SEQ ID NO: 718566 - RNA, 22 nt, Haemophilus influenzae Rd
ucauuuguuuuccguauuuuca

SEQ ID NO: 718567 - RNA, 11 nt, Haemophilus influenzae Rd
ucauuuuaaaa

SEQ ID NO: 718568 - RNA, 13 nt, Haemophilus influenzae Rd
ucauuuucacucc

SEQ ID NO: 718569 - RNA, 17 nt, Haemophilus influenzae Rd
ucauuuucaagccacca

SEQ ID NO: 718570 - RNA, 22 nt, Haemophilus influenzae Rd
ucauuuuucgcaaaaucuugcu

SEQ ID NO: 718571 - RNA, 20 nt, Haemophilus influenzae Rd
ucauuguaaagcccacauga

SEQ ID NO: 718572 - RNA, 12 nt, Haemophilus influenzae Rd
ucauuuauaaaa

SEQ ID NO: 718573 - RNA, 13 nt, Haemophilus influenzae Rd
ucauuuauaaaau

SEQ ID NO: 718574 - RNA, 17 nt, Haemophilus influenzae Rd
ucauuuauggaaauaaa

SEQ ID NO: 718575 - RNA, 22 nt, Haemophilus influenzae Rd
ucauuuauggaaauaaauccug

SEQ ID NO: 718576 - RNA, 12 nt, Haemophilus influenzae Rd
ucauuuauuaaa

SEQ ID NO: 718577 - RNA, 13 nt, Haemophilus influenzae Rd
ucauuuauuaaaa

SEQ ID NO: 718578 - RNA, 15 nt, Haemophilus influenzae Rd
ucauuucaauaucaa

SEQ ID NO: 718579 - RNA, 16 nt, Haemophilus influenzae Rd
ucauuucaauguuugg

SEQ ID NO: 718580 - RNA, 18 nt, Haemophilus influenzae Rd
ucauuucaucuacaccaa

SEQ ID NO: 718581 - RNA, 13 nt, Haemophilus influenzae Rd
ucauugcuugagu

SEQ ID NO: 718582 - RNA, 18 nt, Haemophilus influenzae Rd
ucauuggcgguuuugcca

SEQ ID NO: 718583 - RNA, 19 nt, Haemophilus influenzae Rd
ucauuggcgguuuugccaa

SEQ ID NO: 718584 - RNA, 23 nt, Haemophilus influenzae Rd
ucauuggcgguuuugccaauacu

SEQ ID NO: 718585 - RNA, 16 nt, Haemophilus influenzae Rd
ucauugcuccacuucu

SEQ ID NO: 718586 - RNA, 14 nt, Haemophilus influenzae Rd
ucauugcugcuuua

SEQ ID NO: 718587 - RNA, 16 nt, Haemophilus influenzae Rd
ucaugaauaauuuugu

SEQ ID NO: 718588 - RNA, 20 nt, Haemophilus influenzae Rd
ucaugaauaauuuuguuacu

SEQ ID NO: 718589 - RNA, 18 nt, Haemophilus influenzae Rd
ucaugauuaacaaugauu

SEQ ID NO: 718590 - RNA, 18 nt, Haemophilus influenzae Rd
ucaugauguaauucugcu

SEQ ID NO: 718591 - RNA, 17 nt, Haemophilus influenzae Rd
ucaucucuuguuuuucc

SEQ ID NO: 718592 - RNA, 21 nt, Haemophilus influenzae Rd
ucaucugaacguaagaucaga

SEQ ID NO: 718593 - RNA, 18 nt, Haemophilus influenzae Rd
ucaucucuaaccuaaaau

SEQ ID NO: 718594 - RNA, 15 nt, Haemophilus influenzae Rd
ucaucucaaauguga

SEQ ID NO: 718595 - RNA, 14 nt, Haemophilus influenzae Rd
ucaucuacccacac

SEQ ID NO: 718596 - RNA, 20 nt, Haemophilus influenzae Rd
ucaucuacccacacaccuuu

SEQ ID NO: 718597 - RNA, 19 nt, Haemophilus influenzae Rd
ucaucuaauugauucaaau

SEQ ID NO: 718598 - RNA, 18 nt, Haemophilus influenzae Rd
ucaucuagauuucuaucc

SEQ ID NO: 718599 - RNA, 21 nt, Haemophilus influenzae Rd
ucaucuaguuuuaauacuaaa

SEQ ID NO: 718600 - RNA, 13 nt, Haemophilus influenzae Rd
ucaucuaacaaua

SEQ ID NO: 718601 - RNA, 21 nt, Haemophilus influenzae Rd
ucaucuaagguuuuauuuuca

SEQ ID NO: 718602 - RNA, 13 nt, Haemophilus influenzae Rd
ucaucuaauaaua

SEQ ID NO: 718603 - RNA, 14 nt, Haemophilus influenzae Rd
ucaucuaauaauaa

SEQ ID NO: 718604 - RNA, 16 nt, Haemophilus influenzae Rd
ucaucguuaauuaauu

SEQ ID NO: 718605 - RNA, 19 nt, Haemophilus influenzae Rd
ucaucgguucuuuuaauuc

SEQ ID NO: 718606 - RNA, 16 nt, Haemophilus influenzae Rd
ucaucugcugguuuua

SEQ ID NO: 718607 - RNA, 12 nt, Haemophilus influenzae Rd
ucaucugcauca

SEQ ID NO: 718608 - RNA, 14 nt, Haemophilus influenzae Rd
ucaucugcaucaca

SEQ ID NO: 718609 - RNA, 16 nt, Haemophilus influenzae Rd
ucaucugcaucacaaa

SEQ ID NO: 718610 - RNA, 22 nt, Haemophilus influenzae Rd
ucaucugauacugccaaccuug

SEQ ID NO: 718611 - RNA, 19 nt, Haemophilus influenzae Rd
ucaucuucaucugcaucac

SEQ ID NO: 718612 - RNA, 21 nt, Haemophilus influenzae Rd
ucaucuucagcauuuaaaauu

SEQ ID NO: 718613 - RNA, 15 nt, Haemophilus influenzae Rd
ucaucuguuggaaug

SEQ ID NO: 718614 - RNA, 20 nt, Haemophilus influenzae Rd
ucaucuguuggaaugaucga

SEQ ID NO: 718615 - RNA, 18 nt, Haemophilus influenzae Rd
ucaucuucugcugauaau

SEQ ID NO: 718616 - RNA, 14 nt, Haemophilus influenzae Rd
ucaucuuuacccac

SEQ ID NO: 718617 - RNA, 15 nt, Haemophilus influenzae Rd
ucaucuuuuaaauaa

SEQ ID NO: 718618 - RNA, 16 nt, Haemophilus influenzae Rd
ucaucuuuuaaauaac

SEQ ID NO: 718619 - RNA, 17 nt, Haemophilus influenzae Rd
ucaucacccaucaaauc

SEQ ID NO: 718620 - RNA, 18 nt, Haemophilus influenzae Rd
ucaucacccaucaaaucu

SEQ ID NO: 718621 - RNA, 18 nt, Haemophilus influenzae Rd
ucaucacaucaauacuug

SEQ ID NO: 718622 - RNA, 20 nt, Haemophilus influenzae Rd
ucaucaauuugugcauaaac

SEQ ID NO: 718623 - RNA, 12 nt, Haemophilus influenzae Rd
ucaucaauggca

SEQ ID NO: 718624 - RNA, 14 nt, Haemophilus influenzae Rd
ucaucacaaaucuu

SEQ ID NO: 718625 - RNA, 16 nt, Haemophilus influenzae Rd
ucaucaaucuucucau

SEQ ID NO: 718626 - RNA, 23 nt, Haemophilus influenzae Rd
ucaucaaugcaacaucuucuacg

SEQ ID NO: 718627 - RNA, 16 nt, Haemophilus influenzae Rd
ucaucaaagcucaccu

SEQ ID NO: 718628 - RNA, 21 nt, Haemophilus influenzae Rd
ucaucaaaguaacguugcucu

SEQ ID NO: 718629 - RNA, 21 nt, Haemophilus influenzae Rd
ucauauccaaauugagaucuu

SEQ ID NO: 718630 - RNA, 21 nt, Haemophilus influenzae Rd
ucauauccaccacaauuaaug

SEQ ID NO: 718631 - RNA, 22 nt, Haemophilus influenzae Rd
ucauauccaccacaauuaauga

SEQ ID NO: 718632 - RNA, 18 nt, Haemophilus influenzae Rd
ucauauauucaacuaaag

SEQ ID NO: 718633 - RNA, 22 nt, Haemophilus influenzae Rd
ucauauauucaacuaaaggcac

SEQ ID NO: 718634 - RNA, 22 nt, Haemophilus influenzae Rd
ucauaucgagcagacaaaauug

SEQ ID NO: 718635 - RNA, 14 nt, Haemophilus influenzae Rd
ucauaucuaacaua

SEQ ID NO: 718636 - RNA, 19 nt, Haemophilus influenzae Rd
ucauaucugucauauaacc

SEQ ID NO: 718637 - RNA, 21 nt, Haemophilus influenzae Rd
ucauauugauuuacauuaauu

SEQ ID NO: 718638 - RNA, 22 nt, Haemophilus influenzae Rd
ucauauugauuuacauuaauuu

SEQ ID NO: 718639 - RNA, 23 nt, Haemophilus influenzae Rd
ucaucaaaacaccuccagcaaaa

SEQ ID NO: 718640 - RNA, 12 nt, Haemophilus influenzae Rd
ucauauuuuaaa

SEQ ID NO: 718641 - RNA, 17 nt, Haemophilus influenzae Rd
ucauauuuuaaauaauu

SEQ ID NO: 718642 - RNA, 18 nt, Haemophilus influenzae Rd
ucauauuuuaaauaauua

SEQ ID NO: 718643 - RNA, 15 nt, Haemophilus influenzae Rd
ucauauuucugcaaa

SEQ ID NO: 718644 - RNA, 14 nt, Haemophilus influenzae Rd
ucauauuucuguau

SEQ ID NO: 718645 - RNA, 21 nt, Haemophilus influenzae Rd
ucauagcugacguguaaaucu

SEQ ID NO: 718646 - RNA, 22 nt, Haemophilus influenzae Rd
ucauagcugacguguaaaucua

SEQ ID NO: 718647 - RNA, 23 nt, Haemophilus influenzae Rd
ucauagcugacguguaaaucuaa

SEQ ID NO: 718648 - RNA, 15 nt, Haemophilus influenzae Rd
ucauagauaaaauua

SEQ ID NO: 718649 - RNA, 15 nt, Haemophilus influenzae Rd
ucauagauaaauaua

SEQ ID NO: 718650 - RNA, 22 nt, Haemophilus influenzae Rd
ucauagagacuuguaaauacca

SEQ ID NO: 718651 - RNA, 13 nt, Haemophilus influenzae Rd
ucauagagccaau

SEQ ID NO: 718652 - RNA, 22 nt, Haemophilus influenzae Rd
ucauagaaaccaauaauuucau

SEQ ID NO: 718653 - RNA, 12 nt, Haemophilus influenzae Rd
ucauagaaaucc

SEQ ID NO: 718654 - RNA, 14 nt, Haemophilus influenzae Rd
ucauagaaaucccu

SEQ ID NO: 718655 - RNA, 15 nt, Haemophilus influenzae Rd
ucauagaaaucccuu

SEQ ID NO: 718656 - RNA, 17 nt, Haemophilus influenzae Rd
ucauaggcuuuaacuaa

SEQ ID NO: 718657 - RNA, 17 nt, Haemophilus influenzae Rd
ucauauauaaauuuaga

SEQ ID NO: 718658 - RNA, 16 nt, Haemophilus influenzae Rd
ucauauaaauaagaau

SEQ ID NO: 718659 - RNA, 14 nt, Haemophilus influenzae Rd
ucauauaaagugga

SEQ ID NO: 718660 - RNA, 19 nt, Haemophilus influenzae Rd
ucauaauuuauucaaaaua

SEQ ID NO: 718661 - RNA, 23 nt, Haemophilus influenzae Rd
ucauaauaggcgcguaauaaaua

SEQ ID NO: 718662 - RNA, 13 nt, Haemophilus influenzae Rd
ucauaauccacua

SEQ ID NO: 718663 - RNA, 17 nt, Haemophilus influenzae Rd
ucauacguucaacaauc

SEQ ID NO: 718664 - RNA, 19 nt, Haemophilus influenzae Rd
ucauacguucaacaaucac

SEQ ID NO: 718665 - RNA, 19 nt, Haemophilus influenzae Rd
ucauacuaaauacauuuuu

SEQ ID NO: 718666 - RNA, 20 nt, Haemophilus influenzae Rd
ucauacgaccuucaaccauu

SEQ ID NO: 718667 - RNA, 15 nt, Haemophilus influenzae Rd
ucaucauauucacuu

SEQ ID NO: 718668 - RNA, 14 nt, Haemophilus influenzae Rd
ucaucaucaaauug

SEQ ID NO: 718669 - RNA, 18 nt, Haemophilus influenzae Rd
ucaucauaauuuauucaa

SEQ ID NO: 718670 - RNA, 19 nt, Haemophilus influenzae Rd
ucaucagaaauauaaucaa

SEQ ID NO: 718671 - RNA, 16 nt, Haemophilus influenzae Rd
ucaucagaaauaucuu

SEQ ID NO: 718672 - RNA, 18 nt, Haemophilus influenzae Rd
ucaucagaaauaucuuca

SEQ ID NO: 718673 - RNA, 19 nt, Haemophilus influenzae Rd
ucaucagaaauaucuucaa

SEQ ID NO: 718674 - RNA, 23 nt, Haemophilus influenzae Rd
ucaucagcuuaucaaucaagaau

SEQ ID NO: 718675 - RNA, 23 nt, Haemophilus influenzae Rd
ucaucagccgcuuuuugaucucu

SEQ ID NO: 718676 - RNA, 21 nt, Haemophilus influenzae Rd
ucaucauuuuggcuuuacgca

SEQ ID NO: 718677 - RNA, 15 nt, Haemophilus influenzae Rd
ucaucauuugcucua

SEQ ID NO: 718678 - RNA, 18 nt, Haemophilus influenzae Rd
ucauccacauaaggugga

SEQ ID NO: 718679 - RNA, 18 nt, Haemophilus influenzae Rd
ucauccaaucaucagaau

SEQ ID NO: 718680 - RNA, 13 nt, Haemophilus influenzae Rd
ucaucgcuucuaa

SEQ ID NO: 718681 - RNA, 23 nt, Haemophilus influenzae Rd
ucaucgcguuuauuuuuauaaau

SEQ ID NO: 718682 - RNA, 23 nt, Haemophilus influenzae Rd
ucaucggcuacagguucuacgua

SEQ ID NO: 718683 - RNA, 19 nt, Haemophilus influenzae Rd
ucaucgcccgcuucuuucg

SEQ ID NO: 718684 - RNA, 20 nt, Haemophilus influenzae Rd
ucaucgccgugauaauaucg

SEQ ID NO: 718685 - RNA, 20 nt, Haemophilus influenzae Rd
ucaucgaguuuuaucuucaa

SEQ ID NO: 718686 - RNA, 14 nt, Haemophilus influenzae Rd
ucaucgauguaaag

SEQ ID NO: 718687 - RNA, 22 nt, Haemophilus influenzae Rd
ucaucgauuacgcuuacucauu

SEQ ID NO: 718688 - RNA, 21 nt, Haemophilus influenzae Rd
ucaucgaaaauuaagguugga

SEQ ID NO: 718689 - RNA, 22 nt, Haemophilus influenzae Rd
ucauccgcuucguuguaaucuu

SEQ ID NO: 718690 - RNA, 19 nt, Haemophilus influenzae Rd
ucaucccagauuuuacuug

SEQ ID NO: 718691 - RNA, 23 nt, Haemophilus influenzae Rd
ucaucccagauuuuacuugccgu

SEQ ID NO: 718692 - RNA, 14 nt, Haemophilus influenzae Rd
ucaucccauuuuug

SEQ ID NO: 718693 - RNA, 23 nt, Haemophilus influenzae Rd
ucauaaauaggaaaggcauuuuu

SEQ ID NO: 718694 - RNA, 11 nt, Haemophilus influenzae Rd
ucauaaauauc

SEQ ID NO: 718695 - RNA, 15 nt, Haemophilus influenzae Rd
ucauaaauccaaucc

SEQ ID NO: 718696 - RNA, 18 nt, Haemophilus influenzae Rd
ucauaaaucgguucuaca

SEQ ID NO: 718697 - RNA, 14 nt, Haemophilus influenzae Rd
ucauaaauucaucu

SEQ ID NO: 718698 - RNA, 12 nt, Haemophilus influenzae Rd
ucauaaauuccu

SEQ ID NO: 718699 - RNA, 17 nt, Haemophilus influenzae Rd
ucauaacgggcauuuuu

SEQ ID NO: 718700 - RNA, 10 nt, Haemophilus influenzae Rd
ucauaagucc

SEQ ID NO: 718701 - RNA, 16 nt, Haemophilus influenzae Rd
ucauaaggugcauuag

SEQ ID NO: 718702 - RNA, 17 nt, Haemophilus influenzae Rd
ucauaaguaaaaccauu

SEQ ID NO: 718703 - RNA, 23 nt, Haemophilus influenzae Rd
ucaguuaugcaaauacauauuuu

SEQ ID NO: 718704 - RNA, 21 nt, Haemophilus influenzae Rd
ucaguuccugacccacaucau

SEQ ID NO: 718705 - RNA, 13 nt, Haemophilus influenzae Rd
ucauaaaaaacau

SEQ ID NO: 718706 - RNA, 14 nt, Haemophilus influenzae Rd
ucauaaaaaaugcu

SEQ ID NO: 718707 - RNA, 14 nt, Haemophilus influenzae Rd
ucauaaaaacaaua

SEQ ID NO: 718708 - RNA, 23 nt, Haemophilus influenzae Rd
ucaguuuugcuuuuuuaauuugg

SEQ ID NO: 718709 - RNA, 13 nt, Haemophilus influenzae Rd
ucaguuaagaaaa

SEQ ID NO: 718710 - RNA, 18 nt, Haemophilus influenzae Rd
ucaguuaauuagaauaac

SEQ ID NO: 718711 - RNA, 16 nt, Haemophilus influenzae Rd
ucaguuaccauacauu

SEQ ID NO: 718712 - RNA, 17 nt, Haemophilus influenzae Rd
ucaguuacguaauauuu

SEQ ID NO: 718713 - RNA, 15 nt, Haemophilus influenzae Rd
ucaguauuuuuucga

SEQ ID NO: 718714 - RNA, 11 nt, Haemophilus influenzae Rd
ucagguugaau

SEQ ID NO: 718715 - RNA, 12 nt, Haemophilus influenzae Rd
ucaggugcuuua

SEQ ID NO: 718716 - RNA, 14 nt, Haemophilus influenzae Rd
ucaggugcuuuagc

SEQ ID NO: 718717 - RNA, 19 nt, Haemophilus influenzae Rd
ucaggugggaaauaauuuu

SEQ ID NO: 718718 - RNA, 17 nt, Haemophilus influenzae Rd
ucaggguuuucaucauu

SEQ ID NO: 718719 - RNA, 20 nt, Haemophilus influenzae Rd
ucagguugcgguaaaucuac

SEQ ID NO: 718720 - RNA, 15 nt, Haemophilus influenzae Rd
ucagguuuaauaauc

SEQ ID NO: 718721 - RNA, 20 nt, Haemophilus influenzae Rd
ucaguaaaccaagugaaauu

SEQ ID NO: 718722 - RNA, 15 nt, Haemophilus influenzae Rd
ucaguaacuacaacu

SEQ ID NO: 718723 - RNA, 15 nt, Haemophilus influenzae Rd
ucaggaucaaaaaua

SEQ ID NO: 718724 - RNA, 11 nt, Haemophilus influenzae Rd
ucagcuucaau

SEQ ID NO: 718725 - RNA, 23 nt, Haemophilus influenzae Rd
ucagcuuaucaaucaagaauucc

SEQ ID NO: 718726 - RNA, 15 nt, Haemophilus influenzae Rd
ucagcuugugcucga

SEQ ID NO: 718727 - RNA, 18 nt, Haemophilus influenzae Rd
ucagcuuguuuaaucaca

SEQ ID NO: 718728 - RNA, 16 nt, Haemophilus influenzae Rd
ucagcguuuucaacuu

SEQ ID NO: 718729 - RNA, 23 nt, Haemophilus influenzae Rd
ucagcuaaaauuaccccaauucc

SEQ ID NO: 718730 - RNA, 14 nt, Haemophilus influenzae Rd
ucagcuaaugcuuu

SEQ ID NO: 718731 - RNA, 18 nt, Haemophilus influenzae Rd
ucagcuaaugcuuuaauu

SEQ ID NO: 718732 - RNA, 18 nt, Haemophilus influenzae Rd
ucagcuaauucagcuaaa

SEQ ID NO: 718733 - RNA, 16 nt, Haemophilus influenzae Rd
ucagcugcgaugcaua

SEQ ID NO: 718734 - RNA, 18 nt, Haemophilus influenzae Rd
ucacugacaucaagcaca

SEQ ID NO: 718735 - RNA, 21 nt, Haemophilus influenzae Rd
ucacugacaucaagcacauca

SEQ ID NO: 718736 - RNA, 15 nt, Haemophilus influenzae Rd
ucacugugccaacuu

SEQ ID NO: 718737 - RNA, 18 nt, Haemophilus influenzae Rd
ucacucuaccaucuaaag

SEQ ID NO: 718738 - RNA, 14 nt, Haemophilus influenzae Rd
ucacucguggaauu

SEQ ID NO: 718739 - RNA, 14 nt, Haemophilus influenzae Rd
ucacucuuauucau

SEQ ID NO: 718740 - RNA, 14 nt, Haemophilus influenzae Rd
ucacugaaaguaag

SEQ ID NO: 718741 - RNA, 14 nt, Haemophilus influenzae Rd
ucacugaauuucau

SEQ ID NO: 718742 - RNA, 17 nt, Haemophilus influenzae Rd
ucagccacuucuucaaa

SEQ ID NO: 718743 - RNA, 13 nt, Haemophilus influenzae Rd
ucacuuaaauuca

SEQ ID NO: 718744 - RNA, 21 nt, Haemophilus influenzae Rd
ucacuuaauaaaaauuguaaa

SEQ ID NO: 718745 - RNA, 21 nt, Haemophilus influenzae Rd
ucagcgagagaauauuuagau

SEQ ID NO: 718746 - RNA, 12 nt, Haemophilus influenzae Rd
ucagccugcuca

SEQ ID NO: 718747 - RNA, 22 nt, Haemophilus influenzae Rd
uaggcgacgcugcaaaaugaac

SEQ ID NO: 718748 - RNA, 15 nt, Haemophilus influenzae Rd
uaggcgaaucaaaau

SEQ ID NO: 718749 - RNA, 21 nt, Haemophilus influenzae Rd
uaggcaauaaaaaaacaccuu

SEQ ID NO: 718750 - RNA, 20 nt, Haemophilus influenzae Rd
uaggcaauguuccaccacuc

SEQ ID NO: 718751 - RNA, 15 nt, Haemophilus influenzae Rd
uagggcugcaugugc

SEQ ID NO: 718752 - RNA, 15 nt, Haemophilus influenzae Rd
uagggaauaaaaaag

SEQ ID NO: 718753 - RNA, 17 nt, Haemophilus influenzae Rd
uaggcugaaaaaauauc

SEQ ID NO: 718754 - RNA, 18 nt, Haemophilus influenzae Rd
uaggcugaauacauuaag

SEQ ID NO: 718755 - RNA, 18 nt, Haemophilus influenzae Rd
uaggcuucggccuauuaa

SEQ ID NO: 718756 - RNA, 16 nt, Haemophilus influenzae Rd
uaggcgugcguuuuuu

SEQ ID NO: 718757 - RNA, 14 nt, Haemophilus influenzae Rd
uagguaguuuucaa

SEQ ID NO: 718758 - RNA, 13 nt, Haemophilus influenzae Rd
uagguuucaauuu

SEQ ID NO: 718759 - RNA, 18 nt, Haemophilus influenzae Rd
uagguaaacuuuggaaua

SEQ ID NO: 718760 - RNA, 11 nt, Haemophilus influenzae Rd
uagguaaaaau

SEQ ID NO: 718761 - RNA, 19 nt, Haemophilus influenzae Rd
uagggcucaaaucuacuaa

SEQ ID NO: 718762 - RNA, 14 nt, Haemophilus influenzae Rd
uaguaaaaauuguu

SEQ ID NO: 718763 - RNA, 23 nt, Haemophilus influenzae Rd
uaguaaaacuaauacuucauagu

SEQ ID NO: 718764 - RNA, 18 nt, Haemophilus influenzae Rd
uaguaaaaaaucaagccc

SEQ ID NO: 718765 - RNA, 16 nt, Haemophilus influenzae Rd
uaguaaacuuuuaaag

SEQ ID NO: 718766 - RNA, 15 nt, Haemophilus influenzae Rd
uaguaaagaaauaag

SEQ ID NO: 718767 - RNA, 16 nt, Haemophilus influenzae Rd
uaguaaagaauauuuu

SEQ ID NO: 718768 - RNA, 19 nt, Haemophilus influenzae Rd
uaguaaagaauauuuuaau

SEQ ID NO: 718769 - RNA, 20 nt, Haemophilus influenzae Rd
uaguaaagaauauuuuaaug

SEQ ID NO: 718770 - RNA, 18 nt, Haemophilus influenzae Rd
uaguaaaguuuagcuuua

SEQ ID NO: 718771 - RNA, 12 nt, Haemophilus influenzae Rd
uaguaaauaaca

SEQ ID NO: 718772 - RNA, 16 nt, Haemophilus influenzae Rd
uaguacuuguaacuug

SEQ ID NO: 718773 - RNA, 13 nt, Haemophilus influenzae Rd
uaguuguuuuagu

SEQ ID NO: 718774 - RNA, 13 nt, Haemophilus influenzae Rd
uaguuuagguuua

SEQ ID NO: 718775 - RNA, 17 nt, Haemophilus influenzae Rd
uaguuuaggaaguaaau

SEQ ID NO: 718776 - RNA, 14 nt, Haemophilus influenzae Rd
uaguuuauuaauuu

SEQ ID NO: 718777 - RNA, 14 nt, Haemophilus influenzae Rd
uaguguuuuuaauc

SEQ ID NO: 718778 - RNA, 15 nt, Haemophilus influenzae Rd
uaguucaaggacuga

SEQ ID NO: 718779 - RNA, 16 nt, Haemophilus influenzae Rd
uagugaugaugguguu

SEQ ID NO: 718780 - RNA, 18 nt, Haemophilus influenzae Rd
uagugcuguauauuuuua

SEQ ID NO: 718781 - RNA, 23 nt, Haemophilus influenzae Rd
uagugcuguauauuuuuaauuug

SEQ ID NO: 718782 - RNA, 23 nt, Haemophilus influenzae Rd
uagugcuaaauggaauguagaua

SEQ ID NO: 718783 - RNA, 13 nt, Haemophilus influenzae Rd
uauaaauuuaaag

SEQ ID NO: 718784 - RNA, 17 nt, Haemophilus influenzae Rd
uauaacacagaugaaaa

SEQ ID NO: 718785 - RNA, 14 nt, Haemophilus influenzae Rd
uauaacaccaaaca

SEQ ID NO: 718786 - RNA, 19 nt, Haemophilus influenzae Rd
uauaaacccaucauaaaua

SEQ ID NO: 718787 - RNA, 18 nt, Haemophilus influenzae Rd
uauaaacguugugaacuu

SEQ ID NO: 718788 - RNA, 21 nt, Haemophilus influenzae Rd
uauaaacguugugaacuuugu

SEQ ID NO: 718789 - RNA, 14 nt, Haemophilus influenzae Rd
uauaaacuaucuug

SEQ ID NO: 718790 - RNA, 15 nt, Haemophilus influenzae Rd
uauaaacugacagaa

SEQ ID NO: 718791 - RNA, 20 nt, Haemophilus influenzae Rd
uauaaaaauauuuuaauaaa

SEQ ID NO: 718792 - RNA, 20 nt, Haemophilus influenzae Rd
uauaaaaccccguucaauuu

SEQ ID NO: 718793 - RNA, 16 nt, Haemophilus influenzae Rd
uauaaaacuuuucuua

SEQ ID NO: 718794 - RNA, 18 nt, Haemophilus influenzae Rd
uauaaaacuuuucuuaua

SEQ ID NO: 718795 - RNA, 18 nt, Haemophilus influenzae Rd
uauaaaccaguuaaaucc

SEQ ID NO: 718796 - RNA, 22 nt, Haemophilus influenzae Rd
uaguuuuucgcugcagcugcug

SEQ ID NO: 718797 - RNA, 13 nt, Haemophilus influenzae Rd
uaguuuuuauuau

SEQ ID NO: 718798 - RNA, 14 nt, Haemophilus influenzae Rd
uaguuuuguauaag

SEQ ID NO: 718799 - RNA, 17 nt, Haemophilus influenzae Rd
uaguuuucaauaucaaa

SEQ ID NO: 718800 - RNA, 20 nt, Haemophilus influenzae Rd
uaguuuuuuacguaauaagu

SEQ ID NO: 718801 - RNA, 19 nt, Haemophilus influenzae Rd
uaguuuuuuuauaaaaaaa

SEQ ID NO: 718802 - RNA, 12 nt, Haemophilus influenzae Rd
uauaaaaaaaca

SEQ ID NO: 718803 - RNA, 23 nt, Haemophilus influenzae Rd
uauaaaaaaacuaaaaacaaaua

SEQ ID NO: 718804 - RNA, 20 nt, Haemophilus influenzae Rd
uaguuuuaguaauuuuaauu

SEQ ID NO: 718805 - RNA, 18 nt, Haemophilus influenzae Rd
uaguuuguuucucaaguu

SEQ ID NO: 718806 - RNA, 20 nt, Haemophilus influenzae Rd
uaguuuuccuuucuuuccga

SEQ ID NO: 718807 - RNA, 15 nt, Haemophilus influenzae Rd
uaguuuuauuuuaau

SEQ ID NO: 718808 - RNA, 16 nt, Haemophilus influenzae Rd
uaguuuggcucuucuu

SEQ ID NO: 718809 - RNA, 17 nt, Haemophilus influenzae Rd
uaguuuggcucuucuuu

SEQ ID NO: 718810 - RNA, 18 nt, Haemophilus influenzae Rd
uaguuuggcucuucuuua

SEQ ID NO: 718811 - RNA, 23 nt, Haemophilus influenzae Rd
uaguuuggcugaaauucuaaaaa

SEQ ID NO: 718812 - RNA, 12 nt, Haemophilus influenzae Rd
uaguuuccccug

SEQ ID NO: 718813 - RNA, 18 nt, Haemophilus influenzae Rd
uaguuuccccugaaugcg

SEQ ID NO: 718814 - RNA, 13 nt, Haemophilus influenzae Rd
uaguuucuaauuc

SEQ ID NO: 718815 - RNA, 15 nt, Haemophilus influenzae Rd
uaguuucuaauucuu

SEQ ID NO: 718816 - RNA, 18 nt, Haemophilus influenzae Rd
uaguuucuaauucuucca

SEQ ID NO: 718817 - RNA, 16 nt, Haemophilus influenzae Rd
uauauaccuuaacauu

SEQ ID NO: 718818 - RNA, 18 nt, Haemophilus influenzae Rd
uauaucacagauuuuuaa

SEQ ID NO: 718819 - RNA, 22 nt, Haemophilus influenzae Rd
uauaucacagauuuuuaaauca

SEQ ID NO: 718820 - RNA, 21 nt, Haemophilus influenzae Rd
uauaucacagauuuuuuauua

SEQ ID NO: 718821 - RNA, 15 nt, Haemophilus influenzae Rd
uauaguuaaugcagu

SEQ ID NO: 718822 - RNA, 20 nt, Haemophilus influenzae Rd
uauagugauuauuuacaauu

SEQ ID NO: 718823 - RNA, 18 nt, Haemophilus influenzae Rd
uauagccuucgcuauuuu

SEQ ID NO: 718824 - RNA, 22 nt, Haemophilus influenzae Rd
uauagcgucuuuuugcacguuc

SEQ ID NO: 718825 - RNA, 17 nt, Haemophilus influenzae Rd
uauagcgugcuuuaaua

SEQ ID NO: 718826 - RNA, 23 nt, Haemophilus influenzae Rd
uauagauuuaguccuuaauuuua

SEQ ID NO: 718827 - RNA, 20 nt, Haemophilus influenzae Rd
uauagaugaacucaauuccu

SEQ ID NO: 718828 - RNA, 21 nt, Haemophilus influenzae Rd
uauagauaaaauguugaauau

SEQ ID NO: 718829 - RNA, 19 nt, Haemophilus influenzae Rd
uauacugcucuuggauuuu

SEQ ID NO: 718830 - RNA, 22 nt, Haemophilus influenzae Rd
uauacucguucguuauuuugau

SEQ ID NO: 718831 - RNA, 19 nt, Haemophilus influenzae Rd
uauagaacgguuaugaaaa

SEQ ID NO: 718832 - RNA, 21 nt, Haemophilus influenzae Rd
uauagaacgguuaugaaaaau

SEQ ID NO: 718833 - RNA, 24 nt, Haemophilus influenzae Rd
uauagaacuuagcccuuaaacuaa

SEQ ID NO: 718834 - RNA, 15 nt, Haemophilus influenzae Rd
uauacuuaauuucuc

SEQ ID NO: 718835 - RNA, 14 nt, Haemophilus influenzae Rd
uauacuugccaaaa

SEQ ID NO: 718836 - RNA, 21 nt, Haemophilus influenzae Rd
uauacuuuucaacacuuuauu

SEQ ID NO: 718837 - RNA, 22 nt, Haemophilus influenzae Rd
uauacaucaggaggaauaauga

SEQ ID NO: 718838 - RNA, 15 nt, Haemophilus influenzae Rd
uauaagaaaaacauu

SEQ ID NO: 718839 - RNA, 17 nt, Haemophilus influenzae Rd
uauacaguuagaacaac

SEQ ID NO: 718840 - RNA, 12 nt, Haemophilus influenzae Rd
uauaacucaaca

SEQ ID NO: 718841 - RNA, 23 nt, Haemophilus influenzae Rd
uauaacguagcgauaaaauauau

SEQ ID NO: 718842 - RNA, 15 nt, Haemophilus influenzae Rd
uauaacguuuaaaaa

SEQ ID NO: 718843 - RNA, 20 nt, Haemophilus influenzae Rd
uauaacugugugauuuauuu

SEQ ID NO: 718844 - RNA, 23 nt, Haemophilus influenzae Rd
uaucaauaccaauugaugcacaa

SEQ ID NO: 718845 - RNA, 18 nt, Haemophilus influenzae Rd
uaucacuaauauaaagau

SEQ ID NO: 718846 - RNA, 22 nt, Haemophilus influenzae Rd
uaucaauuacguaaucauccac

SEQ ID NO: 718847 - RNA, 16 nt, Haemophilus influenzae Rd
uaucaauuccuucaaa

SEQ ID NO: 718848 - RNA, 16 nt, Haemophilus influenzae Rd
uaucacgaaaaucacg

SEQ ID NO: 718849 - RNA, 19 nt, Haemophilus influenzae Rd
uaucacgaaaaucacgcuc

SEQ ID NO: 718850 - RNA, 21 nt, Haemophilus influenzae Rd
uaucaaugcucucuuuuaauc

SEQ ID NO: 718851 - RNA, 14 nt, Haemophilus influenzae Rd
uaucaaugccaucg

SEQ ID NO: 718852 - RNA, 13 nt, Haemophilus influenzae Rd
uaucaaucauauc

SEQ ID NO: 718853 - RNA, 21 nt, Haemophilus influenzae Rd
uaucaaucauaucaucaacca

SEQ ID NO: 718854 - RNA, 20 nt, Haemophilus influenzae Rd
uauaucauggcacaaaauaa

SEQ ID NO: 718855 - RNA, 15 nt, Haemophilus influenzae Rd
uaucaaaacuugcua

SEQ ID NO: 718856 - RNA, 13 nt, Haemophilus influenzae Rd
uauauuuuuucuu

SEQ ID NO: 718857 - RNA, 22 nt, Haemophilus influenzae Rd
uaucaaaaaacgaaauuuuuca

SEQ ID NO: 718858 - RNA, 13 nt, Haemophilus influenzae Rd
uaucaaaaagaaa

SEQ ID NO: 718859 - RNA, 13 nt, Haemophilus influenzae Rd
uauauuuuuaauu

SEQ ID NO: 718860 - RNA, 19 nt, Haemophilus influenzae Rd
uauauuuuuaauuuauacu

SEQ ID NO: 718861 - RNA, 15 nt, Haemophilus influenzae Rd
uauauuuuuauugaa

SEQ ID NO: 718862 - RNA, 18 nt, Haemophilus influenzae Rd
uaucaucuagauuucuau

SEQ ID NO: 718863 - RNA, 23 nt, Haemophilus influenzae Rd
uaucaucuagauuucuauccauu

SEQ ID NO: 718864 - RNA, 14 nt, Haemophilus influenzae Rd
uaucauccgcuugu

SEQ ID NO: 718865 - RNA, 22 nt, Haemophilus influenzae Rd
uaucauccgcuuguaauuucau

SEQ ID NO: 718866 - RNA, 20 nt, Haemophilus influenzae Rd
uaucaucauuuuuauuuaau

SEQ ID NO: 718867 - RNA, 17 nt, Haemophilus influenzae Rd
uaucauaaacaauuuca

SEQ ID NO: 718868 - RNA, 18 nt, Haemophilus influenzae Rd
uaucauaaacaauuucau

SEQ ID NO: 718869 - RNA, 21 nt, Haemophilus influenzae Rd
uaucauggcacaaaauaauga

SEQ ID NO: 718870 - RNA, 22 nt, Haemophilus influenzae Rd
uaucauggcgaccauucucuaa

SEQ ID NO: 718871 - RNA, 19 nt, Haemophilus influenzae Rd
uaucauuaaucuuauacaa

SEQ ID NO: 718872 - RNA, 22 nt, Haemophilus influenzae Rd
uaucacuuaaaccaaauugauu

SEQ ID NO: 718873 - RNA, 22 nt, Haemophilus influenzae Rd
uaucacuuuguacaccaaaaua

SEQ ID NO: 718874 - RNA, 16 nt, Haemophilus influenzae Rd
uaucacuuuuuuauuc

SEQ ID NO: 718875 - RNA, 11 nt, Haemophilus influenzae Rd
uauccacaaaa

SEQ ID NO: 718876 - RNA, 18 nt, Haemophilus influenzae Rd
uaucauuugaauuaauaa

SEQ ID NO: 718877 - RNA, 16 nt, Haemophilus influenzae Rd
uauccaacauuaauaa

SEQ ID NO: 718878 - RNA, 22 nt, Haemophilus influenzae Rd
uauccaaaucaaaaagcuacug

SEQ ID NO: 718879 - RNA, 16 nt, Haemophilus influenzae Rd
uauccaaauugagauc

SEQ ID NO: 718880 - RNA, 14 nt, Haemophilus influenzae Rd
uauccaaaauuaaa

SEQ ID NO: 718881 - RNA, 23 nt, Haemophilus influenzae Rd
uagcccgccuaauauuucuuuuu

SEQ ID NO: 718882 - RNA, 23 nt, Haemophilus influenzae Rd
uagcccgaaaauuaagaaaauaa

SEQ ID NO: 718883 - RNA, 12 nt, Haemophilus influenzae Rd
uagccauugcac

SEQ ID NO: 718884 - RNA, 22 nt, Haemophilus influenzae Rd
uagcccauaauuaaacagcaca

SEQ ID NO: 718885 - RNA, 14 nt, Haemophilus influenzae Rd
uagccaauuuuguc

SEQ ID NO: 718886 - RNA, 21 nt, Haemophilus influenzae Rd
uagccauauuaucugcuggau

SEQ ID NO: 718887 - RNA, 20 nt, Haemophilus influenzae Rd
uagccauauccguaucauuu

SEQ ID NO: 718888 - RNA, 15 nt, Haemophilus influenzae Rd
uagccuaguauuuuu

SEQ ID NO: 718889 - RNA, 20 nt, Haemophilus influenzae Rd
uagccuaagauuuuaucuaa

SEQ ID NO: 718890 - RNA, 20 nt, Haemophilus influenzae Rd
uagccguaaguuaaaccaac

SEQ ID NO: 718891 - RNA, 22 nt, Haemophilus influenzae Rd
uagcccuuacaccuauuauucc

SEQ ID NO: 718892 - RNA, 15 nt, Haemophilus influenzae Rd
uagcggauaaccaaa

SEQ ID NO: 718893 - RNA, 21 nt, Haemophilus influenzae Rd
uagccuguuucacaaguucuu

SEQ ID NO: 718894 - RNA, 17 nt, Haemophilus influenzae Rd
uagccuggcacuaagaa

SEQ ID NO: 718895 - RNA, 18 nt, Haemophilus influenzae Rd
uagccuggcacuaagaaa

SEQ ID NO: 718896 - RNA, 17 nt, Haemophilus influenzae Rd
uagccucuucuuuugau

SEQ ID NO: 718897 - RNA, 13 nt, Haemophilus influenzae Rd
uagcgaacaugcg

SEQ ID NO: 718898 - RNA, 15 nt, Haemophilus influenzae Rd
uagcgauaaaauaua

SEQ ID NO: 718899 - RNA, 18 nt, Haemophilus influenzae Rd
uagcucucguuguucuuu

SEQ ID NO: 718900 - RNA, 18 nt, Haemophilus influenzae Rd
uagcugauuuuuuaaagu

SEQ ID NO: 718901 - RNA, 22 nt, Haemophilus influenzae Rd
uagcugccgaauagauuuaaac

SEQ ID NO: 718902 - RNA, 20 nt, Haemophilus influenzae Rd
uagcuuaauagagaauaauu

SEQ ID NO: 718903 - RNA, 21 nt, Haemophilus influenzae Rd
uagcuucaucagccgcuuuuu

SEQ ID NO: 718904 - RNA, 17 nt, Haemophilus influenzae Rd
uagcuucaucuucauca

SEQ ID NO: 718905 - RNA, 14 nt, Haemophilus influenzae Rd
uagcuauuuuucaa

SEQ ID NO: 718906 - RNA, 16 nt, Haemophilus influenzae Rd
uagcuauuuuucaaua

SEQ ID NO: 718907 - RNA, 19 nt, Haemophilus influenzae Rd
uagcucagucgguuagagc

SEQ ID NO: 718908 - RNA, 16 nt, Haemophilus influenzae Rd
uagcgucuuuuugcac

SEQ ID NO: 718909 - RNA, 14 nt, Haemophilus influenzae Rd
uagcuaaaaauaau

SEQ ID NO: 718910 - RNA, 22 nt, Haemophilus influenzae Rd
uaggcaaaaacacucucagaau

SEQ ID NO: 718911 - RNA, 13 nt, Haemophilus influenzae Rd
uaggauuccacuu

SEQ ID NO: 718912 - RNA, 16 nt, Haemophilus influenzae Rd
uaggauugccuucaua

SEQ ID NO: 718913 - RNA, 22 nt, Haemophilus influenzae Rd
uaggauugccuucauauaauaa

SEQ ID NO: 718914 - RNA, 19 nt, Haemophilus influenzae Rd
uaggauuguugauuuuggu

SEQ ID NO: 718915 - RNA, 22 nt, Haemophilus influenzae Rd
uaggauuaacguaagaaauaac

SEQ ID NO: 718916 - RNA, 20 nt, Haemophilus influenzae Rd
uaggauuagcauaaaauuaa

SEQ ID NO: 718917 - RNA, 14 nt, Haemophilus influenzae Rd
uagcuucugccagc

SEQ ID NO: 718918 - RNA, 14 nt, Haemophilus influenzae Rd
uagcuugaauauuu

SEQ ID NO: 718919 - RNA, 18 nt, Haemophilus influenzae Rd
uagcuuuuuaauuguguu

SEQ ID NO: 718920 - RNA, 23 nt, Haemophilus influenzae Rd
uaggaauaacacaccaacaacga

SEQ ID NO: 718921 - RNA, 24 nt, Haemophilus influenzae Rd
uaggaaguaaauaguuauaagcgu

SEQ ID NO: 718922 - RNA, 21 nt, Haemophilus influenzae Rd
uagcaacgacacacuauuaau

SEQ ID NO: 718923 - RNA, 17 nt, Haemophilus influenzae Rd
uagcaaagaauuaaaau

SEQ ID NO: 718924 - RNA, 16 nt, Haemophilus influenzae Rd
uagcaaggcguucaau

SEQ ID NO: 718925 - RNA, 13 nt, Haemophilus influenzae Rd
uagcaauguuuuc

SEQ ID NO: 718926 - RNA, 20 nt, Haemophilus influenzae Rd
uagcaauaucugcuaauacu

SEQ ID NO: 718927 - RNA, 14 nt, Haemophilus influenzae Rd
uagcacauaaagac

SEQ ID NO: 718928 - RNA, 13 nt, Haemophilus influenzae Rd
uagcacaaucgca

SEQ ID NO: 718929 - RNA, 20 nt, Haemophilus influenzae Rd
uagcacaaucgcaucgucuu

SEQ ID NO: 718930 - RNA, 15 nt, Haemophilus influenzae Rd
uagcacagaaaagau

SEQ ID NO: 718931 - RNA, 22 nt, Haemophilus influenzae Rd
uagcacagaaaagauugcggca

SEQ ID NO: 718932 - RNA, 18 nt, Haemophilus influenzae Rd
uagcaaugccaaucuaaa

SEQ ID NO: 718933 - RNA, 14 nt, Haemophilus influenzae Rd
uagauuuuuauuca

SEQ ID NO: 718934 - RNA, 15 nt, Haemophilus influenzae Rd
uagauuugaaccuuc

SEQ ID NO: 718935 - RNA, 17 nt, Haemophilus influenzae Rd
uagauuugaaccuucac

SEQ ID NO: 718936 - RNA, 18 nt, Haemophilus influenzae Rd
uagauuugaaucaauuag

SEQ ID NO: 718937 - RNA, 13 nt, Haemophilus influenzae Rd
uagauuugacuuc

SEQ ID NO: 718938 - RNA, 13 nt, Haemophilus influenzae Rd
uagauuuaaacaa

SEQ ID NO: 718939 - RNA, 22 nt, Haemophilus influenzae Rd
uagauuuauuuacugauuuaaa

SEQ ID NO: 718940 - RNA, 14 nt, Haemophilus influenzae Rd
uagauuuauuucug

SEQ ID NO: 718941 - RNA, 17 nt, Haemophilus influenzae Rd
uagauuuucuuauuaua

SEQ ID NO: 718942 - RNA, 20 nt, Haemophilus influenzae Rd
uagcaaaaaaccuuggaaua

SEQ ID NO: 718943 - RNA, 17 nt, Haemophilus influenzae Rd
uagauuuuuuacucaaa

SEQ ID NO: 718944 - RNA, 21 nt, Haemophilus influenzae Rd
uagauuuucaucguuaauuaa

SEQ ID NO: 718945 - RNA, 17 nt, Haemophilus influenzae Rd
uagcacuuguuuuuagu

SEQ ID NO: 718946 - RNA, 13 nt, Haemophilus influenzae Rd
uagcauaaaacag

SEQ ID NO: 718947 - RNA, 20 nt, Haemophilus influenzae Rd
uagcauaaaacaguauuuuc

SEQ ID NO: 718948 - RNA, 13 nt, Haemophilus influenzae Rd
uagcauaauaaaa

SEQ ID NO: 718949 - RNA, 15 nt, Haemophilus influenzae Rd
uagcauaaaauuaac

SEQ ID NO: 718950 - RNA, 12 nt, Haemophilus influenzae Rd
uagcauagauau

SEQ ID NO: 718951 - RNA, 15 nt, Haemophilus influenzae Rd
uagcauagauauauu

SEQ ID NO: 718952 - RNA, 16 nt, Haemophilus influenzae Rd
uagcauagauauauug

SEQ ID NO: 718953 - RNA, 17 nt, Haemophilus influenzae Rd
uagcaucaaaauaaaua

SEQ ID NO: 718954 - RNA, 22 nt, Haemophilus influenzae Rd
uagcaucaaaauaaauaaaaua

SEQ ID NO: 718955 - RNA, 21 nt, Haemophilus influenzae Rd
uagcauuaaagucuaauauga

SEQ ID NO: 718956 - RNA, 23 nt, Haemophilus influenzae Rd
uagcauucccacgguuccaagca

SEQ ID NO: 718957 - RNA, 19 nt, Haemophilus influenzae Rd
uagccaaggauuugacaua

SEQ ID NO: 718958 - RNA, 22 nt, Haemophilus influenzae Rd
uagccaaaacgaauagaaauag

SEQ ID NO: 718959 - RNA, 17 nt, Haemophilus influenzae Rd
uagauacauaaaaaaca

SEQ ID NO: 718960 - RNA, 14 nt, Haemophilus influenzae Rd
uagauaauaaaaaa

SEQ ID NO: 718961 - RNA, 15 nt, Haemophilus influenzae Rd
uagauaauaaaaugg

SEQ ID NO: 718962 - RNA, 15 nt, Haemophilus influenzae Rd
uagauaauacagaaa

SEQ ID NO: 718963 - RNA, 14 nt, Haemophilus influenzae Rd
uagauaaauuucaa

SEQ ID NO: 718964 - RNA, 13 nt, Haemophilus influenzae Rd
uagauaacaaaag

SEQ ID NO: 718965 - RNA, 15 nt, Haemophilus influenzae Rd
uagauaacaaugaaa

SEQ ID NO: 718966 - RNA, 19 nt, Haemophilus influenzae Rd
uagauaacguucauauugu

SEQ ID NO: 718967 - RNA, 16 nt, Haemophilus influenzae Rd
uagauacaaaauguuu

SEQ ID NO: 718968 - RNA, 12 nt, Haemophilus influenzae Rd
uagauacaaaga

SEQ ID NO: 718969 - RNA, 18 nt, Haemophilus influenzae Rd
uagauacaagaaagaaau

SEQ ID NO: 718970 - RNA, 19 nt, Haemophilus influenzae Rd
uagauaaaguaguuuuagu

SEQ ID NO: 718971 - RNA, 13 nt, Haemophilus influenzae Rd
uagauaaauauau

SEQ ID NO: 718972 - RNA, 23 nt, Haemophilus influenzae Rd
uagauaaaauuaaucauaaaaau

SEQ ID NO: 718973 - RNA, 20 nt, Haemophilus influenzae Rd
uagauaaacgcuguuuugcu

SEQ ID NO: 718974 - RNA, 23 nt, Haemophilus influenzae Rd
uagauaaacgcuguuuugcuucc

SEQ ID NO: 718975 - RNA, 22 nt, Haemophilus influenzae Rd
uagagccaucacguucaaaaau

SEQ ID NO: 718976 - RNA, 16 nt, Haemophilus influenzae Rd
uagagccuacauuaga

SEQ ID NO: 718977 - RNA, 18 nt, Haemophilus influenzae Rd
uagagcagggauuuucau

SEQ ID NO: 718978 - RNA, 19 nt, Haemophilus influenzae Rd
uagagcaggggauugaaaa

SEQ ID NO: 718979 - RNA, 24 nt, Haemophilus influenzae Rd
uagagauuguaugaaaaaugcuug

SEQ ID NO: 718980 - RNA, 19 nt, Haemophilus influenzae Rd
uagagcucaauuauuuaua

SEQ ID NO: 718981 - RNA, 15 nt, Haemophilus influenzae Rd
uagagucaauccagu

SEQ ID NO: 718982 - RNA, 15 nt, Haemophilus influenzae Rd
uagaucgauuuuccu

SEQ ID NO: 718983 - RNA, 21 nt, Haemophilus influenzae Rd
uagaucgauuuuccucuuuua

SEQ ID NO: 718984 - RNA, 21 nt, Haemophilus influenzae Rd
uagaucagccccuuaauuauu

SEQ ID NO: 718985 - RNA, 23 nt, Haemophilus influenzae Rd
uagaucacaguugugaaaaaacg

SEQ ID NO: 718986 - RNA, 19 nt, Haemophilus influenzae Rd
uagaucauaaaaaaaugua

SEQ ID NO: 718987 - RNA, 20 nt, Haemophilus influenzae Rd
uagaucauaaaaaaauguag

SEQ ID NO: 718988 - RNA, 18 nt, Haemophilus influenzae Rd
uagauaugugaauaaaau

SEQ ID NO: 718989 - RNA, 22 nt, Haemophilus influenzae Rd
uagauagggauuuuuacuaaau

SEQ ID NO: 718990 - RNA, 20 nt, Haemophilus influenzae Rd
uagauauuauuuauuuugaa

SEQ ID NO: 718991 - RNA, 12 nt, Haemophilus influenzae Rd
uagauaguuuuc

SEQ ID NO: 718992 - RNA, 13 nt, Haemophilus influenzae Rd
uagauagagccaa

SEQ ID NO: 718993 - RNA, 21 nt, Haemophilus influenzae Rd
uagaugucggcuauuuaagau

SEQ ID NO: 718994 - RNA, 15 nt, Haemophilus influenzae Rd
uagauguauguggcg

SEQ ID NO: 718995 - RNA, 18 nt, Haemophilus influenzae Rd
uagaugacuggcaaaaau

SEQ ID NO: 718996 - RNA, 14 nt, Haemophilus influenzae Rd
uagaugaaaugccg

SEQ ID NO: 718997 - RNA, 16 nt, Haemophilus influenzae Rd
uagaugaagugaacuu

SEQ ID NO: 718998 - RNA, 17 nt, Haemophilus influenzae Rd
uagaugaauuagaaaaa

SEQ ID NO: 718999 - RNA, 17 nt, Haemophilus influenzae Rd
uagauucuaagguugcu

SEQ ID NO: 719000 - RNA, 15 nt, Haemophilus influenzae Rd
uagauugaaaaguaa

SEQ ID NO: 719001 - RNA, 19 nt, Haemophilus influenzae Rd
uagauguaacugaaacuaa

SEQ ID NO: 719002 - RNA, 16 nt, Haemophilus influenzae Rd
uagauuacguagaaaa

SEQ ID NO: 719003 - RNA, 24 nt, Haemophilus influenzae Rd
uagauuacguagaaaacaauaaaa

SEQ ID NO: 719004 - RNA, 16 nt, Haemophilus influenzae Rd
uagauuacuuuuagau

SEQ ID NO: 719005 - RNA, 22 nt, Haemophilus influenzae Rd
uagauuacacauuaacagaauu

SEQ ID NO: 719006 - RNA, 16 nt, Haemophilus influenzae Rd
uagauuacagagccua

SEQ ID NO: 719007 - RNA, 21 nt, Haemophilus influenzae Rd
uagauuagugugauuuuagaa

SEQ ID NO: 719008 - RNA, 17 nt, Haemophilus influenzae Rd
uagauuaucauuaaaua

SEQ ID NO: 719009 - RNA, 14 nt, Haemophilus influenzae Rd
uaccuaaaaaugcc

SEQ ID NO: 719010 - RNA, 15 nt, Haemophilus influenzae Rd
uaccuaaaaauuuaa

SEQ ID NO: 719011 - RNA, 17 nt, Haemophilus influenzae Rd
uaccuaaaaauuuaaau

SEQ ID NO: 719012 - RNA, 16 nt, Haemophilus influenzae Rd
uaccuauauacuuuuu

SEQ ID NO: 719013 - RNA, 16 nt, Haemophilus influenzae Rd
uaccuaauggauauag

SEQ ID NO: 719014 - RNA, 22 nt, Haemophilus influenzae Rd
uaccuaacauacugcuuucuag

SEQ ID NO: 719015 - RNA, 16 nt, Haemophilus influenzae Rd
uaccacuccccaaaaa

SEQ ID NO: 719016 - RNA, 16 nt, Haemophilus influenzae Rd
uaccacgauaaauccu

SEQ ID NO: 719017 - RNA, 22 nt, Haemophilus influenzae Rd
uaccacgauacggcaaauuaaa

SEQ ID NO: 719018 - RNA, 17 nt, Haemophilus influenzae Rd
uaccacgguugauacca

SEQ ID NO: 719019 - RNA, 17 nt, Haemophilus influenzae Rd
uaccaccgcuaaaucau

SEQ ID NO: 719020 - RNA, 17 nt, Haemophilus influenzae Rd
uaccaauucaaaaacca

SEQ ID NO: 719021 - RNA, 20 nt, Haemophilus influenzae Rd
uaccaauucaaaaaccaaac

SEQ ID NO: 719022 - RNA, 15 nt, Haemophilus influenzae Rd
uaccaaucacaacac

SEQ ID NO: 719023 - RNA, 23 nt, Haemophilus influenzae Rd
uaccaauagauugugaaauuuca

SEQ ID NO: 719024 - RNA, 17 nt, Haemophilus influenzae Rd
uaccuucgccuacuucu

SEQ ID NO: 719025 - RNA, 13 nt, Haemophilus influenzae Rd
uaccuucaaccac

SEQ ID NO: 719026 - RNA, 16 nt, Haemophilus influenzae Rd
uaccuugcauuucuuu

SEQ ID NO: 719027 - RNA, 22 nt, Haemophilus influenzae Rd
uaccuuguggcaguaaaggcac

SEQ ID NO: 719028 - RNA, 18 nt, Haemophilus influenzae Rd
uaccuuguucgacaauuu

SEQ ID NO: 719029 - RNA, 15 nt, Haemophilus influenzae Rd
uaccuuuaagcauug

SEQ ID NO: 719030 - RNA, 14 nt, Haemophilus influenzae Rd
uaccuuuuucuacc

SEQ ID NO: 719031 - RNA, 18 nt, Haemophilus influenzae Rd
uaccugguugcauaaaau

SEQ ID NO: 719032 - RNA, 19 nt, Haemophilus influenzae Rd
uaccugguugcauaaaauc

SEQ ID NO: 719033 - RNA, 15 nt, Haemophilus influenzae Rd
uaccuguugcauuag

SEQ ID NO: 719034 - RNA, 18 nt, Haemophilus influenzae Rd
uaccugugcauugcuauu

SEQ ID NO: 719035 - RNA, 14 nt, Haemophilus influenzae Rd
uaccuuaauuaauc

SEQ ID NO: 719036 - RNA, 20 nt, Haemophilus influenzae Rd
uaccuuagccaaaucaucua

SEQ ID NO: 719037 - RNA, 15 nt, Haemophilus influenzae Rd
uaccugaugaaauca

SEQ ID NO: 719038 - RNA, 22 nt, Haemophilus influenzae Rd
uaccugaugaaaucauuacaca

SEQ ID NO: 719039 - RNA, 18 nt, Haemophilus influenzae Rd
uaccugauucauugcauu

SEQ ID NO: 719040 - RNA, 17 nt, Haemophilus influenzae Rd
uacgcugaauagcaaau

SEQ ID NO: 719041 - RNA, 17 nt, Haemophilus influenzae Rd
uacgcuuacucauuuau

SEQ ID NO: 719042 - RNA, 23 nt, Haemophilus influenzae Rd
uacgcuuggaaauguuuaauuau

SEQ ID NO: 719043 - RNA, 18 nt, Haemophilus influenzae Rd
uacgcuuuacuacaucag

SEQ ID NO: 719044 - RNA, 21 nt, Haemophilus influenzae Rd
uacgaucugcaucuaauucac

SEQ ID NO: 719045 - RNA, 20 nt, Haemophilus influenzae Rd
uacgauaaugccauuugcuu

SEQ ID NO: 719046 - RNA, 14 nt, Haemophilus influenzae Rd
uacgaauugguucu

SEQ ID NO: 719047 - RNA, 20 nt, Haemophilus influenzae Rd
uacgaauuguaccuucugcu

SEQ ID NO: 719048 - RNA, 20 nt, Haemophilus influenzae Rd
uacgaucacgauuuuucucu

SEQ ID NO: 719049 - RNA, 18 nt, Haemophilus influenzae Rd
uacgauacuuuuaauuaa

SEQ ID NO: 719050 - RNA, 19 nt, Haemophilus influenzae Rd
uacgauacuuuuaauuaaa

SEQ ID NO: 719051 - RNA, 16 nt, Haemophilus influenzae Rd
uacgauaguaaaaaau

SEQ ID NO: 719052 - RNA, 15 nt, Haemophilus influenzae Rd
uacguguucaucauc

SEQ ID NO: 719053 - RNA, 20 nt, Haemophilus influenzae Rd
uacgugcaaauaaauuuggu

SEQ ID NO: 719054 - RNA, 15 nt, Haemophilus influenzae Rd
uacguggcucaucca

SEQ ID NO: 719055 - RNA, 16 nt, Haemophilus influenzae Rd
uacuauacacaucaga

SEQ ID NO: 719056 - RNA, 16 nt, Haemophilus influenzae Rd
uacuauaggaauauca

SEQ ID NO: 719057 - RNA, 16 nt, Haemophilus influenzae Rd
uacguuuuguuuuaau

SEQ ID NO: 719058 - RNA, 19 nt, Haemophilus influenzae Rd
uacguuguuguucuuucca

SEQ ID NO: 719059 - RNA, 12 nt, Haemophilus influenzae Rd
uacguuucacua

SEQ ID NO: 719060 - RNA, 16 nt, Haemophilus influenzae Rd
uacguucauauaaauu

SEQ ID NO: 719061 - RNA, 21 nt, Haemophilus influenzae Rd
uacguugaguauagucauuca

SEQ ID NO: 719062 - RNA, 15 nt, Haemophilus influenzae Rd
uacguuuaguaaaau

SEQ ID NO: 719063 - RNA, 17 nt, Haemophilus influenzae Rd
uacucauaucuaaagca

SEQ ID NO: 719064 - RNA, 20 nt, Haemophilus influenzae Rd
uacucauaucuaaagcauua

SEQ ID NO: 719065 - RNA, 20 nt, Haemophilus influenzae Rd
uacucauuuaucaaacaagc

SEQ ID NO: 719066 - RNA, 21 nt, Haemophilus influenzae Rd
uacucacagagccuuuuucua

SEQ ID NO: 719067 - RNA, 15 nt, Haemophilus influenzae Rd
uagaagccaaaucau

SEQ ID NO: 719068 - RNA, 19 nt, Haemophilus influenzae Rd
uagaacguuuuuuacuugc

SEQ ID NO: 719069 - RNA, 16 nt, Haemophilus influenzae Rd
uagaacgcacacaaca

SEQ ID NO: 719070 - RNA, 19 nt, Haemophilus influenzae Rd
uagaaccgucuuuaaauag

SEQ ID NO: 719071 - RNA, 16 nt, Haemophilus influenzae Rd
uagaacgguuaugaaa

SEQ ID NO: 719072 - RNA, 15 nt, Haemophilus influenzae Rd
uagaacaauauuuau

SEQ ID NO: 719073 - RNA, 22 nt, Haemophilus influenzae Rd
uagaacaacaauacguugaacu

SEQ ID NO: 719074 - RNA, 20 nt, Haemophilus influenzae Rd
uagaaauuuuggcuuaauua

SEQ ID NO: 719075 - RNA, 19 nt, Haemophilus influenzae Rd
uagaaauugccauauaagc

SEQ ID NO: 719076 - RNA, 20 nt, Haemophilus influenzae Rd
uagaaauugccauauaagca

SEQ ID NO: 719077 - RNA, 19 nt, Haemophilus influenzae Rd
uagaaauucgauugcauuu

SEQ ID NO: 719078 - RNA, 22 nt, Haemophilus influenzae Rd
uagaaauucgauugcauuuuuu

SEQ ID NO: 719079 - RNA, 15 nt, Haemophilus influenzae Rd
uagaaguaaauucag

SEQ ID NO: 719080 - RNA, 23 nt, Haemophilus influenzae Rd
uagaauaaaccaaugagaaaaag

SEQ ID NO: 719081 - RNA, 14 nt, Haemophilus influenzae Rd
uagaauaaauuaaa

SEQ ID NO: 719082 - RNA, 18 nt, Haemophilus influenzae Rd
uagaauaacaacaaaagu

SEQ ID NO: 719083 - RNA, 13 nt, Haemophilus influenzae Rd
uagaauauuuugc

SEQ ID NO: 719084 - RNA, 14 nt, Haemophilus influenzae Rd
uagaauauuuugca

SEQ ID NO: 719085 - RNA, 15 nt, Haemophilus influenzae Rd
uagaauauuuugcau

SEQ ID NO: 719086 - RNA, 17 nt, Haemophilus influenzae Rd
uagaauguaaauuauuu

SEQ ID NO: 719087 - RNA, 12 nt, Haemophilus influenzae Rd
uagaaugcaaac

SEQ ID NO: 719088 - RNA, 16 nt, Haemophilus influenzae Rd
uagaaugcaacaagua

SEQ ID NO: 719089 - RNA, 15 nt, Haemophilus influenzae Rd
uagaaucaauggcuu

SEQ ID NO: 719090 - RNA, 13 nt, Haemophilus influenzae Rd
uagaaugaaaaac

SEQ ID NO: 719091 - RNA, 17 nt, Haemophilus influenzae Rd
uagaaugaaaaacauuc

SEQ ID NO: 719092 - RNA, 17 nt, Haemophilus influenzae Rd
uagacuaugaaaucaag

SEQ ID NO: 719093 - RNA, 15 nt, Haemophilus influenzae Rd
uagacuuaauaauau

SEQ ID NO: 719094 - RNA, 18 nt, Haemophilus influenzae Rd
uagacucguuuuuuauuu

SEQ ID NO: 719095 - RNA, 15 nt, Haemophilus influenzae Rd
uagacgauugccuuu

SEQ ID NO: 719096 - RNA, 23 nt, Haemophilus influenzae Rd
uagacuucaagugauuauuucuc

SEQ ID NO: 719097 - RNA, 19 nt, Haemophilus influenzae Rd
uagacagacuauuucugua

SEQ ID NO: 719098 - RNA, 21 nt, Haemophilus influenzae Rd
uagacagacuauuucuguauu

SEQ ID NO: 719099 - RNA, 16 nt, Haemophilus influenzae Rd
uagacaacuaacauuu

SEQ ID NO: 719100 - RNA, 19 nt, Haemophilus influenzae Rd
uagacaauauugaaauaag

SEQ ID NO: 719101 - RNA, 14 nt, Haemophilus influenzae Rd
uagaauuuuuauuu

SEQ ID NO: 719102 - RNA, 23 nt, Haemophilus influenzae Rd
uagaauuuuaccgcacuuuauua

SEQ ID NO: 719103 - RNA, 20 nt, Haemophilus influenzae Rd
uagaaaagacaauaauucag

SEQ ID NO: 719104 - RNA, 15 nt, Haemophilus influenzae Rd
uagaaaacucaucca

SEQ ID NO: 719105 - RNA, 14 nt, Haemophilus influenzae Rd
uagaaaaauuggua

SEQ ID NO: 719106 - RNA, 22 nt, Haemophilus influenzae Rd
uagaaaaauugguacgagaaaa

SEQ ID NO: 719107 - RNA, 14 nt, Haemophilus influenzae Rd
uagaaaaauuuaau

SEQ ID NO: 719108 - RNA, 18 nt, Haemophilus influenzae Rd
uagaaaaagaaaaccugc

SEQ ID NO: 719109 - RNA, 23 nt, Haemophilus influenzae Rd
uacuuuuugacccgcuuuuaaug

SEQ ID NO: 719110 - RNA, 14 nt, Haemophilus influenzae Rd
uacuuuuuuaagua

SEQ ID NO: 719111 - RNA, 21 nt, Haemophilus influenzae Rd
uacuuuuuuaccuucagcacu

SEQ ID NO: 719112 - RNA, 23 nt, Haemophilus influenzae Rd
uacuuuuuuugcgcuuucaauuu

SEQ ID NO: 719113 - RNA, 15 nt, Haemophilus influenzae Rd
uacuuucuuucaaua

SEQ ID NO: 719114 - RNA, 17 nt, Haemophilus influenzae Rd
uacuuugcgccuguacu

SEQ ID NO: 719115 - RNA, 20 nt, Haemophilus influenzae Rd
uacuuuuaacacuuuuucac

SEQ ID NO: 719116 - RNA, 14 nt, Haemophilus influenzae Rd
uacuuuugauuuua

SEQ ID NO: 719117 - RNA, 13 nt, Haemophilus influenzae Rd
uacuuuugcuuca

SEQ ID NO: 719118 - RNA, 16 nt, Haemophilus influenzae Rd
uacuuuuuaauaaauc

SEQ ID NO: 719119 - RNA, 21 nt, Haemophilus influenzae Rd
uacuuuuuauuuuugauuuag

SEQ ID NO: 719120 - RNA, 16 nt, Haemophilus influenzae Rd
uacuuuuagaauaaau

SEQ ID NO: 719121 - RNA, 16 nt, Haemophilus influenzae Rd
uacuuuuauaaagauc

SEQ ID NO: 719122 - RNA, 14 nt, Haemophilus influenzae Rd
uacuuuuauaucua

SEQ ID NO: 719123 - RNA, 14 nt, Haemophilus influenzae Rd
uagaaaaucagauu

SEQ ID NO: 719124 - RNA, 19 nt, Haemophilus influenzae Rd
uagaaaccaauaauuucau

SEQ ID NO: 719125 - RNA, 18 nt, Haemophilus influenzae Rd
uagaaacagaaguauuua

SEQ ID NO: 719126 - RNA, 17 nt, Haemophilus influenzae Rd
uagaaaaucgcaauaaa

SEQ ID NO: 719127 - RNA, 12 nt, Haemophilus influenzae Rd
uagaaaauagaa

SEQ ID NO: 719128 - RNA, 15 nt, Haemophilus influenzae Rd
uagaaagaauauuua

SEQ ID NO: 719129 - RNA, 23 nt, Haemophilus influenzae Rd
uagaaacuuuccauacccuugcu

SEQ ID NO: 719130 - RNA, 14 nt, Haemophilus influenzae Rd
uagaaaguggcuua

SEQ ID NO: 719131 - RNA, 20 nt, Haemophilus influenzae Rd
uagaaauacauuauuaaaag

SEQ ID NO: 719132 - RNA, 14 nt, Haemophilus influenzae Rd
uagaaauaaagaua

SEQ ID NO: 719133 - RNA, 17 nt, Haemophilus influenzae Rd
uagaaaucaaaaaugcu

SEQ ID NO: 719134 - RNA, 18 nt, Haemophilus influenzae Rd
uagaaaugaucaaaucaa

SEQ ID NO: 719135 - RNA, 14 nt, Haemophilus influenzae Rd
uacuggcucuucuu

SEQ ID NO: 719136 - RNA, 13 nt, Haemophilus influenzae Rd
uacucgaauuauu

SEQ ID NO: 719137 - RNA, 20 nt, Haemophilus influenzae Rd
uacugucgaaccaaguugga

SEQ ID NO: 719138 - RNA, 12 nt, Haemophilus influenzae Rd
uacuuaaaucuu

SEQ ID NO: 719139 - RNA, 13 nt, Haemophilus influenzae Rd
uacugucaaucca

SEQ ID NO: 719140 - RNA, 18 nt, Haemophilus influenzae Rd
uacugucaauccaugcca

SEQ ID NO: 719141 - RNA, 16 nt, Haemophilus influenzae Rd
uacugucacaauauuu

SEQ ID NO: 719142 - RNA, 13 nt, Haemophilus influenzae Rd
uacuuagauaaau

SEQ ID NO: 719143 - RNA, 15 nt, Haemophilus influenzae Rd
uacuuaaucaaauaa

SEQ ID NO: 719144 - RNA, 20 nt, Haemophilus influenzae Rd
uacuuaauugauuuuaaaga

SEQ ID NO: 719145 - RNA, 16 nt, Haemophilus influenzae Rd
uacuuuacguaaagua

SEQ ID NO: 719146 - RNA, 15 nt, Haemophilus influenzae Rd
uacuuucuaauuauu

SEQ ID NO: 719147 - RNA, 17 nt, Haemophilus influenzae Rd
uacuuguuuaugucuaa

SEQ ID NO: 719148 - RNA, 13 nt, Haemophilus influenzae Rd
uacuuuaaagaau

SEQ ID NO: 719149 - RNA, 20 nt, Haemophilus influenzae Rd
uacuuuaaagaauauucuuu

SEQ ID NO: 719150 - RNA, 15 nt, Haemophilus influenzae Rd
uacuuguucaaaaau

SEQ ID NO: 719151 - RNA, 17 nt, Haemophilus influenzae Rd
uacuuguucaaaaauuu

SEQ ID NO: 719152 - RNA, 17 nt, Haemophilus influenzae Rd
uacuuccacuaguucau

SEQ ID NO: 719153 - RNA, 21 nt, Haemophilus influenzae Rd
uacuuagcgugcuaauuccaa

SEQ ID NO: 719154 - RNA, 19 nt, Haemophilus influenzae Rd
uacuuggaaacggaaaaug

SEQ ID NO: 719155 - RNA, 14 nt, Haemophilus influenzae Rd
uacuuggaauauca

SEQ ID NO: 719156 - RNA, 14 nt, Haemophilus influenzae Rd
uacuuggaugaaau

SEQ ID NO: 719157 - RNA, 16 nt, Haemophilus influenzae Rd
uacuucuaaaggcuaa

SEQ ID NO: 719158 - RNA, 22 nt, Haemophilus influenzae Rd
uacuucuagaaaauaaccaaua

SEQ ID NO: 719159 - RNA, 14 nt, Haemophilus influenzae Rd
uaaucucuucuaaa

SEQ ID NO: 719160 - RNA, 16 nt, Haemophilus influenzae Rd
uaaucugaauuuccau

SEQ ID NO: 719161 - RNA, 16 nt, Haemophilus influenzae Rd
uaaucugauaaauuuu

SEQ ID NO: 719162 - RNA, 12 nt, Haemophilus influenzae Rd
uaaucucccaaa

SEQ ID NO: 719163 - RNA, 14 nt, Haemophilus influenzae Rd
uaaucuauuucuuu

SEQ ID NO: 719164 - RNA, 22 nt, Haemophilus influenzae Rd
uaaucuauuucuuugaguaaaa

SEQ ID NO: 719165 - RNA, 18 nt, Haemophilus influenzae Rd
uaaucgugccugccacca

SEQ ID NO: 719166 - RNA, 12 nt, Haemophilus influenzae Rd
uaaucuacaaaa

SEQ ID NO: 719167 - RNA, 14 nt, Haemophilus influenzae Rd
uaaucuacaaaaca

SEQ ID NO: 719168 - RNA, 14 nt, Haemophilus influenzae Rd
uaaucguuuuucca

SEQ ID NO: 719169 - RNA, 16 nt, Haemophilus influenzae Rd
uaaucuaaaaauuaac

SEQ ID NO: 719170 - RNA, 16 nt, Haemophilus influenzae Rd
uaaucggauguuugaa

SEQ ID NO: 719171 - RNA, 15 nt, Haemophilus influenzae Rd
uaaucggcaauguuu

SEQ ID NO: 719172 - RNA, 17 nt, Haemophilus influenzae Rd
uaaucggcaauguuuua

SEQ ID NO: 719173 - RNA, 18 nt, Haemophilus influenzae Rd
uaaucggcaauguuuuaa

SEQ ID NO: 719174 - RNA, 22 nt, Haemophilus influenzae Rd
uaaucgguuguuuuuuaauauc

SEQ ID NO: 719175 - RNA, 15 nt, Haemophilus influenzae Rd
uaaucgggauaacuu

SEQ ID NO: 719176 - RNA, 16 nt, Haemophilus influenzae Rd
uaaucguagaaaucaa

SEQ ID NO: 719177 - RNA, 23 nt, Haemophilus influenzae Rd
uaaucguagaaaucaaaaaugcu

SEQ ID NO: 719178 - RNA, 16 nt, Haemophilus influenzae Rd
uaaucguccaauuuca

SEQ ID NO: 719179 - RNA, 22 nt, Haemophilus influenzae Rd
uaauccugcgugaaugacuuuc

SEQ ID NO: 719180 - RNA, 15 nt, Haemophilus influenzae Rd
uaauccuaguuuuuu

SEQ ID NO: 719181 - RNA, 15 nt, Haemophilus influenzae Rd
uaauccuaaaaugcu

SEQ ID NO: 719182 - RNA, 14 nt, Haemophilus influenzae Rd
uaauccuaaauuau

SEQ ID NO: 719183 - RNA, 14 nt, Haemophilus influenzae Rd
uaaucgaaaucaca

SEQ ID NO: 719184 - RNA, 16 nt, Haemophilus influenzae Rd
uaaucgcccuuuuguu

SEQ ID NO: 719185 - RNA, 14 nt, Haemophilus influenzae Rd
uaaucgccccaaaa

SEQ ID NO: 719186 - RNA, 20 nt, Haemophilus influenzae Rd
uaaucgcucugcaagacuau

SEQ ID NO: 719187 - RNA, 21 nt, Haemophilus influenzae Rd
uaacgauaagauuugcuuuuu

SEQ ID NO: 719188 - RNA, 18 nt, Haemophilus influenzae Rd
uaacgauauguuaauaag

SEQ ID NO: 719189 - RNA, 15 nt, Haemophilus influenzae Rd
uaacgauauucagug

SEQ ID NO: 719190 - RNA, 16 nt, Haemophilus influenzae Rd
uaacgacgggaaacug

SEQ ID NO: 719191 - RNA, 17 nt, Haemophilus influenzae Rd
uaauccguuaauuucau

SEQ ID NO: 719192 - RNA, 17 nt, Haemophilus influenzae Rd
uaacgauguugcaaccu

SEQ ID NO: 719193 - RNA, 17 nt, Haemophilus influenzae Rd
uaaugaaccaaaucuaa

SEQ ID NO: 719194 - RNA, 18 nt, Haemophilus influenzae Rd
uaaugaaacuucaccagu

SEQ ID NO: 719195 - RNA, 20 nt, Haemophilus influenzae Rd
uaaucuggugcuuguuuuaa

SEQ ID NO: 719196 - RNA, 21 nt, Haemophilus influenzae Rd
uaaucugucacgagcuaaaaa

SEQ ID NO: 719197 - RNA, 22 nt, Haemophilus influenzae Rd
uaaucugucacgagcuaaaaaa

SEQ ID NO: 719198 - RNA, 20 nt, Haemophilus influenzae Rd
uaaucuuaaagaauuucuuu

SEQ ID NO: 719199 - RNA, 13 nt, Haemophilus influenzae Rd
uaaucuugaccaa

SEQ ID NO: 719200 - RNA, 12 nt, Haemophilus influenzae Rd
uaaucuucuucc

SEQ ID NO: 719201 - RNA, 13 nt, Haemophilus influenzae Rd
uaaucuucuuccc

SEQ ID NO: 719202 - RNA, 13 nt, Haemophilus influenzae Rd
uaaucuuuaaaau

SEQ ID NO: 719203 - RNA, 21 nt, Haemophilus influenzae Rd
uaaucuuucacugcauuuucu

SEQ ID NO: 719204 - RNA, 23 nt, Haemophilus influenzae Rd
uaaucuuuuacaccguccaaggu

SEQ ID NO: 719205 - RNA, 15 nt, Haemophilus influenzae Rd
uaaugcuucuaaucc

SEQ ID NO: 719206 - RNA, 16 nt, Haemophilus influenzae Rd
uaaugcuuuaaauugu

SEQ ID NO: 719207 - RNA, 17 nt, Haemophilus influenzae Rd
uaaugcuuuaauuuguu

SEQ ID NO: 719208 - RNA, 23 nt, Haemophilus influenzae Rd
uaaugcuucuguugcuucaauug

SEQ ID NO: 719209 - RNA, 23 nt, Haemophilus influenzae Rd
uaaugcuguuuaaaucuaagccu

SEQ ID NO: 719210 - RNA, 16 nt, Haemophilus influenzae Rd
uaauggacggaaugaa

SEQ ID NO: 719211 - RNA, 19 nt, Haemophilus influenzae Rd
uaauggauauagaaaucau

SEQ ID NO: 719212 - RNA, 22 nt, Haemophilus influenzae Rd
uaauggagguuuuacauauaaa

SEQ ID NO: 719213 - RNA, 14 nt, Haemophilus influenzae Rd
uaauggcaauucgu

SEQ ID NO: 719214 - RNA, 20 nt, Haemophilus influenzae Rd
uaaugccauugcgugaauau

SEQ ID NO: 719215 - RNA, 23 nt, Haemophilus influenzae Rd
uaaugccauuggacacaauaaua

SEQ ID NO: 719216 - RNA, 22 nt, Haemophilus influenzae Rd
uaaugacauuaaagcaauugcu

SEQ ID NO: 719217 - RNA, 16 nt, Haemophilus influenzae Rd
uaauuucgaucucaga

SEQ ID NO: 719218 - RNA, 12 nt, Haemophilus influenzae Rd
uaauuuauacua

SEQ ID NO: 719219 - RNA, 18 nt, Haemophilus influenzae Rd
uaauuucucugcgcacuu

SEQ ID NO: 719220 - RNA, 14 nt, Haemophilus influenzae Rd
uaauuucguagaga

SEQ ID NO: 719221 - RNA, 19 nt, Haemophilus influenzae Rd
uaauuucccuaaaaucuuc

SEQ ID NO: 719222 - RNA, 22 nt, Haemophilus influenzae Rd
uaauuuacguaaugcuuuugcu

SEQ ID NO: 719223 - RNA, 23 nt, Haemophilus influenzae Rd
uaauuuacguaucgcuaagaaua

SEQ ID NO: 719224 - RNA, 18 nt, Haemophilus influenzae Rd
uaauuuacuggaaauucu

SEQ ID NO: 719225 - RNA, 22 nt, Haemophilus influenzae Rd
uaauuuacuggaaauucuucaa

SEQ ID NO: 719226 - RNA, 20 nt, Haemophilus influenzae Rd
uaauuuagaaaaagaaaacc

SEQ ID NO: 719227 - RNA, 13 nt, Haemophilus influenzae Rd
uaauuuagucaua

SEQ ID NO: 719228 - RNA, 23 nt, Haemophilus influenzae Rd
uaauuguugguuacuaaauguga

SEQ ID NO: 719229 - RNA, 18 nt, Haemophilus influenzae Rd
uaauuuaaaaaguaguau

SEQ ID NO: 719230 - RNA, 22 nt, Haemophilus influenzae Rd
uaauuuaacauaacuuuccaua

SEQ ID NO: 719231 - RNA, 15 nt, Haemophilus influenzae Rd
uaauuuaagaaaaac

SEQ ID NO: 719232 - RNA, 14 nt, Haemophilus influenzae Rd
uaauuguuuuaaaa

SEQ ID NO: 719233 - RNA, 19 nt, Haemophilus influenzae Rd
uaauuggcgaaggcaaauc

SEQ ID NO: 719234 - RNA, 16 nt, Haemophilus influenzae Rd
uaauugguaaaauuaa

SEQ ID NO: 719235 - RNA, 22 nt, Haemophilus influenzae Rd
uaauugguaaucaaauucugug

SEQ ID NO: 719236 - RNA, 15 nt, Haemophilus influenzae Rd
uaauuggaaaaguaa

SEQ ID NO: 719237 - RNA, 18 nt, Haemophilus influenzae Rd
uaauuggaaaaguaagaa

SEQ ID NO: 719238 - RNA, 17 nt, Haemophilus influenzae Rd
uaauugugauaaaugug

SEQ ID NO: 719239 - RNA, 14 nt, Haemophilus influenzae Rd
uaauugugcaauuu

SEQ ID NO: 719240 - RNA, 20 nt, Haemophilus influenzae Rd
uaauugugcggauuuaucuu

SEQ ID NO: 719241 - RNA, 15 nt, Haemophilus influenzae Rd
uaauugugcuaaaua

SEQ ID NO: 719242 - RNA, 19 nt, Haemophilus influenzae Rd
uaauugacaauuaauauaa

SEQ ID NO: 719243 - RNA, 17 nt, Haemophilus influenzae Rd
uaauugaauuguguaag

SEQ ID NO: 719244 - RNA, 19 nt, Haemophilus influenzae Rd
uaauugcugggcaauauaa

SEQ ID NO: 719245 - RNA, 18 nt, Haemophilus influenzae Rd
uaauugaaauuuaucuaa

SEQ ID NO: 719246 - RNA, 14 nt, Haemophilus influenzae Rd
uaauucuugccaga

SEQ ID NO: 719247 - RNA, 22 nt, Haemophilus influenzae Rd
uaauucuugaccgauuaauuca

SEQ ID NO: 719248 - RNA, 23 nt, Haemophilus influenzae Rd
uaauucuugaccgauuaauucaa

SEQ ID NO: 719249 - RNA, 20 nt, Haemophilus influenzae Rd
uaauucuugucuuuuaaguu

SEQ ID NO: 719250 - RNA, 23 nt, Haemophilus influenzae Rd
uaauucuuuuucacuauuaccgc

SEQ ID NO: 719251 - RNA, 18 nt, Haemophilus influenzae Rd
uaauucugcuaaaucugu

SEQ ID NO: 719252 - RNA, 22 nt, Haemophilus influenzae Rd
uaauucacgaauguuuucgauc

SEQ ID NO: 719253 - RNA, 17 nt, Haemophilus influenzae Rd
uaauucagcaaaaagug

SEQ ID NO: 719254 - RNA, 14 nt, Haemophilus influenzae Rd
uaauucagcaagaa

SEQ ID NO: 719255 - RNA, 18 nt, Haemophilus influenzae Rd
uaauucaagaugauauuu

SEQ ID NO: 719256 - RNA, 19 nt, Haemophilus influenzae Rd
uaauucagggauuaagaaa

SEQ ID NO: 719257 - RNA, 19 nt, Haemophilus influenzae Rd
uaauucaggugggaaauaa

SEQ ID NO: 719258 - RNA, 22 nt, Haemophilus influenzae Rd
uaauucaggugggaaauaauuu

SEQ ID NO: 719259 - RNA, 21 nt, Haemophilus influenzae Rd
uaauucagcgagagaauauuu

SEQ ID NO: 719260 - RNA, 22 nt, Haemophilus influenzae Rd
uaauucagcgagagaauauuua

SEQ ID NO: 719261 - RNA, 13 nt, Haemophilus influenzae Rd
uaauucagcggca

SEQ ID NO: 719262 - RNA, 17 nt, Haemophilus influenzae Rd
uaauucagcuaaacauu

SEQ ID NO: 719263 - RNA, 15 nt, Haemophilus influenzae Rd
uaauuaguggaugua

SEQ ID NO: 719264 - RNA, 17 nt, Haemophilus influenzae Rd
uaauuauaaaauagccu

SEQ ID NO: 719265 - RNA, 12 nt, Haemophilus influenzae Rd
uaauuauauuuu

SEQ ID NO: 719266 - RNA, 17 nt, Haemophilus influenzae Rd
uaauuaucaaaaagaaa

SEQ ID NO: 719267 - RNA, 19 nt, Haemophilus influenzae Rd
uaauuaucaaaaagaaaua

SEQ ID NO: 719268 - RNA, 18 nt, Haemophilus influenzae Rd
uaauuaucaacaucaacu

SEQ ID NO: 719269 - RNA, 16 nt, Haemophilus influenzae Rd
uaauucuccaccuuga

SEQ ID NO: 719270 - RNA, 18 nt, Haemophilus influenzae Rd
uaauucuccaccuugauu

SEQ ID NO: 719271 - RNA, 15 nt, Haemophilus influenzae Rd
uaauucugcccuuuu

SEQ ID NO: 719272 - RNA, 22 nt, Haemophilus influenzae Rd
uaauucugcccuuuuucaauua

SEQ ID NO: 719273 - RNA, 14 nt, Haemophilus influenzae Rd
uaauucuacaccag

SEQ ID NO: 719274 - RNA, 21 nt, Haemophilus influenzae Rd
uaauucuacaccagcuuuaac

SEQ ID NO: 719275 - RNA, 19 nt, Haemophilus influenzae Rd
uaauucuaaauucucaaga

SEQ ID NO: 719276 - RNA, 20 nt, Haemophilus influenzae Rd
uaauucuaaauucucaagaa

SEQ ID NO: 719277 - RNA, 17 nt, Haemophilus influenzae Rd
uaauucauugaguuuag

SEQ ID NO: 719278 - RNA, 19 nt, Haemophilus influenzae Rd
uaauucauugaguuuaguc

SEQ ID NO: 719279 - RNA, 19 nt, Haemophilus influenzae Rd
uaauucauuacauaauacu

SEQ ID NO: 719280 - RNA, 22 nt, Haemophilus influenzae Rd
uaauucgggauaaggcagaaau

SEQ ID NO: 719281 - RNA, 15 nt, Haemophilus influenzae Rd
uaauucguuucuugg

SEQ ID NO: 719282 - RNA, 17 nt, Haemophilus influenzae Rd
uaauggcgauaauuauu

SEQ ID NO: 719283 - RNA, 13 nt, Haemophilus influenzae Rd
uaaugguuugcug

SEQ ID NO: 719284 - RNA, 22 nt, Haemophilus influenzae Rd
uaauuaaauaaacauuaugaaa

SEQ ID NO: 719285 - RNA, 23 nt, Haemophilus influenzae Rd
uaauuaaauaaacauuaugaaaa

SEQ ID NO: 719286 - RNA, 19 nt, Haemophilus influenzae Rd
uaauuaaauucauuuaaaa

SEQ ID NO: 719287 - RNA, 12 nt, Haemophilus influenzae Rd
uaauuaacaaau

SEQ ID NO: 719288 - RNA, 15 nt, Haemophilus influenzae Rd
uaauggguuaaaagc

SEQ ID NO: 719289 - RNA, 18 nt, Haemophilus influenzae Rd
uaauggguuaaaagccaa

SEQ ID NO: 719290 - RNA, 21 nt, Haemophilus influenzae Rd
uaaugguuguaaauuuucaau

SEQ ID NO: 719291 - RNA, 22 nt, Haemophilus influenzae Rd
uaauuagguucgcuauguuuaa

SEQ ID NO: 719292 - RNA, 22 nt, Haemophilus influenzae Rd
uaauuaacgugcauuuuuauga

SEQ ID NO: 719293 - RNA, 23 nt, Haemophilus influenzae Rd
uaauuaagagaggagaaauaauc

SEQ ID NO: 719294 - RNA, 18 nt, Haemophilus influenzae Rd
uaauuaacugaaaauuag

SEQ ID NO: 719295 - RNA, 17 nt, Haemophilus influenzae Rd
uacagcucaaaaugcuc

SEQ ID NO: 719296 - RNA, 19 nt, Haemophilus influenzae Rd
uacagcuuguuucaucauu

SEQ ID NO: 719297 - RNA, 23 nt, Haemophilus influenzae Rd
uacagcuuguuucaucauucugg

SEQ ID NO: 719298 - RNA, 17 nt, Haemophilus influenzae Rd
uaccaauaacuaaaaau

SEQ ID NO: 719299 - RNA, 20 nt, Haemophilus influenzae Rd
uaccaaaaggugguuuugca

SEQ ID NO: 719300 - RNA, 17 nt, Haemophilus influenzae Rd
uaccaagauaauaaagu

SEQ ID NO: 719301 - RNA, 13 nt, Haemophilus influenzae Rd
uaccaaaauuuaa

SEQ ID NO: 719302 - RNA, 15 nt, Haemophilus influenzae Rd
uaccaaaauuuaaaa

SEQ ID NO: 719303 - RNA, 20 nt, Haemophilus influenzae Rd
uacauuuuugauugcaccua

SEQ ID NO: 719304 - RNA, 18 nt, Haemophilus influenzae Rd
uacauuugacgaauggca

SEQ ID NO: 719305 - RNA, 20 nt, Haemophilus influenzae Rd
uacauuugccccaacaacau

SEQ ID NO: 719306 - RNA, 16 nt, Haemophilus influenzae Rd
uacauuuggcaaaaua

SEQ ID NO: 719307 - RNA, 17 nt, Haemophilus influenzae Rd
uacauuuggcaaaauaa

SEQ ID NO: 719308 - RNA, 17 nt, Haemophilus influenzae Rd
uacauuuuguuucuaaa

SEQ ID NO: 719309 - RNA, 18 nt, Haemophilus influenzae Rd
uacauuguuucaaucacu

SEQ ID NO: 719310 - RNA, 20 nt, Haemophilus influenzae Rd
uacauuuaaccaaaacguca

SEQ ID NO: 719311 - RNA, 15 nt, Haemophilus influenzae Rd
uacauuucuaaaaua

SEQ ID NO: 719312 - RNA, 18 nt, Haemophilus influenzae Rd
uacauuucuaaaauaaua

SEQ ID NO: 719313 - RNA, 17 nt, Haemophilus influenzae Rd
uacauuaagugcgugua

SEQ ID NO: 719314 - RNA, 24 nt, Haemophilus influenzae Rd
uacauuaagugcguguauauauuu

SEQ ID NO: 719315 - RNA, 21 nt, Haemophilus influenzae Rd
uacauggaacguuuuuuacuu

SEQ ID NO: 719316 - RNA, 15 nt, Haemophilus influenzae Rd
uacaucuugcguuaa

SEQ ID NO: 719317 - RNA, 22 nt, Haemophilus influenzae Rd
uacauauuucaccgcagaagua

SEQ ID NO: 719318 - RNA, 13 nt, Haemophilus influenzae Rd
uacauauaaagau

SEQ ID NO: 719319 - RNA, 21 nt, Haemophilus influenzae Rd
uacauaaagaauaauuuucaa

SEQ ID NO: 719320 - RNA, 22 nt, Haemophilus influenzae Rd
uacauaaaaucucgcauugauu

SEQ ID NO: 719321 - RNA, 20 nt, Haemophilus influenzae Rd
uacaauaucuagcacagcaa

SEQ ID NO: 719322 - RNA, 15 nt, Haemophilus influenzae Rd
uacaaugcucacuuc

SEQ ID NO: 719323 - RNA, 19 nt, Haemophilus influenzae Rd
uacaaugcucacuucgcuu

SEQ ID NO: 719324 - RNA, 22 nt, Haemophilus influenzae Rd
uacaauuaauuaaauaugauaa

SEQ ID NO: 719325 - RNA, 21 nt, Haemophilus influenzae Rd
uacacaucagagcgaauacug

SEQ ID NO: 719326 - RNA, 14 nt, Haemophilus influenzae Rd
uacacauugccaua

SEQ ID NO: 719327 - RNA, 20 nt, Haemophilus influenzae Rd
uacacauugccauauucgcu

SEQ ID NO: 719328 - RNA, 16 nt, Haemophilus influenzae Rd
uacaauaccaauuucc

SEQ ID NO: 719329 - RNA, 14 nt, Haemophilus influenzae Rd
uacaacgugaagua

SEQ ID NO: 719330 - RNA, 21 nt, Haemophilus influenzae Rd
uacaacgcucugcaccuucac

SEQ ID NO: 719331 - RNA, 19 nt, Haemophilus influenzae Rd
uacaacgaguuaaguaagu

SEQ ID NO: 719332 - RNA, 18 nt, Haemophilus influenzae Rd
uacaacgccgccaauauc

SEQ ID NO: 719333 - RNA, 17 nt, Haemophilus influenzae Rd
uaauuuucaauagccaa

SEQ ID NO: 719334 - RNA, 17 nt, Haemophilus influenzae Rd
uaauuuuaguauucuuu

SEQ ID NO: 719335 - RNA, 14 nt, Haemophilus influenzae Rd
uaauuuuauagcuu

SEQ ID NO: 719336 - RNA, 16 nt, Haemophilus influenzae Rd
uaauuuuaucuaauca

SEQ ID NO: 719337 - RNA, 17 nt, Haemophilus influenzae Rd
uaauuuuaucuaaucau

SEQ ID NO: 719338 - RNA, 22 nt, Haemophilus influenzae Rd
uacaacauuaccuucuguuuuc

SEQ ID NO: 719339 - RNA, 18 nt, Haemophilus influenzae Rd
uacaacauuuugacuuuc

SEQ ID NO: 719340 - RNA, 12 nt, Haemophilus influenzae Rd
uaauuuuaaaac

SEQ ID NO: 719341 - RNA, 22 nt, Haemophilus influenzae Rd
uaauuuuacguaguacaucauu

SEQ ID NO: 719342 - RNA, 16 nt, Haemophilus influenzae Rd
uaauuuguuuuucgau

SEQ ID NO: 719343 - RNA, 19 nt, Haemophilus influenzae Rd
uaauuuuaccaagaaauaa

SEQ ID NO: 719344 - RNA, 17 nt, Haemophilus influenzae Rd
uacagaagcugcgaauu

SEQ ID NO: 719345 - RNA, 15 nt, Haemophilus influenzae Rd
uacagauacagaagg

SEQ ID NO: 719346 - RNA, 16 nt, Haemophilus influenzae Rd
uacagauacagaagga

SEQ ID NO: 719347 - RNA, 16 nt, Haemophilus influenzae Rd
uacacuuaaauuauau

SEQ ID NO: 719348 - RNA, 17 nt, Haemophilus influenzae Rd
uacacuuaaauuauauu

SEQ ID NO: 719349 - RNA, 20 nt, Haemophilus influenzae Rd
uacacuuaaauuauauuuuc

SEQ ID NO: 719350 - RNA, 11 nt, Haemophilus influenzae Rd
uacacuucuaa

SEQ ID NO: 719351 - RNA, 17 nt, Haemophilus influenzae Rd
uacagaaauaugaaauu

SEQ ID NO: 719352 - RNA, 20 nt, Haemophilus influenzae Rd
uacacuuuuaacuuaaucau

SEQ ID NO: 719353 - RNA, 22 nt, Haemophilus influenzae Rd
uacacuuuuaacuuaaucauuu

SEQ ID NO: 719354 - RNA, 22 nt, Haemophilus influenzae Rd
uacagaaccgccguauugaaua

SEQ ID NO: 719355 - RNA, 18 nt, Haemophilus influenzae Rd
uacagaaaccagaaauag

SEQ ID NO: 719356 - RNA, 14 nt, Haemophilus influenzae Rd
uacaccccaaaauc

SEQ ID NO: 719357 - RNA, 17 nt, Haemophilus influenzae Rd
uacacccacugauuuuu

SEQ ID NO: 719358 - RNA, 15 nt, Haemophilus influenzae Rd
uacaccaaaaccaau

SEQ ID NO: 719359 - RNA, 13 nt, Haemophilus influenzae Rd
uacaccaagcauu

SEQ ID NO: 719360 - RNA, 16 nt, Haemophilus influenzae Rd
uacaccaauaauuaaa

SEQ ID NO: 719361 - RNA, 15 nt, Haemophilus influenzae Rd
uacacggagauauug

SEQ ID NO: 719362 - RNA, 15 nt, Haemophilus influenzae Rd
uacacguucagcuug

SEQ ID NO: 719363 - RNA, 18 nt, Haemophilus influenzae Rd
gugcgaauuaaacggcuc

SEQ ID NO: 719364 - RNA, 22 nt, Haemophilus influenzae Rd
gugcgaccucgccauuuuucaa

SEQ ID NO: 719365 - RNA, 17 nt, Haemophilus influenzae Rd
gugccaauacuugcagu

SEQ ID NO: 719366 - RNA, 17 nt, Haemophilus influenzae Rd
gugccaguucaagucug

SEQ ID NO: 719367 - RNA, 17 nt, Haemophilus influenzae Rd
gugccauuucuaaacca

SEQ ID NO: 719368 - RNA, 20 nt, Haemophilus influenzae Rd
gugccauuuggucuaacauu

SEQ ID NO: 719369 - RNA, 19 nt, Haemophilus influenzae Rd
gugccagcuggaaauucca

SEQ ID NO: 719370 - RNA, 16 nt, Haemophilus influenzae Rd
gugcccgcuacaaaua

SEQ ID NO: 719371 - RNA, 18 nt, Haemophilus influenzae Rd
gugcccgcuacaaauaag

SEQ ID NO: 719372 - RNA, 21 nt, Haemophilus influenzae Rd
gugcccgcuacaaauaagcca

SEQ ID NO: 719373 - RNA, 14 nt, Haemophilus influenzae Rd
gugauuuuuuucau

SEQ ID NO: 719374 - RNA, 16 nt, Haemophilus influenzae Rd
gugauuuuuuucauuu

SEQ ID NO: 719375 - RNA, 11 nt, Haemophilus influenzae Rd
gugcaacugcu

SEQ ID NO: 719376 - RNA, 13 nt, Haemophilus influenzae Rd
gugcauuuuucau

SEQ ID NO: 719377 - RNA, 19 nt, Haemophilus influenzae Rd
gugcauuaaaucaaauuua

SEQ ID NO: 719378 - RNA, 17 nt, Haemophilus influenzae Rd
gugcauuaaugccucag

SEQ ID NO: 719379 - RNA, 21 nt, Haemophilus influenzae Rd
gugcaguuucaguaucacgca

SEQ ID NO: 719380 - RNA, 16 nt, Haemophilus influenzae Rd
aaauaguuuucacaau

SEQ ID NO: 719381 - RNA, 17 nt, Haemophilus influenzae Rd
aaauaguuuucacaauc

SEQ ID NO: 719382 - RNA, 18 nt, Haemophilus influenzae Rd
gugauguaaauuuucagc

SEQ ID NO: 719383 - RNA, 13 nt, Haemophilus influenzae Rd
gugauguaauauu

SEQ ID NO: 719384 - RNA, 16 nt, Haemophilus influenzae Rd
gugaugggaaacugaa

SEQ ID NO: 719385 - RNA, 15 nt, Haemophilus influenzae Rd
gugauuuuuuuauuu

SEQ ID NO: 719386 - RNA, 13 nt, Haemophilus influenzae Rd
gugauuuuagaaa

SEQ ID NO: 719387 - RNA, 21 nt, Haemophilus influenzae Rd
gugauuuuaguuucuaauucu

SEQ ID NO: 719388 - RNA, 14 nt, Haemophilus influenzae Rd
gugauuaaaauuga

SEQ ID NO: 719389 - RNA, 13 nt, Haemophilus influenzae Rd
gucuauuuugacc

SEQ ID NO: 719390 - RNA, 13 nt, Haemophilus influenzae Rd
gucucaaauuuuu

SEQ ID NO: 719391 - RNA, 15 nt, Haemophilus influenzae Rd
gucucaaauuuuuca

SEQ ID NO: 719392 - RNA, 21 nt, Haemophilus influenzae Rd
gugaucacaaggcucaucauu

SEQ ID NO: 719393 - RNA, 13 nt, Haemophilus influenzae Rd
gucuauuauaaau

SEQ ID NO: 719394 - RNA, 12 nt, Haemophilus influenzae Rd
gucuaucuaaga

SEQ ID NO: 719395 - RNA, 22 nt, Haemophilus influenzae Rd
gugcgauaguguucgcaauuaa

SEQ ID NO: 719396 - RNA, 13 nt, Haemophilus influenzae Rd
gugcgauauuuuu

SEQ ID NO: 719397 - RNA, 15 nt, Haemophilus influenzae Rd
gugcgauuaacaaua

SEQ ID NO: 719398 - RNA, 15 nt, Haemophilus influenzae Rd
gugcgguugaaauuu

SEQ ID NO: 719399 - RNA, 15 nt, Haemophilus influenzae Rd
gugcgguaaaaaaau

SEQ ID NO: 719400 - RNA, 15 nt, Haemophilus influenzae Rd
gugcgguaagaaaau

SEQ ID NO: 719401 - RNA, 16 nt, Haemophilus influenzae Rd
gugcgguaagaaaauc

SEQ ID NO: 719402 - RNA, 14 nt, Haemophilus influenzae Rd
gugcgguaaucuuu

SEQ ID NO: 719403 - RNA, 14 nt, Haemophilus influenzae Rd
gugcgguacguccc

SEQ ID NO: 719404 - RNA, 17 nt, Haemophilus influenzae Rd
gugcggauuaagauggc

SEQ ID NO: 719405 - RNA, 15 nt, Haemophilus influenzae Rd
gugcggcaaaaaaug

SEQ ID NO: 719406 - RNA, 14 nt, Haemophilus influenzae Rd
gugcggaaaauuuu

SEQ ID NO: 719407 - RNA, 18 nt, Haemophilus influenzae Rd
gugcuauacaaaauuuug

SEQ ID NO: 719408 - RNA, 23 nt, Haemophilus influenzae Rd
gugcuaaauggaauguagauaau

SEQ ID NO: 719409 - RNA, 19 nt, Haemophilus influenzae Rd
guggaaucgguagacacaa

SEQ ID NO: 719410 - RNA, 18 nt, Haemophilus influenzae Rd
gugcuuuuaaauuuuuaa

SEQ ID NO: 719411 - RNA, 12 nt, Haemophilus influenzae Rd
gugcuuuuucaa

SEQ ID NO: 719412 - RNA, 18 nt, Haemophilus influenzae Rd
gugcuuucauagaugauu

SEQ ID NO: 719413 - RNA, 23 nt, Haemophilus influenzae Rd
gugcuuugcugccacuucagcua

SEQ ID NO: 719414 - RNA, 12 nt, Haemophilus influenzae Rd
gugcuguuuuca

SEQ ID NO: 719415 - RNA, 19 nt, Haemophilus influenzae Rd
gugcuuacuuuauuuuuaa

SEQ ID NO: 719416 - RNA, 15 nt, Haemophilus influenzae Rd
gugcuucauagaaac

SEQ ID NO: 719417 - RNA, 14 nt, Haemophilus influenzae Rd
gugcugcaacuggg

SEQ ID NO: 719418 - RNA, 19 nt, Haemophilus influenzae Rd
guggcuuuaaagguuuaaa

SEQ ID NO: 719419 - RNA, 20 nt, Haemophilus influenzae Rd
guggcuuuucagcuaaaauu

SEQ ID NO: 719420 - RNA, 21 nt, Haemophilus influenzae Rd
guggcuuuucugauaauuuuu

SEQ ID NO: 719421 - RNA, 21 nt, Haemophilus influenzae Rd
guggcuuuuguuuauaucuuu

SEQ ID NO: 719422 - RNA, 19 nt, Haemophilus influenzae Rd
guggacgagauaaaacuug

SEQ ID NO: 719423 - RNA, 13 nt, Haemophilus influenzae Rd
gugguuuuuguuu

SEQ ID NO: 719424 - RNA, 21 nt, Haemophilus influenzae Rd
guguacacaaugcuaucaggc

SEQ ID NO: 719425 - RNA, 14 nt, Haemophilus influenzae Rd
guguauaacaaaua

SEQ ID NO: 719426 - RNA, 21 nt, Haemophilus influenzae Rd
gugucaaaugccgcuaauggu

SEQ ID NO: 719427 - RNA, 18 nt, Haemophilus influenzae Rd
guguauuaaguaaauauu

SEQ ID NO: 719428 - RNA, 14 nt, Haemophilus influenzae Rd
gugguauucuuucc

SEQ ID NO: 719429 - RNA, 22 nt, Haemophilus influenzae Rd
guuaaauugaacugaauuaaaa

SEQ ID NO: 719430 - RNA, 14 nt, Haemophilus influenzae Rd
guuaaauuuagauu

SEQ ID NO: 719431 - RNA, 22 nt, Haemophilus influenzae Rd
guuaaauuuaugcuguuuuaua

SEQ ID NO: 719432 - RNA, 17 nt, Haemophilus influenzae Rd
guuaaguucagaaagag

SEQ ID NO: 719433 - RNA, 15 nt, Haemophilus influenzae Rd
guuaauaaauccaug

SEQ ID NO: 719434 - RNA, 14 nt, Haemophilus influenzae Rd
guuaauaguuguuu

SEQ ID NO: 719435 - RNA, 13 nt, Haemophilus influenzae Rd
guuaauaaucaca

SEQ ID NO: 719436 - RNA, 21 nt, Haemophilus influenzae Rd
guuaauccuaaauuaugcucc

SEQ ID NO: 719437 - RNA, 20 nt, Haemophilus influenzae Rd
guuaauccuaguuuuuuccc

SEQ ID NO: 719438 - RNA, 17 nt, Haemophilus influenzae Rd
guuaaucgaaaauuuac

SEQ ID NO: 719439 - RNA, 20 nt, Haemophilus influenzae Rd
guuacgaauugcaauaacca

SEQ ID NO: 719440 - RNA, 21 nt, Haemophilus influenzae Rd
guuacgaauugcaauaaccac

SEQ ID NO: 719441 - RNA, 19 nt, Haemophilus influenzae Rd
guuacaaacaaucuuaacu

SEQ ID NO: 719442 - RNA, 18 nt, Haemophilus influenzae Rd
guuacagcugcauaaagc

SEQ ID NO: 719443 - RNA, 22 nt, Haemophilus influenzae Rd
guuacaucuucaaaaacauaau

SEQ ID NO: 719444 - RNA, 23 nt, Haemophilus influenzae Rd
guuaaacugccgccuucuuccac

SEQ ID NO: 719445 - RNA, 14 nt, Haemophilus influenzae Rd
guuaaauaaacaca

SEQ ID NO: 719446 - RNA, 15 nt, Haemophilus influenzae Rd
guuaaauaagcuaga

SEQ ID NO: 719447 - RNA, 11 nt, Haemophilus influenzae Rd
guuaaauaaug

SEQ ID NO: 719448 - RNA, 10 nt, Haemophilus influenzae Rd
guuaaauguu

SEQ ID NO: 719449 - RNA, 15 nt, Haemophilus influenzae Rd
guguuugaaaagaaa

SEQ ID NO: 719450 - RNA, 17 nt, Haemophilus influenzae Rd
guguuuuguaauugcuc

SEQ ID NO: 719451 - RNA, 16 nt, Haemophilus influenzae Rd
guuaaaccuaaauccc

SEQ ID NO: 719452 - RNA, 14 nt, Haemophilus influenzae Rd
guuaaacgcauauu

SEQ ID NO: 719453 - RNA, 15 nt, Haemophilus influenzae Rd
guuauccaucaagaa

SEQ ID NO: 719454 - RNA, 18 nt, Haemophilus influenzae Rd
guuauccauccagaaaau

SEQ ID NO: 719455 - RNA, 14 nt, Haemophilus influenzae Rd
guuaucgccaauaa

SEQ ID NO: 719456 - RNA, 15 nt, Haemophilus influenzae Rd
guuaucgacuuccac

SEQ ID NO: 719457 - RNA, 17 nt, Haemophilus influenzae Rd
guuaucgacuuuuucac

SEQ ID NO: 719458 - RNA, 13 nt, Haemophilus influenzae Rd
guucaaacaucac

SEQ ID NO: 719459 - RNA, 13 nt, Haemophilus influenzae Rd
guuauuuuuucaa

SEQ ID NO: 719460 - RNA, 19 nt, Haemophilus influenzae Rd
guucaaaaauuucgcuauu

SEQ ID NO: 719461 - RNA, 21 nt, Haemophilus influenzae Rd
guuauuaagcgugcuuugcug

SEQ ID NO: 719462 - RNA, 11 nt, Haemophilus influenzae Rd
guuauguugcc

SEQ ID NO: 719463 - RNA, 17 nt, Haemophilus influenzae Rd
guuauuaaauaaaccgc

SEQ ID NO: 719464 - RNA, 13 nt, Haemophilus influenzae Rd
guuauuaugaaau

SEQ ID NO: 719465 - RNA, 14 nt, Haemophilus influenzae Rd
guuauuaugaaauu

SEQ ID NO: 719466 - RNA, 13 nt, Haemophilus influenzae Rd
guuaguuuguauu

SEQ ID NO: 719467 - RNA, 21 nt, Haemophilus influenzae Rd
guuauaaaagaagaaugcggu

SEQ ID NO: 719468 - RNA, 19 nt, Haemophilus influenzae Rd
guuauaaguuuuuugccaa

SEQ ID NO: 719469 - RNA, 18 nt, Haemophilus influenzae Rd
guuauaagccuaaaccaa

SEQ ID NO: 719470 - RNA, 22 nt, Haemophilus influenzae Rd
guuacuaaaauaauuuuuugaa

SEQ ID NO: 719471 - RNA, 15 nt, Haemophilus influenzae Rd
guuacguaauauuua

SEQ ID NO: 719472 - RNA, 14 nt, Haemophilus influenzae Rd
guuacguuucacua

SEQ ID NO: 719473 - RNA, 18 nt, Haemophilus influenzae Rd
guuagacuaugaaaucaa

SEQ ID NO: 719474 - RNA, 13 nt, Haemophilus influenzae Rd
guuagauacuuua

SEQ ID NO: 719475 - RNA, 13 nt, Haemophilus influenzae Rd
guucggacuuaca

SEQ ID NO: 719476 - RNA, 15 nt, Haemophilus influenzae Rd
guucgauuucaucuu

SEQ ID NO: 719477 - RNA, 20 nt, Haemophilus influenzae Rd
guucgauggaaaugaguaaa

SEQ ID NO: 719478 - RNA, 20 nt, Haemophilus influenzae Rd
guucgauaacaauuuuugca

SEQ ID NO: 719479 - RNA, 18 nt, Haemophilus influenzae Rd
guucauucgguacgccau

SEQ ID NO: 719480 - RNA, 15 nt, Haemophilus influenzae Rd
guucaugugggcuuu

SEQ ID NO: 719481 - RNA, 17 nt, Haemophilus influenzae Rd
guucagauuucuucgcc

SEQ ID NO: 719482 - RNA, 14 nt, Haemophilus influenzae Rd
guucauaaauagga

SEQ ID NO: 719483 - RNA, 14 nt, Haemophilus influenzae Rd
guucaauaugcaaa

SEQ ID NO: 719484 - RNA, 15 nt, Haemophilus influenzae Rd
guucaauauaacuca

SEQ ID NO: 719485 - RNA, 20 nt, Haemophilus influenzae Rd
guucaaggacugaguucugu

SEQ ID NO: 719486 - RNA, 13 nt, Haemophilus influenzae Rd
guucaauaaaaau

SEQ ID NO: 719487 - RNA, 12 nt, Haemophilus influenzae Rd
guucaauaaugu

SEQ ID NO: 719488 - RNA, 14 nt, Haemophilus influenzae Rd
guucaacaaguaaa

SEQ ID NO: 719489 - RNA, 22 nt, Haemophilus influenzae Rd
guucaaaugaaagaagaaaaag

SEQ ID NO: 719490 - RNA, 11 nt, Haemophilus influenzae Rd
guucaaauaag

SEQ ID NO: 719491 - RNA, 12 nt, Haemophilus influenzae Rd
guucaaauaagc

SEQ ID NO: 719492 - RNA, 12 nt, Haemophilus influenzae Rd
guucaaauaaug

SEQ ID NO: 719493 - RNA, 17 nt, Haemophilus influenzae Rd
guucaacccauuuucca

SEQ ID NO: 719494 - RNA, 20 nt, Haemophilus influenzae Rd
guucaauuuggaaaccugca

SEQ ID NO: 719495 - RNA, 18 nt, Haemophilus influenzae Rd
guucaauuuuaauugguu

SEQ ID NO: 719496 - RNA, 16 nt, Haemophilus influenzae Rd
guucacagagaauaaa

SEQ ID NO: 719497 - RNA, 15 nt, Haemophilus influenzae Rd
guucagaaagagacu

SEQ ID NO: 719498 - RNA, 16 nt, Haemophilus influenzae Rd
guucagauucaauaau

SEQ ID NO: 719499 - RNA, 15 nt, Haemophilus influenzae Rd
guugaaauuccucac

SEQ ID NO: 719500 - RNA, 21 nt, Haemophilus influenzae Rd
guugaaaagaauaauauuaaa

SEQ ID NO: 719501 - RNA, 21 nt, Haemophilus influenzae Rd
guucuuuguuaccuuuuccaa

SEQ ID NO: 719502 - RNA, 23 nt, Haemophilus influenzae Rd
guucuuuuaaaagaccacauucu

SEQ ID NO: 719503 - RNA, 20 nt, Haemophilus influenzae Rd
guucuuuugguaauaaauca

SEQ ID NO: 719504 - RNA, 19 nt, Haemophilus influenzae Rd
guucuuccgucaauauccc

SEQ ID NO: 719505 - RNA, 18 nt, Haemophilus influenzae Rd
guucuucuguuaaacgca

SEQ ID NO: 719506 - RNA, 22 nt, Haemophilus influenzae Rd
guucuuguuuuaaaucuucuau

SEQ ID NO: 719507 - RNA, 17 nt, Haemophilus influenzae Rd
guucuuguucaaguugu

SEQ ID NO: 719508 - RNA, 17 nt, Haemophilus influenzae Rd
guucuuggauaauuucg

SEQ ID NO: 719509 - RNA, 17 nt, Haemophilus influenzae Rd
guucuugaugauaaucu

SEQ ID NO: 719510 - RNA, 22 nt, Haemophilus influenzae Rd
guucuugaugauaaucuuccca

SEQ ID NO: 719511 - RNA, 23 nt, Haemophilus influenzae Rd
guucuugaugauaaucuucccau

SEQ ID NO: 719512 - RNA, 13 nt, Haemophilus influenzae Rd
guucguuuaaauu

SEQ ID NO: 719513 - RNA, 16 nt, Haemophilus influenzae Rd
guucugacacuucccc

SEQ ID NO: 719514 - RNA, 16 nt, Haemophilus influenzae Rd
guugagaauuuuuucu

SEQ ID NO: 719515 - RNA, 13 nt, Haemophilus influenzae Rd
guugaagaaaguu

SEQ ID NO: 719516 - RNA, 21 nt, Haemophilus influenzae Rd
guugaagcuaauucuucuauu

SEQ ID NO: 719517 - RNA, 19 nt, Haemophilus influenzae Rd
guugaagagaauuuucauc

SEQ ID NO: 719518 - RNA, 20 nt, Haemophilus influenzae Rd
guugaauuucuuuuucugcu

SEQ ID NO: 719519 - RNA, 20 nt, Haemophilus influenzae Rd
guugaauuuuugugauuuca

SEQ ID NO: 719520 - RNA, 12 nt, Haemophilus influenzae Rd
guugaauuuuuu

SEQ ID NO: 719521 - RNA, 13 nt, Haemophilus influenzae Rd
guugauagaaacg

SEQ ID NO: 719522 - RNA, 15 nt, Haemophilus influenzae Rd
guugcaucuucuauu

SEQ ID NO: 719523 - RNA, 18 nt, Haemophilus influenzae Rd
guugcaagauuuccagca

SEQ ID NO: 719524 - RNA, 21 nt, Haemophilus influenzae Rd
guugauugacuuguuuuaaaa

SEQ ID NO: 719525 - RNA, 17 nt, Haemophilus influenzae Rd
guugauuuaucauaaug

SEQ ID NO: 719526 - RNA, 22 nt, Haemophilus influenzae Rd
guugauuaagucgauaaagaau

SEQ ID NO: 719527 - RNA, 12 nt, Haemophilus influenzae Rd
guugauuuuccc

SEQ ID NO: 719528 - RNA, 23 nt, Haemophilus influenzae Rd
guugauuuuccccgcucuuucca

SEQ ID NO: 719529 - RNA, 23 nt, Haemophilus influenzae Rd
guugauuuugguucguuuugggg

SEQ ID NO: 719530 - RNA, 14 nt, Haemophilus influenzae Rd
guuuaaaguaagaa

SEQ ID NO: 719531 - RNA, 17 nt, Haemophilus influenzae Rd
guuuaaaucuaagccuu

SEQ ID NO: 719532 - RNA, 12 nt, Haemophilus influenzae Rd
guuguucuucug

SEQ ID NO: 719533 - RNA, 14 nt, Haemophilus influenzae Rd
guuguucuucuguu

SEQ ID NO: 719534 - RNA, 14 nt, Haemophilus influenzae Rd
guuguucuuuauaa

SEQ ID NO: 719535 - RNA, 14 nt, Haemophilus influenzae Rd
guuguucuaacauu

SEQ ID NO: 719536 - RNA, 22 nt, Haemophilus influenzae Rd
guuguggugcaagguauuucaa

SEQ ID NO: 719537 - RNA, 15 nt, Haemophilus influenzae Rd
guuguguuucaacaa

SEQ ID NO: 719538 - RNA, 20 nt, Haemophilus influenzae Rd
guuuaccaccgauaaacacu

SEQ ID NO: 719539 - RNA, 16 nt, Haemophilus influenzae Rd
guuuaccgcaaaauua

SEQ ID NO: 719540 - RNA, 19 nt, Haemophilus influenzae Rd
guuuauugguaacaacugc

SEQ ID NO: 719541 - RNA, 13 nt, Haemophilus influenzae Rd
guuuauuuauuca

SEQ ID NO: 719542 - RNA, 21 nt, Haemophilus influenzae Rd
guuuauagcgucuuuuugcac

SEQ ID NO: 719543 - RNA, 16 nt, Haemophilus influenzae Rd
guuuauagaugaacuc

SEQ ID NO: 719544 - RNA, 16 nt, Haemophilus influenzae Rd
guuuaguuuacuuuug

SEQ ID NO: 719545 - RNA, 19 nt, Haemophilus influenzae Rd
guugguaaaucuaacaauc

SEQ ID NO: 719546 - RNA, 22 nt, Haemophilus influenzae Rd
guuggguaaucaaauucaauug

SEQ ID NO: 719547 - RNA, 13 nt, Haemophilus influenzae Rd
guuggcauaucaa

SEQ ID NO: 719548 - RNA, 14 nt, Haemophilus influenzae Rd
guugggauuuaucu

SEQ ID NO: 719549 - RNA, 17 nt, Haemophilus influenzae Rd
guuguacuuuagaaauu

SEQ ID NO: 719550 - RNA, 18 nt, Haemophilus influenzae Rd
guuguacuauuuuauaau

SEQ ID NO: 719551 - RNA, 17 nt, Haemophilus influenzae Rd
guuguaauuguugaaug

SEQ ID NO: 719552 - RNA, 17 nt, Haemophilus influenzae Rd
guugugacucaaacuug

SEQ ID NO: 719553 - RNA, 20 nt, Haemophilus influenzae Rd
guugugaguaaaccacaaua

SEQ ID NO: 719554 - RNA, 19 nt, Haemophilus influenzae Rd
guuggcacuucaauuucac

SEQ ID NO: 719555 - RNA, 17 nt, Haemophilus influenzae Rd
uaaaccuugugauguac

SEQ ID NO: 719556 - RNA, 15 nt, Haemophilus influenzae Rd
uaaacgaagaaaaag

SEQ ID NO: 719557 - RNA, 14 nt, Haemophilus influenzae Rd
uaaacgaauaucag

SEQ ID NO: 719558 - RNA, 23 nt, Haemophilus influenzae Rd
uaaacgaccuucaucaccugcuu

SEQ ID NO: 719559 - RNA, 17 nt, Haemophilus influenzae Rd
uaaacguaacuaaaaaa

SEQ ID NO: 719560 - RNA, 18 nt, Haemophilus influenzae Rd
uaaacggucauuuacaaa

SEQ ID NO: 719561 - RNA, 16 nt, Haemophilus influenzae Rd
uaaacgagauaagcau

SEQ ID NO: 719562 - RNA, 19 nt, Haemophilus influenzae Rd
uaaacgcaacaucgcagug

SEQ ID NO: 719563 - RNA, 15 nt, Haemophilus influenzae Rd
uaaacgcauauuuug

SEQ ID NO: 719564 - RNA, 16 nt, Haemophilus influenzae Rd
uaaacgcauauuuugu

SEQ ID NO: 719565 - RNA, 17 nt, Haemophilus influenzae Rd
uaaacgccacgcuuugu

SEQ ID NO: 719566 - RNA, 22 nt, Haemophilus influenzae Rd
uaaacgccaucaaccauaacaa

SEQ ID NO: 719567 - RNA, 19 nt, Haemophilus influenzae Rd
uaaaccucgccuuguaauu

SEQ ID NO: 719568 - RNA, 19 nt, Haemophilus influenzae Rd
uaaaccccguuuuuuagaa

SEQ ID NO: 719569 - RNA, 17 nt, Haemophilus influenzae Rd
uaaaccaguuaaauccu

SEQ ID NO: 719570 - RNA, 18 nt, Haemophilus influenzae Rd
uaaacccaccauacgcaa

SEQ ID NO: 719571 - RNA, 17 nt, Haemophilus influenzae Rd
uaaagaaaauacaauau

SEQ ID NO: 719572 - RNA, 13 nt, Haemophilus influenzae Rd
uaaagaaccacaa

SEQ ID NO: 719573 - RNA, 17 nt, Haemophilus influenzae Rd
uaaagaacuauuauucc

SEQ ID NO: 719574 - RNA, 20 nt, Haemophilus influenzae Rd
uaaagaaacguaaacaaaau

SEQ ID NO: 719575 - RNA, 14 nt, Haemophilus influenzae Rd
uaaagaaauuucau

SEQ ID NO: 719576 - RNA, 15 nt, Haemophilus influenzae Rd
uaaagaaauaaauuu

SEQ ID NO: 719577 - RNA, 20 nt, Haemophilus influenzae Rd
uaaagaaauaagcaauuuca

SEQ ID NO: 719578 - RNA, 14 nt, Haemophilus influenzae Rd
uaaagaaagcaaug

SEQ ID NO: 719579 - RNA, 20 nt, Haemophilus influenzae Rd
uaaacguucuuggaaaucuu

SEQ ID NO: 719580 - RNA, 21 nt, Haemophilus influenzae Rd
uaaacguucuuggaaaucuug

SEQ ID NO: 719581 - RNA, 19 nt, Haemophilus influenzae Rd
uaaacguugaaucgcacuu

SEQ ID NO: 719582 - RNA, 20 nt, Haemophilus influenzae Rd
uaaacguugaaucgcacuua

SEQ ID NO: 719583 - RNA, 18 nt, Haemophilus influenzae Rd
uaaacguuuauuuauucc

SEQ ID NO: 719584 - RNA, 14 nt, Haemophilus influenzae Rd
uaaacuaaaauauc

SEQ ID NO: 719585 - RNA, 22 nt, Haemophilus influenzae Rd
uaaacuuccaaaauuuaaagug

SEQ ID NO: 719586 - RNA, 23 nt, Haemophilus influenzae Rd
uaaacuuuacggauaauuucccu

SEQ ID NO: 719587 - RNA, 20 nt, Haemophilus influenzae Rd
uaaacuuuagagauuuuauu

SEQ ID NO: 719588 - RNA, 22 nt, Haemophilus influenzae Rd
uaaacuuuagagauuuuauuca

SEQ ID NO: 719589 - RNA, 22 nt, Haemophilus influenzae Rd
uaaacuuguuaaauaaacacaa

SEQ ID NO: 719590 - RNA, 14 nt, Haemophilus influenzae Rd
uaaacuugauauaa

SEQ ID NO: 719591 - RNA, 23 nt, Haemophilus influenzae Rd
uaaacuucugcaaguugagcaua

SEQ ID NO: 719592 - RNA, 20 nt, Haemophilus influenzae Rd
uaaacauccgaauaaaugca

SEQ ID NO: 719593 - RNA, 20 nt, Haemophilus influenzae Rd
uaaacaucgcagaaauagau

SEQ ID NO: 719594 - RNA, 13 nt, Haemophilus influenzae Rd
uaaacauauugau

SEQ ID NO: 719595 - RNA, 15 nt, Haemophilus influenzae Rd
uaaacaauuccccuu

SEQ ID NO: 719596 - RNA, 19 nt, Haemophilus influenzae Rd
uaaacaauuccccuuccuu

SEQ ID NO: 719597 - RNA, 13 nt, Haemophilus influenzae Rd
uaaacaauucacu

SEQ ID NO: 719598 - RNA, 13 nt, Haemophilus influenzae Rd
uaaacaaaauacc

SEQ ID NO: 719599 - RNA, 12 nt, Haemophilus influenzae Rd
uaaacaaaaaua

SEQ ID NO: 719600 - RNA, 16 nt, Haemophilus influenzae Rd
uaaaauuuuuaccaua

SEQ ID NO: 719601 - RNA, 22 nt, Haemophilus influenzae Rd
uaaaauuuuuaccauauccauu

SEQ ID NO: 719602 - RNA, 19 nt, Haemophilus influenzae Rd
uaaaauuuuuagugauuuu

SEQ ID NO: 719603 - RNA, 16 nt, Haemophilus influenzae Rd
uaaaauuacaaaacca

SEQ ID NO: 719604 - RNA, 20 nt, Haemophilus influenzae Rd
uaaaauuacaaaaccaauca

SEQ ID NO: 719605 - RNA, 21 nt, Haemophilus influenzae Rd
uaaaauuaguaacagguaaaa

SEQ ID NO: 719606 - RNA, 23 nt, Haemophilus influenzae Rd
uaaaauuagugaugaugguguuc

SEQ ID NO: 719607 - RNA, 22 nt, Haemophilus influenzae Rd
uaaaauucgacgauaaccaucu

SEQ ID NO: 719608 - RNA, 23 nt, Haemophilus influenzae Rd
uaaaauucgcacacuuucacuaa

SEQ ID NO: 719609 - RNA, 19 nt, Haemophilus influenzae Rd
uaaaauugauuucauauau

SEQ ID NO: 719610 - RNA, 24 nt, Haemophilus influenzae Rd
uaaaauugccgccaguaagaucuu

SEQ ID NO: 719611 - RNA, 23 nt, Haemophilus influenzae Rd
uaaaauugcuuuguuaauucacg

SEQ ID NO: 719612 - RNA, 19 nt, Haemophilus influenzae Rd
uaaaauuuauuacaaacaa

SEQ ID NO: 719613 - RNA, 21 nt, Haemophilus influenzae Rd
uaaaauuuauuuuaaaaucau

SEQ ID NO: 719614 - RNA, 22 nt, Haemophilus influenzae Rd
uaaaauuucuucuacaccuucu

SEQ ID NO: 719615 - RNA, 21 nt, Haemophilus influenzae Rd
uaaagacguuugauuguaaaa

SEQ ID NO: 719616 - RNA, 17 nt, Haemophilus influenzae Rd
uaaagaagugagaaaua

SEQ ID NO: 719617 - RNA, 22 nt, Haemophilus influenzae Rd
uaaagaagugagaaauaucuac

SEQ ID NO: 719618 - RNA, 17 nt, Haemophilus influenzae Rd
uaaagagaauauuucca

SEQ ID NO: 719619 - RNA, 19 nt, Haemophilus influenzae Rd
uaaagagaauauuuccacu

SEQ ID NO: 719620 - RNA, 22 nt, Haemophilus influenzae Rd
uaaagagcaaauuuaaauaaua

SEQ ID NO: 719621 - RNA, 18 nt, Haemophilus influenzae Rd
uaaagcaauauuuagauc

SEQ ID NO: 719622 - RNA, 12 nt, Haemophilus influenzae Rd
uaaagcaccaua

SEQ ID NO: 719623 - RNA, 15 nt, Haemophilus influenzae Rd
uaaagcaccauaaug

SEQ ID NO: 719624 - RNA, 23 nt, Haemophilus influenzae Rd
uaaagccuguugauguuuuaaca

SEQ ID NO: 719625 - RNA, 21 nt, Haemophilus influenzae Rd
uaaagcaacugaaauaugacu

SEQ ID NO: 719626 - RNA, 9 nt, Haemophilus influenzae Rd
uaaagauuu

SEQ ID NO: 719627 - RNA, 17 nt, Haemophilus influenzae Rd
uaaaggauuaaauaaca

SEQ ID NO: 719628 - RNA, 22 nt, Haemophilus influenzae Rd
uaaaggaaucccauauuuaaaa

SEQ ID NO: 719629 - RNA, 12 nt, Haemophilus influenzae Rd
uaaagcuacuaa

SEQ ID NO: 719630 - RNA, 24 nt, Haemophilus influenzae Rd
uaaagguuuaaaccuuauugcaua

SEQ ID NO: 719631 - RNA, 18 nt, Haemophilus influenzae Rd
uaaagggcgguuaaaaau

SEQ ID NO: 719632 - RNA, 21 nt, Haemophilus influenzae Rd
uaaagggcugcuacaauuuca

SEQ ID NO: 719633 - RNA, 15 nt, Haemophilus influenzae Rd
uaaaggcauagcuau

SEQ ID NO: 719634 - RNA, 21 nt, Haemophilus influenzae Rd
uaaauacuaauaggaguaaaa

SEQ ID NO: 719635 - RNA, 17 nt, Haemophilus influenzae Rd
uaaauagagcuugccuu

SEQ ID NO: 719636 - RNA, 13 nt, Haemophilus influenzae Rd
uaaauagccgaca

SEQ ID NO: 719637 - RNA, 20 nt, Haemophilus influenzae Rd
uaaauagccgacaucuauuu

SEQ ID NO: 719638 - RNA, 15 nt, Haemophilus influenzae Rd
uaaauagcuaacaau

SEQ ID NO: 719639 - RNA, 23 nt, Haemophilus influenzae Rd
uaaauagauccgcaauauaguca

SEQ ID NO: 719640 - RNA, 14 nt, Haemophilus influenzae Rd
uaaauauuauuaaa

SEQ ID NO: 719641 - RNA, 18 nt, Haemophilus influenzae Rd
uaaauaggcucauuuuuu

SEQ ID NO: 719642 - RNA, 22 nt, Haemophilus influenzae Rd
uaaauaggcucauuuuuucucu

SEQ ID NO: 719643 - RNA, 14 nt, Haemophilus influenzae Rd
uaaauauuucacua

SEQ ID NO: 719644 - RNA, 13 nt, Haemophilus influenzae Rd
uaaauauuuaaaa

SEQ ID NO: 719645 - RNA, 21 nt, Haemophilus influenzae Rd
uaaauauuuaaaaagaauauu

SEQ ID NO: 719646 - RNA, 23 nt, Haemophilus influenzae Rd
uaaauauugagcaauaaauucua

SEQ ID NO: 719647 - RNA, 17 nt, Haemophilus influenzae Rd
uaaauacacuucuaaaa

SEQ ID NO: 719648 - RNA, 21 nt, Haemophilus influenzae Rd
uaaauacagcucaaaaugcuc

SEQ ID NO: 719649 - RNA, 14 nt, Haemophilus influenzae Rd
uaaauaauuuccuu

SEQ ID NO: 719650 - RNA, 18 nt, Haemophilus influenzae Rd
uaaauacauuuagugcua

SEQ ID NO: 719651 - RNA, 18 nt, Haemophilus influenzae Rd
uaaauaccaggauuauua

SEQ ID NO: 719652 - RNA, 15 nt, Haemophilus influenzae Rd
uaaauacaaaacagg

SEQ ID NO: 719653 - RNA, 21 nt, Haemophilus influenzae Rd
uaaauaaucuucuuuguuucc

SEQ ID NO: 719654 - RNA, 13 nt, Haemophilus influenzae Rd
uaaauaauuaaaa

SEQ ID NO: 719655 - RNA, 14 nt, Haemophilus influenzae Rd
uaaauaauuaaaaa

SEQ ID NO: 719656 - RNA, 20 nt, Haemophilus influenzae Rd
uaaauaauuaaaaauaaaua

SEQ ID NO: 719657 - RNA, 23 nt, Haemophilus influenzae Rd
uaaauaauggcgauaauuauuga

SEQ ID NO: 719658 - RNA, 13 nt, Haemophilus influenzae Rd
uaaauaaaauaac

SEQ ID NO: 719659 - RNA, 20 nt, Haemophilus influenzae Rd
uaaauaaaauaacaaaaaag

SEQ ID NO: 719660 - RNA, 13 nt, Haemophilus influenzae Rd
uaaauaaaauauu

SEQ ID NO: 719661 - RNA, 17 nt, Haemophilus influenzae Rd
uaaauaaaauauuuaau

SEQ ID NO: 719662 - RNA, 21 nt, Haemophilus influenzae Rd
uaaauaaaacgggaucuauuu

SEQ ID NO: 719663 - RNA, 19 nt, Haemophilus influenzae Rd
uaaauaaacauuaugaaaa

SEQ ID NO: 719664 - RNA, 21 nt, Haemophilus influenzae Rd
uaacaaccuuugguaaaagaa

SEQ ID NO: 719665 - RNA, 14 nt, Haemophilus influenzae Rd
uaacaacaaaagug

SEQ ID NO: 719666 - RNA, 20 nt, Haemophilus influenzae Rd
uaacaacaaagucaauacac

SEQ ID NO: 719667 - RNA, 23 nt, Haemophilus influenzae Rd
uaacaacaaagucaauacacauu

SEQ ID NO: 719668 - RNA, 16 nt, Haemophilus influenzae Rd
uaacaaauucacuguc

SEQ ID NO: 719669 - RNA, 15 nt, Haemophilus influenzae Rd
uaacaaauaauuauu

SEQ ID NO: 719670 - RNA, 17 nt, Haemophilus influenzae Rd
uaacaaauaauuauuau

SEQ ID NO: 719671 - RNA, 18 nt, Haemophilus influenzae Rd
uaacaaauacaucuucac

SEQ ID NO: 719672 - RNA, 20 nt, Haemophilus influenzae Rd
uaacaaauacaucuucacaa

SEQ ID NO: 719673 - RNA, 20 nt, Haemophilus influenzae Rd
uaacaaauaggauaaaaaug

SEQ ID NO: 719674 - RNA, 22 nt, Haemophilus influenzae Rd
uaaauuuggauaguuuauuaau

SEQ ID NO: 719675 - RNA, 21 nt, Haemophilus influenzae Rd
uaaauuugguucaauuuuaau

SEQ ID NO: 719676 - RNA, 20 nt, Haemophilus influenzae Rd
uaaauuugaucguuaauauc

SEQ ID NO: 719677 - RNA, 12 nt, Haemophilus influenzae Rd
uaaauuuuaaaa

SEQ ID NO: 719678 - RNA, 14 nt, Haemophilus influenzae Rd
uaaauuuuaaaaaa

SEQ ID NO: 719679 - RNA, 15 nt, Haemophilus influenzae Rd
uaaauuuuaaaauag

SEQ ID NO: 719680 - RNA, 16 nt, Haemophilus influenzae Rd
uaaauuuuaaaaucuu

SEQ ID NO: 719681 - RNA, 11 nt, Haemophilus influenzae Rd
uaaauuucuaa

SEQ ID NO: 719682 - RNA, 24 nt, Haemophilus influenzae Rd
uaaauuucccauuugucucaaaau

SEQ ID NO: 719683 - RNA, 20 nt, Haemophilus influenzae Rd
uaaauuuagcguauuuuguu

SEQ ID NO: 719684 - RNA, 20 nt, Haemophilus influenzae Rd
uaaauuuagggcuuguggga

SEQ ID NO: 719685 - RNA, 23 nt, Haemophilus influenzae Rd
uaaauuuauauaugauaaaaaua

SEQ ID NO: 719686 - RNA, 20 nt, Haemophilus influenzae Rd
uaaauuucagcuuaaauacu

SEQ ID NO: 719687 - RNA, 14 nt, Haemophilus influenzae Rd
uaaauuguaacuau

SEQ ID NO: 719688 - RNA, 20 nt, Haemophilus influenzae Rd
uaaauugugauggaaguagu

SEQ ID NO: 719689 - RNA, 15 nt, Haemophilus influenzae Rd
uaaauuuaaauuauu

SEQ ID NO: 719690 - RNA, 20 nt, Haemophilus influenzae Rd
uaaauuuaaccacuaaaaaa

SEQ ID NO: 719691 - RNA, 16 nt, Haemophilus influenzae Rd
uaaauuauauuuuccu

SEQ ID NO: 719692 - RNA, 18 nt, Haemophilus influenzae Rd
uaaauuaugcccaauuac

SEQ ID NO: 719693 - RNA, 14 nt, Haemophilus influenzae Rd
uaaauuaguuuaaa

SEQ ID NO: 719694 - RNA, 14 nt, Haemophilus influenzae Rd
uaaauuagcucaau

SEQ ID NO: 719695 - RNA, 16 nt, Haemophilus influenzae Rd
uaaauuagcuuaauaa

SEQ ID NO: 719696 - RNA, 21 nt, Haemophilus influenzae Rd
uaaauuagcuuaauaaaucac

SEQ ID NO: 719697 - RNA, 22 nt, Haemophilus influenzae Rd
uaaauuaggaauuugaucacga

SEQ ID NO: 719698 - RNA, 15 nt, Haemophilus influenzae Rd
uaaaucuuauuaaua

SEQ ID NO: 719699 - RNA, 14 nt, Haemophilus influenzae Rd
uaaaucuuuccaga

SEQ ID NO: 719700 - RNA, 17 nt, Haemophilus influenzae Rd
uaaaucuucuuuaccaa

SEQ ID NO: 719701 - RNA, 23 nt, Haemophilus influenzae Rd
uaaaucuugcuuuugguuuucug

SEQ ID NO: 719702 - RNA, 16 nt, Haemophilus influenzae Rd
uaaaucuguuucauuu

SEQ ID NO: 719703 - RNA, 14 nt, Haemophilus influenzae Rd
uaaaucaauuaacu

SEQ ID NO: 719704 - RNA, 15 nt, Haemophilus influenzae Rd
uaaaucaauuaacua

SEQ ID NO: 719705 - RNA, 19 nt, Haemophilus influenzae Rd
uaaaucacacaguuauaca

SEQ ID NO: 719706 - RNA, 22 nt, Haemophilus influenzae Rd
uaaaucacccgcauaaccacua

SEQ ID NO: 719707 - RNA, 20 nt, Haemophilus influenzae Rd
uaaaucacccggcacauaaa

SEQ ID NO: 719708 - RNA, 23 nt, Haemophilus influenzae Rd
uaaaucacccggcacauaaauca

SEQ ID NO: 719709 - RNA, 13 nt, Haemophilus influenzae Rd
uaaaucaacaauu

SEQ ID NO: 719710 - RNA, 14 nt, Haemophilus influenzae Rd
uaaaucaaauuuag

SEQ ID NO: 719711 - RNA, 13 nt, Haemophilus influenzae Rd
uaaaucaaaaauu

SEQ ID NO: 719712 - RNA, 15 nt, Haemophilus influenzae Rd
uaaaucaaaagaauu

SEQ ID NO: 719713 - RNA, 15 nt, Haemophilus influenzae Rd
uaaauauuuuuuagu

SEQ ID NO: 719714 - RNA, 16 nt, Haemophilus influenzae Rd
uaaaugggacaaagca

SEQ ID NO: 719715 - RNA, 16 nt, Haemophilus influenzae Rd
uaaauggucuucaucg

SEQ ID NO: 719716 - RNA, 15 nt, Haemophilus influenzae Rd
uaaaugugauuucca

SEQ ID NO: 719717 - RNA, 15 nt, Haemophilus influenzae Rd
uaaauguuaauggcu

SEQ ID NO: 719718 - RNA, 17 nt, Haemophilus influenzae Rd
uaaaugcaucauuaaua

SEQ ID NO: 719719 - RNA, 22 nt, Haemophilus influenzae Rd
uaaaugcaucauuaauacacaa

SEQ ID NO: 719720 - RNA, 23 nt, Haemophilus influenzae Rd
uaaaugcaucauuaauacacaaa

SEQ ID NO: 719721 - RNA, 13 nt, Haemophilus influenzae Rd
uaaaugauaaaaa

SEQ ID NO: 719722 - RNA, 23 nt, Haemophilus influenzae Rd
uaaaugauuauccacuaaaaaac

SEQ ID NO: 719723 - RNA, 16 nt, Haemophilus influenzae Rd
uaaaugaucagcuaaa

SEQ ID NO: 719724 - RNA, 17 nt, Haemophilus influenzae Rd
uaaaugaucuaaugggg

SEQ ID NO: 719725 - RNA, 21 nt, Haemophilus influenzae Rd
uaacauaggguguucaacuuc

SEQ ID NO: 719726 - RNA, 23 nt, Haemophilus influenzae Rd
uaacauaucguuaucuuuaaaga

SEQ ID NO: 719727 - RNA, 11 nt, Haemophilus influenzae Rd
uaacaucaacg

SEQ ID NO: 719728 - RNA, 15 nt, Haemophilus influenzae Rd
uaacauaccuagauu

SEQ ID NO: 719729 - RNA, 15 nt, Haemophilus influenzae Rd
uaacauagaaaucac

SEQ ID NO: 719730 - RNA, 16 nt, Haemophilus influenzae Rd
uaacauagaaaucacu

SEQ ID NO: 719731 - RNA, 15 nt, Haemophilus influenzae Rd
uaacauaacuuucca

SEQ ID NO: 719732 - RNA, 17 nt, Haemophilus influenzae Rd
uaacauaacuuuccaua

SEQ ID NO: 719733 - RNA, 20 nt, Haemophilus influenzae Rd
uaacauuugcguauuaugga

SEQ ID NO: 719734 - RNA, 16 nt, Haemophilus influenzae Rd
uaacauuuauuuuucu

SEQ ID NO: 719735 - RNA, 22 nt, Haemophilus influenzae Rd
uaacauuacacgagcaauggca

SEQ ID NO: 719736 - RNA, 19 nt, Haemophilus influenzae Rd
uaacauuccguuuuuaauc

SEQ ID NO: 719737 - RNA, 17 nt, Haemophilus influenzae Rd
uaacauugcaucagcca

SEQ ID NO: 719738 - RNA, 21 nt, Haemophilus influenzae Rd
uaacaauauucgcuucuuuua

SEQ ID NO: 719739 - RNA, 23 nt, Haemophilus influenzae Rd
uaacaaucccaggcuuaauugcu

SEQ ID NO: 719740 - RNA, 22 nt, Haemophilus influenzae Rd
uaacaaucgacuuuguccaaaa

SEQ ID NO: 719741 - RNA, 14 nt, Haemophilus influenzae Rd
uaacaaugaaaucg

SEQ ID NO: 719742 - RNA, 13 nt, Haemophilus influenzae Rd
uaacaaugaaauu

SEQ ID NO: 719743 - RNA, 16 nt, Haemophilus influenzae Rd
uaacaaugaaauuauu

SEQ ID NO: 719744 - RNA, 14 nt, Haemophilus influenzae Rd
uaacagcaaacuua

SEQ ID NO: 719745 - RNA, 20 nt, Haemophilus influenzae Rd
uaacagcaaacuuaaauaca

SEQ ID NO: 719746 - RNA, 21 nt, Haemophilus influenzae Rd
uaacagcaaacuuaaauacau

SEQ ID NO: 719747 - RNA, 13 nt, Haemophilus influenzae Rd
uaacaauguagaa

SEQ ID NO: 719748 - RNA, 18 nt, Haemophilus influenzae Rd
uaacaauauaucagacaa

SEQ ID NO: 719749 - RNA, 14 nt, Haemophilus influenzae Rd
uaacaguuaacgcu

SEQ ID NO: 719750 - RNA, 20 nt, Haemophilus influenzae Rd
uaacgaauuaguauaaacau

SEQ ID NO: 719751 - RNA, 19 nt, Haemophilus influenzae Rd
uaaccgcuuguguuucauu

SEQ ID NO: 719752 - RNA, 22 nt, Haemophilus influenzae Rd
uaaccuuaaaucaaacaaaauu

SEQ ID NO: 719753 - RNA, 14 nt, Haemophilus influenzae Rd
uaaccuuacugccu

SEQ ID NO: 719754 - RNA, 21 nt, Haemophilus influenzae Rd
uaaccuuacugccuuuuucuu

SEQ ID NO: 719755 - RNA, 17 nt, Haemophilus influenzae Rd
uaaccuuagcaccacuu

SEQ ID NO: 719756 - RNA, 21 nt, Haemophilus influenzae Rd
uaaccuuagcaccacuuaacg

SEQ ID NO: 719757 - RNA, 20 nt, Haemophilus influenzae Rd
uaaccuugcgcugcuuuauu

SEQ ID NO: 719758 - RNA, 19 nt, Haemophilus influenzae Rd
uaaccuugcugauaaauuc

SEQ ID NO: 719759 - RNA, 19 nt, Haemophilus influenzae Rd
uaaccgcacuguaauaaag

SEQ ID NO: 719760 - RNA, 16 nt, Haemophilus influenzae Rd
uaaccgcacuuucauu

SEQ ID NO: 719761 - RNA, 18 nt, Haemophilus influenzae Rd
uaaccgcacuuucauucc

SEQ ID NO: 719762 - RNA, 17 nt, Haemophilus influenzae Rd
uaaccgcacuuuuaauu

SEQ ID NO: 719763 - RNA, 17 nt, Haemophilus influenzae Rd
uaaccgcacuuuuucuu

SEQ ID NO: 719764 - RNA, 11 nt, Haemophilus influenzae Rd
uaacccauuua

SEQ ID NO: 719765 - RNA, 11 nt, Haemophilus influenzae Rd
uaaccaaagaa

SEQ ID NO: 719766 - RNA, 20 nt, Haemophilus influenzae Rd
uaaccaaagcguccaagcaa

SEQ ID NO: 719767 - RNA, 23 nt, Haemophilus influenzae Rd
uaaccaaauagaugaaauuuauu

SEQ ID NO: 719768 - RNA, 19 nt, Haemophilus influenzae Rd
uaaccaagcguuaauccaa

SEQ ID NO: 719769 - RNA, 17 nt, Haemophilus influenzae Rd
uaaccaagcuguaccag

SEQ ID NO: 719770 - RNA, 14 nt, Haemophilus influenzae Rd
uaaccaauauuugu

SEQ ID NO: 719771 - RNA, 16 nt, Haemophilus influenzae Rd
uaaccaacauaaacau

SEQ ID NO: 719772 - RNA, 23 nt, Haemophilus influenzae Rd
uaaccaacauaaacauuggucgc

SEQ ID NO: 719773 - RNA, 22 nt, Haemophilus influenzae Rd
uaaccaacguggcuuuucugau

SEQ ID NO: 719774 - RNA, 16 nt, Haemophilus influenzae Rd
uaaccaagccaaacua

SEQ ID NO: 719775 - RNA, 17 nt, Haemophilus influenzae Rd
uaaccaagccaaacuau

SEQ ID NO: 719776 - RNA, 20 nt, Haemophilus influenzae Rd
uaaccacaaaaucugcuccg

SEQ ID NO: 719777 - RNA, 22 nt, Haemophilus influenzae Rd
uaaaaagcccaaaugcaacaau

SEQ ID NO: 719778 - RNA, 11 nt, Haemophilus influenzae Rd
uaaaaagauaa

SEQ ID NO: 719779 - RNA, 13 nt, Haemophilus influenzae Rd
uaaaaagcacuga

SEQ ID NO: 719780 - RNA, 20 nt, Haemophilus influenzae Rd
uaaaaagcacugaaauucau

SEQ ID NO: 719781 - RNA, 19 nt, Haemophilus influenzae Rd
uaaaaagaaauaaaagaua

SEQ ID NO: 719782 - RNA, 12 nt, Haemophilus influenzae Rd
uaaaaagaaaua

SEQ ID NO: 719783 - RNA, 14 nt, Haemophilus influenzae Rd
uaaaaagacuaaac

SEQ ID NO: 719784 - RNA, 17 nt, Haemophilus influenzae Rd
uaaaaagugcgguaaau

SEQ ID NO: 719785 - RNA, 20 nt, Haemophilus influenzae Rd
uaaaaagugcgguaaauuuu

SEQ ID NO: 719786 - RNA, 21 nt, Haemophilus influenzae Rd
uaaaaagugcggugaaauuuu

SEQ ID NO: 719787 - RNA, 19 nt, Haemophilus influenzae Rd
uaaaaagugcgguuaauuu

SEQ ID NO: 719788 - RNA, 21 nt, Haemophilus influenzae Rd
uaaaaaguacagcaaaccaag

SEQ ID NO: 719789 - RNA, 20 nt, Haemophilus influenzae Rd
uaaaaagggaugguuaauuu

SEQ ID NO: 719790 - RNA, 22 nt, Haemophilus influenzae Rd
uaaaaauaauguuuuuaugacc

SEQ ID NO: 719791 - RNA, 22 nt, Haemophilus influenzae Rd
uaaaaauaauuagauaauacag

SEQ ID NO: 719792 - RNA, 21 nt, Haemophilus influenzae Rd
uaaaaauaacccuuacuuuau

SEQ ID NO: 719793 - RNA, 12 nt, Haemophilus influenzae Rd
uaaaaauaaaua

SEQ ID NO: 719794 - RNA, 13 nt, Haemophilus influenzae Rd
uaaaaauaaaaac

SEQ ID NO: 719795 - RNA, 14 nt, Haemophilus influenzae Rd
uaaaaauaaaaaca

SEQ ID NO: 719796 - RNA, 15 nt, Haemophilus influenzae Rd
uaaaaauaaaaacau

SEQ ID NO: 719797 - RNA, 21 nt, Haemophilus influenzae Rd
uaaaaaccgcugucauauuca

SEQ ID NO: 719798 - RNA, 23 nt, Haemophilus influenzae Rd
uaaaaacucgaauagaagugagu

SEQ ID NO: 719799 - RNA, 22 nt, Haemophilus influenzae Rd
uaaaaaauaauuuaguuauaug

SEQ ID NO: 719800 - RNA, 13 nt, Haemophilus influenzae Rd
uaaaaaauaaauu

SEQ ID NO: 719801 - RNA, 22 nt, Haemophilus influenzae Rd
uaaaaaaugauuaaguuaaaag

SEQ ID NO: 719802 - RNA, 15 nt, Haemophilus influenzae Rd
uaaaaacaaauauau

SEQ ID NO: 719803 - RNA, 14 nt, Haemophilus influenzae Rd
uaaaaaauuaaaag

SEQ ID NO: 719804 - RNA, 19 nt, Haemophilus influenzae Rd
uaaaaaaacccaguuuuaa

SEQ ID NO: 719805 - RNA, 21 nt, Haemophilus influenzae Rd
uaaaaaaacccaguuuuaaac

SEQ ID NO: 719806 - RNA, 17 nt, Haemophilus influenzae Rd
uaaaaaaaucugcacuu

SEQ ID NO: 719807 - RNA, 16 nt, Haemophilus influenzae Rd
uaaaaaaauaguuaau

SEQ ID NO: 719808 - RNA, 20 nt, Haemophilus influenzae Rd
uaaaaaagugcgguaaaauu

SEQ ID NO: 719809 - RNA, 16 nt, Haemophilus influenzae Rd
uaaaaaagaguaaaua

SEQ ID NO: 719810 - RNA, 18 nt, Haemophilus influenzae Rd
uaaaaaagaguaaauauu

SEQ ID NO: 719811 - RNA, 14 nt, Haemophilus influenzae Rd
uaaaaaagcgaauu

SEQ ID NO: 719812 - RNA, 21 nt, Haemophilus influenzae Rd
uaaaaaagcguugaguaaaua

SEQ ID NO: 719813 - RNA, 19 nt, Haemophilus influenzae Rd
uaaaaaacccguaauuaaa

SEQ ID NO: 719814 - RNA, 20 nt, Haemophilus influenzae Rd
uaaaaaacccguaauuaaaa

SEQ ID NO: 719815 - RNA, 22 nt, Haemophilus influenzae Rd
uaaaaaacccguaauuaaaaau

SEQ ID NO: 719816 - RNA, 15 nt, Haemophilus influenzae Rd
guuuuugucguucuu

SEQ ID NO: 719817 - RNA, 18 nt, Haemophilus influenzae Rd
guuuuugcauagccacua

SEQ ID NO: 719818 - RNA, 16 nt, Haemophilus influenzae Rd
guuuuuaaucguccaa

SEQ ID NO: 719819 - RNA, 14 nt, Haemophilus influenzae Rd
guuuuucgaucucu

SEQ ID NO: 719820 - RNA, 16 nt, Haemophilus influenzae Rd
guuuuucgcugcagcu

SEQ ID NO: 719821 - RNA, 13 nt, Haemophilus influenzae Rd
guuuuuuccagcg

SEQ ID NO: 719822 - RNA, 18 nt, Haemophilus influenzae Rd
guuuuuugaugaaaauua

SEQ ID NO: 719823 - RNA, 14 nt, Haemophilus influenzae Rd
guuuuuuuauaaaa

SEQ ID NO: 719824 - RNA, 12 nt, Haemophilus influenzae Rd
guuuuuguuucg

SEQ ID NO: 719825 - RNA, 20 nt, Haemophilus influenzae Rd
guuuuuuacgaacuaauaag

SEQ ID NO: 719826 - RNA, 11 nt, Haemophilus influenzae Rd
guuuuuuagaa

SEQ ID NO: 719827 - RNA, 17 nt, Haemophilus influenzae Rd
guuuuccuuucuuuccg

SEQ ID NO: 719828 - RNA, 23 nt, Haemophilus influenzae Rd
guuuuccguauuuucacgguuuu

SEQ ID NO: 719829 - RNA, 19 nt, Haemophilus influenzae Rd
guuuuccguuaaaaguuuu

SEQ ID NO: 719830 - RNA, 17 nt, Haemophilus influenzae Rd
guuuuccacuucuucuu

SEQ ID NO: 719831 - RNA, 15 nt, Haemophilus influenzae Rd
guuuuccaaaaacca

SEQ ID NO: 719832 - RNA, 20 nt, Haemophilus influenzae Rd
guuuucgcaauaucaucauc

SEQ ID NO: 719833 - RNA, 17 nt, Haemophilus influenzae Rd
guuuucuacugaaccau

SEQ ID NO: 719834 - RNA, 13 nt, Haemophilus influenzae Rd
guuuucucguccg

SEQ ID NO: 719835 - RNA, 18 nt, Haemophilus influenzae Rd
guuuucugaacuaaaaua

SEQ ID NO: 719836 - RNA, 12 nt, Haemophilus influenzae Rd
guuuucuugcca

SEQ ID NO: 719837 - RNA, 18 nt, Haemophilus influenzae Rd
guuuugucugaaauuuuu

SEQ ID NO: 719838 - RNA, 18 nt, Haemophilus influenzae Rd
guuuugugaguaaaauac

SEQ ID NO: 719839 - RNA, 15 nt, Haemophilus influenzae Rd
guuuuguucaucuaa

SEQ ID NO: 719840 - RNA, 23 nt, Haemophilus influenzae Rd
aaaucaguuauugauaaaaauau

SEQ ID NO: 719841 - RNA, 19 nt, Haemophilus influenzae Rd
aaaucagcccuuauuuuuu

SEQ ID NO: 719842 - RNA, 20 nt, Haemophilus influenzae Rd
guuuucaucuaagugaauga

SEQ ID NO: 719843 - RNA, 22 nt, Haemophilus influenzae Rd
guuuuauauucauuuaaaacaa

SEQ ID NO: 719844 - RNA, 20 nt, Haemophilus influenzae Rd
guuuuaucgagauuucuuug

SEQ ID NO: 719845 - RNA, 21 nt, Haemophilus influenzae Rd
guuuuaucgagauuucuuuga

SEQ ID NO: 719846 - RNA, 21 nt, Haemophilus influenzae Rd
guuugccgaagccuaaaucuu

SEQ ID NO: 719847 - RNA, 14 nt, Haemophilus influenzae Rd
guuugaucgguuuu

SEQ ID NO: 719848 - RNA, 20 nt, Haemophilus influenzae Rd
guuugaucgguuuuauuauu

SEQ ID NO: 719849 - RNA, 16 nt, Haemophilus influenzae Rd
guuuauuuuuauuauu

SEQ ID NO: 719850 - RNA, 15 nt, Haemophilus influenzae Rd
guuucuuuucaucuu

SEQ ID NO: 719851 - RNA, 23 nt, Haemophilus influenzae Rd
guuucuuuguucacaucaaaauu

SEQ ID NO: 719852 - RNA, 14 nt, Haemophilus influenzae Rd
guuugaaaucaaau

SEQ ID NO: 719853 - RNA, 17 nt, Haemophilus influenzae Rd
guuugaacaaauucagc

SEQ ID NO: 719854 - RNA, 18 nt, Haemophilus influenzae Rd
guuugaacaaauucagcu

SEQ ID NO: 719855 - RNA, 14 nt, Haemophilus influenzae Rd
guuugaaaagaaau

SEQ ID NO: 719856 - RNA, 23 nt, Haemophilus influenzae Rd
guuugaauaauugaucugcuggu

SEQ ID NO: 719857 - RNA, 18 nt, Haemophilus influenzae Rd
aaaucagcgcauuuuuua

SEQ ID NO: 719858 - RNA, 16 nt, Haemophilus influenzae Rd
aaaucagcaaauuguu

SEQ ID NO: 719859 - RNA, 17 nt, Haemophilus influenzae Rd
aaaucagcuaauaacac

SEQ ID NO: 719860 - RNA, 19 nt, Haemophilus influenzae Rd
guuuuaauaaaaacgugcu

SEQ ID NO: 719861 - RNA, 23 nt, Haemophilus influenzae Rd
guuuuaauccuuccaaauccauc

SEQ ID NO: 719862 - RNA, 21 nt, Haemophilus influenzae Rd
guuuuaaccguuauaacguuu

SEQ ID NO: 719863 - RNA, 13 nt, Haemophilus influenzae Rd
guuuuaauacuaa

SEQ ID NO: 719864 - RNA, 18 nt, Haemophilus influenzae Rd
guuuguagcgauauucuu

SEQ ID NO: 719865 - RNA, 20 nt, Haemophilus influenzae Rd
guuuguaaaaguaggagcaa

SEQ ID NO: 719866 - RNA, 15 nt, Haemophilus influenzae Rd
guuuguuuuuaaccu

SEQ ID NO: 719867 - RNA, 13 nt, Haemophilus influenzae Rd
guuuuaaaaucuc

SEQ ID NO: 719868 - RNA, 14 nt, Haemophilus influenzae Rd
guuuuaaaaucucu

SEQ ID NO: 719869 - RNA, 18 nt, Haemophilus influenzae Rd
guuuuaaaaucucucaaa

SEQ ID NO: 719870 - RNA, 16 nt, Haemophilus influenzae Rd
uaaaacuauaaaaauu

SEQ ID NO: 719871 - RNA, 18 nt, Haemophilus influenzae Rd
uaaaacuauuuuuaauuu

SEQ ID NO: 719872 - RNA, 15 nt, Haemophilus influenzae Rd
uaaaacuaauuugca

SEQ ID NO: 719873 - RNA, 21 nt, Haemophilus influenzae Rd
uaaaacgggaucuauuugauu

SEQ ID NO: 719874 - RNA, 17 nt, Haemophilus influenzae Rd
uaaaacgaacaauuucu

SEQ ID NO: 719875 - RNA, 19 nt, Haemophilus influenzae Rd
uaaaaccuuguaaacgauu

SEQ ID NO: 719876 - RNA, 15 nt, Haemophilus influenzae Rd
uaaaaccucagaaga

SEQ ID NO: 719877 - RNA, 18 nt, Haemophilus influenzae Rd
uaaaaccucagaagaaau

SEQ ID NO: 719878 - RNA, 22 nt, Haemophilus influenzae Rd
uaaaagccuucagccugcucac

SEQ ID NO: 719879 - RNA, 18 nt, Haemophilus influenzae Rd
uaaaagcaccgcauugua

SEQ ID NO: 719880 - RNA, 17 nt, Haemophilus influenzae Rd
uaaaagcaccuaaaauu

SEQ ID NO: 719881 - RNA, 15 nt, Haemophilus influenzae Rd
uaaaagauaaaacag

SEQ ID NO: 719882 - RNA, 19 nt, Haemophilus influenzae Rd
uaaaagauaaaacagagaa

SEQ ID NO: 719883 - RNA, 14 nt, Haemophilus influenzae Rd
uaaaagauaaacaa

SEQ ID NO: 719884 - RNA, 21 nt, Haemophilus influenzae Rd
uaaaagauaaacaaaccuaaa

SEQ ID NO: 719885 - RNA, 15 nt, Haemophilus influenzae Rd
uaaaagcaauaaucc

SEQ ID NO: 719886 - RNA, 23 nt, Haemophilus influenzae Rd
uaaaacuugacguuguucuucug

SEQ ID NO: 719887 - RNA, 16 nt, Haemophilus influenzae Rd
uaaaacuugcaaacca

SEQ ID NO: 719888 - RNA, 17 nt, Haemophilus influenzae Rd
uaaaacuugcaaaccaa

SEQ ID NO: 719889 - RNA, 14 nt, Haemophilus influenzae Rd
uaaaacuuccuaau

SEQ ID NO: 719890 - RNA, 12 nt, Haemophilus influenzae Rd
uaaaacauuuca

SEQ ID NO: 719891 - RNA, 21 nt, Haemophilus influenzae Rd
uaaaaccauccgaaauuaauu

SEQ ID NO: 719892 - RNA, 16 nt, Haemophilus influenzae Rd
uaaaaccaauaauccu

SEQ ID NO: 719893 - RNA, 22 nt, Haemophilus influenzae Rd
uaaaaccaauuuuuucauacaa

SEQ ID NO: 719894 - RNA, 18 nt, Haemophilus influenzae Rd
uaaaaccacaauaaaaua

SEQ ID NO: 719895 - RNA, 19 nt, Haemophilus influenzae Rd
uaaaacaaugcaaauacaa

SEQ ID NO: 719896 - RNA, 19 nt, Haemophilus influenzae Rd
uaaaacaccgucuaaauug

SEQ ID NO: 719897 - RNA, 18 nt, Haemophilus influenzae Rd
uaaaacagagaaaaaaau

SEQ ID NO: 719898 - RNA, 19 nt, Haemophilus influenzae Rd
uaaaacagagaaaaaaaua

SEQ ID NO: 719899 - RNA, 21 nt, Haemophilus influenzae Rd
uaaaaauuucucucauuuuuu

SEQ ID NO: 719900 - RNA, 16 nt, Haemophilus influenzae Rd
uaaaacaacaguagaa

SEQ ID NO: 719901 - RNA, 16 nt, Haemophilus influenzae Rd
uaaaacaaaagaaauu

SEQ ID NO: 719902 - RNA, 14 nt, Haemophilus influenzae Rd
uaaaaaucguacau

SEQ ID NO: 719903 - RNA, 20 nt, Haemophilus influenzae Rd
uaaaaaucguacaucgaaaa

SEQ ID NO: 719904 - RNA, 20 nt, Haemophilus influenzae Rd
uaaaaaucugugauauauau

SEQ ID NO: 719905 - RNA, 22 nt, Haemophilus influenzae Rd
uaaaaauccccauuauugugau

SEQ ID NO: 719906 - RNA, 21 nt, Haemophilus influenzae Rd
uaaaaauccgccacuuugaug

SEQ ID NO: 719907 - RNA, 16 nt, Haemophilus influenzae Rd
uaaaaaucaucguauu

SEQ ID NO: 719908 - RNA, 19 nt, Haemophilus influenzae Rd
uaaaaaucaucguauuaaa

SEQ ID NO: 719909 - RNA, 21 nt, Haemophilus influenzae Rd
uaaaaaucaucguauuaaaag

SEQ ID NO: 719910 - RNA, 16 nt, Haemophilus influenzae Rd
uaaaaaucauuaaaua

SEQ ID NO: 719911 - RNA, 13 nt, Haemophilus influenzae Rd
uaaaaauauauuu

SEQ ID NO: 719912 - RNA, 15 nt, Haemophilus influenzae Rd
uaaaaauauguauuu

SEQ ID NO: 719913 - RNA, 11 nt, Haemophilus influenzae Rd
uaaaaauuuac

SEQ ID NO: 719914 - RNA, 15 nt, Haemophilus influenzae Rd
uaaaaauuuaaauau

SEQ ID NO: 719915 - RNA, 18 nt, Haemophilus influenzae Rd
uaaaaauuuaaauauaau

SEQ ID NO: 719916 - RNA, 20 nt, Haemophilus influenzae Rd
uaaaaauuggaaaauaaaau

SEQ ID NO: 719917 - RNA, 12 nt, Haemophilus influenzae Rd
uaaaaauuuaaa

SEQ ID NO: 719918 - RNA, 21 nt, Haemophilus influenzae Rd
uaaaaauugaucuaaauuauc

SEQ ID NO: 719919 - RNA, 20 nt, Haemophilus influenzae Rd
uaaaaauuagguaacuaaag

SEQ ID NO: 719920 - RNA, 17 nt, Haemophilus influenzae Rd
uaaaaauuaucaucauu

SEQ ID NO: 719921 - RNA, 15 nt, Haemophilus influenzae Rd
uaaaaaugggguuac

SEQ ID NO: 719922 - RNA, 19 nt, Haemophilus influenzae Rd
uaaaaaugcuguuucuaau

SEQ ID NO: 719923 - RNA, 15 nt, Haemophilus influenzae Rd
uaaaaauggaaaaag

SEQ ID NO: 719924 - RNA, 16 nt, Haemophilus influenzae Rd
uaaaaaugaauaaaau

SEQ ID NO: 719925 - RNA, 17 nt, Haemophilus influenzae Rd
uaaaaaugagauuauuu

SEQ ID NO: 719926 - RNA, 20 nt, Haemophilus influenzae Rd
uaaaaaugagauuauuucua

SEQ ID NO: 719927 - RNA, 19 nt, Haemophilus influenzae Rd
uaaaagugcggcuucauuu

SEQ ID NO: 719928 - RNA, 23 nt, Haemophilus influenzae Rd
uaaaagugcggcuucauuuugag

SEQ ID NO: 719929 - RNA, 19 nt, Haemophilus influenzae Rd
uaaaagugcgguaaaaauu

SEQ ID NO: 719930 - RNA, 19 nt, Haemophilus influenzae Rd
uaaaagugcggugauuuuu

SEQ ID NO: 719931 - RNA, 22 nt, Haemophilus influenzae Rd
uaaaagugcgguuaaaauuucu

SEQ ID NO: 719932 - RNA, 22 nt, Haemophilus influenzae Rd
uaaaagugcgguugauuuuccu

SEQ ID NO: 719933 - RNA, 17 nt, Haemophilus influenzae Rd
uaaaaguggaagucauu

SEQ ID NO: 719934 - RNA, 15 nt, Haemophilus influenzae Rd
uaaaaguaucuugcu

SEQ ID NO: 719935 - RNA, 17 nt, Haemophilus influenzae Rd
uaaaaguuuacuauuaa

SEQ ID NO: 719936 - RNA, 23 nt, Haemophilus influenzae Rd
uaaaaguuuaguccuuaauuuaa

SEQ ID NO: 719937 - RNA, 21 nt, Haemophilus influenzae Rd
uaaaauaaaacccaguuuaaa

SEQ ID NO: 719938 - RNA, 15 nt, Haemophilus influenzae Rd
uaaaauaaaagaauu

SEQ ID NO: 719939 - RNA, 19 nt, Haemophilus influenzae Rd
uaaaauaaacauuuuucau

SEQ ID NO: 719940 - RNA, 21 nt, Haemophilus influenzae Rd
uaaaauaaacauuuuucauuu

SEQ ID NO: 719941 - RNA, 22 nt, Haemophilus influenzae Rd
uaaaaggcuuucuguguuagaa

SEQ ID NO: 719942 - RNA, 18 nt, Haemophilus influenzae Rd
uaaaagggaacauuuucu

SEQ ID NO: 719943 - RNA, 23 nt, Haemophilus influenzae Rd
uaaaaguaagcaauuuucugcag

SEQ ID NO: 719944 - RNA, 14 nt, Haemophilus influenzae Rd
uaaaaguaaaaaua

SEQ ID NO: 719945 - RNA, 16 nt, Haemophilus influenzae Rd
uaaaaguaaaaauaaa

SEQ ID NO: 719946 - RNA, 13 nt, Haemophilus influenzae Rd
uaaaaguaaacaa

SEQ ID NO: 719947 - RNA, 15 nt, Haemophilus influenzae Rd
uaaaaguaaacaauu

SEQ ID NO: 719948 - RNA, 20 nt, Haemophilus influenzae Rd
uaaaagcuguuguuguggau

SEQ ID NO: 719949 - RNA, 14 nt, Haemophilus influenzae Rd
uaaaaggacuaaac

SEQ ID NO: 719950 - RNA, 16 nt, Haemophilus influenzae Rd
uaaaauaauaucacaa

SEQ ID NO: 719951 - RNA, 15 nt, Haemophilus influenzae Rd
uaaaauaaugcaaaa

SEQ ID NO: 719952 - RNA, 18 nt, Haemophilus influenzae Rd
uaaaauaaccuuaaauca

SEQ ID NO: 719953 - RNA, 19 nt, Haemophilus influenzae Rd
uaaaauaaccuuaaaucaa

SEQ ID NO: 719954 - RNA, 12 nt, Haemophilus influenzae Rd
uaaaauaagaau

SEQ ID NO: 719955 - RNA, 13 nt, Haemophilus influenzae Rd
uaaaauacgcccc

SEQ ID NO: 719956 - RNA, 17 nt, Haemophilus influenzae Rd
uaaaauacccauaaaau

SEQ ID NO: 719957 - RNA, 16 nt, Haemophilus influenzae Rd
uaaaauagcuaacaaa

SEQ ID NO: 719958 - RNA, 21 nt, Haemophilus influenzae Rd
uaaaauagcuaacaaauuuaa

SEQ ID NO: 719959 - RNA, 22 nt, Haemophilus influenzae Rd
uaaaauagcuaacaaauuuaau

SEQ ID NO: 719960 - RNA, 23 nt, Haemophilus influenzae Rd
uaaaauagcuaacaaauuuaaua

SEQ ID NO: 719961 - RNA, 19 nt, Haemophilus influenzae Rd
uaaaauagccuaaauauuu

SEQ ID NO: 719962 - RNA, 21 nt, Haemophilus influenzae Rd
uaaaauagccuaaauauuuau

SEQ ID NO: 719963 - RNA, 18 nt, Haemophilus influenzae Rd
uaaaauagaaugaaaaac

SEQ ID NO: 719964 - RNA, 22 nt, Haemophilus influenzae Rd
uaaaauagaaugaaaaacauuc

SEQ ID NO: 719965 - RNA, 18 nt, Haemophilus influenzae Rd
uaaaauagacaauauuga

SEQ ID NO: 719966 - RNA, 17 nt, Haemophilus influenzae Rd
uaaaauauaacauuuau

SEQ ID NO: 719967 - RNA, 18 nt, Haemophilus influenzae Rd
uaaaauauacaauucuug

SEQ ID NO: 719968 - RNA, 15 nt, Haemophilus influenzae Rd
uaaaauauauauuau

SEQ ID NO: 719969 - RNA, 21 nt, Haemophilus influenzae Rd
uaaaauauauauuaucgucua

SEQ ID NO: 719970 - RNA, 23 nt, Haemophilus influenzae Rd
uaaaauauauuaauuauuuuaga

SEQ ID NO: 719971 - RNA, 15 nt, Haemophilus influenzae Rd
uaaaauguaauagcc

SEQ ID NO: 719972 - RNA, 17 nt, Haemophilus influenzae Rd
uaaaauguugaauauaa

SEQ ID NO: 719973 - RNA, 19 nt, Haemophilus influenzae Rd
uaaaauguugaauauaaua

SEQ ID NO: 719974 - RNA, 14 nt, Haemophilus influenzae Rd
uaaaauuaagcaau

SEQ ID NO: 719975 - RNA, 19 nt, Haemophilus influenzae Rd
uaaaaugccguuuaccaua

SEQ ID NO: 719976 - RNA, 14 nt, Haemophilus influenzae Rd
uaaaauggauaaac

SEQ ID NO: 719977 - RNA, 16 nt, Haemophilus influenzae Rd
uaaaaugggucaagau

SEQ ID NO: 719978 - RNA, 23 nt, Haemophilus influenzae Rd
uaaaaugggucaagauuaaucuu

SEQ ID NO: 719979 - RNA, 22 nt, Haemophilus influenzae Rd
uaaaauggcgguuuuuuaauuu

SEQ ID NO: 719980 - RNA, 15 nt, Haemophilus influenzae Rd
uaaaauguaaaaaau

SEQ ID NO: 719981 - RNA, 18 nt, Haemophilus influenzae Rd
uaaaauguaaaaaauccu

SEQ ID NO: 719982 - RNA, 15 nt, Haemophilus influenzae Rd
uaaaaugaacaaaaa

SEQ ID NO: 719983 - RNA, 16 nt, Haemophilus influenzae Rd
uaaaaugaacaaaaaa

SEQ ID NO: 719984 - RNA, 17 nt, Haemophilus influenzae Rd
uaaaaugaacaaaaaau

SEQ ID NO: 719985 - RNA, 18 nt, Haemophilus influenzae Rd
uaaaaugaacaaaaaauu

SEQ ID NO: 719986 - RNA, 12 nt, Haemophilus influenzae Rd
uaaaaucucuau

SEQ ID NO: 719987 - RNA, 18 nt, Haemophilus influenzae Rd
uaaaaucucucaaaaauc

SEQ ID NO: 719988 - RNA, 21 nt, Haemophilus influenzae Rd
uaaaaucucucaaaaaucaac

SEQ ID NO: 719989 - RNA, 15 nt, Haemophilus influenzae Rd
uaaaaucuuuggauu

SEQ ID NO: 719990 - RNA, 18 nt, Haemophilus influenzae Rd
uaaaaucuuuggauuggu

SEQ ID NO: 719991 - RNA, 19 nt, Haemophilus influenzae Rd
uaaaaucuugguuuaaauu

SEQ ID NO: 719992 - RNA, 17 nt, Haemophilus influenzae Rd
uaaaauauuuuuuauuu

SEQ ID NO: 719993 - RNA, 15 nt, Haemophilus influenzae Rd
uaaaaucacauaaaa

SEQ ID NO: 719994 - RNA, 20 nt, Haemophilus influenzae Rd
uaaaaucacauaaaaaauga

SEQ ID NO: 719995 - RNA, 22 nt, Haemophilus influenzae Rd
uaaaauauccacauaaccaaag

SEQ ID NO: 719996 - RNA, 21 nt, Haemophilus influenzae Rd
uaaaauaucuuguuuuaauau

SEQ ID NO: 719997 - RNA, 12 nt, Haemophilus influenzae Rd
uaaaauauuaag

SEQ ID NO: 719998 - RNA, 22 nt, Haemophilus influenzae Rd
uaaaauauuaagugcaacugcu

SEQ ID NO: 719999 - RNA, 16 nt, Haemophilus influenzae Rd
uaaaauauuuggcuga

SEQ ID NO: 720000 - RNA, 15 nt, Haemophilus influenzae Rd
uaaaauauuuucccc

SEQ ID NO: 720001 - RNA, 12 nt, Haemophilus influenzae Rd
uaaaaucgccug

SEQ ID NO: 720002 - RNA, 15 nt, Haemophilus influenzae Rd
guagaaaacaauaaa

SEQ ID NO: 720003 - RNA, 16 nt, Haemophilus influenzae Rd
guagaaaacaauaaaa

SEQ ID NO: 720004 - RNA, 13 nt, Haemophilus influenzae Rd
guagaaaggcaau

SEQ ID NO: 720005 - RNA, 18 nt, Haemophilus influenzae Rd
guagaaaaucgcaauaaa

SEQ ID NO: 720006 - RNA, 18 nt, Haemophilus influenzae Rd
guagaaaauuugaacagg

SEQ ID NO: 720007 - RNA, 21 nt, Haemophilus influenzae Rd
guacuguugcgauuuccacuu

SEQ ID NO: 720008 - RNA, 16 nt, Haemophilus influenzae Rd
guacuuggauugcaug

SEQ ID NO: 720009 - RNA, 21 nt, Haemophilus influenzae Rd
guacguccaugaacuguaauu

SEQ ID NO: 720010 - RNA, 17 nt, Haemophilus influenzae Rd
guacucgaaaaggcaaa

SEQ ID NO: 720011 - RNA, 19 nt, Haemophilus influenzae Rd
guagagcagggauuuucau

SEQ ID NO: 720012 - RNA, 14 nt, Haemophilus influenzae Rd
guagagauaauaaa

SEQ ID NO: 720013 - RNA, 21 nt, Haemophilus influenzae Rd
guagaucgacuccacuuugcu

SEQ ID NO: 720014 - RNA, 14 nt, Haemophilus influenzae Rd
guagcacuuuccau

SEQ ID NO: 720015 - RNA, 22 nt, Haemophilus influenzae Rd
guagcacuuuccaucauugcuc

SEQ ID NO: 720016 - RNA, 12 nt, Haemophilus influenzae Rd
guagauuuucau

SEQ ID NO: 720017 - RNA, 13 nt, Haemophilus influenzae Rd
guagguaguuuuc

SEQ ID NO: 720018 - RNA, 19 nt, Haemophilus influenzae Rd
guaguacaucauuugcaau

SEQ ID NO: 720019 - RNA, 18 nt, Haemophilus influenzae Rd
guagugaguauguugcuu

SEQ ID NO: 720020 - RNA, 14 nt, Haemophilus influenzae Rd
guaguguuuuauuu

SEQ ID NO: 720021 - RNA, 19 nt, Haemophilus influenzae Rd
guaguuaaaccaaauuuug

SEQ ID NO: 720022 - RNA, 22 nt, Haemophilus influenzae Rd
guaguggugguggaauaaauaa

SEQ ID NO: 720023 - RNA, 14 nt, Haemophilus influenzae Rd
guaguauuuuauuu

SEQ ID NO: 720024 - RNA, 15 nt, Haemophilus influenzae Rd
guagcguaaaccuug

SEQ ID NO: 720025 - RNA, 17 nt, Haemophilus influenzae Rd
guagccuaguauuuuug

SEQ ID NO: 720026 - RNA, 19 nt, Haemophilus influenzae Rd
guaggauguucaaguaaau

SEQ ID NO: 720027 - RNA, 21 nt, Haemophilus influenzae Rd
guagcugaauaucagaagaau

SEQ ID NO: 720028 - RNA, 17 nt, Haemophilus influenzae Rd
guauaagcaaugcaagc

SEQ ID NO: 720029 - RNA, 21 nt, Haemophilus influenzae Rd
guauaacguagcgauaaaaua

SEQ ID NO: 720030 - RNA, 22 nt, Haemophilus influenzae Rd
guauaacaaauaggauaaaaau

SEQ ID NO: 720031 - RNA, 22 nt, Haemophilus influenzae Rd
guauaaauaauggcgauaauua

SEQ ID NO: 720032 - RNA, 22 nt, Haemophilus influenzae Rd
guauaauauuuucuuuuauccg

SEQ ID NO: 720033 - RNA, 18 nt, Haemophilus influenzae Rd
guauaauuccuaaaauac

SEQ ID NO: 720034 - RNA, 14 nt, Haemophilus influenzae Rd
guaguuggaacuga

SEQ ID NO: 720035 - RNA, 18 nt, Haemophilus influenzae Rd
guaguuuaggaaguaaau

SEQ ID NO: 720036 - RNA, 17 nt, Haemophilus influenzae Rd
guaguuuauaaaaaaau

SEQ ID NO: 720037 - RNA, 18 nt, Haemophilus influenzae Rd
guaguuuauaaaaaaauc

SEQ ID NO: 720038 - RNA, 20 nt, Haemophilus influenzae Rd
guaguuuuucacgccgauac

SEQ ID NO: 720039 - RNA, 13 nt, Haemophilus influenzae Rd
guauaaaaaagug

SEQ ID NO: 720040 - RNA, 19 nt, Haemophilus influenzae Rd
guaguuuucuguauaccaa

SEQ ID NO: 720041 - RNA, 18 nt, Haemophilus influenzae Rd
guauaaacaucagugauu

SEQ ID NO: 720042 - RNA, 12 nt, Haemophilus influenzae Rd
guauaaaccuug

SEQ ID NO: 720043 - RNA, 15 nt, Haemophilus influenzae Rd
guauagcuuugcuuu

SEQ ID NO: 720044 - RNA, 16 nt, Haemophilus influenzae Rd
guauauuguuugcuuu

SEQ ID NO: 720045 - RNA, 12 nt, Haemophilus influenzae Rd
guauauuuaucu

SEQ ID NO: 720046 - RNA, 16 nt, Haemophilus influenzae Rd
guauauuuaucuaagc

SEQ ID NO: 720047 - RNA, 18 nt, Haemophilus influenzae Rd
guauauucuguaucaauu

SEQ ID NO: 720048 - RNA, 18 nt, Haemophilus influenzae Rd
guauagucauucaaugca

SEQ ID NO: 720049 - RNA, 23 nt, Haemophilus influenzae Rd
guauauaagcguucguuaucauu

SEQ ID NO: 720050 - RNA, 16 nt, Haemophilus influenzae Rd
guaucuaaauuugcug

SEQ ID NO: 720051 - RNA, 16 nt, Haemophilus influenzae Rd
guaucuacuuuauuca

SEQ ID NO: 720052 - RNA, 14 nt, Haemophilus influenzae Rd
guaugaaaaaugcu

SEQ ID NO: 720053 - RNA, 18 nt, Haemophilus influenzae Rd
guaugacuauuuagaaau

SEQ ID NO: 720054 - RNA, 23 nt, Haemophilus influenzae Rd
guauccaauccuaaaucugccaa

SEQ ID NO: 720055 - RNA, 18 nt, Haemophilus influenzae Rd
guaucauuuaauaauuua

SEQ ID NO: 720056 - RNA, 17 nt, Haemophilus influenzae Rd
guaucagaaauuaccac

SEQ ID NO: 720057 - RNA, 21 nt, Haemophilus influenzae Rd
guaucagcuguugcaaugaca

SEQ ID NO: 720058 - RNA, 17 nt, Haemophilus influenzae Rd
guaucaauuuuauugaa

SEQ ID NO: 720059 - RNA, 23 nt, Haemophilus influenzae Rd
guaugggagacgccuaaacguug

SEQ ID NO: 720060 - RNA, 17 nt, Haemophilus influenzae Rd
guauguauuuucaacaa

SEQ ID NO: 720061 - RNA, 22 nt, Haemophilus influenzae Rd
guauuaaaaaagugcgguaaau

SEQ ID NO: 720062 - RNA, 14 nt, Haemophilus influenzae Rd
guauuaaauaccgc

SEQ ID NO: 720063 - RNA, 21 nt, Haemophilus influenzae Rd
guauuaaucugauaaauuuug

SEQ ID NO: 720064 - RNA, 15 nt, Haemophilus influenzae Rd
guauuagaaguaaau

SEQ ID NO: 720065 - RNA, 20 nt, Haemophilus influenzae Rd
guauuagguaaauuugguuc

SEQ ID NO: 720066 - RNA, 12 nt, Haemophilus influenzae Rd
guauuauaccgc

SEQ ID NO: 720067 - RNA, 17 nt, Haemophilus influenzae Rd
guaugaugauuguuauu

SEQ ID NO: 720068 - RNA, 13 nt, Haemophilus influenzae Rd
guaugccaguggg

SEQ ID NO: 720069 - RNA, 21 nt, Haemophilus influenzae Rd
guauucagugccuaaauuucc

SEQ ID NO: 720070 - RNA, 19 nt, Haemophilus influenzae Rd
guauucauauaauucauua

SEQ ID NO: 720071 - RNA, 21 nt, Haemophilus influenzae Rd
guauucgccacgauaggaucu

SEQ ID NO: 720072 - RNA, 24 nt, Haemophilus influenzae Rd
guauucgggcuucucaaaugaaau

SEQ ID NO: 720073 - RNA, 22 nt, Haemophilus influenzae Rd
guauucgugaaucguuuguaaa

SEQ ID NO: 720074 - RNA, 23 nt, Haemophilus influenzae Rd
guauucuuuaaagagcaaauuua

SEQ ID NO: 720075 - RNA, 17 nt, Haemophilus influenzae Rd
guauugaacuaaaauau

SEQ ID NO: 720076 - RNA, 16 nt, Haemophilus influenzae Rd
guauuuacugauuuua

SEQ ID NO: 720077 - RNA, 23 nt, Haemophilus influenzae Rd
guauuuauaacacagaugaaaau

SEQ ID NO: 720078 - RNA, 18 nt, Haemophilus influenzae Rd
guauuuacaagucucuau

SEQ ID NO: 720079 - RNA, 23 nt, Haemophilus influenzae Rd
guauuuacaagucucuaugauuu

SEQ ID NO: 720080 - RNA, 22 nt, Haemophilus influenzae Rd
guauuguuggcccaacagaaau

SEQ ID NO: 720081 - RNA, 14 nt, Haemophilus influenzae Rd
guauuuuauuuaua

SEQ ID NO: 720082 - RNA, 17 nt, Haemophilus influenzae Rd
guauuucaacauagugu

SEQ ID NO: 720083 - RNA, 21 nt, Haemophilus influenzae Rd
guauuuccuauuuacguaaaa

SEQ ID NO: 720084 - RNA, 19 nt, Haemophilus influenzae Rd
guauuucgucuuaauuuuu

SEQ ID NO: 720085 - RNA, 21 nt, Haemophilus influenzae Rd
gucaaaauuaugcugauuuga

SEQ ID NO: 720086 - RNA, 17 nt, Haemophilus influenzae Rd
gucaaagccauauucuu

SEQ ID NO: 720087 - RNA, 14 nt, Haemophilus influenzae Rd
gucaaaagaaagac

SEQ ID NO: 720088 - RNA, 21 nt, Haemophilus influenzae Rd
guauuuuuuauugaaauuuua

SEQ ID NO: 720089 - RNA, 13 nt, Haemophilus influenzae Rd
guauuuuugaaug

SEQ ID NO: 720090 - RNA, 20 nt, Haemophilus influenzae Rd
guauuuuucauaucuuccgu

SEQ ID NO: 720091 - RNA, 12 nt, Haemophilus influenzae Rd
guauuuuguucu

SEQ ID NO: 720092 - RNA, 18 nt, Haemophilus influenzae Rd
guauuuucuuauugaaga

SEQ ID NO: 720093 - RNA, 21 nt, Haemophilus influenzae Rd
guauuuuuaaggaaacguaaa

SEQ ID NO: 720094 - RNA, 13 nt, Haemophilus influenzae Rd
guauuuuccaugc

SEQ ID NO: 720095 - RNA, 19 nt, Haemophilus influenzae Rd
guauuuuccaugccuaauu

SEQ ID NO: 720096 - RNA, 15 nt, Haemophilus influenzae Rd
gucacgaggauuaau

SEQ ID NO: 720097 - RNA, 17 nt, Haemophilus influenzae Rd
gucacgagcuaaaaaau

SEQ ID NO: 720098 - RNA, 15 nt, Haemophilus influenzae Rd
gucacagcaagaaca

SEQ ID NO: 720099 - RNA, 13 nt, Haemophilus influenzae Rd
gucaauuuuucua

SEQ ID NO: 720100 - RNA, 19 nt, Haemophilus influenzae Rd
gucaagugguuuauuuuuu

SEQ ID NO: 720101 - RNA, 15 nt, Haemophilus influenzae Rd
gucagugaauuuagc

SEQ ID NO: 720102 - RNA, 18 nt, Haemophilus influenzae Rd
gucaggaucgguaaguug

SEQ ID NO: 720103 - RNA, 20 nt, Haemophilus influenzae Rd
gucagcaauacccgcuucaa

SEQ ID NO: 720104 - RNA, 18 nt, Haemophilus influenzae Rd
gucagauuuauaaauagg

SEQ ID NO: 720105 - RNA, 13 nt, Haemophilus influenzae Rd
gucauuuauaaaa

SEQ ID NO: 720106 - RNA, 18 nt, Haemophilus influenzae Rd
gucauuuauggaaauaaa

SEQ ID NO: 720107 - RNA, 23 nt, Haemophilus influenzae Rd
gucauugauggcucgaaaguuac

SEQ ID NO: 720108 - RNA, 17 nt, Haemophilus influenzae Rd
gucauugggcguaaugu

SEQ ID NO: 720109 - RNA, 18 nt, Haemophilus influenzae Rd
gucauucaaugcagaaau

SEQ ID NO: 720110 - RNA, 18 nt, Haemophilus influenzae Rd
guccacuucuuccgcugu

SEQ ID NO: 720111 - RNA, 22 nt, Haemophilus influenzae Rd
gucaugccgcaaucaagcaaau

SEQ ID NO: 720112 - RNA, 15 nt, Haemophilus influenzae Rd
gucauagcuaaacau

SEQ ID NO: 720113 - RNA, 17 nt, Haemophilus influenzae Rd
gucaugacuauuacaau

SEQ ID NO: 720114 - RNA, 17 nt, Haemophilus influenzae Rd
gucauacuuauuuuggg

SEQ ID NO: 720115 - RNA, 22 nt, Haemophilus influenzae Rd
gucaguuugcuuugauaaaugg

SEQ ID NO: 720116 - RNA, 20 nt, Haemophilus influenzae Rd
guccccauaucucugccauc

SEQ ID NO: 720117 - RNA, 21 nt, Haemophilus influenzae Rd
guccuucauugauggaauaaa

SEQ ID NO: 720118 - RNA, 22 nt, Haemophilus influenzae Rd
guccuucauugauggaauaaau

SEQ ID NO: 720119 - RNA, 24 nt, Haemophilus influenzae Rd
guccuucaaauucuuuauaaauaa

SEQ ID NO: 720120 - RNA, 15 nt, Haemophilus influenzae Rd
gucgaaucugaguau

SEQ ID NO: 720121 - RNA, 22 nt, Haemophilus influenzae Rd
gucgcuaauaccgcguauuauc

SEQ ID NO: 720122 - RNA, 13 nt, Haemophilus influenzae Rd
gucgcuacauuuc

SEQ ID NO: 720123 - RNA, 18 nt, Haemophilus influenzae Rd
gucuaauuuuuuauucaa

SEQ ID NO: 720124 - RNA, 15 nt, Haemophilus influenzae Rd
gucuacaagaaacca

SEQ ID NO: 720125 - RNA, 18 nt, Haemophilus influenzae Rd
gucuaaugccgccuuauc

SEQ ID NO: 720126 - RNA, 16 nt, Haemophilus influenzae Rd
gucuaagguuuccaua

SEQ ID NO: 720127 - RNA, 19 nt, Haemophilus influenzae Rd
gucuaagguuuccauaaug

SEQ ID NO: 720128 - RNA, 13 nt, Haemophilus influenzae Rd
gguggauuauaaa

SEQ ID NO: 720129 - RNA, 20 nt, Haemophilus influenzae Rd
gguggaagucugcuacaagu

SEQ ID NO: 720130 - RNA, 14 nt, Haemophilus influenzae Rd
gguggaauguaaaa

SEQ ID NO: 720131 - RNA, 19 nt, Haemophilus influenzae Rd
ggugcuuguuuuaaaauuu

SEQ ID NO: 720132 - RNA, 17 nt, Haemophilus influenzae Rd
gguggaaagguugcuau

SEQ ID NO: 720133 - RNA, 19 nt, Haemophilus influenzae Rd
ggugcuuacuuuauuuuua

SEQ ID NO: 720134 - RNA, 18 nt, Haemophilus influenzae Rd
ggugcuuuaaguaaaagu

SEQ ID NO: 720135 - RNA, 21 nt, Haemophilus influenzae Rd
ggugcuuugugauugacauuu

SEQ ID NO: 720136 - RNA, 17 nt, Haemophilus influenzae Rd
ggugggcuuuagcccac

SEQ ID NO: 720137 - RNA, 17 nt, Haemophilus influenzae Rd
ggugccguuugugcuaa

SEQ ID NO: 720138 - RNA, 15 nt, Haemophilus influenzae Rd
ggugcugcaacuggg

SEQ ID NO: 720139 - RNA, 21 nt, Haemophilus influenzae Rd
ggugagauuucuugcuaaaau

SEQ ID NO: 720140 - RNA, 23 nt, Haemophilus influenzae Rd
ggugcagauuuuuuauuuauuaa

SEQ ID NO: 720141 - RNA, 18 nt, Haemophilus influenzae Rd
ggugauccauuaauaacu

SEQ ID NO: 720142 - RNA, 15 nt, Haemophilus influenzae Rd
ggugcaauuugaaaa

SEQ ID NO: 720143 - RNA, 18 nt, Haemophilus influenzae Rd
ggugcaauaaaaucauua

SEQ ID NO: 720144 - RNA, 10 nt, Haemophilus influenzae Rd
gguuccucag

SEQ ID NO: 720145 - RNA, 17 nt, Haemophilus influenzae Rd
gguuacuaaaugugaca

SEQ ID NO: 720146 - RNA, 16 nt, Haemophilus influenzae Rd
gguuaaugcuucuaau

SEQ ID NO: 720147 - RNA, 12 nt, Haemophilus influenzae Rd
gguuaaguaauc

SEQ ID NO: 720148 - RNA, 20 nt, Haemophilus influenzae Rd
gguuacagaaauauuauuaa

SEQ ID NO: 720149 - RNA, 23 nt, Haemophilus influenzae Rd
gguuaauuuuuuguucauuuuaa

SEQ ID NO: 720150 - RNA, 22 nt, Haemophilus influenzae Rd
gguuauuugcaauaaaauuugc

SEQ ID NO: 720151 - RNA, 14 nt, Haemophilus influenzae Rd
gguucaaaaccaaa

SEQ ID NO: 720152 - RNA, 20 nt, Haemophilus influenzae Rd
ggugugccaucacagucuuu

SEQ ID NO: 720153 - RNA, 19 nt, Haemophilus influenzae Rd
gguguuauuugagcaagau

SEQ ID NO: 720154 - RNA, 21 nt, Haemophilus influenzae Rd
gguuaaaaguaagcaauuuuc

SEQ ID NO: 720155 - RNA, 12 nt, Haemophilus influenzae Rd
gguuaaaaauag

SEQ ID NO: 720156 - RNA, 20 nt, Haemophilus influenzae Rd
guaaaacauuguuuuguuca

SEQ ID NO: 720157 - RNA, 11 nt, Haemophilus influenzae Rd
guaaaaaugcu

SEQ ID NO: 720158 - RNA, 23 nt, Haemophilus influenzae Rd
guaaaaauaaucacuugauaaaa

SEQ ID NO: 720159 - RNA, 19 nt, Haemophilus influenzae Rd
guaaaaauauuauguguuu

SEQ ID NO: 720160 - RNA, 20 nt, Haemophilus influenzae Rd
guaaaaauaaaaacauugcc

SEQ ID NO: 720161 - RNA, 11 nt, Haemophilus influenzae Rd
gguuuugugag

SEQ ID NO: 720162 - RNA, 14 nt, Haemophilus influenzae Rd
gguuuuguuuuaua

SEQ ID NO: 720163 - RNA, 13 nt, Haemophilus influenzae Rd
gguuuucguauuu

SEQ ID NO: 720164 - RNA, 13 nt, Haemophilus influenzae Rd
guaaaaaaccuug

SEQ ID NO: 720165 - RNA, 16 nt, Haemophilus influenzae Rd
gguuucagaauaaaga

SEQ ID NO: 720166 - RNA, 17 nt, Haemophilus influenzae Rd
gguuuauguaaauaagg

SEQ ID NO: 720167 - RNA, 19 nt, Haemophilus influenzae Rd
gguuuauguugaugaagac

SEQ ID NO: 720168 - RNA, 23 nt, Haemophilus influenzae Rd
gguuuaucuaccacaucaaauuu

SEQ ID NO: 720169 - RNA, 14 nt, Haemophilus influenzae Rd
gguuuauuuucagc

SEQ ID NO: 720170 - RNA, 15 nt, Haemophilus influenzae Rd
gguuuauagaugaac

SEQ ID NO: 720171 - RNA, 22 nt, Haemophilus influenzae Rd
gguuuccaagaauuuuaauaag

SEQ ID NO: 720172 - RNA, 13 nt, Haemophilus influenzae Rd
gguuugaaauuua

SEQ ID NO: 720173 - RNA, 14 nt, Haemophilus influenzae Rd
gguuuuauccugua

SEQ ID NO: 720174 - RNA, 16 nt, Haemophilus influenzae Rd
gguuuuacauauaaag

SEQ ID NO: 720175 - RNA, 13 nt, Haemophilus influenzae Rd
gguuuucaucauu

SEQ ID NO: 720176 - RNA, 23 nt, Haemophilus influenzae Rd
gguuuuccuacagugacuaaaac

SEQ ID NO: 720177 - RNA, 13 nt, Haemophilus influenzae Rd
gguuuaaauuuua

SEQ ID NO: 720178 - RNA, 13 nt, Haemophilus influenzae Rd
gguuggaagaaaa

SEQ ID NO: 720179 - RNA, 23 nt, Haemophilus influenzae Rd
gguuggaagaaaagcauuaauag

SEQ ID NO: 720180 - RNA, 16 nt, Haemophilus influenzae Rd
gguugcgauuuuugca

SEQ ID NO: 720181 - RNA, 19 nt, Haemophilus influenzae Rd
gguuggccuguuggaauuu

SEQ ID NO: 720182 - RNA, 15 nt, Haemophilus influenzae Rd
gguugcauaaaaucu

SEQ ID NO: 720183 - RNA, 17 nt, Haemophilus influenzae Rd
gguugaucuacaucagu

SEQ ID NO: 720184 - RNA, 11 nt, Haemophilus influenzae Rd
gguucuuuuaa

SEQ ID NO: 720185 - RNA, 17 nt, Haemophilus influenzae Rd
gguucuuuuaauucgcc

SEQ ID NO: 720186 - RNA, 20 nt, Haemophilus influenzae Rd
guacccgugccuaauucacu

SEQ ID NO: 720187 - RNA, 12 nt, Haemophilus influenzae Rd
guacgagaaaaa

SEQ ID NO: 720188 - RNA, 13 nt, Haemophilus influenzae Rd
guacgccacauac

SEQ ID NO: 720189 - RNA, 20 nt, Haemophilus influenzae Rd
guacgccaugccaagcuaau

SEQ ID NO: 720190 - RNA, 22 nt, Haemophilus influenzae Rd
guacgaauuaagcgaacaccuu

SEQ ID NO: 720191 - RNA, 19 nt, Haemophilus influenzae Rd
guaccuuuaaauucuucga

SEQ ID NO: 720192 - RNA, 16 nt, Haemophilus influenzae Rd
guaccacgguugauac

SEQ ID NO: 720193 - RNA, 21 nt, Haemophilus influenzae Rd
guacauuauuaaccguuuuua

SEQ ID NO: 720194 - RNA, 20 nt, Haemophilus influenzae Rd
guacauguugggcuaaaaau

SEQ ID NO: 720195 - RNA, 19 nt, Haemophilus influenzae Rd
guaccaacggggcaaggcu

SEQ ID NO: 720196 - RNA, 15 nt, Haemophilus influenzae Rd
guaccaaauuccauu

SEQ ID NO: 720197 - RNA, 15 nt, Haemophilus influenzae Rd
guacaucauuugcaa

SEQ ID NO: 720198 - RNA, 15 nt, Haemophilus influenzae Rd
guacaucuggauauu

SEQ ID NO: 720199 - RNA, 20 nt, Haemophilus influenzae Rd
guacacggccguaaugaauu

SEQ ID NO: 720200 - RNA, 13 nt, Haemophilus influenzae Rd
guaaucauuaagc

SEQ ID NO: 720201 - RNA, 20 nt, Haemophilus influenzae Rd
guaaucgccccaaaagcugc

SEQ ID NO: 720202 - RNA, 13 nt, Haemophilus influenzae Rd
guaaucaaauuca

SEQ ID NO: 720203 - RNA, 12 nt, Haemophilus influenzae Rd
aaauagaauauu

SEQ ID NO: 720204 - RNA, 15 nt, Haemophilus influenzae Rd
aaauagaaugaaaaa

SEQ ID NO: 720205 - RNA, 23 nt, Haemophilus influenzae Rd
aaauagaagcguucaucuuauaa

SEQ ID NO: 720206 - RNA, 16 nt, Haemophilus influenzae Rd
aaauagauacaagaaa

SEQ ID NO: 720207 - RNA, 23 nt, Haemophilus influenzae Rd
aaauagauacaagaaagaaauau

SEQ ID NO: 720208 - RNA, 23 nt, Haemophilus influenzae Rd
aaauagaggacuugcguugauuu

SEQ ID NO: 720209 - RNA, 13 nt, Haemophilus influenzae Rd
aaauagacuaauu

SEQ ID NO: 720210 - RNA, 16 nt, Haemophilus influenzae Rd
aaauagacuacuuaaa

SEQ ID NO: 720211 - RNA, 13 nt, Haemophilus influenzae Rd
guaaucuaaauau

SEQ ID NO: 720212 - RNA, 16 nt, Haemophilus influenzae Rd
guaaugguuugcuggu

SEQ ID NO: 720213 - RNA, 14 nt, Haemophilus influenzae Rd
guaauguaauaacg

SEQ ID NO: 720214 - RNA, 15 nt, Haemophilus influenzae Rd
guaauguaauaacgu

SEQ ID NO: 720215 - RNA, 20 nt, Haemophilus influenzae Rd
guaaugcuugggaaucuggc

SEQ ID NO: 720216 - RNA, 18 nt, Haemophilus influenzae Rd
guaaugcuuuauuuaaau

SEQ ID NO: 720217 - RNA, 14 nt, Haemophilus influenzae Rd
guaauggaagaaua

SEQ ID NO: 720218 - RNA, 21 nt, Haemophilus influenzae Rd
guaaugcuucuguugcuucaa

SEQ ID NO: 720219 - RNA, 18 nt, Haemophilus influenzae Rd
guaaugcaaaccauuuau

SEQ ID NO: 720220 - RNA, 19 nt, Haemophilus influenzae Rd
guaaugcaaaccauuuauc

SEQ ID NO: 720221 - RNA, 16 nt, Haemophilus influenzae Rd
guaaugcuaaauauau

SEQ ID NO: 720222 - RNA, 16 nt, Haemophilus influenzae Rd
guaauuuaauuuauca

SEQ ID NO: 720223 - RNA, 16 nt, Haemophilus influenzae Rd
guaauuuaaaaaguag

SEQ ID NO: 720224 - RNA, 14 nt, Haemophilus influenzae Rd
guaauuucucacca

SEQ ID NO: 720225 - RNA, 17 nt, Haemophilus influenzae Rd
guaauuucucaccaaau

SEQ ID NO: 720226 - RNA, 20 nt, Haemophilus influenzae Rd
guaauuucucaccaaauugu

SEQ ID NO: 720227 - RNA, 21 nt, Haemophilus influenzae Rd
guaauugcccaauaaaaguaa

SEQ ID NO: 720228 - RNA, 14 nt, Haemophilus influenzae Rd
guaauguuaucgac

SEQ ID NO: 720229 - RNA, 12 nt, Haemophilus influenzae Rd
guaauuaaaaau

SEQ ID NO: 720230 - RNA, 18 nt, Haemophilus influenzae Rd
guaauuaaaaauaaccgc

SEQ ID NO: 720231 - RNA, 22 nt, Haemophilus influenzae Rd
guaauuaaaaucacauaaaaaa

SEQ ID NO: 720232 - RNA, 14 nt, Haemophilus influenzae Rd
guaauuaaacaaaa

SEQ ID NO: 720233 - RNA, 17 nt, Haemophilus influenzae Rd
guacacaagaaaguuua

SEQ ID NO: 720234 - RNA, 14 nt, Haemophilus influenzae Rd
guacaacauuuuga

SEQ ID NO: 720235 - RNA, 22 nt, Haemophilus influenzae Rd
guaauuuggggcuaauuuauua

SEQ ID NO: 720236 - RNA, 22 nt, Haemophilus influenzae Rd
guaauuugaugcucagaaagac

SEQ ID NO: 720237 - RNA, 10 nt, Haemophilus influenzae Rd
guaauuugcg

SEQ ID NO: 720238 - RNA, 15 nt, Haemophilus influenzae Rd
guaauuuuaaaacca

SEQ ID NO: 720239 - RNA, 22 nt, Haemophilus influenzae Rd
guaauuuuggcgaaccuuucau

SEQ ID NO: 720240 - RNA, 20 nt, Haemophilus influenzae Rd
guaauauuuaccgcuuucaa

SEQ ID NO: 720241 - RNA, 24 nt, Haemophilus influenzae Rd
guaauauaaguuauuuauauaauu

SEQ ID NO: 720242 - RNA, 12 nt, Haemophilus influenzae Rd
guaaguuuuaca

SEQ ID NO: 720243 - RNA, 13 nt, Haemophilus influenzae Rd
guaauaaaaagca

SEQ ID NO: 720244 - RNA, 13 nt, Haemophilus influenzae Rd
guaauaaauaaaa

SEQ ID NO: 720245 - RNA, 12 nt, Haemophilus influenzae Rd
guaauaaaucaa

SEQ ID NO: 720246 - RNA, 18 nt, Haemophilus influenzae Rd
guaauaaguauuuugcag

SEQ ID NO: 720247 - RNA, 15 nt, Haemophilus influenzae Rd
guaauaaguuuucau

SEQ ID NO: 720248 - RNA, 14 nt, Haemophilus influenzae Rd
guaauacaaaauau

SEQ ID NO: 720249 - RNA, 17 nt, Haemophilus influenzae Rd
guaaguacgauaaacac

SEQ ID NO: 720250 - RNA, 14 nt, Haemophilus influenzae Rd
guaagucgcaucaa

SEQ ID NO: 720251 - RNA, 15 nt, Haemophilus influenzae Rd
guaagggcaaaaaau

SEQ ID NO: 720252 - RNA, 16 nt, Haemophilus influenzae Rd
guaaggguaucacaaa

SEQ ID NO: 720253 - RNA, 14 nt, Haemophilus influenzae Rd
guaaguuugcuaau

SEQ ID NO: 720254 - RNA, 19 nt, Haemophilus influenzae Rd
guaaguguagcaauaaaca

SEQ ID NO: 720255 - RNA, 16 nt, Haemophilus influenzae Rd
guaaguggcauaaaga

SEQ ID NO: 720256 - RNA, 14 nt, Haemophilus influenzae Rd
guaagugguaucaa

SEQ ID NO: 720257 - RNA, 16 nt, Haemophilus influenzae Rd
guaagcauuaaaaauu

SEQ ID NO: 720258 - RNA, 14 nt, Haemophilus influenzae Rd
guaacugauuuugc

SEQ ID NO: 720259 - RNA, 16 nt, Haemophilus influenzae Rd
guaacugauuuugcua

SEQ ID NO: 720260 - RNA, 20 nt, Haemophilus influenzae Rd
guaacuguuuguuuuuucua

SEQ ID NO: 720261 - RNA, 14 nt, Haemophilus influenzae Rd
guaacuuucacaac

SEQ ID NO: 720262 - RNA, 14 nt, Haemophilus influenzae Rd
guaagcaaguacaa

SEQ ID NO: 720263 - RNA, 12 nt, Haemophilus influenzae Rd
guaagaucuucu

SEQ ID NO: 720264 - RNA, 20 nt, Haemophilus influenzae Rd
guaagaucagauuuuuuuca

SEQ ID NO: 720265 - RNA, 22 nt, Haemophilus influenzae Rd
guaacgcccccgccauuuugaa

SEQ ID NO: 720266 - RNA, 18 nt, Haemophilus influenzae Rd
guaacgccguauuuuuaa

SEQ ID NO: 720267 - RNA, 14 nt, Haemophilus influenzae Rd
guaacguauuuaaa

SEQ ID NO: 720268 - RNA, 22 nt, Haemophilus influenzae Rd
guaaacaagauucugaaagaua

SEQ ID NO: 720269 - RNA, 16 nt, Haemophilus influenzae Rd
guaaacaaguauaaaa

SEQ ID NO: 720270 - RNA, 22 nt, Haemophilus influenzae Rd
guaaacaaaauaccccaauuaa

SEQ ID NO: 720271 - RNA, 19 nt, Haemophilus influenzae Rd
guaaaauucuauuaaaaua

SEQ ID NO: 720272 - RNA, 19 nt, Haemophilus influenzae Rd
guaaaauuggguuuugcgu

SEQ ID NO: 720273 - RNA, 22 nt, Haemophilus influenzae Rd
guaaaauuucuucuacaccuuc

SEQ ID NO: 720274 - RNA, 21 nt, Haemophilus influenzae Rd
guaaaauuuuuagugauuuua

SEQ ID NO: 720275 - RNA, 18 nt, Haemophilus influenzae Rd
guaaaauuuuucucacca

SEQ ID NO: 720276 - RNA, 15 nt, Haemophilus influenzae Rd
guaaacauuuuguau

SEQ ID NO: 720277 - RNA, 15 nt, Haemophilus influenzae Rd
guaaaauaaaaagga

SEQ ID NO: 720278 - RNA, 12 nt, Haemophilus influenzae Rd
guaaaagugcgg

SEQ ID NO: 720279 - RNA, 14 nt, Haemophilus influenzae Rd
guaaaauuaagcaa

SEQ ID NO: 720280 - RNA, 12 nt, Haemophilus influenzae Rd
guaaaauaucca

SEQ ID NO: 720281 - RNA, 18 nt, Haemophilus influenzae Rd
guaaaauauccacauaac

SEQ ID NO: 720282 - RNA, 16 nt, Haemophilus influenzae Rd
guaaagcccacaugaa

SEQ ID NO: 720283 - RNA, 21 nt, Haemophilus influenzae Rd
guaaagauuuuucuugcuauu

SEQ ID NO: 720284 - RNA, 23 nt, Haemophilus influenzae Rd
guaaagauuguccuuuugccauu

SEQ ID NO: 720285 - RNA, 23 nt, Haemophilus influenzae Rd
guaaagcuacaucaacaaauguc

SEQ ID NO: 720286 - RNA, 22 nt, Haemophilus influenzae Rd
guaaacgccaucaaccauaaca

SEQ ID NO: 720287 - RNA, 16 nt, Haemophilus influenzae Rd
guaaacuaaaucuugc

SEQ ID NO: 720288 - RNA, 19 nt, Haemophilus influenzae Rd
guaaaccucgccuuguaau

SEQ ID NO: 720289 - RNA, 19 nt, Haemophilus influenzae Rd
guaaacgaccuugcaaauu

SEQ ID NO: 720290 - RNA, 16 nt, Haemophilus influenzae Rd
guaaagagagcauauu

SEQ ID NO: 720291 - RNA, 19 nt, Haemophilus influenzae Rd
guaaaucggcuggauuucc

SEQ ID NO: 720292 - RNA, 22 nt, Haemophilus influenzae Rd
guaaaucuacuuggacauuguu

SEQ ID NO: 720293 - RNA, 23 nt, Haemophilus influenzae Rd
guaaaucugauucagaaaaagcu

SEQ ID NO: 720294 - RNA, 23 nt, Haemophilus influenzae Rd
guaaaugcgcuuuuaauuuagcu

SEQ ID NO: 720295 - RNA, 15 nt, Haemophilus influenzae Rd
guaaaugauaaaaau

SEQ ID NO: 720296 - RNA, 18 nt, Haemophilus influenzae Rd
guaaauuagcaauaccua

SEQ ID NO: 720297 - RNA, 14 nt, Haemophilus influenzae Rd
guaaauuauuuauu

SEQ ID NO: 720298 - RNA, 16 nt, Haemophilus influenzae Rd
guaaauuauuuauuua

SEQ ID NO: 720299 - RNA, 16 nt, Haemophilus influenzae Rd
guaaauucaauacuua

SEQ ID NO: 720300 - RNA, 18 nt, Haemophilus influenzae Rd
guaaauucuucaaguguu

SEQ ID NO: 720301 - RNA, 11 nt, Haemophilus influenzae Rd
guaaauaaucc

SEQ ID NO: 720302 - RNA, 13 nt, Haemophilus influenzae Rd
guaaauaaacguc

SEQ ID NO: 720303 - RNA, 21 nt, Haemophilus influenzae Rd
guaaauaacacaucagaaaau

SEQ ID NO: 720304 - RNA, 20 nt, Haemophilus influenzae Rd
guaaaguuuagcuuuacgua

SEQ ID NO: 720305 - RNA, 19 nt, Haemophilus influenzae Rd
guaaauaugccuuauauuu

SEQ ID NO: 720306 - RNA, 21 nt, Haemophilus influenzae Rd
guaaccaagcuguaccagcga

SEQ ID NO: 720307 - RNA, 10 nt, Haemophilus influenzae Rd
guaacaucaa

SEQ ID NO: 720308 - RNA, 15 nt, Haemophilus influenzae Rd
guaacaauguagaaa

SEQ ID NO: 720309 - RNA, 23 nt, Haemophilus influenzae Rd
guaaauuuuuauuguguuuugga

SEQ ID NO: 720310 - RNA, 15 nt, Haemophilus influenzae Rd
guaaauuuucagcgu

SEQ ID NO: 720311 - RNA, 15 nt, Haemophilus influenzae Rd
guaaauuuuccaauu

SEQ ID NO: 720312 - RNA, 22 nt, Haemophilus influenzae Rd
guaaauucucgguuguuucauc

SEQ ID NO: 720313 - RNA, 17 nt, Haemophilus influenzae Rd
guaaauucuguuuaguc

SEQ ID NO: 720314 - RNA, 22 nt, Haemophilus influenzae Rd
guaaauugguuaauguaaacaa

SEQ ID NO: 720315 - RNA, 23 nt, Haemophilus influenzae Rd
guaaauugguuaauguaaacaaa

SEQ ID NO: 720316 - RNA, 21 nt, Haemophilus influenzae Rd
guaaauuuuaaaaucuuugga

SEQ ID NO: 720317 - RNA, 17 nt, Haemophilus influenzae Rd
gcaacuaauaaaccaau

SEQ ID NO: 720318 - RNA, 21 nt, Haemophilus influenzae Rd
gcaacuaauaaaccaauaaga

SEQ ID NO: 720319 - RNA, 15 nt, Haemophilus influenzae Rd
aaagcgagaauaguu

SEQ ID NO: 720320 - RNA, 21 nt, Haemophilus influenzae Rd
aaagcgaguaagggcaaaaaa

SEQ ID NO: 720321 - RNA, 22 nt, Haemophilus influenzae Rd
aaagcgcauauuaucucgaaua
